United States Patent 7,510,834 (GENE MAPPING METHOD USING MICROSATELLITE GENETIC POLYMORPHISM MARKERS) - sequence listing, part 2

SEQ ID NO: 5341 - DNA, 412 bp, Homo sapiens
  chr3.fa.O7frz.90737705
  Located on chromosome 3
  Distance between a terminus base of telomere on chromosomal short arm and 5'-terminus of this base sequence : 82852161
  Distance between 3'-terminus of neighbour sequence of sequence listing upward to telomere on chrosomal short arm and 5'-terminus of this base sequence : 102125
attgtacaattgaggttggattttcactgaaaatgaaatatttcagttatgagttcaatttattaagaaaaaatacttttaaaaacctagtggccatctttttccattctatatctatctatctatctatctatctatctatctatctatctatctatctatctatctatcatctatctatctatctacctttgtctatcatctatctatctatctatcatctatctagaggtcatgtctatttttactttaaaaaggaaaaagaaaatagggacactgatattcattccttaaactctgctgacttagtggagacactgcaatatatagtctatgaactgagagccctttcagaagccaacgagctttataggcgctgacattgacactccactctgcaattctgcacttc

SEQ ID NO: 5342 - DNA, 405 bp, Homo sapiens
  chr3.fa.O7frz.93083903
  Located on chromosome 3
  Distance between a terminus base of telomere on chromosomal short arm and 5'-terminus of this base sequence : 82905824
  Distance between 3'-terminus of neighbour sequence of sequence listing upward to telomere on chrosomal short arm and 5'-terminus of this base sequence : 53251
gccaagatatgtaaacaatctaaatatctttcaatgcaagaattaattttttaaagtgtaatgcccacacacacacacacacacacacatcattgagtactattcacccttaaaaaagaaggaaattctgtcatttcccatacatggataaacctaaaggatttttatgttaaatgaaataaaccaggcacaaaaagacaacataccacatgatctcacttacatgtggaacgtaaaagagtcagactcatggaaacagagaataaaatgctggttatcagaggctggggaaggatggaggggtggggagaggattgtggaggtgttggtcaaaggacaaaaaaattcagttagaaaggaggaataacttcaaaagatctattgtacatcgtgataactgcagtt

SEQ ID NO: 5343 - DNA, 332 bp, Homo sapiens
  chr3.fa.O7frz.93172291
  Located on chromosome 3
  Distance between a terminus base of telomere on chromosomal short arm and 5'-terminus of this base sequence : 83124196
  Distance between 3'-terminus of neighbour sequence of sequence listing upward to telomere on chrosomal short arm and 5'-terminus of this base sequence : 217967
catcaccaaatttgttactgacctgactagaaaataaaggtggaggaagttcagattaactctgtctatcttgctgagatgggacatcagtcttctcctgcccttggagctccaggtttcaggcctttgaatgatacctccagctttcctgggtttccaacttgcagatggcatatcatgggaccttccagtgtccataatcatttaaacaaataccttataatatatcatgtgagtcaagaaaagattctgtgtgtgtgtgtgtctgtgtgtgtaatttcctattggtgctctgtctgtagaaccattcattactaatgcacaggcataag

SEQ ID NO: 5344 - DNA, 467 bp, Homo sapiens
  chr3.fa.O7frz.93281890
  Located on chromosome 3
  Distance between a terminus base of telomere on chromosomal short arm and 5'-terminus of this base sequence : 83141412
  Distance between 3'-terminus of neighbour sequence of sequence listing upward to telomere on chrosomal short arm and 5'-terminus of this base sequence : 16884
aatgtgatactttaatccaagtttatttttataacacacagcaagataatttatctatttgaagagaaaggcaatttatatcatatacatgtatgtatgaatgtgtgtgtgtgtgtgtgtgtgtgtgtgtgtgtgtatttgcagttgtattttttttttttttttgctagggcttcagtaaagtaataccacagatggggtggcttaaataatataaatttattttctctcagttctagaaattggaaggctaagaccaaggtgtcagcagcttggtttctcttgagttctctctccatggcttgcagatttccaccttcttgcttcatctttctgtggtcttttctctgtggtggcacatccctagtgtctcctcctccttttaaagtgacatcagtaatattggattagggatccacccttattaactcatttaaccttaactacctctttaaaggtaccatctc

SEQ ID NO: 5345 - DNA, 255 bp, Homo sapiens
  chr3.fa.O7frz.97957922
  Located on chromosome 3
  Distance between a terminus base of telomere on chromosomal short arm and 5'-terminus of this base sequence : 83228799
  Distance between 3'-terminus of neighbour sequence of sequence listing upward to telomere on chrosomal short arm and 5'-terminus of this base sequence : 86920
cttgtaaacaaggttaagattcagcctggttcatatgttcttctttcctgggctaatagagttagtatttattcctacatatatttcctgaattttgctgatatatttatacacatgtttacacacacacacacacacacacacacacacacacagctctttgttgcaattcctctgttcctggatttggatatgtttttttaattagacattttaaaaatggtaaaatctggctccagttctaaatctggaaac

SEQ ID NO: 5346 - DNA, 347 bp, Homo sapiens
  HUMUT1286
  Located on chromosome 3
  Distance between a terminus base of telomere on chromosomal short arm and 5'-terminus of this base sequence : 83371259
  Distance between 3'-terminus of neighbour sequence of sequence listing upward to telomere on chrosomal short arm and 5'-terminus of this base sequence : 142205
gaccaatttgcaggataccgcaataacataggtgaggcatgctggaggccataatgaaggatatattagatagatgtacatgttatttaggctacaacgttgaccacatgtggtgattaagaaagaaaacctacagatatttatccttttttttttttaggtttaagccatggaatgcaatattaagggtgagaagaatggattttttggggaaaaaacataaaacaatttgttacattatatatatatcatatagatagatagatagatagatagatagatagatagatagatagatgatagatagatagataatgttttttgtggcacctgtgagatttccacct

SEQ ID NO: 5347 - DNA, 383 bp, Homo sapiens
  AC034152.5_162151
  Located on chromosome 3
  Distance between a terminus base of telomere on chromosomal short arm and 5'-terminus of this base sequence : 83501579
  Distance between 3'-terminus of neighbour sequence of sequence listing upward to telomere on chrosomal short arm and 5'-terminus of this base sequence : 129973
attagaacaatcattgctttaaattttttcttaatgaatgtattttataatgaacatgtgttaaagttatttaatacactactctatatgtgtgctctatattcttggctttgataataatttccattttaactcctttagcacaatgagaatttacattgctgttttttgtactcttatattttgtcaatatttatgtcaaacatgtgtgatatatataactgtgtgtgtgtgtgtgtgtgtgtgtgtgggtgtgtgtgttgtttctatgtgatttggtattaccagccatttatcttcagactatcttttcttatgtttgacattgtatcaagggcatggccttgggaaaatagaggcagtggatccaactgaagtaaatt

SEQ ID NO: 5348 - DNA, 329 bp, Homo sapiens
  AC023503.17_22493
  Located on chromosome 3
  Distance between a terminus base of telomere on chromosomal short arm and 5'-terminus of this base sequence : 83667623
  Distance between 3'-terminus of neighbour sequence of sequence listing upward to telomere on chrosomal short arm and 5'-terminus of this base sequence : 165661
tcaagatggactaaacatttaaacataagacctcaaaccataaatatcctagaagaaaatgtaggaaatactcttcttgatattggctttggaaaataatttattgctgtgtcccccaatgcaattgcaacaaaaccaaacattgacaactgggacctaattcaactaaagagcttctgcatggcatatatatatgtgtgtgtgtatatatatatatatatatacacacatatatgtacacacacacatatatatacatatatatatatatatacatacacatacacatatatatattcaacagtgtaaacagacaacttacagaatgg

SEQ ID NO: 5349 - DNA, 415 bp, Homo sapiens
  chr3.fa.O7frz.97503965
  Located on chromosome 3
  Distance between a terminus base of telomere on chromosomal short arm and 5'-terminus of this base sequence : 83710989
  Distance between 3'-terminus of neighbour sequence of sequence listing upward to telomere on chrosomal short arm and 5'-terminus of this base sequence : 43037
ctaagtaacttaaagcaggaacagtaaacccaataccacatgttctcacttataagtaggagctaaatactggttacgtagagacataaagatgagaacaagagactctgggaactattacaggggacacagtaggagggagacaaaggctgaaaaactatgttttgggtactatgcttatttcctgggtgacaagattatttgtaccctaacctcagcatcatgcaatatacctaggtaacaaacctgcacatgtaccccctgaatctaaaataaaagttgaaattattcataaaatcatggaaaaataaataaataaataaataaataaatagaatactgtcttttgagttcaaattgtaccttttgtatttccctcttttccgttctctcctttccagatgttgacagagta

SEQ ID NO: 5350 - DNA, 112 bp, Homo sapiens
  D3S2388
  Located on chromosome 3
  Distance between a terminus base of telomere on chromosomal short arm and 5'-terminus of this base sequence : 83861867
  Distance between 3'-terminus of neighbour sequence of sequence listing upward to telomere on chrosomal short arm and 5'-terminus of this base sequence : 150463
tccactcagtacaagtctgggagataattagatagatagatagatagatagatagatagatagatagatagatagattagataaatagataagatcgacaaaccacaggatc

SEQ ID NO: 5351 - DNA, 335 bp, Homo sapiens
  chr3.fa.O7frz.97405404
  Located on chromosome 3
  Distance between a terminus base of telomere on chromosomal short arm and 5'-terminus of this base sequence : 83985659
  Distance between 3'-terminus of neighbour sequence of sequence listing upward to telomere on chrosomal short arm and 5'-terminus of this base sequence : 123680
accttctagtcctcacaatcacatgagccaacaaatctcctaacataagtctctctctgtctctctctctctctctctctctccccaccccgccaacactcctgacacccaaccacaaatacatgtgtatatcctgtttctctgttctgtttctcttaaaaactcataactaatgcagttatcatattttaaacatcatcttattccatatacacaaatgtccaaaaattcattttctatctctcatatcccaaattaacagcatataaaaaatcagtttttttttttacattttagaagttatgagtatagtgttacttatttggtcgataaag

SEQ ID NO: 5352 - DNA, 177 bp, Homo sapiens
  DISO7_10001147
  Located on chromosome 3
  Distance between a terminus base of telomere on chromosomal short arm and 5'-terminus of this base sequence : 84211426
  Distance between 3'-terminus of neighbour sequence of sequence listing upward to telomere on chrosomal short arm and 5'-terminus of this base sequence : 225432
tgagtatatgtgttcacaaggttctactttatttgcattaaagataaaatgaaaatcaacccttagaaatcagatttactgatataaaacatttgaaaggaatatatatatatatatatatatatatatatatatatatatatatacacacacacatacatgaatatacatcacctg

SEQ ID NO: 5353 - DNA, 139 bp, Homo sapiens
  DISO7_10001144
  Located on chromosome 3
  Distance between a terminus base of telomere on chromosomal short arm and 5'-terminus of this base sequence : 84339612
  Distance between 3'-terminus of neighbour sequence of sequence listing upward to telomere on chrosomal short arm and 5'-terminus of this base sequence : 128009
ggagaatgattcgtctctatgttactatatcttctaatgaaagctttgtatagcttcatttaaatatagattcagaaacactactactactactactactactactactacaaaaattaggtatgtcactggtggacaa

SEQ ID NO: 5354 - DNA, 101 bp, Homo sapiens
  DISO7_10001143
  Located on chromosome 3
  Distance between a terminus base of telomere on chromosomal short arm and 5'-terminus of this base sequence : 84364499
  Distance between 3'-terminus of neighbour sequence of sequence listing upward to telomere on chrosomal short arm and 5'-terminus of this base sequence : 24748
gagcaagcttccatcttctctttttcacccatattgtatatgacaaatcatacacacacacacacacacacattcacaccacacatacacaagcccttcat

SEQ ID NO: 5355 - DNA, 218 bp, Homo sapiens
  DISO7_10001142
  Located on chromosome 3
  Distance between a terminus base of telomere on chromosomal short arm and 5'-terminus of this base sequence : 84387245
  Distance between 3'-terminus of neighbour sequence of sequence listing upward to telomere on chrosomal short arm and 5'-terminus of this base sequence : 22645
aatgaatgagaataacctgtcttcaatttttcaagttttttgaaacctattccctttaggttttgtttttttgtttgtgtgtgtatgtgtgtgtgtgtgtgtgtgtgtgtgtgtgtgtatgtgtgaattaatgggttaatgcttttaatgtacttagcactgtgcctgactcagtaagagctcagtgaatgttagctgcagacaccattcactcttta

SEQ ID NO: 5356 - DNA, 208 bp, Homo sapiens
  HUMUT436
  Located on chromosome 3
  Distance between a terminus base of telomere on chromosomal short arm and 5'-terminus of this base sequence : 84586808
  Distance between 3'-terminus of neighbour sequence of sequence listing upward to telomere on chrosomal short arm and 5'-terminus of this base sequence : 199345
aaatccaaaagccacaacagaggagagtgaaggggatgagagtttctgtaggcactactcttcaaagatgtagctgttgccttatagccttttatatataagatgagctagcttgtgtggagctagctcaccacctgcacacacacacacacacacacacacacacacacgtagctcacgtgaaactgccttgggtattattttggct

SEQ ID NO: 5357 - DNA, 414 bp, Homo sapiens
  AC073164.12_17745
  Located on chromosome 3
  Distance between a terminus base of telomere on chromosomal short arm and 5'-terminus of this base sequence : 84685032
  Distance between 3'-terminus of neighbour sequence of sequence listing upward to telomere on chrosomal short arm and 5'-terminus of this base sequence : 98016
ctcagacttggagctaaactatctcatcaagaactgcacagcgagtgcggtggctcacgcttgtaatcccagcactttgggaggccgaggcaggcagatgacctgaggttgggagttcgagaccagcctgaccaacatggagaaacctcatctctactaaaaatacaaaattaggcgggcgtggtggcgcatgcttataatcctagctacttgagaggctgaggcaggaaaatcccttgaacctaggaggcagaggttatggtgaactgagatcatgccattgcacttctgcctgggcaacaagagtgaaagtccatttcaaaaacaaaacaaaacaaaacaaaacaaaacaaaaacagaaaaaacaaagaaaagaatgacactgaagcctaaacctgaagagattactggttt

SEQ ID NO: 5358 - DNA, 243 bp, Homo sapiens
  D3S2446
  Located on chromosome 3
  Distance between a terminus base of telomere on chromosomal short arm and 5'-terminus of this base sequence : 84688078
  Distance between 3'-terminus of neighbour sequence of sequence listing upward to telomere on chrosomal short arm and 5'-terminus of this base sequence : 2632
ataagaggaatcctttactaggagctgtcaaatgtcaaaataacaactaacatgtttctatctatctatctatctatctatctatctatctatctatctatctatctaacatctatctatctatctatctatcattttcatctacctaatctgtatctgtaagtcctgaaatacctgtatacatctattaacggaagttatataaaaaatatttgaatttttttctttctgcagatttccacg

SEQ ID NO: 5359 - DNA, 357 bp, Homo sapiens
  AC017015.4_134547
  Located on chromosome 3
  Distance between a terminus base of telomere on chromosomal short arm and 5'-terminus of this base sequence : 84753535
  Distance between 3'-terminus of neighbour sequence of sequence listing upward to telomere on chrosomal short arm and 5'-terminus of this base sequence : 65214
gtatgacttatgttggctctgtgctctattttttcttaaccttttaaatccctgtcagttggcattttctgtacgggtgtgtatgagagagagattttggggctgaataattagtggtctggacctcagttcagttactgagagggtgaattccctaagactccttttagcttttaatgtttgtgatggattcttttagacaaaatttgattttaaataaattgtgtgtgtgtgtgtgtgtgtgtgcactttctaacactcttaggcagtacagtgggagtttgttgtaatttccagattcagccactaaacaggtgatccggaggcactattcttagcagtttgtatagttggaga

SEQ ID NO: 5360 - DNA, 384 bp, Homo sapiens
  AC068386.2_130223
  Located on chromosome 3
  Distance between a terminus base of telomere on chromosomal short arm and 5'-terminus of this base sequence : 84792295
  Distance between 3'-terminus of neighbour sequence of sequence listing upward to telomere on chrosomal short arm and 5'-terminus of this base sequence : 38403
ggtcagtatgactttagtgaacacagaatttttattgtgatgacaacctacgtgaaaatatactcttagataactgaactaaccatgccttaacacacacacacacacacacacacacacacacacacacacacacacacacacacacactctctctctctctctctctccagggattctgtattttatttttcccttattaacataaaatccgttttttcctaataatagttgagcaaaaagaaagattttttttcttttttttttttgtgcctactgacctgagactattttagttacaggtacttagaataatcaaatataaatgctatttaagaaagaaattgcctgctgggttcagtggctaacacctataatctgtaa

SEQ ID NO: 5361 - DNA, 468 bp, Homo sapiens
  chr3.fa.O7frz.77211918
  Located on chromosome 3
  Distance between a terminus base of telomere on chromosomal short arm and 5'-terminus of this base sequence : 84881452
  Distance between 3'-terminus of neighbour sequence of sequence listing upward to telomere on chrosomal short arm and 5'-terminus of this base sequence : 88773
atccatcagtgttctattagtcatcttctccttcatcctcctctctttcctccccttcatcatcttcatcttcttcaccttcatccttatcccctacttcatcagtatcttctaatccttcctcctttgcgtcatcatcgtcatcatcatcatcatctttttctccttttccttcttcatcatccatatcaggaaccaagtagtactgtaatggttttggccaaatattgtctttgatgaactctcctaactcatccacacctgcatcagaatagtcagcaaatcaggtaaagaagctctctggaccacctcctgctgtgggacccaaggagacatctgctcctgcaggcttgcctaaaaagggacaagaagaacagtaagaagcaattgaacacagtgatgaagtacaaaatgaaatagacttaatgtgaggagattttgaaagtcgaatagaaatgtaacaaactc

SEQ ID NO: 5362 - DNA, 362 bp, Homo sapiens
  AC021722.4_135812
  Located on chromosome 3
  Distance between a terminus base of telomere on chromosomal short arm and 5'-terminus of this base sequence : 84948181
  Distance between 3'-terminus of neighbour sequence of sequence listing upward to telomere on chrosomal short arm and 5'-terminus of this base sequence : 66261
agcctggtgacatagcaagactccatgtaaaaaaaaaaagaaagaaagaaaaggaaggaaggaaggaaggaaggaaaggaagaaagggagaaagggagaaagggagaatgggagaaggggaaggaagaaagaaaaagaaagaaaggaaggaaggaagagaaaaggaaagaaagaaagaaagatgtagactagacatcctaataagtacatgggaaactcctttagaagggtaggtcactttctcaatttgtacatgttttgctaagatgtagggagggaatgggttgaatcaggctgttttttttttctccttctttgctttggtttgtgttcattttgtctgtagcttgattatggaaatg

SEQ ID NO: 5363 - DNA, 387 bp, Homo sapiens
  AC021722.4_89054
  Located on chromosome 3
  Distance between a terminus base of telomere on chromosomal short arm and 5'-terminus of this base sequence : 85050120
  Distance between 3'-terminus of neighbour sequence of sequence listing upward to telomere on chrosomal short arm and 5'-terminus of this base sequence : 101577
agtccagcactgataaagaactagggaagaatgtcatttttaattcactcttgaaagatactgctatagtttaaatgtgtccctcaaaagcatgtgttggaaacttagttcccaatgcaacagtgttggaaggtggggcctagcaggaggtgtttagatcatgaggggccctccctcatgaatggattagggctgattataaaagggctgtaagctgtgagttcaatctcttgggttaatgtgtgctctctctgtctgtctgtctgtctgtctgtctgtctgtctctcctttcttacccttccacgttccaccatgggaaaacacagcaagaataccctcaccagatatggcctccttgatcttggacttctagcctccagaattgt

SEQ ID NO: 5364 - DNA, 310 bp, Homo sapiens
  AC021722.4_15297
  Located on chromosome 3
  Distance between a terminus base of telomere on chromosomal short arm and 5'-terminus of this base sequence : 85079584
  Distance between 3'-terminus of neighbour sequence of sequence listing upward to telomere on chrosomal short arm and 5'-terminus of this base sequence : 29077
cctaagtagagttcaatgtttgattttataaacccagttgataagggtcaggttattgtaataacaccacacacacacacacacacacacacacacacacacacacaatttttaaaccgtcttctctatgagaaatcatcaaacaggagatgtcattggctagtattttttatttatttactggttaaaaacaatggatacaagttagaaaacaatagtggtaatatagagtgatggttaagagtataggcatgtgaagtcattcttatatactgtaagatccttagtttagatcctggttgtaacatta

SEQ ID NO: 5365 - DNA, 355 bp, Homo sapiens
  AC022071.11_100249
  Located on chromosome 3
  Distance between a terminus base of telomere on chromosomal short arm and 5'-terminus of this base sequence : 85114625
  Distance between 3'-terminus of neighbour sequence of sequence listing upward to telomere on chrosomal short arm and 5'-terminus of this base sequence : 34731
gccttaatatttgttctccaacaacatttcaacctctgatttatatcatcacacacacacacacacacacacacacacacacacacacacacacactccctcatgttctgtgcaaaagactataaacagctccatgtgcctagaaaggcttccttctgccctgtccctttggctgggttacctcttacatgttttccaacattcagttcgtgttttaccttctctggaatgcctttctctttttccctatgttaaaatttatttatttatttattcatttttctatttttaaagattgtcttggttacatagtaggtgtacatatttgtgggatacacaagatgctttgatacaa

SEQ ID NO: 5366 - DNA, 335 bp, Homo sapiens
  AC021966.3_166318
  Located on chromosome 3
  Distance between a terminus base of telomere on chromosomal short arm and 5'-terminus of this base sequence : 85216881
  Distance between 3'-terminus of neighbour sequence of sequence listing upward to telomere on chrosomal short arm and 5'-terminus of this base sequence : 101901
tgagctagcatgtctattctcttctgccctcagacatcggttctcctggttctcgggtatttgaacgcagatcagaacttttgactgaatgacacccactggctttcctgattctccagcttgcagatagatggtagattgtgaaatttctcagcttctgtaattgcatgagccaaatcctataataaatctctctctctctctctctctctctctctctctctctccctctctccctctctctctctctcctccattggttatatttctctgaagaaccctgttcattacactcaagttctagaaccagcaggatcagagttcatccataagct

SEQ ID NO: 5367 - DNA, 425 bp, Homo sapiens
  chr3.fa.O7frz.76805741
  Located on chromosome 3
  Distance between a terminus base of telomere on chromosomal short arm and 5'-terminus of this base sequence : 85309591
  Distance between 3'-terminus of neighbour sequence of sequence listing upward to telomere on chrosomal short arm and 5'-terminus of this base sequence : 92375
ctgctcagataatctattgcagtatgtttctataaatgctctatattctttctttctcttcctttttctttttttcctcacttattccccccctttctctttctttccttccttcttcccttctccctttctttttctttcttcctcccttctttattccttccttcctccctccctcccttccttcctttcttccttccttccttcctcattctccctcccttccttccttccttccttttttccatccttcgtgtctctctctcactctctcattgtttccttccttccttctttcttcatttcatttagtgatggctatagaactatcatctatatgtttacttgttattgtctttaaacctcttttaaatttatttaacccttcgataaatcaatacctaccttctgtatcttcagatgac

SEQ ID NO: 5368 - DNA, 456 bp, Homo sapiens
  AC024967.3_20881
  Located on chromosome 3
  Distance between a terminus base of telomere on chromosomal short arm and 5'-terminus of this base sequence : 85330716
  Distance between 3'-terminus of neighbour sequence of sequence listing upward to telomere on chrosomal short arm and 5'-terminus of this base sequence : 20700
atgtaaccttaccactcacctccctcccaacctccctcaccaagtccccacagtcgattatatcattctgtgtgtctttatgtccccatggcttagctcccacttataagcaggaacatacagtatttggttttccattcttgggttacttcacttagaataatggcctccagcttcatccaagttgttactaaagactacttcatttctttctatcactgagtaatatttcatttatatatatatatatatatatatatatatatatatatatatcacattttatacctcaatggctgagtagtattccatgatgtatatatatcacatttttttatccacttgttggttgatgggcacttaggttgattctatatctttggaattgtgaaatgtgttgctataaacatgtgtgtgcatgtgtccttttctataatgacttatgttcctttggat

SEQ ID NO: 5369 - DNA, 460 bp, Homo sapiens
  chr3.fa.O7frz.76678031
  Located on chromosome 3
  Distance between a terminus base of telomere on chromosomal short arm and 5'-terminus of this base sequence : 85368550
  Distance between 3'-terminus of neighbour sequence of sequence listing upward to telomere on chrosomal short arm and 5'-terminus of this base sequence : 37378
acctaattgttaaacttcctgatcttggaaagtataaagatctactttctcttgcatttagggggattctaaaataagtatttcgattgacccttttatttatttattattattaattattattattattattattattgagacagcgtttcattcttgttgcccaggttgggatgcaatggcatgatcttggctcactgcaaccgccacttcctgggttcaagcgattctcctgcctcagcctccagagtaaatgggattataggcaggcgccaccatgcccagctaatttcgtatttttagtagagatgaggtttctccatgttggtcagactggtcttgaactcccgacttcaggtgatccgcccgcctcctcatcccaaagtgctgggattacaggcgtgagccactgcgcccagccaaccttttattatatttacttctgaatgtatttcaggaa

SEQ ID NO: 5370 - DNA, 198 bp, Homo sapiens
  D3S2372
  Located on chromosome 3
  Distance between a terminus base of telomere on chromosomal short arm and 5'-terminus of this base sequence : 85389804
  Distance between 3'-terminus of neighbour sequence of sequence listing upward to telomere on chrosomal short arm and 5'-terminus of this base sequence : 20794
tgcttaactctgtgtgaatgtgcgtgtgtgtgtgtgtgtgtgtgtgtgtgtgtgtataaaataagaatgctaattttagtccctatactactctataaaattaaattttctattaaagatataattgcaattgaaagtgtttttaattagaacatttaatgctgcatttccaatgttttacactggggcctcaacatt

SEQ ID NO: 5371 - DNA, 339 bp, Homo sapiens
  HUMUT603
  Located on chromosome 3
  Distance between a terminus base of telomere on chromosomal short arm and 5'-terminus of this base sequence : 85465517
  Distance between 3'-terminus of neighbour sequence of sequence listing upward to telomere on chrosomal short arm and 5'-terminus of this base sequence : 75515
ccttggactgagacttatgctatcatcattcatggttcgcaggagtaaagactcagtctggaactacactaaaagctcccctgggtgttcagtttgcagacagcaaaccatggtacctctaggcctctataattgtgcaaactaattccttaaaatctctctcactccccccactctctacatatgtatatatctatatagagagatatatacatacaagtatatatctacatatgcatatatagatatatacatatatattacacacacacacacacacagccacacgcatacttacacacatgtcttctattggttctgtttctttgaagaactctg

SEQ ID NO: 5372 - DNA, 260 bp, Homo sapiens
  DISD22_0002852
  Located on chromosome 3
  Distance between a terminus base of telomere on chromosomal short arm and 5'-terminus of this base sequence : 85628812
  Distance between 3'-terminus of neighbour sequence of sequence listing upward to telomere on chrosomal short arm and 5'-terminus of this base sequence : 162956
cacctccatttccaggactatatatatatatatagtccagaatatatatataattcatatatatatatatatatatatatatatatatatatatatgaattaagtccctagaatttaatgacagattacaaaggcaaacaaaatcaaaaatcaggatagggtaaaactctgagagctttgttaacccataaactacatctctatatgtggaattatgtgtgtgtttaaatacatacatgtaacaacagagattaggaaat

SEQ ID NO: 5373 - DNA, 420 bp, Homo sapiens
  chr3.fa.O7frz.76304067
  Located on chromosome 3
  Distance between a terminus base of telomere on chromosomal short arm and 5'-terminus of this base sequence : 85875623
  Distance between 3'-terminus of neighbour sequence of sequence listing upward to telomere on chrosomal short arm and 5'-terminus of this base sequence : 246551
tacctgacttttgaattcacttagatgtattgtggctatatgcttcaaattttttatagttgcacattgtttattaaaagcattatatcgttctcactcaaaagtgggagttgaacaatgagaacatatgggcacagggaggggaacatcacacaccagggcctgtcgggtggtggggggctaggggagggatagcattaggagaaatacctaatgtagatgacgggttgatgggtgcagtaaaccaccatggcacatgtatacctttgtaacaaacctgcacgttcacgttctaccaagtattccagaacatatatatatatatatatatatatataaagatttttgagggagcaggagtagctctgttaccgccagagttgacattaaatctttttgtgcgttacatttcagtctaag

SEQ ID NO: 5374 - DNA, 446 bp, Homo sapiens
  AC068756.6_69648
  Located on chromosome 3
  Distance between a terminus base of telomere on chromosomal short arm and 5'-terminus of this base sequence : 85879733
  Distance between 3'-terminus of neighbour sequence of sequence listing upward to telomere on chrosomal short arm and 5'-terminus of this base sequence : 3690
ggaatgcaagtactagcttctaatttggcaaatgtgaaagaatgtcagttctgagattaggatacagaaagtctctctctctctctctctctgtaatcaaccataggtgtgatttcactgtgcattacaaatatgttttagacataatttaacctgtggtatatctgaacctgtggaataaaaaaaaaaggcaaggactgttctcactgtcagagtcccctgtcacattctgtgccccatttctcagactgggaaaaacaaattgccatgtgtgaagagccctacggagagcttcatgtagccctgtgaagaggtccaggagcccttgaagaactgaagactgacaacaatcacgtgagtgagcttcgaagtgaatcattcaatgccaacccagtcctaagaaaactaaccatccgtctgaaagcttggttacaaatgacagactg

SEQ ID NO: 5375 - DNA, 283 bp, Homo sapiens
  AC076963.4_117195
  Located on chromosome 3
  Distance between a terminus base of telomere on chromosomal short arm and 5'-terminus of this base sequence : 85979193
  Distance between 3'-terminus of neighbour sequence of sequence listing upward to telomere on chrosomal short arm and 5'-terminus of this base sequence : 99014
tctttgaggttgattgcataattccgtattcccttgatgtctctcagatatgatacagcatatatacaggtgtgtgtttgcatatatatatatatatatatatatatatatgctgtaacatatctacacatatatagatgtatatgtatttgtacatataaatatgtgtatgtataaaatatatatgtacatatattctttcaaaatatttccaaaatagtgtatattattttctaaattttctactattttaagcaggagattggtctcagttacttaggct

SEQ ID NO: 5376 - DNA, 414 bp, Homo sapiens
  chr3.fa.O7frz.76089670
  Located on chromosome 3
  Distance between a terminus base of telomere on chromosomal short arm and 5'-terminus of this base sequence : 86018760
  Distance between 3'-terminus of neighbour sequence of sequence listing upward to telomere on chrosomal short arm and 5'-terminus of this base sequence : 39284
agaacgattcagaatcaagatcagagaacttggtgaaatttagattagacttgaaatgaggacaatgagagaaataaaaaggcttcgtaaactagaaaagtttggtgaggagcgactacagttctcaaaatgcaagatgaaagaagctcctatcaagagaaccagggaacagagatgagattctccatttaacattttctattttgattcttagatatgaacaatttacatttgacaagtctggttgtcaagccttgtcaattttcaagcttgacttaaggctcctaaaaatgtgtgtgtgtgtgtgtgtgtgtgtgtgtgtgtgagtgtgtgtgtgtgtgtgtgttaaaggcaggacaactttcatctcaataaatgcataaaaggaaagactggtgacacgaagtggagatg

SEQ ID NO: 5377 - DNA, 382 bp, Homo sapiens
  AC060778.2_82865
  Located on chromosome 3
  Distance between a terminus base of telomere on chromosomal short arm and 5'-terminus of this base sequence : 86234073
  Distance between 3'-terminus of neighbour sequence of sequence listing upward to telomere on chrosomal short arm and 5'-terminus of this base sequence : 214899
agatggtgtattagtcaatccttatactgctataaagagctaattgagagtgggtaatttatgaagaaaagaggtttacttgactcacagttccacaggctgtagaggaaacatggctgggaggcctcaggaaacttacaatcatagccgaaagcaaaatggaagcagacacatcttaccatggaggaacgagagagagagagagagagagagagagagagagagagagagagtgaaagtgctacaaacttttaaagaaccagatctcatgagaactcactcactgtcacaagaagagcagggggacatccgcccctctgatttaatcaccccccaccagggcctctcccaaaataaagaattacaatttgatgtgacattt

SEQ ID NO: 5378 - DNA, 460 bp, Homo sapiens
  AC036139.3_9047
  Located on chromosome 3
  Distance between a terminus base of telomere on chromosomal short arm and 5'-terminus of this base sequence : 86338097
  Distance between 3'-terminus of neighbour sequence of sequence listing upward to telomere on chrosomal short arm and 5'-terminus of this base sequence : 103642
agaaggagtacgctctaaactaactataaaaagtatagtataataaatacataaaccagttagataatagtttattaccattatcaatgattatgtactgtacataattatatgtgctagacttttacgtgactggcagcacattaggtttgtttacaccagcctcatcacaaacatgagtaatgtgttgcactacaaatttatgacagctatgatatcagaaggtgacaggaactctcccgctccattacaatcccctggtaccactagcatatatgtcattcattactcaagcaaatgtcccttatataccacatgactgtatatatacaatctgggtgtgtgtgtgtgtgtgtgtgtgtgtgtgtgtgtgtatatatatacacagaaagagagagagagtaagtgagagaaaaagttagggctagtaagcccaaagttttgaggatagaccagtagc

SEQ ID NO: 5379 - DNA, 231 bp, Homo sapiens
  D3S1577
  Located on chromosome 3
  Distance between a terminus base of telomere on chromosomal short arm and 5'-terminus of this base sequence : 86338340
  Distance between 3'-terminus of neighbour sequence of sequence listing upward to telomere on chrosomal short arm and 5'-terminus of this base sequence : -217
tccattacaatcccctggtaccactagcatatatgtcattcattactcaagcaaatgtcccttatataccacatgactgtatatatacaatctgggtgtgtgtgtgtgtgtgtgtgtgtgtgtgtgtgtgtatatatatacacagaaagagagagagagtaagtgagagaaaaagttagggctagtaagcccaaagttttgaggatagaccagtagcgatgcaacttttga

SEQ ID NO: 5380 - DNA, 317 bp, Homo sapiens
  AC036139.3_114354
  Located on chromosome 3
  Distance between a terminus base of telomere on chromosomal short arm and 5'-terminus of this base sequence : 86398368
  Distance between 3'-terminus of neighbour sequence of sequence listing upward to telomere on chrosomal short arm and 5'-terminus of this base sequence : 59797
caagtggactgtaattcctaatattgtattgtatactggaaatttgccaagagactagattttagattctcttaacatacacacacacacacaaacacacacacagacacacacacacacacacacacacacacacacacgttctcttaccaatatgtgaagtgacttatatgttaatatgattgactgtagtaatttcagtgtttgtgtgtgtgtgtgtatatatatatatattcagaacatcatattgtataccttaaatatagacaataattaatagatacatattcacataaataaaggctacaatgaacatc

SEQ ID NO: 5381 - DNA, 184 bp, Homo sapiens
  D3S3508
  Located on chromosome 3
  Distance between a terminus base of telomere on chromosomal short arm and 5'-terminus of this base sequence : 86483338
  Distance between 3'-terminus of neighbour sequence of sequence listing upward to telomere on chrosomal short arm and 5'-terminus of this base sequence : 84653
tacaggggtcattgatatgccaagtaactgctcagatctacaggcctatcccttacattttctttccatttcaaattctagaatacacacacacacacacacacacacacacacacacacacaggcacagggaaaatattggtagagcatataccatttttctgaattgtttgagtaaaatcaa

SEQ ID NO: 5382 - DNA, 458 bp, Homo sapiens
  chr3.fa.O7frz.95939980
  Located on chromosome 3
  Distance between a terminus base of telomere on chromosomal short arm and 5'-terminus of this base sequence : 86592138
  Distance between 3'-terminus of neighbour sequence of sequence listing upward to telomere on chrosomal short arm and 5'-terminus of this base sequence : 108616
ctagttctagatccttgaggaatcgccacactgtcttccacaatggttgaaccagtttacagaggaggaacatcacacaccagggcctgtttttgggtgggggtagggggtaggatgtagggatagcattaggagatatacctaatgtaaatgacaagttaatgggtgcagcacaccaacatggcacatgtatacatatgtaacaaacctgcacattgtgcacatgtaccctagaacttaaagtataataataataataataataataataataataataaatccagattgcaatagtaattctactcagttacataaatttgatagtaagaaaagccatggaatgttggtgattttcatagcacaggacttcttcatttataacttatttcacataaagaatggtcatgtccagggtacattagttatttttgcttatttgcttcagagatcactta

SEQ ID NO: 5383 - DNA, 185 bp, Homo sapiens
  D3S2438
  Located on chromosome 3
  Distance between a terminus base of telomere on chromosomal short arm and 5'-terminus of this base sequence : 86665333
  Distance between 3'-terminus of neighbour sequence of sequence listing upward to telomere on chrosomal short arm and 5'-terminus of this base sequence : 72737
tctccttgtcatccttctgccatactgactccatctcctacctttatctccaaataggtagaaagatgatggacacatgatagatagatagatagatagatagatagatagatagatagatagatgataggtagatagatagacagataatagggtgaggataaggcaggagggaaagtttcttc

SEQ ID NO: 5384 - DNA, 226 bp, Homo sapiens
  D3S3681
  Located on chromosome 3
  Distance between a terminus base of telomere on chromosomal short arm and 5'-terminus of this base sequence : 86774264
  Distance between 3'-terminus of neighbour sequence of sequence listing upward to telomere on chrosomal short arm and 5'-terminus of this base sequence : 108746
gtgagaaccatttggggcagaattctggacaaacacacacacacacacacacacaaaagccgagaggaatgaaacatcctgagtgtttaagaaaatgcaagtaaattttcatagtaattgataattctgaagactgaaaagaagaattcatgcttcatatcacagagtaccttcaatgactaaggagtttagaaattgtcatttttgccctgacagatagctcgcc

SEQ ID NO: 5385 - DNA, 472 bp, Homo sapiens
  chr3.fa.O7frz.94605556
  Located on chromosome 3
  Distance between a terminus base of telomere on chromosomal short arm and 5'-terminus of this base sequence : 87018678
  Distance between 3'-terminus of neighbour sequence of sequence listing upward to telomere on chrosomal short arm and 5'-terminus of this base sequence : 244188
cactttacaaatacttcggtgtaccatcctggttaggtgtttgcagagttgttttaaatgatactgaaatagatgtatccaaattatttcctcaaagaggaaaatctgaaaatcacttgcagtaaagatggttgttgaagaaacaaattaatcatgatacaaagtgtctgctgctgcacagataacatatggtagctcagtttctattttgcttccccacaggttaacaaccatcgactaggacatgaaaagaaatgcataagtgttgtcgatgttccttggggaatttggatagtttacatacataatgttctctctctctttttctctctctctctctctctctctctctcacatacacacacatacacagaggatttcatggaatttgaaagttaagaaagaggtttttctcttttgttgtattttataagagagttttaacatattaaattatggcatgatcttactg

SEQ ID NO: 5386 - DNA, 205 bp, Homo sapiens
  DISO7_10001133
  Located on chromosome 3
  Distance between a terminus base of telomere on chromosomal short arm and 5'-terminus of this base sequence : 87117815
  Distance between 3'-terminus of neighbour sequence of sequence listing upward to telomere on chrosomal short arm and 5'-terminus of this base sequence : 98665
tctggcttcactctaaacctcatttctcacatctctcacctcctccctaacccacaccatgcccccgccaaccacacatacacaacacacatgcatgcaggcgcacacacacacacacacacacacacacacacacatgccccaccaccacgaccaacaacaactatattaactttcttgcaaacccttgcttacatgttcactt

SEQ ID NO: 5387 - DNA, 270 bp, Homo sapiens
  DISO7_10001135
  Located on chromosome 3
  Distance between a terminus base of telomere on chromosomal short arm and 5'-terminus of this base sequence : 87165048
  Distance between 3'-terminus of neighbour sequence of sequence listing upward to telomere on chrosomal short arm and 5'-terminus of this base sequence : 47028
tgagctaataatcattggattccaatgaaaatatttgcaaaatttggcattctttattttaaaggatttttaaagaaagcctaactttaaaattgtctttgatcaactataactcaattacagaccttattgaaaaaagtttgttgatagtcatgctacacacacacacacacacacacacacacacatttttttaagcatgaacgaagggatcttagatacctcagatcagctgcctgccgctaggcaatgaacagaataatattgtga

SEQ ID NO: 5388 - DNA, 112 bp, Homo sapiens
  DISO7_10001140
  Located on chromosome 3
  Distance between a terminus base of telomere on chromosomal short arm and 5'-terminus of this base sequence : 87308290
  Distance between 3'-terminus of neighbour sequence of sequence listing upward to telomere on chrosomal short arm and 5'-terminus of this base sequence : 142972
aatcacggatccgatttcaggctttaaaacacacacacacacacacacacacacacacacacacacacacactgcacctcggaatttttatagtcacattcgcatactgagc

SEQ ID NO: 5389 - DNA, 391 bp, Homo sapiens
  AC060795.2_56009
  Located on chromosome 3
  Distance between a terminus base of telomere on chromosomal short arm and 5'-terminus of this base sequence : 87380815
  Distance between 3'-terminus of neighbour sequence of sequence listing upward to telomere on chrosomal short arm and 5'-terminus of this base sequence : 72413
acactagaacagatctgcttacagtttgccaagtaaaaagtttgtgaatggaaaaccagtaaaaatacttaattccttaagtattttctgtaccctgtaccattttcattttgtgtgtgtgtgtgtgtgtgtgtgtgtgtgtgtgtgtgtgtgtgtgtgtgtgtgttttaatacggagtctcgcttcgttgcccaggctggagagcagtggcgcaatctcggctcactgcaagctctgcctcctgggttcaagcaattctgcctcagcctcccgaggaactgagactacaggcacgtgccaccacaaccagctaactttttgtatttttagtagcgatgggatttcaccatgttagccaggatggtctcgatctcttgacctcgtgattca

SEQ ID NO: 5390 - DNA, 458 bp, Homo sapiens
  AC060795.2_109668
  Located on chromosome 3
  Distance between a terminus base of telomere on chromosomal short arm and 5'-terminus of this base sequence : 87411935
  Distance between 3'-terminus of neighbour sequence of sequence listing upward to telomere on chrosomal short arm and 5'-terminus of this base sequence : 30729
agctcttcctaactgataaggaagttgtttctcggtcaagcacagtggctcatacctgtaatcccagcagtttgggaggctgaggtaggcagatggcttgtggctcaggagtttgagaccagcctgggcaacatggtgaaaccctgtctctacaaaaaaatacaaaaattagccgggcgtggtggtgcatgcctgtaatcccagctacacaggaggctgaggtggaaggattggttgagcccgggatgtggaggttgcagtgagctgaggtggcatcactgtgctccagcctgggcaatagagcgagactccatctctaaataaataaataaataaataaataaataaataaataaatgatactggaaaagaaataatttctgtgttgacagtgcctgaatttcctgaggttgcttgagacactttacatatgcaaaacaggacctagcaacctttac

SEQ ID NO: 5391 - DNA, 341 bp, Homo sapiens
  AC060795.2_77297
  Located on chromosome 3
  Distance between a terminus base of telomere on chromosomal short arm and 5'-terminus of this base sequence : 87455653
  Distance between 3'-terminus of neighbour sequence of sequence listing upward to telomere on chrosomal short arm and 5'-terminus of this base sequence : 43260
aagcataactggttaaatatttgacataactatttgatgttgtttttttataaacaaagctaaaagataaagtcatatatcaaatgttagaagacgttttacaaaaatataaacttgttcatgtataggtaatattattcttcaaatgaatctttaattacttaaaaaaatatatatgtatgtatatatatatatatatatatatatatatataaaattttgctatcagtagtagggtcttgaaaatgccattttacttcatttcttcatctgtaaaatgggcagggttgtatgaacataatttttctaaaattaaatagtccatgtaggatttacagtca

SEQ ID NO: 5392 - DNA, 180 bp, Homo sapiens
  G08285
  Located on chromosome 3
  Distance between a terminus base of telomere on chromosomal short arm and 5'-terminus of this base sequence : 87484447
  Distance between 3'-terminus of neighbour sequence of sequence listing upward to telomere on chrosomal short arm and 5'-terminus of this base sequence : 28453
ttgcacattccatgaacatctgtattaaatgcacaaatccaaactccttatcttctcactcagaaaacctattcagcaatctatcatctatctatctatctatctatctatctatctatctatctatctacctatctacctacctatgttcccttctttcctaaaaccccttgtgtcttt

SEQ ID NO: 5393 - DNA, 467 bp, Homo sapiens
  AC027755.2_134899
  Located on chromosome 3
  Distance between a terminus base of telomere on chromosomal short arm and 5'-terminus of this base sequence : 87736207
  Distance between 3'-terminus of neighbour sequence of sequence listing upward to telomere on chrosomal short arm and 5'-terminus of this base sequence : 251580
gctttaggagatcaaagtaggtggatggcttgagcataggagttcgagaccagcctgagcaacatagtgaaaccctgtctctacaaaaactacaaaagttaatcgggtgtggtggcatgtagtcccagtttctcaggaggctgaggtgggaggatcacttgatgggagacagaggctgcagtgagctgagatcacaccactgcactccagcctaggcaacaaagcaagactttgtctccaaaaaagggaagaaattaaattatataagttacattatatgtaatatgtattacttaagatgtaactacaactagaagtaactgtgtgtgtgtgtgtgtgtgtgtgtgtgtaaatgaaattaacatatatttataccagtgattatctggtttaaaacctctgggtacgtaaacacaatggtgagatgccatcaatgaatagtagattataaacatgcaattgaatgt

SEQ ID NO: 5394 - DNA, 106 bp, Homo sapiens
  D3S3507
  Located on chromosome 3
  Distance between a terminus base of telomere on chromosomal short arm and 5'-terminus of this base sequence : 87772186
  Distance between 3'-terminus of neighbour sequence of sequence listing upward to telomere on chrosomal short arm and 5'-terminus of this base sequence : 35512
tccagcccttatacctactctctcacacacacacatacacacacacacacacacacacaaataagcacatataaacacctaaaagttcagtcttgtcttgattcca

SEQ ID NO: 5395 - DNA, 421 bp, Homo sapiens
  chr3.fa.O7frz.93662105
  Located on chromosome 3
  Distance between a terminus base of telomere on chromosomal short arm and 5'-terminus of this base sequence : 87937347
  Distance between 3'-terminus of neighbour sequence of sequence listing upward to telomere on chrosomal short arm and 5'-terminus of this base sequence : 165055
cacttcagtgaacaacttaggtggttagaggctattttggacgatagcctagaaatggctctgagtaagataaataaggctgaaatagaagaaagttgctatctcacactgtaatcacaataaccttcacttaaaaatactcttgagaggtcaggaaagaaacaagatcattacaaaaagaaatatacaaaatcttaattggaagaatgtctgaaatgcttgggtaaattttgactgtgctcttaatagaaatgaatagcaacagtagaggtgtattcccctttgaggtttgaagtgcctccgtgtgtgtgtgtgtgtgtgtgtgtgtgtgtgtgtacatgctcacacaaagctctgaacaaatgaaatgaacaaagagcttctgtgggttgctctgtcattctgaacttgcttcctgaaa

SEQ ID NO: 5396 - DNA, 417 bp, Homo sapiens
  AC053483.2_101288
  Located on chromosome 3
  Distance between a terminus base of telomere on chromosomal short arm and 5'-terminus of this base sequence : 88003965
  Distance between 3'-terminus of neighbour sequence of sequence listing upward to telomere on chrosomal short arm and 5'-terminus of this base sequence : 66197
accagaaagaccaagtttactatctttggattttgtaaatgataaatatttattgaatggatgtatgattcttccttcaagatctttctccctctctctctttttctgtgtgtgtgtgtgtgtgtgtgtgtgtgtgtgtgtgaccaaattagtctaactcaagaggaaaacacatataagagaaagagcagataaggaaaaagaattgtgaagataccaaaatatgctatcccaaaatatgcctctttggcatctggaatattttgagctaaaggctattgaaaagcagcaaacctaggaaaagctccaaaaacagggcacaagttttctttctataaagaaaagtcttatttggaaaaggtagctctctctcctgtaccagaaacaggaagactcttaacaattcttatcaaagga

SEQ ID NO: 5397 - DNA, 447 bp, Homo sapiens
  AC053483.2_55549
  Located on chromosome 3
  Distance between a terminus base of telomere on chromosomal short arm and 5'-terminus of this base sequence : 88030765
  Distance between 3'-terminus of neighbour sequence of sequence listing upward to telomere on chrosomal short arm and 5'-terminus of this base sequence : 26383
agccaatgaacctaaactagacacaggaaaaataaacggtttccttccttacaaaggaaaagggtactttgcttttctgatggaccaccactgagccacaatggtggggcagtaaaaatacagaagatgagaacctctggaatgagaaacacctatgttcaaatttcagctctcacttatttgctatattatgataaaacacacagacacacacacacacacacacacacacaagctgttatttgatgcatgtaataatttttagcttaaactttgcaaaaaatttatgtaaaatcataacttggtcccataattcttcaaatatataaaaaactcatgcccctttgggaataaacttttgagcaaagatgcagagcaaaatgatagcactgtttcttacatattcacgctgtgtttaatcatcataaatgtcatgacttgtgctta

SEQ ID NO: 5398 - DNA, 93 bp, Homo sapiens
  Z67758
  Located on chromosome 3
  Distance between a terminus base of telomere on chromosomal short arm and 5'-terminus of this base sequence : 88142559
  Distance between 3'-terminus of neighbour sequence of sequence listing upward to telomere on chrosomal short arm and 5'-terminus of this base sequence : 111347
cataggtaatgaggtctcccttattgagatccgtctgtgtgtgtgtgtgtgtgtgtgtgtcagtgttcagaatggcattcaagatacaacttt

SEQ ID NO: 5399 - DNA, 369 bp, Homo sapiens
  AC073144.2_111024
  Located on chromosome 3
  Distance between a terminus base of telomere on chromosomal short arm and 5'-terminus of this base sequence : 88196221
  Distance between 3'-terminus of neighbour sequence of sequence listing upward to telomere on chrosomal short arm and 5'-terminus of this base sequence : 53569
tgtctaggatgaaatttagcactctaagtcttgatctcattaatttatcccagccaatgtgagtttggcatattcttctttattatttctagttatctgggacacacacacacacacacacacacacacacacacacacacacacacctttcccaacaacaaataccaaattctagagacagtaaatataggtcccgattcaacaatcttttccctaagtgcaacatacgttcttccacataaaggacaaagcttcatatacatgtttaaagaaattgctagagacaccccttcacccttattttcttacccttctgtttctaaaccatacgtagaaagctgtaggtacattaaagtacgacctagtgc

SEQ ID NO: 5400 - DNA, 447 bp, Homo sapiens
  AC073144.2_24201
  Located on chromosome 3
  Distance between a terminus base of telomere on chromosomal short arm and 5'-terminus of this base sequence : 88271410
  Distance between 3'-terminus of neighbour sequence of sequence listing upward to telomere on chrosomal short arm and 5'-terminus of this base sequence : 74820
atagcctaatgactcaagagtttcccagagctggaattcttttccaaaatgagttaaccagatcccttttatgcatggctgcatgaaatgaaatgaaaacagaagatgaccatttttcattttcctgttcagattctgatctgtaagtactccctgagatcctactacgggccagatgccagtttatgtgttcttagatatgattccttgataatatataacctgtaacacacacacacacacacacacacacacacacacacacacacacacacacacacaacatgtgagatacttaacatataacctctggctggcctcaaacccccttctgacctcgtctctgagttttgctgtcttcttcaaaaagagaaacttgcttacccattgctgaagctcaggtttactgatgctgaatgttttataaatccgataaatacaattcag

SEQ ID NO: 5401 - DNA, 231 bp, Homo sapiens
  AC012221.3_83908
  Located on chromosome 3
  Distance between a terminus base of telomere on chromosomal short arm and 5'-terminus of this base sequence : 88407583
  Distance between 3'-terminus of neighbour sequence of sequence listing upward to telomere on chrosomal short arm and 5'-terminus of this base sequence : 135726
aatctttgtggactgacagaatacagaaaataatgagtggcttttcttgaaagttctataagggttttctttacaatagtccatgatcttaggccttagcaatatggtttatcaaaaatataaaaattgatctatctgtctgtctgtctatctatctatctatctatagagagagagagagtgagagattgggtctcactctgtcatacaggctggagtgcagtgacatga

SEQ ID NO: 5402 - DNA, 354 bp, Homo sapiens
  AC012221.3_122643
  Located on chromosome 3
  Distance between a terminus base of telomere on chromosomal short arm and 5'-terminus of this base sequence : 88482209
  Distance between 3'-terminus of neighbour sequence of sequence listing upward to telomere on chrosomal short arm and 5'-terminus of this base sequence : 74395
tgaaactcctatgagattatccatgaaaagcccctggaaaaatgttgggcatttgatactgtcattaaatattgaccatttttattctcggtctagagactcccagatctccacagaaaataaataaataaataaataaataaataaataaataaataaataaaatgaggttggaatacactcttcttaatggaaaatgagtgttagtgagtataagtaattgtaatcttacttccattgttaccttcggcattaaaatgtttcatttaaatgaaaattgtatttgcatttagaagttggtaaaaatgatcatgtccaacttatacaaacctcatttatggcataagatttctt

SEQ ID NO: 5403 - DNA, 218 bp, Homo sapiens
  D3S3671
  Located on chromosome 3
  Distance between a terminus base of telomere on chromosomal short arm and 5'-terminus of this base sequence : 88533532
  Distance between 3'-terminus of neighbour sequence of sequence listing upward to telomere on chrosomal short arm and 5'-terminus of this base sequence : 50969
tgtaggaggttctcaataaaacatcactgcagaaacacacacacacacacacacacacacttattgttattagggtgtgtcaatttcttctaatatctaccatgtattcagccactcagttcttcaacagccctgtaattaggtgctcctattatccttctccttgcacaggtgggaaactgagaggtggagacattaggtaacttggtcacagccga

SEQ ID NO: 5404 - DNA, 421 bp, Homo sapiens
  chr3.fa.O7frz.100805226
  Located on chromosome 3
  Distance between a terminus base of telomere on chromosomal short arm and 5'-terminus of this base sequence : 88662271
  Distance between 3'-terminus of neighbour sequence of sequence listing upward to telomere on chrosomal short arm and 5'-terminus of this base sequence : 128521
aagtgttcttgaatcaaacaatacataattttccatcaaatgttgaaaattattagctctccatttctcaaaattaagttattacattattattattttttatttatttatttatttatttatttatttatttatttattttgagacggggtctcgctctgtcgcccaagctggagtgcagtggcgcaagctcggatcactgcaacctccgcctcccaggttcaagccattctcctgcctcagtctcctgagtagctgggattataggcacccaccaccatgcccggctaaattttgtatttttagtagaaacagagtttcaccatgttggccagactggtctcgagctcctgacctcaggcccgccttggcctcccaattcaccttacatttatatgttatgttacacctgcattacact

SEQ ID NO: 5405 - DNA, 202 bp, Homo sapiens
  DISD22_0002864
  Located on chromosome 3
  Distance between a terminus base of telomere on chromosomal short arm and 5'-terminus of this base sequence : 88760479
  Distance between 3'-terminus of neighbour sequence of sequence listing upward to telomere on chrosomal short arm and 5'-terminus of this base sequence : 97787
ctggctaaaggacaattagtctcatgccgagatcatgccattgcactccagcctgggtgacagagaaagactccatctccaccacaacaacaacaacaacaacaacaacaactatatatatatataatatatatatatattatatatatataaaatatatatatattatatatatatatatccctgcatttctgtatgcatt

SEQ ID NO: 5406 - DNA, 241 bp, Homo sapiens
  AC037430.2_136796
  Located on chromosome 3
  Distance between a terminus base of telomere on chromosomal short arm and 5'-terminus of this base sequence : 88957075
  Distance between 3'-terminus of neighbour sequence of sequence listing upward to telomere on chrosomal short arm and 5'-terminus of this base sequence : 196394
ccattaaacatgtattgtttcagccatttaaaaatatttattccaaaatatttactgatgtactccagcctgggcgacacagtgagattctgtctctctctctctctctctctcaagagcatctgctctgtgctagacattgttttaataatatttaaggaaactgaaaattcactatcatttatttatactataatttatttttaaatttatgaaagtcaaatttcatgctatttaagtt

SEQ ID NO: 5407 - DNA, 238 bp, Homo sapiens
  AC037430.2_34964
  Located on chromosome 3
  Distance between a terminus base of telomere on chromosomal short arm and 5'-terminus of this base sequence : 89044079
  Distance between 3'-terminus of neighbour sequence of sequence listing upward to telomere on chrosomal short arm and 5'-terminus of this base sequence : 86763
ttcttaatgcaccttgataactcttggtttaggaaataggcaaatttacatttgttttcattgctgttgtaataaaacatttatttcaaagtggtaaattatacccatacacatacacaaccacacacacacacacacacacacacacacacacacacacgaagaaaaaatatgtatcaagtagtggcctgcattttggaaatgtagcttccaagtctgagttaatggagtagcataa

SEQ ID NO: 5408 - DNA, 115 bp, Homo sapiens
  HUMUT6384
  Located on chromosome 3
  Distance between a terminus base of telomere on chromosomal short arm and 5'-terminus of this base sequence : 89137240
  Distance between 3'-terminus of neighbour sequence of sequence listing upward to telomere on chrosomal short arm and 5'-terminus of this base sequence : 92923
aaggtgcatctgtggactacaaaggcggtgctctgtacaaaataaataaataaataaataaataaataaataaataaatatctgtcccacctttctcagcattggagacctgttt

SEQ ID NO: 5409 - DNA, 291 bp, Homo sapiens
  D3S2386
  Located on chromosome 3
  Distance between a terminus base of telomere on chromosomal short arm and 5'-terminus of this base sequence : 89237042
  Distance between 3'-terminus of neighbour sequence of sequence listing upward to telomere on chrosomal short arm and 5'-terminus of this base sequence : 99687
aagctctccataccacagcatgttaggtgagtgctttagtcagggttctccagaaaaaaacagaaccaataggatagatagatagacaaacagatagatagatagatagatagatagatagatagatagatagatacatagatagatagatagatgatagatagatagatagatagatagatgatagatagatattctaaagaactgttttatacaattatggaggctgaaaagtcctaagatgttcagggtgagtcgataaactggagacccaagagagctgatgatgta

SEQ ID NO: 5410 - DNA, 154 bp, Homo sapiens
  DISD22_0002871
  Located on chromosome 3
  Distance between a terminus base of telomere on chromosomal short arm and 5'-terminus of this base sequence : 89346557
  Distance between 3'-terminus of neighbour sequence of sequence listing upward to telomere on chrosomal short arm and 5'-terminus of this base sequence : 109224
attgctgcaccctaatgggcaatcagggactggagtggaaagaaggatggaaggaagggagggagggagggaggaaggaaggaaggaaggaaggaaggaaggaaggaaggaaggaaaagagagagatgggaaagactgagggtcctagtgctac

SEQ ID NO: 5411 - DNA, 350 bp, Homo sapiens
  chr3.fa.O7frz.101775839
  Located on chromosome 3
  Distance between a terminus base of telomere on chromosomal short arm and 5'-terminus of this base sequence : 95442293
  Distance between 3'-terminus of neighbour sequence of sequence listing upward to telomere on chrosomal short arm and 5'-terminus of this base sequence : 6095582
actagcagtggctagacagatatattcacagaagtaatttttgcgtaagatctcaatgacttctgtgcaaagttgtgtttttttgtagcttttcatgatagtttttgttattcagcattcacacatgagaaccctcccttccatgaagggacacttcatggccttccctggctccatttttctcccttccttcctttctttctctctctctttctttctttctctctctctctctttctttctttctttctttcttttctctctctcttctttctttcttcattttttgaaaaaacacaagtaaatccattttgattctgcaactttcacatctgttatggattgaatgt

SEQ ID NO: 5412 - DNA, 135 bp, Homo sapiens
  DISO7_10001164
  Located on chromosome 3
  Distance between a terminus base of telomere on chromosomal short arm and 5'-terminus of this base sequence : 95480465
  Distance between 3'-terminus of neighbour sequence of sequence listing upward to telomere on chrosomal short arm and 5'-terminus of this base sequence : 37822
tccagattatcatggagatgagtttttttcatatatatatatatatatatatgtattgtaaatttttttacattctgtgatttgcctttattctttctaatatgatgtcttttggttattgggaggtcttaagtt

SEQ ID NO: 5413 - DNA, 470 bp, Homo sapiens
  chr3.fa.O7frz.101683406
  Located on chromosome 3
  Distance between a terminus base of telomere on chromosomal short arm and 5'-terminus of this base sequence : 95526676
  Distance between 3'-terminus of neighbour sequence of sequence listing upward to telomere on chrosomal short arm and 5'-terminus of this base sequence : 46076
gaagcctagataaagctttcacagacaaatcctggccaagcaagctctttgtgtgtgttcattattttaaatgcctttatttatatttatgtgattatctatctgtctatctatctatctatctatctatctatctatcatctatctatatctttttttttttttaggcaaaatttcgctcttgtcacccagtgcaatggcttgatctcagttcactgcaacctccgcctcccgggttcaagcaattctcctgcctcagctgggattacaggtgttcaccaccatgcccagctaattttgtatttttaatagagacagggtttcgccatgttagccaggctggtctcgaacttctaacctcaggtgatctgcagacctttgcctctcaaagagctgggattacaggcgtgagccacggcacccagcctatcatctgtctatccatatctatctcgcttagcgataaatac

SEQ ID NO: 5414 - DNA, 101 bp, Homo sapiens
  DISO7_10001163
  Located on chromosome 3
  Distance between a terminus base of telomere on chromosomal short arm and 5'-terminus of this base sequence : 95637007
  Distance between 3'-terminus of neighbour sequence of sequence listing upward to telomere on chrosomal short arm and 5'-terminus of this base sequence : 109861
aatgtctacagggaactgaatgtcagtgtgtgtgtgtgtgtgtgtgtgtgtgcgcgcgggcgtgtgttctctcttgtgggtgtgactttctcctctattct

SEQ ID NO: 5415 - DNA, 130 bp, Homo sapiens
  DISO7_10001167
  Located on chromosome 3
  Distance between a terminus base of telomere on chromosomal short arm and 5'-terminus of this base sequence : 95756507
  Distance between 3'-terminus of neighbour sequence of sequence listing upward to telomere on chrosomal short arm and 5'-terminus of this base sequence : 119399
ctgtaaccaagcctgctgtttttgtaccccactttcgttttctgtacataaataaataaatatatatatgtgtgtgtgtgtgtgtgtgtgtgtgtgtgtgtatacactccctacagtatggaatgcatac

SEQ ID NO: 5416 - DNA, 334 bp, Homo sapiens
  AC023127.4_156073
  Located on chromosome 3
  Distance between a terminus base of telomere on chromosomal short arm and 5'-terminus of this base sequence : 95917130
  Distance between 3'-terminus of neighbour sequence of sequence listing upward to telomere on chrosomal short arm and 5'-terminus of this base sequence : 160493
gacttgtaaagctgtatttgtcacaaacatctcaagctgtacctttgcacctggctcagggaccatatttagaaaatactgtatctggttagtatgagtaaggaagggacattggttttttgcagctataacagaaagcatacacacacacacacacacacacacacacacacacacacacacatacacacatgcatatataatgcaataaatacttttaaggagccccatcaccccaatatccctcacaagtataaggggcaagcccattacacttgccctcctgtgatacttcatccctggcatttctatttgctaactatgcttcctgata

SEQ ID NO: 5417 - DNA, 464 bp, Homo sapiens
  AC023127.4_25339
  Located on chromosome 3
  Distance between a terminus base of telomere on chromosomal short arm and 5'-terminus of this base sequence : 96021491
  Distance between 3'-terminus of neighbour sequence of sequence listing upward to telomere on chrosomal short arm and 5'-terminus of this base sequence : 104027
gactatagtcattctaccagtgctttgtgggaagactgcattctgactactgtgtttaattcttgttgctgtatttataggaaggacactgctgagattgaaaaggtcagacaaaatgacagtaactaattcagaaatgagatgtcaagaattgaagttctaaagcagggattaacctataagcaatttaagtaggtttagacacacacacacacacacacacacacacacatacacacatacgcacaaatgctagttaaacctataagcagtttaagtaggtttagacacacacacacacacacacacacacacacacacacatacaaaaatgctacttaaaacagtatttaatataaatcgacaaggtcaacaaaaaaagcaatgtatgtgagctgaagagtgaacttctgtaaaatagggaaagtgaaggtgaactctaagactagaaggtttctgtacgt

SEQ ID NO: 5418 - DNA, 280 bp, Homo sapiens
  chr3.fa.O7frz.102485264
  Located on chromosome 3
  Distance between a terminus base of telomere on chromosomal short arm and 5'-terminus of this base sequence : 96130337
  Distance between 3'-terminus of neighbour sequence of sequence listing upward to telomere on chrosomal short arm and 5'-terminus of this base sequence : 108382
aattagacagaggtcctagcacacactataaagaccagaagcacagaaagaacagaagagccaaggagagaggacgtgtgtgtgtgtgtgtgtgtgtgtgtgtgtgtgtgtgtgtagaagtgtatggcaaattgtgtaaaatgctgggcaacgtggcaatttaagaaatcattggcaaatttttagtttatccttagatgaatagtgagggcagaagccagcacgcagtgaaaagactagaggagtaaattggagatgatgaagtggattatgaattcaa

SEQ ID NO: 5419 - DNA, 341 bp, Homo sapiens
  AC053541.3_168730
  Located on chromosome 3
  Distance between a terminus base of telomere on chromosomal short arm and 5'-terminus of this base sequence : 96382731
  Distance between 3'-terminus of neighbour sequence of sequence listing upward to telomere on chrosomal short arm and 5'-terminus of this base sequence : 252114
tatggtgatcttgttagttcagtcccttgatactgtctgggaggcctgagagtcagtttcctgaggaaggaactcagataaggcaaatgtaagtttcaaactttaaactaggaggatcaatttctacgtgtgtgtgtgtgtgtgtgtgtgtgtgtgtgtgtgtgtgtgtttccataaacatcagttctatgggacccttgggctggttccattaagaaagctagttttcctggtgctacgtgaagtagggagagaggagtagagcgtgggacaagtgagtaagagaagtgaggcagatcaggtagggccaagcagaagtacatggtgagacttctgataat

SEQ ID NO: 5420 - DNA, 180 bp, Homo sapiens
  D3S3690
  Located on chromosome 3
  Distance between a terminus base of telomere on chromosomal short arm and 5'-terminus of this base sequence : 96421831
  Distance between 3'-terminus of neighbour sequence of sequence listing upward to telomere on chrosomal short arm and 5'-terminus of this base sequence : 38759
tgtgccaataccaatgagtagtctgtattttagaaataaaaagttggcagctgcagggtaaattcagagtgtgtgtgtgtgtgtgtgtgtgtgtgtgtgtgtgtgttcataaataagtgggttataatttaaatatatagaaatttttccacaaagactcagattaaggattctcttgaa

SEQ ID NO: 5421 - DNA, 222 bp, Homo sapiens
  AC053541.3_156097
  Located on chromosome 3
  Distance between a terminus base of telomere on chromosomal short arm and 5'-terminus of this base sequence : 96483153
  Distance between 3'-terminus of neighbour sequence of sequence listing upward to telomere on chrosomal short arm and 5'-terminus of this base sequence : 61142
gatgacctcaatcattacatttattaccctcattggatattaaccagtgtgggatatattagcacatttttagcatattatgattacctaaacacacacacacacacacacacacgctcacacacacacacacataattatgtatctgttcttcaagtttttcttagcacaggttttaatctcttgctaatctgtttattaattaatgagttaaacagccgg

SEQ ID NO: 5422 - DNA, 334 bp, Homo sapiens
  AC026305.13_118005
  Located on chromosome 3
  Distance between a terminus base of telomere on chromosomal short arm and 5'-terminus of this base sequence : 96667867
  Distance between 3'-terminus of neighbour sequence of sequence listing upward to telomere on chrosomal short arm and 5'-terminus of this base sequence : 184492
atgtcctatgtaacttagcaacagtgtgtgtcgaggcaaagctgtggccagctctgaaatgcaccatcttgtgtttgctcttccacattcctgccttcactctcctatatccttgactcttgcttccctgggaatgtatctcccaatacaacattaacctgttagtttttgccctaggccctgtattcagaagaatcagtattaagaccatgtggggtgtgtgtgtgtgtgtgtgtgtgtgtgtgtgtgtatgtgagagagagagagacagagacagagacaagagagagagagaaaccccaaactgtgtttgtaagcctattctgtttcaaca

SEQ ID NO: 5423 - DNA, 408 bp, Homo sapiens
  AC069083.3_14049
  Located on chromosome 3
  Distance between a terminus base of telomere on chromosomal short arm and 5'-terminus of this base sequence : 96959747
  Distance between 3'-terminus of neighbour sequence of sequence listing upward to telomere on chrosomal short arm and 5'-terminus of this base sequence : 291546
gcttgaaaggtagcttaagaattttacataaatagagcaaataattaattactggaaatgcataggaaacaaaatgactattcatagaaccaaatacaaacattccattagaaagtaaaaaaattaatggagatatatatatatatatatatatatatatatatatatatatatatgtatgtatatgtaaaatttaaagaacaaacagcaaataaatgaaaattagaagcacaaacaaacaggaaacaaacccaaaatattctcctattgagtttaccttggaggctacactactatcaagagcctttaaaaaagcacaaggtgaatattttgttcctggtatacaaattaatatccttaagtccaccaataccactatagattttgtgcaattatgaaattcacttc

SEQ ID NO: 5424 - DNA, 386 bp, Homo sapiens
  chr3.fa.O7frz.103428146
  Located on chromosome 3
  Distance between a terminus base of telomere on chromosomal short arm and 5'-terminus of this base sequence : 97028247
  Distance between 3'-terminus of neighbour sequence of sequence listing upward to telomere on chrosomal short arm and 5'-terminus of this base sequence : 68092
ctcagtctacaaggccagtatttccctgacaccaaaaccagataaggacccataaggagagagagagagagagagagagagagagagagagagagagagaaagaagagaagagaaaaggaaaagaaaaagaaaaaggaaaggaaaagaaaagaaagaaagagaaagaaagagagagaggaaggaaggaaggagaaaggaaaaataaaagaaaactagaggcaatatctctgatgaaccttaatggaaaaatcctcgataaaatattagcaaattgaatttaacaacacattaaaaagatcgttcaccatgaccaagtgggatttatcccagggacacaagggtagttcaacatatataaatcaaacaatgtgatacatcacatgaa

SEQ ID NO: 5425 - DNA, 121 bp, Homo sapiens
  Z66646
  Located on chromosome 3
  Distance between a terminus base of telomere on chromosomal short arm and 5'-terminus of this base sequence : 97302821
  Distance between 3'-terminus of neighbour sequence of sequence listing upward to telomere on chrosomal short arm and 5'-terminus of this base sequence : 274188
tactgaaaaatggatgcacgtgtgtgtgtgtgtgtgtgtgtgtgtgtgtatatatatatatatatataattttattaaaagcaattgccccaaaagcagaaattgacaagcgggacctaat

SEQ ID NO: 5426 - DNA, 256 bp, Homo sapiens
  DISD22_0002878
  Located on chromosome 3
  Distance between a terminus base of telomere on chromosomal short arm and 5'-terminus of this base sequence : 97313365
  Distance between 3'-terminus of neighbour sequence of sequence listing upward to telomere on chrosomal short arm and 5'-terminus of this base sequence : 10423
tcatgcttcgtgataaatgcttttgaagccaggcaggagtctcatgcctttaatcccagctacttggattgagacaggaggattgcttgagctccggagttttcagactagcctggtaggcaacatagcatgagacccagtctcaagggaaaaaaaagagagagagagagagagagagagagagagagagagagagagagatgaaatgctttttttttcttttttgcttttttttcatcctgcacactttcttgca

SEQ ID NO: 5427 - DNA, 176 bp, Homo sapiens
  D3S3556
  Located on chromosome 3
  Distance between a terminus base of telomere on chromosomal short arm and 5'-terminus of this base sequence : 97498408
  Distance between 3'-terminus of neighbour sequence of sequence listing upward to telomere on chrosomal short arm and 5'-terminus of this base sequence : 184787
catgagatcaggcatggaattttccacttgtgatgtcatgtcagctctcaaaaggttcaggattttggagcatttcagatatcaaatttttggattagggatactcaacacgtgtgtgtgtgtgtgtgtgtgtgtgtgtgtgtgtgtgggtgggtgtttatgtataatttgatgaa

SEQ ID NO: 5428 - DNA, 251 bp, Homo sapiens
  D3S3634
  Located on chromosome 3
  Distance between a terminus base of telomere on chromosomal short arm and 5'-terminus of this base sequence : 97498495
  Distance between 3'-terminus of neighbour sequence of sequence listing upward to telomere on chrosomal short arm and 5'-terminus of this base sequence : -89
ttttggattagggatactcaacacgtgtgtgtgtgtgtgtgtgtgtgtgtgtgtgtgtgtgggtgggtgtttatgtataatttgatgaaagttaaaagaggaatgtgaataagcatgaggaaaaaattaagacacatgattggaaatccactggtcaaaatgattagcttattacttttagaattgcccttaatcattcagaaagaaaggtgatgagttactactatcagagggactgtgtcctccagcaa

SEQ ID NO: 5429 - DNA, 406 bp, Homo sapiens
  AC024890.12_105558
  Located on chromosome 3
  Distance between a terminus base of telomere on chromosomal short arm and 5'-terminus of this base sequence : 97553344
  Distance between 3'-terminus of neighbour sequence of sequence listing upward to telomere on chrosomal short arm and 5'-terminus of this base sequence : 54598
ttgtaccatactgactttccaccaaaaacaactagaaaaccagacaaaatatgtaaaacaggtgtttcagacattggacagacagcagcacactactgttacccaaaaaaaagaaaaataagacaaattctatgatttccccatctttccgtctgaaggcactttctggaaagtactgtgtgtgtgtgtgtgtgtgtgtgtgtgtgtgtgtgtgtgtgtggttgggggtggaggttgtgagagccaagcagaatatagtgcatttactgagttgagaagatagagatggagttcagatgactgagtcgacgagaatttgcagggcagagtgctggagaggaaggagctatgtggagaagattctccttgatgctattgcaaaatgctaatctgtactaatctggaa

SEQ ID NO: 5430 - DNA, 406 bp, Homo sapiens; identical to SEQ ID NO: 5429
  AC068019.2_92010
  Located on chromosome 3
  Distance between a terminus base of telomere on chromosomal short arm and 5'-terminus of this base sequence : 97553344
  Distance between 3'-terminus of neighbour sequence of sequence listing upward to telomere on chrosomal short arm and 5'-terminus of this base sequence : -406

SEQ ID NO: 5431 - DNA, 413 bp, Homo sapiens
  chr3.fa.O7frz.106965155
  Located on chromosome 3
  Distance between a terminus base of telomere on chromosomal short arm and 5'-terminus of this base sequence : 97741305
  Distance between 3'-terminus of neighbour sequence of sequence listing upward to telomere on chrosomal short arm and 5'-terminus of this base sequence : 187555
aaggtctgaactatttggaaacatttcagttttcatgttcaatagataagatgccaagaactcacaatagaagatgagggttttgagaacagtcacctctaattaggagagaatatcgtatttgtaggctgatttcttccatatctcttgctaatatttttttctgcttgacttagcatgtctcttattatagtatttggaggataatggaaattggattaaggcagcaaaatgctgaaatgggagaaaagagtgtgtgtgtgtgtgtgtgtgtgtgtgtgtgtgtgtgacttttatgtgttttagtaaaaaagtagttctttaaactgtgtgagagattccatagccttgttcccattaagtagcaaacaccagggcttatacaaaatgttctataatgtttcagatcaagc

SEQ ID NO: 5432 - DNA, 475 bp, Homo sapiens
  AC024218.9_86574
  Located on chromosome 3
  Distance between a terminus base of telomere on chromosomal short arm and 5'-terminus of this base sequence : 97879824
  Distance between 3'-terminus of neighbour sequence of sequence listing upward to telomere on chrosomal short arm and 5'-terminus of this base sequence : 138106
ctgaacttaatcttccaacactagagggaaataaaagaactgcaagggattttaaaatggaattcttgcttacacataatatctaccatatatcaaatacagactgtttacccatcactgtgccttacctctgcgtgtgtgtgtgtgtgtgtgtgtgtgtgtatgtgtgtgtgtgtatgttctgacaaaaacttgacaagacatttattattatccccattctacatatttctatacataagaccttggagaaatgaagatgaaatgactacctaaagattaattaagagctcagtggatttggaaatcaaatcttgtgattcctaatccattgcttgttcaccaaatccaatggcttttgcattatcagtatgcattcagctggaaatttagggatgtacaagtgtctctctttgcaaaatgttgcaatagatgatatccagatttgcatgtctatcattctctaccaagacaa

SEQ ID NO: 5433 - DNA, 262 bp, Homo sapiens
  DISO7_10001170
  Located on chromosome 3
  Distance between a terminus base of telomere on chromosomal short arm and 5'-terminus of this base sequence : 97990729
  Distance between 3'-terminus of neighbour sequence of sequence listing upward to telomere on chrosomal short arm and 5'-terminus of this base sequence : 110430
acttcctatggtggtaacactatcaaaaatgttttttcctatttcctttgtttctggtaacactattatctatctctatctatctatctatctatctatctatctatctatctatctgtcatctatctatctgtatttggaaaatatatttttagtataatatttaggcttcaaagcataaaagcctaatgttcaagttagacaaaaataatgaacttttttttaaagaaatgaagacccatgtacctaatataccctgcag

SEQ ID NO: 5434 - DNA, 220 bp, Homo sapiens
  chr3.fa.O7frz.107802888
  Located on chromosome 3
  Distance between a terminus base of telomere on chromosomal short arm and 5'-terminus of this base sequence : 98141269
  Distance between 3'-terminus of neighbour sequence of sequence listing upward to telomere on chrosomal short arm and 5'-terminus of this base sequence : 150278
acataattgacaccaatctgaggccattaagatgcattttgcttcacattggaaatctttgtcctcttcatcttagaagccacattattattattattattattattattattattatcatcttgctaatgaaatgaagtggtatgggatttctaatttacttaaaactaagatcggttttctttcaagtccatagctggactgatagaaatctacttca

SEQ ID NO: 5435 - DNA, 202 bp, Homo sapiens
  DISO7_10001172
  Located on chromosome 3
  Distance between a terminus base of telomere on chromosomal short arm and 5'-terminus of this base sequence : 98352288
  Distance between 3'-terminus of neighbour sequence of sequence listing upward to telomere on chrosomal short arm and 5'-terminus of this base sequence : 210799
tacaggaactctgagcatcacttttctgttctcttcaaaggtagaaatgagacttgaactctttatgaatcttagatatatatatacacacacacacacacacacacacacataacctttggttattcaaatcaaaggtgaaataggacattttcagacaaaagttgaaaaacttttccttggtctaactgagtcttacttt

SEQ ID NO: 5436 - DNA, 218 bp, Homo sapiens
  DISO7_10645130
  Located on chromosome 3
  Distance between a terminus base of telomere on chromosomal short arm and 5'-terminus of this base sequence : 98552792
  Distance between 3'-terminus of neighbour sequence of sequence listing upward to telomere on chrosomal short arm and 5'-terminus of this base sequence : 200302
cagaagcctgacatgctggcaaaagggtagacttttgtgtgtgtgtgtgtgtgtgtgtgtgtgtgtgtgtttcttttcttttttttttttcttaccagttgggcttttaacctccttctcactgtgaaaactggtaaaaggcctcaactttttgaactctcctttcccccacttgttttgttttgatatatgttttctaataacctggtttgcctctt

SEQ ID NO: 5437 - DNA, 193 bp, Homo sapiens
  DISO7_10009622
  Located on chromosome 3
  Distance between a terminus base of telomere on chromosomal short arm and 5'-terminus of this base sequence : 98723939
  Distance between 3'-terminus of neighbour sequence of sequence listing upward to telomere on chrosomal short arm and 5'-terminus of this base sequence : 170929
ttcattctcatctttgtgaacccagagtgtcatttcaatccctttctctatgtttctccctgtctctctctctctctgtcacacacacacacacacacatacacacacacacacacacacacaaacacacacccccatccctggaactaaaactaaaatgtatataaggaatttgcatgttcaggcccagtta

SEQ ID NO: 5438 - DNA, 183 bp, Homo sapiens
  D3S3619
  Located on chromosome 3
  Distance between a terminus base of telomere on chromosomal short arm and 5'-terminus of this base sequence : 98896378
  Distance between 3'-terminus of neighbour sequence of sequence listing upward to telomere on chrosomal short arm and 5'-terminus of this base sequence : 172246
tgtgtttatctcaaatactttctgttcttcatgatacaattttttaaatattggcttacacatacacagacacacacacacacacacacacacacacacatacatatacacacaaaatccaaaaaatcaattgctgaattcatttattcattttacagttttcttaggtcaagttcccatgaa

SEQ ID NO: 5439 - DNA, 399 bp, Homo sapiens
  AC060756.2_177542
  Located on chromosome 3
  Distance between a terminus base of telomere on chromosomal short arm and 5'-terminus of this base sequence : 99055434
  Distance between 3'-terminus of neighbour sequence of sequence listing upward to telomere on chrosomal short arm and 5'-terminus of this base sequence : 158873
gtatatgagctagaaggactggtaaatgatgatttggtgatttatgactgttagcaacatgtgattttaactcctgtgaattcttgctagtttttcctgggccttttaaactacctaagttagagatgtgttttaagttttaagtgtgtgtgtgtgtgtgtgtgtgtgtgttgttttgttttctctctggatagtttttagatgctttttgtggttgaattggatcaatcatgcttggtgctgtaaactgttcttgaacttcatctatattctcctcctggcttcttcctaccccttcatatttgtggtagcatcgctttgccacttgccacagacatctccacggcaggcttcctagatgtcttagtctgttttgagtagctacaactgaatacctga

SEQ ID NO: 5440 - DNA, 435 bp, Homo sapiens
  chr3.fa.O7frz.110909118
  Located on chromosome 3
  Distance between a terminus base of telomere on chromosomal short arm and 5'-terminus of this base sequence : 99062148
  Distance between 3'-terminus of neighbour sequence of sequence listing upward to telomere on chrosomal short arm and 5'-terminus of this base sequence : 6315
ttggatttgctagacttcataataattacatgagcccaaattcttataataagtctaataaagatatatatatatatgtttatatatacatatacataaatatggaacatatgtgtacatatgtcatcccacagtatacacagagaggattggtttcaggacccctgtgcataccaaaatttatacatgctcaagccctgaagtcagtcctgcagaatgagcttacacaaaacatcagccctccctatacacaggttttgcatcccaagaatcttgtattttcaatccacatgtaagtagacctttacaatttaaacccatgttgctcaagggtcaactgtgtgtgtgtgtgtgcgtgtgtgtgtgagtgtgtgtgtgtgtgtatcctattggttctctggagaactccaactaatgtactatgttagccagcat

SEQ ID NO: 5441 - DNA, 425 bp, Homo sapiens
  chr3.fa.O7frz.111226913
  Located on chromosome 3
  Distance between a terminus base of telomere on chromosomal short arm and 5'-terminus of this base sequence : 99223547
  Distance between 3'-terminus of neighbour sequence of sequence listing upward to telomere on chrosomal short arm and 5'-terminus of this base sequence : 160964
atatttgcaaactattcatctgacaagggactgatatccagaatacaaaaggaactcaaacaactcaacagtaaacacacacacacacacacacacacacacacagacaattccattaaaaagtaggcaaaagacagacacttttcaaaagaagacacacatgcatccaacaatcatgtgagaaaatgctcagcatctgtaatcagtggagaaatacaaattgaaatcacaatgagacatcatctcacaatagtcagaaaggctattattaaaaagtcaaaaaacaacagatactggtgagattgtggagaaaagggaacgcttatacattactggtgggaatgtaaattagttcagccactgtggaaagcagtttggagatttctcaacgaacttaaaacagaagtaccattcaacctagcaat

SEQ ID NO: 5442 - DNA, 241 bp, Homo sapiens
  D3S2462
  Located on chromosome 3
  Distance between a terminus base of telomere on chromosomal short arm and 5'-terminus of this base sequence : 99256201
  Distance between 3'-terminus of neighbour sequence of sequence listing upward to telomere on chrosomal short arm and 5'-terminus of this base sequence : 32229
ttttcacctgtgctgttgctcaatgtattggggttctccagagaaataaaaacaataagatgtgaatgtctcttggtagatgataggtagatgatagatagatagatagatagatagatagatagatagatagatagatagataagaattaatccaaaaggtgaagcacctttcagaaacatccagaacaatgtttggccaaatatttgggcaccatggcccagacaagttggcagataaa

SEQ ID NO: 5443 - DNA, 296 bp, Homo sapiens
  AC060756.2_97361
  Located on chromosome 3
  Distance between a terminus base of telomere on chromosomal short arm and 5'-terminus of this base sequence : 99259624
  Distance between 3'-terminus of neighbour sequence of sequence listing upward to telomere on chrosomal short arm and 5'-terminus of this base sequence : 3182
ctacactgagtaacatgtttggtaaagactggtgcttcttcatggctccagttttcaatatttagaacctccatcatagtcccaaattctgccagccaggtttccaacatcagctgtgtagtcccagctccttatctctgttaaccctacttgatcccgtaagcccttctagccatagggatgaagtgtgtgtgtgtgtgtgtgtgtgtgtgtgtgtgtaaaataaacactggctcatatgattatggaaacagacaattcccaaagtctgcaggatgagtaggcaagttggatat

SEQ ID NO: 5444 - DNA, 365 bp, Homo sapiens
  chr3.fa.O7frz.110582865
  Located on chromosome 3
  Distance between a terminus base of telomere on chromosomal short arm and 5'-terminus of this base sequence : 99534983
  Distance between 3'-terminus of neighbour sequence of sequence listing upward to telomere on chrosomal short arm and 5'-terminus of this base sequence : 275063
taaacaaaggaatcaacagtttatacaagtattctaacatattttcttactataaaagtaaatacactgttacctggttgttttggagactcaatgggctctccctgggttgctttttcagtataaatatttcatatattacattctcataaataaatatgtgtgtatctctctctctctctctctctatatatatatatatgcattatttattttcttattagagatgaggtctcactctgtctcccaaactggagggctggagagtaatgatgtgatcacaactctctgcacattgacttttcaaacgcaggtgttcctcccacgtcaatctcccgattagtagaactacaggcataaacaac

SEQ ID NO: 5445 - DNA, 421 bp, Homo sapiens
  AC073036.2_22326
  Located on chromosome 3
  Distance between a terminus base of telomere on chromosomal short arm and 5'-terminus of this base sequence : 99742639
  Distance between 3'-terminus of neighbour sequence of sequence listing upward to telomere on chrosomal short arm and 5'-terminus of this base sequence : 207291
gaaccattactgttgccagaatgaccatggtgaaagcactacgattttgaagaagtctccttaattttgtgaatctcattcttattttggagatgagtcttctcctctggaacctaacgttttcatagcactcatttgagagaataactgagaggctttcaggttattttgaacacacacacacacacacacacacacacacacacacatccaagatgtacctctggaaaaattcttagtctgatatactgtcactcctttgtgaccccttaaagatttgtgaacattcatgaagaacacttcttcattctactaaaaataaagaattggagaacagtgaaagaaggtggttggcgatgataaacttgcaaattggaaataagtagtaatgctctaactagaatgttctactgatggtgtt

SEQ ID NO: 5446 - DNA, 122 bp, Homo sapiens
  DISO7_10001179
  Located on chromosome 3
  Distance between a terminus base of telomere on chromosomal short arm and 5'-terminus of this base sequence : 99900529
  Distance between 3'-terminus of neighbour sequence of sequence listing upward to telomere on chrosomal short arm and 5'-terminus of this base sequence : 157469
gccatcacaggcatacagaaaagtttgccctgaatgattagagaggcattctgtttaaaaaaagaaagaaagaaagaaagaaagaaagaaagagaaagaaagatgttaacctggattatctt

SEQ ID NO: 5447 - DNA, 106 bp, Homo sapiens
  DISO7_10001175
  Located on chromosome 3
  Distance between a terminus base of telomere on chromosomal short arm and 5'-terminus of this base sequence : 99911358
  Distance between 3'-terminus of neighbour sequence of sequence listing upward to telomere on chrosomal short arm and 5'-terminus of this base sequence : 10707
ctggagtagtatgaagaactttcagataatggttgtgtgtgtgtgcgtgtgtgtgtgtgtgttttccacaaacaagtaaaacttattagctcttgagagtctaccc

SEQ ID NO: 5448 - DNA, 293 bp, Homo sapiens
  chr3.fa.O7frz.109662300
  Located on chromosome 3
  Distance between a terminus base of telomere on chromosomal short arm and 5'-terminus of this base sequence : 100220330
  Distance between 3'-terminus of neighbour sequence of sequence listing upward to telomere on chrosomal short arm and 5'-terminus of this base sequence : 308866
tatctgctaattactcagcaaatcatatcttaaggttgaatgtgttcatatctacaaaattttagcttacttttttgtcccttttctatcagttgtgagacttgataatattttttactaatgaagtaactcatatacatatatatatatatatatatatatatatatgggttatgttagtttaaggtatacatttgagtttggtctagcaacaattccatatatatctatggaatatatatatatatatatatatatatgtatgtatatatgccagattggattatagatat

SEQ ID NO: 5449 - DNA, 356 bp, Homo sapiens
  AC023837.12_73903
  Located on chromosome 3
  Distance between a terminus base of telomere on chromosomal short arm and 5'-terminus of this base sequence : 100361235
  Distance between 3'-terminus of neighbour sequence of sequence listing upward to telomere on chrosomal short arm and 5'-terminus of this base sequence : 140612
atgccttgataaccatctagttgttgactttgtggaaaccatatttcatttatcagctgaaaaaaagaattattaacattaaagtaaaaatggactcttttaaaaaaagataacagattccccttccttttctctctctccaatctttctgaattactttgtttttatcttttcctgtttgggtctttgatatttacatagccttttaaaattgattgatccttccttacctttagaagtagagagagagagagagagagagagtgtgtgtgtgtgtgtgtgtgtgtgtgtgtgtgtgtgtgtgcagcccctttaattttcttgcctattctatgttctgttcctgaatttgaaat

SEQ ID NO: 5450 - DNA, 363 bp, Homo sapiens
  chr3.fa.O7frz.109452704
  Located on chromosome 3
  Distance between a terminus base of telomere on chromosomal short arm and 5'-terminus of this base sequence : 100442551
  Distance between 3'-terminus of neighbour sequence of sequence listing upward to telomere on chrosomal short arm and 5'-terminus of this base sequence : 80960
aaaacttactaaactggtttggacgtatgtttggttgatgggttttaacaatgctcaacttagacccgtgtattgggggtgtgtgtgtgtgtgtgtgtgtgtgtgtgtgtgtgtgtgtaagtgtaatttaaattatatcataaaaaactgaaagccgaataagaatgtttatttggggtaataaaagtaggcaacatttcaatcaacaaacactttacagagtttactaagtatcattcgtggtgttttctctgggctaccactctgtctctgcagcttaccctctaagctgttaactgtggataacatcctaattcttctggacttctctggcaatatgtaatcctttaggaaacagtctgt

SEQ ID NO: 5451 - DNA, 470 bp, Homo sapiens
  AC027530.2_13207
  Located on chromosome 3
  Distance between a terminus base of telomere on chromosomal short arm and 5'-terminus of this base sequence : 100467098
  Distance between 3'-terminus of neighbour sequence of sequence listing upward to telomere on chrosomal short arm and 5'-terminus of this base sequence : 24184
taaaggtaatgctctcagtgatacagagataaaatattatctgtctcctgccttgggtacaagtaaatttactgagcaatgaagagaagatcctagagaagtatagtctgataaattaaagaaaaattttatgttttatgtttgaccattgtactaaacatatagtcagctctgattttcagggtctgattgtattattctccttcagatgcgttctttgactcaatccctggcatcatgattgtgtgtgtgtgtgtgtgtgtgtgtgtgtgtgtgtgtgtgcatgttgtgtgtatgtatacttgtttaccatcgtgggggggagacaaataataagcaaataaatttataaaatgtcagctgggaagatgagaaaaaataaagtgtgataataagagaaagaatagggggagtccctccctctctgagacctaattgaagttagagagcaattcatgtgaaggtttgga

SEQ ID NO: 5452 - DNA, 335 bp, Homo sapiens
  AC026100.11_107524
  Located on chromosome 3
  Distance between a terminus base of telomere on chromosomal short arm and 5'-terminus of this base sequence : 100561911
  Distance between 3'-terminus of neighbour sequence of sequence listing upward to telomere on chrosomal short arm and 5'-terminus of this base sequence : 94343
  misc_feature (1)...(335): n = A,T,G or C
gtcaggagttcaagaccagactggccaacatggtgaaaccctgtctctactaaaaatacaaaaattaaccagatgtcatggtgggcagctgtaatcccagcttcacaggaggctgaggcaggagaatcacttgaacctggagggcagaggttgcagtgagctgagatcatgccactgcactcagcctgggcgacagagcaagactctgtctaataataataataataataataatagcagcacagtattacagaatactcctaattagtatacactgttcctaattagaagtatactattcaagaatcttanagattccttattgatttccagat

SEQ ID NO: 5453 - DNA, 183 bp, Homo sapiens
  G08222
  Located on chromosome 3
  Distance between a terminus base of telomere on chromosomal short arm and 5'-terminus of this base sequence : 100691477
  Distance between 3'-terminus of neighbour sequence of sequence listing upward to telomere on chrosomal short arm and 5'-terminus of this base sequence : 129231
ggaggggaaatgtctgttttagcatagctcctttgtgagcaacttgcagcagccttcagccggagaccttgctcagcacctccttccagaaaaaggtggctgtcatcatcatcatcatcatcatcatcatcatcatcatcatcatcatcgtgggcagcaggagcaataacgcaagaccctgag

SEQ ID NO: 5454 - DNA, 462 bp, Homo sapiens
  AC026100.10_42175
  Located on chromosome 3
  Distance between a terminus base of telomere on chromosomal short arm and 5'-terminus of this base sequence : 100766743
  Distance between 3'-terminus of neighbour sequence of sequence listing upward to telomere on chrosomal short arm and 5'-terminus of this base sequence : 75083
ggtgagttaatcttcatgagtaaggtctattgttccttactgtgccacttataagcctgttcaaatcacacacacacacacacacacacacacacacctccctgtacatacaatttttttaacatggagatgaatgagagaaagaattacgtctatttatatctatttctgtaacctttattatgatcaacatttcaatgagaataaacaacaccctcaaagaagcaagagaaagaagtgacatgaaaactgctatttcaacatcaattctgtactggtgctgctgttatttcttggcaaggccttaggcatagcagtcaatgttatattccaactacctcatttatggaatggagccacctagtctttctctgtaaacactgctttaaaacactctatcacactatagtgtcttgcttttccaactgcaaattttttctttcctggatttaacaaataact

SEQ ID NO: 5455 - DNA, 228 bp, Homo sapiens
  DISO7_10645132
  Located on chromosome 3
  Distance between a terminus base of telomere on chromosomal short arm and 5'-terminus of this base sequence : 100874798
  Distance between 3'-terminus of neighbour sequence of sequence listing upward to telomere on chrosomal short arm and 5'-terminus of this base sequence : 107593
aacagcatataaagatggatgcattttgagattcggaagttaaatcaaaattgctatcactaaaaacagcttaaggttcatcttgatttttcacatacttggaaactctctctttctcttacacacagacacacacacacacacacacacacacacacacacacaccccttgattacctgaaaactatgatggagagaaaaagatttacattgatcagttgaggtgga

SEQ ID NO: 5456 - DNA, 397 bp, Homo sapiens
  AC074274.5_59317
  Located on chromosome 3
  Distance between a terminus base of telomere on chromosomal short arm and 5'-terminus of this base sequence : 101208151
  Distance between 3'-terminus of neighbour sequence of sequence listing upward to telomere on chrosomal short arm and 5'-terminus of this base sequence : 333125
acaaggtcaggagttcaagaccagcctgaccaacatagtgaaaccccgtctctactaaaaatacaaaaaattagcagggcatggtggcaggcacctataatcccagctactcaggaggctgaggcaagagaatcgcttgaacccaggaaatggaggttgcagtgagccaagattgcaccattgcactccagcccaggtgacagtgctagactctgtctcaaaaataataataataataataataaaatttcttcatttttaatttgaacaatttctatttctatacttacgtagatattctacatatacatatacattcagatatacatagaatcacagactcatatttataccttttcattatttttattacctgaattaaactagcctaaaggct

SEQ ID NO: 5457 - DNA, 464 bp, Homo sapiens
  AC021660.12_63678
  Located on chromosome 3
  Distance between a terminus base of telomere on chromosomal short arm and 5'-terminus of this base sequence : 101242501
  Distance between 3'-terminus of neighbour sequence of sequence listing upward to telomere on chrosomal short arm and 5'-terminus of this base sequence : 33953
atgattctgcctagccttataggtattagtacataaacatcatttttcaaactccacatgcttctcagaatccttacgaactttttcctaaagccctgttgaacataacttattttaggcctgctggtgcatgttagagagagttctaatgtttatccctctggtagctttactgccttctaacaacacacacacacacacacacacacacacctagaattctcactatttttactaaactatactattttcaacaattataaaattctgaaagccaaagttaagaaatgtattaccaaattcactcagttctgttgctttcagatagatacagaaactcaggctaattagtaacaaaatattgctgaaaatctgtgtttgccttggcatccttctgcccaactcatcagaaattttggtggggtgatgggaggggggtggtaggattaccaaggaagtagaat

SEQ ID NO: 5458 - DNA, 155 bp, Homo sapiens
  D3S2461
  Located on chromosome 3
  Distance between a terminus base of telomere on chromosomal short arm and 5'-terminus of this base sequence : 101345553
  Distance between 3'-terminus of neighbour sequence of sequence listing upward to telomere on chrosomal short arm and 5'-terminus of this base sequence : 102588
acagaagcaacatgatgtgtatgtgcatgtatatatatgtagatagatagatagatagatagatgatagatagatagatagatagatagatagatagatagatagatagaggaattggctcacatgaatatggaggttggcaaatccaaaatctg

SEQ ID NO: 5459 - DNA, 165 bp, Homo sapiens
  D3S1603
  Located on chromosome 3
  Distance between a terminus base of telomere on chromosomal short arm and 5'-terminus of this base sequence : 101396657
  Distance between 3'-terminus of neighbour sequence of sequence listing upward to telomere on chrosomal short arm and 5'-terminus of this base sequence : 50949
tcagcgaacagcaacaaatactttgcatctatcatatgccaagtactctgctattataaagggatccatgggcatatagtagagggattcagtgtgtgtgtgtgtgtgtgtgtgtgtgtgtgtgtgcatgcatgtatgtacatatgctttcaagtggagttaggg

SEQ ID NO: 5460 - DNA, 421 bp, Homo sapiens
  AC013497.4_14290
  Located on chromosome 3
  Distance between a terminus base of telomere on chromosomal short arm and 5'-terminus of this base sequence : 101576938
  Distance between 3'-terminus of neighbour sequence of sequence listing upward to telomere on chrosomal short arm and 5'-terminus of this base sequence : 180116
tgacagagtaagatggaaaggaaagggaaagggaaagggaaatggaaggaagaagagatagagaaagagagagagagagagagagagaaatagagaaagaaaaagagagagaaaaaaagaaagaaaaaggaaaagaaaagaaagaaaaagaaagaaagaaagaaagaaagaaagaaagaaagaaagaaagaaagaaagaaagaaagaaagaaagaaagaaaggtaggcaggcattggtggtattttgataggaactctactgaatctgtagattgttttgggcagtatggtcattttcacaatattgattcttttaattcatgaacataggaggttttctatttgtttgtatcatctatggtttctttcatcagtgttttgcagttctatgtgtagagatctttcacctctttggttaagt

SEQ ID NO: 5461 - DNA, 464 bp, Homo sapiens
  chr3.fa.O7frz.111781823
  Located on chromosome 3
  Distance between a terminus base of telomere on chromosomal short arm and 5'-terminus of this base sequence : 101708283
  Distance between 3'-terminus of neighbour sequence of sequence listing upward to telomere on chrosomal short arm and 5'-terminus of this base sequence : 130924
tattacagcaagtcagtatgtcagggctgtggtgaagctggggagaaatgatatgtggagattcaaaaagcaaggtaaattctaccattgtcaaaaatttatcagtaggagctcagggaaaggaatcatatcctgtgaagtacatttccaggtgtaagacatggtcctacatcccagacgggctagactactaagaaggtaaccaaagcaagaacttaaacagagagtagaacagggattgagttaccaaacaggtgtcaactgggttttaccaacagggcagaagctccattccaccagtcagtcagtcagtcagtcagtcagtcaatcagcaaacatttttgtctatgtgtaagccaccaatatattagattctagggcataaaataaaataagatatagttgctgtcctttaattgctcacagttagagactgggatacaagttcaagacctgtctaggag

SEQ ID NO: 5462 - DNA, 233 bp, Homo sapiens
  D3S3716
  Located on chromosome 3
  Distance between a terminus base of telomere on chromosomal short arm and 5'-terminus of this base sequence : 101746850
  Distance between 3'-terminus of neighbour sequence of sequence listing upward to telomere on chrosomal short arm and 5'-terminus of this base sequence : 38103
ccaatgacacaggagtttattctagttttctttccatatttgtacttcccttttttgacaatgagaaaactggctccctcttcaaagtgtgtgtgtgtgtgtgtgtgtgtgtgtgtgtatgtgaaatctcctaggtgtccaatctctcattggcactgtcaccaatgatgccccgtctagatatgcttggcttcctcacccttgtgctgggctcacctatatgctgggctctg

SEQ ID NO: 5463 - DNA, 243 bp, Homo sapiens
  AC073093.1_64571
  Located on chromosome 3
  Distance between a terminus base of telomere on chromosomal short arm and 5'-terminus of this base sequence : 101808925
  Distance between 3'-terminus of neighbour sequence of sequence listing upward to telomere on chrosomal short arm and 5'-terminus of this base sequence : 61842
tcagactgagatttatacctggacttccctgtttctgagactttcaaacttagactgagccaggccaccaagttccctggttctccagcttgcagatggcctatcatagaaattttcagcctccataattccatagggcaattccccccaataaatgtcttctcatctatctatctatctatctatctatctatctatctatctatctatctatcatctatctaatctatccaaccatgcatc

SEQ ID NO: 5464 - DNA, 421 bp, Homo sapiens
  AC078828.6_37569
  Located on chromosome 3
  Distance between a terminus base of telomere on chromosomal short arm and 5'-terminus of this base sequence : 102184183
  Distance between 3'-terminus of neighbour sequence of sequence listing upward to telomere on chrosomal short arm and 5'-terminus of this base sequence : 375015
ttctttatagcagtgcaagaacagactaatatacccacatactgataaaggaaaattagtatgagatatgtccaagtggtatatatatatatatatataagagatagttaatctttaatgagactatctggggaacaaggtgagaaaccacttcagttatctatgctacctgaatttttaatgttgagtaattttaaggataaatgcaatcaaatatttttaaagaccgcacatctgcaatgtctgatcagagggctctagtatagattggttatattaagataaggtctaggagtttagaagaacttagctgtttgtggggaataaacacagctgatgtctacctgcccatcatggtatgaccccctgggtttttcttggggatgggggctgaccattcttattggttaggcacttcttt

SEQ ID NO: 5465 - DNA, 428 bp, Homo sapiens
  chr3.fa.O7frz.112322519
  Located on chromosome 3
  Distance between a terminus base of telomere on chromosomal short arm and 5'-terminus of this base sequence : 102274311
  Distance between 3'-terminus of neighbour sequence of sequence listing upward to telomere on chrosomal short arm and 5'-terminus of this base sequence : 89707
gtattgaccttgtctattgtttcttatagaatagtatttacattaatgtcaaattccaaaaagcaaaactaaatgagtctaatatgaactacatattaattcatacacacacacacacacacacacacacacacagacacacacacatacataaattattgtgcctatgtcaggaaaagataaatatacagccagttctcattatttgcttttgtgatcttttctcttttggtttgtattgtgtttatttaatcaaagtctacttctgatcccatttctccctgcattgtttctctgaatcaggcactttgttttcctttcaaatccagtcttaactttttcttcttcctttttcctctctgttttcagacttcatcttatttttgttcccagccaatctttcaaaaatgtattgagcatcaagtctg

SEQ ID NO: 5466 - DNA, 386 bp, Homo sapiens
  AC055744.10_30054
  Located on chromosome 3
  Distance between a terminus base of telomere on chromosomal short arm and 5'-terminus of this base sequence : 102332564
  Distance between 3'-terminus of neighbour sequence of sequence listing upward to telomere on chrosomal short arm and 5'-terminus of this base sequence : 57825
tatgtgccaagctacttagaagaaaaatataaatgccagcagcccagaccgccagcaagactgctggaaggtatggggacttgcagaatgaggctgcagcatcatgatctcctggagacaggactgaggcaggccaggaactgtgcaggagggagggagggagggagaggaatgtgtctcccaacagcatgtttgagaacaagcagttattttccccaaagccatctgtgagactctcaacttgtgcctgaaaaataaaagggcgagacagagagagagagagagagagagagagagagagaaaagtgaattactggaaaaaataggtatctctttgggagtttgtgagggcagcgaaaagactgtctaccagtctgttagtcttg

SEQ ID NO: 5467 - DNA, 423 bp, Homo sapiens
  chr3.fa.O7frz.112600116
  Located on chromosome 3
  Distance between a terminus base of telomere on chromosomal short arm and 5'-terminus of this base sequence : 102467144
  Distance between 3'-terminus of neighbour sequence of sequence listing upward to telomere on chrosomal short arm and 5'-terminus of this base sequence : 134194
cttcgccttgtaatcatgtgattcaattatccctaataaactcatatatatcctactggtatgtgtgtgtgtgtgtggtgtgtgtgtgtgtgtgtgtgtgtgtgtgtgtgtgtgtatctcctactggttctgttcctctggagaaccctaatacacatacctaaattgagcatgtgtatcattgtatgttgagctgacttcatggggatgttgagtgagtggagtgcccaccaactggcacacagcaggcatctggaaggtggaaagaactttagagagggtctggttaagccttcttattttacaaatgcagacacttttacaaatgcaaacactgagtccaaaaaggataaaacacctgccccaagttttcacctgggtagttagtggcagagcggggactaaactccagatttcctgact

SEQ ID NO: 5468 - DNA, 385 bp, Homo sapiens
  chr3.fa.O7frz.112523811
  Located on chromosome 3
  Distance between a terminus base of telomere on chromosomal short arm and 5'-terminus of this base sequence : 102767029
  Distance between 3'-terminus of neighbour sequence of sequence listing upward to telomere on chrosomal short arm and 5'-terminus of this base sequence : 299462
tctatttcttggacagttctttagattatttccattcatgttcaaaatttctatgacataatacctcagtgttttccaaaaattaacctctatggttgaactttatgttttttattacagcctgggtaccctgcaagttcccagagtgtgtgtgtgtgtgtgtgtgtgtgtgtaagcacatgtatgtgtgtgcatgtgtgtgtttgtgtgtgtatgtgcctgcacatgcacgtgagagtggggagcattctctggcatttggtagattttggttgattcaagcaacaaacctagtggacgcatcctgtctatggttcattctttttaactttcctattgaacttgtcgtatttatctgttttgtgtaggctttaagtgcgttaga

SEQ ID NO: 5469 - DNA, 323 bp, Homo sapiens
  chr3.fa.O7frz.112975001
  Located on chromosome 3
  Distance between a terminus base of telomere on chromosomal short arm and 5'-terminus of this base sequence : 102866685
  Distance between 3'-terminus of neighbour sequence of sequence listing upward to telomere on chrosomal short arm and 5'-terminus of this base sequence : 99271
cctggtattgacaaagatacagtgaattaggacgtgcacttgcacactgctagtagatgtgtaaatggcctttaaagcaattttgccatgttattataaacctggatggatgcatagtgagacaaacatgaatgatgaaagagcctctgtgtgtgtgtgtgtgtgtgtgtgtgtgtcagagagatatagtatcttttgactcagtaaacacatttaactacaaaacatcatctgaactaacacacaagtctatctagattctttaacaatttaatgtaaatattcatacatcttgctataggaatattaatgttggattagtg

SEQ ID NO: 5470 - DNA, 334 bp, Homo sapiens
  DISO7_00015030
  Located on chromosome 3
  Distance between a terminus base of telomere on chromosomal short arm and 5'-terminus of this base sequence : 102934301
  Distance between 3'-terminus of neighbour sequence of sequence listing upward to telomere on chrosomal short arm and 5'-terminus of this base sequence : 67293
gttgaggtcatgtcacctaaacccctgatgtggactaatgattcctgaggagcctttgtgtgtgtgtgcatgtgtgtgtgtgtgtgtgtgtgtgtgtgtgtgtgtgtgtgtgtgtgtgtgtgtttaagagacagggtcttgctctgtcacccaggcctggagtgcagtggcatcatcatagctcattgtatcttcgaactcctcagctcaagtgatcctcctgcctcagcctcccaagttgctgggactacagatgcatgtaccactgcacctcacttcctgtgtgcatatttaaaaataagtgaatacaacattactaaactggagcagtcaa

SEQ ID NO: 5471 - DNA, 418 bp, Homo sapiens
  chr3.fa.O7frz.113101341
  Located on chromosome 3
  Distance between a terminus base of telomere on chromosomal short arm and 5'-terminus of this base sequence : 103068212
  Distance between 3'-terminus of neighbour sequence of sequence listing upward to telomere on chrosomal short arm and 5'-terminus of this base sequence : 133577
ctgtagttccaaccactcaagaggctgaggtgggaggatggcttgagcccgggaggtggaggttgcagtgagccaagattgtgccactgcactccagcctgggtgacagagcctgacacttgtcaaaaaaagaaggaaagaaagaaagagagagaggaaacgaaggaagaaaggaaggaaggaaggaaggaaggaaggaaggaaggaatggagggagggagggaggaagagaggaagagagaaagagaggaaagagaggaaaggaaggaaaggaaggaaaggaaaggaaggaagaaaggaagaaaggaagaaagaaagaaagaggaaggggccatctccagaacataaaagtgcaaggtgaagcaggaagtgctgatgtagaagctgcagcaagttatccagacgatctagctaagat

SEQ ID NO: 5472 - DNA, 360 bp, Homo sapiens
  AC023782.2_193191
  Located on chromosome 3
  Distance between a terminus base of telomere on chromosomal short arm and 5'-terminus of this base sequence : 103074381
  Distance between 3'-terminus of neighbour sequence of sequence listing upward to telomere on chrosomal short arm and 5'-terminus of this base sequence : 5751
tctgatagcagaacagatccagaactgtgcttggtccgctaataaccatagccatttttagtatagagttttcccttcctctcttctatccaacatttatcttatttgcacccctccccaccaaaacaaacaaacaaacaaacaaacaaacaaaccatctagggtagaactacttaaaagattccataaagtcaggtgtagagaagttaggcagtagacataaaaagaaatcagatgaattatgttctaagtgtttaggtaactacatgcataggaaatgagatttgcatttcaaatgagtatacgtgctgcttgctaaattttcctggcctgtgttatagcttctccaggttctatgaa

SEQ ID NO: 5473 - DNA, 430 bp, Homo sapiens
  AC021873.10_19054
  Located on chromosome 3
  Distance between a terminus base of telomere on chromosomal short arm and 5'-terminus of this base sequence : 103367086
  Distance between 3'-terminus of neighbour sequence of sequence listing upward to telomere on chrosomal short arm and 5'-terminus of this base sequence : 292345
cctcatttaaaggacatacttcacaaagttttgtttgtttgtttttccttccttccttccttccttccttccttccttccttccttccttccttccttcctttcttctttccttccttccttccttcctcccttccttccccccgttccttttttcctttatgtaagcgacatctatttttaaagggaaatttatgatgacttataaaggacacagttatagcaaaaccattaaaaacaaggaccaaagtacaaaaacaacatgagaaagagtgcaggatgggggacagaaaacctgaaagttcaaggcttggggggagttgctgaaaataaatacaaaatatattcccgaactttctgagtactaagatccaaaaggaggcataataagtaataaagatcccatgtctaacaatagaggcataccagct

SEQ ID NO: 5474 - DNA, 430 bp, Homo sapiens; identical to SEQ ID NO: 5473
  AC068763.4_32480
  Located on chromosome 3
  Distance between a terminus base of telomere on chromosomal short arm and 5'-terminus of this base sequence : 103367086
  Distance between 3'-terminus of neighbour sequence of sequence listing upward to telomere on chrosomal short arm and 5'-terminus of this base sequence : -430

SEQ ID NO: 5475 - DNA, 105 bp, Homo sapiens
  DISO7_10009632
  Located on chromosome 3
  Distance between a terminus base of telomere on chromosomal short arm and 5'-terminus of this base sequence : 103390857
  Distance between 3'-terminus of neighbour sequence of sequence listing upward to telomere on chrosomal short arm and 5'-terminus of this base sequence : 23341
aatgatgctgccatctagtgaaaaccaagacacacacacacacacacacacacacacatacacacacacgtgcgcgcgcatggacacccagcttcaccaatgaca

SEQ ID NO: 5476 - DNA, 383 bp, Homo sapiens
  chr3.fa.O7frz.113694234
  Located on chromosome 3
  Distance between a terminus base of telomere on chromosomal short arm and 5'-terminus of this base sequence : 103601718
  Distance between 3'-terminus of neighbour sequence of sequence listing upward to telomere on chrosomal short arm and 5'-terminus of this base sequence : 210756
acttgtgcagaaatagattgtaacagatgaacggcaaaagcagtagtgatgtgtcagactgaagttcatataacaaagtaaaaattctgagtgtgtgtgtgtgtgtgtgtgagtgagtctgtatgacagaagagagaagggaggagggagagtgtgtgtatgtgtgagagaaaggaagggagggaaagaaagagagggagggagaggatgtgtgtgtgtgtgtgtgtgtgtgagagagagagagagagagagagagggaaggggagaagaaagagtgtctgggagatggagagagagaggagagtatgcatgtgagagagagtgtgtgagaaagagaaagggaattgtatgtgtaagggagtgcatgtataggtctaagtacc

SEQ ID NO: 5477 - DNA, 322 bp, Homo sapiens
  chr3.fa.O7frz.113783855
  Located on chromosome 3
  Distance between a terminus base of telomere on chromosomal short arm and 5'-terminus of this base sequence : 103722254
  Distance between 3'-terminus of neighbour sequence of sequence listing upward to telomere on chrosomal short arm and 5'-terminus of this base sequence : 120153
ttcagcaatggtctttgtatagtgtgctgggctggaagcattggtgtctagagacagctgcctcatgctgccagactcacacagaattgacttttgctactgtgtgtatgatttaaacacacacacacacacgcacacacacacacacacacacagatacacatttataaatgaaaagatcaaacgtctcagagttctgttactcacttgaggaaacagggtaggaaaaatgacttggaaaaggaaaatcaaattacaatcagaataattattgatgaacagggaatctgagtgaagaagagatttaagatactcgtgctga

SEQ ID NO: 5478 - DNA, 158 bp, Homo sapiens
  D3S1271
  Located on chromosome 3
  Distance between a terminus base of telomere on chromosomal short arm and 5'-terminus of this base sequence : 103840030
  Distance between 3'-terminus of neighbour sequence of sequence listing upward to telomere on chrosomal short arm and 5'-terminus of this base sequence : 117454
agctatcatgtagaaaagcagcagagagagggaggaaacactatcatctgtatagtcacttatggagtgagtgtgtgtgtgtgtgtgtgtgtgtgtgtgtagccccccacactcttggaccttgtttccaattgtctgacctctaccacctccaatca

SEQ ID NO: 5479 - DNA, 419 bp, Homo sapiens
  AC027757.3_93324
  Located on chromosome 3
  Distance between a terminus base of telomere on chromosomal short arm and 5'-terminus of this base sequence : 103894232
  Distance between 3'-terminus of neighbour sequence of sequence listing upward to telomere on chrosomal short arm and 5'-terminus of this base sequence : 54044
tgctcaataaatgattcttgagttggaataataaactccatactcctcttctaattatgctattcctaaaataaaagtcaatttaaaaatgcatggtggaatctttaaagtatcagcctatttggtgtatgtatgtatgtgtacacacacacacacacacacacacacacacacacacatacagagtcttaattccacacatttcttctcaagagttcaaggtggctatcaggaccaagcctacaaataaagagattgaaatttccacaaagttatcactttaaccaaaaggaagtcctagttaaaatgcaaaaacaaaaacaatatttacaaagaatattttaaaacttggagaagagcttatggtataattaaataaaaaaccaagaggaaataatattgccagtcttcagaataag

SEQ ID NO: 5480 - DNA, 372 bp, Homo sapiens
  AC068764.5_77066
  Located on chromosome 3
  Distance between a terminus base of telomere on chromosomal short arm and 5'-terminus of this base sequence : 104106576
  Distance between 3'-terminus of neighbour sequence of sequence listing upward to telomere on chrosomal short arm and 5'-terminus of this base sequence : 211925
atgattggttatttcctcttcactatttaatcagttcccaaaataccaagatattcttattttaaaataatataaagtacggtgagaccccatctctaccaaaaacacaaaaaaacaaaacaaaaaaaactagctgggcatggtggcatgtgcctgtaatcccagctacttgggaggctaaggcaggagaatcacttgaacccaggaggtggagggtgcagtgagccgagatcatgccactgcactccagcctgggcgacagaatgtgagtatgtcccaaaaaatagtaataaataataataataataataataataataataataataatataaagtaaaaatccaggtggtagaaatcgaatcttgataa

SEQ ID NO: 5481 - DNA, 451 bp, Homo sapiens
  chr3.fa.O7frz.114500799
  Located on chromosome 3
  Distance between a terminus base of telomere on chromosomal short arm and 5'-terminus of this base sequence : 104406998
  Distance between 3'-terminus of neighbour sequence of sequence listing upward to telomere on chrosomal short arm and 5'-terminus of this base sequence : 300050
ctaaaatgtccagtttccagtaaaaaattaaagacatgcaaagaagcaagtcttatataaatatataaaatttaggctacactaaatttatttatttatttatttatttattttttaataaatagagatggtgtctcactatatcacccaggctgatcttgaactactggcctcaagcaatcctcctgcctcagcttcccaaagtgctaatattacaggtgtgagccaccacaccaggccttcactaatttattaaaaattgcttttcttcaataataaacttagcttactacagtttttttcactttataaactaattttttaaacttttaaattctttgtaataacgcttagcttaaacacatagccaggcgcagtggctcacacctgtaatcccagcactttgggagtccgaggcgggcggatcacaaggtcaggagatggaaaccat

SEQ ID NO: 5482 - DNA, 267 bp, Homo sapiens
  AC009761.4_114783
  Located on chromosome 3
  Distance between a terminus base of telomere on chromosomal short arm and 5'-terminus of this base sequence : 104516142
  Distance between 3'-terminus of neighbour sequence of sequence listing upward to telomere on chrosomal short arm and 5'-terminus of this base sequence : 108693
gactacgcttttgtctttcctagttctaaggcttttggactggaatgaagccaccagcttttctggttctccagtttgtggacaccctgttagtgagacttcttcacctttgtgattgtgtaagccaattccgcctaataaaatctctatctatctatctatctatctatctatctatctatctatctatctatctcctattggttctgtcctgaaggggtgggttgcccctccacacctgtgggtgtttctcgttaggtggaatga

SEQ ID NO: 5483 - DNA, 130 bp, Homo sapiens
  DISO7_10001182
  Located on chromosome 3
  Distance between a terminus base of telomere on chromosomal short arm and 5'-terminus of this base sequence : 104610554
  Distance between 3'-terminus of neighbour sequence of sequence listing upward to telomere on chrosomal short arm and 5'-terminus of this base sequence : 94145
gaagacaatttaatgatggtgaagaaataataaacctcactttacttgttaaaagggatatatatatatatatatatgtctgcaacttcagggagaaataagattgtgtttgaatattgtaggtagatgc

SEQ ID NO: 5484 - DNA, 114 bp, Homo sapiens
  DISO7_10001184
  Located on chromosome 3
  Distance between a terminus base of telomere on chromosomal short arm and 5'-terminus of this base sequence : 104707668
  Distance between 3'-terminus of neighbour sequence of sequence listing upward to telomere on chrosomal short arm and 5'-terminus of this base sequence : 96984
ttgaaccagtatctagcaagtatgtttgtgtgtgcgtgtgtgtgtgtgcaaagatgtaaataatttgaggctaagacatataagacatttcttagccttaagatgtttacgtga

SEQ ID NO: 5485 - DNA, 113 bp, Homo sapiens
  DISO7_10001183
  Located on chromosome 3
  Distance between a terminus base of telomere on chromosomal short arm and 5'-terminus of this base sequence : 104707669
  Distance between 3'-terminus of neighbour sequence of sequence listing upward to telomere on chrosomal short arm and 5'-terminus of this base sequence : -113
tgaaccagtatctagcaagtatgtttgtgtgtgcgtgtgtgtgtgtgcaaagatgtaaataatttgaggctaagacatataagacatttcttagccttaagatgtttacgtga

SEQ ID NO: 5486 - DNA, 202 bp, Homo sapiens
  D3S3655
  Located on chromosome 3
  Distance between a terminus base of telomere on chromosomal short arm and 5'-terminus of this base sequence : 104806455
  Distance between 3'-terminus of neighbour sequence of sequence listing upward to telomere on chrosomal short arm and 5'-terminus of this base sequence : 98673
gcattcatactatgctagttgagagatgggtatacgtgggaatgtaggcttggtacctgctattaatgagcttataatttaattggggagacaacacacacacacacacacacacacacacacacacacacacacatacttaattaaccttcacaatcacaatataattcaagaaccgaaagctccagtgggcaaacattat

SEQ ID NO: 5487 - DNA, 364 bp, Homo sapiens
  chr3.fa.O7frz.115093701
  Located on chromosome 3
  Distance between a terminus base of telomere on chromosomal short arm and 5'-terminus of this base sequence : 104840610
  Distance between 3'-terminus of neighbour sequence of sequence listing upward to telomere on chrosomal short arm and 5'-terminus of this base sequence : 33953
ggtaatcttagattgcgaaaagaggtatattttatatttaccatagtctgtcatttccgagaaggcaaagaccatgaccaacataattatttgttcaggtgaacagttctttgttcacttgtcatgggtgataagtaaaagcacttaagagaagaagaataataatagttgtgtaattgtaataataataataataataataataatttattgagggccctgtctctgccaggcattaggtactttgtgtatctttttttccagtcttcataacaaccaagcaaagaaggtattgctgtcatcctcattttgcagaagaggaaagtgaaaaatgaaagaggttaaatagattgctcaaggttgt

SEQ ID NO: 5488 - DNA, 377 bp, Homo sapiens
  chr3.fa.O7frz.115244258
  Located on chromosome 3
  Distance between a terminus base of telomere on chromosomal short arm and 5'-terminus of this base sequence : 104899857
  Distance between 3'-terminus of neighbour sequence of sequence listing upward to telomere on chrosomal short arm and 5'-terminus of this base sequence : 58883
gaatcatacttcaacattctcaacatgtattcatgttgtagcatttccttccttttcaaggctgaataatatttgtgtgtgtgtgtgtgtgtgtaccacattttgtttatccattcatcccaatagacacttgggttgtttcttccttttagctcttgtgaacaatgttgctatgaacatgagtgtaccaatatcttttcatgtctatgctttcaattcttttgaatattgtattcatctcttctcacattgctatgaagaaatacctgatactggataatttataaagaaaaggggtttaactgattcatggttccgtaggctgttcaggaagcatggcagcatctgcttctgggaagacctcaggaaacttacag

SEQ ID NO: 5489 - DNA, 300 bp, Homo sapiens
  D3S1753
  Located on chromosome 3
  Distance between a terminus base of telomere on chromosomal short arm and 5'-terminus of this base sequence : 104985352
  Distance between 3'-terminus of neighbour sequence of sequence listing upward to telomere on chrosomal short arm and 5'-terminus of this base sequence : 85118
tggcctcaggtatcatcagtttccttggttcttagaccttccaacttggggtgagctatacaaccaacttgtctggttttccagcttgcagacagtctatagtgggacttctcagcctccatactgggtgagccaattcctctaataaagctcctctcatatatctctatatctaattatctatctatctatctatctatctatctatctatctatctatcatctaatctatctcctattggttctgtctccttaaagaacaaccatagcttccaagaatcttatgccactttgaggagg

SEQ ID NO: 5490 - DNA, 180 bp, Homo sapiens
  chr3.fa.O7frz.115397424
  Located on chromosome 3
  Distance between a terminus base of telomere on chromosomal short arm and 5'-terminus of this base sequence : 105058506
  Distance between 3'-terminus of neighbour sequence of sequence listing upward to telomere on chrosomal short arm and 5'-terminus of this base sequence : 72854
gtgactcaggagtctttcctaccctcttcagtgtctctttcagggatatgaagttaaaactaggtgctgtgagggctcacctgatttttggttcttataaaggtgatttgtgtgtgtgtgtgtgtgtgtgtgtgtgtgtgtacatagttgttaacttggtgtccttacaggacataggat

SEQ ID NO: 5491 - DNA, 152 bp, Homo sapiens
  D3S3652
  Located on chromosome 3
  Distance between a terminus base of telomere on chromosomal short arm and 5'-terminus of this base sequence : 105136417
  Distance between 3'-terminus of neighbour sequence of sequence listing upward to telomere on chrosomal short arm and 5'-terminus of this base sequence : 77731
gaaaaatagtctccagtcaagtagctgtgaatgcaattattttgttccttttttcttttgatatttcatggtatatacacacacacacacacacacacacacacatatatatagctcacattttctttatccactcattgattgatgggcat

SEQ ID NO: 5492 - DNA, 189 bp, Homo sapiens
  D3S2459
  Located on chromosome 3
  Distance between a terminus base of telomere on chromosomal short arm and 5'-terminus of this base sequence : 105349796
  Distance between 3'-terminus of neighbour sequence of sequence listing upward to telomere on chrosomal short arm and 5'-terminus of this base sequence : 213227
agggacttagaaagatagcaggatttattaaaaatagttaaattcaaacaatgtaatgggaaacatattatgtctaatatatttacctctatctgtttatctattatatctatctatctatctatctatctatctatctatctatctatctatctctaattgttatgatccataacagacccaaaccag

SEQ ID NO: 5493 - DNA, 152 bp, Homo sapiens
  DISD22_0002886
  Located on chromosome 3
  Distance between a terminus base of telomere on chromosomal short arm and 5'-terminus of this base sequence : 105421260
  Distance between 3'-terminus of neighbour sequence of sequence listing upward to telomere on chrosomal short arm and 5'-terminus of this base sequence : 71275
cgcactcagatggctattacacactagccatatccaatagatataataaataattaattgaacaaataaataaataaataaataaataaataaaaattacagcccataaaagctcctcattaactttcccagtactaacctacctcttgcaa

SEQ ID NO: 5494 - DNA, 134 bp, Homo sapiens
  DISO7_10001187
  Located on chromosome 3
  Distance between a terminus base of telomere on chromosomal short arm and 5'-terminus of this base sequence : 105637239
  Distance between 3'-terminus of neighbour sequence of sequence listing upward to telomere on chrosomal short arm and 5'-terminus of this base sequence : 215827
cttcaccaccttcttatgtaactcataagattatttttaggactaaatggcattttttttatatatatatatatatatatatatatatatataaagctattaatattatacctggcacataataaatattcatt

SEQ ID NO: 5495 - DNA, 245 bp, Homo sapiens
  chr3.fa.O7frz.116059197
  Located on chromosome 3
  Distance between a terminus base of telomere on chromosomal short arm and 5'-terminus of this base sequence : 105704062
  Distance between 3'-terminus of neighbour sequence of sequence listing upward to telomere on chrosomal short arm and 5'-terminus of this base sequence : 66689
cctgaattatctgagtgactacagtctaatcacaagtgttagagtcagtaaaaggatgtgacaatagaagtatagggggagagagagaggggaggggaggggagaggggagaggggaggacaggagagtagaggagaggagaggagaggagaggagaggagaggagaggagaggggaggctgctgatcttgaaaatggagaaagggaccaggacctcaaaaatgtaattggcctctagaagctag

SEQ ID NO: 5496 - DNA, 453 bp, Homo sapiens
  AC026019.3_115156
  Located on chromosome 3
  Distance between a terminus base of telomere on chromosomal short arm and 5'-terminus of this base sequence : 105753302
  Distance between 3'-terminus of neighbour sequence of sequence listing upward to telomere on chrosomal short arm and 5'-terminus of this base sequence : 48995
acatgtagctctgacaacttctagggtagaaatatgaagggaaagaggtataaacaaatggaagcatacacaaagcagttataatgaggaaacactgaatgtaagctggctatggaaatgagtaccagaggggactgaagttcagttattaattccttaattttctttacaagtttattttctgagtataaaagggctttatcatgtcatgcacacacacacacacacacacacacacacacacacacacatacatacatacagagagagagggagaaataaacaatttcaaaaattttctatgtaagtatttacatatgacttaggtatgagaggagagatataaatgtgctattctctggttaagttccaattcccatatgtttcttaaacttttaaacacgctgagtttgattgcagcattgatcccaaattccatggaagtacttcatt

SEQ ID NO: 5497 - DNA, 303 bp, Homo sapiens
  AC063941.9_160610
  Located on chromosome 3
  Distance between a terminus base of telomere on chromosomal short arm and 5'-terminus of this base sequence : 105920497
  Distance between 3'-terminus of neighbour sequence of sequence listing upward to telomere on chrosomal short arm and 5'-terminus of this base sequence : 166742
aaacgatgactagcaagtacagtcatgcgtcccttaaccacagggatacattatgagaaatgtatctttaagtgattttgtcatttcatgaacatcatagagtatacttataaaaacctagatggtatatatactaatacatatacatatatatatatatatatatatatttatctgaaaaaccaaatgtcccaacatcattactgaatattgaatatcaattatttcccctacctgatctgaaatgccaatatcaagttcgatatatcaggtttttatatgtgctccatgataatcttacag

SEQ ID NO: 5498 - DNA, 235 bp, Homo sapiens
  DISO7_10001189
  Located on chromosome 3
  Distance between a terminus base of telomere on chromosomal short arm and 5'-terminus of this base sequence : 106021018
  Distance between 3'-terminus of neighbour sequence of sequence listing upward to telomere on chrosomal short arm and 5'-terminus of this base sequence : 100218
tgcaacacaaggactttccacttattgagaatacatatgattcctatctttgtttttcaaatgaagaaacaaggcttagaggggttattaacttacctgaagctgcacacttaaattatacagttggctaaaaaccgatgtaagtttgatgtcagaatccacagcattaagccccacactcgtgtgtgtgtgtgtgtgtgtgtgtaagtatatgggtgttcatgtgtttctgtgt

SEQ ID NO: 5499 - DNA, 148 bp, Homo sapiens
  DISO7_10001191
  Located on chromosome 3
  Distance between a terminus base of telomere on chromosomal short arm and 5'-terminus of this base sequence : 106202540
  Distance between 3'-terminus of neighbour sequence of sequence listing upward to telomere on chrosomal short arm and 5'-terminus of this base sequence : 181287
ggagtgtcttggaaatctatcacctatctatctatctatctatctatctatctatctatctatctatcatctatcatctatctatctataatctatcatctatctgtctataacgtttatttatctcctaatctctacatttccaacg

SEQ ID NO: 5500 - DNA, 460 bp, Homo sapiens
  chr3.fa.O7frz.116826179
  Located on chromosome 3
  Distance between a terminus base of telomere on chromosomal short arm and 5'-terminus of this base sequence : 106377498
  Distance between 3'-terminus of neighbour sequence of sequence listing upward to telomere on chrosomal short arm and 5'-terminus of this base sequence : 174810
taggagcaaatgagtgatttagtaaaaatcatttttatatttaagaaagatttctgagtagactggacaatatttctgaactgaaaatacaattttttaaaattgtttaaaaacaagaggtgagtaaagataccctgaagtaattatacttaataatttagttagataacataattcattttacatcttttttttctgctggagattgacacaattgtcaatttatttttagttattatgtgtcaggtaaattacaaaggcatctaggtcaactagatttttgtttgtttgtttgtttgtttgtttcttttttgttttgagactgggtcttgctctgtcaccaggctggagtgcagtggcatgatctcggctccctgcaatctccacctcccaggttcaagtgagtcccctgcctcaggcaattcccctgcctcagcctcctgagtagttggaactacag

SEQ ID NO: 5501 - DNA, 379 bp, Homo sapiens
  chr3.fa.O7frz.117014377
  Located on chromosome 3
  Distance between a terminus base of telomere on chromosomal short arm and 5'-terminus of this base sequence : 106562577
  Distance between 3'-terminus of neighbour sequence of sequence listing upward to telomere on chrosomal short arm and 5'-terminus of this base sequence : 184619
gataatttaggaatgattcagctattcttcactattcaaataatttatgtgtttacactgctcacctgcatgtaagcattaatattttcataagctaaagaaacataacatacatgtttttataacatgcggtaaaaaaatatagtgtaaggtactatggcagaatgttccatcaaaaaaattatatatatatatataatatatatatatatatataaatggggaaactactaacacatcaattaattatacttttattttctatttctattgtaaaacataaagcatcttttaagtaaatcctatctatttagaaatacatatataaaaatattgtcctagagagaaggtcttctattaaggtaaaacgatttcactc

SEQ ID NO: 5502 - DNA, 453 bp, Homo sapiens
  AC046144.10_3054
  Located on chromosome 3
  Distance between a terminus base of telomere on chromosomal short arm and 5'-terminus of this base sequence : 106575943
  Distance between 3'-terminus of neighbour sequence of sequence listing upward to telomere on chrosomal short arm and 5'-terminus of this base sequence : 12987
aagtaccttcgttggagataagggtggctaaaatgttgagcacactttgtcttaaattacttgcttaatggggctgtaaggattaatgatttctcattcagaaaaaacaaaatcatgtgcacttattctattactattttctcaggtgccatatttaatatgtaacaatataggctatatttcctaagagttcattcaacatagtatattatagctaagaatttcaacactgccatttttgtttctcctaagaaagctgcaatatagcaaaactctttttcttcttctctctcccctcctctctctctctctctgtctctctctctctctcacacacacacacacatgcacacacacacacacacacacacaggttcacgcatgtagagatgaatttacctagacgctaaagagaattaaccttcagggctgtcatatgctcatgatctgttc

SEQ ID NO: 5503 - DNA, 141 bp, Homo sapiens
  D3S3632
  Located on chromosome 3
  Distance between a terminus base of telomere on chromosomal short arm and 5'-terminus of this base sequence : 106634871
  Distance between 3'-terminus of neighbour sequence of sequence listing upward to telomere on chrosomal short arm and 5'-terminus of this base sequence : 58475
acaaatggcaggaataccttcctttttaaggctggatgagattccagtatttctatttcattgtgtgtgtgtgtgtgtgtgtgtgtgtgtgtgtgtatgacccttgaacaatgtgggggttaggactactgaccccctgca

SEQ ID NO: 5504 - DNA, 385 bp, Homo sapiens
  chr3.fa.O7frz.117210865
  Located on chromosome 3
  Distance between a terminus base of telomere on chromosomal short arm and 5'-terminus of this base sequence : 106790394
  Distance between 3'-terminus of neighbour sequence of sequence listing upward to telomere on chrosomal short arm and 5'-terminus of this base sequence : 155382
ctatcatatgcaaccactgaagtatctgcttggttgggttagctaatgaatggtcatacatttccttaaattccttgtaccaataaatactccaccttagccaagaggttgtgtgtgtgtgtgtgtgtgtgtgtgtgtgtgtgtgtgtgcgtgtgtgtgtgttaggatatactttcatttctcaggcagtttataaatctgccttagctttcccttattgcttgcacagagcctaaagtcagccagccagaggtaattgaagcatcttacatctttcctggacaagcaaatagcaatatatatgcacactgcctcctctcttctatatctctaataatatgttagagttttacaaagccccctctggacatttaattcctagacc

SEQ ID NO: 5505 - DNA, 405 bp, Homo sapiens
  chr3.fa.O7frz.117306898
  Located on chromosome 3
  Distance between a terminus base of telomere on chromosomal short arm and 5'-terminus of this base sequence : 106844906
  Distance between 3'-terminus of neighbour sequence of sequence listing upward to telomere on chrosomal short arm and 5'-terminus of this base sequence : 54127
ttggattctgagaagcactactgtagttccactaatatccattagagacttcagagggactcagctacaagaccccttatcatacagtgtgtgtgtgtgtgtgtgtgtgtgtgtgtgtgtgtgtgtgtgtttatgatacagagggactaggaaaatctgaaagagttagaagtatattgttacataaaacttaagaattttcagataggtagctagaatattctttttatatgccaaaatatggacatctagaataaatgatgttcctaaaaggaaacaggccagaaagaaagctgaagtgtgggaagaatgggatctatccaagaagcagagataaataatatcaaccccttaatcatatgactcacatcatcataaaatataaatggacgttataatggttag

SEQ ID NO: 5506 - DNA, 448 bp, Homo sapiens
  chr3.fa.O7frz.117468514
  Located on chromosome 3
  Distance between a terminus base of telomere on chromosomal short arm and 5'-terminus of this base sequence : 107002266
  Distance between 3'-terminus of neighbour sequence of sequence listing upward to telomere on chrosomal short arm and 5'-terminus of this base sequence : 156955
ggtatcatttatctggatccacctattattgatatcttgcatcgtttaatcattctctccccccgcaccttgtgtgtgtgtgtgtgtgtgtgtggggtgtgtctctctctgtctcttcctccctctcccatgtatgtatttgtatgcatgtgtgcacgttttttctgaaacatttgagaataatttggagatggtttcttttaacagaacaagagtattctgttacagagctataacatagctaccaaaatcggaaaatttaaccttgatataatattatcatttaattcacagccatgttcaaatttcatcaactgccacaataatgtaatttatagctgttttctaccacgcttccctccaccccagtgaagtccaggatccaatccaggatcattcacaacatttgatatcatgcatttttagcttcctttcatctgaaagaatt

SEQ ID NO: 5507 - DNA, 327 bp, Homo sapiens
  chr3.fa.O7frz.117395091
  Located on chromosome 3
  Distance between a terminus base of telomere on chromosomal short arm and 5'-terminus of this base sequence : 107049000
  Distance between 3'-terminus of neighbour sequence of sequence listing upward to telomere on chrosomal short arm and 5'-terminus of this base sequence : 46286
tcattaagaaagtgcaaattttagaaacaatgaaatacaattttatgcccattagaatggctgaaattaaaatactggcaacaccaaataattgccagaaagtggagcaactgggctgggcgagatgtctcacacctgtaatcctagcatattgggaggctgaggtgggaagatagcttgaagccagaagttcaaggccagcctaggtaacaaagcaagactctgtctctacaaaataataataataataataataataataatattaataagaaaaatttagccaggtatggtggcacatgcctgtggtctcagctattaggaagt

SEQ ID NO: 5508 - DNA, 450 bp, Homo sapiens
  AC016970.12_75095
  Located on chromosome 3
  Distance between a terminus base of telomere on chromosomal short arm and 5'-terminus of this base sequence : 107125120
  Distance between 3'-terminus of neighbour sequence of sequence listing upward to telomere on chrosomal short arm and 5'-terminus of this base sequence : 75793
aggctgacctaatgatatgaactctttaaatctagatttctaataatatttttagatgtgttttaccatttttctctctgctttctagttagaatattatatatttataaacaacatacacacacacacacacacacacgcacacacacacacacacacacacgtgatttcttttttgagatagggtctcactctgtcacccagtctagagtgtagaggaattaacgcagctcactgccaccttgacctactgtcctaaagggatcaatcttcccaagtagctgggaccacaggtgtgcaccaccttgcttggctaattaaaaaaaaaaaaaaattgtagagacaggattgcacaggacctcgctatgttgcccatgctagtctcaaactcctgggctcaggtaaccctcccaccttggcccatcaaagtactgagattaaaggcctgag

SEQ ID NO: 5509 - DNA, 120 bp, Homo sapiens
  HUMUT2104
  Located on chromosome 3
  Distance between a terminus base of telomere on chromosomal short arm and 5'-terminus of this base sequence : 107156951
  Distance between 3'-terminus of neighbour sequence of sequence listing upward to telomere on chrosomal short arm and 5'-terminus of this base sequence : 31381
ttcctagactccattagcctatgaaagattaaactgttagatagatagatagatagatagatagatagatagatagatagatgatatattttatacctctgtggttaaggtcacaggagg

SEQ ID NO: 5510 - DNA, 415 bp, Homo sapiens
  chr3.fa.O7frz.117814535
  Located on chromosome 3
  Distance between a terminus base of telomere on chromosomal short arm and 5'-terminus of this base sequence : 107230069
  Distance between 3'-terminus of neighbour sequence of sequence listing upward to telomere on chrosomal short arm and 5'-terminus of this base sequence : 72998
gtcttgcagaaactaatttcatagaatatgaaaattgccaaaaatatcacctacatcattagacatcagggaattgcaaattgtaaccaaaatgagacccatacacacacacacacacacacacacacacacacagaaacacacacacacccagatggctacaaatatgcatgtcaaatacaaaatatttatggtaatataaaaaagtcaaaactttaatacacttttacggggaatgtaaattaacacaagtaatttgtaaaacatttgaacatacacagagcttatgtctcagcaactacattctcacatgcattccaacagattggcatatagcaggtttccaaaagtcatgcagtaaattgttcctatcagcagaatttatggtatttctaaactggaagctacttaaatg

SEQ ID NO: 5511 - DNA, 469 bp, Homo sapiens
  chr3.fa.O7frz.117681416
  Located on chromosome 3
  Distance between a terminus base of telomere on chromosomal short arm and 5'-terminus of this base sequence : 107296344
  Distance between 3'-terminus of neighbour sequence of sequence listing upward to telomere on chrosomal short arm and 5'-terminus of this base sequence : 65860
ctagtttccagatgacgtatctagacataccctgtgtgagaagggaacctgctgccttgaagggaaggaacaagttcttgtagaattcatcacatactgaataaaatcccttgggaacagaataattagcagtggtggcaaggcagtacttgccacaggcctttagtgctccttagagaaatactggcttcaaatgggatccagcacattcccagctgtgttggccacaggagtgcttgtgtcacccagctcccaaatccaagcagctcagcacagagagagagagagagagagagagactctgttgtttgagagaaagtaaagggaagagaacaaaagcctatgcctggtaatccagggaattctcctagctctcacccaagaccatcaaggcagcacatccataagtctggaaaagaaacagcaacactaggattggggtgccctctaatgcagatacagctgaagt

SEQ ID NO: 5512 - DNA, 372 bp, Homo sapiens
  AC024147.14_62550
  Located on chromosome 3
  Distance between a terminus base of telomere on chromosomal short arm and 5'-terminus of this base sequence : 107621473
  Distance between 3'-terminus of neighbour sequence of sequence listing upward to telomere on chrosomal short arm and 5'-terminus of this base sequence : 324660
ttccacctgctgattgtagagccccaggaccttgaacaaacagagacagtagccagggagtagttacagcaggccttgggcaagttccagcactgtgctagctacaggtctgacccagcacagtaatagtggcggtggtcacaggggtgcttgtgttactccaccttcctcccagctttaggtggctcagaacagagagagagagagagagagagagagagaaagagagagagactctttatgtttgggagaaagtaaacaaagaaaaagagaacaagaatctcttcattgtaatctatagaaattcctcacatattatccaagacaatcaagacagtacctctatgagtctacaagaatcacagtgctact

SEQ ID NO: 5513 - DNA, 346 bp, Homo sapiens
  AC024147.14_271858
  Located on chromosome 3
  Distance between a terminus base of telomere on chromosomal short arm and 5'-terminus of this base sequence : 107747618
  Distance between 3'-terminus of neighbour sequence of sequence listing upward to telomere on chrosomal short arm and 5'-terminus of this base sequence : 125773
tatacattcaaaggcattgaacaaatccaggaaaaaatactccaaaggctgaacaaagcatactgggaaggaatggtatttgacagtagggttgtgagaatattgccttaaatatgtattttctgtttgtttgtttgtttgttttggttaagtatatctatttgtgtgtgtgtgtgtgtgtgtgtgtgtgtgtgtgtgtgtgtgtactacatagaactttcaagttatttagagttacagaaagtgaagaggcagagaaaattgataatgggcacactgaaatgtggagaactgccgatgtctagcttccttaatcccttcttgctatccagagttggaaacctat

SEQ ID NO: 5514 - DNA, 154 bp, Homo sapiens
  DISD22_0002890
  Located on chromosome 3
  Distance between a terminus base of telomere on chromosomal short arm and 5'-terminus of this base sequence : 107904636
  Distance between 3'-terminus of neighbour sequence of sequence listing upward to telomere on chrosomal short arm and 5'-terminus of this base sequence : 156672
ttatgcaagatgactcaggaggggtgcgtgtgcgtgtgtgtgtgtgtgtgtgtgtgagagagagagacagagagagagagagagagagagagagagagaaacattgtataaaaacactctacttaggaaaaccaccaaagcagtgaggcaagtt

SEQ ID NO: 5515 - DNA, 448 bp, Homo sapiens
  AC026958.3_164982
  Located on chromosome 3
  Distance between a terminus base of telomere on chromosomal short arm and 5'-terminus of this base sequence : 108081869
  Distance between 3'-terminus of neighbour sequence of sequence listing upward to telomere on chrosomal short arm and 5'-terminus of this base sequence : 177079
ttcttgatttaagtacaattccagatttataatttttttttattttataatcgttgatgttcaaagcttaaaagaatggcataaaaaaaagctttcagaaatttgcttattcagtgtctctgaccaaccttatcagtttcctgggatcaaaaaagtttctcaggaatgcaggactttcagtgcaggactttgccagaaagttctgaacaaatgagaacttggtttgtgtgtgtgtgtgtatgtgtgtgtgccattgtgtgtgtgtgtgtgtgtgtgtgtgtgtgtgtgtgtgtacatgccccgtgaggggggatggctggggtaacttgggtgggcactgaagaaatataacttgaagtgactcatgggaagtgataaatttcttaaaagggaaaatatttaaggcccaaggatagctttaaaagccttgaaatcttgcattctgtac

SEQ ID NO: 5516 - DNA, 376 bp, Homo sapiens
  AC026958.3_13575
  Located on chromosome 3
  Distance between a terminus base of telomere on chromosomal short arm and 5'-terminus of this base sequence : 108114116
  Distance between 3'-terminus of neighbour sequence of sequence listing upward to telomere on chrosomal short arm and 5'-terminus of this base sequence : 31799
accttgatatctatggaatcctagaatcattttgaatctctatccagcatcagggctcatattatgctttgttattccatccaatacactgaaatactgaaaagtcacagaaaactattatcatcctatatctctcaattggaaatgttgtggtaagttgattttctaaaggcagctccttgatataaagattttttcttttacagagtccaattcacattcttaaattcacattcttagggatcatttaaaaaactacaatctgtgtgtgtgtgtgtgtgtgtgtgtgtgtgtgtgtgtgtatgttttaagatggccaactaggatgtcagataccaactcccttcataaggaagatcaaagttacaggtgaatg

SEQ ID NO: 5517 - DNA, 188 bp, Homo sapiens
  D3S1291
  Located on chromosome 3
  Distance between a terminus base of telomere on chromosomal short arm and 5'-terminus of this base sequence : 108190068
  Distance between 3'-terminus of neighbour sequence of sequence listing upward to telomere on chrosomal short arm and 5'-terminus of this base sequence : 75576
tttaacaatcccaatcaggataaactctctctctctctctctctctctctcacacacacacacacacacacacacacacacacacactttatgcaaaatctgaatagcaaacagtagtgggtggagatagagaggatgtacattatgtataaaagaccaaatatctgaattacagcagacattttgcc

SEQ ID NO: 5518 - DNA, 450 bp, Homo sapiens
  chr3.fa.O7frz.118946514
  Located on chromosome 3
  Distance between a terminus base of telomere on chromosomal short arm and 5'-terminus of this base sequence : 108277307
  Distance between 3'-terminus of neighbour sequence of sequence listing upward to telomere on chrosomal short arm and 5'-terminus of this base sequence : 87051
aaaggttattctagccactttaagtttagcagatatgttataaaagattacttaaatgtgtgaagtttcaggtgtattattgttatattttaacctcacaaaactctgtaaggaaagcaaggcacccaatgcacaggtgaacaaattgagtctcagaggcatttggtgatttgcttaaggtccccagatttttcagtgttgtaggtcatttgaacccaggtcataatgcaacaaacttgcaaaaatgtaacatgatgacagtcattactctgtgtgtgtgtgtgtgtgtgtgtgtgtgtgtgtgtgtgtgtgtgcttgagaataatagagggaataatagcaagaaaaacaaaacaaaacaaaacaaaaaaactctggttattttctctgagcccctgtttactccttcttataaatagtggaaaaacttactggctcagtgagtttgag

SEQ ID NO: 5519 - DNA, 480 bp, Homo sapiens
  AC073356.3_63092
  Located on chromosome 3
  Distance between a terminus base of telomere on chromosomal short arm and 5'-terminus of this base sequence : 108394748
  Distance between 3'-terminus of neighbour sequence of sequence listing upward to telomere on chrosomal short arm and 5'-terminus of this base sequence : 116991
ctttcctgtcaactgaatgtacaataactgcccaatattatgaaacatgttcaccttcttaggactacagtcatttcaaaaatgttaaaagatcacacaatatatccagtttcaaattagagccaggttaacctgttactatagttactaaatccccaaaagaaatgcatgcaagcacatagacagtgtgtgtgtgtgtgtgtgtgtgtgtgtgtgtgtgtgtgtgcatgtgtgtagaatactgatatgatttgtctgtgtccccacccacccaaatctcatcctgaattgtaatccccataatccctacatgtctcgggagaggcctggtgggaggtgattgaatcatggaggcggtttcctccatgctgttcttgtggtagtgagtgaattctcatgagatctaatggttttataaggggctcttcgcctttccatattcactctgtctctcacctgctaccatgtaagatgtgcctt

SEQ ID NO: 5520 - DNA, 454 bp, Homo sapiens
  chr3.fa.O7frz.119165251
  Located on chromosome 3
  Distance between a terminus base of telomere on chromosomal short arm and 5'-terminus of this base sequence : 108460314
  Distance between 3'-terminus of neighbour sequence of sequence listing upward to telomere on chrosomal short arm and 5'-terminus of this base sequence : 65086
gctagacattggtgttagacacattcttagttactcatgtacagaacaggctagttcatcagtgattcatatgaaagagacatggagttctaacttttggttaacaagctagacatgcccccaacaacgtgacaaggttgctaagaaatctaatgaaatctcagcctccattaagaatacaatgtccagaactcgagagataatatctcccctgtggcttgtactaattagataacaattaggctcttgcatcaaatttcaatgctactcttgaagaggtacataggcaaactggagtttatcacaagaggagcagtcaggttggtgtcagggtgggaaaccactgtgtgtgtgtgtgtgtgtgtgtgtgtgtgtgtgtgtgtatacatatacaacagttgatgtgactgggaaatcttagaatgcaatcgagtagacgttgataggccataat

SEQ ID NO: 5521 - DNA, 360 bp, Homo sapiens
  chr3.fa.O7frz.119274092
  Located on chromosome 3
  Distance between a terminus base of telomere on chromosomal short arm and 5'-terminus of this base sequence : 108557030
  Distance between 3'-terminus of neighbour sequence of sequence listing upward to telomere on chrosomal short arm and 5'-terminus of this base sequence : 96262
cagttgcactatggagtataaatccaaagaaaattaggttggtatgttgaagagatagctgcactctcatgtttattgaagctctattcataatagccatgatatggattcaacctaagtatctaccaatggatgaatggataaaggaaatttggtgtacacacacacacacacacacacacacacacacacacacacataatggagtactactgagccctaaaaaagcatgaaatcatgtcatttgtggcaacatggatgacacttgaggacattatgataggtgaaataagcaagacaaagaaagacaaaggccttccttattatctcacttacctgtagaatctacaggagttgatc

SEQ ID NO: 5522 - DNA, 243 bp, Homo sapiens
  D3S1591
  Located on chromosome 3
  Distance between a terminus base of telomere on chromosomal short arm and 5'-terminus of this base sequence : 108784811
  Distance between 3'-terminus of neighbour sequence of sequence listing upward to telomere on chrosomal short arm and 5'-terminus of this base sequence : 227421
tggagtcttcagcattttttagtctaatcacattaaacagccaactccagaaacctcaaaatcaacaaaagaactccatccttaatattgtgttcctctagaaccactcctgataccaaaatctgttttagttagggttctctagagggacagaagtaatagtacacacacacacacacacacacacacacacacacatatatatactctgtaaagaaggttaatatctgtaaatagatgtca

SEQ ID NO: 5523 - DNA, 320 bp, Homo sapiens
  AC069225.8_26606
  Located on chromosome 3
  Distance between a terminus base of telomere on chromosomal short arm and 5'-terminus of this base sequence : 108828807
  Distance between 3'-terminus of neighbour sequence of sequence listing upward to telomere on chrosomal short arm and 5'-terminus of this base sequence : 43753
ttgagctaaagtttgaacattctctgatgtaatttgaattattggtaggcaaactatatatatatgtgtgtgtttctcacgtgtgtgtgtgtgtgtctaaagatagagatagatagatagatagatagatagagagtcttgctctattgctaggctggactgcagagacgtgatcatagctcactgcagcctcaaactccttggctcaagccactcttccacctcaggctaccaagtatctgagattacaggcaggcacctccatgccaggctaatttaaaataaaaattttgtttctgagacagtgtcttgttatgttg

SEQ ID NO: 5524 - DNA, 315 bp, Homo sapiens
  AC016138.8_114490
  Located on chromosome 3
  Distance between a terminus base of telomere on chromosomal short arm and 5'-terminus of this base sequence : 108828808
  Distance between 3'-terminus of neighbour sequence of sequence listing upward to telomere on chrosomal short arm and 5'-terminus of this base sequence : -319
tgagctaaagtttgaacattctctgatgtaatttgaattattggtaggcaaactatatatatatgtgtgtgtttctcacgtgtgtgtgtgtgtgtctaaagatagagatagatagatagatagatagatagagagtcttgctctattgctaggctggactgcagagacgtgatcatagctcactgcagcctcaaactccttggctcaagccactcttccacctcaggctaccaagtatctgagattacaggcaggcacctccatgccaggctaatttaaaataaaaattttgtttctgagacagtgtcttgttat

SEQ ID NO: 5525 - DNA, 341 bp, Homo sapiens
  AC027095.3_112542
  Located on chromosome 3
  Distance between a terminus base of telomere on chromosomal short arm and 5'-terminus of this base sequence : 108970710
  Distance between 3'-terminus of neighbour sequence of sequence listing upward to telomere on chrosomal short arm and 5'-terminus of this base sequence : 141587
gcatagtgatctgtagtcctttaaggggaaaggcactttattaatggagcagattacaaattattctttgtttagccaaacagtcaatggagaaaaatatttctgccggatgctcctgaagccttttaaatacaggctagcttcttctagagctaatttttctatgtcaaatactttttttaactacagaacatgtaaccctccaccacacacacacacacacacacacacacacacacacaccccattttgtcatttattttttctacaacactggttattaaggcatgattcaaaggctctgaaatgacattaatgttaatgttaaggcaacatctatg

SEQ ID NO: 5526 - DNA, 401 bp, Homo sapiens
  AC022213.6_21215
  Located on chromosome 3
  Distance between a terminus base of telomere on chromosomal short arm and 5'-terminus of this base sequence : 108998980
  Distance between 3'-terminus of neighbour sequence of sequence listing upward to telomere on chrosomal short arm and 5'-terminus of this base sequence : 27929
gtaaacaatcttgtgcatcaagatggaacaactttgtggtgccatttgcactccagagctcccaatgagatcatgactgaaaatcaaatatttgttcagtttattcttccccatgatcctgatttctttatttcctcacagatttccccaattgtgttcatcttgtcagcccacgggacactgtatttaccaacttagtacactgcgtgtgtgtgtgtgtgtgtgtgtgtgtgtgtgtgtgcgtgtctatgtctgtgtgtgtagtgggccaacattattgtcagttgtggtcagtagtggctctcctttgtaagttgggctttttatcacagatctaagattcttagcaatgagaatgatggaatcctagactagcagaggccaagtaacagtacttaact

SEQ ID NO: 5527 - DNA, 252 bp, Homo sapiens
  Z67443
  Located on chromosome 3
  Distance between a terminus base of telomere on chromosomal short arm and 5'-terminus of this base sequence : 109103906
  Distance between 3'-terminus of neighbour sequence of sequence listing upward to telomere on chrosomal short arm and 5'-terminus of this base sequence : 104525
acacttgatgctagagataatttttctcttgtttctatttttcatagatcttaatagaatatatcaagaatctgtttatctaaatacagacctattattgaggataataaagagtactttcataaccatttacctcatacttacctaacacagcaggagaacaggtgcgtgtgtgtgtgtgtgtgtgtctgtgtgtgtgtgtgtgtgtgtgtgtgttgaagttttgaagggagggagtctagacaaccaaag

SEQ ID NO: 5528 - DNA, 452 bp, Homo sapiens
  AC022213.6_94612
  Located on chromosome 3
  Distance between a terminus base of telomere on chromosomal short arm and 5'-terminus of this base sequence : 109331977
  Distance between 3'-terminus of neighbour sequence of sequence listing upward to telomere on chrosomal short arm and 5'-terminus of this base sequence : 227819
caagttgatggtattaacaggtagggcctttcagaggtaatttggtcatgatgatggatggtgctctcattaatggggttagtgcccttataaagagatttttaaaatctcatttgtcacttccaccatgtgaggatgccatgagaaggcaccttctgtgaaccaaaaagtgggctctcaccacatcctgaattagctaacaccttgatcttggacttctcagcctccgtaaatgttagaaataaatttctgttatttataagctaaccagtttctgttttttgtttgcttgtttgttgttgttgttgttgttgttgttgttatagcaccagaaatgaactactaaaaattcattctagttagttcaagcagataagagctaacagaggaaaatagatgaataagaaattgtaggagagggcaaagcaagatagccacatagaatacttgac

SEQ ID NO: 5529 - DNA, 222 bp, Homo sapiens
  D3S1563
  Located on chromosome 3
  Distance between a terminus base of telomere on chromosomal short arm and 5'-terminus of this base sequence : 109472722
  Distance between 3'-terminus of neighbour sequence of sequence listing upward to telomere on chrosomal short arm and 5'-terminus of this base sequence : 140293
caaagcagacacacaattctgatacatatcttagtaatattttaagtgtttgcttaaatatttctgtttcctaggtcattttaaaatccattcctaaccttccaaagtgcacacgtgcacatacacacacacacacacacacacacacacacacacaaaatcaagtaaatgaatctggggattaaaagatctaatgaaatcccagttatttttacttacctg

SEQ ID NO: 5530 - DNA, 159 bp, Homo sapiens
  D3S3654
  Located on chromosome 3
  Distance between a terminus base of telomere on chromosomal short arm and 5'-terminus of this base sequence : 109479329
  Distance between 3'-terminus of neighbour sequence of sequence listing upward to telomere on chrosomal short arm and 5'-terminus of this base sequence : 6385
caggctacttgtcttatcttttgaactcaggctatattattgaaatgtatgagaaaaaaaattaagacagtaaagcacacacatacacacacatataaacacacacacacacacacacacacacacacacacaccccaaactggaatagctacaagatc

SEQ ID NO: 5531 - DNA, 124 bp, Homo sapiens
  D3S1281
  Located on chromosome 3
  Distance between a terminus base of telomere on chromosomal short arm and 5'-terminus of this base sequence : 109588492
  Distance between 3'-terminus of neighbour sequence of sequence listing upward to telomere on chrosomal short arm and 5'-terminus of this base sequence : 109004
taggccaaagtttacatttccatgtcttcttataaccttttacaaaacacatacacacacacacacacacacacacacacacacacgattttactgttcttatacaccttgcatgtaaatctgt

SEQ ID NO: 5532 - DNA, 149 bp, Homo sapiens
  D3S3638
  Located on chromosome 3
  Distance between a terminus base of telomere on chromosomal short arm and 5'-terminus of this base sequence : 109740788
  Distance between 3'-terminus of neighbour sequence of sequence listing upward to telomere on chrosomal short arm and 5'-terminus of this base sequence : 152172
accgaatagtcttgcactgagaaaaataactaaaaaagtcagtcttgatattacgtgtgtgtgtgtgtgtgtgtgtgtgtgtgttgtttgaaaaggactgtacatatctaataactaactggaattaagattttgttgtccaatgtgaa

SEQ ID NO: 5533 - DNA, 178 bp, Homo sapiens
  HUMUT5948
  Located on chromosome 3
  Distance between a terminus base of telomere on chromosomal short arm and 5'-terminus of this base sequence : 109876848
  Distance between 3'-terminus of neighbour sequence of sequence listing upward to telomere on chrosomal short arm and 5'-terminus of this base sequence : 135911
ggaatgtccttcttgaagaaaaggttttttactgaggatggagatagatatgtatatatctcataattctcagtgttgagagagatagagaagaaagagaaggaaggaaggaaggaaggaaggaaggaaggaaggaaggaaggaaggaaggaaagaaggaaggaaggaaggaagggac

SEQ ID NO: 5534 - DNA, 439 bp, Homo sapiens
  AC080097.9_65565
  Located on chromosome 3
  Distance between a terminus base of telomere on chromosomal short arm and 5'-terminus of this base sequence : 109932924
  Distance between 3'-terminus of neighbour sequence of sequence listing upward to telomere on chrosomal short arm and 5'-terminus of this base sequence : 55898
ttctaagaaatcttgttctcacatcagggagcatttattgtttccccatcaccattatattgtatttctctagtaaaacagaatagcatagatgtgtgtgtgtgtgtgtgtgtgtgtgtgtgtgtgtgtgtgtatgagatttgttatgagaattggcttgtgtgattatggaagttgagaagtccaacaatttgtgttccgcaatctgaagaaccaagaaagcaagtggtataattccatcagagtctgactgcctgagaaccaaaataaccaatgtgtctaagggcaaaagaacatggatgttttgattcaagcaggaagagtaaatttgtccttcttctacctttttattctacatgggctctcaacagattatgggtgatgctcattcacaatgatgaaggccatctttactcagtctactgattcaaatgctaaa

SEQ ID NO: 5535 - DNA, 415 bp, Homo sapiens
  chr3.fa.O7frz.120668023
  Located on chromosome 3
  Distance between a terminus base of telomere on chromosomal short arm and 5'-terminus of this base sequence : 109973496
  Distance between 3'-terminus of neighbour sequence of sequence listing upward to telomere on chrosomal short arm and 5'-terminus of this base sequence : 40133
acataatcttcatagctgtttgtattgttgttactgttgttcaggttagttcttattccagagaaggacagagggctggaaggaaggaaggaaggaaggaaggaaggaaggaaggaagtgaacttgctaatgttcaagtaataatgtggtttagaaaatacaaacgtcaaatttgcctttaatggtataagaggaaataattaaaccaaagtgtctgatcatctttgtaggatttctgaaatcttacaacaatagaaagccacattttgtgtgtagatcattgtatttatgtcacctcattttaccttacatcattttatttctcacttcaggttatttgcagtgcactatatttcaaagtggaaaatcagctttatcaaatggaagaagtaactgagcttatccaagatactga

SEQ ID NO: 5536 - DNA, 341 bp, Homo sapiens
  AC068776.10_24259
  Located on chromosome 3
  Distance between a terminus base of telomere on chromosomal short arm and 5'-terminus of this base sequence : 110031327
  Distance between 3'-terminus of neighbour sequence of sequence listing upward to telomere on chrosomal short arm and 5'-terminus of this base sequence : 57416
cgtttagtaataccgtaggctctgtggtatggtttccataaactaccagatctattgtatttttgcattcttatttttattttgttaccaatttatttctttagctgtatttcccgattgtattatattcctataacatatataaaattcctttaggaggaaatcaaggggtgtgcgtgtgtgtgtgtgtgtgtgtgtgtgtgtgtgtgtgtgtgtgcatgtgtgtgtgtgtgcacgcgtgcagtattaaactttacctgatggtatttacccacatttttttcctgaaatatattttacaattatctaaaacagtgcttatttccacagtaaatggtatt

SEQ ID NO: 5537 - DNA, 288 bp, Homo sapiens
  Z67676
  Located on chromosome 3
  Distance between a terminus base of telomere on chromosomal short arm and 5'-terminus of this base sequence : 110031438
  Distance between 3'-terminus of neighbour sequence of sequence listing upward to telomere on chrosomal short arm and 5'-terminus of this base sequence : -230
tcccgattgtattatattcctataacatatataaaattcctttaggaggaaatcaaggggtgtgcgtgtgtgtgtgtgtgtgtgtgtgtgtgtgtgtgtgtgtgtgcatgtgtgtgtgtgtgcacgcgtgcagtattaaactttacctgatggtatttacccacatttttttcctgaaatatattttacaattatctaaaacagtgcttatttccacagtaaatggtatttcttttaccacatgtgaggttaaatttcaaacatcaatatttagtgacctcaagggtc

SEQ ID NO: 5538 - DNA, 228 bp, Homo sapiens
  Z67074
  Located on chromosome 3
  Distance between a terminus base of telomere on chromosomal short arm and 5'-terminus of this base sequence : 110059214
  Distance between 3'-terminus of neighbour sequence of sequence listing upward to telomere on chrosomal short arm and 5'-terminus of this base sequence : 27488
agctgacatctcaccactgcactccagcctggggggactccatctcaaaataaataaataataaataaataaataaacaaatatttattaaaagttgttgaattgtacacttaaggtctgtgcattctctgtaaattttacttcaagtgtgtgtgtgtgtgtgtgtgtgtgtgtgtgtgtgtgtaaaattggagtaacatgaaataccaatttccaggaaggtagtgt

SEQ ID NO: 5539 - DNA, 305 bp, Homo sapiens
  HUMUT7556
  Located on chromosome 3
  Distance between a terminus base of telomere on chromosomal short arm and 5'-terminus of this base sequence : 110152270
  Distance between 3'-terminus of neighbour sequence of sequence listing upward to telomere on chrosomal short arm and 5'-terminus of this base sequence : 92828
taatcccagctactcaggaggctgagtcaggagaattacttgaacccgggaggcggaggttgcagtgagctgagatcgggccactgcactccatctctaaagatagatagatagatagatgctagatgatagatagatagatagatagatagatagatagatagatagatagataaatagatacatgatagatagatgatagataggtacatagatacatagatagacaggtagaaagaaagtattatgccttctaggcatagtagggacaatatcaggtgggattgatagactattaccccgac

SEQ ID NO: 5540 - DNA, 191 bp, Homo sapiens
  G08279
  Located on chromosome 3
  Distance between a terminus base of telomere on chromosomal short arm and 5'-terminus of this base sequence : 110561002
  Distance between 3'-terminus of neighbour sequence of sequence listing upward to telomere on chrosomal short arm and 5'-terminus of this base sequence : 408427
accaaatgagacagtggcataaatcaggacctctctgggcagagtagaacaatatgtacttcttaactacagaagcagagagaaagggagagatagagatagatagatagatatagatagatagatagatagatagatagatagatagatagatgatattgatttcccatgcagatgtcaaccgtcctcat

SEQ ID NO: 5541 - DNA, 172 bp, Homo sapiens
  DISO7_10001194
  Located on chromosome 3
  Distance between a terminus base of telomere on chromosomal short arm and 5'-terminus of this base sequence : 110656611
  Distance between 3'-terminus of neighbour sequence of sequence listing upward to telomere on chrosomal short arm and 5'-terminus of this base sequence : 95418
caagtcatgtggaagcaaacaaatagtataggcctagaactgagagagagagagagagagagaaagagagagagaatgagtgagtgagagagagagagagagagagagaaaataccttactttgatttatttctttttcttcttcttaaaccatgaccctgcgaggagatta

SEQ ID NO: 5542 - DNA, 332 bp, Homo sapiens
  AC068765.5_122517
  Located on chromosome 3
  Distance between a terminus base of telomere on chromosomal short arm and 5'-terminus of this base sequence : 110802434
  Distance between 3'-terminus of neighbour sequence of sequence listing upward to telomere on chrosomal short arm and 5'-terminus of this base sequence : 145651
gcctggctaattgtactgtattttttgtagagatgaagttccatcatgttgcccaggatagtcttgaacccctgagctcaagtgattctcccacttcagcctcccaaattattgggattacaggtgtgagccactgcactcggccgtccagccctactgtatttgtttgtttgtttgtttgtttgtttttgttttgtttttgaacagaatcttgctctgttgcccaggctgaagtgacttgacctcccaaagtgctgtgattataggcgtgagccaggtgcacagccgagtcctgctctttagtaaaaaggataagcttaacaatttagctg

SEQ ID NO: 5543 - DNA, 421 bp, Homo sapiens
  AC026876.11_27863
  Located on chromosome 3
  Distance between a terminus base of telomere on chromosomal short arm and 5'-terminus of this base sequence : 110847605
  Distance between 3'-terminus of neighbour sequence of sequence listing upward to telomere on chrosomal short arm and 5'-terminus of this base sequence : 44839
gtcctgagtccaatgacattttaaaagattgataaagtagctgggcgtggtggctcatgcctgtaatcccagcactatgggaggctgaggcgggcagatcacttgaggtcgggagttcaagaccagcctgaccaacatggagaaaccccatctctactaaaaatacaaaattagccgggcatggtgacgcatgcctgtaattccagctactcgggaggctgaggcaggagaatcgcttgaacctgggaggcggaggttgcaatgagccgagatcgtggcattgcactccagcctgggcaacaagagcgaaactccgtctcaaaacaacaacaacaacaacaacaacaacaacaaaatacatatgtttctactttattttcatagtattgatatttgtttctgctaaaccaaagctcctatt

SEQ ID NO: 5544 - DNA, 412 bp, Homo sapiens
  AC068765.5_7736
  Located on chromosome 3
  Distance between a terminus base of telomere on chromosomal short arm and 5'-terminus of this base sequence : 110858180
  Distance between 3'-terminus of neighbour sequence of sequence listing upward to telomere on chrosomal short arm and 5'-terminus of this base sequence : 10154
ggctagcacttctaatatgttgattgtttttagtgatagcatacatccttatttgtacatattttttacatattttaattagtctaatatttatttcactactattaacaatagttttattttatttatttatttatttatttatttatttatttatgtatgtttgagacggagtctcactctgttgcccaggctggagggcagtggcgcaatctcggctcactgcaacctctgcctcccaggttcacacagttctttgcctcagccttccgagtagctgggattacagatgcccaccaccatgcccggataatttttgtatttttagtagagatggggtttcaccatcttggtcagactggtcttgaactcctgccctcgtgatccactgggatcatgctcggattacagg

SEQ ID NO: 5545 - DNA, 308 bp, Homo sapiens
  AC026876.11_57254
  Located on chromosome 3
  Distance between a terminus base of telomere on chromosomal short arm and 5'-terminus of this base sequence : 110924863
  Distance between 3'-terminus of neighbour sequence of sequence listing upward to telomere on chrosomal short arm and 5'-terminus of this base sequence : 66271
ctcacaggtttcaatttcagatcctagtgggaacctctggtggaatcttagaaatgctttttttgttgttgttgttgttgagatggcgtctccctctgccactcaggctggagtgcagtggcatgaccttggctcactgcaacctccgcctcctgggttcaagtgattctcctacctcagcctacccgagtagctgggactacaggcatgcaccaccatgcccagctaattttttttttttgtatttttagtagagacaaggctttaccaggttggccaggctggtctcaaactcttgacctcagata

SEQ ID NO: 5546 - DNA, 305 bp, Homo sapiens
  chr3.fa.O7frz.121710511
  Located on chromosome 3
  Distance between a terminus base of telomere on chromosomal short arm and 5'-terminus of this base sequence : 110993050
  Distance between 3'-terminus of neighbour sequence of sequence listing upward to telomere on chrosomal short arm and 5'-terminus of this base sequence : 67879
aagactaatggctcaggataactggagggaaacatatagattgggagtgtggtgagggaaggagttgaccttgaatctctacctttgaaagaaaacagaagaagaaaataaactttgaaagtggcagggaagatgagaatttgggagggttcaggaaaattaacaccttcttgctagttaagcaggaggcaaaggtattttctttcatcatcattattattattattattattattattattattattattatactttaagttttagggtacatgtgcacaacgtccaggtttgttacgtatgta

SEQ ID NO: 5547 - DNA, 316 bp, Homo sapiens
  chr3.fa.O7frz.121819352
  Located on chromosome 3
  Distance between a terminus base of telomere on chromosomal short arm and 5'-terminus of this base sequence : 111090153
  Distance between 3'-terminus of neighbour sequence of sequence listing upward to telomere on chrosomal short arm and 5'-terminus of this base sequence : 96798
gatgtacctaaatccattaaacacctagattaaacattttaaatgagggctgtgcaagtgtttataccaacaagttcattttttcacaccctgagttattcttgctctagtttttttttcctcttagtttagcttttcttccaaatatatatatatatatatatatatatagctttattgccaatatctaccttcagatatgcctcctctggatttagtttgcttagggcttgttatgtctgacattagttttctgacccacattctccttttctttgtcaaaaataatttctatgtctatcctaagaaattggat

SEQ ID NO: 5548 - DNA, 103 bp, Homo sapiens
  D3S1616
  Located on chromosome 3
  Distance between a terminus base of telomere on chromosomal short arm and 5'-terminus of this base sequence : 111244382
  Distance between 3'-terminus of neighbour sequence of sequence listing upward to telomere on chrosomal short arm and 5'-terminus of this base sequence : 153913
tcggcttaaagactcagtttattaaattttaacatgtgcgtgcgtgtgtgtgtgtgtgtgtgtgtgtgtgtgtttatatgaaagcatcttttcaggtagggag

SEQ ID NO: 5549 - DNA, 394 bp, Homo sapiens
  AC027296.9_94956
  Located on chromosome 3
  Distance between a terminus base of telomere on chromosomal short arm and 5'-terminus of this base sequence : 111366465
  Distance between 3'-terminus of neighbour sequence of sequence listing upward to telomere on chrosomal short arm and 5'-terminus of this base sequence : 121980
ttggtcttgaactggtgacctcaagtgatcaacccgcctcggcctcccaacatgctgggattacaggcatgagtcactgtgtctagcccctacatttttaaaatgcaagttcagatccaggggttctggagtggggtctgactgaaggtctgcctttctaaccagctcccaagtgatgctgatgttgctggtttgtggacaacactttgagtagcaaagctttaaaccaatcctaaggggaaaaaatgggaatgaggaaaggtccctctgtggtttagggaaatgtgtgtgtgtgtgtgtgtgtgtgtgtgtgtggtgtgactttttatcctagtgactagttatatccttgttctgtctctagatcacacggtataattggtttgcttgatca

SEQ ID NO: 5550 - DNA, 460 bp, Homo sapiens
  AC012020.12_74560
  Located on chromosome 3
  Distance between a terminus base of telomere on chromosomal short arm and 5'-terminus of this base sequence : 111499110
  Distance between 3'-terminus of neighbour sequence of sequence listing upward to telomere on chrosomal short arm and 5'-terminus of this base sequence : 132251
ggtatggctccagtagaaatactttccattaagaaataaatactccttagagaggaaaaaatgtccatccactgtagtatccagtcacatgacaatctctatttattcctcttcataaccccatgagaagggtcatcctcactggagtttcaatttcttaaccgaagaaattagttgaaaagtggaaatccaacctgctgatagtttctttatctgtccacacctaataatgagtttgactgattcttctatttaaattgacagattatttacacctctgtgaattacaatgttgctatggtctttctttcctttgcatttgtgtgtgtgtgtgtgtgtgtgtgtgtgtggttagaacgtctatagtcaggctaaaattcagatcccatctttataattcttgtttgtgtaatatgaatttatcacaatggcaggagagtgaattatcatacagccttga

SEQ ID NO: 5551 - DNA, 271 bp, Homo sapiens
  Z67497
  Located on chromosome 3
  Distance between a terminus base of telomere on chromosomal short arm and 5'-terminus of this base sequence : 111512645
  Distance between 3'-terminus of neighbour sequence of sequence listing upward to telomere on chrosomal short arm and 5'-terminus of this base sequence : 13075
tgcaggtttgttgttgggataaaagttaacgtgctctagtgcactgtagcctataaaatgttatcctttctgtgacgcatgccccatttccaccatgccatgtggggacacaaggaacagatctttgtccacaggaaaagtggaaactcagagttgaatttcctcttcactccaaagcatgactatgcatgcacacacacacacacacacacacacacacacacacacacgtgcgcgcacacacacacatgcactcaaactcctaagagct

SEQ ID NO: 5552 - DNA, 461 bp, Homo sapiens
  chr3.fa.O7frz.122315467
  Located on chromosome 3
  Distance between a terminus base of telomere on chromosomal short arm and 5'-terminus of this base sequence : 111590119
  Distance between 3'-terminus of neighbour sequence of sequence listing upward to telomere on chrosomal short arm and 5'-terminus of this base sequence : 77203
cctcattgtcactaaagacattagtcttctcttgccttctgactcagactgaaacaaactatcagctcagctctcctggtcctcaggccttcagactcaaactgggactaccatcagctcttctgggtctccggcttgatagctgtggatcttgggacttctcagcctccagaaccatgtaagccaattccttagtctttttctatatgtgtgtgtgtgtgtgtgtgtacctcctattggttctattcctctgaagaactcaaactaattcatagaaaaaggattaagttactaagtattaagagagcattcaagaggaattcaaatgtaaacaggcttagaaaattgttttgtaaactattagaatacaataggattctaatctcagtaattcagaaggcactcaaaaatttcctactatttgtctaatatgccttcttaattctgactgccaattacta

SEQ ID NO: 5553 - DNA, 239 bp, Homo sapiens
  D3S2495
  Located on chromosome 3
  Distance between a terminus base of telomere on chromosomal short arm and 5'-terminus of this base sequence : 111790615
  Distance between 3'-terminus of neighbour sequence of sequence listing upward to telomere on chrosomal short arm and 5'-terminus of this base sequence : 200035
atctgtaagttctgctttgtgaattcaacctaccgaggtcctacaatttaactcaattctgacactattttcctggagacagtgtcagatacacacacacacgtacaggtatgtatatatatatacacacacacacacacacacacacacacacatatacacacttaaacacacacatatatacacacctatatgtacatgcatatatctttttataaatcacatcgcatacaatattt

SEQ ID NO: 5554 - DNA, 101 bp, Homo sapiens
  DISO7_10001196
  Located on chromosome 3
  Distance between a terminus base of telomere on chromosomal short arm and 5'-terminus of this base sequence : 111918648
  Distance between 3'-terminus of neighbour sequence of sequence listing upward to telomere on chrosomal short arm and 5'-terminus of this base sequence : 127794
tgcagaggttaccactgttcactgtttctaatatacacatacacacacacacacacacacacaaacaaatcttaaagatattcaggtatctgaatcattgt

SEQ ID NO: 5555 - DNA, 124 bp, Homo sapiens
  DISO7_10001195
  Located on chromosome 3
  Distance between a terminus base of telomere on chromosomal short arm and 5'-terminus of this base sequence : 112026507
  Distance between 3'-terminus of neighbour sequence of sequence listing upward to telomere on chrosomal short arm and 5'-terminus of this base sequence : 107758
ttggttaattgccattgtgtgtgtgtgtatatatatatatatatatatatatatatatatatgtagtattttcattttttaaaagtggtctctgttagtagtgtagttactgaaatccatgttg

SEQ ID NO: 5556 - DNA, 133 bp, Homo sapiens
  D3S1302
  Located on chromosome 3
  Distance between a terminus base of telomere on chromosomal short arm and 5'-terminus of this base sequence : 112206756
  Distance between 3'-terminus of neighbour sequence of sequence listing upward to telomere on chrosomal short arm and 5'-terminus of this base sequence : 180125
ctgagtttcagtttccttatctataagatgtggaaaataccatctagaccctagggttcttgtaagaattacacacacacacacacacacacacacacacacatctttgcatagtgctggggacttagtaggt

SEQ ID NO: 5557 - DNA, 446 bp, Homo sapiens
  chr3.fa.O7frz.123174249
  Located on chromosome 3
  Distance between a terminus base of telomere on chromosomal short arm and 5'-terminus of this base sequence : 112406201
  Distance between 3'-terminus of neighbour sequence of sequence listing upward to telomere on chrosomal short arm and 5'-terminus of this base sequence : 199312
ctgacaataccactttctgtctccaactacatgattaacataagaaggaaaaccatgatctcaactagtataaaattaaactgaaagaaagaaagaaggaaagcaagaaaggaggaaggaaggaaggaaggaaggaaggaaggaaggaaggaaggaaggaaggaaggaagggaagttagttttttgaaccatatacacattttcttctgtactttcttctgttcttattcccctctccagtctatagtttctgatttcttcacccactttccaaaacagtccttccttgcctttaggacgaaggcacacttccctctccaggctacacttacatttaatcctgaattccctccagacacactgctaacggctcgtaggttaacacttgtccctttcatctaaggcagagagagtcagtacacacaaaggttaagaacttgaacagc

SEQ ID NO: 5558 - DNA, 439 bp, Homo sapiens
  AC063923.10_123521
  Located on chromosome 3
  Distance between a terminus base of telomere on chromosomal short arm and 5'-terminus of this base sequence : 112523747
  Distance between 3'-terminus of neighbour sequence of sequence listing upward to telomere on chrosomal short arm and 5'-terminus of this base sequence : 117100
agcattacactggtgagttataaccagctaatgtctttaaattacaatgtgctctgagacactcacttaaactgagccagcctcactttcttcatctggcaatgtgggctgtaattgtgtatgattgtatatgctttggttataactgcttaataataacttggctaaaaatgtttcaatcacatatttaaacatgacccaacagcaaattgcaatatttatgattaaaactcattattaaaattatttctatgtttaggaattgaaggcttattttatatatatatatatatatatatatatatatacacacacacacacacacatatatacatctatctagctgtgtgtgggaagggcttcaggaaaaatataatttttgtgcatgagtctcaagattttcatagaagcaaaagtttattctaatttaagcatctgc

SEQ ID NO: 5559 - DNA, 467 bp, Homo sapiens
  chr3.fa.O7frz.123504184
  Located on chromosome 3
  Distance between a terminus base of telomere on chromosomal short arm and 5'-terminus of this base sequence : 112717941
  Distance between 3'-terminus of neighbour sequence of sequence listing upward to telomere on chrosomal short arm and 5'-terminus of this base sequence : 193755
tggttcaagaccattgaactcctgagctcaagcaatccactcgcttaatcttccaaagtgcagggattacaggcgtgagccactgtgcctggctattttattattattattattattattatttttagacagaatcatactttatcaccaggctggagtgcagtgacgccgatctcagctcactggaacctccgcctcccaggttcaagcgattctcctgcctcagccttccgagtagctgggattacaggcacccgccactatgcccagctaattttttgtatttttttagtagagatggggtttcaccatgttggccaggctggtcttgagctcctgacctcgtgattcacccgccttgggctcccaaagggctgggattacaggcgtgagccaccgtgcccggctattttattatttttttatagagatggggtctcaccatgtttctcaggctagtcaaactt

SEQ ID NO: 5560 - DNA, 411 bp, Homo sapiens
  AC023130.3_115583
  Located on chromosome 3
  Distance between a terminus base of telomere on chromosomal short arm and 5'-terminus of this base sequence : 112745331
  Distance between 3'-terminus of neighbour sequence of sequence listing upward to telomere on chrosomal short arm and 5'-terminus of this base sequence : 26923
ctaattccacctagaggtaagaactggatgtggtcagggagaatcctcttgctacttctctcttgctacaagctggcaggctccagttttactaaggaacacaaaagagtccagaatagggcgcgcacacacacacacacacacacacacacacacacacgatcatattttttggttcatttaaaaattttttattgtcatataatatacacaataaagtgtaccaatcttaagtgctccatgaacttttacatatgaaaacaccttttaaccacaattcggttaaaattatctgaatatatgcagcagcccagaaggtaatatgaggtgtgttttcagtaaatactgtcatccaaagtaactaatatttatttttccacccaaatgtagatggacattggattaacttct

SEQ ID NO: 5561 - DNA, 217 bp, Homo sapiens
  D3S3695
  Located on chromosome 3
  Distance between a terminus base of telomere on chromosomal short arm and 5'-terminus of this base sequence : 112749214
  Distance between 3'-terminus of neighbour sequence of sequence listing upward to telomere on chrosomal short arm and 5'-terminus of this base sequence : 3472
tggcacctgtatgtatgagagagagagagagagagagagagagagagagagagaaggagagagagagagtgtgtgtgtgtgtgtgtgtgtgtgtaagagagagaagcagggggcttgtctgagtttgggctgctataacaaaatgtcatagactgagtggtgttcacaacagacatttatttctcacagttctggacgctgaaaagtccaaaatcaa

SEQ ID NO: 5562 - DNA, 196 bp, Homo sapiens
  chr3.fa.O7frz.123691571
  Located on chromosome 3
  Distance between a terminus base of telomere on chromosomal short arm and 5'-terminus of this base sequence : 112852226
  Distance between 3'-terminus of neighbour sequence of sequence listing upward to telomere on chrosomal short arm and 5'-terminus of this base sequence : 102795
ttgcaaactatttatccaacagggattagtgtccagaatatataagaacacaaacttctcaacagtaaaaaaacaagacaaaacaaaaacaaacaacacacacacacacacacacacacacatacacaaacacagttctattaaaagaaggggaaatgatctgaacagacatttctcaaaagaagacatatgaatg

SEQ ID NO: 5563 - DNA, 395 bp, Homo sapiens
  AC069319.3_63602
  Located on chromosome 3
  Distance between a terminus base of telomere on chromosomal short arm and 5'-terminus of this base sequence : 112939658
  Distance between 3'-terminus of neighbour sequence of sequence listing upward to telomere on chrosomal short arm and 5'-terminus of this base sequence : 87236
cacttagccgtcaactgatggcaactactaaaagagcactgattgtaacacacaccctctggggctccaggggtcacagacaacccttcctggacagcagagctaaaagagcattgtcacatgcttggacgtggcttcaggacccgcacaaagcctgttctccccggagaggagcaaccagccagtcccagcgttcatttgctctggttcctgcacctgtctgcctgcatgctccctctcctgcaaggggtttgagagctgtgggaaaacactctgtctctttctctctttctctctctctctctctctctctctgccatgtgaggatataacaagaaaatgatcatctacaaaccagaaagagtgccctaaccagatactgagtctgccagcac

SEQ ID NO: 5564 - DNA, 338 bp, Homo sapiens
  AC069319.3_34628
  Located on chromosome 3
  Distance between a terminus base of telomere on chromosomal short arm and 5'-terminus of this base sequence : 112994758
  Distance between 3'-terminus of neighbour sequence of sequence listing upward to telomere on chrosomal short arm and 5'-terminus of this base sequence : 54705
ttccatttcacagaacaattatctttgtttgcttatttatattttagttaatcattacttgggcatttgcaaaggttgaattaaaaatcaatttaaatgaaaaattagctgactaacctagggcagaatattcgctagcagatatgaatatgaaaccttgttctcctgattcacagtctacttccataatcacattacaagtttaaaatgtagtgttataggtgagtgtgtgtgtgtgtgtgtgtgcgcgcgcgcgcgctgagagaagaatttattggaaaaggaaagagagaaccacagggaaaagaatatataactatcaaagacaagcaggtaaa

SEQ ID NO: 5565 - DNA, 370 bp, Homo sapiens
  chr3.fa.O7frz.123975964
  Located on chromosome 3
  Distance between a terminus base of telomere on chromosomal short arm and 5'-terminus of this base sequence : 113183180
  Distance between 3'-terminus of neighbour sequence of sequence listing upward to telomere on chrosomal short arm and 5'-terminus of this base sequence : 188084
cacagcacataatttaggtctaagaatgctaagaatatatgctaagaatgctacctatatataagtgtgtatatatacttacatatatatacctccagaactgtaagataagtttttgtgttatttagacagtaatttgtgataatttgttacagtagcaataagaaatgaatgcacttattaaataaagctctccctgtcttgcacgtgctctttctctctctctgtctctgtctctctctctgtgtgtgtgtgtgtgtgtgtgtgtgtatgtatgtgtgtgtgtaacttaccagatgaaaagggtggttaatacttacttgggagcatatgcagaaaggaatatgaatggtgaaatagtaaccacaga

SEQ ID NO: 5566 - DNA, 462 bp, Homo sapiens
  AC078786.9_57097
  Located on chromosome 3
  Distance between a terminus base of telomere on chromosomal short arm and 5'-terminus of this base sequence : 113256601
  Distance between 3'-terminus of neighbour sequence of sequence listing upward to telomere on chrosomal short arm and 5'-terminus of this base sequence : 73051
tctgtagatgcaacaccttaacaaacatggaagataaagtacataatggttctttgtagatgaaataaattaaaaacatgtatttgccaggggataggctttagaaaaaccccaggtagcagattattgtcaaagacgctttatttcaatataaaatgtgacagtaaaaaagaaattagtccaaccctgctcaacttgaaaggggaataaatatgtcagaatgaagctgtcccagcatgtgtgctgtgtatttagtgggagaaatagactcaatcttatgtatgggaaatgtgtgtatcgattgtttttacctggcaagaagtgtatgtacctgggtgtgcatgtgtgtgtgtgtgtgtgtgtgtgtgtgtcttgggagtgagtataaggaagggtgtgaggttagtttgcatatgtagaggccagaatagagttgatcagtcatagaaactggacaaactg

SEQ ID NO: 5567 - DNA, 124 bp, Homo sapiens
  DISD22_0002914
  Located on chromosome 3
  Distance between a terminus base of telomere on chromosomal short arm and 5'-terminus of this base sequence : 113506314
  Distance between 3'-terminus of neighbour sequence of sequence listing upward to telomere on chrosomal short arm and 5'-terminus of this base sequence : 249251
gtcctacttcacaacccacccctttactgctagctcaatagacacacacacacacacacacacacacacacacacacacacacacacacttattcacatcagtttgggacagctttcaacctgg

SEQ ID NO: 5568 - DNA, 155 bp, Homo sapiens
  DISD22_0002922
  Located on chromosome 3
  Distance between a terminus base of telomere on chromosomal short arm and 5'-terminus of this base sequence : 113689801
  Distance between 3'-terminus of neighbour sequence of sequence listing upward to telomere on chrosomal short arm and 5'-terminus of this base sequence : 183363
tctgttaaggtgcttacagaaactatttttctctgtaatatatgtgtgtgtgtgtgtgtgtgtgtgtgtgtgtgtgtgtgtgtataaagctggtagggcaaaactattatttccctggtatttactgtaattgtacttcaatatgcttgaagctg

SEQ ID NO: 5569 - DNA, 162 bp, Homo sapiens
  G10268
  Located on chromosome 3
  Distance between a terminus base of telomere on chromosomal short arm and 5'-terminus of this base sequence : 113800559
  Distance between 3'-terminus of neighbour sequence of sequence listing upward to telomere on chrosomal short arm and 5'-terminus of this base sequence : 110603
agcataatttgcttcttgtcttttatgtggcttgggcaaaatacatagatagatagatagatagatagatagatagatagatagatgatggatagatagatagataatttgtaggtcaagtgaagatctcagacaaaatcaagcacttttatggactggatc

SEQ ID NO: 5570 - DNA, 465 bp, Homo sapiens
  chr3.fa.O7frz.124510658
  Located on chromosome 3
  Distance between a terminus base of telomere on chromosomal short arm and 5'-terminus of this base sequence : 113837582
  Distance between 3'-terminus of neighbour sequence of sequence listing upward to telomere on chrosomal short arm and 5'-terminus of this base sequence : 36861
gagttaccagtcagaagtcatagagtggaattaaagaactggggaatgtaactgtttcttatacagatttccaacaagtatagcttctctcatatgggatgtctccaacttccaagcttttctacagtatgattacaaatgatttatttcttgttactatcaccctcattatacacctatacttttaaaaaatgtcttctgctaaataatataccattctttctactttccccttcatatatttttatttatggttacagatacgatctagttttactaattctgtcatatatttttatttatggttacagatacgatctagttttactaattctggagtttgaggctttgtttcttactcttcgtgcgtgtgtgtgtgtgtgtgtgtgtgtgtgtgtgtgtgattgattgattgatggaagaagacggaagaaacttctttagtttgccaactttaaacagtaa

SEQ ID NO: 5571 - DNA, 259 bp, Homo sapiens
  chr3.fa.O7frz.124724825
  Located on chromosome 3
  Distance between a terminus base of telomere on chromosomal short arm and 5'-terminus of this base sequence : 113872433
  Distance between 3'-terminus of neighbour sequence of sequence listing upward to telomere on chrosomal short arm and 5'-terminus of this base sequence : 34386
ggaggtcattggtaatatagataagagcagtttcagagtgttggccttcaatataatttatggtttttaattggaaaggacagagacattgaatatagatatagatgcaagtctattaggagattgggaggcaaaaggagagagttccagtctcaatagtcaatgacaaggacataataggtacagctattttctgtgtgtgtgtgtgtgtgtgtgtgtgtgtgtgcacgtgtgtgtatagatgtaaaggctggagttt

SEQ ID NO: 5572 - DNA, 406 bp, Homo sapiens
  chr3.fa.O7frz.124966776
  Located on chromosome 3
  Distance between a terminus base of telomere on chromosomal short arm and 5'-terminus of this base sequence : 114120404
  Distance between 3'-terminus of neighbour sequence of sequence listing upward to telomere on chrosomal short arm and 5'-terminus of this base sequence : 247712
gcctaacctatgtattctggacttgctagctcccataatcatgcaagacaattcctcatttccttaaaatctctctttcttttcatgtatgtgtgtgtgtgtgtgtgtgtgtatatgtgtgtgtgtgtgtatatatatataaaacaaataggggacacatgtatataaccaataggggactgtgtgtgtgtgtatatatatatatgtatctcctattggttctgtttttatctatgaactcgaatgcaaatgtacatgtaataaaattagaaagagatttatggaaatgataagaaacaagatcatgatttcatgttaggaaaggaggtacatatgttctggaagggatacactatgggtttaaaatctaatggtaatttatttcttaagccatgtggtaacatta

SEQ ID NO: 5573 - DNA, 101 bp, Homo sapiens
  DISO7_10001198
  Located on chromosome 3
  Distance between a terminus base of telomere on chromosomal short arm and 5'-terminus of this base sequence : 114352246
  Distance between 3'-terminus of neighbour sequence of sequence listing upward to telomere on chrosomal short arm and 5'-terminus of this base sequence : 231436
tcttctatgtcatattgtgatctcctaaaagttcttactgaaaatgtgtctatatatatatatatatatatatatatcactcttaacaatctatcccaatg

SEQ ID NO: 5574 - DNA, 373 bp, Homo sapiens
  chr3.fa.O7frz.125289681
  Located on chromosome 3
  Distance between a terminus base of telomere on chromosomal short arm and 5'-terminus of this base sequence : 114447165
  Distance between 3'-terminus of neighbour sequence of sequence listing upward to telomere on chrosomal short arm and 5'-terminus of this base sequence : 94818
aataagtgctcacatcagtgatagggttatattaacagggatcccttttacatttgtcaagtgaacagagttgctttcccctgcccttaccttcccctcagtctcaacacaatacacacacacacacacacacacacacacacacactctctctctctctcatgcacaaatatatttgctttgctttttcttttcttgctcttcaactcctcatatctataatataattgagagcagtaaataagcacaataattagacccgaggtttctgccttggacatcaggcaataaataggcacaattcagtctaattaaagcacccttaaatgtgaagttaccctaagaacttttctcagaatttcaattgaaagtg

SEQ ID NO: 5575 - DNA, 313 bp, Homo sapiens
  AC021983.2_110069
  Located on chromosome 3
  Distance between a terminus base of telomere on chromosomal short arm and 5'-terminus of this base sequence : 114668507
  Distance between 3'-terminus of neighbour sequence of sequence listing upward to telomere on chrosomal short arm and 5'-terminus of this base sequence : 220969
gattgaattgtctttcctgtttacttgttaattagaaaatgcatccttcataaacagctcctttctcaaattttttgtatattgtgtttgtgtttgggttttagtttgtacccgcgctaagttttggttttgttgtgtttggtgttttttgttttgttttgttttgttttgttttttcttttttaaccaacctgtgtattaggtgttagccctgttagccccaatagccatgcatgaaatctttaaataaaagttaaaaaagttctttagaggcatatttctgtaataagttcattgctctatgttaccatct

SEQ ID NO: 5576 - DNA, 244 bp, Homo sapiens
  D3S1572
  Located on chromosome 3
  Distance between a terminus base of telomere on chromosomal short arm and 5'-terminus of this base sequence : 114822606
  Distance between 3'-terminus of neighbour sequence of sequence listing upward to telomere on chrosomal short arm and 5'-terminus of this base sequence : 153786
ccactccatccttaattgaactgaagtgtgtgtgtgtgtgtgtgtgtgtgtgtatgtgtctgtgtgtgtgtgtgtgtggtgtgttttcctcctggaaaacagcaagggaattgggcattataagatagtagttgatgggaccttggcctataggtggactgttccaacagcatatttttaaagcaagtaagttataagacatggagaggaggctataaatccatacctgttgcttgttctggac

SEQ ID NO: 5577 - DNA, 197 bp, Homo sapiens
  D3S2496
  Located on chromosome 3
  Distance between a terminus base of telomere on chromosomal short arm and 5'-terminus of this base sequence : 115025379
  Distance between 3'-terminus of neighbour sequence of sequence listing upward to telomere on chrosomal short arm and 5'-terminus of this base sequence : 202529
gataatcagagcaagtaatgcagtcaatggtgtgtgtgtgtgtctgtgtgtgtgtgtgtgtgtgtgtgtgtgtgtgacagagagagagagagagaattaggaaaaaaagaaaaaagagatgggggaaagaaagaattatttaaaagcaagtgctttttaaaaacccattttcttcccaaatgatttagtgaatacta

SEQ ID NO: 5578 - DNA, 360 bp, Homo sapiens
  AC024251.4_12664
  Located on chromosome 3
  Distance between a terminus base of telomere on chromosomal short arm and 5'-terminus of this base sequence : 115056136
  Distance between 3'-terminus of neighbour sequence of sequence listing upward to telomere on chrosomal short arm and 5'-terminus of this base sequence : 30560
cattaacatcctatcagctcagcgtgggccccttatatgcactgggtgaggaaggagaagtttcttctaaacgcagccatttctctctttctttctctgtgcaccagcaaagctccccaagtttatagcttggctccagtgtgttagcagtttctatgtctttcctttgtactctcacatgaagagaaccccaaaccttgaaagtctgttttattttttcaaaacaacccagctccacaaggaggctttctctctctctctctctctctctctctccccccctccctctctctcggaaatggtaaagttagctttaattatttaactatcagataactcacaggctaaagtaatagatca

SEQ ID NO: 5579 - DNA, 456 bp, Homo sapiens
  AC074277.3_143057
  Located on chromosome 3
  Distance between a terminus base of telomere on chromosomal short arm and 5'-terminus of this base sequence : 115080793
  Distance between 3'-terminus of neighbour sequence of sequence listing upward to telomere on chrosomal short arm and 5'-terminus of this base sequence : 24297
taggtctaccatttgatccagcaatcccgcttccaggtatccacccagaggaaaataagacattatatgaaaaagatacttgcacacagatgtttatagcagcacaatttgcaattgcaaaaatttagaaccaacccaaatgcccatcaaccaatgagtagatgaaaaaagtgtgtgtatatatatatatatatacacacacacacacatatatacatatacatacacatacacacacacacacacacacacacacacaccatggaatactactcagacataaaaaggaatgaaataatggcattcatagcaacctggatggaattggagagcattattctaggtaaagtagaataacgtaactcaggaatagaaaaccaaacatcatatgttctcactcataagtgggagctgagttttgaggatgcaaaggcatgacaatgatacaatggaact

SEQ ID NO: 5580 - DNA, 335 bp, Homo sapiens
  G08281
  Located on chromosome 3
  Distance between a terminus base of telomere on chromosomal short arm and 5'-terminus of this base sequence : 115125901
  Distance between 3'-terminus of neighbour sequence of sequence listing upward to telomere on chrosomal short arm and 5'-terminus of this base sequence : 44652
acagaaccaacaggatggaaagctatacagatgaatggatagatgatagatagatagatagatagatagatagatagatagatagatagatgatagataataataataatagtggtgatgaagatagatgatagataaatagatagatagatagataataggtagatacatagacgatagataatgatggtggtgatgaagataggtgatagataggtgatagatagatagatagatagacagatagatagataatagatagaaagaggggatttatcatgagaattgactcacgatattatatagaggctgagaagtcccttggtaggctgtct

SEQ ID NO: 5581 - DNA, 307 bp, Homo sapiens
  AC060225.7_79880
  Located on chromosome 3
  Distance between a terminus base of telomere on chromosomal short arm and 5'-terminus of this base sequence : 115228145
  Distance between 3'-terminus of neighbour sequence of sequence listing upward to telomere on chrosomal short arm and 5'-terminus of this base sequence : 101909
gtatcgaggaatactgctgttaaggtgttggtttcttttttccatgataagcagataagatacagagaaactccttgttttaagcccactacgcaggcaaagtagaccaattcagggtcctcaagtgataagaaaagtgagccagataacacagctgggataggttaatctaaaagacacacacacacacacacacacacacacatacacacacaccatccttttcctgcctgattacaatacagactcacagaaaagattgggggtagggcagaaggagaacgtttaatgcagaaattaatcagat

SEQ ID NO: 5582 - DNA, 472 bp, Homo sapiens
  AC026354.18_27658
  Located on chromosome 3
  Distance between a terminus base of telomere on chromosomal short arm and 5'-terminus of this base sequence : 115242255
  Distance between 3'-terminus of neighbour sequence of sequence listing upward to telomere on chrosomal short arm and 5'-terminus of this base sequence : 13803
gcttgaaattagctttgagatcaaaagatcagagggtgcttttccctgtagcactcctgtgattaaagaagagtatctgaagttagttatcccatgattctgcacttcactgggtgattacgtagtaaaggaagacccttctagctttacgggggacttgatcaggatccttggttaggattctgtgaagaacttgacctaaagagctcctccactctcttccttaacataagtttctaaggggtgtgtgtgtgtgtgtgtgtgtgtgtgtgtgtgtgtgtgtgtattttaaccttttaattgaggctggaattcttgatatggagggtttgacagttttatgaagaaatcattatttgggcacgcagtggtgacacttagctaccccacataacgttatcttgcaaatatcttaaatgtgatggcctgcttacttgttatcttgaaaatgtatttgctttcaaacttctcc

SEQ ID NO: 5583 - DNA, 449 bp, Homo sapiens
  chr3.fa.O7frz.126313871
  Located on chromosome 3
  Distance between a terminus base of telomere on chromosomal short arm and 5'-terminus of this base sequence : 115341709
  Distance between 3'-terminus of neighbour sequence of sequence listing upward to telomere on chrosomal short arm and 5'-terminus of this base sequence : 98982
gaataaagtgactccaaacattaggtgtcatttatatagaacgttggtgatagtcttgttggtctgatatctttaagtcattaaactaatgggaaggactctcatgggtcattatttttagactttggaggaagcatttagaagtcacactttgtaagatttggttttggtttatttacctatgagtaaagcattagcattattttgcttgcctatattttgtcttctaaactgaggtaagtcagtgtcacctacaattctcagagttgaattgatttgcctcttcggtccaatgactcgtaagtaacattctttaaattatatatgcttggattttgttatgcacctcccttgaccccatgtgtgtgtgtgtgtgtgtgtctggggtgtgtgtgtgtgtgtgtgtgtatgtattagagagacttctcagtctaaaccaatattctcaa

SEQ ID NO: 5584 - DNA, 398 bp, Homo sapiens
  AC073522.8_256399
  Located on chromosome 3
  Distance between a terminus base of telomere on chromosomal short arm and 5'-terminus of this base sequence : 115399630
  Distance between 3'-terminus of neighbour sequence of sequence listing upward to telomere on chrosomal short arm and 5'-terminus of this base sequence : 57472
ccatgattgtacattccttgaggtcctcaccagaagcagatgctggcaccatgcttgctgtactgcctacaaacccatgagctaattaaacctcttttcctcacaaattacccagtctcagtttctttcttttcttttcttttcttttcttttcttttttttgtttttgttttgagatggagttttgctcttgttgcccaggctggggtgcaatggtgcaatctcaactcactgcaaactccgcctcccagtttcaagcgattctccttcctcagcctcccaagtagctgggattgcaggcatgtgccaccacacccagctaatttttggtatttagtagagacggggtttaaccttgttcgtcaggctggtctcgaactcctgaccttaggtgatcc

SEQ ID NO: 5585 - DNA, 394 bp, Homo sapiens
  chr3.fa.O7frz.126438922
  Located on chromosome 3
  Distance between a terminus base of telomere on chromosomal short arm and 5'-terminus of this base sequence : 115467180
  Distance between 3'-terminus of neighbour sequence of sequence listing upward to telomere on chrosomal short arm and 5'-terminus of this base sequence : 67152
cctgtttagtaactgtcttgtgacaaatacttttgatgcataaatgcatttaattatcacaactaacttaagaggaaggcgtcagtattctggtttgtcagattgaagatgctgagtgaagaaattgagggaggctcagaggagttaccaaaatcctcaagttcactcagtggtgcctctgaagcttgaacgtatgttttttagttgctgtttctgttgatttattctatctatctatctatctatctattatctatcagcatttaatttaaatatgtcatatataatttatactcatttgtttatagttgcctaagttattaattattactaatttctataagttaggtaatttataattaggcaatttaagtgagctaggagttgagtatca

SEQ ID NO: 5586 - DNA, 236 bp, Homo sapiens
  Z66960
  Located on chromosome 3
  Distance between a terminus base of telomere on chromosomal short arm and 5'-terminus of this base sequence : 115576944
  Distance between 3'-terminus of neighbour sequence of sequence listing upward to telomere on chrosomal short arm and 5'-terminus of this base sequence : 109370
acggaagccacggtctttttataacctaattttgaaagtcacttcccattacttcttcatattctatttattagaagtgagtcaatacgtctagtccatatttaagatgactaagtatctaatatcaacagtatatttcagcgtgtgagatacacacacacacacacacacacacacactcaagagtaaactgagtaccactttacattttctcttccagagtgagatgtatgcag

SEQ ID NO: 5587 - DNA, 107 bp, Homo sapiens
  DISD22_0002936
  Located on chromosome 3
  Distance between a terminus base of telomere on chromosomal short arm and 5'-terminus of this base sequence : 115755142
  Distance between 3'-terminus of neighbour sequence of sequence listing upward to telomere on chrosomal short arm and 5'-terminus of this base sequence : 177962
tggtgatgtgaacagaaacactaaagtgaagaggtggaactgagagagagagagagagagagagagagtgtttagagtttgtagaaaagcaaaggagacagacgaat

SEQ ID NO: 5588 - DNA, 186 bp, Homo sapiens
  Z67725
  Located on chromosome 3
  Distance between a terminus base of telomere on chromosomal short arm and 5'-terminus of this base sequence : 115893169
  Distance between 3'-terminus of neighbour sequence of sequence listing upward to telomere on chrosomal short arm and 5'-terminus of this base sequence : 137920
gtagatttaacttattctctgtggatatcacctgatattgctctttagacaagaagagccattttctccctgggtaaacacacacacacacacacacacacacacacacacacaatgtaaaatttccttcacaaaaatggaactggaaagtattaatgccaagaatacacagggcataaatctaca

SEQ ID NO: 5589 - DNA, 467 bp, Homo sapiens
  AC048334.14_147008
  Located on chromosome 3
  Distance between a terminus base of telomere on chromosomal short arm and 5'-terminus of this base sequence : 116052736
  Distance between 3'-terminus of neighbour sequence of sequence listing upward to telomere on chrosomal short arm and 5'-terminus of this base sequence : 159381
agtgattaagcaaacattgataactgttaaatataaatgtgagaatctctgactatgcctaggtatttgtattttatttctttaaactcacccaaagttcagcattacttaaatatattacatttatatttatatctatatctatctacacatacaacaaatatatgtgtttacagatatacacatatctgtaaatatgtatatatacatataatctaaacacacaagcaaatatatatatatttgtgtgtgcagatagaaatatacacagatacatatatatatatatatatatacacacacatatctgtaaattgctgtacctataaggttcacacttagtgttgctattatctcattcttgcaaggaatagtttttcttctcattgaatacaatgatatattttttactccatggccctttcaaatatgtgccaagtaaccagtcagatactgtgaaatgacgt

SEQ ID NO: 5590 - DNA, 438 bp, Homo sapiens
  AC026559.2_68238
  Located on chromosome 3
  Distance between a terminus base of telomere on chromosomal short arm and 5'-terminus of this base sequence : 116312233
  Distance between 3'-terminus of neighbour sequence of sequence listing upward to telomere on chrosomal short arm and 5'-terminus of this base sequence : 259030
aattggtatgaaatggtacctcattgtggttttcattcgcatttccctaatgattagtggtattgaccattttttttcatatgcttgcagccagatgtatgttttcttttgagaagtgattgttcatgctctttgcccatttttaaacgggattgtttggttttgtggttgttgactttttaaagttccttatagactcgtatattagacctttgtcagatgcatagcttgcaaatattttctacccatctgtaggttgtctgtttactctgttgatagttttatttgtttgtttttttgttttgtttgtgtgtgtgtgtgtgtgtgtgtgtgtgtgtgcagaagctctttagtttaattaggtctcacttgtcaatttttgatgttgctgccattgcttttggcatcttcatcaggaaatttgccagttcttaagtc

SEQ ID NO: 5591 - DNA, 462 bp, Homo sapiens
  AC024108.14_70501
  Located on chromosome 3
  Distance between a terminus base of telomere on chromosomal short arm and 5'-terminus of this base sequence : 116453847
  Distance between 3'-terminus of neighbour sequence of sequence listing upward to telomere on chrosomal short arm and 5'-terminus of this base sequence : 141176
aagttatctccttctgcttgacaaagaaacagtacatcagcagtttataattacattgtgggaacaaggaatactgggcaaaaagcgagtggttaacatgtacaagcaagcaagggcctgttcaaaattttcattatttcatgcacacacacacacacacacacacacaaaaatgctggggtgctgaaatctcaagcagctgaaatctcaaggttatatagctacaaaatcccttctcagtgcaaggtaacatatttacagattatggaaattagcatgtgaacatctttgggtgggaggtggagggatctttattcagcctaccacagcctctctcacagaatttacctcgctttattgtatttctttgtttactttcatgtctatttctccaatggcatatgaacctactgaaagcgagaactaccattgacatagctaactggtctttctatctcaatg

SEQ ID NO: 5592 - DNA, 436 bp, Homo sapiens
  chr3.fa.O7frz.127454649
  Located on chromosome 3
  Distance between a terminus base of telomere on chromosomal short arm and 5'-terminus of this base sequence : 116519200
  Distance between 3'-terminus of neighbour sequence of sequence listing upward to telomere on chrosomal short arm and 5'-terminus of this base sequence : 64891
ctagcttctgaggtctcatttctcacaatgagtcccatgtggttctctttatctcagcctttcagcagtcaatagagggagcctttttattttcaactctaactatacagccacgctactcccccaacacacacacacacacacacacacacacacccctaccagtgtgggacagtgagcaagacattggaaatgtgtgaaaaattatttcccctgcacaggtttgctggattttctatcctcctgccagacccgtacttatgggacattcactcctccaccactgctctctgcctctcttgccccagcttcgccccctagacttgattccctcctcctctattatacacccctccccctctcctccgtggatgcctcagaaactccagagaggttgaagggagaggaggttcttgactctttagaaagtcatgag

SEQ ID NO: 5593 - DNA, 425 bp, Homo sapiens
  AC024108.14_118033
  Located on chromosome 3
  Distance between a terminus base of telomere on chromosomal short arm and 5'-terminus of this base sequence : 116519835
  Distance between 3'-terminus of neighbour sequence of sequence listing upward to telomere on chrosomal short arm and 5'-terminus of this base sequence : 199
aatttgttcctaaggctatgactgaagcagccacaggctctgaatttacgcagcttgatagaaaataattcgtctatttttcaaacaatattgttatatattctcatagggtgcctgagtttgaataggcacagcgttcttaaccaggggtggaagcttttagaaacagattccaggcctcatctccccaagattctgcttcagcagctgtgaatggggcagtgtgtgtgtgtgtgtgtgtgtgtgtgtgtgtgtgtgtgtgtcagagaaagagagagacagagattgatcttgatgtacagtgccatttgaaaatctcaaaactaagtaagttgttccccttcagctacatcaggggagtattcatcaaataacagtcactagttgtgctgggaaaatagttgattaattgagccaaacctatc

SEQ ID NO: 5594 - DNA, 347 bp, Homo sapiens
  chr3.fa.O7frz.127586338
  Located on chromosome 3
  Distance between a terminus base of telomere on chromosomal short arm and 5'-terminus of this base sequence : 116541000
  Distance between 3'-terminus of neighbour sequence of sequence listing upward to telomere on chrosomal short arm and 5'-terminus of this base sequence : 20740
gtaaacatttgattcaaatttgagatttggggttcagcaatcagctgaacctctccctctcctttacgtgcacgtgcaaacacacacacacacacacacacacacacacacacacattctgtagcatgtgtgtcctcatccagctgactagcgaaggataggcctagttgttgctggccctgcctgtgctacaattttgatcagacaggtattagaagttaatttcagaaaaaaatcatagcagtttctggcacataagccaacttcaacctaacctttcgatgaggtaagggtaaaggaatctgataaacacatttaatttcctgtgaaatgaacaggggtttaga

SEQ ID NO: 5595 - DNA, 392 bp, Homo sapiens
  AC027293.5_13778
  Located on chromosome 3
  Distance between a terminus base of telomere on chromosomal short arm and 5'-terminus of this base sequence : 116550258
  Distance between 3'-terminus of neighbour sequence of sequence listing upward to telomere on chrosomal short arm and 5'-terminus of this base sequence : 8911
gaatctccagattcaaccttattagccctttcccatgtcaccttcttgtcaggtttccaaatctcagagacctggagaggctgtatttctggccaagtgtcaacttcctctcatcaagaagaaaatacatcacttgctacagagggaaattccagggtgagatgtcttgggtcctagtctctagtccacagagctggtgcatcttctctctctctctctctctctttctctctctctctctctcctgattccttagagttcttatagttccattctgaatacccagtatacctctgtctatcctggcattttaatgggtagggtaggaattgctattgataggtacaactacatgctcatgtgctgtttggtatcctaatttggtgtccact

SEQ ID NO: 5596 - DNA, 225 bp, Homo sapiens
  D3S3675
  Located on chromosome 3
  Distance between a terminus base of telomere on chromosomal short arm and 5'-terminus of this base sequence : 116559413
  Distance between 3'-terminus of neighbour sequence of sequence listing upward to telomere on chrosomal short arm and 5'-terminus of this base sequence : 8763
catgccccaggtgctgacacagcctccaagccacacacacacacacacacacacacacacacacacacaccagtttgttaatttacccagaaaaatacaactaataagagtactggttattcactctggccaaatcagcacactggctcagaatgcaggcagtgagttaagcttcagaagtgtctctccattgagatgctttaggctctctcagcaagtcaagga

SEQ ID NO: 5597 - DNA, 341 bp, Homo sapiens
  chr3.fa.O7frz.127828915
  Located on chromosome 3
  Distance between a terminus base of telomere on chromosomal short arm and 5'-terminus of this base sequence : 116731463
  Distance between 3'-terminus of neighbour sequence of sequence listing upward to telomere on chrosomal short arm and 5'-terminus of this base sequence : 171825
ataacaatgactggcactaagtaggtatcccataagtgacagcaacttaataaatctgaataactccttttagggttacttttaggaatattttcattagtctaatgcttactgcagattcatccccagtacttcacaaaaaatatttaagaagaggcaatatctcaggggctggatacctccctcatagggtggcccagcatcctgccttggacatgtgcattctccacctctaagacaggcaggcatgtgcacgtgtgcacacacacacacacacacacacacacactcgcacagcaaacagctccagctctagctgctaagtatgctttggagtcatg

SEQ ID NO: 5598 - DNA, 370 bp, Homo sapiens
  AC023894.11_106735
  Located on chromosome 3
  Distance between a terminus base of telomere on chromosomal short arm and 5'-terminus of this base sequence : 116803356
  Distance between 3'-terminus of neighbour sequence of sequence listing upward to telomere on chrosomal short arm and 5'-terminus of this base sequence : 71552
tgagcttcagctgtactaagactgactttcctatcttcttgatagaatagaagcccagagtcaaagtcagatttaagttagtttaaataaaataaagaacagccatgtacttacatacctaagtttgcgagttaggattcatatatatgtatgaatacacacacacacacacacacacacacacacacacacacacacacaaaacttatatatactgtgaatacttattaaagccaaacataggctgctatgttgagagttcttcctgagaggaacttcttcaccactttcatcttttagcaggtagcaatctggttataattcagggattcaaatactgaaatattatctaggaattcaactattcagg

SEQ ID NO: 5599 - DNA, 370 bp, Homo sapiens; identical to SEQ ID NO: 5598
  AC026348.10_66890
  Located on chromosome 3
  Distance between a terminus base of telomere on chromosomal short arm and 5'-terminus of this base sequence : 116803356
  Distance between 3'-terminus of neighbour sequence of sequence listing upward to telomere on chrosomal short arm and 5'-terminus of this base sequence : -370

SEQ ID NO: 5600 - DNA, 181 bp, Homo sapiens
  D3S1610
  Located on chromosome 3
  Distance between a terminus base of telomere on chromosomal short arm and 5'-terminus of this base sequence : 116803465
  Distance between 3'-terminus of neighbour sequence of sequence listing upward to telomere on chrosomal short arm and 5'-terminus of this base sequence : -261
cttacatacctaagtttgcgagttaggattcatatatatgtatgaatacacacacacacacacacacacacacacacacacacacacacacaaaacttatatatactgtgaatacttattaaagccaaacataggctgctatgttgagagttcttcctgagaggaacttcttcaccacttt

SEQ ID NO: 5601 - DNA, 464 bp, Homo sapiens
  AC023894.11_45123
  Located on chromosome 3
  Distance between a terminus base of telomere on chromosomal short arm and 5'-terminus of this base sequence : 116885812
  Distance between 3'-terminus of neighbour sequence of sequence listing upward to telomere on chrosomal short arm and 5'-terminus of this base sequence : 82166
atggtctaacatgatactcatgttattaaattttgtattttgtactttggaggcattcttctgggttacaaaaataatgttttactttttaaaaagtgtatgtacgtgtgtgtgtgtgtgtgtgtgtgtgtgttttcctttcctttcttttttagttgtgaatcttccttcctctctctctccatcctttcttccttttctccttcccttccttcctctttccttccacctaattgtagaatatataccttttggggtttatggagggggtggggttaggaatcaaacaataaaaacctgtaagtagcaaaatcttttaaaattcacattctgtcatccttttagttatccacatctcaacatccactccagcactgtcagaaaagcagtctagtgtgttggccagggctgagaatattttctattccttccagtttgggatacacagacttgctttctatgtt

SEQ ID NO: 5602 - DNA, 172 bp, Homo sapiens
  D3S3683
  Located on chromosome 3
  Distance between a terminus base of telomere on chromosomal short arm and 5'-terminus of this base sequence : 116992864
  Distance between 3'-terminus of neighbour sequence of sequence listing upward to telomere on chrosomal short arm and 5'-terminus of this base sequence : 106588
caatttggattgcactcccatagtttttcctcaggcagggctttttctaggaagagacttttaattagtttttgcttggttgtgtgtgtgtgtgtgtgtgtgtgtgtgtgtgtgtgtttgtttgtttgtttgtttttcagatggagtctcactctgtcacccaggctggagt

SEQ ID NO: 5603 - DNA, 478 bp, Homo sapiens
  chr3.fa.O7frz.128295322
  Located on chromosome 3
  Distance between a terminus base of telomere on chromosomal short arm and 5'-terminus of this base sequence : 117140451
  Distance between 3'-terminus of neighbour sequence of sequence listing upward to telomere on chrosomal short arm and 5'-terminus of this base sequence : 147415
gcaaacatctatgtttactgagtagctacctagctaccttccattgagatgtggagaaagaaaaacaaattagaaggcatagtgtgtgccattgtgttaaggaaacagaaagcacaatttttaaaaaggctgaaaaatacatacatggagccgggcattgtaatcccagcactttgggaggccgaggtgggtggatcacttgaggtcaggagtttgagaccagcctggccaacatggtaaaaccccatctctactaaaaatacaaaaattagcctggcgtggtggcatgcacctgtaatcctagctactcaggaggctgaggcaagagaatcacttgaacctgggaggcggaggttgcagtgagccgagatcatgccactgcattccagcctaggcaacagagtgagactgtctcaaaacaaacaaacaaacaaacaaacaaacaaacagaaacatatatggaagtctaagtccatcc

SEQ ID NO: 5604 - DNA, 386 bp, Homo sapiens
  AC023963.2_55421
  Located on chromosome 3
  Distance between a terminus base of telomere on chromosomal short arm and 5'-terminus of this base sequence : 117342475
  Distance between 3'-terminus of neighbour sequence of sequence listing upward to telomere on chrosomal short arm and 5'-terminus of this base sequence : 201546
cagtggctgatacctgtaatcccagcactttgggaggctgaggtgggaggattgcctgaggccaggagttcgagaccagcctgggcaacaaagcgagaccttggctcaacaaataaataaataaataaaagacacacacacacacacacacacacacacacacacacacacacacacaggaatattaagtactaagaaaatataactaaaaataaatgatttctcacaatgattttggtgcatcaaattggagagaaaatttaaacttgatgttcaatatatatttacctccagaaaaatacactttctaacagatgtactcatagagaaacttcacaaatgttctagggctaaatcattatttgtgtaattgttcacatggattt

SEQ ID NO: 5605 - DNA, 420 bp, Homo sapiens
  AC023963.2_176220
  Located on chromosome 3
  Distance between a terminus base of telomere on chromosomal short arm and 5'-terminus of this base sequence : 117463007
  Distance between 3'-terminus of neighbour sequence of sequence listing upward to telomere on chrosomal short arm and 5'-terminus of this base sequence : 120146
gtctaggattctggtcctgtagcgtacctcctcctcagaaggggatgcaggagagggtgagggtgcagaaaaggctgagaggcattggcgtgggcctcaagtgcatggctcaagtgcagggcagctcttttctgggtccttgtctttagaagtaaacaggtgttttcatttttagatgttctacttctgtgtcttcacttattcgtgtgtgtgtgtgtgtgtgtgtgtgtgtgtgtgcgtgtgtgttccatttacaaatgctggtttgcagaaggctcacctaacagcagatatgtgcccactggagcatcctggcatgcagtgggtagaaggcactccctctacattctgccccacaaatggccatgacacagaactgtttttacctgccaaagagcctgcatgttatcaagttgttct

SEQ ID NO: 5606 - DNA, 269 bp, Homo sapiens
  D3S3585
  Located on chromosome 3
  Distance between a terminus base of telomere on chromosomal short arm and 5'-terminus of this base sequence : 117463144
  Distance between 3'-terminus of neighbour sequence of sequence listing upward to telomere on chrosomal short arm and 5'-terminus of this base sequence : -283
ccttgtctttagaagtaaacaggtgttttcatttttagatgttctacttctgtgtcttcacttattcgtgtgtgtgtgtgtgtgtgtgtgtgtgtgtgtgcgtgtgtgttccatttacaaatgctggtttgcagaaggctcacctaacagcagatatgtgcccactggagcatcctggcatgcagtgggtagaaggcactccctctacattctgccccacaaatggccatgacacagaactgtttttacctgccaaagagcctgcatgt

SEQ ID NO: 5607 - DNA, 294 bp, Homo sapiens
  chr3.fa.O7frz.128949418
  Located on chromosome 3
  Distance between a terminus base of telomere on chromosomal short arm and 5'-terminus of this base sequence : 117855019
  Distance between 3'-terminus of neighbour sequence of sequence listing upward to telomere on chrosomal short arm and 5'-terminus of this base sequence : 391606
tcaatgtcctgagttacagaagcctgggtaactgcagcttcttcacagagactggttagcaaccagaggcatcttctggaagatacacttttgtctttgctattatagatgaatatataagcagctgtactctccatcagtgctgcgtgtgtgtgtgtgtgtgtatgtgtgtgtgtgttcagttgagtgaataaatgtcatcctcttctccatcttcatttccttggccttttcgttctattccattttgcattatggcaggcctagggtgagtaacgtggatcttgatcataa

SEQ ID NO: 5608 - DNA, 404 bp, Homo sapiens
  AC027054.3_84643
  Located on chromosome 3
  Distance between a terminus base of telomere on chromosomal short arm and 5'-terminus of this base sequence : 117862223
  Distance between 3'-terminus of neighbour sequence of sequence listing upward to telomere on chrosomal short arm and 5'-terminus of this base sequence : 6910
aattaacctttcaatttaaagctctctttccttgcctctccctctttccaaactcttcctcaattcccaggtctttgttctgaaaagacaatctggttagaaaagttgccctccactcataattcactgggaaatggaaactgcataaacagtgacacacagacactggaaacaccacttgaatgaatgaatgaatggatatgtatgtgtgtgtgcatgtgtgtatgttttaggtcacataaacatacagtgtgtgcgtgggtgtgtgtattttaggtctaaacatacagtgtgtgtgtgtgtgtgtgtgtgtgtgtgtgtgtgtgtacacagtagcaattgcaaaaaagggaccatattcctttccatactaagatacaatgtgataagaaacatttctgtgc

SEQ ID NO: 5609 - DNA, 425 bp, Homo sapiens
  AC068938.2_106285
  Located on chromosome 3
  Distance between a terminus base of telomere on chromosomal short arm and 5'-terminus of this base sequence : 117862358
  Distance between 3'-terminus of neighbour sequence of sequence listing upward to telomere on chrosomal short arm and 5'-terminus of this base sequence : -269
ggaaactgcataaacagtgacacacagacactggaaacaccacttgaatgaatgaatgaatggatatgtatgtgtgtgtgcatgtgtgtatgttttaggtcacataaacatacagtgtgtgcgtgggtgtgtgtattttaggtctaaacatacagtgtgtgtgtgtgtgtgtgtgtgtgtgtgtgtgtgtgtacacagtagcaattgcaaaaaagggaccatattcctttccatactaagatacaatgtgataagaaacatttctgtgcagggaaaaaggtttcttcgaatcttatcacaacactgcggcgggaaaatcaggaaatgggttcacctttcagcagtcaccacagtaaacttcattgagaacatacatgcccagatatctcttctgtgcacatgtatatgttaacagctagccattc

SEQ ID NO: 5610 - DNA, 247 bp, Homo sapiens
  D3S3665
  Located on chromosome 3
  Distance between a terminus base of telomere on chromosomal short arm and 5'-terminus of this base sequence : 118041003
  Distance between 3'-terminus of neighbour sequence of sequence listing upward to telomere on chrosomal short arm and 5'-terminus of this base sequence : 178220
ccatcttcaggcagtaaagctaaaacatattaaatgtgcacccagcaaatgttgtgggagccaggagagctccagaaatatttttgttggaatgcagagaggccccattataggcagatttgtaatgcatctaataggcaggagaaaagctcatatcaatagagtgtgtgtgtgtgtgtgtgtgcgcgtgcatgtgtgtgtgtgcgtgagtgcacgcacgcacgtgtatggaagtgctttgaggccc

SEQ ID NO: 5611 - DNA, 215 bp, Homo sapiens
  Z66586
  Located on chromosome 3
  Distance between a terminus base of telomere on chromosomal short arm and 5'-terminus of this base sequence : 118051781
  Distance between 3'-terminus of neighbour sequence of sequence listing upward to telomere on chrosomal short arm and 5'-terminus of this base sequence : 10531
gcatgtccctgaggtgtgtatcagtgcaagtctgtgtatacacacacacacacacacacacacagtctctctctctcttacatatatatgtaaatagaacttaaatctgtcttgtgctgtgttttcgccttagtaatactttatttctcttattaaaaatacatggaactcaccatctgataggtagaaaggctaagagaaatgcaaccagaggg

SEQ ID NO: 5612 - DNA, 394 bp, Homo sapiens
  AC078986.13_7281
  Located on chromosome 3
  Distance between a terminus base of telomere on chromosomal short arm and 5'-terminus of this base sequence : 118304600
  Distance between 3'-terminus of neighbour sequence of sequence listing upward to telomere on chrosomal short arm and 5'-terminus of this base sequence : 252604
cattggtaactgtcagagtgagaaaaggaaattgaacattcaatgtgaccagaggaagggtgaacatgggagatactgcccaggaaaagtgctcatgatgagtaattcaaagacccagaatcttaacataaattttttatagttttcttttcaagggactatttgaaaaaagatggttctggggtttttgttgtagcttctttctttctttctttctttctttctttctttctttctttctttctttctttcttctttctttctttcttttctctctctctctctctctctctctctttctttcttttggctttgttgtagcttcctctttctctctctctctttctctttctttctagctaaaatttcactctaaattccaggaaattttcac

SEQ ID NO: 5613 - DNA, 194 bp, Homo sapiens
  D3S3526
  Located on chromosome 3
  Distance between a terminus base of telomere on chromosomal short arm and 5'-terminus of this base sequence : 118322946
  Distance between 3'-terminus of neighbour sequence of sequence listing upward to telomere on chrosomal short arm and 5'-terminus of this base sequence : 17952
tgcatgaataagagactgtaccttgatttttcttcaaaaggattcaatagtgggatggaaatgtgtgtgtgtgtgtgtgtgtgtgtgtgtgtgtgtgtgtgtataagctaagctgttactgcaggtaggtcaatgaagaaatacttcatggaacaggaagttatagcgttatacaatgtgttccctggagaagt

SEQ ID NO: 5614 - DNA, 450 bp, Homo sapiens
  AC069506.6_26427
  Located on chromosome 3
  Distance between a terminus base of telomere on chromosomal short arm and 5'-terminus of this base sequence : 118334653
  Distance between 3'-terminus of neighbour sequence of sequence listing upward to telomere on chrosomal short arm and 5'-terminus of this base sequence : 11513
cctaatgctaaatgacgagttaatgggtgcagcacaccaacatggcacatgtgtacatatgtaacaaacctgcacgttgtgcacatgtaccctaaaacttaaagtatgttaataataataataataataataataataataataatacacattcaaaaaaaaaagatcacaccgttgcactccagcctcggcaacaagagcaaaactccatctcaaaacaaaacagcaacaacaacaaaaaacccaataacttaaaattggaaaagtccaatagcaaaattattgtgaccaaaccacccagtttatccctttctctagttcatcgttaaaaacacttggtagcagcattattaataaagaactaaaaatacacctgaactctatgattcttcttagctatatggcttttcaacaaccaaaccattaatcttcgtaatcaccatgaagcta

SEQ ID NO: 5615 - DNA, 257 bp, Homo sapiens
  AC027493.3_166585
  Located on chromosome 3
  Distance between a terminus base of telomere on chromosomal short arm and 5'-terminus of this base sequence : 118600839
  Distance between 3'-terminus of neighbour sequence of sequence listing upward to telomere on chrosomal short arm and 5'-terminus of this base sequence : 265736
gagccgagattgtaccactacactccagcctgggcaacactcagcaagactctggtctcaaaaagaaataaaataaaataaaataaaataaaataaaataaaataaaataaaataaaataataaaataaataaaagtagttgaaaccagaaaaaaagagatcatctaacatataggagtagaattttgagatataaagttttactccacattttctttgtcactaatatttccccactattccttgcactcataagc

SEQ ID NO: 5616 - DNA, 389 bp, Homo sapiens
  AC027493.3_178196
  Located on chromosome 3
  Distance between a terminus base of telomere on chromosomal short arm and 5'-terminus of this base sequence : 118612286
  Distance between 3'-terminus of neighbour sequence of sequence listing upward to telomere on chrosomal short arm and 5'-terminus of this base sequence : 11190
aacctcaggtctgagttcttatagaaatcaaaacttttataggagtccatgctttcctgacaacagacaaacattccaggggttccttgagacaaagccatgtacacaatgcaggtcccagtttcttggacttctttctattatcactaatatatatagccatagagtaattttaacttacaaacttttgctccctccaacttacaatcttttgctccctcctggtaatctctctctctctctctctctctctctctctctctctcactgtccactagccttggaagaaaccaactgtcatgtcataaggacactcaagcagccctacagacaggactttgtggtcagaaactgagacttcctaccaagaaccataggattaatccatt

SEQ ID NO: 5617 - DNA, 145 bp, Homo sapiens
  D3S1310
  Located on chromosome 3
  Distance between a terminus base of telomere on chromosomal short arm and 5'-terminus of this base sequence : 118620963
  Distance between 3'-terminus of neighbour sequence of sequence listing upward to telomere on chrosomal short arm and 5'-terminus of this base sequence : 8288
cattattgtcaaagcaacacacacacacacacacacacacacacacaaacacacacacacagtttaccagttaaatagtaccacaaagtttatacaaaatacagcatcccgtatccaaaactttgaccctctgccaaaactcatt

SEQ ID NO: 5618 - DNA, 294 bp, Homo sapiens
  AC046136.7_113675
  Located on chromosome 3
  Distance between a terminus base of telomere on chromosomal short arm and 5'-terminus of this base sequence : 118924630
  Distance between 3'-terminus of neighbour sequence of sequence listing upward to telomere on chrosomal short arm and 5'-terminus of this base sequence : 303522
gaattactgttcaccttcagtaagcagctgatttcacagctcaggctagacctagatggtgtcactgcttcttaaggccagtggtctagctgattttatccaggatggcctctgccaaagaggactagggctgactttagccataggtaggggtgtgtgtgtgtgtgtgtgtgtgtgtgtgtgtgtgtgtgtgtgtgtgtaggggagtgacaaagagaagataaacatctgtgtgctgttttccattagtttccctgaaagcagcaatggaagtcaagtgtatcacaaagcaat

SEQ ID NO: 5619 - DNA, 288 bp, Homo sapiens
  AC046136.7_32258
  Located on chromosome 3
  Distance between a terminus base of telomere on chromosomal short arm and 5'-terminus of this base sequence : 118978193
  Distance between 3'-terminus of neighbour sequence of sequence listing upward to telomere on chrosomal short arm and 5'-terminus of this base sequence : 53269
ttcagaaactgtggtcttacatagcaacagtggggtgtgtgcatctactcaaagcacttatgggccagaaattccattaacttgttgttgttgttgttgttgttgttgtttttatccctaaggaatcctttatcttgttattcctgagttttccagaaaggaaatgcagaaagtgttaactgcagagatatcattcttgtggaagatgcctataaatgtgaattgtataccagaaacacaaactagtgtcctgggcttagtgcaggaaatgtttgactacatatggct

SEQ ID NO: 5620 - DNA, 101 bp, Homo sapiens
  DISD22_0002943
  Located on chromosome 3
  Distance between a terminus base of telomere on chromosomal short arm and 5'-terminus of this base sequence : 119079810
  Distance between 3'-terminus of neighbour sequence of sequence listing upward to telomere on chrosomal short arm and 5'-terminus of this base sequence : 101329
agtaaatcagaagcttccaagcttttatacacacacacacacacacacatgcacactcactcactcttggggacttttcaaggtgacttcaacaacataag

SEQ ID NO: 5621 - DNA, 209 bp, Homo sapiens
  DISO7_00001219
  Located on chromosome 3
  Distance between a terminus base of telomere on chromosomal short arm and 5'-terminus of this base sequence : 119227065
  Distance between 3'-terminus of neighbour sequence of sequence listing upward to telomere on chrosomal short arm and 5'-terminus of this base sequence : 147154
ggagtcactcagtaggccaaccaccaggtgttccagaaccagttgttgagatctcctttctcccctggacttttcacacacacacacacacacacacagcagtgagatgccaaagtccaactacttacaaggcacagcatggcggtaaaggttatcccttatggtctgctggagctcatgatcaggagaccccttctggaatcgctgat

SEQ ID NO: 5622 - DNA, 252 bp, Homo sapiens
  D3S3670
  Located on chromosome 3
  Distance between a terminus base of telomere on chromosomal short arm and 5'-terminus of this base sequence : 119331477
  Distance between 3'-terminus of neighbour sequence of sequence listing upward to telomere on chrosomal short arm and 5'-terminus of this base sequence : 104203
atgactgagacacacgcctgagctccttacgttcaatttctgtatgcatagctagcgtgaagaaccactgagaagatagaaaatttatttccatgtttgtctcattgtgtgtgtgtgtgtgtgtgtgtgtgtgtgtatccgttttgctttgctgtaaggaaatacctgacactggagaaactataaagaaaggagattaatttggctctctgttctgcaggctgtacaagtatggcaccagcatcttcttgg

SEQ ID NO: 5623 - DNA, 433 bp, Homo sapiens
  AC027525.2_33637
  Located on chromosome 3
  Distance between a terminus base of telomere on chromosomal short arm and 5'-terminus of this base sequence : 119409887
  Distance between 3'-terminus of neighbour sequence of sequence listing upward to telomere on chrosomal short arm and 5'-terminus of this base sequence : 78158
ctcaaatcagagcatacttgtaaccttccctttttctcattataaagttttcttactcctctgcctgccattgagtctctgccaaacaccagtgatggtggctgaatctcttgttatgtagcaagctctgaatgaagggcctctgcttgttctcatttgggtggtctgggtggtcttcatttatttccacagtgggaaaggcacatacccatgacagtctgtttctcttttgctattacacaactatacacacacacacacacacacacacacacacacacacacacacacacacagagttctctttctctctaccactgttcctccttccttcccactatctacttttctataggctttcttaccaatctcccaagaatgctcttaaaaaagacaggtgttgaggaagctattacttccatttcaaagatga

SEQ ID NO: 5624 - DNA, 433 bp, Homo sapiens; identical to SEQ ID NO: 5623
  AC026341.16_114299
  Located on chromosome 3
  Distance between a terminus base of telomere on chromosomal short arm and 5'-terminus of this base sequence : 119409887
  Distance between 3'-terminus of neighbour sequence of sequence listing upward to telomere on chrosomal short arm and 5'-terminus of this base sequence : -433

SEQ ID NO: 5625 - DNA, 369 bp, Homo sapiens
  AC012565.3_48966
  Located on chromosome 3
  Distance between a terminus base of telomere on chromosomal short arm and 5'-terminus of this base sequence : 119472941
  Distance between 3'-terminus of neighbour sequence of sequence listing upward to telomere on chrosomal short arm and 5'-terminus of this base sequence : 62621
ttgactacacggacaattaaatttgtccaaactggcacttaaccacaacagaagaaacagtaaatatcttttaaaatctaattttatgtctagatttgggtttgtaaataccattccctcattaaacacacacacacacacacacacacacacacacacacacacacacacacacacagaggactgcttctagggttggggcaaggaaaatacaagatgaacttagaatatcttacggtgctacaaagtaaagaagtaatttttttttaaacgaaagatgtcgacctgttaaaaggacataatgaccaacttgaaagggctctctctgatcaaatctgtgatgatttgtgcattgaaatgcataattat

SEQ ID NO: 5626 - DNA, 385 bp, Homo sapiens
  chr3.fa.O7frz.130944680
  Located on chromosome 3
  Distance between a terminus base of telomere on chromosomal short arm and 5'-terminus of this base sequence : 119664718
  Distance between 3'-terminus of neighbour sequence of sequence listing upward to telomere on chrosomal short arm and 5'-terminus of this base sequence : 191408
tatcaaatggagctttgtagacagaccatattgatagaaataattttctgttgccttctttttattgctgaatgccactctgctttataagagaatcccagactgatgttaaaattccagatcaatgtgagacaaactatgatagactgtcactaggttttttgtttaatttcttccttgggtttattctgtaatgactctctctctcttgctttctctctctctctctctctctctctctgtgtgtgtgtgtgtgtgtgtgtgtgtgtgtgtgtgtgtgtgtgtgtgtgtattgggtcgtgtctttgatagctccctgatgtagaaacaagcaacgcttttgaaacctagcaattctctgaattgttaccttagatagcttgtc

SEQ ID NO: 5627 - DNA, 394 bp, Homo sapiens
  chr3.fa.O7frz.130819920
  Located on chromosome 3
  Distance between a terminus base of telomere on chromosomal short arm and 5'-terminus of this base sequence : 119757842
  Distance between 3'-terminus of neighbour sequence of sequence listing upward to telomere on chrosomal short arm and 5'-terminus of this base sequence : 92739
tcctagtgacaaagctgttaagctcagtttctagaatatgagtgttttctagcacacagtttgaaaaccatttaactcatttccaggaagagaaatcaatgcaactatgctcaatggttacgctaaaataaaaaattcagaagtatagtaaagaatatgactgctgcatagaccaactgacaattgttcaaactttgatagccataaacaaaaagccagattaggtcaggagatcatttgacatctcttggttcccttcataacctctatcttggagggggagagagagagagagagagagagagagagagagactgactgagagagagagactgcctacaaatacaaaaagaatggctctccctttgaaatctctacttgatgagtaccagca

SEQ ID NO: 5628 - DNA, 110 bp, Homo sapiens
  chr3.fa.O7frz.131044320
  Located on chromosome 3
  Distance between a terminus base of telomere on chromosomal short arm and 5'-terminus of this base sequence : 119787400
  Distance between 3'-terminus of neighbour sequence of sequence listing upward to telomere on chrosomal short arm and 5'-terminus of this base sequence : 29164
ctcagtccactttagtaccaatatatgattgcctcatttgcatgaagatgcatatatatatatatatatatatatatgcacccaaaagacatttctttgatcttaacaag

SEQ ID NO: 5629 - DNA, 120 bp, Homo sapiens
  DISO7_10009658
  Located on chromosome 3
  Distance between a terminus base of telomere on chromosomal short arm and 5'-terminus of this base sequence : 119946755
  Distance between 3'-terminus of neighbour sequence of sequence listing upward to telomere on chrosomal short arm and 5'-terminus of this base sequence : 159245
cagcttgaagtttggcactatatagtagctacacacacacacacacacacacacccacacacacacacacacacacacagagtgaatggtatttattctagtgaacctagagtgcagcag

SEQ ID NO: 5630 - DNA, 472 bp, Homo sapiens
  chr3.fa.O7frz.131446539
  Located on chromosome 3
  Distance between a terminus base of telomere on chromosomal short arm and 5'-terminus of this base sequence : 120085873
  Distance between 3'-terminus of neighbour sequence of sequence listing upward to telomere on chrosomal short arm and 5'-terminus of this base sequence : 138998
actagaagccattcagtgattctcttccaaataacaagtactttgtatcagcagtctctgataaaatgggggtcccctggtgaggcctaaaacaaaagtatcccactcggacacacacacacacacacacacacacacacacactctctctctctctcactcactttgtctaggttctgtcacccactccctgttgtaacctttctctgtcctctctttccagaataagtttaggagagagacaagaactgcatgagtgcagactataggtctgaaatttataactttgtccttgtcacttctccttccaaacgtctcacctccaaaactcagatggagccagctgcttcaagatgcagacaacatcatctttttttttaaactatagtgcaggcaatcatggtttacaaactagtttgaagtatacaaactcaccttactcagctagatcggataagttacaactctacag

SEQ ID NO: 5631 - DNA, 149 bp, Homo sapiens
  D3S1579
  Located on chromosome 3
  Distance between a terminus base of telomere on chromosomal short arm and 5'-terminus of this base sequence : 120110601
  Distance between 3'-terminus of neighbour sequence of sequence listing upward to telomere on chrosomal short arm and 5'-terminus of this base sequence : 24256
cgccctggagagatgcgaaggaacacttacaattaactttacagagaacagattgaaaacctctatgtgcaacattctgcgtgatcctaaaaagaagtgtgtgtgtgtgtgtgtgtgtgtgtgtgtgtgtaggtgaggggtggcaaaca

SEQ ID NO: 5632 - DNA, 264 bp, Homo sapiens
  D3S1575
  Located on chromosome 3
  Distance between a terminus base of telomere on chromosomal short arm and 5'-terminus of this base sequence : 120359328
  Distance between 3'-terminus of neighbour sequence of sequence listing upward to telomere on chrosomal short arm and 5'-terminus of this base sequence : 248578
aaccactgcacttagcctgggtgacagagtgagactctctctcaaaaacaaaacaaaacaaacatgcaaaaaaaccctcaaaacctaatccttactcctttcttcttaatctctccatctctccacacaacacacacacacacacacacacacacacacacacacacgtaaggatgcacaatagaagaacaacaatgaaaggatggaaagacagaaaaaaatgaaagagaaatggttagatgtgaggtcttcagttgcttggat

SEQ ID NO: 5633 - DNA, 330 bp, Homo sapiens
  AC068087.2_32307
  Located on chromosome 3
  Distance between a terminus base of telomere on chromosomal short arm and 5'-terminus of this base sequence : 120414561
  Distance between 3'-terminus of neighbour sequence of sequence listing upward to telomere on chrosomal short arm and 5'-terminus of this base sequence : 54969
attaaagtatcctgctatggaataaaaatagagacataagtgaagaggccaatgcatgaaaaattaatcaagaaaaatgttttttcatcttatagacagtacatacacacacacacacacacacacacacacacacacgacttgtttaaatgctatggcaagaatggaaaaggaggaggaagaaataactacagataaataatatatcctcatggaaatgaggacaaaatacacattaatcatttttttttagaaatgtggaagctgcctttgcataataatgttggattcaaggaaaatacttttctacatatgtcatgacatttgaaa

SEQ ID NO: 5634 - DNA, 330 bp, Homo sapiens; identical to SEQ ID NO: 5633
  AC078801.7_14545
  Located on chromosome 3
  Distance between a terminus base of telomere on chromosomal short arm and 5'-terminus of this base sequence : 120414561
  Distance between 3'-terminus of neighbour sequence of sequence listing upward to telomere on chrosomal short arm and 5'-terminus of this base sequence : -330

SEQ ID NO: 5635 - DNA, 166 bp, Homo sapiens
  Z66821
  Located on chromosome 3
  Distance between a terminus base of telomere on chromosomal short arm and 5'-terminus of this base sequence : 120573404
  Distance between 3'-terminus of neighbour sequence of sequence listing upward to telomere on chrosomal short arm and 5'-terminus of this base sequence : 158513
atcacacaattttgcatggcatttgcccttataagtcttcagcagtttttcactttatttctaatgtagtccaatctcttcggccacacacacacacacacacatacacacacacacacacacacacacacacctgccctgatcacttctccagccccatctctag

SEQ ID NO: 5636 - DNA, 437 bp, Homo sapiens
  AC068159.2_149307
  Located on chromosome 3
  Distance between a terminus base of telomere on chromosomal short arm and 5'-terminus of this base sequence : 120636716
  Distance between 3'-terminus of neighbour sequence of sequence listing upward to telomere on chrosomal short arm and 5'-terminus of this base sequence : 63146
ttaagtcctaatcctcaatgctactgtatttagagataggcctttaaagatataattaagatcactgggtgtggtggctcacgcctgtaatcccagcactttgggaagccaaggcaggtggattgcttgagctcaggagtacaagaccagcctgggcaacatagtgaaacccccatctctactaaaaaatacaaaaataaaattagctggcaggaggctgaggcaggagaatcgcttgaacccgggaggtagaggttgcaatgagctgaggtggtgccactgcactccagcttgggcaacagagcgagactccatctcaataaaataaaataaaataaaacaaaataaaataaaataaaataaaataaaataaaataaaataaaataaaataaaatagctgggcatggtggtgctcacctgtagtcctagctactca

SEQ ID NO: 5637 - DNA, 438 bp, Homo sapiens
  AC068303.6_132124
  Located on chromosome 3
  Distance between a terminus base of telomere on chromosomal short arm and 5'-terminus of this base sequence : 120893022
  Distance between 3'-terminus of neighbour sequence of sequence listing upward to telomere on chrosomal short arm and 5'-terminus of this base sequence : 255869
caaacatccaggcatctagctctgtcccagactcttttcctacagcttcgaaaagcagcgtattgggttaaaacacacacacatgcgcacacaccacacacacacacacacacacacacacacacacacgaagcaagacttcttttcaaggctccttcatcctctctctgccatcaggatgtggtctgaaccctatcataaaaagagaagtcatagttaatgaggaagtgggaacgcgacagagatgaagcaggaatcatagtggcagaaaaacagaaaaggacatttctttccttaataaatatttattgcaagtgtcggccaattaccttttaaagatgattatacacatcctatggctttcatctttctcatgtcacaggttattcgagttgggaaaagtacatgtgacaagtaagtgttgacttaaatgcaaat

SEQ ID NO: 5638 - DNA, 394 bp, Homo sapiens
  AC055710.7_45825
  Located on chromosome 3
  Distance between a terminus base of telomere on chromosomal short arm and 5'-terminus of this base sequence : 121126573
  Distance between 3'-terminus of neighbour sequence of sequence listing upward to telomere on chrosomal short arm and 5'-terminus of this base sequence : 233113
gaacttccttaaatggtctatcttaaagtacattatcattgtcttagtacatagtgcatattggttattgttggatgatgaatcttacttttgcttttgctttttaattttatctctctggttggtaaaattttatttttcactctaggtactacaaatgtcaatcttttaataaaactttcaaataaagaacctatgcgtgtgtgtgtgtgtgtgtgtgtgtgtgtgtgtgtgtgtgtcttctgttaagctaaaatcaacttgagtttaaatctagtttttttatagcctgatttactcattctttttactttctgcctcagggatcagattctatattggtttattttcaatgaccaaaaatttagagaatgttgtcagatagaatagccga

SEQ ID NO: 5639 - DNA, 109 bp, Homo sapiens
  DISD22_0002948
  Located on chromosome 3
  Distance between a terminus base of telomere on chromosomal short arm and 5'-terminus of this base sequence : 121346284
  Distance between 3'-terminus of neighbour sequence of sequence listing upward to telomere on chrosomal short arm and 5'-terminus of this base sequence : 219317
cctaaggctcagaaggagcaaaatgctgtacacacacacacatacacacacacacacacacacacacacacatgcacgcaagcacacaccaatgcctctaacttcatcg

SEQ ID NO: 5640 - DNA, 107 bp, Homo sapiens
  D3S2457
  Located on chromosome 3
  Distance between a terminus base of telomere on chromosomal short arm and 5'-terminus of this base sequence : 121454147
  Distance between 3'-terminus of neighbour sequence of sequence listing upward to telomere on chrosomal short arm and 5'-terminus of this base sequence : 107754
ttcatatctggaaaaaacagtcctaaaatatatctttatctatctatctatctatctatctatctatctatctatctaggatgctgtataactgaacagaacacaga

SEQ ID NO: 5641 - DNA, 164 bp, Homo sapiens
  D3S1558
  Located on chromosome 3
  Distance between a terminus base of telomere on chromosomal short arm and 5'-terminus of this base sequence : 121513929
  Distance between 3'-terminus of neighbour sequence of sequence listing upward to telomere on chrosomal short arm and 5'-terminus of this base sequence : 59675
ccttaatgtgctcatggaagaataagttttcataaatgtacaaaaataattataagtgtgtgtgtgtgtgtgtgtgtgtgtgtgtgtgtgcgcgtgcagaaaggtgttcctgcccatccttaaggtgaaatacaactatgaaaatggttaaaatgatagcaccc

SEQ ID NO: 5642 - DNA, 409 bp, Homo sapiens
  AC026762.12_45499
  Located on chromosome 3
  Distance between a terminus base of telomere on chromosomal short arm and 5'-terminus of this base sequence : 121556405
  Distance between 3'-terminus of neighbour sequence of sequence listing upward to telomere on chrosomal short arm and 5'-terminus of this base sequence : 42312
tacatacgtaaacatgtgccacgatggtttgctgcacctatcaacccatcacctaggcattaggccccacatgcattagctatttgtcctgattaacatttgtcttgttttgatttgttttgttttgttttgttttgtttgagatggggtctttttctcttgcctaggctggagttcagtggtgcaaacacggctcactgctgccttgacctcatgggctcaagtgatcctcctacctcagcctcccgaatagctgggactactggtgcataccagtaggcccagctaattttaaaatattttttgtagagatgaggtttccctttgttaccaaggctggtcttgaacttttggcctcaagcaatcctcccacctcagcctcccaaaatgttgagattacaggcaagag

SEQ ID NO: 5643 - DNA, 274 bp, Homo sapiens
  D3S1769
  Located on chromosome 3
  Distance between a terminus base of telomere on chromosomal short arm and 5'-terminus of this base sequence : 121731223
  Distance between 3'-terminus of neighbour sequence of sequence listing upward to telomere on chrosomal short arm and 5'-terminus of this base sequence : 174409
ttacccctgtagctgctcacaatagctaataagcttttgctataaagagacaggagacagaatgttataagttagtggaatgtagtgagtacagaaatacttatgttcaagaattccaagatagatagatagatagatagatagatagatagatagatagatagatagatagatagataaaataaaaatttatagatctcaggtaaaggggaagcaatgctatatgcaatattatttttgaacctgaccttggcttcagctgaaaacggtatat

SEQ ID NO: 5644 - DNA, 384 bp, Homo sapiens
  chr3.fa.O7frz.133134950
  Located on chromosome 3
  Distance between a terminus base of telomere on chromosomal short arm and 5'-terminus of this base sequence : 121866627
  Distance between 3'-terminus of neighbour sequence of sequence listing upward to telomere on chrosomal short arm and 5'-terminus of this base sequence : 135130
atcaccagccttaagactaaataaaagccttctctcaagattcaaacatagaatgggtgggtggcatccacctttttttttgccctcacacccataattgaaagactcaggaggaaaaggtgtgtgattgatatcttgtgccaggtgcagttcagactatacataaatataggacagattttacatcaaataaaatattttaagacaaaatacaggaagacaaaatacaaatatttacaaaattagtgatgcaagatttcaataccaagttaaagaaagcactacacacacacacacatgcacacacacacacacacacacactcacacaaatggtggaaacagtgtggtagctgttcatgaggacagtgaagtacgttgaagg

SEQ ID NO: 5645 - DNA, 286 bp, Homo sapiens
  D3S3649
  Located on chromosome 3
  Distance between a terminus base of telomere on chromosomal short arm and 5'-terminus of this base sequence : 121871672
  Distance between 3'-terminus of neighbour sequence of sequence listing upward to telomere on chrosomal short arm and 5'-terminus of this base sequence : 4661
tgtccatcaccagagtcaatctgtaaacttattattattggtgaaatgtaggaaataagaggcctttattcacaatagccaagacacagaatcaacctaagtgtctatggacagatgaatggacaaaaaaaaagtaacacacacacacacacacacacacacacacacacacacacacacacacacaccatggaatattattaatccttaaaaaggaaatcctgtcattcttgacaatatgaatgaacctggaggatatattatgctaagtgaaataagccaggca

SEQ ID NO: 5646 - DNA, 408 bp, Homo sapiens
  AC026343.10_111266
  Located on chromosome 3
  Distance between a terminus base of telomere on chromosomal short arm and 5'-terminus of this base sequence : 122020411
  Distance between 3'-terminus of neighbour sequence of sequence listing upward to telomere on chrosomal short arm and 5'-terminus of this base sequence : 148453
gttttgatgtaagtatttggtcactgcagccatatctgctttaggtggcacttcaaactctataattctgtggctcttgaagacttgtagaggtactgctttggggtcttgggtaagatccaggagaattctctagattaacaggtagagacccttgttctcttcccttacttcccctaaacaaaagaaatctctctctctctctctctctctctccgtactgagctgcctagagcttgggtaggggtgacacaagcacccttgtggccaacaccagtggaactgcactgggtcaaacctgaaaccagcacagtactaggtttcatccaagccctgcagtgaccactacctgtctactcattatgtctcctcaaggctcaaggagtctacaatcagaaggtagcaata

SEQ ID NO: 5647 - DNA, 478 bp, Homo sapiens
  AC023793.11_31365
  Located on chromosome 3
  Distance between a terminus base of telomere on chromosomal short arm and 5'-terminus of this base sequence : 122146078
  Distance between 3'-terminus of neighbour sequence of sequence listing upward to telomere on chrosomal short arm and 5'-terminus of this base sequence : 125259
atgtcatagacaagtctggaatacagttctaactgggcttgactgaagtaattctctgataacactctacgcaatatggccagttaaataaacaaattacatgattctgagggaattttcttcattgtgatgctacattcttcaagctagaaagcagacatgcaaaataggcactgccaatctcagatgctgtgtgtgtgtgtgtgtgtgtgtgtgtgtgcgtgtgcacgtgcgtgcgtgtaattgaaaactaatagtggaaagacagggttctgagaagaatccatttgggtaaagggggcacgagagacaacgttcagaggcaacagtggctaaattcacagaagaaaggcccaattctcagtatcaggtgtataagctcagtcagtgtgtgtgctgaacagggctggtattaattttttccccattagaagagcacaagacaattatttatgtctacctcgcctctaaacataat

SEQ ID NO: 5648 - DNA, 458 bp, Homo sapiens
  AC069519.8_29705
  Located on chromosome 3
  Distance between a terminus base of telomere on chromosomal short arm and 5'-terminus of this base sequence : 122326501
  Distance between 3'-terminus of neighbour sequence of sequence listing upward to telomere on chrosomal short arm and 5'-terminus of this base sequence : 179945
cctgtactccaagctatttgagagactgaggtgggaggatcacttgaggccaggaggtcgaggctgcagtgagccaagattacaccactacactccagcctggttgatagagcaagaccctgtctcaaaaataaataaataaataaataaataaataaataaataaataaataaataaaattagctgggtgtggtagtgtgcacctatagtctcagctactcaggaggttgaggcaggaggattgcttgagctcaagaagtgaggctgtggtgagccattattacaccactgcatttcagaattttgaacattgatgccctggtcccttgctcattgtgtacccagatcctaggcaaataaaaccatctgtctccaccttacaatgggtgagtaggaccccctttctaaaagaggggtgggaactaaccagcacaccctaccagttgaacaatgcctt

SEQ ID NO: 5649 - DNA, 457 bp, Homo sapiens
  AC073352.7_5796
  Located on chromosome 3
  Distance between a terminus base of telomere on chromosomal short arm and 5'-terminus of this base sequence : 122353411
  Distance between 3'-terminus of neighbour sequence of sequence listing upward to telomere on chrosomal short arm and 5'-terminus of this base sequence : 26452
ccaacattaggcctagctcccttggggcctccagggtaagtgaagaaagaagtaggccaggtgcagtggctcacgtctctaatcccagcacttcgggaggctgaggtgggagggttgcttgaggagaggagttcgagactgcagtgagctgattgtgccagtgcattccagcctgggcaagagagcaagaacctgtttctgaagaaagaagaagaagaagaagaaggagaaggagaagaagaagaagaaggagaaggagaaggagaagaagaggaagaggaggaggaggaggaagaagaagaagaagaagaagaagaagaagaagaagaagaagaagaagaagaagaagacagaatcttagaaaactttcttaatcaatgatacttgctagcaaaggaagaagtattaataatataatatagcaaactcagccctgagaattaaattcctaaagctt

SEQ ID NO: 5650 - DNA, 366 bp, Homo sapiens
  G08300
  Located on chromosome 3
  Distance between a terminus base of telomere on chromosomal short arm and 5'-terminus of this base sequence : 122642671
  Distance between 3'-terminus of neighbour sequence of sequence listing upward to telomere on chrosomal short arm and 5'-terminus of this base sequence : 288803
tggtgggcgcctgtagtcccagctactcgggaggctgaagcaggagaatggcatgaactcaggaggtggaggttgcaatgagccgagattgcgccactgcactccagcctgggcgacagagagagactctgactcaaaaagagaaagaaagaaaggaaggaaggaaggaaggaaggaaggaaccataaaaatgggcacccaggagccctcggggctgcaatgtctatggtgtagccattcttttattcctctactttcttaataaacttgttttcactttatgtactcactctgaattctttctttcttgagacccaggaaccctctcttggggtctggcttgggacccctttctgggtaacatct

SEQ ID NO: 5651 - DNA, 221 bp, Homo sapiens
  D3S3720
  Located on chromosome 3
  Distance between a terminus base of telomere on chromosomal short arm and 5'-terminus of this base sequence : 122691928
  Distance between 3'-terminus of neighbour sequence of sequence listing upward to telomere on chrosomal short arm and 5'-terminus of this base sequence : 48891
agcaatcctccagcctcagcctcccaaagtgctggggttataggcgtgagccactgcacacagcaattgatataaatttctaactaatttccaggagatgctgatgctactgctctaaggaccatactctgagaaccactggtgtagactcaatttaaaacacacacacacacacacacacacacacacacacacacacaggctttagattcagatacagc

SEQ ID NO: 5652 - DNA, 101 bp, Homo sapiens
  DISO7_10001212
  Located on chromosome 3
  Distance between a terminus base of telomere on chromosomal short arm and 5'-terminus of this base sequence : 122713339
  Distance between 3'-terminus of neighbour sequence of sequence listing upward to telomere on chrosomal short arm and 5'-terminus of this base sequence : 21190
tcattatctctgtgagctcagtcccagaacaaagaggcaagggtttttctctctctctctctctctctctctctctaagtgtttcttactcttctggcaag

SEQ ID NO: 5653 - DNA, 303 bp, Homo sapiens
  AC068633.10_121361
  Located on chromosome 3
  Distance between a terminus base of telomere on chromosomal short arm and 5'-terminus of this base sequence : 123078125
  Distance between 3'-terminus of neighbour sequence of sequence listing upward to telomere on chrosomal short arm and 5'-terminus of this base sequence : 364685
tgatcactgatatgcttcctatttatatgaatttgactacattatatatttcatataagtgaattatttcacttagcatagtatcctcaagtttattcacgttgtagcatgtgacaggattcccttcctttttaagattgcacaatagtccattgtatgtgtatgtgtatgtgtgtgtgtgtgtgtgtgtgtgtgtgtatatatatatatatatatatgtctcacattttttaatctatgtatatatcagtggagatttgagttgccttaacctcttggttattatgaattgtgctcctacaa

SEQ ID NO: 5654 - DNA, 372 bp, Homo sapiens
  AC068633.10_23295
  Located on chromosome 3
  Distance between a terminus base of telomere on chromosomal short arm and 5'-terminus of this base sequence : 123108060
  Distance between 3'-terminus of neighbour sequence of sequence listing upward to telomere on chrosomal short arm and 5'-terminus of this base sequence : 29632
aaagagctaagcagatgctatctggtcccataaggataaagcatgtacatagcaacaaggccatctcaaggtatcatatcacacaccagatcaaagtacagcatctttttttctatttcaaacttagggttgttcctcactggtgattttcatctacaacaacttatatctcaaaagaaaccaaacccaaacaaatatttcattatgtgtgtgtgtgtgtgtgtgtgtgtgtgtgtgtgtaatatattctaagacctcttttgctcagcagcaattatgctcaaacctagataataactacttttggaagccattgtctgatgattaatcttggttggtggagacacagagaataggtgatgtgactcaata

SEQ ID NO: 5655 - DNA, 202 bp, Homo sapiens
  D3S1303
  Located on chromosome 3
  Distance between a terminus base of telomere on chromosomal short arm and 5'-terminus of this base sequence : 123108178
  Distance between 3'-terminus of neighbour sequence of sequence listing upward to telomere on chrosomal short arm and 5'-terminus of this base sequence : -254
caaacttagggttgttcctcactggtgattttcatctacaacaacttatatctcaaaagaaaccaaacccaaacaaatatttcattatgtgtgtgtgtgtgtgtgtgtgtgtgtgtgtgtgtaatatattctaagacctcttttgctcagcagcaattatgctcaaacctagataataactacttttggaagccattgtctg

SEQ ID NO: 5656 - DNA, 238 bp, Homo sapiens
  D3S3703
  Located on chromosome 3
  Distance between a terminus base of telomere on chromosomal short arm and 5'-terminus of this base sequence : 123282478
  Distance between 3'-terminus of neighbour sequence of sequence listing upward to telomere on chrosomal short arm and 5'-terminus of this base sequence : 174098
ggaaatgtggaaccaacagaaatgcccattaatcaatgagtgataaagaaactgtgatatatatatttatatatatatatatatacacacacacacacacacacacacacacacacacacacacatatacatatgatggaatactactcagccataaaagggaatgaattaatggcattcgcagcaacctggatgagattggagactattattctaagtgaagtaactcaggaatgga

SEQ ID NO: 5657 - DNA, 412 bp, Homo sapiens
  AC026360.7_14615
  Located on chromosome 3
  Distance between a terminus base of telomere on chromosomal short arm and 5'-terminus of this base sequence : 123304380
  Distance between 3'-terminus of neighbour sequence of sequence listing upward to telomere on chrosomal short arm and 5'-terminus of this base sequence : 21664
tgtgcagacctttaccaagcaaacattctgcctctaataatgctctttttttctttccaccacaaaacttccaggagccagttttcttcctgggctcatttgtgtgtgtgtgtgtgtgtgtgtgtggcccttcatcttatatatagcaagagaccaagaacgttcattcataccctttgacccaaatatttaatttctgggaatacagcccaaagaaaaaattcaaaatgtggtggtggcagagtaggataaactatgaaatattcaccatagcataatttttaatagcaaaaattagaagcaacccaagtggcccacaattgggaagtaattaagtaaaactaggcatatccataaagtaattttttttcaaaataatagccattaaaattaatgactaagactaggtggc

SEQ ID NO: 5658 - DNA, 424 bp, Homo sapiens
  AC026330.7_148180
  Located on chromosome 3
  Distance between a terminus base of telomere on chromosomal short arm and 5'-terminus of this base sequence : 123382623
  Distance between 3'-terminus of neighbour sequence of sequence listing upward to telomere on chrosomal short arm and 5'-terminus of this base sequence : 77831
gacacttcacagttcttgacagatgtgtcataatttatttaaccactatcctatatatgggcatttaggtaccacagttccacagtttaatggctgctgatagaggacatgagacccatagattagagacaaaggactttattatgtgtgtgtatatatatatatgtatgtgtgtgtgtgtgtgtgtgtgtgtgtgtgtgtctatgtggatatatatacatacatatccaagaataataaatcactattgttttaatttgcatttctctattaatgagtttgaacatatttatatgattaggagatatatatactttttggtgagttatctgtttatgcattttcccatttttctattttttcccctttgtcaagttttaaaagatcttcatatactgggaatattaacttatgtccgtggtat

SEQ ID NO: 5659 - DNA, 270 bp, Homo sapiens
  D3S3515
  Located on chromosome 3
  Distance between a terminus base of telomere on chromosomal short arm and 5'-terminus of this base sequence : 123482637
  Distance between 3'-terminus of neighbour sequence of sequence listing upward to telomere on chrosomal short arm and 5'-terminus of this base sequence : 99590
gctaatggctaccagaattgaatagtacagacatagaacaatttgtgtcatcacagaatattctattggacaacactgtgtgtgtgtgtgtgtgtgtgtgtgtgtgtctgggtgtctgggtgtctgggtgttatgtgtgtattcttgtctatctatagtttagtttcttttgaaaataacagacacacaataaaacacatttataacaagacgttcaaaagtcaagttagagatccatggtttgcagaaccaggttcttccaactggtca

SEQ ID NO: 5660 - DNA, 248 bp, Homo sapiens
  D3S3664
  Located on chromosome 3
  Distance between a terminus base of telomere on chromosomal short arm and 5'-terminus of this base sequence : 123623797
  Distance between 3'-terminus of neighbour sequence of sequence listing upward to telomere on chrosomal short arm and 5'-terminus of this base sequence : 140890
atgcccatcaatcaatgagtggataaagaaattgtggtatgtatgtatgtatatgtacatacacacacacacacacacacacacacacacacacatacacacacacaccatggaatactactcagccatataaaggaatgaaataacagcattcacagcaacccagatggaaccggagaccattattctaagtgaagtaactcagtaatggaaaaccaaatatcatgtgttcttactcacaggtggga

SEQ ID NO: 5661 - DNA, 289 bp, Homo sapiens
  chr3.fa.O7frz.134333079
  Located on chromosome 3
  Distance between a terminus base of telomere on chromosomal short arm and 5'-terminus of this base sequence : 123752031
  Distance between 3'-terminus of neighbour sequence of sequence listing upward to telomere on chrosomal short arm and 5'-terminus of this base sequence : 127986
gcacctggtaagactatttctatgtagtagtttattcccacctcctttcctatccctcctgggaataactgacctaattgatctatagaacaaacactcttaccacaaagatcacacacacacacacacacacacacacacacaaacacacacacacacacatagagtcatgtaccacataatgatgtttcagataacagacctcatatatgatagtggtcctataagatataatagaattcaaaaattcttatcacctagagacatgtagccattgtaacatcttagt

SEQ ID NO: 5662 - DNA, 453 bp, Homo sapiens
  AC017034.3_61119
  Located on chromosome 3
  Distance between a terminus base of telomere on chromosomal short arm and 5'-terminus of this base sequence : 123943596
  Distance between 3'-terminus of neighbour sequence of sequence listing upward to telomere on chrosomal short arm and 5'-terminus of this base sequence : 191276
aagtaccatcctgacctttaagtgctggggatgaggtagaaagattaggaactactgatggaaactctgagagtgtgtgtgtgtgtgtgtgtgtgtgtgtgtgtgtgtgtgtgtgatgcatgtgtatttaaaacacatacacattcaaaaatgcccactagatggcaaacccacatctcaaatgttaaccattactggagtgacccttctggaaggctagggcactttaataattcaagccaattcgtaaaaggccaagattttgtatacagtttaaggggcatgcaaattagctttgtgatgatggtcttacaaatcatttctaggaatagaggctaaacttataactccaccatttccagaacctaatctgatttattttccacgcaaaatacagtatgaatgcaggtaaattaaatttccttactataccatctgatttcatatctaggt

SEQ ID NO: 5663 - DNA, 343 bp, Homo sapiens
  AC017034.3_79877
  Located on chromosome 3
  Distance between a terminus base of telomere on chromosomal short arm and 5'-terminus of this base sequence : 124102239
  Distance between 3'-terminus of neighbour sequence of sequence listing upward to telomere on chrosomal short arm and 5'-terminus of this base sequence : 158190
gttggacatttatgccatacagatagatttaatcaagaaacagagggtcagttagcaccattttttaaaagttttattttattttattttattttattttattttattttattttattttgagacagagtctcactctgtcactcaggctggattgcagtagcgccatcttgggtcagtgaaacctgtgcctcccgggttcaagcaattctttcgcctcagcctcccaagtagctgggattacaggcgcccaccaccaagcccagctaattttaacagaattctccattcttctgtgcttgggcaggggatagacaaagccaagataagccaaatcaaaggtc

SEQ ID NO: 5664 - DNA, 331 bp, Homo sapiens
  AC024927.2_43604
  Located on chromosome 3
  Distance between a terminus base of telomere on chromosomal short arm and 5'-terminus of this base sequence : 124257740
  Distance between 3'-terminus of neighbour sequence of sequence listing upward to telomere on chrosomal short arm and 5'-terminus of this base sequence : 155158
agtgacaatgattaattcctacatctgctcagccagatagaaacaaaggtcactgtgcatagattagcatcccgatcaccaccccctcctaatacacacacacacacacacacacacacacacacagagagagagagagagagagagagagagagagagaatctttcaccatttacaatggcaaaattcaaaatgcctgaaaaatgtttactatctggctaaaagaaacaaaaaatgcaagctctttagtgggatggtgatggaagaagacacagaataggatcaggcactgattactgtcagataactgtctaatcttgttagcatccaa

SEQ ID NO: 5665 - DNA, 450 bp, Homo sapiens
  AC063952.9_130988
  Located on chromosome 3
  Distance between a terminus base of telomere on chromosomal short arm and 5'-terminus of this base sequence : 124455263
  Distance between 3'-terminus of neighbour sequence of sequence listing upward to telomere on chrosomal short arm and 5'-terminus of this base sequence : 197192
cttaatattccaacattcaatgacacaaaacagccagagctgagagctgggaatgtggagaggctgataggcaggcaggcaaacacacacacatgtgcgcgcgcgcgcgcgcgcgcacacacacacacacacacacacacacacacacacactccaattcttctgcagcctaactgtaaggatctcttgctgtatatactattgggggaacactttgttttcctcctgatctcaagcctttgttgtgaagctaggagtagggttgcctgggtctttgtgaagtactacagagaatcattatggacagggaaatggaacaaagttcatatggcaactaggttatgctttggctgctgaaggtgccaagatcacaggcaagttcagtttctttggacttctatggtttttaaaggggagaagcaggaagtaaatttagctcagatccaataa

SEQ ID NO: 5666 - DNA, 435 bp, Homo sapiens
  chr3.fa.O7frz.136058596
  Located on chromosome 3
  Distance between a terminus base of telomere on chromosomal short arm and 5'-terminus of this base sequence : 124532513
  Distance between 3'-terminus of neighbour sequence of sequence listing upward to telomere on chrosomal short arm and 5'-terminus of this base sequence : 76800
caaattaagactgagtttgcacataaaagtctgtaagactgtcttttatctaagcattagtaaaatatatatacacacacacacacacacacacacacacacacacacacatatatatatatatacacacacacacacatatataccaggcttgctgggttattttccagtggtagaaagaaagctttccccactggataaagtttagagttgacacaggaaacagaaaacgaagttggattttgattgtgtcacagtcacacttgttcaatgtactgcttctataaacatgatgaaaacaaaaaagttatacttttaaaaggtaaaatttttaaaaccatgacaatcaagtaataaatatttataagatgcatacaaaaaatagctgcatgatttaaacatgtgaagaactccttgatctaggcttaagattgg

SEQ ID NO: 5667 - DNA, 224 bp, Homo sapiens
  chr3.fa.O7frz.136265192
  Located on chromosome 3
  Distance between a terminus base of telomere on chromosomal short arm and 5'-terminus of this base sequence : 124718183
  Distance between 3'-terminus of neighbour sequence of sequence listing upward to telomere on chrosomal short arm and 5'-terminus of this base sequence : 185235
agcagttctagtaagtccgaactactcctgtgtccatctatatgccattaggctagaaaaatacaagcttatgtgcgcatgtgcacacacacacacacacacacacacacacacacacacacgcagactgttaatcaagtttgtcctaaagttgcctccttacatattttaagttctgcctaaaggtttctccatacatagtgaaccataacctaattggatgt

SEQ ID NO: 5668 - DNA, 372 bp, Homo sapiens
  AC012534.3_12413
  Located on chromosome 3
  Distance between a terminus base of telomere on chromosomal short arm and 5'-terminus of this base sequence : 124763272
  Distance between 3'-terminus of neighbour sequence of sequence listing upward to telomere on chrosomal short arm and 5'-terminus of this base sequence : 44865
gcaaattacggaacttctcacctccataatcatgtgagccaattatcccaataaattgcatcttatctatctatctatctatctatctatctatctatctatctatctacctatctatcatctgtctatctttatcatgactcccgggttaatgacacacctgcgacacagcctcaggaggtcctgaggacatgtgcccaaggtggtcagggtacagcttgcttttatacatttcagggagccatgagacatcaatcaatatgtgtaaaatatacattgtttctgtctgctaaggtgggacagctcgggcttccaggtcagaagtagaaaagagaaaaaggttgaattcttttcagccttctactgaataca

SEQ ID NO: 5669 - DNA, 353 bp, Homo sapiens
  AC067734.11_139846
  Located on chromosome 3
  Distance between a terminus base of telomere on chromosomal short arm and 5'-terminus of this base sequence : 124962888
  Distance between 3'-terminus of neighbour sequence of sequence listing upward to telomere on chrosomal short arm and 5'-terminus of this base sequence : 199244
tacctcagaatgtgaccgtgtttcaaaatatttaaaggggtaattaaattaaaataaagaaaattagggttagccctaatgcaatatgactgatttccttataaggaaaggacattaggacacacacacacacacacacacacacgcgcgcgcgtgcgcggaaagccatatgaagatatggggagaacacagccatctgcaagtcgggagaaaggtcacaagaagccaccctgcaacacaccttgatcttgatttctggctcccagaattgtgagaaaatacatttctttattgttgtattcatttgttagagataccatagcaaactaatacatcaagaaactcttaggaca

SEQ ID NO: 5670 - DNA, 231 bp, Homo sapiens
  chr3.fa.O7frz.136668661
  Located on chromosome 3
  Distance between a terminus base of telomere on chromosomal short arm and 5'-terminus of this base sequence : 125038005
  Distance between 3'-terminus of neighbour sequence of sequence listing upward to telomere on chrosomal short arm and 5'-terminus of this base sequence : 74764
tctatcaccatagcttatgcttacatgttctgagacttcatataaatagaatcatatggtatacagagtgtgtgtgtgtgtgtgtgtgtgtgtgtgtgtgtgtgtcttatacaacacaatgtgttaagatttattcaagttgttgatggtgtcagtgatttgttctttttttattgctgagtagtaggtagagagaaaaaaacttcaaaagtatccatacttcaaacatgc

SEQ ID NO: 5671 - DNA, 104 bp, Homo sapiens
  DISO7_10001209
  Located on chromosome 3
  Distance between a terminus base of telomere on chromosomal short arm and 5'-terminus of this base sequence : 125382769
  Distance between 3'-terminus of neighbour sequence of sequence listing upward to telomere on chrosomal short arm and 5'-terminus of this base sequence : 344533
attggtggaaagagaactcctgccagaacacacacacacacacacacacacatacacacacacacacacacacactatattctctggagattggactaaactcc

SEQ ID NO: 5672 - DNA, 187 bp, Homo sapiens
  DISO7_10001210
  Located on chromosome 3
  Distance between a terminus base of telomere on chromosomal short arm and 5'-terminus of this base sequence : 125388281
  Distance between 3'-terminus of neighbour sequence of sequence listing upward to telomere on chrosomal short arm and 5'-terminus of this base sequence : 5408
agtggcagtgtatcaagacagaaaacatatggaaaataatctctctacttaggtttaacaacaacacacacacatacacacacacacacacacacacacacacacacacgcacacacctttctcccacacacacaagtgtggccccaccccaactcactccagtaaaagccaagtggagagcttaga

SEQ ID NO: 5673 - DNA, 413 bp, Homo sapiens
  chr3.fa.O7frz.137276100
  Located on chromosome 3
  Distance between a terminus base of telomere on chromosomal short arm and 5'-terminus of this base sequence : 125443888
  Distance between 3'-terminus of neighbour sequence of sequence listing upward to telomere on chrosomal short arm and 5'-terminus of this base sequence : 55420
tatgcagtcttaatgtgctgtattctggggtaattatagaatttaaccaaaagttgaattaagatgaattaaaactatctgaaacagcatcccaactgtgtcactgcacaaataccaatacaaataacaatcagtcccttggcaaagggggtataaaagattgagtgttggattgagaaataaagagagattttcatagtccaatttgaaacaacagtggaacttaatcttattaaagctacagcccagccccagcttaaatacttagcagaatctgaatgattctacattatatgtgtgtgtgtgtgtgtgtgtgtgtgtgtgtgtgtgtgatattcctgatattagtgataatatacatatatgaatgattctttagtttttactactgttgtacacagatcataccatca

SEQ ID NO: 5674 - DNA, 177 bp, Homo sapiens
  D3S3709
  Located on chromosome 3
  Distance between a terminus base of telomere on chromosomal short arm and 5'-terminus of this base sequence : 125693652
  Distance between 3'-terminus of neighbour sequence of sequence listing upward to telomere on chrosomal short arm and 5'-terminus of this base sequence : 249351
tgcatgtgcgtgtatatttgtgtataaatacacacacacacacacacacacacacacacacagagttgactgtcaaacaacacaggagttagaaacacagaaacccccagtcaaaaatccgcacacaacttgacttccccaaaagttaactactaataggtggtgtctcacaactgt

SEQ ID NO: 5675 - DNA, 101 bp, Homo sapiens
  DISO7_10001213
  Located on chromosome 3
  Distance between a terminus base of telomere on chromosomal short arm and 5'-terminus of this base sequence : 125980201
  Distance between 3'-terminus of neighbour sequence of sequence listing upward to telomere on chrosomal short arm and 5'-terminus of this base sequence : 286372
tttagctgcttctgtcttcttgatttacatatatatatatatatatatatatatatttttttttttttttttttctgtagagcctcacagtatcttctttc

SEQ ID NO: 5676 - DNA, 202 bp, Homo sapiens
  DISO7_10001217
  Located on chromosome 3
  Distance between a terminus base of telomere on chromosomal short arm and 5'-terminus of this base sequence : 126314093
  Distance between 3'-terminus of neighbour sequence of sequence listing upward to telomere on chrosomal short arm and 5'-terminus of this base sequence : 333791
agaagtagtcagcctttctggaaagtagtatagatggatagatagatagatagatagatagatagatagatagatagatagatagatagatgagatagatagatggaaacttaaaggggttcatacccttttacccttcacttccaggattttattctaaggaaataatcagaaataccatcaaagatgtatgtagagaact

SEQ ID NO: 5677 - DNA, 168 bp, Homo sapiens
  HUMUT5026
  Located on chromosome 3
  Distance between a terminus base of telomere on chromosomal short arm and 5'-terminus of this base sequence : 126442239
  Distance between 3'-terminus of neighbour sequence of sequence listing upward to telomere on chrosomal short arm and 5'-terminus of this base sequence : 127944
tgacgtcagcatattacctgtctagatatattttttaaacacatgaattagaaatataaatacatcaatatctatctatctatctatctatctatctatctatctaatctatctatctatctcacattctagctacatcactgaaagagcctagaaacactgacaccc

SEQ ID NO: 5678 - DNA, 473 bp, Homo sapiens
  AC048348.11_72485
  Located on chromosome 3
  Distance between a terminus base of telomere on chromosomal short arm and 5'-terminus of this base sequence : 126448406
  Distance between 3'-terminus of neighbour sequence of sequence listing upward to telomere on chrosomal short arm and 5'-terminus of this base sequence : 5999
taactgtcctcatttcacagaggagaaaccaaaaccagaggttaagaggtctgccctaatcatgaggcaggctgacaggatggggctgggactacaccttggggtattgccctattctctctgccacccctattgcatgcatgcacatgtgcgttccacacacacacacacacacacacacacacacacattaccttccttgtacctggaataccaagttacaaccataggagtccagatgacagggtgtgtgggctcccaaggagccaatccacaatgtactttcctgtccatttcttccaggaaacccgaagtcagaccatttcacatcctgttttgaaataaagttgcaatccatcaagaactaaccaacttctctgtatggtaatgctgcccattttcacttgcacatctgttatttagcagttggaatattctattatggaaaatgctacagatggaagaggttaggt

SEQ ID NO: 5679 - DNA, 393 bp, Homo sapiens
  AC026506.2_9280
  Located on chromosome 3
  Distance between a terminus base of telomere on chromosomal short arm and 5'-terminus of this base sequence : 126618401
  Distance between 3'-terminus of neighbour sequence of sequence listing upward to telomere on chrosomal short arm and 5'-terminus of this base sequence : 169522
gtgaatgtaggtattgaaactgacaccagtgccagcttaggggaacaggatacaaagaaacatggatctcctataaaacttgtggcattattttgttagagtgtgtgtgtgtgtgtgtgtgtgtgtgtgtgtgtggcattgctttaaattaactgaaatcataaggtgggccaatgctcccagctattgacaattttgagtcatataagtctcttgctctgccgcacgatggcacttttggtagttgaggactaagcatattattccatagaagccttagaggttcaggcaaacctgccctgtcttaatcagattaagatcttcattaacaaaatggataattttgagatgagttatcattataaggaatatcaaatatccatcagaacaata

SEQ ID NO: 5680 - DNA, 204 bp, Homo sapiens
  D3S3576
  Located on chromosome 3
  Distance between a terminus base of telomere on chromosomal short arm and 5'-terminus of this base sequence : 126630396
  Distance between 3'-terminus of neighbour sequence of sequence listing upward to telomere on chrosomal short arm and 5'-terminus of this base sequence : 11602
gatctagttggcaaggcgtagtggctcactcctataatcccaacactttgggaggccaaagtgagaggatcacttgaggccaggagtttgagaccagcctaggcaacatagtgagacctccatctacacacacacacacacacacacacacacacacacacacatacacacacacaaattacctgaaggattgctcgagtccaa

SEQ ID NO: 5681 - DNA, 123 bp, Homo sapiens
  DISD22_0002953
  Located on chromosome 3
  Distance between a terminus base of telomere on chromosomal short arm and 5'-terminus of this base sequence : 126731724
  Distance between 3'-terminus of neighbour sequence of sequence listing upward to telomere on chrosomal short arm and 5'-terminus of this base sequence : 101124
tttgcagacaggagtagccaaatatagatagatagatagatagatagatagggaatatatatctataatttccatgtgtgtgcgtgtgtgtgtgtgtgtgcacgcgcgcacatatggaagttg

SEQ ID NO: 5682 - DNA, 194 bp, Homo sapiens
  D3S3645
  Located on chromosome 3
  Distance between a terminus base of telomere on chromosomal short arm and 5'-terminus of this base sequence : 127065595
  Distance between 3'-terminus of neighbour sequence of sequence listing upward to telomere on chrosomal short arm and 5'-terminus of this base sequence : 333748
acctggacttgggatggtttatttgccccctacctctccttctgtgtgtgtgtgtgtgtgtgtgtgtgtgtgtatgtggtgttgttgtttttaacacctggcatcttaggtcccaacgggagagggaaggagcaggagtgctcagccctggtgggctggcccattccttctgcctggccatctttcagcactgc

SEQ ID NO: 5683 - DNA, 185 bp, Homo sapiens
  D3S3674
  Located on chromosome 3
  Distance between a terminus base of telomere on chromosomal short arm and 5'-terminus of this base sequence : 127262895
  Distance between 3'-terminus of neighbour sequence of sequence listing upward to telomere on chrosomal short arm and 5'-terminus of this base sequence : 197106
gccttggaaaaccttgaattaaatatatgtgtgtgtgtgtgtgtgtgtgtgtgtgtgtgtgtgtatatattactggaaatgctagctcatttttacagtagcattccaagcaataaatatagataaaaaatggaaatataaaatcaccattaagcgaacaccacagtaatcattgttgcaggcaa

SEQ ID NO: 5684 - DNA, 268 bp, Homo sapiens
  DISD22_0002960
  Located on chromosome 3
  Distance between a terminus base of telomere on chromosomal short arm and 5'-terminus of this base sequence : 127345406
  Distance between 3'-terminus of neighbour sequence of sequence listing upward to telomere on chrosomal short arm and 5'-terminus of this base sequence : 82326
agtgcgattaatggtataaatgtagaataggaactcccatttctagcagaattactgaatttaactaagtatgtactgagaatgagccatgtgcctagaactgtgctgatggtctagaagatacagaaatgtgaacagaagaatccctacttttcaagaaacttacaatccagataggaatactaaaaatatatatatatatatatatatatatatatatattttcacataattagctaactattcattcaatgtgtatttatgcagc

SEQ ID NO: 5685 - DNA, 216 bp, Homo sapiens
  chr3.fa.O7frz.141210576
  Located on chromosome 3
  Distance between a terminus base of telomere on chromosomal short arm and 5'-terminus of this base sequence : 127548806
  Distance between 3'-terminus of neighbour sequence of sequence listing upward to telomere on chrosomal short arm and 5'-terminus of this base sequence : 203132
gctgaccattactaatgatcagggaaatgttaagtaagcaataacagcatgccacattttacctacaagatttcccccagcaaaaacacacacacacacacacacacacacacacacacacacacacacaacaaaacaaccaacctagtaggagactaaattgatataatattcttataagtcaatttggcagtacaatcaacatttctaaagcat

SEQ ID NO: 5686 - DNA, 420 bp, Homo sapiens
  AC069233.5_49638
  Located on chromosome 3
  Distance between a terminus base of telomere on chromosomal short arm and 5'-terminus of this base sequence : 127760359
  Distance between 3'-terminus of neighbour sequence of sequence listing upward to telomere on chrosomal short arm and 5'-terminus of this base sequence : 211337
tctttccttctgctagaaagtcattgttgctgttatccttctttgaccaggtgttggactggattgaaaaccatggtgaggcctttctcagcaaacacactggagttgggaagtccctacatcgagcccgggccctgcagaagaggcatgatgactttgaagaggtggctcaggtgagaagctgtgtgtgtgtgtgtgtgtgtgtgtgtgtgtgtgtgtgtgtgtgtgtctagatgagggaggcatgatgactttgaagaggtggctcaggtgagaagctgtgtgtgtgtgtgtgtgtgtgtgtgtgtgtgtctagatgagggagaccagggctgtggctttggtgtttggtgaggcatgctgggttgataacctgtggctgctgggctgccttcctgcctgatgcaaggagtcctttgt

SEQ ID NO: 5687 - DNA, 203 bp, Homo sapiens
  D3S3646
  Located on chromosome 3
  Distance between a terminus base of telomere on chromosomal short arm and 5'-terminus of this base sequence : 127851845
  Distance between 3'-terminus of neighbour sequence of sequence listing upward to telomere on chrosomal short arm and 5'-terminus of this base sequence : 91066
atgcaagggctcagactcctggccttggccgccttgttctttcatcctctttctctttctcttttctttctttctctttctctctctttctctttctctctctttctctttctcctcctcctccttcttctccttctctctctctctcacacacacacacacacacacacacacacacacacacgcagcttcaaacatgcttc

SEQ ID NO: 5688 - DNA, 210 bp, Homo sapiens
  D3S1269
  Located on chromosome 3
  Distance between a terminus base of telomere on chromosomal short arm and 5'-terminus of this base sequence : 127878710
  Distance between 3'-terminus of neighbour sequence of sequence listing upward to telomere on chrosomal short arm and 5'-terminus of this base sequence : 26662
ttagcacctagaccaagggttatgtggtgaatacatatcttaactagatagtattgatctgtctaaatggtgtcactttgaaaaattgcaaccaggattagttctctctcttgctctgtgtgtgtgtgtgtgtgtgtgtgtgtgtgtgtgtgtgtgtgtctgtgatctgtctgtctcaaggacctttgtctttataggtattgaatgggg

SEQ ID NO: 5689 - DNA, 360 bp, Homo sapiens
  AC026603.3_27341
  Located on chromosome 3
  Distance between a terminus base of telomere on chromosomal short arm and 5'-terminus of this base sequence : 127962281
  Distance between 3'-terminus of neighbour sequence of sequence listing upward to telomere on chrosomal short arm and 5'-terminus of this base sequence : 83361
gtaagctcctagacttaccaattccctcagcctcctctatcttgccactgccaactgaaacacagattatggactagaaatactgacttttttttaaggaaagaaaaccccaagaagccaacacacacacacacacacacacacacacataatcacacacacacataatctcacacacacacaatcacacacacacacgatatagttcatcatctcacacacacatacacgggtcttctgactaatgccaaacacagagctctgtggatgccttatgtgttgaaacaatgccataaaataggagaaaagtgataaaactaagaagccactctaaaaatgactattcagtaagccaaatag

SEQ ID NO: 5690 - DNA, 210 bp, Homo sapiens
  G08257
  Located on chromosome 3
  Distance between a terminus base of telomere on chromosomal short arm and 5'-terminus of this base sequence : 128134860
  Distance between 3'-terminus of neighbour sequence of sequence listing upward to telomere on chrosomal short arm and 5'-terminus of this base sequence : 172219
tatggtggtgcatgactgtcccagttatttgggaggctgaggtgagaggattgcttgagcctaggaggtcaaggctgcagtgagccatgattgcaccactgtactccagactgggcaatagagtgagaccctgtctcaaaatagatagatagatagatagatagatagatagatagatagatagatagatagatattatggctgggtgca

SEQ ID NO: 5691 - DNA, 346 bp, Homo sapiens
  G10267
  Located on chromosome 3
  Distance between a terminus base of telomere on chromosomal short arm and 5'-terminus of this base sequence : 128134944
  Distance between 3'-terminus of neighbour sequence of sequence listing upward to telomere on chrosomal short arm and 5'-terminus of this base sequence : -126
ccatgattgcaccactgtactccagactgggcaatagagtgagaccctgtctcaaaatagatagatagatagatagatagatagatagatagatagatagatagatagatattatggctgggtgcattggctcatgcttgtaaccccaacactttgggagactgaagcgggaagatcacttgagcccaggagttcaagaccagcctgggcaacatagtgagaccctgtctctaaaataaaataataataataataataataataataataataataataataaagaatagccttagattagtctctcattatttgttttacagttgcccaacttgaccttactctc

SEQ ID NO: 5692 - DNA, 322 bp, Homo sapiens
  AC013494.4_93881
  Located on chromosome 3
  Distance between a terminus base of telomere on chromosomal short arm and 5'-terminus of this base sequence : 128231835
  Distance between 3'-terminus of neighbour sequence of sequence listing upward to telomere on chrosomal short arm and 5'-terminus of this base sequence : 96545
tcagtcaaggaatatttacagaacatgatctctgggcattgtaactcctggtcttagtggggaatatagggaccccatgtctccatggggtgcacagaatgtctgtgagactgatggagtggagaacgccatcccccagcctctccagctactcgaggcattctgtagaacataagcccatagattgtgtgtgtgtgtgtgtgtgtgtgtgtgtgtgtgtgtgtgtgcatgcgcgcgcgtgcgcactggaggaacctaagaaactatttggtgcacttcctcttattttagagctcccaaagtgtagctccagaatcgtaaa

SEQ ID NO: 5693 - DNA, 322 bp, Homo sapiens; identical to SEQ ID NO: 5692
  AC022336.12_37816
  Located on chromosome 3
  Distance between a terminus base of telomere on chromosomal short arm and 5'-terminus of this base sequence : 128231835
  Distance between 3'-terminus of neighbour sequence of sequence listing upward to telomere on chrosomal short arm and 5'-terminus of this base sequence : -322

SEQ ID NO: 5694 - DNA, 443 bp, Homo sapiens
  AC026342.18_92283
  Located on chromosome 3
  Distance between a terminus base of telomere on chromosomal short arm and 5'-terminus of this base sequence : 128336695
  Distance between 3'-terminus of neighbour sequence of sequence listing upward to telomere on chrosomal short arm and 5'-terminus of this base sequence : 104538
acttgaatttcaacagctacagccttgggcatacaaatttaaccctaaattttccagacatgagggctgagggaaagaaggcatgatatataggtccctttgtatcctaagaggctatctattctgaagcaagaaacttcttggcattacattctaagagaaattgatcagtaagaaaacacacacacacacacacacacacacacacacacgcacacatcccttcccaaaggaaggctgcagttgttaaaaagaaatagtgtgccatttttccagaaagagagggatgtaagaaagatggtaacaccactgatgttcagaatgagggtttattgctgcctctaatatacttgattttaaatgccacagactcctgaataggccgtggcaatgacagaatgttctgtcagcagatcctggagggactgacattcctggtcaga

SEQ ID NO: 5695 - DNA, 442 bp, Homo sapiens
  AC026342.17_123075
  Located on chromosome 3
  Distance between a terminus base of telomere on chromosomal short arm and 5'-terminus of this base sequence : 128369421
  Distance between 3'-terminus of neighbour sequence of sequence listing upward to telomere on chrosomal short arm and 5'-terminus of this base sequence : 32283
ataaagtacctgtagtgcttcaagaaaacaaagaagggaagggaagcaaaaaaaaaaaagaaaaaaaaaaagaatgttgaagttaattcagcaacactgaaaaactaggagaaatgacacagatgtgagtcaacctctgctaatcctgagaagcttcagggccctaagaggtaagcagcaagttctggaggccagtgccatggcttgctccaccaccaccaccaccaaaacctgtagtcaaagagatgggcagaggccagccgtggtggctcacacctgtaatcctagcattttgggaggccgaggcgggcggatcacctgaggttgggagttagagaccagcctgaccaacatggggaaaccctgtctctactaaaaatacaaaattagccaggcgtggtggtacatgcctgtaatcccagttactcagcaggacaatcac

SEQ ID NO: 5696 - DNA, 264 bp, Homo sapiens
  AC026618.2_145812
  Located on chromosome 3
  Distance between a terminus base of telomere on chromosomal short arm and 5'-terminus of this base sequence : 128518267
  Distance between 3'-terminus of neighbour sequence of sequence listing upward to telomere on chrosomal short arm and 5'-terminus of this base sequence : 148404
ttctgataattgtcatgttcaacatttttcacttctttactcatgtttattatgataggtgtatacacttaggcaatagagaatgttataacatcgaagaaaggctttccaacccttccccattcagtataatcattgtatatccttccagacaatttctatacatgtacagatatatatatatatatatatatcagtagtataaattccgaagggaaaaattattggaccaaagattatgtacatttaacaatttggtggata

SEQ ID NO: 5697 - DNA, 180 bp, Homo sapiens
  D3S3636
  Located on chromosome 3
  Distance between a terminus base of telomere on chromosomal short arm and 5'-terminus of this base sequence : 128705685
  Distance between 3'-terminus of neighbour sequence of sequence listing upward to telomere on chrosomal short arm and 5'-terminus of this base sequence : 187154
ggtgaatgaatggactcttggtttggctttaatcattttaggaccagatagggtagctctctctctctctctctctctctctctctctctgtgtgtgtgtgtgtgtgtgtgtgtgtgtgtgtgtgtgtgtgtgtagattggtcagtaataagtgaaccagctgggaaggagctgtagatc

SEQ ID NO: 5698 - DNA, 468 bp, Homo sapiens
  AC055752.9_122732
  Located on chromosome 3
  Distance between a terminus base of telomere on chromosomal short arm and 5'-terminus of this base sequence : 128705710
  Distance between 3'-terminus of neighbour sequence of sequence listing upward to telomere on chrosomal short arm and 5'-terminus of this base sequence : -155
gctttaatcattttaggaccagatagggtagctctctctctctctctctctctctctctctctctgtgtgtgtgtgtgtgtgtgtgtgtgtgtgtgtgtgtgtgtgtgtagattggtcagtaataagtgaaccagctgggaaggagctgtagatctgagtgttaatggtgtggtggtcgagggtgcatgtgctgcctgggtcaagtcctggctctaatactttgtgaccttgaacaagtttcgtaacctcactaagcctccgtttcctcacctacaaaatgactgcccagtgattgaaactaccatagagaatgaagacaattaaaagagataatttgtgtaaatatttggtatagtgcttggttcctggtcagcattcagcttatattatataaatggctaataattaaactaaggggagtatgtatttaatccagggggtagtggtataaatgagcagaaggatcc

SEQ ID NO: 5699 - DNA, 367 bp, Homo sapiens
  AC067998.2_8447
  Located on chromosome 3
  Distance between a terminus base of telomere on chromosomal short arm and 5'-terminus of this base sequence : 128757820
  Distance between 3'-terminus of neighbour sequence of sequence listing upward to telomere on chrosomal short arm and 5'-terminus of this base sequence : 51642
agcttgaccaacatagtgaaaccctgtctctactaaatacaaaaattagccaggcgtggtggcgcacgtctgtaatcccagctgcttgggaggctgaggcaggagaattgcttgaacctgggaggcagaggttgcagttagctgagaatgcgccactgcactccagcctgggtgacagagcgatactccatttcaaaataataataataataataataaaaagtaaaacaaaagcttgcaaaggctcgtcattgccctgcatcctacaaaacccttcccccttcatccctctcaggccttggtggcagggcctgctctgtgggaccaaactctttgtcaggggaggagacgatggactacagactcc

SEQ ID NO: 5700 - DNA, 367 bp, Homo sapiens; identical to SEQ ID NO: 5699
  AC055752.9_69357
  Located on chromosome 3
  Distance between a terminus base of telomere on chromosomal short arm and 5'-terminus of this base sequence : 128757820
  Distance between 3'-terminus of neighbour sequence of sequence listing upward to telomere on chrosomal short arm and 5'-terminus of this base sequence : -367

SEQ ID NO: 5701 - DNA, 251 bp, Homo sapiens
  D3S1551
  Located on chromosome 3
  Distance between a terminus base of telomere on chromosomal short arm and 5'-terminus of this base sequence : 128802328
  Distance between 3'-terminus of neighbour sequence of sequence listing upward to telomere on chrosomal short arm and 5'-terminus of this base sequence : 44141
agctagtaccatgccctgctaagtgtgtgtgtgtgtgtgtgtgtgtgtgtgtgtgtgtgtgtgttttgtagaaggggtctttctgtgttgcccaggctggtctaaaacacctgggctcaagcaatcctcccacctcagcctcccaaagtgctgggattgcagacatgagccactgcactcagccctttaacttaaatgcggatgttttgtagaaataaaaaaagaaagtacaagaattgcctgtaattgca

SEQ ID NO: 5702 - DNA, 401 bp, Homo sapiens
  AC025571.14_106746
  Located on chromosome 3
  Distance between a terminus base of telomere on chromosomal short arm and 5'-terminus of this base sequence : 128965816
  Distance between 3'-terminus of neighbour sequence of sequence listing upward to telomere on chrosomal short arm and 5'-terminus of this base sequence : 163237
gtccttgtgtaaaggacctaattagtaaataataacagatatcagtcactcttgaggcttcacaacagcaggtaaacagggcctaattaagggtttattggttttccctgtgctggcctcacgggacacatctaaccacatggaacacgtgtgtgtgtgtgtgtgtgtgtgtgtgtgtgtgtgtgtgtagggagttggtggtatggcggagcacgtgacatatacccacagtacaccaagtggagtgaaaaggagacccaacaatacagcagactgcagccctggagtagcctcagcatctgctttaaaacaagcagccggatgcagtggctcacacctggaatcccagcactttgggaggccaaggtgggaatatcacttgagtccaggaattcaagacc

SEQ ID NO: 5703 - DNA, 418 bp, Homo sapiens
  AC025571.14_120433
  Located on chromosome 3
  Distance between a terminus base of telomere on chromosomal short arm and 5'-terminus of this base sequence : 129080699
  Distance between 3'-terminus of neighbour sequence of sequence listing upward to telomere on chrosomal short arm and 5'-terminus of this base sequence : 114482
cacgactctaatcctagcactttgggaggccaaggcaggcggatcacgaggtcaagagatcgaaaccatcctggccaacgtggtgaaaccctgtctctactaaaaatacaaaaattagctaggcgtggtggtgtgtgcctgtagtcccagctacttgggaggctgaggcaggagaattgcttgaacccagaaggtggaagttgcagtgagccaaggttgcaccactgcactccaggcctggcaacacagcaatactctgtctcaaaaaaaataaaataaaattatttatatatatatatatatatatatatgagtttgcccaaagctcatagttgtagcagtctgctcgttgtattctaccatgcagcaatgtagcagatatgacatgggtggcaccctcaagacatagtcaactgca

SEQ ID NO: 5704 - DNA, 381 bp, Homo sapiens
  AC023601.10_74934
  Located on chromosome 3
  Distance between a terminus base of telomere on chromosomal short arm and 5'-terminus of this base sequence : 129099397
  Distance between 3'-terminus of neighbour sequence of sequence listing upward to telomere on chrosomal short arm and 5'-terminus of this base sequence : 18280
atttgctgagcactgttctaatttcttttcttttcttttcttttctttttctttttttttttttttagacagggtcttactctgtcacccaggctggagtgcagtggtgcaatcatggctcactgcagcctcaacctcccaggctcaagcaatccttccaccttagcctcccaagaagctaggaccacaggcatgtgccaccatgcctggctaatcttggaaaatcttttgtagagatagggcctctatgttttccaggctggtcttgaattcctgggctcaagcactcctcctgcctagcctcccaaagtgctaagataactggtgtgagccactgcgcccagctcttatttctttatagacattgtctcattgaggtct

SEQ ID NO: 5705 - DNA, 440 bp, Homo sapiens
  AC023601.10_119699
  Located on chromosome 3
  Distance between a terminus base of telomere on chromosomal short arm and 5'-terminus of this base sequence : 129165757
  Distance between 3'-terminus of neighbour sequence of sequence listing upward to telomere on chrosomal short arm and 5'-terminus of this base sequence : 65979
aagccaaggtgagacaatcacttgagtccaggtgtttgagaccagcctggataacagtgagactccacatctacaaaaatttttttaaaaaatagccgggcatggtagcatgtgtccgtaatcccagctactcaggttgaggtgggaggaacgcttgaaccaggagtttgaggctgcattgagctatgatggcactaactgcactccagcctggaatgacagtgagactctatctcaaaacaacaacaaatacacacacacacacacacacacacacacacacggtaaaaaaaagttttaaaatttttttttgatgaataatgtttttaatgaaaaatgtctttttcatgatagtataagctatgtctgtctgcctactttttctttctcatattaatatacatgtgaagagaatgctctctggaatgacatttaactaa

SEQ ID NO: 5706 - DNA, 192 bp, Homo sapiens
  AC020631.8_123751
  Located on chromosome 3
  Distance between a terminus base of telomere on chromosomal short arm and 5'-terminus of this base sequence : 129165942
  Distance between 3'-terminus of neighbour sequence of sequence listing upward to telomere on chrosomal short arm and 5'-terminus of this base sequence : -255
atgatggcactaactgcactccagcctggaatgacagtgagactctatctcaaaacaacaacaaatacacacacacacacacacacacacacacacacggtaaaaaaaagttttaaaatttttttttgatgaataatgtttttaatgaaaaatgtctttttcatgatagtataagctatgtctgtctgccta

SEQ ID NO: 5707 - DNA, 380 bp, Homo sapiens
  AC023165.11_158927
  Located on chromosome 3
  Distance between a terminus base of telomere on chromosomal short arm and 5'-terminus of this base sequence : 129191930
  Distance between 3'-terminus of neighbour sequence of sequence listing upward to telomere on chrosomal short arm and 5'-terminus of this base sequence : 25796
atgctcagaatggtcctataactaaacccacaggagcagtgtggagcatggacttggagccacacagccataggttcaagtcctgggctagggcttagtgctgtgtgaactttggcaagacatgatacatttcttcttttttgaattgacaaaaaaatatatacacacacacacacacacacacacttatggtgtacaacgtgatgttatgaaatatgaatatactgtggaatgactaaatcaagctaattaacatatgcatcacctcacacatttatttgtggtaagaacaaagacaggaaaccttctaaccctcagtctcagctggaagatgggaagtaaatgagataatgaatgtaaagcactggaatacagtaagt

SEQ ID NO: 5708 - DNA, 173 bp, Homo sapiens
  DISO7_10009723
  Located on chromosome 3
  Distance between a terminus base of telomere on chromosomal short arm and 5'-terminus of this base sequence : 129203175
  Distance between 3'-terminus of neighbour sequence of sequence listing upward to telomere on chrosomal short arm and 5'-terminus of this base sequence : 10865
aacagaagacgagctatcccaaaataaaatttacatttcacaacctagatttcataccattacacacacacacacacacacacacacatacacacacacacaggcaataatatgaaatattagtctatatgaaagaaatacaatgaaatccctacatatcatgtgtctccaat

SEQ ID NO: 5709 - DNA, 124 bp, Homo sapiens
  D3S3558
  Located on chromosome 3
  Distance between a terminus base of telomere on chromosomal short arm and 5'-terminus of this base sequence : 129319701
  Distance between 3'-terminus of neighbour sequence of sequence listing upward to telomere on chrosomal short arm and 5'-terminus of this base sequence : 116353
tcttccggtttcaagactgtgtgtgtgtgtgtgtgtgtgtgtgtgtgtgtgtgtgtgtgtgtgtgtgtgttttgagacagggtcttgctctgttgcccaggctggagtgcaatggggtaatcat

SEQ ID NO: 5710 - DNA, 213 bp, Homo sapiens
  D3S3519
  Located on chromosome 3
  Distance between a terminus base of telomere on chromosomal short arm and 5'-terminus of this base sequence : 129408072
  Distance between 3'-terminus of neighbour sequence of sequence listing upward to telomere on chrosomal short arm and 5'-terminus of this base sequence : 88247
cagagtaaaaaactggcctcacaaaggtaggctaagatacaaagggaaacacactattcatttgttatggattctgctaggaattatttcccttcattatatatgtgtttgtgtgtgtgtgtgtgtgtgtgtgtgtgtgtgtgtgtgtgtggcacaatactagaaaaaaaggatagagataattatctggcataataggtataagcaacagct

SEQ ID NO: 5711 - DNA, 169 bp, Homo sapiens
  D3S3552
  Located on chromosome 3
  Distance between a terminus base of telomere on chromosomal short arm and 5'-terminus of this base sequence : 129630587
  Distance between 3'-terminus of neighbour sequence of sequence listing upward to telomere on chrosomal short arm and 5'-terminus of this base sequence : 222302
aacttgattgcccccctgggacccacactctatgcagcccccactctgctcatttcagagggatgttgtgtgtgtgtgtgtgtgtgtgtgtgtgtgtgtgtgtgtgtgtaagaagacagtgatggcagttttgttactcagtgtcccctgacagacatttgggagtggc

SEQ ID NO: 5712 - DNA, 412 bp, Homo sapiens
  AC080133.6_4729
  Located on chromosome 3
  Distance between a terminus base of telomere on chromosomal short arm and 5'-terminus of this base sequence : 129889978
  Distance between 3'-terminus of neighbour sequence of sequence listing upward to telomere on chrosomal short arm and 5'-terminus of this base sequence : 259222
ttccatcttaagcacagctagcttgagggcctccagtgatgccaaaacagctttttaattttcatttttgtttttatctctgcctgtctatgtctggctccatttttcaggcagaaattttataagcatcagaggaaacagccactggcaaccccagacatacaatcccagcagaaacagtgtttctccctcaccacatttaaagaatattttcagagaggattggtggtctgccttgggtcacattccaactgccccagccaaataggatgtcattagtagtccagccaggaccgtgtggctatcctggtgactccgtgtgtgtgtgtgtgtgtgtgtgtgtgtgtgtgtgtgtgtgtgtgtggtgtggccagtggaaggagggcagaccttaattggtaggttcaacagg

SEQ ID NO: 5713 - DNA, 369 bp, Homo sapiens
  AC023593.10_67348
  Located on chromosome 3
  Distance between a terminus base of telomere on chromosomal short arm and 5'-terminus of this base sequence : 130085002
  Distance between 3'-terminus of neighbour sequence of sequence listing upward to telomere on chrosomal short arm and 5'-terminus of this base sequence : 194612
ccacaagtaatagctttccattcttcttcctggagcatccacaagatgtttttgtgggggagaaaccagctaatttcagctcctctattaactagctgtttgaccttaatcccactaggcctcagttatttcatttgtaaaacaagagggttggattacaaattttgtgtgtgtgtgtgtgtgtgtgtgtgtgtgggagaaaccagctaatttcagctcctctattaactagctgtttgaccttaatcccaccaggcctcagttatttcatttgtaaaacaagagggttggattagactactaattatttattcaaacctttattgtgtccccatcatgtgtaaaaggttgtgctaggcactggaatta

SEQ ID NO: 5714 - DNA, 154 bp, Homo sapiens
  D3S3607
  Located on chromosome 3
  Distance between a terminus base of telomere on chromosomal short arm and 5'-terminus of this base sequence : 130244584
  Distance between 3'-terminus of neighbour sequence of sequence listing upward to telomere on chrosomal short arm and 5'-terminus of this base sequence : 159213
acaggctcaggcccacagacacaagacagaagagcacacacacacacacacacacacacacacacacacacacttcaaatggtttaaacttgtgctgcaaaaaaagtacacgccctttgacctaaaaattccgtttctgggaagctattcttag

SEQ ID NO: 5715 - DNA, 378 bp, Homo sapiens
  AC069232.9_239263
  Located on chromosome 3
  Distance between a terminus base of telomere on chromosomal short arm and 5'-terminus of this base sequence : 130407273
  Distance between 3'-terminus of neighbour sequence of sequence listing upward to telomere on chrosomal short arm and 5'-terminus of this base sequence : 162535
cttgacctcatactaaagtttcaccatcaaaggcaaatgaggtggtagttatgtttaggtggggaaagtccagtgaagggttgggtaactgcagaaactgctacatatgtatagatatttccaggtaatttaggcaaggttgttggggagggaagcaaactacacagcctttctaaacaacagcatttgtgtgtgtgtgtgtgtgtgtgtgtgtgtgtgtgtgtgttgggcgggggtgggtgggtgttctgttttttaattgactactttgagtcagagaagctacacggtgtgtactggttaagggtactgaccctaggagctgaaacacttcttggacttacaagctctgtggcctggaacaagttacttagcctt

SEQ ID NO: 5716 - DNA, 378 bp, Homo sapiens; identical to SEQ ID NO: 5715
  AC073357.3_67688
  Located on chromosome 3
  Distance between a terminus base of telomere on chromosomal short arm and 5'-terminus of this base sequence : 130407273
  Distance between 3'-terminus of neighbour sequence of sequence listing upward to telomere on chrosomal short arm and 5'-terminus of this base sequence : -378

SEQ ID NO: 5717 - DNA, 267 bp, Homo sapiens
  AC016959.11_72374
  Located on chromosome 3
  Distance between a terminus base of telomere on chromosomal short arm and 5'-terminus of this base sequence : 130630702
  Distance between 3'-terminus of neighbour sequence of sequence listing upward to telomere on chrosomal short arm and 5'-terminus of this base sequence : 223051
ctgagaggtagaagtagcaatgagccgagatcgcaccattgcactccagcctgggtgacacagagagacttcatgtcaaaacaaaacaaaacaaaacaaaacaaaaaacaaaaaaatcaaaaggaataaaagataaggccttgggtaagcataggcatagatgtagaataaaggtgaccaaaaataaataaataaataaataaataaataaataaataagtaaaaataaagaaaaagaaaagataaggcttggagacacctgcattc

SEQ ID NO: 5718 - DNA, 214 bp, Homo sapiens
  DISD22_0002968
  Located on chromosome 3
  Distance between a terminus base of telomere on chromosomal short arm and 5'-terminus of this base sequence : 130796847
  Distance between 3'-terminus of neighbour sequence of sequence listing upward to telomere on chrosomal short arm and 5'-terminus of this base sequence : 165878
attcaattctttggaggaccctgaataaatgctcaagtccatctgttcatctgtccatccatccatccaccattccatccatccatccatccatccatccatccatccatccatccagacatgcatacatccatccacccaccttaccatctatccacccaccacccacccatctatccatccaacccactctcttatgcacccagctatcatc

SEQ ID NO: 5719 - DNA, 431 bp, Homo sapiens
  AC016924.13_130177
  Located on chromosome 3
  Distance between a terminus base of telomere on chromosomal short arm and 5'-terminus of this base sequence : 131172391
  Distance between 3'-terminus of neighbour sequence of sequence listing upward to telomere on chrosomal short arm and 5'-terminus of this base sequence : 375330
gatgactaaatgcaatacctgatcctaaacctgatcctgcactgaaggaaagaaatactatgaaaggcatgatgagatcaacagacaaaattggcatatagacattggacttgagaaagaaatatatcaatgtaaaagccactgaaatcagtaacagcacaataaatgaaaatgccttattgttagtaaatacacactggaataggggtaaaggcctgtgatttatgcaacttaccctgaaatggttcagaaagaaattttacatatatatatatatatatatagatagatagatagatagatagatagatatgtagatatatatatgtatatatacatgtatgtgtgttcatgtatatacatgcctatgtgtgtacatgtatacacacacatacatatagacagagaagatagtaaagcaactgtggcaa

SEQ ID NO: 5720 - DNA, 169 bp, Homo sapiens
  DISO7_10001225
  Located on chromosome 3
  Distance between a terminus base of telomere on chromosomal short arm and 5'-terminus of this base sequence : 131206799
  Distance between 3'-terminus of neighbour sequence of sequence listing upward to telomere on chrosomal short arm and 5'-terminus of this base sequence : 33977
tctcatggctaaagttctgaagtaaaagctataggatctgtgtgtgtgtgtgtgtgtgtgtgtgtgtgtgtgtgtgtgtatttaaaaggattttataatagacttctataattttgtttaaatggcaaattaaatccattttaatttccctctagcaaaccagactgtc

SEQ ID NO: 5721 - DNA, 167 bp, Homo sapiens
  D3S1589
  Located on chromosome 3
  Distance between a terminus base of telomere on chromosomal short arm and 5'-terminus of this base sequence : 131345429
  Distance between 3'-terminus of neighbour sequence of sequence listing upward to telomere on chrosomal short arm and 5'-terminus of this base sequence : 138461
cattttgtgctatgtattttttactacaattatgtgtgtgtgtgtgtgtgtgtgtgtgtgtgtgtgtgtatgacatgtatctctataaaggggagggccccatcatcacacacagtcccccaggcttccttcccatccccatctccagttccaccgtagccagcatt

SEQ ID NO: 5722 - DNA, 420 bp, Homo sapiens
  AC016924.13_137009
  Located on chromosome 3
  Distance between a terminus base of telomere on chromosomal short arm and 5'-terminus of this base sequence : 131356667
  Distance between 3'-terminus of neighbour sequence of sequence listing upward to telomere on chrosomal short arm and 5'-terminus of this base sequence : 11071
agagtattgccatcttataccatatgcgatccatgaacatgggatgtccttccatttttaagttcttcaatttttttcaaccaagctttgtagttttctgagtataagttttacacattacattgtgatattgtgatatacatatataaatatatttatatatatatatatatatatatatagtttttgtcctatttcctgacatacaactcctaaaaccctcagaatctccagcgtgataaggatgtcttttgtatgctaatgagatgactggtggatagcagcccctaagtagtttgaagatgtgggggtgatcacaggaaaaacatgggcatgattagagggttgggacttttcagccccacccccaacctccaaagaggggagagaagctgaaggttaagttgatcaacagtgacc

SEQ ID NO: 5723 - DNA, 238 bp, Homo sapiens
  chr3.fa.O7frz.144247939
  Located on chromosome 3
  Distance between a terminus base of telomere on chromosomal short arm and 5'-terminus of this base sequence : 131431104
  Distance between 3'-terminus of neighbour sequence of sequence listing upward to telomere on chrosomal short arm and 5'-terminus of this base sequence : 74017
tacaacctaaatgatacctgaaactagtgtaaagactaccttccccgggctcctggggctaaatcacgccctcccggggagcacccctgatgctcacatctcctacccttcctcctgtatctggatcccaccctagcctcctcagcaccatggtccctccagcttgccttctgcctctacacacactctctctctgtctctctctctctctgtatgtctctttcatttcctctacgcc

SEQ ID NO: 5724 - DNA, 441 bp, Homo sapiens
  chr3.fa.O7frz.144339662
  Located on chromosome 3
  Distance between a terminus base of telomere on chromosomal short arm and 5'-terminus of this base sequence : 131462107
  Distance between 3'-terminus of neighbour sequence of sequence listing upward to telomere on chrosomal short arm and 5'-terminus of this base sequence : 30765
cgtgactcacgcctataatcctaggactttgggaggtcgaggcgggcggattgcttgagtccaggagttccagaccagtctagacaacagggcagtttcgcctgtctctacaaatatacaaaaattagccaggcatggtggtgtgtgcctgtagttagtcccagctacttgggaggctgaggtgggaaaattgcttgagcctaggaggtggaggctgcagtgagccaagattgcacactgcgctctagcctgggcaacagaacaagaccctgtctcaataaataaataaataaataaataaataaataaataaataaataaaaatatgcctgtgtcttttgtgtctgtacaacaagtgtatggccccaccctgcctgccaaatagtgtctgtgcccccagaggcatggctgcatagactgtgaataggtagctttggtctc

SEQ ID NO: 5725 - DNA, 427 bp, Homo sapiens
  AC063919.6_29430
  Located on chromosome 3
  Distance between a terminus base of telomere on chromosomal short arm and 5'-terminus of this base sequence : 131466544
  Distance between 3'-terminus of neighbour sequence of sequence listing upward to telomere on chrosomal short arm and 5'-terminus of this base sequence : 3996
gaacagtgtcttaaacaggagactgtctctctccctctggcctcccacctgctgagtgtcagggatggggatggtaacccagtgtggggcccaggctcctcccactttgtggctctgccattgctcagtcacagccctcactcgcgtggcccaagatgactcaaacacacacacacacacacacacacacacacacacacgggctccagcccctggggagaggaaggagggcaggaaggcacagagctgctctataagggaatccggcagaaggagtcatcatcagcccagggtgtgatgtctccctgccagcaggttgggagcctggagacctgcaggctaagccctgctctaactggctgcagagatctgagcaagtcaccaccctccaccggtctctgctttctcctctgcaccaagagttcag

SEQ ID NO: 5726 - DNA, 423 bp, Homo sapiens
  AC024558.12_104746
  Located on chromosome 3
  Distance between a terminus base of telomere on chromosomal short arm and 5'-terminus of this base sequence : 131606179
  Distance between 3'-terminus of neighbour sequence of sequence listing upward to telomere on chrosomal short arm and 5'-terminus of this base sequence : 139208
aagcatgattcaacatcactacacttgcactatttcttgatcgcagtccagtaaaacccacttcagatttctgatctctggaactgcaggagaataaatatgtgttgttttaagccactacacttgtggcaatttattacagcagacatgggaagctaatacaggcagtaacagaactctgcctcgggcatcagggcacctgtgccaggcgcacgcctgtcctgcatggtggctgagcaccgaaatgaagggatgccagcctgcaacgttgttcagcccacagagcagggtgtgtgtgtgtgtgtgtgtgtgtgtgtgtgtgttcagcctaggacttactttcattctaacctggcagtcagcttgtggggcagtagctcacttttaaacctcacccatctgaaagtttctgactgtcactat

SEQ ID NO: 5727 - DNA, 233 bp, Homo sapiens
  Z66752
  Located on chromosome 3
  Distance between a terminus base of telomere on chromosomal short arm and 5'-terminus of this base sequence : 131855153
  Distance between 3'-terminus of neighbour sequence of sequence listing upward to telomere on chrosomal short arm and 5'-terminus of this base sequence : 248551
tatccaggtgttggtggcactgttgtctatgtgtgtgtgtacatctgtgtgtgcatgtgtgtgtgtgtgtgtgtgtgtgtgtgtgtagacacagacattccttatgcctggtcctggatcaggtgctttgagtaggttttctcatttgattctcacagtgcccctttaggtaggggcagtgttgaccctttttgcagatgactgtgaggctctgggaggttagtaaactgtcc

SEQ ID NO: 5728 - DNA, 428 bp, Homo sapiens
  AC017042.7_177240
  Located on chromosome 3
  Distance between a terminus base of telomere on chromosomal short arm and 5'-terminus of this base sequence : 131863263
  Distance between 3'-terminus of neighbour sequence of sequence listing upward to telomere on chrosomal short arm and 5'-terminus of this base sequence : 7877
agttactcagcattttggatgtacataatgctgaaattgtatgctttacaatggttaaaaatggcatattttatttatattttaccacagagaataaagctaaaaacaactaactctgcttctatatagctctgctcccctatttatgttatcgtcacaaattatatttttatacattgtgtcccaataatatagatttataatttttttgttttctagacaattatatcatttatttaaaatgtttactctaagaaatatatatatacacacacatatatacacatacatacatacatacatgcatatatatatatatatatatatataaatatatgaaataatacaattacagcactaaaccaggcaccttcaaccaaatcacaaccttctctttgattccccttcatgctaatcatctttcaaat

SEQ ID NO: 5729 - DNA, 432 bp, Homo sapiens
  chr3.fa.O7frz.143854807
  Located on chromosome 3
  Distance between a terminus base of telomere on chromosomal short arm and 5'-terminus of this base sequence : 131999189
  Distance between 3'-terminus of neighbour sequence of sequence listing upward to telomere on chrosomal short arm and 5'-terminus of this base sequence : 135498
tactgttctattcaaagcctagagatcactcaattaaaaataaatcagctggctgggcgctgtggctcatgcctgtaatcccagcactttgggaggccagccgagacagcagatcacttgaggccaggagttcgagaccagcttggcaaaaccccatctctactaaaaatacaaaattagctgtgcataatggcgggtccctgtaatcccagctacttgggaggctgaggcaggagaatcacttgaacccaggtggtggacgttgcagtgagccaagattgcgccactgcactccagcctgggagacagagcaagactcggtctcaaaaacaaaacaaaacaaaacaaaacaaaacaacaacaacaacaaaaaaagaaaaacaaaaacaaaaaaacagctgaagagactttcaggaaataagaactatttga

SEQ ID NO: 5730 - DNA, 124 bp, Homo sapiens
  DISO7_10001221
  Located on chromosome 3
  Distance between a terminus base of telomere on chromosomal short arm and 5'-terminus of this base sequence : 132065683
  Distance between 3'-terminus of neighbour sequence of sequence listing upward to telomere on chrosomal short arm and 5'-terminus of this base sequence : 66062
cacgaatgtgctgttgtgtgtgtcagtgtgcgcacgagagagagagagagagagagagagagaaatctggaaggagaccaaccaatccaaaattacgctcaggaggctgggccagtgactgact

SEQ ID NO: 5731 - DNA, 182 bp, Homo sapiens
  HUMUT7589
  Located on chromosome 3
  Distance between a terminus base of telomere on chromosomal short arm and 5'-terminus of this base sequence : 132253649
  Distance between 3'-terminus of neighbour sequence of sequence listing upward to telomere on chrosomal short arm and 5'-terminus of this base sequence : 187842
ggatggatggatagagagataaatgatagatagatagatagatagatagatagatagatagatagaagatttactgtgagaattggctcacacaattatagaggttcagaggtccatgatatgccatctgcaagctggagaaccagggaagacatggtataatttagtctgagtccaaggcc

SEQ ID NO: 5732 - DNA, 253 bp, Homo sapiens
  chr3.fa.O7frz.146353646
  Located on chromosome 3
  Distance between a terminus base of telomere on chromosomal short arm and 5'-terminus of this base sequence : 132397789
  Distance between 3'-terminus of neighbour sequence of sequence listing upward to telomere on chrosomal short arm and 5'-terminus of this base sequence : 143958
tgaattatgctctcctgaaacattgctctgggggagacaaggggtaggtggggtggcagctgggaagggtggggaagaggggtgtgtgtgtgtgtgtgtgtgtgtgtgtgtgtgtgtgtgtgtaacgaggactgggtttgtttgtaagatagagagcaaacaggaggggagggagcatgcgggggctgggacaggaaggtctgattagggaaccccagatgctgaaggaggcagatgaacaaggtcagctttg

SEQ ID NO: 5733 - DNA, 467 bp, Homo sapiens
  chr3.fa.O7frz.145487031
  Located on chromosome 3
  Distance between a terminus base of telomere on chromosomal short arm and 5'-terminus of this base sequence : 132525047
  Distance between 3'-terminus of neighbour sequence of sequence listing upward to telomere on chrosomal short arm and 5'-terminus of this base sequence : 127005
aatttgtaagaattcattgtcaacacttaaaaattggaatgtttggccaggcggggtgactcatacctgtaatcccagcactttgggaggctgaggcagggtgatcacttgagatcaggagttcgagatcagcctagccaacatggtgaaactccatctcttctaaaaatacaaaaattagccgggcatagtggcaggcacctgtgatcccagctacttgggaggctgaggcaggagaattgcttgaacccgggaggcggaggttgcaatgagtgaagatcgcaccactgcactccagcctggggacagagcgaaactctgtctaaaataataataataataataataataataataataataataataatattggaatgtttgccttgggcaatgccatcttggggtcagaaacctcgaaatgggatctcttgggacagacccaggcatggcttccaatgaacata

SEQ ID NO: 5734 - DNA, 371 bp, Homo sapiens
  AC011311.11_170616
  Located on chromosome 3
  Distance between a terminus base of telomere on chromosomal short arm and 5'-terminus of this base sequence : 132620835
  Distance between 3'-terminus of neighbour sequence of sequence listing upward to telomere on chrosomal short arm and 5'-terminus of this base sequence : 95321
gaagagtggagaacaggactaaaaacagcacgtaaaaagcactagatggtgatgacgtggtagagagcagaggccagaggacttggagcctgaacttgagtgctgacttccaagaacaggctggcaggcctgatgtgtttagtctcacccactgctgtgtgtgtgtgtgtgtgtgtgtgtgtgtgtgtgtacatcaatgcctgcagcttcagggtcagcacctgtgggagggtggggcttccagcagtcacagctccttcattttttgtccttcctaactgtcctggtctgaagggcttggagctcggagcattgttgccagggcccattacatgatgctcaccctacagagcttcatacagtggccatgt

SEQ ID NO: 5735 - DNA, 391 bp, Homo sapiens
  chr3.fa.O7frz.136448111
  Located on chromosome 3
  Distance between a terminus base of telomere on chromosomal short arm and 5'-terminus of this base sequence : 132696202
  Distance between 3'-terminus of neighbour sequence of sequence listing upward to telomere on chrosomal short arm and 5'-terminus of this base sequence : 74996
gagtaagctttgttctcaggtctattagcacacaaggatgaggatgttaattgcaactctgttgtaattgttgggagttagaggcagtggaaggtctaacactgggaggagaataagatgtggtggatgcttagggtgggacttggacaacagcagggattaccaatctggtggggagcaatgagaaatggagagattgtacacacacacacacacacacacacacacacaaaacatacacatacatcacaccctcggtgttgggtggaaaaggtaacaaacagaatgagatctgtagtacaagggcatgtatgtacttgcttatataaatgaatgccacatatttgccagggatagaaagccagccaggacctggaccaaatgcattaga

SEQ ID NO: 5736 - DNA, 233 bp, Homo sapiens
  Z67486
  Located on chromosome 3
  Distance between a terminus base of telomere on chromosomal short arm and 5'-terminus of this base sequence : 132730538
  Distance between 3'-terminus of neighbour sequence of sequence listing upward to telomere on chrosomal short arm and 5'-terminus of this base sequence : 33945
catcacgcccaggtaatttttgtatttttagtagagatggggttttgccatattggccgggctggtttcgaactcctgacctcaggtgatccacctgcctcggcctcccagagtgctgggattacaggcgtgtaccaccgcccctggcccatcagtgatgtttgaactgttatttagcacacacacacacacacacacacacacacacaaaggaacaactctggtggaagtgg

SEQ ID NO: 5737 - DNA, 291 bp, Homo sapiens
  AC027635.4_105211
  Located on chromosome 3
  Distance between a terminus base of telomere on chromosomal short arm and 5'-terminus of this base sequence : 133074301
  Distance between 3'-terminus of neighbour sequence of sequence listing upward to telomere on chrosomal short arm and 5'-terminus of this base sequence : 343530
tttactgagtctgtaccattgatctgtttattcttacagcagaaccacagggtttgaacgattgtgataatagaatcttgtttaatatcagaaagcatttatctctctctctctctctctctctcacacacacacacacacacacacacacacacacacctcgctttatttttcctaatttttgacttcttctgctgatcttattagtttttccagataaagtttggaatcatttgtcattttgcctttaaaaaaaacccagcagagttttgatcgaaccatcctgtatga

SEQ ID NO: 5738 - DNA, 539 bp, Homo sapiens
  chr3.fa.O7frz.145076022
  Located on chromosome 3
  Distance between a terminus base of telomere on chromosomal short arm and 5'-terminus of this base sequence : 133283753
  Distance between 3'-terminus of neighbour sequence of sequence listing upward to telomere on chrosomal short arm and 5'-terminus of this base sequence : 209161
agtggtgctatcatagctcactgcagccttgaactcctgggcttaagcaatcctcttttttttgagatggagtttcgctcttgttgcccaggctggagtccaatggcatgatctcggctcactgcaacttccgcctccagggttgagtcttgcctcagactctcgagtagctgggattacaggcgactgccaccatgcccagctatttttgtatttttagtagagacaggattttaccatgttggccaggctggtctcgaactcctgacctcaggtgattcacctgcctcggcctcccaaagtgttgggattacaggcatgagccaccgcacccggcctcaagcaatcctcttgctcagcctcccaaagcactgagattacaggtgtgatccaccacagccagccaagaatatatatatatatatatattcttcaattacaaaagcaatacgtactcaatgtaaaaagttaaaataataccgaagtatgtataataagtgcagttccctcacctccccttgtctcactaaatcctgaca

SEQ ID NO: 5739 - DNA, 348 bp, Homo sapiens
  chr3.fa.O7frz.144947628
  Located on chromosome 3
  Distance between a terminus base of telomere on chromosomal short arm and 5'-terminus of this base sequence : 133301703
  Distance between 3'-terminus of neighbour sequence of sequence listing upward to telomere on chrosomal short arm and 5'-terminus of this base sequence : 17411
cagcaagagtgaaactttgtctctctctctctttctgtctctggcacatacacacacacacgcacacacacgggcctcctgtggtctcacttggtcctctttgtgacagtgccattgttaccatttacagaggaggaactgaagctcatggttgagcctctcacttgcccactttgccaaaccctggtagggatgggattagaggctccttttctttcgtgaaatgagacaacgatctgggggatcgttggaaggattaaaatgagtattcagattacaatgctggattcttaatagtgtcctctgttaataataataataatgtagtagcaacagtcacgtagtctt

SEQ ID NO: 5740 - DNA, 328 bp, Homo sapiens
  AC024933.20_231884
  Located on chromosome 3
  Distance between a terminus base of telomere on chromosomal short arm and 5'-terminus of this base sequence : 133485649
  Distance between 3'-terminus of neighbour sequence of sequence listing upward to telomere on chrosomal short arm and 5'-terminus of this base sequence : 183598
tggaaactgcaccagttacaggcctgcaggccagccctgagctgccggtgggttttaagtcctgcagtttttctttaatctgaagttttatggctccaatgttcaaaacacacacacacacacacacacacacacacacacacacacacacacacacacgagatgacgcataaaaaatgctgatgcccacatctcttcaaaccgtcttgcagccccaggcccccattctccttgctgcagcaactggagccgctggtgctcccaggcagggccaccgcacctccagcaccggctcctcacctcctgcctctcaggcagatttagatca

SEQ ID NO: 5741 - DNA, 455 bp, Homo sapiens
  AC022993.4_95139
  Located on chromosome 3
  Distance between a terminus base of telomere on chromosomal short arm and 5'-terminus of this base sequence : 133620640
  Distance between 3'-terminus of neighbour sequence of sequence listing upward to telomere on chrosomal short arm and 5'-terminus of this base sequence : 134663
gatgcagtaagcacttcctaaaaagtgttcttctgtttccttcatagaaccctcagctacctcctgtcacctaccaggcaggaccgggtctggcctccttccaaatgctgtggcaccaccccacatgccaaaggtgagggccacagaatcaaagaaaagcctcttagccccgaccaagttctttctccttcctatctctccagcctcctcctcctccttcattaatacatccagcaagcactagctagggccagacctgttgctggctctaaaaatataaagacagggtttgtacctcctgccccacacccagcagcaagtgaactgtctgcctgctgaacatctctggcccttcctcaacagcagcctctcctgccctggggaaagaagcagccccctcctccgtgcccccgctgggtcccagggtatcccactgcctgtgttctttatgtcat

SEQ ID NO: 5742 - DNA, 395 bp, Homo sapiens
  chr3.fa.O7frz.147543956
  Located on chromosome 3
  Distance between a terminus base of telomere on chromosomal short arm and 5'-terminus of this base sequence : 133771432
  Distance between 3'-terminus of neighbour sequence of sequence listing upward to telomere on chrosomal short arm and 5'-terminus of this base sequence : 150337
  misc_feature (1)...(395): n = A,T,G or C
gctcatgcctgtaatcctagcactttgggaggctgaagcgggtggaccatctgaggtcaggagtttgagaccagtctggccaacatggcgaaaccccgtctctactaaaaatacaaaaaacagccgggcatggcgggcatgcgcctgtaatcccagctactcaggaggctgaggcagaagaatcgcttgaacccggggggtggaggttgcagtgagccggaatcataccagtgcactccagcctaggggacaaagtgagacagacaggcaggcaggcaggcagacaggcagccaggcaggcaggcaggcgggaaaacagacagacagacanacaacacnacacacacacacacacacacacacacacacacacactggcagtaatactcattcac

SEQ ID NO: 5743 - DNA, 349 bp, Homo sapiens
  AC022944.2_182070
  Located on chromosome 3
  Distance between a terminus base of telomere on chromosomal short arm and 5'-terminus of this base sequence : 133854080
  Distance between 3'-terminus of neighbour sequence of sequence listing upward to telomere on chrosomal short arm and 5'-terminus of this base sequence : 82253
agtttaacttctccgaatgaacccctgccccctcacggcccctgccgtgggtatttgccacatcttcccatcatctgtgctattacctgtgttaaaacacacacacacacacacacacacacacacacacacacacacacacacgtatacatttagaagaagagaagcctttatttcctgtaaaaggtgccagcctacaaggtggccatctgcaggctgggaagtgtgccaatggccgagcactttgaaagaggaggggttggggcaggagctttatgctgacctgtctggctaaacatacatattcaactggctacaggaggagctatgaatattcataaaggcactg

SEQ ID NO: 5744 - DNA, 112 bp, Homo sapiens
  DISD22_0002974
  Located on chromosome 3
  Distance between a terminus base of telomere on chromosomal short arm and 5'-terminus of this base sequence : 133936425
  Distance between 3'-terminus of neighbour sequence of sequence listing upward to telomere on chrosomal short arm and 5'-terminus of this base sequence : 81996
tcctctttatcctcagctctgctgagagagagagagagagagagagagagagagagagagagagagagtgtgtgtgtgtgtgtgtgtgtgttggggacaatcacttgcttca

SEQ ID NO: 5745 - DNA, 122 bp, Homo sapiens
  DID22N_0021231
  Located on chromosome 3
  Distance between a terminus base of telomere on chromosomal short arm and 5'-terminus of this base sequence : 134427807
  Distance between 3'-terminus of neighbour sequence of sequence listing upward to telomere on chrosomal short arm and 5'-terminus of this base sequence : 491270
acacctgagtgtaactactccttctgtgtgtgtgtatgtgtgtgtgtgtgtttgtgtgtgtgtgtgtgtgtgtgtgtatgtatattgagacttaggaaactagacataaaggctgatctcaa

SEQ ID NO: 5746 - DNA, 327 bp, Homo sapiens
  AC055870.2_59584
  Located on chromosome 3
  Distance between a terminus base of telomere on chromosomal short arm and 5'-terminus of this base sequence : 134543067
  Distance between 3'-terminus of neighbour sequence of sequence listing upward to telomere on chrosomal short arm and 5'-terminus of this base sequence : 115138
aacaggatcataggctatgataacatcaaaataagtcaatttttaacaaacaccgacttagttcaacattgggctaacttgccaaagttgtctttcttgagaaaaaatgctgtactgagatccctgaaaaacaaacaaacaaacaaacaaaaaaacagtctgcaatagtaattaccttacacaaaacacaatcttggcctatccctccgtctatctatctatgactctttggaagcaagaccttatattagcgttctggataaaccaaagagtagtggactttggatactaaaattctcctcctctactcctaagattcaaagctat

SEQ ID NO: 5747 - DNA, 406 bp, Homo sapiens
  chr3.fa.O7frz.149866592
  Located on chromosome 3
  Distance between a terminus base of telomere on chromosomal short arm and 5'-terminus of this base sequence : 134561725
  Distance between 3'-terminus of neighbour sequence of sequence listing upward to telomere on chrosomal short arm and 5'-terminus of this base sequence : 18331
gtaattgataaaccaagtaagcagattggccaggcatagtggctcaccgtggtaatctcagcactttaggaggctggggtgggcagatcacttgaggctaggagttcaagaccagcctggcctacatggcaaaaccctgtttctaccaaaactaccaaaattagctgggcttggtgacatgcacctgtagtcccagctactcaggagactgaggcacgggaatcactgcaacttgggaggtagaagttgcagtgagcagagatcgtgccactgtattccagcctgggtgatacagtgagactttgtctaaaaaaaaacaaaacacacacacacacacacacacacacacacgtaagcagatagatgtgacctcaacagttcagtactatcacctaatttgacctga

SEQ ID NO: 5748 - DNA, 439 bp, Homo sapiens
  AC055727.6_127545
  Located on chromosome 3
  Distance between a terminus base of telomere on chromosomal short arm and 5'-terminus of this base sequence : 134636307
  Distance between 3'-terminus of neighbour sequence of sequence listing upward to telomere on chrosomal short arm and 5'-terminus of this base sequence : 74176
tccgcttattcaagacctaagtttcctggtggccgtgccccccatggggtggctgtcatccaggcaggggtattcctggggagcccttcccttccctacctccaatgcacctacagggcccctactattaatagcagcacctctgcctggggctccctgagaggctggggtgggagaggggtggtccagcaggcagtaatcaatgtccccaaatggtggcaagtgtgtgtgaatatgtgtgccggtgtctgtgtgtgtgtgtgtgtgtgtgtgtgtgtgtgtgtctgtttgtgtttgtgtgtgtgtgtggtgggagtttctgcactgtgataggaggaaagcacaagtggttctgggatccagggcagaaggggctcctctgtgtccagggctcagggatgctccccagagtaccggatatctcagctaggactgaagg

SEQ ID NO: 5749 - DNA, 463 bp, Homo sapiens
  AC055870.2_120032
  Located on chromosome 3
  Distance between a terminus base of telomere on chromosomal short arm and 5'-terminus of this base sequence : 134699895
  Distance between 3'-terminus of neighbour sequence of sequence listing upward to telomere on chrosomal short arm and 5'-terminus of this base sequence : 63149
ttaagttgagatcatgaagcacctcgaatgtcagttaaagaagttcaaacagctaccatctgcttgctttgcaccagctggacatggggcaagattttgtttgaaagaaggagtttgaggcaggtgtcgtggcgtgtgcctgtaatcccagcctgagataggaggattgtttcagcccatgagttcaagactagcttgtgcaacatagcaaaatagaaagaaagaaagaaagaaagaaagaaagaaagaaagaaagaaagaaagaaagaaagaaaaagaagggagggagggagggaaggagggaaagaaaaaggaaggaaggaagagagggagggacagaaagaaaaagaaaggaaagcaaagcaaaggaaacgaaagaaagaaaaaagtttgaaaccagagctggccagcaccagggtttgtattaacaaaaataattggttcttctgacaaatgttcacca

SEQ ID NO: 5750 - DNA, 223 bp, Homo sapiens
  chr3.fa.O7frz.149520438
  Located on chromosome 3
  Distance between a terminus base of telomere on chromosomal short arm and 5'-terminus of this base sequence : 134825858
  Distance between 3'-terminus of neighbour sequence of sequence listing upward to telomere on chrosomal short arm and 5'-terminus of this base sequence : 125500
tgttgagtgaaagaatagagaaagtattttgagtttgtgtgtgtgtgtgtgtgtgtgtgtttacacaactggtgtcagaagtgggatttgctggccgtggccgtggctcatagaaacatgtgctttgggaagagaaagaatgagaggggccgggcacagtggctcatgcctgtaatcccagcactttgggaggccgaggcgggcagatcacgaggtcaacaga

SEQ ID NO: 5751 - DNA, 323 bp, Homo sapiens
  AC000378.1_6010
  Located on chromosome 3
  Distance between a terminus base of telomere on chromosomal short arm and 5'-terminus of this base sequence : 134871066
  Distance between 3'-terminus of neighbour sequence of sequence listing upward to telomere on chrosomal short arm and 5'-terminus of this base sequence : 44985
ctaatgtttgcaatgttaaatcacagatattgccaacatgaaatagtttccatatgctgtgttctcaatacacaccatttccaaagatatcccaagctgtagtcttaggaaactgtgatttttcttatttcatctcataggaatttggggagctatgggggatctccataaaatgagctccagaaagacacatgtgtgcacacacacacactcacacatgaaccacaccacaattgactctgtttatttgggacccatgattatcagaagtgctattttcaacaaatacttctgagaaataatctgaacacttaattggatgc

SEQ ID NO: 5752 - DNA, 167 bp, Homo sapiens
  DISO7_10001231
  Located on chromosome 3
  Distance between a terminus base of telomere on chromosomal short arm and 5'-terminus of this base sequence : 135111225
  Distance between 3'-terminus of neighbour sequence of sequence listing upward to telomere on chrosomal short arm and 5'-terminus of this base sequence : 239836
gctcttaatataatagttgcccagtatatatatatgtatatatatatatatatatattttaaactttgaattgaattttactgtatttatatttgattttcatatagctagttgtgtgagattaatctttactaggtagataaaagggttgaagcttattagttgtg

SEQ ID NO: 5753 - DNA, 130 bp, Homo sapiens
  DISO7_10001230
  Located on chromosome 3
  Distance between a terminus base of telomere on chromosomal short arm and 5'-terminus of this base sequence : 135242334
  Distance between 3'-terminus of neighbour sequence of sequence listing upward to telomere on chrosomal short arm and 5'-terminus of this base sequence : 130942
tctcatcataatctagggatgatgatacttgttctatagatactttttgtgttatgtttgggataagcaggggattgtgtgtgtgtgtgtgtgtgtgccccgctgtgtgtgtgtgaacatgcactgaatg

SEQ ID NO: 5754 - DNA, 131 bp, Homo sapiens
  DISO7_10001228
  Located on chromosome 3
  Distance between a terminus base of telomere on chromosomal short arm and 5'-terminus of this base sequence : 135285313
  Distance between 3'-terminus of neighbour sequence of sequence listing upward to telomere on chrosomal short arm and 5'-terminus of this base sequence : 42849
cacaactggaaacagttcttaagaaaactgtgaaatgaatagcattttagttttcaagatccaagtgtgtgtttttgtgtgtgtgtgtgtgtgtgtgtgtgttttaaatgctactcgtttgtgatgatagc

SEQ ID NO: 5755 - DNA, 342 bp, Homo sapiens
  chr3.fa.O7frz.148946884
  Located on chromosome 3
  Distance between a terminus base of telomere on chromosomal short arm and 5'-terminus of this base sequence : 135414316
  Distance between 3'-terminus of neighbour sequence of sequence listing upward to telomere on chrosomal short arm and 5'-terminus of this base sequence : 128872
gtaataaatgatcattggatgaatggaagtgaaaggaaataaatagtgactgtgatcaatgttgcattcacatggaacttatttgcttcaggaggtcagggggggctctgttgcatttttttcttgggtgtctttgtttgaaagaagccagactcctcttcttctgaagatgggattgaacacataagattaaaaccagttccatttgttcttctatcccaaactctgacagattatatgtgtgtgtgtgtgtgtgtgtgtgtgtgtgtgtgtgtgtgtgtattttttgttttgggaaggtagttgagataacctttccagatgttcaattgagtccgatca

SEQ ID NO: 5756 - DNA, 287 bp, Homo sapiens
  chr3.fa.O7frz.148820199
  Located on chromosome 3
  Distance between a terminus base of telomere on chromosomal short arm and 5'-terminus of this base sequence : 135593663
  Distance between 3'-terminus of neighbour sequence of sequence listing upward to telomere on chrosomal short arm and 5'-terminus of this base sequence : 179005
gatggtgctaaacattctacaattcatagaaaagcaacacacacacacccacacccacacacacccacacccacacacacccacacccacacacacccacacccacacccacacacacccacacccacacacacacgcacacacccacacacacacacacacacacacatacagagagagaattatcggtaacagaggctgagaaatcctgtcttataattttaagactctacaagtatttagaatacttaaactgtagggggaggaaccagaattatcggtaacat

SEQ ID NO: 5757 - DNA, 484 bp, Homo sapiens
  AL136504.2_177132
  Located on chromosome 3
  Distance between a terminus base of telomere on chromosomal short arm and 5'-terminus of this base sequence : 135680493
  Distance between 3'-terminus of neighbour sequence of sequence listing upward to telomere on chrosomal short arm and 5'-terminus of this base sequence : 86543
ttgcttaggatgaaattattgtaggattttctagttcctttgagtaactaaaaaagtcatgcagcctgctccaaaatttactcatatacagaggaaggtgcacacacacacacacacacacacacacacacacacacacacacaggtcatatataaagggatagtaggagtagaaaataatttctttttataatatcaccccatgacttccctgtgttcagtgaagaacttacacacagaaagaacttacctagtgagaaaaaaaaatcagggggaacctattctagatagaaaagtatggaaaccccctccaagcaggtatgatttaagctgaggcctaaagaatgaaaaagaaggcagctgcatacagggagaaggattgctattttttaaaggtacaaactcaaagagccaagagaacaggagtgaaaataaacgccaatcttccgcaaagaaatttctatcctctccttaatggagtaag

SEQ ID NO: 5758 - DNA, 340 bp, Homo sapiens
  AL136504.2_68431
  Located on chromosome 3
  Distance between a terminus base of telomere on chromosomal short arm and 5'-terminus of this base sequence : 135789096
  Distance between 3'-terminus of neighbour sequence of sequence listing upward to telomere on chrosomal short arm and 5'-terminus of this base sequence : 108119
agcaaaggactcttaacttctaacaagttctgaggtagtggatgtgatgctgtcctcctttcagaagctttgctgtatatctgtattcctgttgaggtgattcatgttaatgtattgaaggttttgagagcactgcagtagaggaagctgtttaactcttaactatttctgacttacttggccctagtcctctccctcacttgttcgtatgtatgtatgtatgtatgtatgtatgtatgtatatatgtatgtatgtgtgtatgtatctatactcataaaattgttttttttttcttttttctgtatgcttgggtaggtaaatactgtgtcaggagtgaag

SEQ ID NO: 5759 - DNA, 217 bp, Homo sapiens
  D3S1587
  Located on chromosome 3
  Distance between a terminus base of telomere on chromosomal short arm and 5'-terminus of this base sequence : 135893024
  Distance between 3'-terminus of neighbour sequence of sequence listing upward to telomere on chrosomal short arm and 5'-terminus of this base sequence : 103588
agggagacagagtgatggattacatatatatatgtgtgtgtgtgtttgtgtgtgtgtgtgtgtgtgtgtgtgtatgaacacacatagaaagagacagacagaaatagataactataagagaaaccaagagacactgaaacatctagagaggtggaggaagggccaccccagcaatattgctcaagattagttccatggctgcccttatagaactgta

SEQ ID NO: 5760 - DNA, 398 bp, Homo sapiens
  AC010210.18_62750
  Located on chromosome 3
  Distance between a terminus base of telomere on chromosomal short arm and 5'-terminus of this base sequence : 136067934
  Distance between 3'-terminus of neighbour sequence of sequence listing upward to telomere on chrosomal short arm and 5'-terminus of this base sequence : 174693
ctgaggtcaggagttcaagaccagccaggccaacatggtgaaaccccgtctctactaaaaatacaaaaattagccaggcattatggcgggtgcctgtaatcccagcttctcagaaggctgaggcaggagaatcgctttaacccaagaggtggaggttgcagcaagccaagatcacaccactgcactccagactgggtgagaagagcaagactccatctaagaaagaaagaaagagagagagagagagagagacagacagacagacagacagaaagaaggaaagaaagaaagaaagaaagaaagaaagaaagaaagaaagaaagaaagagagaaagaacagctaatttcccaaacatttaagaatgttaaagtttgtagattaccttggctcataatgt

SEQ ID NO: 5761 - DNA, 325 bp, Homo sapiens
  AC023757.4_194112
  Located on chromosome 3
  Distance between a terminus base of telomere on chromosomal short arm and 5'-terminus of this base sequence : 136325528
  Distance between 3'-terminus of neighbour sequence of sequence listing upward to telomere on chrosomal short arm and 5'-terminus of this base sequence : 257196
aatcttgattctgccacttactagtgtgttccttggagcactgtgcctcatctgtaaaagatactctattctgtaaaagaaataattgtgagctacttcaaaaggttattgtgtagattgcaccagatgataaatgtcaggcacttgaaacaatgttaagtgtccactaaatattagctactattgtctttatcattatcattgttgttattattattattattattattatagaaagatactggtaagagatcatcactcccccaatcactttgaacaactcagttgatcttggggcttagtcttaggcaagtaatgatacagg

SEQ ID NO: 5762 - DNA, 221 bp, Homo sapiens
  D3S3548
  Located on chromosome 3
  Distance between a terminus base of telomere on chromosomal short arm and 5'-terminus of this base sequence : 136370542
  Distance between 3'-terminus of neighbour sequence of sequence listing upward to telomere on chrosomal short arm and 5'-terminus of this base sequence : 44689
caaaggcagcagaatatgtatttaatctgtgtctgtaccattgttctaagaggctttaaaattattgaggaaaagaggatacatgaattgtgtgtgtgtgtgtgtgtgtgtgtacactctagttgtagtaatggtggtagtaatgatagggtatatttcaggccatgaaaagtgcagtcattaaagagacaaaattagtagtccactcttggacctggaag

SEQ ID NO: 5763 - DNA, 412 bp, Homo sapiens
  chr3.fa.O7frz.150343386
  Located on chromosome 3
  Distance between a terminus base of telomere on chromosomal short arm and 5'-terminus of this base sequence : 136441187
  Distance between 3'-terminus of neighbour sequence of sequence listing upward to telomere on chrosomal short arm and 5'-terminus of this base sequence : 70424
gcagtctaggctttagaacatctgcatgcccataatcccagctactcaggaggctgagaggcagcagaattgcttgaaccttggaggtggaggttgcggtgagctgagatggcgccactgcactccagcctgggcaacaagagcaaaaccccatctctctctctcacacacacacacacacacacacacacacacacacacgcacacacacacacacacacacaaaagaacatttgctactccacccccgccacagcccccttctgagggtttctctccatataacttgctataatggtatctcatgcccatgctcccctggccacagatgaaagacgagaaatgggtaccttgtttaaggacaaccaagctgtacattgaccagagcctatgaggtgacttgatgtagaag

SEQ ID NO: 5764 - DNA, 453 bp, Homo sapiens
  AC055754.10_75896
  Located on chromosome 3
  Distance between a terminus base of telomere on chromosomal short arm and 5'-terminus of this base sequence : 136656698
  Distance between 3'-terminus of neighbour sequence of sequence listing upward to telomere on chrosomal short arm and 5'-terminus of this base sequence : 215099
tccatgtgcagattatcctagggttagtaacgaagtggccaatgccagcagttagagttattgctgtctctatcatcaaagaacaagtgtaatagagcagtctttagtttccgagatccttaaacatcaggtggattgttttttgttggtgcgtgtgtgtgtgtgtgttgtgtgtgtgtgtgtgtgtgtgtgtgtgtgtgtgtgtatttcatacatctctttctcccacaaaccttttctttttctttttaattttagattcagagggtacatatgcaggtttgttacatgggtatattgtgtgatgctgaggtttgggcttctaatgatcctgtcacccaagtaatgaacataataccagataggtagtttttaaacacttgtccccctcctctgttttgtaattctcagtgtttattgttgccatctttgtgtctgtacctatccaatgtg

SEQ ID NO: 5765 - DNA, 465 bp, Homo sapiens
  AC055754.10_134745
  Located on chromosome 3
  Distance between a terminus base of telomere on chromosomal short arm and 5'-terminus of this base sequence : 136718148
  Distance between 3'-terminus of neighbour sequence of sequence listing upward to telomere on chrosomal short arm and 5'-terminus of this base sequence : 60997
agctcaacataggttattgtttactgctcaccaaaaagttgtgctttcaaaaagtttatagaataagtgctcaggactgagtctgattctgctgcagaaaactctcctgattcaaagattaaggatttgaacttgcaaaattcctcttgctttttgtacaagtagtcatcttatgactctgagtttagaatatctcatctttgtgtgtgtgtgtgtgtgtgtgtgtgtgtgtgtgtgtgtgtgtgtgtgacggaattttgctgttgttgcccaggctggagtgcaatggcacgatctcagctcatggtaacctccccctcccgggttcaagcggttctcctgcctcagcctcccaagtagttgggattacaggcgcctgccaccatgctcggctaatttttttgtatttttagtagagatggggtttcactatgttggccaggctggtctcgaactcctgacctc

SEQ ID NO: 5766 - DNA, 274 bp, Homo sapiens
  D3S3514
  Located on chromosome 3
  Distance between a terminus base of telomere on chromosomal short arm and 5'-terminus of this base sequence : 136718173
  Distance between 3'-terminus of neighbour sequence of sequence listing upward to telomere on chrosomal short arm and 5'-terminus of this base sequence : -440
gctcaccaaaaagttgtgctttcaaaaagtttatagaataagtgctcaggactgagtctgattctgctgcagaaaactctcctgattcaaagattaaggatttgaacttgcaaaattcctcttgctttttgtacaagtagtcatcttatgactctgagtttagaatatctcatctttgtgtgtgtgtgtgtgtgtgtgtgtgtgtgtgtgtgtgtgtgtgtgtgacggaattttgctgttgttgcccaggctggagtgcaatggcacgatctca

SEQ ID NO: 5767 - DNA, 280 bp, Homo sapiens
  HUMUT1474
  Located on chromosome 3
  Distance between a terminus base of telomere on chromosomal short arm and 5'-terminus of this base sequence : 136858735
  Distance between 3'-terminus of neighbour sequence of sequence listing upward to telomere on chrosomal short arm and 5'-terminus of this base sequence : 140288
tatggactgtaagaaatgccaggagtcttgtaattgtgagagagagagagagaaagaaagagacaaagaaaaaagagaaagaaagaaagaaagaaagaaagaaagaaagaaagaaagaaagaaagaaagaaagaaagaaaatgaagaggaagaggagaaaaaaagaattccatccatactaagtattcgattcaaagcaacaattcttacagattcttcatgtctgcatgaggtgaataaaagatggcccttcagcctttctctttctatccaccccaca

SEQ ID NO: 5768 - DNA, 420 bp, Homo sapiens
  chr3.fa.O7frz.151087174
  Located on chromosome 3
  Distance between a terminus base of telomere on chromosomal short arm and 5'-terminus of this base sequence : 137252555
  Distance between 3'-terminus of neighbour sequence of sequence listing upward to telomere on chrosomal short arm and 5'-terminus of this base sequence : 393540
agataatggtgatgtttacgtaactttgtgcatacactaaaaagcactggatcgcatactttaaaacagtcaatgtggctgggtgcggtggctcacgcctgtaatcccagcactttgggaagctgaggcaggtgggttacaaggtcaggagttcaagaccagcctggccaacatagtgaaacccccatctctactaaaaataacaaaaattagccaggcatggtggtgcgcacctgtagtcccagctactcgggaggctgaggcagaagaatcgcttggacccggaaggcagaggttgcagtgagccgagattgcaccactgcactccagcctgggtgacagagcgagactccatctcaaaataaataaataaataaataaataaataaataaataaataaatgagtgaatgttatgctg

SEQ ID NO: 5769 - DNA, 114 bp, Homo sapiens
  D3S1273
  Located on chromosome 3
  Distance between a terminus base of telomere on chromosomal short arm and 5'-terminus of this base sequence : 137382387
  Distance between 3'-terminus of neighbour sequence of sequence listing upward to telomere on chrosomal short arm and 5'-terminus of this base sequence : 129412
gaggcaaatctgtgggttaccaccaggatgaagtgtatgtggtgtgtgtgtgtgtgtgtgtgtgtgtgtgtgtgtgtgtgtgtataaaatgattacatttcagccaaacacaga

SEQ ID NO: 5770 - DNA, 476 bp, Homo sapiens
  AC020633.3_86309
  Located on chromosome 3
  Distance between a terminus base of telomere on chromosomal short arm and 5'-terminus of this base sequence : 137467244
  Distance between 3'-terminus of neighbour sequence of sequence listing upward to telomere on chrosomal short arm and 5'-terminus of this base sequence : 84743
caactgtaccacgtaaaatcagtttgaggccaggcgaggtggctcaggcctgtaatcccagcactttgggaggccaaggtgggcggatcacaaggtcaggagattgagaccatcctggctaacacggtgaaaccccatctctactaaaaatacaaaaagccgggcatggtggcgggcacctgtagtcccagctactcgggaggctgaggcaggagaatggcgtgaacccgggaagcggaacttgcagtgagccgagatcgcgccactgcactccagcctgggcaacagagcgagactctgtctaaataaataaataaataaataaataaatttgttaccttttcccctgaccctactcttgtctatcttgatgagcagcaatacctggtaacttaggagttattttttaccctaccctctccttcattctccatagtctctcacctcctcttgtaaatctacctgtggtatgtttg

SEQ ID NO: 5771 - DNA, 338 bp, Homo sapiens
  AC020633.3_82729
  Located on chromosome 3
  Distance between a terminus base of telomere on chromosomal short arm and 5'-terminus of this base sequence : 137470994
  Distance between 3'-terminus of neighbour sequence of sequence listing upward to telomere on chrosomal short arm and 5'-terminus of this base sequence : 3274
tttcagtcattacctgtacgagatctctttgtattaagatacaattaatcatgctctcttttctcagtgtctaggacaatgctctggcaaactcctgaaatattttacagtacaaaggagcatatcatttaaaaataaataaataaataaataaataaatatcacagggagagaaagcatacgcgctcacctgagtcttttctttgttttcaggttcctcattccacattcagtattagccagtatacccaggcctctgtcttctatgtctacaatccttatttctacatctaactgtagaattcttgacctgttttgtcaagctgcctactgatagt

SEQ ID NO: 5772 - DNA, 271 bp, Homo sapiens
  chr3.fa.O7frz.151331240
  Located on chromosome 3
  Distance between a terminus base of telomere on chromosomal short arm and 5'-terminus of this base sequence : 137696108
  Distance between 3'-terminus of neighbour sequence of sequence listing upward to telomere on chrosomal short arm and 5'-terminus of this base sequence : 224776
gtttcctcaggctaaagtctaaaaatgaaaaactcaccctgtgcccatctcactttccaaattttgactcccctacaaaatcagcttgcctttgttcacttccctgagaatttcaggcaggcaggtatgtatgtatgtatgtatgtatgtatgtatgcatgtaggtattttgtagctttttagctgttatctgtgggaaggttcatcttaagcacttactccaccagactagcgtagaactcccccagagttcttacctttaaactttgcc

SEQ ID NO: 5773 - DNA, 157 bp, Homo sapiens
  DISO7_10001236
  Located on chromosome 3
  Distance between a terminus base of telomere on chromosomal short arm and 5'-terminus of this base sequence : 137827863
  Distance between 3'-terminus of neighbour sequence of sequence listing upward to telomere on chrosomal short arm and 5'-terminus of this base sequence : 131484
gaagtgcctagaataatttaccttgttatttcctaacaaaaatagtcttgctcctcaattttacattcttatatatatacatatatatatatatatgttacgtatcttagaattttaagtctacttattattttaccaattatcaggaacttcatgt

SEQ ID NO: 5774 - DNA, 450 bp, Homo sapiens
  AC018916.9_98162
  Located on chromosome 3
  Distance between a terminus base of telomere on chromosomal short arm and 5'-terminus of this base sequence : 137897426
  Distance between 3'-terminus of neighbour sequence of sequence listing upward to telomere on chrosomal short arm and 5'-terminus of this base sequence : 69406
aaggatacagcaaggatcagcagtctgcaaccctgaaaaaggagctcaccagagttccaccatgctggcaccctggtctcaggcatctaatctcagaactgtgagaaataaatttctgttgttcattagccacccagtctatggtagtgtgtgtgtgtgtgtgtgtgtgtgtgtgtgtgtgtgtttaactttaaaaatcttgtacatgctttatttgtgttttttaattttttaatcatcttgaaaatgggaggatcgcttactgtaaagtgagtgccttataaccattgctgccttattctaaaagataaatcactatggattgcatacagcttcaaataagaaaaaaaatttgtaacagtacattataatttttataggacattgttatggactgataacagatacagtaagacagctagctgaaagaggcataatcctagcatctac

SEQ ID NO: 5775 - DNA, 450 bp, Homo sapiens
  chr3.fa.O7frz.151709115
  Located on chromosome 3
  Distance between a terminus base of telomere on chromosomal short arm and 5'-terminus of this base sequence : 137976586
  Distance between 3'-terminus of neighbour sequence of sequence listing upward to telomere on chrosomal short arm and 5'-terminus of this base sequence : 78710
acttgactggattgaaggatacaaagtattgattccaggtgtgtctgtgagggtgttgccaaaggagattaactgtttgagtcagtgggctgggaaaaggtgcctactcttactctgggtgggcacaatctaatcagctgctagcatggctagaatataagcaagcagaaaaatgggaaaagtgagactggcctagcctcccagcctacatgggctagtaatggaaggcccgtgtgtatatatatatatatatatatattccattagttctgtccctctagagaaccctaatacaatactctctctatatatatgtacattccattagttttgtccctctagagaaccctaactaatacaatgtataagaagcattaaaaaactactgaccaataatggtgataaataatcatcaaaaatggcaactggttcatgaggtgacctagaaat

SEQ ID NO: 5776 - DNA, 327 bp, Homo sapiens
  HUMUT5225B
  Located on chromosome 3
  Distance between a terminus base of telomere on chromosomal short arm and 5'-terminus of this base sequence : 138026983
  Distance between 3'-terminus of neighbour sequence of sequence listing upward to telomere on chrosomal short arm and 5'-terminus of this base sequence : 49947
caaaaatgctgcaatgaacagccttgtaaattttctcgagtgtgtgtgtgtgtgtgtgtgtgtgtgtgtgtgtgtgtgtatgtgattttctctaaagggtggttacatccactgacatttttacctttgttgtgagggactgtcctgtgcattgtagatggttaatagcatccctcgacaacccacagaatgggagaaaatatttgcaaactatgcatctgacaaaggactagtatccagaatccacaaggaactcaaataaatcagcaagaaaaaaacaaacaatcccatctaaaagtggactaagggcatgaatagacatttctc

SEQ ID NO: 5777 - DNA, 149 bp, Homo sapiens
  HUMUT7131
  Located on chromosome 3
  Distance between a terminus base of telomere on chromosomal short arm and 5'-terminus of this base sequence : 138075457
  Distance between 3'-terminus of neighbour sequence of sequence listing upward to telomere on chrosomal short arm and 5'-terminus of this base sequence : 48147
gaagcaggatttcaaattgtataatcacatgatagatagattagatagatagatagatagatagatagatagatagatagacagacagacagacaatctttctttctctcatctcttttcttaagctttcctcactgtattaatccatt

SEQ ID NO: 5778 - DNA, 257 bp, Homo sapiens
  chr3.fa.O7frz.151890172
  Located on chromosome 3
  Distance between a terminus base of telomere on chromosomal short arm and 5'-terminus of this base sequence : 138170240
  Distance between 3'-terminus of neighbour sequence of sequence listing upward to telomere on chrosomal short arm and 5'-terminus of this base sequence : 94634
actcaaagtaagaataacaatgcttatatttttctagtttgatctactttttagtaataaatatgggctattagttgtgtgtgtgtgtgtatatatatatatatatatatatatatatatatatatatatatatgtgggttttcatggaattaactttgtctctttttgcccatgagtttattggtgagaagacacaagtataactgttggggttcttctgcattctttggttattcatgatattgctaactgaacc

SEQ ID NO: 5779 - DNA, 215 bp, Homo sapiens
  D3S1290
  Located on chromosome 3
  Distance between a terminus base of telomere on chromosomal short arm and 5'-terminus of this base sequence : 138318649
  Distance between 3'-terminus of neighbour sequence of sequence listing upward to telomere on chrosomal short arm and 5'-terminus of this base sequence : 148152
aacacttagggtaatggggcggaggggtatgtggagtatcttgctctgactcagccttataagaacaccatacacgtacgtgtgtgtgtgtgtgtgtgtgtgtgtgtgtgtgtgtgtgtttcctaaaggaggacttattttaatatctgagaatagacttctaggaacttccttgatgtacagaaatctcatagaccctatggtcattactgcaa

SEQ ID NO: 5780 - DNA, 441 bp, Homo sapiens
  AC055753.14_128024
  Located on chromosome 3
  Distance between a terminus base of telomere on chromosomal short arm and 5'-terminus of this base sequence : 138402815
  Distance between 3'-terminus of neighbour sequence of sequence listing upward to telomere on chrosomal short arm and 5'-terminus of this base sequence : 83951
gtatgtgagtttatgctcctgtcaccgcaaattgtatttccttctatactattagctccttaaaggaaatggctatgtcctcaatatgcagacaccatataacagcctccagctttattccgtctgtttccccagcccatagtgtgtgtgtgtgtgtgtgtgtgtgtgtgtgtgtgtgtgcgccaagaatcttcatggccctcctagtatgcttttttttcttatttccctgagggaacctgtggctgttgatcagagaaatcatgatgctgtaaaaagagcctggcattgagatgtttctcttctctgagtctggtcaggaaaggaggacagtaaggaaacccaagttaaaatcagcccgttgagctccatcacttaaaagcccttgatgtctcaatccagagtggtcactgaaagagctttgatttcacttctacatgg

SEQ ID NO: 5781 - DNA, 456 bp, Homo sapiens
  AC022296.17_46413
  Located on chromosome 3
  Distance between a terminus base of telomere on chromosomal short arm and 5'-terminus of this base sequence : 138555309
  Distance between 3'-terminus of neighbour sequence of sequence listing upward to telomere on chrosomal short arm and 5'-terminus of this base sequence : 152053
tacctttgtctgcaacagatacttccacaattattgggcatgctggtcataggtgcagtggcaggcagctggctccacacctcagcttgctacagatgcctttttgctctaggccctgctcaaaacttgcagcccctccatgtgttcatgctgatataaacacacacacaccacacacacacacacacacacacacacacacacacacacaatagggaagaaaggaacattctttctttctttctttctttttttttgagatggagtttcgctcttgttgcctaggctggagtgcaatggtgcaatattggctcaccacaacctccgcctcccaggttcaagcaattctcctgcctcagcctcccgagtagctgggattacaggcatgtgccaccacgcccagctaattttgtatttttagtagagacagcgtttctctatgttgatcaagctggt

SEQ ID NO: 5782 - DNA, 414 bp, Homo sapiens
  AC022296.17_40740
  Located on chromosome 3
  Distance between a terminus base of telomere on chromosomal short arm and 5'-terminus of this base sequence : 138564681
  Distance between 3'-terminus of neighbour sequence of sequence listing upward to telomere on chrosomal short arm and 5'-terminus of this base sequence : 8916
ttagcttagaccaggtaggaactatcccctctgactggagctgggtcagatttctttttgtataggagaaaagcaatggatattaggtagacgactagatgcttcttgtgtgtgtgtgtgtgtgtgtgtgtgtgtgtgtgtgtgtgtgtgtgtgtgttggggtccggtttggggagtatgagagaataactgttatccactgtgtccttgaacctcctgccttgaactgcttctcatcctgtccaatctctcattttcctttcctttcctgtagttagatgatgttattggtccctatttatcatcccttcctgtatccacatcctttgcaatgtaacttggcagtgtcttctctctgtgaattccacctggctctaaactttgggtttggttatgtcagtaatgcagaagtga

SEQ ID NO: 5783 - DNA, 226 bp, Homo sapiens
  D3S3713
  Located on chromosome 3
  Distance between a terminus base of telomere on chromosomal short arm and 5'-terminus of this base sequence : 138564761
  Distance between 3'-terminus of neighbour sequence of sequence listing upward to telomere on chrosomal short arm and 5'-terminus of this base sequence : -334
tattaggtagacgactagatgcttcttgtgtgtgtgtgtgtgtgtgtgtgtgtgtgtgtgtgtgtgtgtgtgtgtgttggggtccggtttggggagtatgagagaataactgttatccactgtgtccttgaacctcctgccttgaactgcttctcatcctgtccaatctctcattttcctttcctttcctgtagttagatgatgttattggtccctatttatcatc

SEQ ID NO: 5784 - DNA, 257 bp, Homo sapiens
  D3S3657
  Located on chromosome 3
  Distance between a terminus base of telomere on chromosomal short arm and 5'-terminus of this base sequence : 138662703
  Distance between 3'-terminus of neighbour sequence of sequence listing upward to telomere on chrosomal short arm and 5'-terminus of this base sequence : 97716
caccagcagagtgactgactgtgatggagaaggtgccatctgagtagagagggggagagttaacctcagagtcacacacacacacacacacacacacacacacacgcatggaaagatggatgacaataatgaatgccataggtacagaaatagtggcattgaaggaaggcactatgacagcatttggctaccagactggtgtcatggaccgcagtgtggtaggcaagggcttgccatggcctcaggagaacctgctt

SEQ ID NO: 5785 - DNA, 411 bp, Homo sapiens
  AC073361.2_3089
  Located on chromosome 3
  Distance between a terminus base of telomere on chromosomal short arm and 5'-terminus of this base sequence : 138852469
  Distance between 3'-terminus of neighbour sequence of sequence listing upward to telomere on chrosomal short arm and 5'-terminus of this base sequence : 189509
aatgaatacctatgtactcaccaccatgcctagaaggcccctgtttctccccaaaagcttttccctcaagaggtcagcaatatccagttttgtattgttttttaaaaatacttttacagtgtgtgtgtgtgtgtgtgtgtgtgtgtgtgtgtgtgttccttcctaaacaaggtattgcttagttttgcctgtggattcttcactaattttgaagcaactttacagaacaagaaatgctttattttgtaagaaagaagattggcagcatgtattcctctgcttctggatagcagaaaggggaaggggaggccgacaaatgagtgttgcttatgcaccctttattagggccagcaggtggcagtaaggggacttacattgggaaggttttggtggttaaagaggttggataat

SEQ ID NO: 5786 - DNA, 332 bp, Homo sapiens
  chr3.fa.O7frz.152945335
  Located on chromosome 3
  Distance between a terminus base of telomere on chromosomal short arm and 5'-terminus of this base sequence : 139114373
  Distance between 3'-terminus of neighbour sequence of sequence listing upward to telomere on chrosomal short arm and 5'-terminus of this base sequence : 261493
caatcaacttgatctcactgacatttatagaacaccccatcccaaaacagcagcacacacatttttctcaagcgcacataaaacatttgccaagctagatcatattctgggccataaaataagtctcaataaataaagattgaattatatattctctgcccactcataattacattagaaatcgagaacaagaagatatttaggaataaaatccccaaatatttggaaatttttaaaagttttcttaataacccatgtgtggcattatgacacacacacacacacacacacacacacacacacacacacactggtttcctctacctcatact

SEQ ID NO: 5787 - DNA, 144 bp, Homo sapiens
  HUMUT877
  Located on chromosome 3
  Distance between a terminus base of telomere on chromosomal short arm and 5'-terminus of this base sequence : 139136483
  Distance between 3'-terminus of neighbour sequence of sequence listing upward to telomere on chrosomal short arm and 5'-terminus of this base sequence : 21778
ttcatctaggttctgataaccataccttctctttgttctccattaaacttttatatcaatggtgtgtgtgtgtgtgtgtgtgtgtgtctgagagagagagagagagagagattgagggagagagagagaggctctacttcctgg

SEQ ID NO: 5788 - DNA, 348 bp, Homo sapiens
  HUMUT5068B
  Located on chromosome 3
  Distance between a terminus base of telomere on chromosomal short arm and 5'-terminus of this base sequence : 139158037
  Distance between 3'-terminus of neighbour sequence of sequence listing upward to telomere on chrosomal short arm and 5'-terminus of this base sequence : 21410
gtgagccaagatagcagcactgcactccagcctgggtgacagagtgagattcagtcaaaaaaacagggaaagaaaaagaaagaaagaaagaaagaaagaaagaaagaaagaaagaaagaaagaaagaaagaaaggaaggaagaaagaaggaaagaaagaaggaaagaaggaaagaaagaaagaaagaaagaaagaaagaaagaaagaaagaaagaaagaaagaaagaaagaaagaaaaagaaaggaaggaaggagggaagaaaagaaagaaagaaaagaaagaaagaagagaaaggaaagaaaggaaggaaagaaggacttggagtcactctttttgccattaataaa

SEQ ID NO: 5789 - DNA, 443 bp, Homo sapiens
  AC026117.10_4277
  Located on chromosome 3
  Distance between a terminus base of telomere on chromosomal short arm and 5'-terminus of this base sequence : 139184486
  Distance between 3'-terminus of neighbour sequence of sequence listing upward to telomere on chrosomal short arm and 5'-terminus of this base sequence : 26101
cagcactttaggctcacagtcccctctcccctgccccaggtctctcaaccaacagcctccccttacttctccagttggcccaagtcaagatgggcttccttgacactgatgtcaagaaagatgctgagtgcccatcccttatgtgcctagaggaccagtgggggcttttccaagtagcgtgtgtgtgtgtttgtgtgtgtgtgtgtgtgtgtgtgtgttggggaggataatcataaaatcaaagacatcatgccatccttcctttttcctggagctctcttgcagttactgtcagcacaaaagactgacccactaaccttaatgggtggcacctttttgcctcatcttacaaaaccattgtcctcttgaagcatttttattcatcctttattcaccaattcaggtgcaattactccttcttcctgttcaccttgcagaatgac

SEQ ID NO: 5790 - DNA, 164 bp, Homo sapiens
  D3S3684
  Located on chromosome 3
  Distance between a terminus base of telomere on chromosomal short arm and 5'-terminus of this base sequence : 139326369
  Distance between 3'-terminus of neighbour sequence of sequence listing upward to telomere on chrosomal short arm and 5'-terminus of this base sequence : 141440
aataacccaatgacacagccacagccacacacacacacacacacacacacacacacacacacgcagaagcaaactgagaaaaaacacacagcaagatacaaatgacataagcaggcagagtggaagatgcaaacagaagtagaactggtgtgactggagattca

SEQ ID NO: 5791 - DNA, 229 bp, Homo sapiens
  Z67391
  Located on chromosome 3
  Distance between a terminus base of telomere on chromosomal short arm and 5'-terminus of this base sequence : 139562390
  Distance between 3'-terminus of neighbour sequence of sequence listing upward to telomere on chrosomal short arm and 5'-terminus of this base sequence : 235857
tatgcggtaaagcagtatttcaaagggaaaggataggatggggcaacaaaatcttctcatgtacaagatatgcaagtgacatacacaggatggatgctatttgtgtaccttttccactaataagtagtgaatgaaaaaaggttttatatatatatacatatacacacacacacacacacacacacatatatatatacacacacacatatgatgtgggttataagtgagg

SEQ ID NO: 5792 - DNA, 416 bp, Homo sapiens
  chr3.fa.O7frz.153422333
  Located on chromosome 3
  Distance between a terminus base of telomere on chromosomal short arm and 5'-terminus of this base sequence : 139623906
  Distance between 3'-terminus of neighbour sequence of sequence listing upward to telomere on chrosomal short arm and 5'-terminus of this base sequence : 61287
gaagatgttattggatttctgtagccctcttgtgccaagaacatatggggctgcaggagagaaggggcagagggtcaggcacttattccttcctctgccccatatcgcctttgagcacctccttcatggtattttagtaattccttggtggtgaagtgatgggattttgaagaggatttttgtaggtgcatccaactgcaacagaatacatcagcctcatcggaaggagaatggaaggcctgagaacgcacaaaaggagcatttggagagggtaaagtcacattcctctgacactttgggtgcaggtgtccgtatctgtgcagtaaatgtggggtgtgtgtgtgtgtgtgtgtgtctgtgcatgtgtgtgtgaaagagagaaagatacatacatacttatgcaacctaattatcga

SEQ ID NO: 5793 - DNA, 458 bp, Homo sapiens
  AC016951.9_109845
  Located on chromosome 3
  Distance between a terminus base of telomere on chromosomal short arm and 5'-terminus of this base sequence : 139847208
  Distance between 3'-terminus of neighbour sequence of sequence listing upward to telomere on chrosomal short arm and 5'-terminus of this base sequence : 222886
catctcactaatcagacttggttccaaatgacttttgcctgtttctgaaattcaaatccactcttggggcataaagaatgtgtcagagtttctgaaggtttttctagaaggtagtgtagatggaccaatgagtagagcccatgacaatgattttgaaaggggaacagtttttacagataaatgagttttgatagcatgctttacatatgcacacagacacacacacacacacacacacacacacacacacacacacacacacaatcagccagactgcagagagtcaatatgcactgtccaaatgtcaacaggcactctagcaatagaactgcaagctctgacttccaataagcaagcctaacaaacctagatcttggagagacctgaaagtgtctttctcatacatcaaagtcatgatctgaaagcctgaacaagtactttctaatggatgtcactgt

SEQ ID NO: 5794 - DNA, 279 bp, Homo sapiens
  D3S3696
  Located on chromosome 3
  Distance between a terminus base of telomere on chromosomal short arm and 5'-terminus of this base sequence : 139892175
  Distance between 3'-terminus of neighbour sequence of sequence listing upward to telomere on chrosomal short arm and 5'-terminus of this base sequence : 44509
ggttcagcatcagccaaagcacttggaaatacctaagtgatgtcatgatcccatttacgcatctggaggatggaggcctggaacataaaactcttattttccagtccatattggaccttagtctagcctgtgttcttcagactttgcggccaaaaatgttctctaaaatgtcaggttactattataaacttttgatttaaagatattaacacacacacacacacacacacacacacacacatcccaaacaaaaacaagagacctattttccatcactgg

SEQ ID NO: 5795 - DNA, 341 bp, Homo sapiens
  AC016951.9_56629
  Located on chromosome 3
  Distance between a terminus base of telomere on chromosomal short arm and 5'-terminus of this base sequence : 139900549
  Distance between 3'-terminus of neighbour sequence of sequence listing upward to telomere on chrosomal short arm and 5'-terminus of this base sequence : 8095
tatgctaatggtaacacctcatgtaactatagtaccaaatcataatcaggaaattaactttgatacaattgattgactttagtcagatatcaccagttttacatacacttgtgtgtgtgtgtgtgtgtgtgtgtgtgtatttagatctgttcagttttatcacatgtagagttgtatgactaccgccatagtcaagacacagaacagtttcatcacaagcttccctggtgatacccttttatagccatggccagcacctttcctccttcttctccctgatcactgacaatcaatgtgttcttgatctctataattttgtcattacaaggtgctgtataaat

SEQ ID NO: 5796 - DNA, 224 bp, Homo sapiens
  D3S3641
  Located on chromosome 3
  Distance between a terminus base of telomere on chromosomal short arm and 5'-terminus of this base sequence : 139956424
  Distance between 3'-terminus of neighbour sequence of sequence listing upward to telomere on chrosomal short arm and 5'-terminus of this base sequence : 55534
cccccatgctctcttgcttcctctctcgccatatgacacgcctcctcccctttcaccttctgccaggatttggtaagcttcctgaggcctcaccagaagcagattgcagtaccatgcttcctgtacagcctgcagaatcatgagccaactaaacaccctttgtgtgtgtgtgtgtgtgtgtgtgtgtgtgtgtgtttaagaacggaggtttaatagacaaaaga

SEQ ID NO: 5797 - DNA, 477 bp, Homo sapiens
  AC026606.3_141790
  Located on chromosome 3
  Distance between a terminus base of telomere on chromosomal short arm and 5'-terminus of this base sequence : 140141214
  Distance between 3'-terminus of neighbour sequence of sequence listing upward to telomere on chrosomal short arm and 5'-terminus of this base sequence : 184566
ttctacctgttggcatcacacctgctggcaggtgtggatgtgggtcagcagatgaccctgaggatgacagggttaggattaattcgctgccagatatcttctcgtagttcaccaaattttacacacacacacacacacacacacacacacacacagacagacacaaaatcttaaatttatcgtatatctgagttaagacataatttttctgaagcagtggttttcaaacatttgaagaattcttggcaacacaactattcaatgcaaagctctgtgtggaaggtgtgtatgaagtcttgaagggaactcagacccctaatgacagtgagctgcctcttcctcttcttctcttctccctcccccatgctccaacagtgacccctgcggcagctctagggaaacccagtccctgcagaaagcagacccatacccttagcatcccccagggaagcaagtcatctggtaccttgtagaaac

SEQ ID NO: 5798 - DNA, 209 bp, Homo sapiens
  D3S1590
  Located on chromosome 3
  Distance between a terminus base of telomere on chromosomal short arm and 5'-terminus of this base sequence : 140141269
  Distance between 3'-terminus of neighbour sequence of sequence listing upward to telomere on chrosomal short arm and 5'-terminus of this base sequence : -422
ccctgaggatgacagggttaggattaattcgctgccagatatcttctcgtagttcaccaaattttacacacacacacacacacacacacacacacacacagacagacacaaaatcttaaatttatcgtatatctgagttaagacataatttttctgaagcagtggttttcaaacatttgaagaattcttggcaacacaactattcaatg

SEQ ID NO: 5799 - DNA, 182 bp, Homo sapiens
  Z24103.1_125
  Located on chromosome 3
  Distance between a terminus base of telomere on chromosomal short arm and 5'-terminus of this base sequence : 140141291
  Distance between 3'-terminus of neighbour sequence of sequence listing upward to telomere on chrosomal short arm and 5'-terminus of this base sequence : -187
attaattcgctgccagatatcttctcgtagttcaccaaattttacacacacacacacacacacacacacacacacacagacagacacaaaatcttaaatttatcgtatatctgagttaagacataatttttctgaagcagtggttttcaaacatttgaagaattcttggcaacacaactatt

SEQ ID NO: 5800 - DNA, 175 bp, Homo sapiens
  Z67511
  Located on chromosome 3
  Distance between a terminus base of telomere on chromosomal short arm and 5'-terminus of this base sequence : 140290594
  Distance between 3'-terminus of neighbour sequence of sequence listing upward to telomere on chrosomal short arm and 5'-terminus of this base sequence : 149121
ccttcacaagatcataggatttcttttttttttttataactggactcatttggagggtgcttacacacacacacacacacacacacacacacacacagcagcagcagcagcagcaggaaaataattaatgaaatcacagcaaaggaaatttaagatatgagatgtggttggaacc

SEQ ID NO: 5801 - DNA, 299 bp, Homo sapiens
  AC016919.8_86547
  Located on chromosome 3
  Distance between a terminus base of telomere on chromosomal short arm and 5'-terminus of this base sequence : 140460518
  Distance between 3'-terminus of neighbour sequence of sequence listing upward to telomere on chrosomal short arm and 5'-terminus of this base sequence : 169749
gtttagctcctgcttataagtaaagaaatgtgatatttcactttctgtttctgagttatatcacttaggataatgccctccagtctcatccatgttgctgcataaaatattatttcattattttttatagctgaatggcattctatggtgtgtgtgtgtgtatgtgtgtgtgtgtgtgtgtgtgtgtgtatcatattgtctttatccaatcatttgttgataggcagttatattggttccgtattgaaatggtttggctgtgtccccatccaaacctcatcttgaattgtagttctcat

SEQ ID NO: 5802 - DNA, 176 bp, Homo sapiens
  D3S1615
  Located on chromosome 3
  Distance between a terminus base of telomere on chromosomal short arm and 5'-terminus of this base sequence : 140480972
  Distance between 3'-terminus of neighbour sequence of sequence listing upward to telomere on chrosomal short arm and 5'-terminus of this base sequence : 20155
tcatcccctacatacatggaccaccacacacacacacacacacacacacacacacacacaaaaatcccatagtagggcaagacatacaaacccaaagaaatgactgtgtaactgcctgcgggggcctctgggacaccattacttggcctggtcagtgctggtgggcagagagtgca

SEQ ID NO: 5803 - DNA, 196 bp, Homo sapiens
  AC016919.8_152517
  Located on chromosome 3
  Distance between a terminus base of telomere on chromosomal short arm and 5'-terminus of this base sequence : 140556048
  Distance between 3'-terminus of neighbour sequence of sequence listing upward to telomere on chrosomal short arm and 5'-terminus of this base sequence : 74900
ctacctctaaattagagctttccagctttaaactctcagtcctattcatctgattgatttttgttctgttttgttgttgttgttgttgttgttgttgtttgcttgtttgtacttttgaaactccttcataatcgagtcctttttcttggatagagaaggtagtcttgacagaaaattgaagtctccaacacttgac

SEQ ID NO: 5804 - DNA, 477 bp, Homo sapiens
  chr3.fa.O7frz.154557179
  Located on chromosome 3
  Distance between a terminus base of telomere on chromosomal short arm and 5'-terminus of this base sequence : 140732161
  Distance between 3'-terminus of neighbour sequence of sequence listing upward to telomere on chrosomal short arm and 5'-terminus of this base sequence : 175917
aagaaataagtcttcaaaggctgggcacagtgactcactcctgtaatcctagcactttgggaggctgaagtgggaagatcacttgaagttgggagttcaagaccagcctggccaacatggaaaaacaccatctctactaaaaatgcaaaaataattagccaggcttggtggtgggctcctgtagtcccagctacttgggaggctgaggcaggagaatcacttggacccaggaggcagaggttgcaatgagccaagatggtgccactgcactccagcctgggtgacagagtaagacaaagaaaaagaaagaaggaaggaaggaaggaaggaaggaaggaaggaaggaaagaaagaaagaaagaaagaaagaaagaaagaaagaaagaaagaaagaaagaaagaaagaaagaaagaaagggaatatagaaaggcaaggtaagaaaattgggaaaagggaggtaaggatggtgactgtat

SEQ ID NO: 5805 - DNA, 459 bp, Homo sapiens
  AC068444.2_109738
  Located on chromosome 3
  Distance between a terminus base of telomere on chromosomal short arm and 5'-terminus of this base sequence : 140766001
  Distance between 3'-terminus of neighbour sequence of sequence listing upward to telomere on chrosomal short arm and 5'-terminus of this base sequence : 33363
ccatttatatgttgatggacacttggattgtttcccagcattgttaaactcttatcccgcattgttttctggcttctattgtaatggttgagaagtctgttgtcactctaattattcttcttatgtagataaagtctattgtctgtggttgctttcatggtactttcctttctttgatgttctgcaatttcatgtgcctaagtgtgaattttccattttgtttatttttctcaagactcaagtttccagaatcagaagagtctggtctttcatcaacactagaaaaaatttcaccattacctcttcaaatattatttttctataattccttttattttagtctctctctctctctctctctctctctctctctctctctgtttctggagatgtgtgtgtcttaggttctctttcatgttttctatgtcttaatttctctgtactgcaattcagttcatc

SEQ ID NO: 5806 - DNA, 417 bp, Homo sapiens
  chr3.fa.O7frz.154647061
  Located on chromosome 3
  Distance between a terminus base of telomere on chromosomal short arm and 5'-terminus of this base sequence : 140832812
  Distance between 3'-terminus of neighbour sequence of sequence listing upward to telomere on chrosomal short arm and 5'-terminus of this base sequence : 66352
atagaccagttcttaacctcacttgatggcttcatattctctgggtgaggaagatggttaatgggaaccctttctttccagacatcttcattgacttgtcagagcttcccaatgggactttatcttctcatgtaatgtttatccatctgggtggtgggtatgtggatgtttattatataattagctgtacttttctgatgctttatttttaattttcttaatcaaaaaaataagaactgagaagaaataaggggaaagaattctaactccacatgaaaacaacctttgctgaatagaaatgtgcttcatcagtctgtctctctctctctctctgtgtgtgtgtgtgtgtgtgtgtgtgtattaccaatcatttctcctctcctggccttcatttttatcacctacataggcctagaa

SEQ ID NO: 5807 - DNA, 107 bp, Homo sapiens
  DISO7_10001238
  Located on chromosome 3
  Distance between a terminus base of telomere on chromosomal short arm and 5'-terminus of this base sequence : 140949561
  Distance between 3'-terminus of neighbour sequence of sequence listing upward to telomere on chrosomal short arm and 5'-terminus of this base sequence : 116332
ttgtgagttagttcactggatggttttattagtaataaaaatattttcaaaacaaaacaaaacaaaacaaaacaaaacacccaaatttcaaacctgtgtctgctgaa

SEQ ID NO: 5808 - DNA, 441 bp, Homo sapiens
  chr3.fa.O7frz.154793366
  Located on chromosome 3
  Distance between a terminus base of telomere on chromosomal short arm and 5'-terminus of this base sequence : 141002287
  Distance between 3'-terminus of neighbour sequence of sequence listing upward to telomere on chrosomal short arm and 5'-terminus of this base sequence : 52619
ggcttaaagtctgttatggttcattgaatttaacatgctccataattttatatttgtttctttctttgtgtgtgtgtgtgtgtgtgtgtgtgtgacagagtttcgctcttgttgcccaggctggagtgcaatggtgtgatctcggctcaccgcaacctccgcctcccgggttcaagtgattctcctgcctcagtctcctgagtaactgggattacaggcatgcaccaccacacccagctaattttgtattttttgtacagacaaggtttctccatattggtcaggctggtctcgaactcccgaccttaggtgatctgcccacctaggcctcccaaagtgctgggattacaggcgtgagctggctgtgcccagcctgttttatagttctctaagcaaaaacaaaaccccaaacattgccagttgtaagcctataatgcattg

SEQ ID NO: 5809 - DNA, 314 bp, Homo sapiens
  AC069524.9_117467
  Located on chromosome 3
  Distance between a terminus base of telomere on chromosomal short arm and 5'-terminus of this base sequence : 141231601
  Distance between 3'-terminus of neighbour sequence of sequence listing upward to telomere on chrosomal short arm and 5'-terminus of this base sequence : 228873
acattagcctaggcctacaaagtgtcagaattatcagtatcagtgtcttccacctcccacatgtctcattggaacgtcttcagtggcagtattttgcatggagctgtcgtatcctatgataataatgcattcttctggagtacctcctgaaggacctgcctgaggatgtttcacagttaatttttttcataagtaggagtacactctaaaatcatgattaaaagtatagaatagaaattagtatagtatagtatagtatagtatagtatagtatagtatagtatagtaaatacatacgccagtaacatagtcat

SEQ ID NO: 5810 - DNA, 332 bp, Homo sapiens
  D3S2453
  Located on chromosome 3
  Distance between a terminus base of telomere on chromosomal short arm and 5'-terminus of this base sequence : 141634191
  Distance between 3'-terminus of neighbour sequence of sequence listing upward to telomere on chrosomal short arm and 5'-terminus of this base sequence : 402276
gagagggagaaagaaatgtgctactggcatctaacaggtagaggccaaaggcactttatattcagtcttttgtatatataagatgtcacaatttaaaaggatttaagaaagataacactgaactacctatctatctatctatctatctatctatctatctatctatctatctatctatatacgtacacactgtacaggtgaggagataagaattcattaaaatagattgctaaagagaatactgattaatatataataaagccatataagcacttgttagtttctatcccccagatgcagatactaaaacaaggatgccagtgcaagtaatt

SEQ ID NO: 5811 - DNA, 456 bp, Homo sapiens
  AC069514.10_14940
  Located on chromosome 3
  Distance between a terminus base of telomere on chromosomal short arm and 5'-terminus of this base sequence : 141634210
  Distance between 3'-terminus of neighbour sequence of sequence listing upward to telomere on chrosomal short arm and 5'-terminus of this base sequence : -313
gctactggcatctaacaggtagaggccaaaggcactttatattcagtcttttgtatatataagatgtcacaatttaaaaggatttaagaaagataacactgaactacctatctatctatctatctatctatctatctatctatctatctatctatctatatacgtacacactgtacaggtgaggagataagaattcattaaaatagattgctaaagagaatactgattaatatataataaagccatataagcacttgttagtttctatcccccagatgcagatactaaaacaaggatgccagtgcaagtaatttatttagaaggacaacccacaaaataccagtaatgcagtagagacatgaaacaagaaaaagaaaaataacaattaaaaaaaagcagacaacaaagagtatgttatctagccaattacaattgtaggtaactggagcctaatta

SEQ ID NO: 5812 - DNA, 460 bp, Homo sapiens
  AC023316.5_115674
  Located on chromosome 3
  Distance between a terminus base of telomere on chromosomal short arm and 5'-terminus of this base sequence : 141691061
  Distance between 3'-terminus of neighbour sequence of sequence listing upward to telomere on chrosomal short arm and 5'-terminus of this base sequence : 56395
tttagaatcatggcagaagacaaaggaggagtaaagtcacatctgacatggcaataggcaaagagagcatgtgcaggaaagctcttctttataaaaccatcagatctcatgagacttatattcattatcacgagaacagcatgggaaagacccacccccatgattcaattacctcccatctttccttcctacaatacatgggaattatgggagctacaatacaatacgtgggaattatgggagctacaattcaggatctgggtggggacacagcaaaacaatatcatacgttgaacttcgttgtgtgtgtgtgtgtgtgtgtgtgtgtgtgtgtgtgtgtgtgtgtgtttgatgatcatgtgatatttttccttctgttaatatcatgtattacattgattgattttcttatgataaaccatccttcattcttgggctaaatcttacttgttcatggtgt

SEQ ID NO: 5813 - DNA, 362 bp, Homo sapiens
  AC069514.10_141690
  Located on chromosome 3
  Distance between a terminus base of telomere on chromosomal short arm and 5'-terminus of this base sequence : 141716877
  Distance between 3'-terminus of neighbour sequence of sequence listing upward to telomere on chrosomal short arm and 5'-terminus of this base sequence : 25356
gcttgtagtgagccgagaccgcaccactgcactccagcctgggcgacagagcaagactccatctcaataaataaataaataaataaataaataaataaataaataaataagaactttctttagttccctaatggatcagtgtttaaaaaaaaaaagcctttggtctgattccagccttacctgcccaccaaatcatcatctaaattgctcccagaaaggcatttctaaaaatgaaaatacaaacaagtaattttctttctaaaataccatcaattttacaaaaagtattcaatggtcagaatgtagtttctctcagctccatttttacaagggcatctactgtcctctatggtcggataaca

SEQ ID NO: 5814 - DNA, 212 bp, Homo sapiens
  D3S1549
  Located on chromosome 3
  Distance between a terminus base of telomere on chromosomal short arm and 5'-terminus of this base sequence : 141776204
  Distance between 3'-terminus of neighbour sequence of sequence listing upward to telomere on chrosomal short arm and 5'-terminus of this base sequence : 58965
acatacaaataaacgtgtgctctctgtatttatttgtgtgtgtgtgtgtgtgtgtgtgtgtgtatcaaacctatggagaaaaggagaatgagtgaataacccacataaaggaaataaataaataaaatgaaagcaaggctttgaatgagtcaattactgcatgccatgaactgtggtcaggattaattcagccctccgcacctgaggtccta

SEQ ID NO: 5815 - DNA, 192 bp, Homo sapiens
  D3S3617
  Located on chromosome 3
  Distance between a terminus base of telomere on chromosomal short arm and 5'-terminus of this base sequence : 142046980
  Distance between 3'-terminus of neighbour sequence of sequence listing upward to telomere on chrosomal short arm and 5'-terminus of this base sequence : 270564
tcattcttcacacagcagcacacaacagccagagaaatgtttttaagatttctgcattaatgatacaacaatacctcttacttggcagcataatacaatgaaagtttacattactttcccacatcactgtgtgtgtgtgtgtgtgtgtgtgtgtgtgtgtgtgtgtgtgttgaggggcacctttgctttatg

SEQ ID NO: 5816 - DNA, 379 bp, Homo sapiens
  AC023402.2_150177
  Located on chromosome 3
  Distance between a terminus base of telomere on chromosomal short arm and 5'-terminus of this base sequence : 142206476
  Distance between 3'-terminus of neighbour sequence of sequence listing upward to telomere on chrosomal short arm and 5'-terminus of this base sequence : 159304
tacagaataaaggaatctgctagttagaataagccaaccccaggctgatggatggggcataaggaggtcattgaaaaagagaaattgtgtgtgtgtgtgtgtgtgtccctgtgcgtgtgtgtgtttcacaagattcctatcccctcccttctcactctttttccagcaaactctaatctttcatattgtattgagacaaatgttgctccatttctctctcactctctgttttttttccttgaagggatatttgatggaacccactctaggttttaatagagtgtgggggcaaaggagaaattaaagcagtgtcatggtttgttagcagcccgggatcgtccaggatgggcccaggctacaaattatgctctggaattaa

SEQ ID NO: 5817 - DNA, 388 bp, Homo sapiens
  chr3.fa.O7frz.156890937
  Located on chromosome 3
  Distance between a terminus base of telomere on chromosomal short arm and 5'-terminus of this base sequence : 142342054
  Distance between 3'-terminus of neighbour sequence of sequence listing upward to telomere on chrosomal short arm and 5'-terminus of this base sequence : 135199
gatagtctgccggttatttaacctctctctaatatctggctttttgttttcactttctacttttcaacagtgtgtgtgtgtgtgtgtgtgtgtgtgtgtgtgtgtgacaaaaagaaggagagagaggggaaaagagagtcatagcatcattttattgtagggtttaggggtatgatgtgatgaagggccttacatttggagctttggtgttgggtggcagggacacgtttgtgagacagtaattgctgaaaaccattcaatgtcttgtctttcatgagagatgtgaaccagagtagttatgaaaaattcagcttggtgctatgcctaatccttttcagtaatatgattgtaatgcttgtgcctggtaggtgatcgatacatattcagt

SEQ ID NO: 5818 - DNA, 398 bp, Homo sapiens
  chr3.fa.O7frz.157060239
  Located on chromosome 3
  Distance between a terminus base of telomere on chromosomal short arm and 5'-terminus of this base sequence : 142484509
  Distance between 3'-terminus of neighbour sequence of sequence listing upward to telomere on chrosomal short arm and 5'-terminus of this base sequence : 142067
tccaataagaatgttgaacaagtttctaggaatatattctaggtcctacaggaagtcattttcatagtcctgtcttgctttggaccttgaggatgccttctctccctttctttttctttcttttctttctttctttctttttctttcttctttctctttctttctctttctttctttctttccttccttcccttccttccttcccttccttcctttccttccttccttcctttccttccttccttccttccttccttccttccttccttccttccttccttccttccttcctttcttctttcttaatttccttttgtaacaacagtttctccctttaggaaaaagagattgttttaaatgtagtgtctgccaataggtccaatacataagttccaaca

SEQ ID NO: 5819 - DNA, 456 bp, Homo sapiens
  AC022077.16_145940
  Located on chromosome 3
  Distance between a terminus base of telomere on chromosomal short arm and 5'-terminus of this base sequence : 142577642
  Distance between 3'-terminus of neighbour sequence of sequence listing upward to telomere on chrosomal short arm and 5'-terminus of this base sequence : 92735
cgtacagaattagattaaccacagtgcttggttcatgacacactttcctccttagctcacttatgtttatatatgtatgtacatattttttatgcgtgtgtgtgtgtgtgtgtgtatttatgtatttcgtcttttctttctttcccttcctatccctttcccttttttctctctgtcttctttccttccttcttttcctctcaccacaaagctgtgtttgacaataatgtacatctagcaatattgttttcctcacaatacatcccctttcctccactcatatttctgaatcctgtagtcatcattcctttcctttttatatataattttaatgggtatatacatatcttataaagcatatttttaattattttttacatccccaacaattttattagtgtgtataatcctttgggactaaatttttcactttctactaaatatgcaagatccacc

SEQ ID NO: 5820 - DNA, 384 bp, Homo sapiens
  AC015653.4_150643
  Located on chromosome 3
  Distance between a terminus base of telomere on chromosomal short arm and 5'-terminus of this base sequence : 142799396
  Distance between 3'-terminus of neighbour sequence of sequence listing upward to telomere on chrosomal short arm and 5'-terminus of this base sequence : 221298
gaagtccgagttatccatctattttcacagttgctgttgttgtatcctatttagaaatttatatctgccccaaggtcataaagatacttctacaaagttgtcttttgagaagtcttagtgtcctgtctttcatatataagttttaatacttataggattctctctctctctctctctctctctctctctctctctgtgtgtgtcttctttttgttttctagtgcatccaaacagccttttttggagtggagggcacagaagtcccacgacaggtggaagacagaccataaaggagaaaaattttctctatcagtttgcttgcagctattgcttgggcaacccagtctcagataatcagatgattctgtatgagttgaaagtgag

SEQ ID NO: 5821 - DNA, 428 bp, Homo sapiens
  AC015653.4_108164
  Located on chromosome 3
  Distance between a terminus base of telomere on chromosomal short arm and 5'-terminus of this base sequence : 142821285
  Distance between 3'-terminus of neighbour sequence of sequence listing upward to telomere on chrosomal short arm and 5'-terminus of this base sequence : 21505
ctaacggtcactatacataggtctttaatgaccacagtctttttcttggattaattaactcttattgtttcagttaggctgataaaataaatcctcctcctccctcaacagtgcacctaacaccagtcccatttcttccactagccataggacagctccttaaatgttctctcacagctcaaactgatacaccaaagtgttgttttgcacaacagtacacacatacacacacacacacacacacacaataaagtctccattcctcatcactgtgccctgttgtcattaagtattgttggtactacctttgaaaaatacctgtcacacatccccttcacgctattcccagactagctcaggccatcagcatgttgtgattttgtaacatcttcttaactatattcctctctgatttactatccagctca

SEQ ID NO: 5822 - DNA, 325 bp, Homo sapiens
  chr3.fa.O7frz.157519329
  Located on chromosome 3
  Distance between a terminus base of telomere on chromosomal short arm and 5'-terminus of this base sequence : 143025841
  Distance between 3'-terminus of neighbour sequence of sequence listing upward to telomere on chrosomal short arm and 5'-terminus of this base sequence : 204128
gaagttaaagtgaaagaaggaaagaaagaaagaaagaaagaaagaaagaaagaaagaaagaaagaaagaaggaaggaaggaaggaaggaaggaaggaaggaaggaaggaaggaaaggaaggaaggaaggaaggaaggaaagaaagaaagaaagaaagaaagaaagaaagaaagaaagaaagaaagaaagaaagaaagaaaaagaaagaaggaaagaaagaaagaaaaaagaaagaaagaaagaaagaaagaaagaaagaaagaaagaaagaaagaaagagagaaaataaacagatatgtgaaaataggcactgttaatgtagcac

SEQ ID NO: 5823 - DNA, 122 bp, Homo sapiens
  DISO7_10001239
  Located on chromosome 3
  Distance between a terminus base of telomere on chromosomal short arm and 5'-terminus of this base sequence : 143093206
  Distance between 3'-terminus of neighbour sequence of sequence listing upward to telomere on chrosomal short arm and 5'-terminus of this base sequence : 67040
agcacttacagcatcatattcagatattttctcattcttcacacacacacacacacacacacacacacacacacacacacacacacacaatattcagaccaaatccctccaaggcattaaga

SEQ ID NO: 5824 - DNA, 103 bp, Homo sapiens
  DISO7_10001242
  Located on chromosome 3
  Distance between a terminus base of telomere on chromosomal short arm and 5'-terminus of this base sequence : 143209905
  Distance between 3'-terminus of neighbour sequence of sequence listing upward to telomere on chrosomal short arm and 5'-terminus of this base sequence : 116577
agggattgaagccaacagccagccaatcaatgtgagtgtgtgtgtgtgtgtgtgtgtgtgtgtgtgtgtgtgtgtgtgtgttggggaaggctggagagctgac

SEQ ID NO: 5825 - DNA, 225 bp, Homo sapiens
  chr3.fa.O7frz.158074735
  Located on chromosome 3
  Distance between a terminus base of telomere on chromosomal short arm and 5'-terminus of this base sequence : 143492270
  Distance between 3'-terminus of neighbour sequence of sequence listing upward to telomere on chrosomal short arm and 5'-terminus of this base sequence : 282262
taattctatcataacctagctccttgaaaataaggatttccaatgtggtggatagaaatatatccaatatagaaaaggttaagcaaaacatcctatagtccagaatttgaattataagtatcagtatgaacttgggatattttgccgtgtgtgtgtgtgtgtgtgtgtgtgtgtgtgtgtgtgtgtgtgtacatttcctagctatcattgaagaccattgtaaac

SEQ ID NO: 5826 - DNA, 101 bp, Homo sapiens
  DISO7_10001245
  Located on chromosome 3
  Distance between a terminus base of telomere on chromosomal short arm and 5'-terminus of this base sequence : 143526043
  Distance between 3'-terminus of neighbour sequence of sequence listing upward to telomere on chrosomal short arm and 5'-terminus of this base sequence : 33548
gcaagcagtacgaaggtgaaacttatccaaccaagtcaagggcagtgttgcacacacacacacacacacacacaaagtagtaggacagctgaattaatcaa

SEQ ID NO: 5827 - DNA, 301 bp, Homo sapiens
  AC022337.17_2171
  Located on chromosome 3
  Distance between a terminus base of telomere on chromosomal short arm and 5'-terminus of this base sequence : 143665025
  Distance between 3'-terminus of neighbour sequence of sequence listing upward to telomere on chrosomal short arm and 5'-terminus of this base sequence : 138881
tttagtgcctgaagtaattagaagaggttttctgttacttttaacaccaaacaaccctaagtactgactcatttcctgaactgaatttactgatattcaagccagatacacacacacacacacacacacacacacacacacacacacacacacatcacctggttttttatgaggctcaaggtaataggaaagtggtgttcattgcagcccttctcttcatggttcatcacaccatttaataatttagaaaagaatggatctaaaaagttattttactttgaattaccagttagtcctttgg

SEQ ID NO: 5828 - DNA, 130 bp, Homo sapiens
  DISO7_10001246
  Located on chromosome 3
  Distance between a terminus base of telomere on chromosomal short arm and 5'-terminus of this base sequence : 143708674
  Distance between 3'-terminus of neighbour sequence of sequence listing upward to telomere on chrosomal short arm and 5'-terminus of this base sequence : 43348
ctcatgctgagaggaggctgggaatgagagagagtgtgtgtgtgtgtgagtgtgtatgtgtgagtgtgtatatgtgtgtgtgtgctccctcttcttgggagtaaagtaaacaaggtgagaaagtgagcat

SEQ ID NO: 5829 - DNA, 399 bp, Homo sapiens
  AC022497.12_133590
  Located on chromosome 3
  Distance between a terminus base of telomere on chromosomal short arm and 5'-terminus of this base sequence : 143767085
  Distance between 3'-terminus of neighbour sequence of sequence listing upward to telomere on chrosomal short arm and 5'-terminus of this base sequence : 58281
aatggctcatgcctgtaatcctagcactttggcaggccaaggcaggtggattgctggagctcaggagttcgagaccagcctgggcaatgtggcaaaaccctgtctctgcaaaaaaatacaaaaattagccagggtggtggggcacacctgtagtcccagctactcaggaggctgaggtgcaaggatcgcttgaacctgggaggttgaggctgtggtgagagatcgtgccactgcactcaagcctggggtcagagtgagaccctatctcaaaaataaatataaaataaaataaataaaataaaataaaataaaataaaataaaataaaataaaataaaataaaaatcaaaagaaacaacctaacattttaaagactgtgtacctgaaaccagtaactcat

SEQ ID NO: 5830 - DNA, 401 bp, Homo sapiens
  AC022337.17_165826
  Located on chromosome 3
  Distance between a terminus base of telomere on chromosomal short arm and 5'-terminus of this base sequence : 143767085
  Distance between 3'-terminus of neighbour sequence of sequence listing upward to telomere on chrosomal short arm and 5'-terminus of this base sequence : -399
aatggctcatgcctgtaatcctagcactttggcaggccaaggcaggtggattgctggagctcaggagttcgagaccagcctgggcaatgtggcaaaaccctgtctctgcaaaaaaatacaaaaattagccagggtggtggggcacacctgtagtcccagctactcaggaggctgaggtgcaaggatcgcttgaacctgggaggttgaggctgtggtgagagatcgtgccactgcactcaagcctggggtcagagtgagaccctatctcaaaaataaatataaaataaaataaataaaataaaataaaataaaataaaataaaataaaataaaataaaataaaaatcaaaagaaacaacctaacattttaaagactgtgtacctgaaaccagtaactcatgt

SEQ ID NO: 5831 - DNA, 142 bp, Homo sapiens
  DISD22_0003010
  Located on chromosome 3
  Distance between a terminus base of telomere on chromosomal short arm and 5'-terminus of this base sequence : 144037683
  Distance between 3'-terminus of neighbour sequence of sequence listing upward to telomere on chrosomal short arm and 5'-terminus of this base sequence : 270197
gaggacttcaactttaactgtaatgtatttgcttaaaatatatatatatatatatatatatatatattatatatatatatatatatatatatattttaaacccatgacaaaaattaacatttcttaattctggagggtggat

SEQ ID NO: 5832 - DNA, 425 bp, Homo sapiens
  chr3.fa.O7frz.158887240
  Located on chromosome 3
  Distance between a terminus base of telomere on chromosomal short arm and 5'-terminus of this base sequence : 144257007
  Distance between 3'-terminus of neighbour sequence of sequence listing upward to telomere on chrosomal short arm and 5'-terminus of this base sequence : 219182
tttacatgtaacgctccataagtagtttattttgatacaaagcatgaagtgttgatccaatttactttttttctagatggctctccagatttcccaacacctttgattgaataatccatctttttctgcagaaataaaatatcaccttcataatatattacatttatttatttatttatttatttatttatttatttatttttgagttggagtcttgctctgttgcccaggctggtgtgcagtggtgcaatctcggctcactgcaacctccgcttcctgggttcaagcaattctcctgcctcagcctccggagtagctgggattacaggcgtgagcgtgagccaccatgctcagctattttttatatttttagtagagactgggttttgccatgttggccatgctgttcttacttgaactgctga

SEQ ID NO: 5833 - DNA, 374 bp, Homo sapiens
  HUMUT869B
  Located on chromosome 3
  Distance between a terminus base of telomere on chromosomal short arm and 5'-terminus of this base sequence : 144272988
  Distance between 3'-terminus of neighbour sequence of sequence listing upward to telomere on chrosomal short arm and 5'-terminus of this base sequence : 15556
cccctaactttcctccagagttctattttctttctttctttctttcctttctttccttgccttccttgcctttccttgcctttccttgccttccttgccttccttgccttccttgccttccttgcctgcctgcctgcctgctttcttttctttctttctttttctttctttctttctctcgctcgctttctttctttctttctttctttctttctttctttctttctttctttctttctttctttctttctttctttctttttttcttccctctccctctccctctctctttctttctttcttttttgagacagagtcttactctgttgcccaggctggagtgcagtggtatgatcttgactcactgcaacctc

SEQ ID NO: 5834 - DNA, 359 bp, Homo sapiens
  AC023046.2_107160
  Located on chromosome 3
  Distance between a terminus base of telomere on chromosomal short arm and 5'-terminus of this base sequence : 144316611
  Distance between 3'-terminus of neighbour sequence of sequence listing upward to telomere on chrosomal short arm and 5'-terminus of this base sequence : 43249
cgttggagtacatgtaaacatcaatcaggccaaagggacttttccaggttggctgcttgagctggtcaaatgaaccagatcatttactttgccttctgagctctgtagacacaaccaaaagaataaaaaaagtgtgtgtgtgtgtgtgtgtgtgtgtgtgtgtgtgtgtgtaaggcagcaaatataccttttactctagaaacaaaaatatcatttctgacccaacaatagccggatccttgtgaatgaagggtttgcatattttcctgttttaacggttctagtataaacagcccaagcccaggcctgattgtcagaaggtcctgagcagcccaaccagaatgctggaaatgactcct

SEQ ID NO: 5835 - DNA, 134 bp, Homo sapiens
  G09845
  Located on chromosome 3
  Distance between a terminus base of telomere on chromosomal short arm and 5'-terminus of this base sequence : 144400391
  Distance between 3'-terminus of neighbour sequence of sequence listing upward to telomere on chrosomal short arm and 5'-terminus of this base sequence : 83421
ctttataatgggccaggagctgctgttcggtcaggagctgctgctgctgctgctgctgtgtgtgtgcgtgcgtgtgtgtgtgtgtgtgtgtgtgtgtgtgtctgtgcacgtgcgcgcatgcacaaaagactaaa

SEQ ID NO: 5836 - DNA, 478 bp, Homo sapiens
  AC044901.2_37572
  Located on chromosome 3
  Distance between a terminus base of telomere on chromosomal short arm and 5'-terminus of this base sequence : 144574143
  Distance between 3'-terminus of neighbour sequence of sequence listing upward to telomere on chrosomal short arm and 5'-terminus of this base sequence : 173618
tccaagaatatgcactcagtaggtggcagagcacttaccccacctgcctgccgtcagggaggctgccatctgtaaattagtctgagggaggactggcatgaggtcaccttgtccaggaccttgtacccatttccaactgtatgtatcatctggacttaccacaggtgtctgtgggtgaataaagacctaaagtttacttctgggtgggtatcatctgtgtgtgtttatgcacccatgcaccttaggaaagggtggccaaggtagaatccagaacagggagagaaattgtattagggctctccagaacaatagcgtcaatagaatgtgtgtgtgtgtgtgtgtgtgtgtgtgtgtgtgtgtcacacacagtgatgtgctgcgtaatgatgtttcagtcaatggtggactgcatataggatgctggtcccataagattataccggaggtgaaagattcctattgcctagtgatgctgtag

SEQ ID NO: 5837 - DNA, 471 bp, Homo sapiens
  AC069525.10_22409
  Located on chromosome 3
  Distance between a terminus base of telomere on chromosomal short arm and 5'-terminus of this base sequence : 144607519
  Distance between 3'-terminus of neighbour sequence of sequence listing upward to telomere on chrosomal short arm and 5'-terminus of this base sequence : 32898
atttaatccagataagcaggtaagcaatttaaggagacaggggcttactactgggaatgatggtgaggtacgatcacccatgaatgtgctgagctacacccctgacttgagctgagcaggtagacacgggtggggtatgttgaaaactggttaggtgatgaagacaagtcagaggagtttgaaggcagtgtgtgtgtgtgtgtgtgtgtgtgtgtgtgtgtgtgtgtgtgtgtatgtgtggttcctgcaaaacaaaccatctgaacaggtagactcaacggttgctacaacttttggtgcttccagtggccccccttgaactaggttcttaactctgtcttcaaatttcagtctgaaaccagagtattgcctaggggtggaatttggtcttctccgtatacactgaagtcagtgaagactgcaaggaacagtaagtccagtctgctatgagcatctgtcaactcagttaag

SEQ ID NO: 5838 - DNA, 232 bp, Homo sapiens
  D3S1764
  Located on chromosome 3
  Distance between a terminus base of telomere on chromosomal short arm and 5'-terminus of this base sequence : 144837767
  Distance between 3'-terminus of neighbour sequence of sequence listing upward to telomere on chrosomal short arm and 5'-terminus of this base sequence : 229777
tccctgggtgaaaatgagtaggtagatagatagatagatagatagatagatagatagatagatagatagacagacagacagacagacagacagatagatgtctgatgctccaattaagaatttgtttcataaaatctggattcctgatggtgctcacaagtcaatgaaggtatacacgttgccaaagtctctacttgaaccatatggtacctggtaggactttcaaagggga

SEQ ID NO: 5839 - DNA, 220 bp, Homo sapiens
  chr3.fa.O7frz.159583455
  Located on chromosome 3
  Distance between a terminus base of telomere on chromosomal short arm and 5'-terminus of this base sequence : 145024879
  Distance between 3'-terminus of neighbour sequence of sequence listing upward to telomere on chrosomal short arm and 5'-terminus of this base sequence : 186880
tctgactacaagactatggtgttcaccactaagctgcgacatacatgaaaatatttggccctcagcaaatgcttaaatacattagtcatctttccttaccttcgtattccttttaaacatacacacacacacacacacacacacacacgtgcacatataccatgaaaaatctgcctcttgggtttatgttcatttatttgttcattactgattcatgcct

SEQ ID NO: 5840 - DNA, 200 bp, Homo sapiens
  D3S3554
  Located on chromosome 3
  Distance between a terminus base of telomere on chromosomal short arm and 5'-terminus of this base sequence : 145268238
  Distance between 3'-terminus of neighbour sequence of sequence listing upward to telomere on chrosomal short arm and 5'-terminus of this base sequence : 243139
tggttggcttacttcagactgtagtaaattttactaagcaaatggacaggtctcttcatgtgcgcgcacacacacacacacacacacacacacacacacacacacacagtgcctgtttaaaaggggagaaacgaaaactattatgacttaagacaagtatcaatgaaatgtaacttgaggtctttagaacctgattaaac

SEQ ID NO: 5841 - DNA, 282 bp, Homo sapiens
  D3S1316
  Located on chromosome 3
  Distance between a terminus base of telomere on chromosomal short arm and 5'-terminus of this base sequence : 145295581
  Distance between 3'-terminus of neighbour sequence of sequence listing upward to telomere on chrosomal short arm and 5'-terminus of this base sequence : 27143
ctttgcctcctagagtccaggtagagtaaatgcttcatgagatccagaagattaaccgataagaacaaattattctacttttttgttcctcctgaagccattttcacacatagtactctgttaagaagcaggattgagtcatttatttctacatcagtgaatcaaatctgtctatataaggcttctgtatcccgagaaaaaaacagtttgtgtgtgtgtgtgtgtgtgtgtgtgtgtgtgtgtgtgtgtgtgtccatgcatgcgtgtattttcaggctaaag

SEQ ID NO: 5842 - DNA, 400 bp, Homo sapiens
  chr3.fa.O7frz.159898553
  Located on chromosome 3
  Distance between a terminus base of telomere on chromosomal short arm and 5'-terminus of this base sequence : 145395861
  Distance between 3'-terminus of neighbour sequence of sequence listing upward to telomere on chrosomal short arm and 5'-terminus of this base sequence : 99998
catcaaagttctataggcacatagttttaaaagagtcaaatcactctacagggcttgttgccaaaacatagcatttatcctgaatcttccctctgccccatgttccacttgtctgaggcaactgctttgaactattttagccaactctttcattatttgcctccacatcactaaacaacatgcttatattgctacctaatttttcacctcttggcattaggtattgactttctactttggaagatgaggatttagttctggttccctctcccttccacacaacacacacacacacacacacacacacacacacacacacacacacacacacacacaatcccccatcccccatcctcccagcagagttagttatattgtactttggttagctcaatattca

SEQ ID NO: 5843 - DNA, 472 bp, Homo sapiens
  chr3.fa.O7frz.160196533
  Located on chromosome 3
  Distance between a terminus base of telomere on chromosomal short arm and 5'-terminus of this base sequence : 145508527
  Distance between 3'-terminus of neighbour sequence of sequence listing upward to telomere on chrosomal short arm and 5'-terminus of this base sequence : 112266
agtttctattgctatgtcttcaagttcaccactctttctcctatggtgtctaatctgtttttaatctcatccaatatatttttaatcccaatgttgtttttgttcatttcctattacatgttatgttatatagtgtgtgtgtgtgtgtgtgtgtgtgtgtgtgtgtgtgtgtataaatttcactgtcttaccttctcatgcttccttttttctcttccttctggaacatatggaatatatttataatattttaatgtttttatctattaattacattatctgcgtcacttctgggtctatttctacgaactatctcttctccttatcatgagtcatgttttctggactctttgcatgccaaataattttttattggattctggacatagtgaactttatgttgtttagttagtagatttttatgcattctttgaaataatttggtactttgttctggaatgcacttaaatta

SEQ ID NO: 5844 - DNA, 482 bp, Homo sapiens
  AC022479.3_22797
  Located on chromosome 3
  Distance between a terminus base of telomere on chromosomal short arm and 5'-terminus of this base sequence : 145758335
  Distance between 3'-terminus of neighbour sequence of sequence listing upward to telomere on chrosomal short arm and 5'-terminus of this base sequence : 249336
agtccgaagtaaaataacctacagcgattgtccaatgccctgaatgttgcattagaggcgagctatgcatgatagtttgcttctccctggaggacatagctgtcacacacacacagagacacacacacacacacacacacacacacacactctctctctctctctctgtctctctttctctctctctctctatggtgatactctctctcttcctcctgttccctctttagtactaatcactgtgtagcctccactccgtgctgaggatcctgtacgtggattcaagctgtcaccacacaagacagggccagaaagggctccatttgtatattattatttatctaatatatattatataatagcctgttcatgctcatttccaacaaggagcaaaattagaaatcacatctcttaatactttcagaaactgaatacaggtccctttaaactccattcccattagatagtgtcttcgaaacacc

SEQ ID NO: 5845 - DNA, 505 bp, Homo sapiens
  AC022479.3_139963
  Located on chromosome 3
  Distance between a terminus base of telomere on chromosomal short arm and 5'-terminus of this base sequence : 145875338
  Distance between 3'-terminus of neighbour sequence of sequence listing upward to telomere on chrosomal short arm and 5'-terminus of this base sequence : 116521
gcatagatggaccttacagagatttgagtgatttgtggaataataatagctttagtggtgatgccaatagatctggtggctgagcagggattctagaattatctctgcaccattattttggctgcccgatgactccctctctctacttcatgtgttgaagatgctgcaggctattgcttactcataactcataaactgcttcatttctgtgtactgccttctcttggtgtgtctttaagcttctgcctccctcttatattctcatattttctctctttctttctctctctctctctctctctctctctctctgctatctttaattcttaaattccccagaaagagttggtgttaatcactcacatccctgtagggaagactgatgccagaccaccctataaatctctggtcagtctttgaatgactgtcttttagtcagttattcattcctaatccaattcatcagggtcagattggcaggacatcatggtacaaagtaaggaca

SEQ ID NO: 5846 - DNA, 483 bp, Homo sapiens
  AC048346.12_132963
  Located on chromosome 3
  Distance between a terminus base of telomere on chromosomal short arm and 5'-terminus of this base sequence : 145943140
  Distance between 3'-terminus of neighbour sequence of sequence listing upward to telomere on chrosomal short arm and 5'-terminus of this base sequence : 67297
tgtaggcagataaattgttcacaggcccttgctatgcattttacacatcttcacctcagtgtctcattacccattactcagatgtgaggtaactgtggcttggaaagattagaaaacaactggctctgtatcaactggccaggaaatagaaacgctgagttttgaatcaagtgtgcattcttttgccagagaaatagtgcgtctagggtcccggacaggtacaggtcgttagtctataggagtgagcagcccagatcatgagatgaggaggatggcaacagacaagaaaaaaaagaagtacatgtgtgtgtgtgtgtgtgtgtgtgtgtgtgtgtgtgtgtgtgtgtgtgtgtgtgtgtgtgtgtgtgtgtgtgtgtgtatatatatatatatatatatatatatatacacacacacacacacacacacacacacacacacacacacacacatatatacagcctctgcctctaaccagatcct

SEQ ID NO: 5847 - DNA, 365 bp, Homo sapiens
  AC025421.15_117448
  Located on chromosome 3
  Distance between a terminus base of telomere on chromosomal short arm and 5'-terminus of this base sequence : 145979764
  Distance between 3'-terminus of neighbour sequence of sequence listing upward to telomere on chrosomal short arm and 5'-terminus of this base sequence : 36141
tacctaagaattcgtctaaccaaggaggtaaaagatctctgcaaagaaaactaccaaacactgctgaaagaaatcagagatgacacaaagaaatgggaaaacgtttcatgcttaaggattggaaggatcaatatcattaaaatggccatactgcccaaagcaatttatacgttaaatgctatccctatcaaaataccaatgtcattttttacagaattagaaaaatctactcataaatttatatgaaacaaacaaacaaacaaaaaaaaaaaacaaccacagcaatactgagcaaacaacaacaacaacaaaaaaaaaactggaggcatcacattactcgacttcaaattataccataaggcaac

SEQ ID NO: 5848 - DNA, 459 bp, Homo sapiens
  AC026324.6_66181
  Located on chromosome 3
  Distance between a terminus base of telomere on chromosomal short arm and 5'-terminus of this base sequence : 146180669
  Distance between 3'-terminus of neighbour sequence of sequence listing upward to telomere on chrosomal short arm and 5'-terminus of this base sequence : 200540
tgcaagatgttctcaagtagacactgccactaattatctctaattagggccatagacacttctctaaagaaaggctgttagggatgttgaaatatgtagctgtatacagagagaatatgcttaacatagtggaatttttaataaacatatacttacaaatctcttgattatatttgacacacacacacacacacacacgcacacattatatattgcacctcagacatgggcctgggaggagggaagctatgtaaatcataacctcagggaccaaataatgtgcagtttctgtgccattaagaaatccacattgcatttggtagaatgggtcagctactggttaagtgggcttctcaaagaatctagctagctgtcttggtcactgaatgcaagtttagatgttttctagagagacaagatcagggtgctgtggtttatttaattctagcctagtccttg

SEQ ID NO: 5849 - DNA, 357 bp, Homo sapiens
  AC068429.1_71890
  Located on chromosome 3
  Distance between a terminus base of telomere on chromosomal short arm and 5'-terminus of this base sequence : 146308128
  Distance between 3'-terminus of neighbour sequence of sequence listing upward to telomere on chrosomal short arm and 5'-terminus of this base sequence : 127000
tagtcacctaagcttgtagttcacagtgaggttatctcaagcaaataaggactaaggttactacttcagacccaacttgaaaaattttgaaaaactactacagatgaaggaaattaagcaaagaatgaagacacaaaaagtaattatgcttattttttcccacatatttataatgttttatatttaaggttaagagtgtgtgtgtgtgtgtgtgtgtgtgtgtgtacaggaagagaaacagagagtctgtgtaacagtgttctatacatgaaatatacaatgattaattaatacccatttgggaaacctgtccccttccaggccaggcactgatgattagatgcataatggtaaagg

SEQ ID NO: 5850 - DNA, 195 bp, Homo sapiens
  D3S1301
  Located on chromosome 3
  Distance between a terminus base of telomere on chromosomal short arm and 5'-terminus of this base sequence : 146361046
  Distance between 3'-terminus of neighbour sequence of sequence listing upward to telomere on chrosomal short arm and 5'-terminus of this base sequence : 52561
cataaatatcacagggccaataaaagaaacacacacacacacacacacacacacacacacacacacacaatcaaggtattcaggcaacaaatagcatgatgaatagaatagtaattcacatctgaatactaacattgaatgtaaatggcctaaatgctcaacttaaaagatactgaatggcagaacggataagaa

SEQ ID NO: 5851 - DNA, 311 bp, Homo sapiens
  chr3.fa.O7frz.161245470
  Located on chromosome 3
  Distance between a terminus base of telomere on chromosomal short arm and 5'-terminus of this base sequence : 146395122
  Distance between 3'-terminus of neighbour sequence of sequence listing upward to telomere on chrosomal short arm and 5'-terminus of this base sequence : 33881
tgttttctacagtggctgtaacattttacattcccaccagcaatgcacacaaagttccaatttttccacatgttcaccaactcttggcatttccttttaaataatagatatcctaatgtgtgtgaggtggtatctcatggtgattttgatttgcattttcctaatgattagtaacattgggcatcttctcatgtgattattggccatttgtatatatgtatatatatatatatatatatatttttttttttggagaaatgtctgttcaagtcctttgctcattaaaacttgtttattcttcaaagaaatca

SEQ ID NO: 5852 - DNA, 281 bp, Homo sapiens
  G09959
  Located on chromosome 3
  Distance between a terminus base of telomere on chromosomal short arm and 5'-terminus of this base sequence : 146457081
  Distance between 3'-terminus of neighbour sequence of sequence listing upward to telomere on chrosomal short arm and 5'-terminus of this base sequence : 61648
gatgattatctccttgccccaacccaggtgctatctatctatctatctatctatctatctatctatctatctatctttccattaaatccttttagccccatgtgtgaagtgttaataatatccccatttcacagatggggaaactgaggctgtgaacggctgaaaggtttcagggccagaactagaatttggactctagtctgcctgatttcaggctcaaagcgtccctttcagaatgtcctgagggctcttttcttcccctgctgtcttcactctgacca

SEQ ID NO: 5853 - DNA, 142 bp, Homo sapiens
  D3S1309
  Located on chromosome 3
  Distance between a terminus base of telomere on chromosomal short arm and 5'-terminus of this base sequence : 146501395
  Distance between 3'-terminus of neighbour sequence of sequence listing upward to telomere on chrosomal short arm and 5'-terminus of this base sequence : 44033
atgagaattgtcatggtgcatatacccttcatttactgttaacttgttaacatcttggaatgtttgctttctcgtgtgtgtgtgtgtgtgtgtgtgtgtgtgtgtgtgtgtgtgtgttatacagactaatgattccccaaag

SEQ ID NO: 5854 - DNA, 194 bp, Homo sapiens
  D3S3612
  Located on chromosome 3
  Distance between a terminus base of telomere on chromosomal short arm and 5'-terminus of this base sequence : 146602860
  Distance between 3'-terminus of neighbour sequence of sequence listing upward to telomere on chrosomal short arm and 5'-terminus of this base sequence : 101323
tgcccagttttagtccaaaacacaagaaaattggtccactcttgcctatagttctgggtgcttggatctcattccagcctacagatttgttttgttatcatacttgtgtgtgtgtgtgtgtgtgtgtgtgtgtgtgtgtgtgtgtgtgtgtgtgcgcgcgcgtgtgttttaataaaattgagcctaacaaagaa

SEQ ID NO: 5855 - DNA, 256 bp, Homo sapiens
  AC022215.3_18219
  Located on chromosome 3
  Distance between a terminus base of telomere on chromosomal short arm and 5'-terminus of this base sequence : 146719705
  Distance between 3'-terminus of neighbour sequence of sequence listing upward to telomere on chrosomal short arm and 5'-terminus of this base sequence : 116651
ccattacctcatgatcacatagacctgtctctattgacttggaaggttgtgcataatatattaaattttaaaatggtacctttatatgcgggtgggtgggggagagagagagagagagagagagagagagagagagagagtgtgtgtgtgtgtgtgtgtgtgtgtgtgtgtgtgtcttgagtcagcaagagcaaatactatcacggctagttagtaaaaatagaaagcattagtagaagtattcagtgaattcagg

SEQ ID NO: 5856 - DNA, 425 bp, Homo sapiens
  AC022215.3_3912
  Located on chromosome 3
  Distance between a terminus base of telomere on chromosomal short arm and 5'-terminus of this base sequence : 146733966
  Distance between 3'-terminus of neighbour sequence of sequence listing upward to telomere on chrosomal short arm and 5'-terminus of this base sequence : 14005
taagtctttgctcaaatgtcaccttctcaataaaacctactcagaacactccagttaaaatgacaaggtgctcctccttccaccctggtctcccacagcccccttagcctgctcttctctttgccacagcatctgttactttctaacccagacaaacacacacacacacacacacacacacacacagagtgttcattgtgtattgtctgcttccccaggctagaatataacctccctaagggcagagatttttatttgtttttgttcactgctgctgcattccaagtgcttaggacagtgactgacatatgagtggtggggtgtgattaaatgtttgttgaatgaataaatgatggcagctgaaactcagaagtggcagcagagatggagagagtgagtgggtcttagagaaggttacaaggtgg

SEQ ID NO: 5857 - DNA, 237 bp, Homo sapiens
  chr3.fa.O7frz.161745547
  Located on chromosome 3
  Distance between a terminus base of telomere on chromosomal short arm and 5'-terminus of this base sequence : 146835894
  Distance between 3'-terminus of neighbour sequence of sequence listing upward to telomere on chrosomal short arm and 5'-terminus of this base sequence : 101503
tttgcttattaggcatttcttaaaaatcctgaataagcagctctttcaacagtttttgttccacatgttaaacatttcattgcaattcgagctttgagtgtgtgtgtgtgtgtgtgtgtgtgtgtgtgcgcgtgtgttgataggaaggaatgaaagggggtgcataagaattcttgaatgttttttatttaaaaaattaattcctcaccattacatattgaactatctgcagaaggt

SEQ ID NO: 5858 - DNA, 472 bp, Homo sapiens
  chr3.fa.O7frz.161817762
  Located on chromosome 3
  Distance between a terminus base of telomere on chromosomal short arm and 5'-terminus of this base sequence : 146929069
  Distance between 3'-terminus of neighbour sequence of sequence listing upward to telomere on chrosomal short arm and 5'-terminus of this base sequence : 92938
ttttgataagaactgctccagcctggtgctgtgacacacacctatgatgccagctacctgggaggctgaagcaagagaatcccataaacgggagttcgagactcacctaggcaacatagcgaaaccccatctgaaaaagaagaagaaagaagaagaagaagaagaagaagaagaagaagaagaagaagaagaagaagaagaagaagaagaagaggaagaagaagaggaagaagaagaggaagaagaagaagaaggagaagaagaagaagaagaagaagaagaagaagaagaagaagaagaagaagaagaagaaggggaggaggaggaggaagaggaagaggaagaagaagaagaagaagatgaggaggaggaggaggaggaagaggaagaggaagaagaagaagaagaactgctctagattatatacttgtatctcattttttaacagtagaattactatcaggactttgct

SEQ ID NO: 5859 - DNA, 470 bp, Homo sapiens
  AC025108.3_10060
  Located on chromosome 3
  Distance between a terminus base of telomere on chromosomal short arm and 5'-terminus of this base sequence : 146988389
  Distance between 3'-terminus of neighbour sequence of sequence listing upward to telomere on chrosomal short arm and 5'-terminus of this base sequence : 58848
tatcttgttggccagaactacatcatatggctatccctgatctcaagggaggctacagaatgtcagtttgctgggctcataactgccccatcaaaaaacaaaacacacacacacacacacacacacacacacaaacttgttttgctgcaattcaaatctattaaatgattacagatataagtaaaactgaacttttgtgtgaaaagagactaaaaagtattctaaaatgttcactgatttgagtttctaaaactgaaaagcagttttaaataatttaaaactttatttttctttactaagaacaacacagtagtagtaaaaactttgaaaattaaattggtagtatatacttttaaaatctgaaaattaaattggtagtatgaacttttaaaatctagagcaaaaaagcaaagaaaatcttctgaaatttcaccaaccaaaggtatcttctatcaacattttggtagatg

SEQ ID NO: 5860 - DNA, 457 bp, Homo sapiens
  AC025108.3_135675
  Located on chromosome 3
  Distance between a terminus base of telomere on chromosomal short arm and 5'-terminus of this base sequence : 146999716
  Distance between 3'-terminus of neighbour sequence of sequence listing upward to telomere on chrosomal short arm and 5'-terminus of this base sequence : 10857
acatggtctagtatctctgtcctaaaaggcatgcctccccagacctcatctctgcccacccataccccagtcctttttatcattcccattcctctgctctcctttgaaggcagacttctctagggaaaaatagtggtaggagtgtgtatgagtgtgtgtgtgcgtgtgtgtgtgtgtgtgtgtgtgtgtgtgtttgcaattctccagtcagcactctccagtagatttttctgtgatgtggaaaatgctttgtatcttcactgtccaaaacagtagccactagccatgtgtggatattgaaaacttgaaatacagctaatgtgaccaaagagctgaagtttaattttatttaattttaattaaatgtaaaaaaccacacatggctaatgactacagcattagtgcagcttcagtaaaagaacctggactcctttttagcagtagcttatttcaggac

SEQ ID NO: 5861 - DNA, 192 bp, Homo sapiens
  D3S3711
  Located on chromosome 3
  Distance between a terminus base of telomere on chromosomal short arm and 5'-terminus of this base sequence : 146999819
  Distance between 3'-terminus of neighbour sequence of sequence listing upward to telomere on chrosomal short arm and 5'-terminus of this base sequence : -354
ttgaaggcagacttctctagggaaaaatagtggtaggagtgtgtatgagtgtgtgtgtgcgtgtgtgtgtgtgtgtgtgtgtgtgtgtgtttgcaattctccagtcagcactctccagtagatttttctgtgatgtggaaaatgctttgtatcttcactgtccaaaacagtagccactagccatgtgtggat

SEQ ID NO: 5862 - DNA, 404 bp, Homo sapiens
  chr3.fa.O7frz.162009345
  Located on chromosome 3
  Distance between a terminus base of telomere on chromosomal short arm and 5'-terminus of this base sequence : 147108824
  Distance between 3'-terminus of neighbour sequence of sequence listing upward to telomere on chrosomal short arm and 5'-terminus of this base sequence : 108813
tggagtcatctaatggcacatagtatagtgcaatggtacatgcccaggtccccaggggtgacctgttttctgcctttcccaaggcctagttgttcagctgtcccttagcagtgtattagtcagggttctccagagaaacagaaccactaggatgggggtgggtgtgtcttgagagagagacagaaacagagagagagagagagagagagattttgaagaattggctcgtgcaatcgtagcagctggcaagtctgaaatctgcagggcaggcctgccagctggagacccagggaagagctgaggttgcagttcaagtccacaggcagtccagaggcagaattccttcttcctcgagggacttctccgtcttttctcctaaggtcttcaactgactagattagcga

SEQ ID NO: 5863 - DNA, 426 bp, Homo sapiens
  AC067952.5_101997
  Located on chromosome 3
  Distance between a terminus base of telomere on chromosomal short arm and 5'-terminus of this base sequence : 147306931
  Distance between 3'-terminus of neighbour sequence of sequence listing upward to telomere on chrosomal short arm and 5'-terminus of this base sequence : 197703
tagtacagcgtttaggagtgagtggctgtgggcaggtggaggggaaacacataatctgaaaacactctacctgtctttctggctctcagcgcttcaagtatgttagcagcagccatttctcccagaacattgtttccaaggtcaatttcccttaagtaggcagagtatttgatcaggctgtcaaaagaaaatcacacacacacacacacacacacacacacacacacacacacacacacaggcatcgtgtcaagcattgttactcaaagaacctcaatccagttattttggagaatgatctctctttttaaacccctcccccaaccccaaacccaagatgatgcattggcccaatgtgagaccaaagacaccccgaaaccaatttttaccaatctactctctctagtttggatacttctcctaggt

SEQ ID NO: 5864 - DNA, 282 bp, Homo sapiens
  chr3.fa.O7frz.162303402
  Located on chromosome 3
  Distance between a terminus base of telomere on chromosomal short arm and 5'-terminus of this base sequence : 147573465
  Distance between 3'-terminus of neighbour sequence of sequence listing upward to telomere on chrosomal short arm and 5'-terminus of this base sequence : 266108
caccgtcagtaggtgaaagtaggggtgtacttggcacaccctgtcttgctccctcctatgaggctgtgtgtgtgtgtgtgtgtgtgtgtgtgtgtatgtgtgtacctccccccataccttatgtattgggttttgtgaatggctctagcctttatggccagaactcttgattggaagaggagggagaaaaggtcatcactgcttgcagctgcaggcataataagccgccatccacccgcctcaggaattctcctccagcttaactttcagtgtgacagaaac

SEQ ID NO: 5865 - DNA, 433 bp, Homo sapiens
  chr3.fa.O7frz.162674405
  Located on chromosome 3
  Distance between a terminus base of telomere on chromosomal short arm and 5'-terminus of this base sequence : 147715394
  Distance between 3'-terminus of neighbour sequence of sequence listing upward to telomere on chrosomal short arm and 5'-terminus of this base sequence : 141647
accactttctatcactagactgttcattaagccagtctgaaaaaataaaaaggtgggtggaaagagaagaggaaaaaggaaggaaggaaggaagggaagggagggagggaggcaatattaaaaaagaaagagaggctgaggaaagaagcaggggaaggggaatagtgaggagggcatgggaggagggaatgagatcagagacaggggaaggaaggacaaaggggagaaggaagggtaagagaaggaatagagagagaggaaaagagaaggggaggaaggggagtaaaggaaggtaatggaggtaaggaagagaggaagggaagaaagtaatcttacaaaacaaaggaaaagaaaatgtgagctgacaagcattaacactaaacatttgttgagacatacacaaaagaaaactaactggaactccacataactc

SEQ ID NO: 5866 - DNA, 424 bp, Homo sapiens
  AC023508.10_110576
  Located on chromosome 3
  Distance between a terminus base of telomere on chromosomal short arm and 5'-terminus of this base sequence : 147767840
  Distance between 3'-terminus of neighbour sequence of sequence listing upward to telomere on chrosomal short arm and 5'-terminus of this base sequence : 52013
gaggctaggtgtttgagactagcctgagcaacacagtgataccccatctctacaaaaaattaaaatagtagcctggcatggtggtatgcacctatagtcccagctattgcagaggcggaggcaggaggattgctcgaactcaggagctccaggttgtggtgaggtataatatgaatgtgccactgcactccaccctgagtgacatagtaagaccccgtctcactaaaaaaaaatataatatatatatatatatatatatatatgaatgaaataaaatttattgtattttcttactatcctgcatgaaagggtttttaatatatggtgcataatctgatctataacttttacagcaatgcattatattattttgattctatttttgcatatttgttttttgattactagatctgtcaggagctgt

SEQ ID NO: 5867 - DNA, 261 bp, Homo sapiens
  AC072028.5_149909
  Located on chromosome 3
  Distance between a terminus base of telomere on chromosomal short arm and 5'-terminus of this base sequence : 147898939
  Distance between 3'-terminus of neighbour sequence of sequence listing upward to telomere on chrosomal short arm and 5'-terminus of this base sequence : 130675
tctttctagccataccatctgtttctctgaggcacattttctcaatattcattttggaatgtaatgatgtactagcttgtattatatttgatttataactctgtaacaaggatgaattcccaggcctcaaaatttaggtgtgtaagaaacacttatcttcattttattttattttattttattttattttattttattttatttttgagatggagttttgctcttgttgcacaggctagagtgtaatggtgcgatctcagc

SEQ ID NO: 5868 - DNA, 449 bp, Homo sapiens
  AC026304.13_104381
  Located on chromosome 3
  Distance between a terminus base of telomere on chromosomal short arm and 5'-terminus of this base sequence : 148242438
  Distance between 3'-terminus of neighbour sequence of sequence listing upward to telomere on chrosomal short arm and 5'-terminus of this base sequence : 343238
taaccacattctgtagttggaggaggtagtaggaatttagaatcaaaatgattgcctggaatggccgacaggggtacatgaagacagacggtaaataaaggggaaggttttttccattcattcacccaatataattatctcctttttaccagtgctaggtgcttttcaaaaatgatctcatttaatcctctcgctaacccttacagatgaagaaatcggatgagagggagaggagaggagggagggctgggttggggggaagggagaaaaagagagagggagacacacacacacacacacacagagagagagagagggagagagagagagagagagactgtcctgaccaaaggaacacagcttgcaagtcggggagcagagttagaaattcagagcaatctgacttcaaagcctctattctcttccctgtcacactgtaggtggactgt

SEQ ID NO: 5869 - DNA, 369 bp, Homo sapiens
  AC055737.11_68222
  Located on chromosome 3
  Distance between a terminus base of telomere on chromosomal short arm and 5'-terminus of this base sequence : 148256936
  Distance between 3'-terminus of neighbour sequence of sequence listing upward to telomere on chrosomal short arm and 5'-terminus of this base sequence : 14049
ctgtaatattacctggtcttgtctcgtgagtttcagtaaatatggggatatgtacgcttcgcactggccaaagccaggtcacaagttaagtgaggccttatctttggtggtccaagtcaagcccacctttgggttgcctggccatggcaagagagagctccccagatttgccgtgtgctggttctcatgacctgccacaggaaccttgagtcctcctttatcacactcacacacacacacacacacacacacactcaggaacgctcatttccatttccacagtacgccatctggactctcctagattttattaaccttgttgataaaataattcctacacagtaaaggtttccttctcactaggatcat

SEQ ID NO: 5870 - DNA, 369 bp, Homo sapiens; identical to SEQ ID NO: 5869
  AC026304.13_47582
  Located on chromosome 3
  Distance between a terminus base of telomere on chromosomal short arm and 5'-terminus of this base sequence : 148256936
  Distance between 3'-terminus of neighbour sequence of sequence listing upward to telomere on chrosomal short arm and 5'-terminus of this base sequence : -369

SEQ ID NO: 5871 - DNA, 241 bp, Homo sapiens
  D3S3546
  Located on chromosome 3
  Distance between a terminus base of telomere on chromosomal short arm and 5'-terminus of this base sequence : 148257108
  Distance between 3'-terminus of neighbour sequence of sequence listing upward to telomere on chrosomal short arm and 5'-terminus of this base sequence : -197
gtgtgctggttctcatgacctgccacaggaaccttgagtcctcctttatcacactcacacacacacacacacacacacacactcaggaacgctcatttccatttccacagtacgccatctggactctcctagattttattaaccttgttgataaaataattcctacacagtaaaggtttccttctcactaggatcatagttaaaatggcaatttctattattttcaacatggcaccagtgt

SEQ ID NO: 5872 - DNA, 263 bp, Homo sapiens
  AC055737.11_43019
  Located on chromosome 3
  Distance between a terminus base of telomere on chromosomal short arm and 5'-terminus of this base sequence : 148352095
  Distance between 3'-terminus of neighbour sequence of sequence listing upward to telomere on chrosomal short arm and 5'-terminus of this base sequence : 94746
agatcttatgaccttcagctagtcattctatggactttaggttccttatctgtaaaatgggcctgttgcactatatgattactcttatcagccaactcagaggagtgtgtgtgtgtgtgtgtgtgtgtgcatgcatggtcatgcctgtgtgagtgtgtgtatgtttgtggtttttaaaagcttacctccaaacaaaattgccccttctcaaactgggtgccactgttctaagccattcttcctgatgcaagctagtaaatgtt

SEQ ID NO: 5873 - DNA, 207 bp, Homo sapiens
  chr3.fa.O7frz.163131683
  Located on chromosome 3
  Distance between a terminus base of telomere on chromosomal short arm and 5'-terminus of this base sequence : 148392963
  Distance between 3'-terminus of neighbour sequence of sequence listing upward to telomere on chrosomal short arm and 5'-terminus of this base sequence : 40605
gaatgaactatttctgaagtgactgatttgcaccatggtagaggtaggggtggaggagggttgacttaaaagcccccaagaaaccaatcagcagtcctttccagactggcactgtgtgcactttgccattttgccctgtatctggggacacacacacacacacacacacacacacacacacattgatagtgtttatcaggtaccggt

SEQ ID NO: 5874 - DNA, 101 bp, Homo sapiens
  DISO7_10001249
  Located on chromosome 3
  Distance between a terminus base of telomere on chromosomal short arm and 5'-terminus of this base sequence : 148473535
  Distance between 3'-terminus of neighbour sequence of sequence listing upward to telomere on chrosomal short arm and 5'-terminus of this base sequence : 80365
tggattatctgagacactttccctcctccttccttctggtcccacttgtgtgtgtgtgtgtgtgtgtgtggagcggggtgcacaataactgctggcaagtg

SEQ ID NO: 5875 - DNA, 101 bp, Homo sapiens
  DISO7_10001248
  Located on chromosome 3
  Distance between a terminus base of telomere on chromosomal short arm and 5'-terminus of this base sequence : 148484557
  Distance between 3'-terminus of neighbour sequence of sequence listing upward to telomere on chrosomal short arm and 5'-terminus of this base sequence : 10921
aaccaaagtatgcatgcatgcgtgcacgcacgcacacacacacacacacacacacacacacaaataggtgtgtgccggcctaactgttcctcctctgggac

SEQ ID NO: 5876 - DNA, 480 bp, Homo sapiens
  AC026673.12_52550
  Located on chromosome 3
  Distance between a terminus base of telomere on chromosomal short arm and 5'-terminus of this base sequence : 148654710
  Distance between 3'-terminus of neighbour sequence of sequence listing upward to telomere on chrosomal short arm and 5'-terminus of this base sequence : 170052
ccaagtatatttgcaatagatgaggcttagagggggataaggtggtagtttcaagtatgtggtgcatgtcacagggaaacaggaaggcagaatattgatcatggctttcaacacatgtgtctctgggaatcactttgtcacacatataaccctcttctaaacatgcatgtgagtacatacacatatgattgtgtgcacacatgtgtgcatgcacacacacacacacacacacatacacacctaccttatatctcagccatattgaagcattttaatttcccccaaatgtagccacaccacctatttcttcttccatgcctcacactaagagtcagtcatctctcctgagaaccttttacccatcagcagcctcctgccccagctaaggtactttcctgctttgtactcccacacgcattcccacatttcccatcctgatagatcacaccctcacagaagtaactcatggttcactaatgg

SEQ ID NO: 5877 - DNA, 357 bp, Homo sapiens
  chr3.fa.O7frz.163941355
  Located on chromosome 3
  Distance between a terminus base of telomere on chromosomal short arm and 5'-terminus of this base sequence : 148668756
  Distance between 3'-terminus of neighbour sequence of sequence listing upward to telomere on chrosomal short arm and 5'-terminus of this base sequence : 13566
aatgactggactagatttctcaggctggaatggggagaaggcttcccccacactcctcttccaacttccaccacacacatacacacacacaaacacacacacacacgccagggagatccttgatggaacctgtctccacactgttccttaaacacagaactctgggcactgccaactcccacataagcctatgctgctctttgaggggagtggagagttggggcccccattttgagactgagctccccactgcctcccctaccaaccgccctgacacacatgacaggcaatagaatcaactaccacctgtgattgatccatgctagctataaactgttatggacctggttaattgtt

SEQ ID NO: 5878 - DNA, 426 bp, Homo sapiens
  AC026673.12_150939
  Located on chromosome 3
  Distance between a terminus base of telomere on chromosomal short arm and 5'-terminus of this base sequence : 148725416
  Distance between 3'-terminus of neighbour sequence of sequence listing upward to telomere on chrosomal short arm and 5'-terminus of this base sequence : 56303
gcctttaaatggtctatttgaggtgacagtgtgtttaatgggatttttaaagggggcacaggcccctcaccagaaaaagccagtatattttcacccacgtaagactgcttagagcatgctaacatacctttaccataacacacatgcatgtacatgcatgcgcacgcacgtacacacacacacacacacacacacacagttaataatactgatctctgtactttggtgcctgcaatatggcttccagagcaacatctgatattgtacagttagtttactacttcaatggggctcacaatggagagccatgagttgagactaggtcaaggacagagctgacagccttttctttgctcattcccgagtcacatagaggtctggtgacaggtgaagagttctctagagttatttaaagttgtggttcct

SEQ ID NO: 5879 - DNA, 438 bp, Homo sapiens
  AC073242.3_44298
  Located on chromosome 3
  Distance between a terminus base of telomere on chromosomal short arm and 5'-terminus of this base sequence : 148746333
  Distance between 3'-terminus of neighbour sequence of sequence listing upward to telomere on chrosomal short arm and 5'-terminus of this base sequence : 20491
cagaatattgacattgatccagtcaagataaagaacatttctggctgggtgcagtggctcacacttgtaatctcagcactttgggaagttgaagtgggaaaatcacatgaagtcaggcattcgagaccagcctgggcaacaaagcaagaccctgtctctacagatttttttttaaattagccaggcatggtggcatgtgtctttagtcccagctactcgaaaggatcacttaagcccaggagttcaaggctgcaatgagctaggattatgccatcagtctgagtgacagaataagtccctggctctaaagagagagagagagagagagagagagagagacagaaacatttccatcaccacaaggatccttcacattgcccttttataaccacacctacttccctcccacatactcactccttaattcctaacaaccag

SEQ ID NO: 5880 - DNA, 276 bp, Homo sapiens
  D3S1569
  Located on chromosome 3
  Distance between a terminus base of telomere on chromosomal short arm and 5'-terminus of this base sequence : 148931503
  Distance between 3'-terminus of neighbour sequence of sequence listing upward to telomere on chrosomal short arm and 5'-terminus of this base sequence : 184732
tgcaccttgcttaccttctagcctcatctccctctgccccctttgctgcctttctcaagtcacactgaacttgccataatttcccaaacacactgtgtagtttcttaactacctttgcattttgattccttctactatggcagcaattccttcctcgtccacttgctaccatccttgtattccttaaatacacacacacacacacacacacacacacacacacttcttgctaccaaggactcatttttttcattctttaagaacctttcaactgtc

SEQ ID NO: 5881 - DNA, 128 bp, Homo sapiens
  D3S3599
  Located on chromosome 3
  Distance between a terminus base of telomere on chromosomal short arm and 5'-terminus of this base sequence : 148934569
  Distance between 3'-terminus of neighbour sequence of sequence listing upward to telomere on chrosomal short arm and 5'-terminus of this base sequence : 2790
gctcaaggagatgaacatgcacatgtacacacacacacacacacacacacacacacaaacacacccctacctctaggtaagcataatagaggaatgtgataactgagaaatgccactgaatccttgca

SEQ ID NO: 5882 - DNA, 159 bp, Homo sapiens
  DISO7_00004757
  Located on chromosome 3
  Distance between a terminus base of telomere on chromosomal short arm and 5'-terminus of this base sequence : 149060648
  Distance between 3'-terminus of neighbour sequence of sequence listing upward to telomere on chrosomal short arm and 5'-terminus of this base sequence : 125951
agtccaagacagcctcagagcatccccagaatgtgtgtgtgtgtgtgtgtgtgtgtgtgtgtgtgtattggacaatgggaggggggtgagcagaatgcttcccactgcctgagagtggcacagacatgccccagcctgctggcatccctggtgctactt

SEQ ID NO: 5883 - DNA, 366 bp, Homo sapiens
  chr3.fa.O7frz.164570453
  Located on chromosome 3
  Distance between a terminus base of telomere on chromosomal short arm and 5'-terminus of this base sequence : 149177302
  Distance between 3'-terminus of neighbour sequence of sequence listing upward to telomere on chrosomal short arm and 5'-terminus of this base sequence : 116495
aggtccttaggtaattcacagtagatatgtatggattaggcgaggtcatctgtaacacattcttttattcttactagtagagaaattctaaagtgaaaactataaaatgccacacattgattttaataactactcaaaaccacacatacacacacacatacacacacacacacacacacacacacacatacacacacacacacacacacacacacaaagattctttgtagcagaatccggttaaatggatcctgccatgtctggagtggttagccctctggagaggcacaaaggtagcactccacggaaccacaatgagccactatattaatctgtctatttattgtatcatacatcctgagaagt

SEQ ID NO: 5884 - DNA, 477 bp, Homo sapiens
  chr3.fa.O7frz.164657729
  Located on chromosome 3
  Distance between a terminus base of telomere on chromosomal short arm and 5'-terminus of this base sequence : 149449540
  Distance between 3'-terminus of neighbour sequence of sequence listing upward to telomere on chrosomal short arm and 5'-terminus of this base sequence : 271872
agcaaagaacttgtagaacaatagtatgtagctcagggagatattaaacattttaaaaactcagtcatgattataaaacagggcgggggaagaacttgaaaagactattgtgttgtaagaaagaaccccaaagcagcatgaaaaaaattagaaaagttggttttcctcttttcacctttgagcattgtgcctgcaatcaagcatgtgtacaaaactgtctaaagccatggtttacctagggcctattagttaaggatgctattgaaaaaacacctgtaatacatcaattgacgttcacatttggagattaggtaaccaaattacaaactataaattcatgtttccactctcaatgttgaagactgccaaaaaaaaaaaaaaaaaaaaaaaatatatatatatatatatatatacacacacacacacacatgacaatgacaccaaaaaagcccccttacaattcctgttaatgaaagg

SEQ ID NO: 5885 - DNA, 427 bp, Homo sapiens
  AC027003.2_39655
  Located on chromosome 3
  Distance between a terminus base of telomere on chromosomal short arm and 5'-terminus of this base sequence : 149503787
  Distance between 3'-terminus of neighbour sequence of sequence listing upward to telomere on chrosomal short arm and 5'-terminus of this base sequence : 53770
aaagcaacctaaatgtcaattaataggaaaactgttatgtatgttttggaaatgccatacatttccaaaatatcatatggatatgatatggaatatcatagaacgattttgaaatgtgagacagatctctaaggactgatgcggaaaaatgttcatggccaactttttaagtttaaaaaacacacccttatttttgaagtgtatgtagagcatattcctatgtttttgttaaagaaaccctcatatatatatatatatatatatatatatatatatatatatatatataaaattaaatctgtaagtgcatgtaagtcatgtattatgaactgagtgaatatttgtgtctctccaaaatttatatgttgaagacctaaccccctttgggagataattagggttagatgagatcatgaggatggagtcc

SEQ ID NO: 5886 - DNA, 427 bp, Homo sapiens
  AC068131.4_66496
  Located on chromosome 3
  Distance between a terminus base of telomere on chromosomal short arm and 5'-terminus of this base sequence : 149555569
  Distance between 3'-terminus of neighbour sequence of sequence listing upward to telomere on chrosomal short arm and 5'-terminus of this base sequence : 51355
aggataaagaatgaccagataatcaatagtattataggtgcatactgacatgaagaacatgagaatagatacacacacacacacacacacacacacacatacacacagacacacacatgaaggaagactaaataccatggaaaaataggggaaaatgtaccagtcattagcattgaggtatccttgagatatcatattatttattacatattacttttggaaaaaaaatttagccttcactagggtatgtgaaactgagtccacaagccaagttgtgcccaaaacagaaacaaagacactgcactcttaagttcattttgtctcagcattcttattttatttggcagatagaaaattatgtgtaatttcctaattcccaatccttgctcagtctcttgccttttcttcaaccttgagtatactttgg

SEQ ID NO: 5887 - DNA, 209 bp, Homo sapiens
  DISO7_10009764
  Located on chromosome 3
  Distance between a terminus base of telomere on chromosomal short arm and 5'-terminus of this base sequence : 149683339
  Distance between 3'-terminus of neighbour sequence of sequence listing upward to telomere on chrosomal short arm and 5'-terminus of this base sequence : 127343
ggaatgatactggattattgcctttttatttacttcgttttaggagaaagctatttgtaatatcagtttactcttaggcatatcaaatttaatatgagatataaatattcaagggtatttgaagtttgggatatatatatatatacacacacacacacacacacacacacacacacacacacacacacacgaggctccgaagaaagaga

SEQ ID NO: 5888 - DNA, 236 bp, Homo sapiens
  chr3.fa.O7frz.165268492
  Located on chromosome 3
  Distance between a terminus base of telomere on chromosomal short arm and 5'-terminus of this base sequence : 149719415
  Distance between 3'-terminus of neighbour sequence of sequence listing upward to telomere on chrosomal short arm and 5'-terminus of this base sequence : 35867
tgctcctacatttgttcattaggttaatggcctccagctgcattcctgttgctgctaaggagattatattattattattattattattattattattattattattattgaggtggagtctctctttgtcgcccaagctggagagcagtggtgtgatcttggctcagtgcaacctccgcctcccgagttcaagagattctcctgcctcagcctccctagtagcatggattacaggc

SEQ ID NO: 5889 - DNA, 289 bp, Homo sapiens
  chr3.fa.O7frz.165191696
  Located on chromosome 3
  Distance between a terminus base of telomere on chromosomal short arm and 5'-terminus of this base sequence : 149795656
  Distance between 3'-terminus of neighbour sequence of sequence listing upward to telomere on chrosomal short arm and 5'-terminus of this base sequence : 76005
acagtctattgagaattgcattaccagatttatttcacaaagccctgtctgggtaacttatttaaaaactttaatcagtctggacggaactggattaatctgcactcttcaaagcaaaagaaaagaaaagaaggaagggaaaagagaagaaaagaaaagaaaagaaaggaaaagaaaagaaaagaaatcagtagcaaaaagaaagcaaggcttcaacccaagtaagttgaaaagatgtcagattaaatagccccaaaatacgcaaccatgtgcaactatttagcatgat

SEQ ID NO: 5890 - DNA, 448 bp, Homo sapiens
  AC012152.12_58424
  Located on chromosome 3
  Distance between a terminus base of telomere on chromosomal short arm and 5'-terminus of this base sequence : 149870201
  Distance between 3'-terminus of neighbour sequence of sequence listing upward to telomere on chrosomal short arm and 5'-terminus of this base sequence : 74256
atggtgtgaaatgaagattaaagtttatttctacccatatggatatctagtttttctggcatcatcatgatttatttatttatttatttatttatttattcattcatttttatcttaagacagagtctcgctctgttacccaggctggagtgcagtggtgcaatctcggctcattgcaacctccgccctccaggttcaagcgattctcgtgtctcagtcttccaagtagctgggattacaggcccgcactgccacatctggctaatttttgtgtttttagtagagacgggggtttcaccatgttggccaggctggacttgaactcctgacctcaggtgatccacccacctcagcctcccaaagtgctgggattatagtcctgaggcatcacgcccagccaggattcttttttaacttttcaagtgtgacttaatgagtaagagtgcat

SEQ ID NO: 5891 - DNA, 459 bp, Homo sapiens
  AC012152.12_41457
  Located on chromosome 3
  Distance between a terminus base of telomere on chromosomal short arm and 5'-terminus of this base sequence : 149887142
  Distance between 3'-terminus of neighbour sequence of sequence listing upward to telomere on chrosomal short arm and 5'-terminus of this base sequence : 16493
gtgattaaaccgatgacagtatttattcctgtgaaccattaggtcagagaggttaaatccagaaactagatagatagatagatgatagatagatagatagatagatagatagatagatagatagattgattttgagatggagtcttgctctgtctcccagtctggagtgcagtggcgcgatctcggctcactgcaagctccgcctcccgggttcacgccattctcctgcctcagcctccccagtagctgggactacaggcgcctgccactatgcccggctaattttttgtatttttagtagtgacagcgtttcacagtgttaaccagaatggtctctatctcctgacctcgtgatccgcccacctcagcctccaaagtgctcggattacaggtgcgagccaccgcatctggccctaatagtgatatatttataaaatatcatgaaattctaggacactg

SEQ ID NO: 5892 - DNA, 133 bp, Homo sapiens
  HUMUT5037
  Located on chromosome 3
  Distance between a terminus base of telomere on chromosomal short arm and 5'-terminus of this base sequence : 149887167
  Distance between 3'-terminus of neighbour sequence of sequence listing upward to telomere on chrosomal short arm and 5'-terminus of this base sequence : -434
ttcctgtgaaccattaggtcagagaggttaaatccagaaactagatagatagatagatgatagatagatagatagatagatagatagatagatagatagattgattttgagatggagtcttgctctgtctccc

SEQ ID NO: 5893 - DNA, 299 bp, Homo sapiens
  HUMUT7672
  Located on chromosome 3
  Distance between a terminus base of telomere on chromosomal short arm and 5'-terminus of this base sequence : 149950505
  Distance between 3'-terminus of neighbour sequence of sequence listing upward to telomere on chrosomal short arm and 5'-terminus of this base sequence : 63205
gaattacaggcatgagccaacacatctggttcacatctgacaattttctaagtttctattagatagagggatatagatagacagatagctagatagagagccagatagacagatagatagatagatagatagatagatagatagatagatagatagatagataggagaaaaaggagaaaaaaatcaaagctccataattaagctgaaggatacccaaatttaattttcttaaaataattattactcttgtttgagctttttaaagtggcttaaagaagttaagccaccaaaactatcgt

SEQ ID NO: 5894 - DNA, 146 bp, Homo sapiens
  D3S1550
  Located on chromosome 3
  Distance between a terminus base of telomere on chromosomal short arm and 5'-terminus of this base sequence : 150128151
  Distance between 3'-terminus of neighbour sequence of sequence listing upward to telomere on chrosomal short arm and 5'-terminus of this base sequence : 177347
ccctcagagatcactgcaattatctgacctagtcttgtcttttcccttactcagaatcacatgcttacaccagtcacatgtccatacatttgggttgcttggtgtgtgtgtgtgtgtgtgtgtgtgtgtatgcttcctgtgacaca

SEQ ID NO: 5895 - DNA, 460 bp, Homo sapiens
  chr3.fa.O7frz.164773367
  Located on chromosome 3
  Distance between a terminus base of telomere on chromosomal short arm and 5'-terminus of this base sequence : 150175969
  Distance between 3'-terminus of neighbour sequence of sequence listing upward to telomere on chrosomal short arm and 5'-terminus of this base sequence : 47672
  misc_feature (1)...(460): n = A,T,G or C
gccattactaggttctaaattctagtcctcctaggcattggttcctactgtccttcaatttccttccttctttctttccttccttccttccttccttccttccttccttccttccttccttccccctccctccctccctttcctttcctttctctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttctctctatctttctctctctccttccttccttccttcctctctctctctttctttctctctttctttctttcttctctctttctctccttctctctctctctttctctctttctctccttccttccttccttccttccctccttctttcttttcttgtcatttttttttatacagaatctcacactgccactgagacttgag

SEQ ID NO: 5896 - DNA, 344 bp, Homo sapiens
  chr3.fa.O7frz.165624763
  Located on chromosome 3
  Distance between a terminus base of telomere on chromosomal short arm and 5'-terminus of this base sequence : 150318801
  Distance between 3'-terminus of neighbour sequence of sequence listing upward to telomere on chrosomal short arm and 5'-terminus of this base sequence : 142372
taagactttgtattgaaaggacacaaatgatagccttacttttgttttataaaagatgaaatgaaacttcagtttaatattcagccgtccaatcattaaaatatgttttcctccctccttctttttctttttcatatgcgcgtcgtgcacacacacacactctctctctctctcacacacccgcacacatgcacacacacacacacacacacacacacacacactcagcatgcagtttcagtaaaacagacacaggctaccagaataaatatcccacattaagaaagagatatacagtaagatacagcagtccacagtcactggtctatggaaagtaagaaatt

SEQ ID NO: 5897 - DNA, 200 bp, Homo sapiens
  chr3.fa.O7frz.165948787
  Located on chromosome 3
  Distance between a terminus base of telomere on chromosomal short arm and 5'-terminus of this base sequence : 150694101
  Distance between 3'-terminus of neighbour sequence of sequence listing upward to telomere on chrosomal short arm and 5'-terminus of this base sequence : 374956
agtcaatactattggctccaactataggaaaaatttcagtttgttcacacgcacacacacacacacatacatacacacacacatttatatgcagataatgagccctaaggatagttgaactaaagccatttcatttaagacaattctgctttcccagatgacatgctaatgaaccaagtaagcagttctaagtcattgat

SEQ ID NO: 5898 - DNA, 143 bp, Homo sapiens
  D3S1593
  Located on chromosome 3
  Distance between a terminus base of telomere on chromosomal short arm and 5'-terminus of this base sequence : 150770513
  Distance between 3'-terminus of neighbour sequence of sequence listing upward to telomere on chrosomal short arm and 5'-terminus of this base sequence : 76212
acagtattcttggttgacaggtatgtgtgcgtgtgtgtgtgtgtgtgtgtgtgtgtgtatgcctccagccctttgaatatatcttcccactctctcctggagtataaggtttctgctgaaaggtctgctaccagccatattga

SEQ ID NO: 5899 - DNA, 291 bp, Homo sapiens
  AC069435.9_138672
  Located on chromosome 3
  Distance between a terminus base of telomere on chromosomal short arm and 5'-terminus of this base sequence : 150787258
  Distance between 3'-terminus of neighbour sequence of sequence listing upward to telomere on chrosomal short arm and 5'-terminus of this base sequence : 16602
ttatcaaagcctgtttatgagtacctaaaaacattatcctggtcagtattaaataatgtatgaatacattatcctggtcagtattgaagatactgttgatattgaatgtgtgtgtgcgtgtgtgtgtgatgtgtgtgtgtgtgtgtgtgtgtgtgtgtatgtttcaaaacgggtgcaggggagaaaaaggcaaaatagtggcggtcaaattgtacatgtagaagacatctaataaaatctgtaatgacctcatggtgaagtgataagaagtattctggtgtattccgatct

SEQ ID NO: 5900 - DNA, 475 bp, Homo sapiens
  AC069435.9_152765
  Located on chromosome 3
  Distance between a terminus base of telomere on chromosomal short arm and 5'-terminus of this base sequence : 150819652
  Distance between 3'-terminus of neighbour sequence of sequence listing upward to telomere on chrosomal short arm and 5'-terminus of this base sequence : 32103
agttgaggaccttaagactgagtgagctttcctgaggaagaaggaattctcctcaacactgcataataaaaaaaatacaaaacctaactaactttgaactcaaacttgcaacattactcttacatgaacttgtaagctttcggccttcccgacaaattttggacatgccggggcccacaatcatgtaagccaattccttaaaatcttgatccctctctccgtgtgtgtgtgtgtgtgtgtgtgtgtgtgtgtgactgtattatctattgtgttatctatctagtattggtattgtttctttggaaaaccctattaattaatgttgatcactttactcaaggttcattggccagacttaaccacacaattacaaccaaactcaacaataaccagaaaataaaaggaagaacttgagatacatgataaccactatcatcattcaattttctgtctcttcatggctactgacttgata

SEQ ID NO: 5901 - DNA, 300 bp, Homo sapiens
  chr3.fa.O7frz.166105777
  Located on chromosome 3
  Distance between a terminus base of telomere on chromosomal short arm and 5'-terminus of this base sequence : 150850987
  Distance between 3'-terminus of neighbour sequence of sequence listing upward to telomere on chrosomal short arm and 5'-terminus of this base sequence : 30860
ctgtggtactatgttatggcagctctagcaagcaagtagattaatatcagctatcatagtcaatagctagcttgaagaaatatatatatatatatatatatatatatatatatatatatataaagtaaagcatacatttctcagtggatcctaatgaatgcgctgcccaaaacaacacaaggtcaggggtttgtctcttttccccaaattcacaaattctctaccttcatatatcttgatgatatctttgtgaaagaagtagggatggtgcaatataggtctgaaagaatgagcacttta

SEQ ID NO: 5902 - DNA, 448 bp, Homo sapiens
  AC055758.13_148154
  Located on chromosome 3
  Distance between a terminus base of telomere on chromosomal short arm and 5'-terminus of this base sequence : 151017648
  Distance between 3'-terminus of neighbour sequence of sequence listing upward to telomere on chrosomal short arm and 5'-terminus of this base sequence : 166361
acctggagaagtggtaaagtattacttctatgtgtgtctgtgatggggaagatctgtcttcaatgtgggcaggtaccatccaatcagctgggggccaggttggaacaaaaaggcagagaaatggtgaatctcctctctctcaatctctctctctctctctctctctctctctctctctctctctctctcataaagctggggagctggtactctgttctcttgcccttggacgtcagaactccaggctttctgggctttggactccagaagctagagcagcagcctccctgtttttcagtcctttctccttttactaataattacaccatcagctttcctagttctgaggttttcacacttggactgagccatgcttagcatcccacggtctccaacttgcagaaagcctgttatgggacttctcagtcaaataatcacgagtcaattt

SEQ ID NO: 5903 - DNA, 266 bp, Homo sapiens
  D3S2394
  Located on chromosome 3
  Distance between a terminus base of telomere on chromosomal short arm and 5'-terminus of this base sequence : 151018035
  Distance between 3'-terminus of neighbour sequence of sequence listing upward to telomere on chrosomal short arm and 5'-terminus of this base sequence : -61
gtctccaacttgcagaaagcctgttatgggacttctcagtcaaataatcacgagtcaatttccctaataaatcctttcttatctatctatctatctatctatctatctatctatctatctatctatcatctatccatctatccctccatcccattggttctgtctttctggagtacctatactaatgtaggcatcaaaaagcctagcttaccccactggtagcatctttggaataaaaggaaataatgggggaaatatggtaaggt

SEQ ID NO: 5904 - DNA, 232 bp, Homo sapiens
  chr3.fa.O7frz.166524796
  Located on chromosome 3
  Distance between a terminus base of telomere on chromosomal short arm and 5'-terminus of this base sequence : 151067620
  Distance between 3'-terminus of neighbour sequence of sequence listing upward to telomere on chrosomal short arm and 5'-terminus of this base sequence : 49319
tttcactagacaatgcactgtactttccaggagattcattaatttccttttacttttaagtttattatctttgcagagtattttatgtatacacacacacacacacacacacacacacacactatactttgctgagtatatatatacacatacactatatatataagcatgtatgtgtgtgtgtctgtatatatgtatacatatagtaaactctaaattatccgtggagact

SEQ ID NO: 5905 - DNA, 186 bp, Homo sapiens
  D3S1608
  Located on chromosome 3
  Distance between a terminus base of telomere on chromosomal short arm and 5'-terminus of this base sequence : 151170860
  Distance between 3'-terminus of neighbour sequence of sequence listing upward to telomere on chrosomal short arm and 5'-terminus of this base sequence : 103008
agcaatcatgtgcccctggaacagggatgagatagagaaacatatcacattcctgcctgtctaaaatgaagggccagtgcagtttacctccacttctgcccatccctgcccaccccacgacatacacacacacacacacacacacacagacctttttcagggctggtgcctgcacttaccattggg

SEQ ID NO: 5906 - DNA, 381 bp, Homo sapiens
  AC018369.3_7841
  Located on chromosome 3
  Distance between a terminus base of telomere on chromosomal short arm and 5'-terminus of this base sequence : 151332427
  Distance between 3'-terminus of neighbour sequence of sequence listing upward to telomere on chrosomal short arm and 5'-terminus of this base sequence : 161381
ctaccagagtcctgcagtgtagactaaggtaagtgacagcttggaaggtgtttaggaagataaatttatggatccggatcaaacaaaccaactataaaaagacatacttgagaaaaagaggcaaaggtgaatttggataggtattcctctgatgacgtcaacgtacggagccaagctgctaagctttaccatcgactgcaggtacgactcctagcaggatccccatctaatagatatctaattatttatacaggcaggcaggcaggcaggcacgcacacacacacacacacacacacacacacacacacacacttttcactacagatgaaacaaacaaaaaaagacagagacaaaataatgagcaaagactatacctaaat

SEQ ID NO: 5907 - DNA, 307 bp, Homo sapiens
  AC069528.6_35107
  Located on chromosome 3
  Distance between a terminus base of telomere on chromosomal short arm and 5'-terminus of this base sequence : 151636592
  Distance between 3'-terminus of neighbour sequence of sequence listing upward to telomere on chrosomal short arm and 5'-terminus of this base sequence : 303784
cactacattcttatgtccttacactattgtgggctcaagaatgcaaacattcttgattctttggttctgtctctttcctctccttgcagtgcctctctctctctctctctctctctctctctctctctctctctctctctccctggctagattctcacaagaaacttaatattaactctacttagttaacaatattttaacttggaagtaaaattgataaccttttctacttctattcaatatcagttatttcatttgcctcaatactatctataacacattacttatttaggctccactaatgtta

SEQ ID NO: 5908 - DNA, 437 bp, Homo sapiens
  chr3.fa.O7frz.167112380
  Located on chromosome 3
  Distance between a terminus base of telomere on chromosomal short arm and 5'-terminus of this base sequence : 151719932
  Distance between 3'-terminus of neighbour sequence of sequence listing upward to telomere on chrosomal short arm and 5'-terminus of this base sequence : 83033
atgagcacaaggatacatgtacagaaatattcattgaagttgattatagaggaaagaggaaagttggcatattattcagggttctccagagaaagagaaccaataggggtaaaaaaagtgaatatataccgtgtgtgtgtgtgtgtgtgtgtgtgtgtgtgtgtgtgtgtaaacaaaaattgtgggaggtcattgttttggagtgagctcacgcactagactccaacaaaccagattaaaccacaatagagtcactcatgccaaatgttacacaatcatactgaaactttaaggaaacagacagatcccaagcagaccatttttttcccctgaaaacaggaaatttcaatctgattgagtcagcataataaggaagtccctctgctttaacccttacaaaaaagtaacctgaagtaatctgatgttaaccaatcatt

SEQ ID NO: 5909 - DNA, 227 bp, Homo sapiens
  D3S3627
  Located on chromosome 3
  Distance between a terminus base of telomere on chromosomal short arm and 5'-terminus of this base sequence : 151860350
  Distance between 3'-terminus of neighbour sequence of sequence listing upward to telomere on chrosomal short arm and 5'-terminus of this base sequence : 139981
ttaaatgtagcttcagatgttaaagaattactaacttcggaaatcatctggaatttgtgtgtgtgtgtgtgtgtgtgtgtgtgtgattctagctaggatataaaagaaatgatatagattttattgaatccttttatttattgaatccttttatttaaaaattcttaccatgtatttttattgaccttagtattacaatgaaaagccttgtttattgatattagctt

SEQ ID NO: 5910 - DNA, 432 bp, Homo sapiens
  AC046133.11_105244
  Located on chromosome 3
  Distance between a terminus base of telomere on chromosomal short arm and 5'-terminus of this base sequence : 151905652
  Distance between 3'-terminus of neighbour sequence of sequence listing upward to telomere on chrosomal short arm and 5'-terminus of this base sequence : 45075
ttttaaggccacgctattatgtgtatgcagatttagaattttatacctttctgttgaattgattcttatgattataaaatgtcccctttattctccaataatacactttgtcttaaagtctttttctgatattttatatattttaatgttattatatttggttactgtctacatagtatatatttttatattctttattgtcattagttatgtgattttatgcaaaagatatacctcataagcaatatatgtgtgtttttgtacatatgtttggatgtatatatgtattgtatatacatatacataatacacataaatacacacacacacacacacacacacacacacacacacatatatatatatatttttactactctgataaccatagacttttgttggggtacctcttccactcacatttaaggtaat

SEQ ID NO: 5911 - DNA, 372 bp, Homo sapiens
  AC046133.11_121293
  Located on chromosome 3
  Distance between a terminus base of telomere on chromosomal short arm and 5'-terminus of this base sequence : 151939042
  Distance between 3'-terminus of neighbour sequence of sequence listing upward to telomere on chrosomal short arm and 5'-terminus of this base sequence : 32958
ttgaaggtagatacataactggactcattggaaaatgttccatttcagtggaagtgtaggttgtcagtggccagccatctcttttcttgcttcttagatgcatgtccgtgattgcaataagtttggctacccccaacccatggtagctacaaaggtgtgtttgtgtgtgtgtgtgtgtgtgtgtgttgtgtgagtgtgttgtgatcaggggttgggagttagggaatatgagcattgtggaatccatgtaagatagcatcatatctttttcagtaaaatgtcatagagtataaaagatattcatgatttaggtatcatctaagtcattcatgttgccttgttcctgtcctggcagttatcagagtatcttac

SEQ ID NO: 5912 - DNA, 447 bp, Homo sapiens
  AC069066.12_22512
  Located on chromosome 3
  Distance between a terminus base of telomere on chromosomal short arm and 5'-terminus of this base sequence : 152121016
  Distance between 3'-terminus of neighbour sequence of sequence listing upward to telomere on chrosomal short arm and 5'-terminus of this base sequence : 181602
cctaacagataattacaaagcaagagtataatgacttttaaactttttgattgtgtgtatgataaaatgtacagctttcctgaatcattccagtaaattttcctaaatcattcttttacttcagagcaaagttggcaaggaaaagtgttcctgattaaaaaataacctactgatgttgttatgtggccattttatgttatatatgttttatatgttaataggttatatggccattctgttatgtagccattcttgtgtgtgtgtgtgtgtgtgtgtatgtttatgtgtagttgagctaagtgtggaaaacctgtgtttaagatttttctgacttacaaactcattaatattgtcattaaagacgaaaaaaaggttttctactgaaacctcagtcatttctctgaccactggtttctgaacaaagaaacctcattgaacatggagcat

SEQ ID NO: 5913 - DNA, 178 bp, Homo sapiens
  DISD22_0003028
  Located on chromosome 3
  Distance between a terminus base of telomere on chromosomal short arm and 5'-terminus of this base sequence : 152251853
  Distance between 3'-terminus of neighbour sequence of sequence listing upward to telomere on chrosomal short arm and 5'-terminus of this base sequence : 130390
tttaataacaagccagctgcattttatcagttcccctctatataaagttctttttgtactttttaagatattttatccttgctttttagcatttttccaagatgtacctgtgtatgtgtgtgtctgtgtgtatgtgtgtgtgtatgcacacttattttgcctggagtctgtttagctt

SEQ ID NO: 5914 - DNA, 404 bp, Homo sapiens
  chr3.fa.O7frz.167919679
  Located on chromosome 3
  Distance between a terminus base of telomere on chromosomal short arm and 5'-terminus of this base sequence : 152355962
  Distance between 3'-terminus of neighbour sequence of sequence listing upward to telomere on chrosomal short arm and 5'-terminus of this base sequence : 103931
tatttagctgccattaaatcttaggttcacatctagaaaatagacgataaaaaatcatacctacccactgtatggttgtgagattcttgcttacaagatgattcatttaaagtgttcactgtagtgtttagcacccctcaaacttcctcagtcagggtttctctgctaaattattttcagaaaacagatctctccacgttttaaaacagtacaataccttagagtttgtggatgaaaaaacttcattttagaccagggattcagttgcagtagatatgtaatgctatatatcaactgaattcctgggtctagtgtgtgtgtgtgtgtgtgtgtgtgtgtgtgtgtgtgtgtgagacagaaagagagagaggttagttaagcagtagcttattggaatccacttt

SEQ ID NO: 5915 - DNA, 376 bp, Homo sapiens
  AC026554.3_59717
  Located on chromosome 3
  Distance between a terminus base of telomere on chromosomal short arm and 5'-terminus of this base sequence : 152446039
  Distance between 3'-terminus of neighbour sequence of sequence listing upward to telomere on chrosomal short arm and 5'-terminus of this base sequence : 89673
aaatatttgatattctggccaggctcacacctataatcctagtacttttggtaggccaagtcaggaagatcacttgagctcaggagtttgaaaacagcctaggcaacatagcgagacctcatgtctctatagaaatatctccagggcatttcagagagcttcctggcagctcctcccatcacagacctggaggcctaagagggaaaaattggtgccctgtgtcccagccactacatctgtgtgtgtgtgtgtgtgtgtgtgtgtgtgtgtgtgtgtgtgtatagtttttatgatcaaatttcagaaaaaataatttagagaataaaaatatgttgaactaatgcaaaagtataatctgaaatactttgcaacattt

SEQ ID NO: 5916 - DNA, 375 bp, Homo sapiens
  chr3.fa.O7frz.168045067
  Located on chromosome 3
  Distance between a terminus base of telomere on chromosomal short arm and 5'-terminus of this base sequence : 152462947
  Distance between 3'-terminus of neighbour sequence of sequence listing upward to telomere on chrosomal short arm and 5'-terminus of this base sequence : 16532
gcaaaggatatacattgctttaattaaaattggcagtcatttataatggtgatccctttcaaaggccctaacgttcttcaatttaaatatatgtgcatgtgtatgtatatatatatatatatatatatatatatatatatatatatatattttcatggtcatttgaagaaatatcagttacttggatgtttacattttgtttatggaaataatttttctagaatatattataaaatgctaagatccttaatgcttcttcacacaagtaaaaacacataaacaaggggctactgaaacacagggcatgaggttgcctttgatgtcacccaactttacattaaaattaaatgttagaactctgtaggaagtaagcat

SEQ ID NO: 5917 - DNA, 421 bp, Homo sapiens
  AC027060.2_149713
  Located on chromosome 3
  Distance between a terminus base of telomere on chromosomal short arm and 5'-terminus of this base sequence : 152611290
  Distance between 3'-terminus of neighbour sequence of sequence listing upward to telomere on chrosomal short arm and 5'-terminus of this base sequence : 147968
tatctgtgaggtctggtcataggcacatggaaaggaaacaggaagtaaccatagtaaccactacctaggctagaaaaggtgattctgtagggcctgagtggttccatccattttgaatgaaacttaaatgcaaaggcagagagcaagcctacacacacacacacacacacacacacacacacacacacacagatcccgaggctcaaaaacaataaacctaaacagagtgactagcactttcagtgactcaagacccagtcccctacaaattctaaacatcttagcttcattttaaatggtcagcgagagcttaggaaaggagatgtcctaggcacagtcttctttcttcctcccttcctctcatagaaaaagccctaaccttgtagaataaaacctactgtcaaagtaccttctcatttag

SEQ ID NO: 5918 - DNA, 277 bp, Homo sapiens
  AC027060.2_151335
  Located on chromosome 3
  Distance between a terminus base of telomere on chromosomal short arm and 5'-terminus of this base sequence : 152612855
  Distance between 3'-terminus of neighbour sequence of sequence listing upward to telomere on chrosomal short arm and 5'-terminus of this base sequence : 1144
tgacggagtatggaaaggtgaggtggtgtgagacagtaaaagagggtgggggaaggtgagaggagggtggagtgggagaaagcaagagggctccacagtcttccaagctactgacaaagggagtgaagggtaagggaaatggggatctgacatatgaatgagggtcaggagctaaaaacaaaacaaaacaaatgaaaaacaaaaacaaaacaaacaaacaaacaaacaaacagcatacttatgaccccttgttccctcaccagacagctttagctaa

SEQ ID NO: 5919 - DNA, 228 bp, Homo sapiens
  AC027060.2_79845
  Located on chromosome 3
  Distance between a terminus base of telomere on chromosomal short arm and 5'-terminus of this base sequence : 152664108
  Distance between 3'-terminus of neighbour sequence of sequence listing upward to telomere on chrosomal short arm and 5'-terminus of this base sequence : 50976
aggatgtagtgcaccagaataaaggtatgcagctgagccactgcctctaaaattgtctggccccatctctctctatagatagatgatagatagatagatagatagatagatagatagatagatagatagatagatagatatagatagatagacaggtagatagataaatatatagatagatacaaagacacacacttccttccgcttaaagataagtgaggactggaa

SEQ ID NO: 5920 - DNA, 169 bp, Homo sapiens
  D3S2439
  Located on chromosome 3
  Distance between a terminus base of telomere on chromosomal short arm and 5'-terminus of this base sequence : 152664149
  Distance between 3'-terminus of neighbour sequence of sequence listing upward to telomere on chrosomal short arm and 5'-terminus of this base sequence : -187
tgcctctaaaattgtctggccccatctctctctatagatagatgatagatagatagatagatagatagatagatagatagatagatagatagatagatatagatagatagacaggtagatagataaatatatagatagatacaaagacacacacttccttccgcttaaa

SEQ ID NO: 5921 - DNA, 154 bp, Homo sapiens
  D3S1744
  Located on chromosome 3
  Distance between a terminus base of telomere on chromosomal short arm and 5'-terminus of this base sequence : 152664164
  Distance between 3'-terminus of neighbour sequence of sequence listing upward to telomere on chrosomal short arm and 5'-terminus of this base sequence : -154
ctggccccatctctctctatagatagatgatagatagatagatagatagatagatagatagatagatagatagatagatagatatagatagatagacaggtagatagataaatatatagatagatacaaagacacacacttccttccgcttaaa

SEQ ID NO: 5922 - DNA, 262 bp, Homo sapiens
  chr3.fa.O7frz.168295692
  Located on chromosome 3
  Distance between a terminus base of telomere on chromosomal short arm and 5'-terminus of this base sequence : 152712093
  Distance between 3'-terminus of neighbour sequence of sequence listing upward to telomere on chrosomal short arm and 5'-terminus of this base sequence : 47775
ttccgttctaagaaatcctaataccagtcaaggctgtgaagacagtgtcacagttacgacaatactttttttgagattcatatgtgtgtgtgtgtgtgtgtgtgtgttgtgtgtgtctgtgtgtttctgttttactcgctggagatactagagtgtgacaatttatatccaccaggcagtgtggcacatggaaaggggatagtcacaggtttttaaagccttttgaaagtagatgcatctctatttaatttggttcgactta

SEQ ID NO: 5923 - DNA, 336 bp, Homo sapiens
  AC027060.2_11666
  Located on chromosome 3
  Distance between a terminus base of telomere on chromosomal short arm and 5'-terminus of this base sequence : 152756480
  Distance between 3'-terminus of neighbour sequence of sequence listing upward to telomere on chrosomal short arm and 5'-terminus of this base sequence : 44125
gatttctagcctcaagaacaagatagaagatgccagttctcatagaaacttttctacaaagagatttttttcagaccatgcttatattctgcaactgggaagaggttagataactagcagataactgctctatgcattctcattctgaagacttatctgaatatttctcaggtttcttcatctatctcttcttgctttatcctacacacacacacacacacacacacacatcattgagaatgttaatagcctttaaagaagtcaatatcctgccatcaggctctcacacggagtgcagcacaggtctagcaggtgagtcattatagtgctggttat

SEQ ID NO: 5924 - DNA, 476 bp, Homo sapiens
  AC027415.3_103282
  Located on chromosome 3
  Distance between a terminus base of telomere on chromosomal short arm and 5'-terminus of this base sequence : 152959516
  Distance between 3'-terminus of neighbour sequence of sequence listing upward to telomere on chrosomal short arm and 5'-terminus of this base sequence : 202700
ctgaatcagtaacgaatagcatgccaatcgaaaaagcccaggatctgatgtattcacagctgaatgctgctagatgtacaaagaaaagtggtaccattcctactaaaactattccaaaaaattgaggaggagggacacctccccaactcattctatgaggccagcattatcctgatacccaaatctggcacatgcacacacacagacacaaacacacacacacacacacacacacacacacacacacacacacacactcttcaggccaatatccttgatgaacatggatgcaaaaatcttcaacaaaattcttttgtgaacccaatccaggagcacatcaaaaagctaatccaccatgatcaagtagacttcatccctgggatgcaaggttggttcaaaatatgcaaatcaataaatgtgatttattacataaacagagctaaagataaaaaccacgtgattatctcaatagatgc

SEQ ID NO: 5925 - DNA, 110 bp, Homo sapiens
  DISD22_0003038
  Located on chromosome 3
  Distance between a terminus base of telomere on chromosomal short arm and 5'-terminus of this base sequence : 153070249
  Distance between 3'-terminus of neighbour sequence of sequence listing upward to telomere on chrosomal short arm and 5'-terminus of this base sequence : 110257
aatgtgaggaacttcgggccctgggctttctctaaagacacacacacacacacacacacacacacacacacccacacacacacacaccgaagtctctgcttataatcgca

SEQ ID NO: 5926 - DNA, 119 bp, Homo sapiens
  D3S3618
  Located on chromosome 3
  Distance between a terminus base of telomere on chromosomal short arm and 5'-terminus of this base sequence : 153242436
  Distance between 3'-terminus of neighbour sequence of sequence listing upward to telomere on chrosomal short arm and 5'-terminus of this base sequence : 172077
aaatgaattttattggtggataagaatcatgaccttgacaacacacacacacacacacacacacacacacacacacacacacacacacacactcctgaatggtacatcagttaggatgc

SEQ ID NO: 5927 - DNA, 166 bp, Homo sapiens
  D3S1306
  Located on chromosome 3
  Distance between a terminus base of telomere on chromosomal short arm and 5'-terminus of this base sequence : 153352044
  Distance between 3'-terminus of neighbour sequence of sequence listing upward to telomere on chrosomal short arm and 5'-terminus of this base sequence : 109489
atttttttgtgttgcacagtgaaaataaatattaaatatcaagatgaaactgaatatttgaataccctcccaagcacattcccccatacacacacacacacacacacacacacacacacacacacacacacaaatacacatatactttcctaccagcagactaaat

SEQ ID NO: 5928 - DNA, 260 bp, Homo sapiens
  D3S3626
  Located on chromosome 3
  Distance between a terminus base of telomere on chromosomal short arm and 5'-terminus of this base sequence : 153438829
  Distance between 3'-terminus of neighbour sequence of sequence listing upward to telomere on chrosomal short arm and 5'-terminus of this base sequence : 86619
cctatggtggagggtgaggaaaaagctcagaataaaagaaagacattaaagatgttgaaaatccataatgggcgcataatgcaatgaacctggacttgggtctttctttgaggaaatgagggatagagaatatgtgtttctctctctctctctctctctctatatatatatatatgtgtgtgtgtgtgtgtgtgtgtgtgtgtgtgtgtgtgcgcgtgtactactggaaattgaagggtgggagtcacagataattctgg

SEQ ID NO: 5929 - DNA, 399 bp, Homo sapiens
  AC025566.11_167112
  Located on chromosome 3
  Distance between a terminus base of telomere on chromosomal short arm and 5'-terminus of this base sequence : 153536482
  Distance between 3'-terminus of neighbour sequence of sequence listing upward to telomere on chrosomal short arm and 5'-terminus of this base sequence : 97393
tttggacatttcgatgaagatgccttttcaatgatattagcatttaaagtagtagactttgagtagagcatactgccctccataatgtgggtgggtctctaatagaatagagactgatttcctccccaacaagaaggaatcccaccagcaaacttccttgaactgcaactgcaactcttccctgagtctccagtctgctggcataccccatcagattctttctcttcctctgtctgttcctctctctctctctctctctctctctctctgtgtgtgtgtgtgtgtgtgtatgtatacatcctgttggttctgtttctctattaattccctattttctattttattaagctaagctcttgactttggttttcagaggtttctgtgattagaaagcatcta

SEQ ID NO: 5930 - DNA, 395 bp, Homo sapiens
  chr3.fa.O7frz.169096215
  Located on chromosome 3
  Distance between a terminus base of telomere on chromosomal short arm and 5'-terminus of this base sequence : 153552025
  Distance between 3'-terminus of neighbour sequence of sequence listing upward to telomere on chrosomal short arm and 5'-terminus of this base sequence : 15144
ctcaaatacagatcttaccatcaccctgatgctaagtcagaaaggatgcacctgttgaagcacacatataagatgaaacaaacaaacaaaaaaagatctgtaagaataaaaaagtgtgtcattaggaagtatttgagataacatcactggaagcagacaaaggcgatcccttgtagatgtaattttttaaaatattttcaccttttattttagatttggagggtacatgtgcaggtttgttatgtgggtataatgtgtgatgctgaggtttggggtagaaatgatcccatccttcaggtggtaagcatagtacttgatagtttttcaacctttgcccccctccctccctccctccctgttctagtagtccccagtgtctattgttgccatcttta

SEQ ID NO: 5931 - DNA, 342 bp, Homo sapiens
  AC069410.5_168377
  Located on chromosome 3
  Distance between a terminus base of telomere on chromosomal short arm and 5'-terminus of this base sequence : 153861653
  Distance between 3'-terminus of neighbour sequence of sequence listing upward to telomere on chrosomal short arm and 5'-terminus of this base sequence : 309233
tactattgagctttggatctacatttggtattttactcctcttgttgaaatttatatgccttatcccctctgttctcctttatcgctttctttgacattgtattagtcaaggttctctagagggacagaactaataggagatatatatatatatatatatatatatatatatatatatatatatatatatatctcctattgtatctcctattatatatatgggagtttattaagtattaacttacatgatcacaaagcccataataggctgtctggaaacttgaggagcaaggagaaccgtctgagtctcaaaactgaagaacttagagtctgatgttcaag

SEQ ID NO: 5932 - DNA, 328 bp, Homo sapiens
  chr3.fa.O7frz.169498799
  Located on chromosome 3
  Distance between a terminus base of telomere on chromosomal short arm and 5'-terminus of this base sequence : 153912835
  Distance between 3'-terminus of neighbour sequence of sequence listing upward to telomere on chrosomal short arm and 5'-terminus of this base sequence : 50840
tgtacatgttcagtgcaaatacaattttttcctccaaatattttcaatgcgtagttggtcaaatccacagatgcagagggctgactgtgtgtgtgtgtgtgtgtgtgtgtgtgtgtatgtgtgtgtacttataatctctgcaaaattacacacaagtaagagtgattgcctccagaaatgaaaactaagtgcccatgagagagggacataccattttaacattttggattgtatactgtatacatataacctatttaaatatcaatatgtcattaattacaaaatagttatttaaaaagcttagtaaatttagtgttgatagctcatg

SEQ ID NO: 5933 - DNA, 336 bp, Homo sapiens
  chr3.fa.O7frz.169580507
  Located on chromosome 3
  Distance between a terminus base of telomere on chromosomal short arm and 5'-terminus of this base sequence : 153984502
  Distance between 3'-terminus of neighbour sequence of sequence listing upward to telomere on chrosomal short arm and 5'-terminus of this base sequence : 71339
tttaagtgctaaccaggtatacatgattaaatagtaaatttaaacacagcaaagcaaggtgacaggatgacttaggaaaaaattgagttaactataaaataattattgccacattcagatgctacactttactagtctctccttccctaccacacacacacacacacacacacacacatgcagatacacatgcacatactcatgcacatgcccacacttgaggaatgaaagaaaaaaattactgaaacacagattccactttctaaaataatatactgatattattatttaaaatatgttatcagagaaaagagagtgagtccatttctaccaatg

SEQ ID NO: 5934 - DNA, 487 bp, Homo sapiens
  AF245699.1_60143
  Located on chromosome 3
  Distance between a terminus base of telomere on chromosomal short arm and 5'-terminus of this base sequence : 154068963
  Distance between 3'-terminus of neighbour sequence of sequence listing upward to telomere on chrosomal short arm and 5'-terminus of this base sequence : 84125
tccactgaaaccttagataagataggcttagactccctgaaacagtgcaagatctccagaaatttccacagaagcctgaggagcttatgtgttcgtggtctcctttagtttttgccatctgcttttccagttcagtttagagattatgatctcactactccacactgtaagatgccatattattccatggctgtaagatgccgtattccatgtgaaacagctccaattacacacacacacacacacacacacactcaacagcacactaacatgctatgtcattagggattacctttgattcaaaaagtcctttgtcccttggaacatttctcctctggactccatgcagtcccagacttcactccatctcacagatcattcccttccttctctgcatcctttccttttttatcaccaactcccttgaagaagtaaatccactttgtatttcctcacccctagcaccctagccattcgtctcattaac

SEQ ID NO: 5935 - DNA, 475 bp, Homo sapiens
  AC024897.13_13415
  Located on chromosome 3
  Distance between a terminus base of telomere on chromosomal short arm and 5'-terminus of this base sequence : 154093412
  Distance between 3'-terminus of neighbour sequence of sequence listing upward to telomere on chrosomal short arm and 5'-terminus of this base sequence : 23962
gctggtaaagcattattcctacgtaagactgtagggtgtcttgaaaagagattggcatttgaatcagtggactaagtaaggaagatcttccttcactcaatatgggcagacatcatgcagtcagcaaagggccagcatagaacaaaaaagtatgagataggcaaatttcctctctctgattctctttctctctgattctctctctctctctctctctctctctctctctctcactctctctctgtttctcttttctggagctgagatacgcatcttctcctgtccttggacatcagaactccaagtcctctggcctttggacttcaggacttgcaccagcagtgccctagtttctcaggccttcggactcagactgagaattccaacatcacttcccctggttctcaggccttcagacttggactgagacatcctaccagcttacccgcttctccaagatcgtagacagtctata

SEQ ID NO: 5936 - DNA, 435 bp, Homo sapiens
  AC024897.13_58647
  Located on chromosome 3
  Distance between a terminus base of telomere on chromosomal short arm and 5'-terminus of this base sequence : 154163382
  Distance between 3'-terminus of neighbour sequence of sequence listing upward to telomere on chrosomal short arm and 5'-terminus of this base sequence : 69495
aatgtattccatttagacaatgacatggatatttggcttacctaaatgcataaatttgaagacctagtaactttaaaactgaaaattgttgttttatactttcagattcagtctttcggagaccaaataaaatatgtaatgccgtaaatattttgagaacaaatcagaaaaataacccagtctcctagaaaattgatagctaatagttggatgggcccttttctttaaaaaacaatacaatttttcaaaaagcttttcatttttccccatccatggccaaaaatatatatatatatatatacatatatatatatatacacatatatatgtgtgtgtgcgtgtgtatatatatatatatatatatatatatatatatatatatatatatgttagcaccgccaagcatttcagtttttcacttaagcttggtctgta

SEQ ID NO: 5937 - DNA, 416 bp, Homo sapiens
  AC025354.3_103416
  Located on chromosome 3
  Distance between a terminus base of telomere on chromosomal short arm and 5'-terminus of this base sequence : 154245206
  Distance between 3'-terminus of neighbour sequence of sequence listing upward to telomere on chrosomal short arm and 5'-terminus of this base sequence : 81389
gttctcagtctggtagactcagattgtgtctaacaccaacagtccctcaattctcaggccttcagactcacactgaattacagcaatgattctggttctccagcttgcagacagcatatcatgggacttctcagcctccataattacgcgaaccagtgtccaaaatagctctcctcttgtatatctgtctgtctatctatttatccatccatccatccatccatccatccatccatccatccaagtcctgttggttctgtttctctggagaaccctaatacggaatgcatgttttataagtttgttttcctatctgaaaattactatttgtcttgtcactgatttagatattttcttataacctttcatctggctttttaattttcttctttaaaaagtcttgcactgttcttacg

SEQ ID NO: 5938 - DNA, 350 bp, Homo sapiens
  AC025354.3_36675
  Located on chromosome 3
  Distance between a terminus base of telomere on chromosomal short arm and 5'-terminus of this base sequence : 154251903
  Distance between 3'-terminus of neighbour sequence of sequence listing upward to telomere on chrosomal short arm and 5'-terminus of this base sequence : 6281
tggcactttcagttaaattcaccttattttgatttagaactcccacctcatatccagtttaaatttcatctcctctcttcttcccagtggatctttcctgggattgcctcacatgacttggagttaggaagaggctgatctcattcattgggtagaggaagaaggagagagtctgggttgtttgtttgtttgtttgtttgtttgttttctggatcaggcatttcagattgagagctggggatgcaggagaaataggagaagaagagatgctcttgggtcattggtaaccagtgggtgcttgggaggctcctctagtattcctctggctcaatcttgttctacctgctact

SEQ ID NO: 5939 - DNA, 319 bp, Homo sapiens
  AC021059.10_113984
  Located on chromosome 3
  Distance between a terminus base of telomere on chromosomal short arm and 5'-terminus of this base sequence : 154330959
  Distance between 3'-terminus of neighbour sequence of sequence listing upward to telomere on chrosomal short arm and 5'-terminus of this base sequence : 78706
tggtagaatcacgactcactatagcctcgacctcctgaggctcaagtgatcctcctgcctcagcctcctgatgagtagctgggactacaggcatgtgccactatgctcagttaatttgtgtgtgtgtgtgtgtgtgtgtgtgtgtgtgtgttttatagagacacggttttgccatgttgcccagactggtcttactcctaggttcaagtgatcctcccacttcagcctcccaaagtgctgggattacaggcgtgagccactgtgcccagcccataaatgcatttattaataatatttttgaaagtgcttagcataatgt

SEQ ID NO: 5940 - DNA, 390 bp, Homo sapiens
  DISO7_00004761
  Located on chromosome 3
  Distance between a terminus base of telomere on chromosomal short arm and 5'-terminus of this base sequence : 154395018
  Distance between 3'-terminus of neighbour sequence of sequence listing upward to telomere on chrosomal short arm and 5'-terminus of this base sequence : 63740
cagcaatcctgtagcctttaaaaatagctcacggccaggcacagtagctcacgcccccagcactttgggaggccgaggtgggaagatcacgaggtcaagagatcaagaccatcctagccaacatggtgagacccccgtctctactaaaaatacaaaaattagctgggtgtggtggcacgcgcctgtagtcctagctactcgggaggctgaggcaggagaaccacttgaacccggcaggcagaggttgcagtgagccaagatagtgcccctgcactccagcctggtgacagagcgagacttcatctcaaaataaataaataaataaataaataaataaataaataaataaataaaaataatagcttgttgggatcctaggtaaagcctggc

SEQ ID NO: 5941 - DNA, 221 bp, Homo sapiens
  D3S1555
  Located on chromosome 3
  Distance between a terminus base of telomere on chromosomal short arm and 5'-terminus of this base sequence : 154407491
  Distance between 3'-terminus of neighbour sequence of sequence listing upward to telomere on chrosomal short arm and 5'-terminus of this base sequence : 12083
gaaggtgatgaagccaagagaaccaaaatgttcactgataaatttaggtaggaatggtatggaaaggaaaggaatccaaaatttctccagccagccacttcccagtcacaaacacacttctcatctgcacccctagccacacacacacatgcccgtgcacacacacacacacacacacacacagaacctttatgcaaattaatcatgtcatgtcactcccg

SEQ ID NO: 5942 - DNA, 449 bp, Homo sapiens
  AC025119.3_62655
  Located on chromosome 3
  Distance between a terminus base of telomere on chromosomal short arm and 5'-terminus of this base sequence : 154531464
  Distance between 3'-terminus of neighbour sequence of sequence listing upward to telomere on chrosomal short arm and 5'-terminus of this base sequence : 123752
gtttgtattctagtgaatgtccattaatagttgcttaaaactttctttaaaatatcagtgaggtaaatagcaatctggaaaagaaaagatggaaagaaagtaaatttggtttgaattaatttcttgtgttatcaaccttaactgaaggcttatatagcccagtgggatctattcatgggcaacatcatgttgccatttggcaggacccacttagattctggcctttggcaagcccctccacaaccaaggctcttccatttgaataaaaactgctcatcatcatgggtgtgtgtgtgtgtgtgtgtgtgtgtgtgtgtgtgtgtgtgttgccttctttcatcttattgatctttgatactttaccaatttctactcaacatttgtggggccgagtaatctgactgaggaataagttttgtcttgtttcctcagttgtaagctcactggta

SEQ ID NO: 5943 - DNA, 108 bp, Homo sapiens
  D3S1308
  Located on chromosome 3
  Distance between a terminus base of telomere on chromosomal short arm and 5'-terminus of this base sequence : 154634544
  Distance between 3'-terminus of neighbour sequence of sequence listing upward to telomere on chrosomal short arm and 5'-terminus of this base sequence : 102631
tgattttaggcagcagtgaaatttgtgtgtgtgtgtgtgtgtgtgttttcatcttaacccagataaagcattttatctgaattgattaagttccttggactgactagg

SEQ ID NO: 5944 - DNA, 378 bp, Homo sapiens
  AC025119.3_31107
  Located on chromosome 3
  Distance between a terminus base of telomere on chromosomal short arm and 5'-terminus of this base sequence : 154647066
  Distance between 3'-terminus of neighbour sequence of sequence listing upward to telomere on chrosomal short arm and 5'-terminus of this base sequence : 12414
tgctagaagtgctaatagtgagttaaggcaaattgaacatgtgaatttttattttacacttaatatcacatatatttgttttctagaaattctctgagtatcataacttgaatctatacctgaatttattatttcccctaggcaattttgaaatctcttccataagtatattacaagtagctactggaggatgactgagtcaactggtcacacacacacacacacacacacacacacacacacacacacgagtgtattttaaattttcaattcttctccataagggacacagtactaaataaagcaacgaatttaatttttaaaagacattggtcaaagaaaatttgccatacaatcttgactacgcattgaaatatc

SEQ ID NO: 5945 - DNA, 234 bp, Homo sapiens
  D3S3705
  Located on chromosome 3
  Distance between a terminus base of telomere on chromosomal short arm and 5'-terminus of this base sequence : 154647244
  Distance between 3'-terminus of neighbour sequence of sequence listing upward to telomere on chrosomal short arm and 5'-terminus of this base sequence : -200
agctactggaggatgactgagtcaactggtcacacacacacacacacacacacacacacacacacacacacgagtgtattttaaattttcaattcttctccataagggacacagtactaaataaagcaacgaatttaatttttaaaagacattggtcaaagaaaatttgccatacaatcttgactacgcattgaaatatcctggggagatttaaaacatatccatgcccaggtt

SEQ ID NO: 5946 - DNA, 388 bp, Homo sapiens
  AC012014.9_2538
  Located on chromosome 3
  Distance between a terminus base of telomere on chromosomal short arm and 5'-terminus of this base sequence : 154847095
  Distance between 3'-terminus of neighbour sequence of sequence listing upward to telomere on chrosomal short arm and 5'-terminus of this base sequence : 199617
ttggagttgtcataagtagcctggggccaggcgcagtggctcatgcctgtaatcctagcactttgggaggttgaggcaggaggatcacttgagcccaggagttcgaggctgcagtgagctatgactgcaccagtgtactacagcctgagcaacagaacaagatcctgtctctaaaaggaagaagaagaaggaggaggaggaggaggagagaaaagtagcctgggtctacagagcttagctcctttgcagagcttttaaaaatcccagtgtccattcccgccccacttccaggtatattaatttaattaagtgagtttggaggccaggcatcagacatcagtcctttttatttttaactcaccaggtgattctaataaggaagcaggtt

SEQ ID NO: 5947 - DNA, 455 bp, Homo sapiens
  chr3.fa.O7frz.170618838
  Located on chromosome 3
  Distance between a terminus base of telomere on chromosomal short arm and 5'-terminus of this base sequence : 154931536
  Distance between 3'-terminus of neighbour sequence of sequence listing upward to telomere on chrosomal short arm and 5'-terminus of this base sequence : 84053
gaaattattgcttctatcctgataagatacaataagaaattcacaaaatcatttatgctgtatttttgtgaaaaattttaacctaatttaatcataaagaacccatcgtgtgtgatagtggtctaaagtttttttcaaaacaggttaagacgaaaaacaaacaaaatggtcaaggggagagacactttttgaatcaggagaaacataattattactaaatgcaatatgtgaatctgattggatcctgcactggggaaaacagacacacacacaaacacacacacaccacacacacacacacagagctacaaaagacatttttggaacaactgggggaatttgaataagggctaaatattaggtcatattattgtactaaggttaattttcttgggtataataatagaatttgttatggtataaaagaatgtcttattcttaggaaatgcattcta

SEQ ID NO: 5948 - DNA, 248 bp, Homo sapiens
  D3S2401
  Located on chromosome 3
  Distance between a terminus base of telomere on chromosomal short arm and 5'-terminus of this base sequence : 155140003
  Distance between 3'-terminus of neighbour sequence of sequence listing upward to telomere on chrosomal short arm and 5'-terminus of this base sequence : 208012
caagaatgcaatgagctgtgatagcaccactgcactccagcctgagcaacagaacgagaccctgtctcaaacaaaaagaaaaaagaaaagcagcagcagcagcagcagcagcagcagcagcagcagcagcagcagcagcagcagcagcagcaagggaccttgagaattgatacaattctttctactgtgtttctttccctcctgaaagtttgaggagtaaagtactgcacagattggattggccaata

SEQ ID NO: 5949 - DNA, 240 bp, Homo sapiens
  AC023872.3_160689
  Located on chromosome 3
  Distance between a terminus base of telomere on chromosomal short arm and 5'-terminus of this base sequence : 155344841
  Distance between 3'-terminus of neighbour sequence of sequence listing upward to telomere on chrosomal short arm and 5'-terminus of this base sequence : 204590
cttatggtgtcacttccaagacataattctcaaatccaatatcctgaagtttttcccctatatttttttctaggagtttaatagttttaggccttacatttaggtctttaatcccttttgagttaattttatgtaaggtgtaagttaaggtccagcttaatatttatttatttatttatttatttatttaggcatgtggatatcccagttttcccagtaccatttgttaaggagactgtc

SEQ ID NO: 5950 - DNA, 468 bp, Homo sapiens
  chr3.fa.O7frz.171033590
  Located on chromosome 3
  Distance between a terminus base of telomere on chromosomal short arm and 5'-terminus of this base sequence : 155376691
  Distance between 3'-terminus of neighbour sequence of sequence listing upward to telomere on chrosomal short arm and 5'-terminus of this base sequence : 31610
gccttcacatattaaataagatgtggtgcaggattgtgatatatgatagaagggaaacaattgaggtgagctctgtaatgtccccaggtttctgcctgcaggctctttctaagctgcagcacaaggaagaggaacccgacttggcccaaccatcatgccaaagtgaggagacagagatcagagtttggggagccaaggcagcatagtaccagagacagagagagaaagggagagagagagagagagagacagagagagagagagagagaaccaacaagagtgccctagagagatgtagaggaatatcctcaagtttttggctgagtacagatctgtatatgcatgagaagcagcaaaaaaagccactaaaatggtggggcagaagaattcctagacttgaaaatagcttgtatttcaccatccagagttaaaagaccttgtaatacacaggaaattgaatagattcct

SEQ ID NO: 5951 - DNA, 397 bp, Homo sapiens
  AC023876.3_94955
  Located on chromosome 3
  Distance between a terminus base of telomere on chromosomal short arm and 5'-terminus of this base sequence : 155526218
  Distance between 3'-terminus of neighbour sequence of sequence listing upward to telomere on chrosomal short arm and 5'-terminus of this base sequence : 149059
ctgcttaactgtttataaagcaacataatttaaagaaggaattgcctcctgtttgatgtctgtttcatcttcaccatcttcctgtgggtaaaaccacatttaaaatttgatgggtctccatctagacttaatttctatgcttagacatataccacacacacacacacacacacacacacacacacagttgtgatattatttttgtcctcttttttttaacaaaataacaaaaaaatggtatcatactatacccagaggtctgcaacttgccttttgtccactctgaaaaagcacaaattctatgtgtcttgattgaatttcatttattgaaaagatatccctagactcaactaacatcttcagacaccatttgccctgtaatgactgaaactccatg

SEQ ID NO: 5952 - DNA, 284 bp, Homo sapiens
  AC018545.8_68466
  Located on chromosome 3
  Distance between a terminus base of telomere on chromosomal short arm and 5'-terminus of this base sequence : 155870858
  Distance between 3'-terminus of neighbour sequence of sequence listing upward to telomere on chrosomal short arm and 5'-terminus of this base sequence : 344243
aagaggatggactatggtacacatgatgaagtattaagtatcaatgaaaaagagagagtcctacatgtccggcatggaaggatctccaggagacaatgttaaaagtttgggggaaaaattgaaagacaatacctgtaatacatatgatactagtgatgttaaatcacatcacacacacacacacacacacacacacacacacacaaatactgtatagtgtacttctacaagtacatatttgtgtattatatagagagaaggtctggaaggatactaaccaaact

SEQ ID NO: 5953 - DNA, 224 bp, Homo sapiens
  D3S1299
  Located on chromosome 3
  Distance between a terminus base of telomere on chromosomal short arm and 5'-terminus of this base sequence : 155870922
  Distance between 3'-terminus of neighbour sequence of sequence listing upward to telomere on chrosomal short arm and 5'-terminus of this base sequence : -220
atgtccggcatggaaggatctccaggagacaatgttaaaagtttgggggaaaaattgaaagacaatacctgtaatacatatgatactagtgatgttaaatcacatcacacacacacacacacacacacacacacacacacaaatactgtatagtgtacttctacaagtacatatttgtgtattatatagagagaaggtctggaaggatactaaccaaactgtca

SEQ ID NO: 5954 - DNA, 260 bp, Homo sapiens
  chr3.fa.O7frz.171518710
  Located on chromosome 3
  Distance between a terminus base of telomere on chromosomal short arm and 5'-terminus of this base sequence : 155875248
  Distance between 3'-terminus of neighbour sequence of sequence listing upward to telomere on chrosomal short arm and 5'-terminus of this base sequence : 4102
tacagcatgtcactgtactgatactatactgtgacacatggtaagtatttgtgtacctaaacatagaaaaggtacagtaaggatacagtataaaagatttaaaatggtacacctgtatagggcacttaccatgaatggagcttgcaggactggaatttgttctgggtgagtcagtgagtgagtggtgagtgaatacgaaggcctgggggcattactgtgcactactgtggacattataaacactgtacacttaggctaca

SEQ ID NO: 5955 - DNA, 176 bp, Homo sapiens
  DISD22_0003053
  Located on chromosome 3
  Distance between a terminus base of telomere on chromosomal short arm and 5'-terminus of this base sequence : 156008524
  Distance between 3'-terminus of neighbour sequence of sequence listing upward to telomere on chrosomal short arm and 5'-terminus of this base sequence : 133016
catgaggattccttatacaattctctccattttgatatgtatttttaaatttccatgtaagttaaaaacacatacatatatttccaatttttatatatgcacacaattttatacacacacacacacacacacacacacacacacacacacacacacggcctggttctactaccaga

SEQ ID NO: 5956 - DNA, 414 bp, Homo sapiens
  chr3.fa.O7frz.171839239
  Located on chromosome 3
  Distance between a terminus base of telomere on chromosomal short arm and 5'-terminus of this base sequence : 156131550
  Distance between 3'-terminus of neighbour sequence of sequence listing upward to telomere on chrosomal short arm and 5'-terminus of this base sequence : 122850
gaagactccttatggattgaacaaggagggccctcttgactggtttgtctttctttctttttctttctttctctttctttctttctttctttctttctttctttctttctttctttctttctttctttctttctttctttccttctctccttccttctttccttccttcctttcttccttccttccttcctatcttctttctctttctctctctctctccccctgcttccttttcttttcttttctcttctcttttttctttctcttttcttttctttccagggtctatgctatgctgcctaggctggtctcaaatttctggactcaagcaatcctcctgccttggtttcccaaagtgctaggattacaggcatgagccaccttgactggtttcttccttaaaggttcctaagc

SEQ ID NO: 5957 - DNA, 455 bp, Homo sapiens
  chr3.fa.O7frz.171965114
  Located on chromosome 3
  Distance between a terminus base of telomere on chromosomal short arm and 5'-terminus of this base sequence : 156257323
  Distance between 3'-terminus of neighbour sequence of sequence listing upward to telomere on chrosomal short arm and 5'-terminus of this base sequence : 125359
agttctaacactgtttgcaaatagattgcagctgcagttatttaaaaatgagaaagctgaaggcagagagaaaatgttattttcttctcacacaaaatcataagccagacttattacaagaagtcaacttttctgactgaacaggtatctgttacgggtttctataaaatgtgtatatttcctaggctgcattcttccctgtcttatcagttcagctctctgggcagcttgccccttaccagtctgttttgagatactttggaggttctctctgtctctttctctctctctctctctctctctcacacacacacaccacacacacaccacacacacacacacacacacacacaccccaccgctattccctattccctattctttccatcaaaaaagggaactgttcaattagctcaccaaaagatacctttctatcaacacctaaggactgatta

SEQ ID NO: 5958 - DNA, 405 bp, Homo sapiens
  AC020636.8_176845
  Located on chromosome 3
  Distance between a terminus base of telomere on chromosomal short arm and 5'-terminus of this base sequence : 156388587
  Distance between 3'-terminus of neighbour sequence of sequence listing upward to telomere on chrosomal short arm and 5'-terminus of this base sequence : 130809
aggaataccaggatctgtaaagataagggcatattgatggaaagagggatggtggtcagataggtgactctatggattcatcataaaaatgcacaggtctcagcaaaggtaatctgtttgggagactagagacagttatgagcaaagattaagcagcaggtaggtctggttaaacggtcaagacctggaaactaaagttcagaattcagtaacagctttttaactttgcatttccaatgagattcctccttctacagacacaggactgtgtgtgtgtgtgtgtgtgtgtgtgtgtgtgtgtgtgtgtgtgtgaagtgtctagtgaatgtttattatatgccatgttattgtcctgagctctgacctacaaagttaatgtttagtaagaacttatgtctggcaact

SEQ ID NO: 5959 - DNA, 238 bp, Homo sapiens
  D3S1315
  Located on chromosome 3
  Distance between a terminus base of telomere on chromosomal short arm and 5'-terminus of this base sequence : 156487176
  Distance between 3'-terminus of neighbour sequence of sequence listing upward to telomere on chrosomal short arm and 5'-terminus of this base sequence : 98184
tccactgtaagggtatggcttgggtgcatatgcatgtgtgaatgtgcatatgtgtataggtttccgtgtgtgttaatgtgtttgtataggtttgtatatgtatgtgtgtgtaggcttatatatgtgtatgtatgtgggtttgtgtgtgtgtgtgtgtgtgtgtgtgtgcgtgtgtttatgcctgtaaccactggctgccactggtgactatgtttgtctcgtccatgagtttgcaggc

SEQ ID NO: 5960 - DNA, 420 bp, Homo sapiens
  AC011103.6_137401
  Located on chromosome 3
  Distance between a terminus base of telomere on chromosomal short arm and 5'-terminus of this base sequence : 156521213
  Distance between 3'-terminus of neighbour sequence of sequence listing upward to telomere on chrosomal short arm and 5'-terminus of this base sequence : 33799
acttctattcaagtcggataatgtcaccttctgtttttttttctttctttccttccttccttcctttcctttcctttccttttccttttccctttccctttccctttccttttccttttccttttccttttccttctcccctcccctcccctcccctcccctcccctcccctttcctttcctttcctacagggtctcgccatgttgggcaggttaatatgaaattcctggtctcaagcagtcctcctgcctcagcctcccaaagtactaggattacaggcatgagccaccatgccccgcctgatgtcaccttcttgcttaaaacctttactgttcttatgataaagacagaagctctttacttggttcacagaccctgcatagtctctcccccaacctgtactgcttcattcttgtcttt

SEQ ID NO: 5961 - DNA, 302 bp, Homo sapiens
  chr3.fa.O7frz.172368115
  Located on chromosome 3
  Distance between a terminus base of telomere on chromosomal short arm and 5'-terminus of this base sequence : 156554003
  Distance between 3'-terminus of neighbour sequence of sequence listing upward to telomere on chrosomal short arm and 5'-terminus of this base sequence : 32370
actattgatgttaaccttgatcacctggctgaggtagcacttaccaggttttacagtgtaaagttatttccctcccatccctttccacactttactctttggaaggaagtaatatggacagtccacacttaagaagtggggagttaaccatccccctccttgagggcagagtatctacttatttaaaattcttctgcatgggtgatttgtctcttatctacctacctacctacctacctgcctacctacctactattctttcattcattaatgtatgtatgtattcaagcatttctatcagt

SEQ ID NO: 5962 - DNA, 181 bp, Homo sapiens
  D3S3625
  Located on chromosome 3
  Distance between a terminus base of telomere on chromosomal short arm and 5'-terminus of this base sequence : 156681422
  Distance between 3'-terminus of neighbour sequence of sequence listing upward to telomere on chrosomal short arm and 5'-terminus of this base sequence : 127117
tgaaatttgggcaatcaattttgacctcttccaaaaaatggttggcagaatttgttatacttctgttctgctttcacaatctccccactggcttgttcattaagtctctgaattttgtgtgtgtgtgtgtgtgtgtgtgtgtgtgtgtgtgtgtgtgtgatggagtttcactcttgttgcc

SEQ ID NO: 5963 - DNA, 326 bp, Homo sapiens
  D3S1594
  Located on chromosome 3
  Distance between a terminus base of telomere on chromosomal short arm and 5'-terminus of this base sequence : 156707231
  Distance between 3'-terminus of neighbour sequence of sequence listing upward to telomere on chrosomal short arm and 5'-terminus of this base sequence : 25628
ctggacacagagggtcctaaaatgaagcccttacacacacacacacacacacacacacacacacacacacacacggtcctaaaatgaagcccttacacacacacacacacacacacacacacacacacacacaccctctaccttcatttctatagtgttgagtaaaggaaaaaataattttaaaaaatccccacacagagaatgaggggatgactgccaaagatcttagtttatagatggaaagtagtagtttcttttcctatccttcaacttcaaggatagatataattctcttttctatactttttgttctctgcaaaagtggc

SEQ ID NO: 5964 - DNA, 280 bp, Homo sapiens
  D3S1279
  Located on chromosome 3
  Distance between a terminus base of telomere on chromosomal short arm and 5'-terminus of this base sequence : 156721158
  Distance between 3'-terminus of neighbour sequence of sequence listing upward to telomere on chrosomal short arm and 5'-terminus of this base sequence : 13601
gacctattttggttaacaatttagagttaaattttttttaggtgacctcaggtaacttgctctgtgtgtgtgtgtgtgtgtgtgtgtgtgtgtgtgtgtgtgtgtgtgtgtgtgtttagagcagatggggggttgatgtaaagtggattgtaaactccctgaagacaagatttgtgtctaatggttctttataaccttaacctcaaacctgactattctttttgacaagtgagggaactgagcaggattcaacaacctgcccaataccacacagatggtg

SEQ ID NO: 5965 - DNA, 457 bp, Homo sapiens
  AC024886.10_174359
  Located on chromosome 3
  Distance between a terminus base of telomere on chromosomal short arm and 5'-terminus of this base sequence : 156722547
  Distance between 3'-terminus of neighbour sequence of sequence listing upward to telomere on chrosomal short arm and 5'-terminus of this base sequence : 1109
ttaatgctgtttaagttaatggagtaagacaattacctaagagagcatttttacttcaatttcatcacttgtcttcactgacaattttaaaattctcaagtgaagtctttaatatgagtggatatttcacctttcttaatcagcatcaaacgttcactctcatttttctcttctcatgaatacaaataaataacccaccctcacccatatgtagtaaaaggatctgggatcacatataactcatttcatgaaatacacgcacacacacacacacacacacgcacacacacacacacacaacgtttcttcaaagtaattcatacttcagtgaatttatcaacttctggcattaatcatgttttaaacaatgtctcttaaactaataggaatatttgaattaaaatatttttctctggcttgatttatagatgtagtaacttcctcaactaggagaaat

SEQ ID NO: 5966 - DNA, 301 bp, Homo sapiens
  AC017016.5_159389
  Located on chromosome 3
  Distance between a terminus base of telomere on chromosomal short arm and 5'-terminus of this base sequence : 156983752
  Distance between 3'-terminus of neighbour sequence of sequence listing upward to telomere on chrosomal short arm and 5'-terminus of this base sequence : 260748
ggaggcacaaattgaaatattttggtggaaaattcttcctggaacccatggagagagcaatagcaataacagaaatgttacctgcacaaatgagtactggtgtgtgtgtgtgtgtgtgtgtgtgtgtgtgtgtgtgtgtgaatacttcagtacttgaaaaatattcatttttttgcttcttccccccaccgccatcccctattcctgccctgggtttgtagtggattgtataccagtgttgggatacttaagccaacttttcctgcaaatattgtatgtacatctgtatgagcaaattctc

SEQ ID NO: 5967 - DNA, 237 bp, Homo sapiens
  AC069067.7_128935
  Located on chromosome 3
  Distance between a terminus base of telomere on chromosomal short arm and 5'-terminus of this base sequence : 156983752
  Distance between 3'-terminus of neighbour sequence of sequence listing upward to telomere on chrosomal short arm and 5'-terminus of this base sequence : -301
ggaggcacaaattgaaatattttggtggaaaattcttcctggaacccatggagagagcaatagcaataacagaaatgttacctgcacaaatgagtactggtgtgtgtgtgtgtgtgtgtgtgtgtgtgtgtgtgtgtgtgaatacttcagtacttgaaaaatattcatttttttgcttcttccccccaccgccatcccctattcctgccctgggtttgtagtggattgtataccagt

SEQ ID NO: 5968 - DNA, 154 bp, Homo sapiens
  D3S1584
  Located on chromosome 3
  Distance between a terminus base of telomere on chromosomal short arm and 5'-terminus of this base sequence : 156983819
  Distance between 3'-terminus of neighbour sequence of sequence listing upward to telomere on chrosomal short arm and 5'-terminus of this base sequence : -170
aacagaaatgttacctgcacaaatgagtactggtgtgtgtgtgtgtgtgtgtgtgtgtgtgtgtgtgtgtgtgaatacttcagtacttgaaaaatattcatttttttgcttcttccccccaccgccatcccctattcctgccctgggtttgtag

SEQ ID NO: 5969 - DNA, 466 bp, Homo sapiens
  AC017016.5_122447
  Located on chromosome 3
  Distance between a terminus base of telomere on chromosomal short arm and 5'-terminus of this base sequence : 157020619
  Distance between 3'-terminus of neighbour sequence of sequence listing upward to telomere on chrosomal short arm and 5'-terminus of this base sequence : 36646
gtacctgctatgtactgtaggactggttttagacactgatgatccagtagtgaacaaaaccaataaagtccctgtcctcttggaggagagacatacaataaattatacacatatctaatatagtatatcatatatatatttacacatatatgcatatacctctgtgtgtgtgtatatgtttgtgtgtgtatatatgtgtgtgtgtgtgtgtgtgtatatatatataacataggtgttcatatggtatgtcagatggtgataagtacaaacagaaaaataagtcagggcatggggcatatggagtgccagaaggtttagagataggagttttaaatatagtggccagaagagacctcacagaaaaggtgacatttgaacacgttcttgaaggaaataagggaataaatcatgtgtcttcattcaggctgctttttcaaaaatactgtaaacggaatggcttataaac

SEQ ID NO: 5970 - DNA, 343 bp, Homo sapiens
  AC017016.5_119201
  Located on chromosome 3
  Distance between a terminus base of telomere on chromosomal short arm and 5'-terminus of this base sequence : 157023873
  Distance between 3'-terminus of neighbour sequence of sequence listing upward to telomere on chrosomal short arm and 5'-terminus of this base sequence : 2788
catgaaacaagatgagtggtagaaaacttaaggagaagtcagctatatggacaaccagtcatagtcagggaaaaagttgggagagcaaagttcaagtagagacaatttgcttcccttccccactccctagctccccagctcatgttaacaatggtagaacaacacacacacacacacacacacacacacacacacacacacacacactctctctctctctccccctctctcaatctctctcgctcatgaaatattctgccttttgcatccaagctgttctcacggtgatcattcagtcatttcttccataaacttgccttttatcctatagttgaagtgaccg

SEQ ID NO: 5971 - DNA, 464 bp, Homo sapiens
  AC017016.5_102789
  Located on chromosome 3
  Distance between a terminus base of telomere on chromosomal short arm and 5'-terminus of this base sequence : 157040329
  Distance between 3'-terminus of neighbour sequence of sequence listing upward to telomere on chrosomal short arm and 5'-terminus of this base sequence : 16113
cactcagaaggaattaactcttatttttatattttctctcttatatttaaaaaagttctcaaagataaagaacgaaactgaactttcttggttaggctgtagggaagaagagatctatgaatttgtgtgtgtgtgtgtgtgtgtgtgtgtgtgtgtgtgtgtgagacagggtcttgctctctcacccaggctggattgcagtggcgcgatcttggctcactgcagcctccgcctcctgagttcaagcgattctcatgcctgagcctccagagtagctgggatcacaggcacacgtcatcacgcctggctaatttttgtatttttggtagagaaggggtttcgtcaggttggccaggctggtctccaactcctgacctcaagtgatccgcccacctcagcctcccaaagtgctgggattatatgcatgagccactgtgcccagccagatctatgaatatttaatg

SEQ ID NO: 5972 - DNA, 449 bp, Homo sapiens
  AC017016.5_76925
  Located on chromosome 3
  Distance between a terminus base of telomere on chromosomal short arm and 5'-terminus of this base sequence : 157066040
  Distance between 3'-terminus of neighbour sequence of sequence listing upward to telomere on chrosomal short arm and 5'-terminus of this base sequence : 25247
tccaagagaattactgaatgtaagcggtgagacctgctgaaatccagaccttttccaccctttggatgaaggtcttaaatttatttgggctattctttgcaaacctccttttcagaatggggattccattttggcctagagggtaagatatttgaatttcaggggaaaaaaagaaaaactgcctttctctgcctctgccatgcagcacgaaagtttgggtcaagatattggcagtctagcatcaatggtttgttttgtgtgtgtgtgtgtgtgtgtgtgtgtgtgtgtgtgtgtgtgtgtgtgtgtgtgtgtgtgtatgcatgtgttgcctaaaattacatagcatgtttttaaaatttcagctgctttctattgtttataatttgaacattaaaaaatattgtgaccaattcctgttttaaactgaaaagtgcatgaaagcaagttct

SEQ ID NO: 5973 - DNA, 449 bp, Homo sapiens; identical to SEQ ID NO: 5972
  AC069067.7_104615
  Located on chromosome 3
  Distance between a terminus base of telomere on chromosomal short arm and 5'-terminus of this base sequence : 157066040
  Distance between 3'-terminus of neighbour sequence of sequence listing upward to telomere on chrosomal short arm and 5'-terminus of this base sequence : -449

SEQ ID NO: 5974 - DNA, 226 bp, Homo sapiens
  AC068647.4_6505
  Located on chromosome 3
  Distance between a terminus base of telomere on chromosomal short arm and 5'-terminus of this base sequence : 157253412
  Distance between 3'-terminus of neighbour sequence of sequence listing upward to telomere on chrosomal short arm and 5'-terminus of this base sequence : 186923
catgttcgtgtcctctaatactagtacagtttctgccaaagagtagttttaaaatgtgcacttgttggaaaagtagtctttgagtatgtgtgtgtgtgtgtgtgtgtgcacgcgcattggatgtgtttgtcttatatatatatttcccataggcaataataatgacaaatgcaaggatttatggagtggtgtactgataaatgtttaacaaccaagtctttgtaaa

SEQ ID NO: 5975 - DNA, 358 bp, Homo sapiens
  chr3.fa.O7frz.173517231
  Located on chromosome 3
  Distance between a terminus base of telomere on chromosomal short arm and 5'-terminus of this base sequence : 157284919
  Distance between 3'-terminus of neighbour sequence of sequence listing upward to telomere on chrosomal short arm and 5'-terminus of this base sequence : 31281
ggatttgtaatttgtcttgagtagcacaaacacacacacacacacacactctctcactctctctctctctctctctctctcgtgaaaatcaagaaagaatgctatatttatttttcttggtttatatatcatatatcttaatttatttatcattacataagtcaaaataaaacaatttttgtaggcattaaaaactctagctttaggcaccataccaagagaatgattgacagtgactcacaggcataaggctcaattcaagacagaaagagccaagtcacaatactgaaaaatagccaagagtcggggaatctaggaaatatcagaaaccagaagataggtacgtggttatgactca

SEQ ID NO: 5976 - DNA, 440 bp, Homo sapiens
  AC084301.5_74118
  Located on chromosome 3
  Distance between a terminus base of telomere on chromosomal short arm and 5'-terminus of this base sequence : 157351694
  Distance between 3'-terminus of neighbour sequence of sequence listing upward to telomere on chrosomal short arm and 5'-terminus of this base sequence : 66417
tatttctgcaaatgctactgtcagccttggcttagaaaggagtgcctccactgaacttattaatgctggggcccgcccatcagcaccttcctttgggtcattgtgtggaccagagtcctctgggggcattcatagtcacacaaaacgtatctactctaaatcgcctacttctctgggcctttcaactccttctttcaacatctgtcatggcaattctggcatttccattttacataatgtagccatcatttttccatgcttccaaaagccatctggatgtgtgtaccatatcccagggtgttaaactctgtatttaagaagtgtgtagaagtgtgtgtgtgtgtgtgtgtgtgtgtgtgtgcgcatgtgtattatttgttctaaatgtattttctgtcccaacttagaccaacagcctcagaatccatatcaatgagtag

SEQ ID NO: 5977 - DNA, 249 bp, Homo sapiens
  D3S1746
  Located on chromosome 3
  Distance between a terminus base of telomere on chromosomal short arm and 5'-terminus of this base sequence : 157400376
  Distance between 3'-terminus of neighbour sequence of sequence listing upward to telomere on chrosomal short arm and 5'-terminus of this base sequence : 48242
cccctgcaaacaaattttttgaaaagctttatctatcttatctatctatctatctatctatcatctatctatctatctatctatctatctatctatctatctataaaattcatatatatttccctctgtgtctttctactttctggcagagtgttttacatatagttgtcacacaaatgtttgttaacttgtataatgtaccaggataccaggactagtaactttagcgcctggattattttaagacac

SEQ ID NO: 5978 - DNA, 230 bp, Homo sapiens
  D3S2463
  Located on chromosome 3
  Distance between a terminus base of telomere on chromosomal short arm and 5'-terminus of this base sequence : 157400376
  Distance between 3'-terminus of neighbour sequence of sequence listing upward to telomere on chrosomal short arm and 5'-terminus of this base sequence : -249
cccctgcaaacaaattttttgaaaagctttatctatcttatctatctatctatctatctatcatctatctatctatctatctatctatctatctatctatctataaaattcatatatatttccctctgtgtctttctactttctggcagagtgttttacatatagttgtcacacaaatgtttgttaacttgtataatgtaccaggataccaggactagtaactttagcgc

SEQ ID NO: 5979 - DNA, 147 bp, Homo sapiens
  D3S3689
  Located on chromosome 3
  Distance between a terminus base of telomere on chromosomal short arm and 5'-terminus of this base sequence : 157531047
  Distance between 3'-terminus of neighbour sequence of sequence listing upward to telomere on chrosomal short arm and 5'-terminus of this base sequence : 130441
tcgcaccactgcactccagtctgggcaacagagcaagacactgtctcaaacacacacacacacacacacacacacacacacacacacacacacacacacacacgatgtccccattaacatctctacagccttttaagactttgaagt

SEQ ID NO: 5980 - DNA, 338 bp, Homo sapiens
  AC068646.7_106788
  Located on chromosome 3
  Distance between a terminus base of telomere on chromosomal short arm and 5'-terminus of this base sequence : 157557281
  Distance between 3'-terminus of neighbour sequence of sequence listing upward to telomere on chrosomal short arm and 5'-terminus of this base sequence : 26087
caaagcagtgaagttcatttatgctgcattattcctgaagaattcataagaggttctggcttattttacttttcacctaaagccaaggggtgtgtgtgtgtgtgtgtgtgtgtgtgtgttgggggtgagtggggtgggcagaggagatgatgatataaaacatttcttccattctatgatatagctttttcactttttaaatttctaaagtcaggatatagtccacaatttacgggaatattgaatatcctacagattttggattttgttaagttcactttggtttcttctctgaaaagctgttatcaaatcggttgtgcatcttacaatctatggtg

SEQ ID NO: 5981 - DNA, 448 bp, Homo sapiens
  AC069242.6_122804
  Located on chromosome 3
  Distance between a terminus base of telomere on chromosomal short arm and 5'-terminus of this base sequence : 157637775
  Distance between 3'-terminus of neighbour sequence of sequence listing upward to telomere on chrosomal short arm and 5'-terminus of this base sequence : 80156
acagagaaattcctttcattctactttcttgtttctataaactcactcaacattgtagtcagtgaatttgcttttcaatagacttatcaatcaattgactgttagttctagtgtgtttttatgtgtgtgtgtgtgtgtgtgtgtgtgtgtgtgtgtaagcacattttatttttttctgatttccttagtattttggttggacattgagaaaggcagttccaggatatactaataaggtgtcagtcaagtccaaagtaaaatctaattttcaggatggcaaatttcacaagttcagaaaataagtaggtataataacatagtctgagactctaaaaggattggtgatttgagaaggttgatagccacatgaaaatttaatttcatttacataggctgaaatgcttccaatctagagaaaaggaaagggtccatattgaatctgaaatga

SEQ ID NO: 5982 - DNA, 456 bp, Homo sapiens
  AC026347.14_96770
  Located on chromosome 3
  Distance between a terminus base of telomere on chromosomal short arm and 5'-terminus of this base sequence : 157708691
  Distance between 3'-terminus of neighbour sequence of sequence listing upward to telomere on chrosomal short arm and 5'-terminus of this base sequence : 70468
cactaatgttaagaaattcctgacaaattgagtcaaggaagtccatgaagggagggctctcccttgtatacctgataaagaaaaagattctacaaagaccttacacaaaggccattgaagtatacatatatgtgtgtgtgtgtgtgtgtgtgtgtgtgtaagtatatatatgtgtgtgtgagtacatatatatgtaagtatatatatgtgtatatatatgtgtatatgtgtatgtatatatgtgtgtgtgtgtgtgtgtgtatatatatatatacttatatatatacttctgcaagaacatctgttcagcaactgcctgtccaacctcggactggtgtcacccttgttattgatctttgtagccaagggtaattatttcaaaacaattatgtactcctcttcattttttcctttagaaagatttgttttcctttacttccttgaataagcacaaac

SEQ ID NO: 5983 - DNA, 252 bp, Homo sapiens
  D3S1280
  Located on chromosome 3
  Distance between a terminus base of telomere on chromosomal short arm and 5'-terminus of this base sequence : 157812974
  Distance between 3'-terminus of neighbour sequence of sequence listing upward to telomere on chrosomal short arm and 5'-terminus of this base sequence : 103827
aggactacaacccacttatatcagagtgtgtgtgtgtgtgtgtgtgtgtgtgtgtgtgcataacaatacaattatgtacagtacaaaatacatgataataaatgattgtgctactggtttacttatttactatactacttatcattagcatgtactctttctaataattaaaaaaaaaaagttaactgtaaaacagcctccagcaggcccttcaggaggtattccagaagaaggcattgttatcataggaga

SEQ ID NO: 5984 - DNA, 186 bp, Homo sapiens
  DISO7_10001252
  Located on chromosome 3
  Distance between a terminus base of telomere on chromosomal short arm and 5'-terminus of this base sequence : 157853813
  Distance between 3'-terminus of neighbour sequence of sequence listing upward to telomere on chrosomal short arm and 5'-terminus of this base sequence : 40587
cttcctatctacatgatgagaaatgaatgataaaaacagtagcattaaaatacacacatacacacacacacacagacaatttactgtgcccactttttaatacttttttgaaagcaacacctcaattttcctgaaatatctttgagtgggctatgtaattttattgtttaagatggaccgctatga

SEQ ID NO: 5985 - DNA, 439 bp, Homo sapiens
  AC009760.4_24155
  Located on chromosome 3
  Distance between a terminus base of telomere on chromosomal short arm and 5'-terminus of this base sequence : 157876599
  Distance between 3'-terminus of neighbour sequence of sequence listing upward to telomere on chrosomal short arm and 5'-terminus of this base sequence : 22600
atttgaggtcaggagttcaagaccagcctggtcaatatgatgaaaccccatctctactaaaaatacacacaaaaaaattagctgggcatggtggtgcatgcctgtaattccagctactcgggaggctaagccaggagaatcacttgaacccaggaggcagacgttgcagtgagccaagattgcaccactgcactccagcctgggagacaatagtgaaactctgtctcaataaataaataaataaataaataaataaataaataaataattttcccaagggaaaaattttttagaaaaatttactggcatccttgattatatgtgtaagcttatttagatcttatgttagaagagaatatctgattctgaaaattgataaatatcatgcattttttccctttttctgatataaactatgttttgaagttgaccattagtt

SEQ ID NO: 5986 - DNA, 471 bp, Homo sapiens
  AC009809.4_81214
  Located on chromosome 3
  Distance between a terminus base of telomere on chromosomal short arm and 5'-terminus of this base sequence : 157982717
  Distance between 3'-terminus of neighbour sequence of sequence listing upward to telomere on chrosomal short arm and 5'-terminus of this base sequence : 105679
gataatgtcagctccttgtttaccaataataaagataaagataatggcagcatttatctttttcagtccaatggggatatttaaggtacctatgtaagtgtgtgagtgcctgtgtgaattgtgacttacttcttctgcataccacattcgtagctcaataagctctcactgcctctgcaatataacttgtctttcctgacacacacacacacacacacacacacacacacacacactctcacacaaacaaatcacctaaataaaaatatctcaaggaggtatactcttttaaaatgctatttttattataccaggataaaaataattgattgaaagatggtgtcaaaaccagaacctagtctcatgtcctgtgcttcctaatcaatatttaaatatagatggtcaagagaagatgactctaaaaggcaatcaaaagttgcaaacattcttgtatggagaatcaagtttaag

SEQ ID NO: 5987 - DNA, 400 bp, Homo sapiens
  chr3.fa.O7frz.174589057
  Located on chromosome 3
  Distance between a terminus base of telomere on chromosomal short arm and 5'-terminus of this base sequence : 158104653
  Distance between 3'-terminus of neighbour sequence of sequence listing upward to telomere on chrosomal short arm and 5'-terminus of this base sequence : 121465
gtacttttgtaaggcttggtactatctgcagtgtcaggcatccacttgaggtcttgaaacatatcccttgcagaagaggggaggctactgtaatttagttcagattgaagaactctgtctctctctctctctctctctctatatatatatatatatatacactcacatatatatattgctctctctatatatatatatgtatacacacacagacatatatatatatatatatatatatatagctttttgatattgaaggaataaaaaggctaaaaacttaaaagagacctcaatgtgaatctgattggtccagtaaagtggttgtacccctttacatactcaacttcagtgtataagagttcagttcacccatatccttaccaatacttgatatggtcag

SEQ ID NO: 5988 - DNA, 340 bp, Homo sapiens
  chr3.fa.O7frz.174671244
  Located on chromosome 3
  Distance between a terminus base of telomere on chromosomal short arm and 5'-terminus of this base sequence : 158199211
  Distance between 3'-terminus of neighbour sequence of sequence listing upward to telomere on chrosomal short arm and 5'-terminus of this base sequence : 94158
gacagtagtgaatcaggtcattagagaattatctctatggcctgtttgttgaggctcccggggtctggctagtgagatcagattagaagatgcaatagattttacaaggtcatttagtattacctctgtctttttcggctttaaatctaactatctatctgtctatctatctatctatatctatctatctatctatctatcatctatctatctatatactgtattcttgaagaggtttcttgaggattcatctgatgattatgtatcattatggcaaagaaagcatgaaatgacttctttaagtcatttctatccacttataagttcatagccaattgaa

SEQ ID NO: 5989 - DNA, 287 bp, Homo sapiens
  AC021662.14_69595
  Located on chromosome 3
  Distance between a terminus base of telomere on chromosomal short arm and 5'-terminus of this base sequence : 158271747
  Distance between 3'-terminus of neighbour sequence of sequence listing upward to telomere on chrosomal short arm and 5'-terminus of this base sequence : 72196
caaatactgttcaggcactatttctcctcctgtacttccctcttcctcctccctctcccacttcttcctcttcttcttcatttcactgtctgctttttattattattattattattattattattattatttcctctcccctctccccgctggcctcctgtttcttgctctcttgctctcttctccctttttcctcactcaacttcagatcaatcctgctgggtatattctgtgtcctatacccctgctgtgattcttaatgaaataaatttcaggaagcctactga

SEQ ID NO: 5990 - DNA, 287 bp, Homo sapiens; identical to SEQ ID NO: 5989
  AC013251.11_154830
  Located on chromosome 3
  Distance between a terminus base of telomere on chromosomal short arm and 5'-terminus of this base sequence : 158271747
  Distance between 3'-terminus of neighbour sequence of sequence listing upward to telomere on chrosomal short arm and 5'-terminus of this base sequence : -287

SEQ ID NO: 5991 - DNA, 211 bp, Homo sapiens
  chr3.fa.O7frz.174835674
  Located on chromosome 3
  Distance between a terminus base of telomere on chromosomal short arm and 5'-terminus of this base sequence : 158361642
  Distance between 3'-terminus of neighbour sequence of sequence listing upward to telomere on chrosomal short arm and 5'-terminus of this base sequence : 89608
gcagtattcacaatagtaaagtcatggaattaacctgtgtccatcaaaagataattggattttaaaatgtagtgtgtgtatacacacacacacacacacacacacacaccacaaaatactactcagccataaaaaagaatgaaattatgtcttttgcagcaacataagtggaactggaggccattatccgtagtgaaatgattcaggaaca

SEQ ID NO: 5992 - DNA, 399 bp, Homo sapiens
  AC069072.14_58278
  Located on chromosome 3
  Distance between a terminus base of telomere on chromosomal short arm and 5'-terminus of this base sequence : 158449256
  Distance between 3'-terminus of neighbour sequence of sequence listing upward to telomere on chrosomal short arm and 5'-terminus of this base sequence : 87403
aggtatcctagactttgtagctcagattgccagcatagatttccctccctccctccctcccttctttccttccttccttttcttcttttctttttcttttccttctttctttcctttctttcttttcttttctttctttctttctttctttctttctttcttccttccttccttccttccttccttccttccttcctttctttctttctttctttctttctttctttctttctttctttctttctttctttctttctttctctctctttcttcctgtgtctctctctctctgtttctctgtttctttcctttcttttttttctttatttttttctttgagacggagtcttgctctgtctcccaggctggagtgcagtggcatgttctcggcttactgga

SEQ ID NO: 5993 - DNA, 438 bp, Homo sapiens
  AC015991.3_143328
  Located on chromosome 3
  Distance between a terminus base of telomere on chromosomal short arm and 5'-terminus of this base sequence : 158519248
  Distance between 3'-terminus of neighbour sequence of sequence listing upward to telomere on chrosomal short arm and 5'-terminus of this base sequence : 69593
gacagtttatgtacttggttccagtttctttcaaaaaagaagagagagtccctgtccccaagaagctcataatcacataaatattcatacataattacaatactatgatatatgttataaatttgtacaaatgttgggcctttcttctctctcagactttctctttctagatagagagatgatagatagatagatgatagatagatagatagatagatagatatacatatgcatgcatgtatgtgcgcatgtatatgtatttaggcatagaatatcctattgctgaaaatgaattctagaattgacataattaaactagcattcaagtcctgacttcatcacttactggtcttgtgactttaggattttggtggaatttagcttctctaaatgatttaacttctcacaaccccagtttgctcaaactagctaacactt

SEQ ID NO: 5994 - DNA, 379 bp, Homo sapiens
  AC069072.14_77797
  Located on chromosome 3
  Distance between a terminus base of telomere on chromosomal short arm and 5'-terminus of this base sequence : 158533302
  Distance between 3'-terminus of neighbour sequence of sequence listing upward to telomere on chrosomal short arm and 5'-terminus of this base sequence : 13616
  misc_feature (1)...(379): n = A,T,G or C
catgaggtcaagagatcaagaccatcctggacaacatggtgaaaccccatctctactaaaaattcanattcttctgggtgtggtggcgcacgcctgcagtcccagctactctggaggctgagtcagaagaatcacttgaacccgggaggcagaggttgcagtgagctgagatcgtgccactgcatgccagcctggtgacagagcaagactctgtcaaaaaaaaggaaggaaggaaggaaggaaggaaggaaggaaggaaggaaggaaggaaggaagggagggagggagggagagagagagagagatacaggagtctgatgtgtcttcagccaaacatgcacagagcctttggtgcaatgccaacagaaagtaacataag

SEQ ID NO: 5995 - DNA, 341 bp, Homo sapiens
  AC015991.3_76201
  Located on chromosome 3
  Distance between a terminus base of telomere on chromosomal short arm and 5'-terminus of this base sequence : 158688472
  Distance between 3'-terminus of neighbour sequence of sequence listing upward to telomere on chrosomal short arm and 5'-terminus of this base sequence : 154791
atgagcatgagtattgagagcttctccgcgtcaggtgtggtggctcacctctgtaatatcagcactttgggaggccaaggtgggggtattgcttgaggccagacatttgagaccaggctgggcaacatactgagaccactatctctatattaaataatattttaaataaaattattattattatttatttatttatttatttatttatttatttatttattttgagacggaatctcactctgtcacccaggctggagtgcagtggtgtgatctctgctcactgcaacctccgcctctcgggttcaagcgattctcctgcctcagcctcacgagtgactagg

SEQ ID NO: 5996 - DNA, 438 bp, Homo sapiens
  chr3.fa.O7frz.175364898
  Located on chromosome 3
  Distance between a terminus base of telomere on chromosomal short arm and 5'-terminus of this base sequence : 158981037
  Distance between 3'-terminus of neighbour sequence of sequence listing upward to telomere on chrosomal short arm and 5'-terminus of this base sequence : 292224
atcataaaggatactggattatgtcaaatgctttttctgtgtctattgagatgatcatgtgatttttgtttttaattctattcatgtgctatatcacatttattgacttgtgtatgttaaaccgtccctgcatccctggtatgaaacccacctgatcatggtggattatctttttgatatgctgtgagatttggtgagctagtgttttgttgagaatttttgcatctatgttcatcaggatattagtctgtagttttctttctttctttctttctttttttttttattttgttacgtcctttcctggttttggtattagggtgatacgggcttcatagaatgatttagagaggatttactttttctctatcctgtggaatagtgtcaatcggattggtaccaattcttctttgaatgtctgatagaattcagctgtga

SEQ ID NO: 5997 - DNA, 216 bp, Homo sapiens
  D3S3531
  Located on chromosome 3
  Distance between a terminus base of telomere on chromosomal short arm and 5'-terminus of this base sequence : 159090080
  Distance between 3'-terminus of neighbour sequence of sequence listing upward to telomere on chrosomal short arm and 5'-terminus of this base sequence : 108605
aagagcctaaattaggaaaataaaattgttctctctctctctctctctctatatatatatatacacacacacatacatacatatacacatatatatacatacataaatatatacatacatatgtacatacatatatatacacatacatacacacacacacacacacacacacacacacacacatatttctttttgagatggagtcttgctttgttt

SEQ ID NO: 5998 - DNA, 442 bp, Homo sapiens
  AC064795.2_50392
  Located on chromosome 3
  Distance between a terminus base of telomere on chromosomal short arm and 5'-terminus of this base sequence : 159262568
  Distance between 3'-terminus of neighbour sequence of sequence listing upward to telomere on chrosomal short arm and 5'-terminus of this base sequence : 172272
attcaccatagttcttagtccagaatagaaaatatattcccctcccaagtctagaatgagatgcagcattgctataagaagcttgcatttgaaaaaggattattaaccctctgaaaggagttgaaaactcattacattataacattattatgcaatggaacagtaaagaaaggcatttttgttgttttactgctagtattcttccagggttttggaaagttttcagagtaaggaatcagagtgcttgaaaacagttccaaaacaaattgtaagtgtaggcctctctctgtctcacacacacacacacacacacacacacacacacacacacacacgccctggtccaaacataaaaacaaacaaaaccctcagtttaaaaaaaaaagacacaagtgacagtttgttactgtgtgttcatgtatggatctagccaagttattta

SEQ ID NO: 5999 - DNA, 238 bp, Homo sapiens
  AC041012.3_53564
  Located on chromosome 3
  Distance between a terminus base of telomere on chromosomal short arm and 5'-terminus of this base sequence : 159285703
  Distance between 3'-terminus of neighbour sequence of sequence listing upward to telomere on chrosomal short arm and 5'-terminus of this base sequence : 22693
tcatggatctttgaaactttctaggaattgatgtaaatatcacttgtctactttgttgaattcactgctttctattctatatttatttatttatttatttatttatttatttgagacagggtctcactctgccatctaggctggagtgcagtggtatgatcatagctcaccatagcctccaactcctggactcaaaagatcccctgccttagcctcgtaagtattgagattacaggtg

SEQ ID NO: 6000 - DNA, 267 bp, Homo sapiens
  D3S3710
  Located on chromosome 3
  Distance between a terminus base of telomere on chromosomal short arm and 5'-terminus of this base sequence : 159299266
  Distance between 3'-terminus of neighbour sequence of sequence listing upward to telomere on chrosomal short arm and 5'-terminus of this base sequence : 13325
gattaactcccactcccattcctgaggaagtgcttttatgcaagatgaagtggttctttgtgtgtgtgtgtgtgtgtgtgtgtgtgtgtgtttttcatatgtgtgaaatgttaccataaccctggttcttctgacagtagtcaatttatcagaaagaattctcctttctagtgtctgtggtatgaatgataaagttcagtgttaggatggtcaacctccagcacatacagatagactggggtcaagttaagggcaatagagtcaggt

SEQ ID NO: 6001 - DNA, 347 bp, Homo sapiens
  AC041012.2_163057
  Located on chromosome 3
  Distance between a terminus base of telomere on chromosomal short arm and 5'-terminus of this base sequence : 159307786
  Distance between 3'-terminus of neighbour sequence of sequence listing upward to telomere on chrosomal short arm and 5'-terminus of this base sequence : 8253
tcttccttatttctgttaaatgactgggacaacagtggggattaggagagatggacatcaattcaaatagtagagaaacctttacaccaaacaataattttttgattttgagggtttctgctgtgcgatacaatgcatgcagttaactttctggaagcacagtgaaagcataaaagctagttccagtccactgcacaccattgatacttgccagtttagccaatggaaaattctctctctctctctctctctctctctctctctctctctctctctgtctctctcacacacacacacacaaattttgtcagaggtgttaatgaataagagctagcaaatgtaaactg

SEQ ID NO: 6002 - DNA, 308 bp, Homo sapiens
  AC072034.10_137349
  Located on chromosome 3
  Distance between a terminus base of telomere on chromosomal short arm and 5'-terminus of this base sequence : 159310627
  Distance between 3'-terminus of neighbour sequence of sequence listing upward to telomere on chrosomal short arm and 5'-terminus of this base sequence : 2494
gtgaggtcaggagttcaagaccagcctggccagatggtgaaacaccgtctccactacaaatacaaaaattagctaggcatggtggcgcacgcctgtagtcccagccactcaggaagctgaggcaggagaatcatttgaacccacgaggtggaggttgcagtgagccaagatcacaccactgcactccagcctgggtgacagaatgagactcagtaataataataataataataataataataataataataattacagagcagatcaagatcttctagcccaaagttcactgttcaatattagcttac

SEQ ID NO: 6003 - DNA, 278 bp, Homo sapiens
  AC073908.8_40901
  Located on chromosome 3
  Distance between a terminus base of telomere on chromosomal short arm and 5'-terminus of this base sequence : 159354369
  Distance between 3'-terminus of neighbour sequence of sequence listing upward to telomere on chrosomal short arm and 5'-terminus of this base sequence : 43434
agaccagcttgaccaacatggagaaaccccgtctctactaaaaatacaaaattagccggtgtggtagcatatgcctgtaatcccagctacttgggagtctgaggcaggagaatcgcttgaactcgggaggcggaggttgcggtgagctgcaatcgtgccattgcactctagcccgggtgacggagccagactctgtctcaaaaaataataaaataaaataaaataaaataaaaaatagcaaaggcatggaatcaatctaggtacctatcaacgatgga

SEQ ID NO: 6004 - DNA, 240 bp, Homo sapiens
  D3S3677
  Located on chromosome 3
  Distance between a terminus base of telomere on chromosomal short arm and 5'-terminus of this base sequence : 159505417
  Distance between 3'-terminus of neighbour sequence of sequence listing upward to telomere on chrosomal short arm and 5'-terminus of this base sequence : 150770
ctggtgagatgtccatgaagaatattgtagaaaccttttctttccagtatttcttctgtcagactgtttctgttctacacacacacacacacacacacacacacacacacaccccttcagctctgcctttctctagggaacatactttattaaatgcacccaacacatgtaaggtcctatgtaaatattccgtctttcctagaatatgaacttagagtgaaaacttaaatctgtgggctg

SEQ ID NO: 6005 - DNA, 392 bp, Homo sapiens
  chr3.fa.O7frz.176196672
  Located on chromosome 3
  Distance between a terminus base of telomere on chromosomal short arm and 5'-terminus of this base sequence : 159714655
  Distance between 3'-terminus of neighbour sequence of sequence listing upward to telomere on chrosomal short arm and 5'-terminus of this base sequence : 208998
tgagaagttctatgttactccaattattgctccttaatgggtcttttttcctctttggaggattttcagatttttctgatgtctcgaaattttgctataatgggtccacagaaaggatttttttcattttttctaatgagaactttaaatattcttgcctcttttatgttctgaaatgaaaataaaattttaaatatttttcccttccattttctttggtccgtttgaaacttttgaaatttttgaaacttttcaatctgtcctcttggcattttggggttatattctaggtgaaatattagcattctgtgtgtgtgtgtgtgtgtgtgtgtgtgtctttggatatgtataaggaaaacccatatacacactatccaacctcaagaactatc

SEQ ID NO: 6006 - DNA, 338 bp, Homo sapiens
  HUMUT607B
  Located on chromosome 3
  Distance between a terminus base of telomere on chromosomal short arm and 5'-terminus of this base sequence : 159845936
  Distance between 3'-terminus of neighbour sequence of sequence listing upward to telomere on chrosomal short arm and 5'-terminus of this base sequence : 130889
accaggtaccccattcaacatgatacacacacacacacacacacacacacacacacacacggagcaaaattgctaagtgcagcaacaataacacaaagtaaagactaccaaattatattttgagaactaataactttataatcacgtgtactcaggtgtgatttatgcctttagttctacctgccacattaaattggaattataactctgcttgttaatactaatataatattttggttttgtggctgaaataatatatttgttaactgcccacactacaactaaattaggaaagtaagaagtaattttcatttggataaggaagatagctggtggtg

SEQ ID NO: 6007 - DNA, 446 bp, Homo sapiens
  AC027188.3_128282
  Located on chromosome 3
  Distance between a terminus base of telomere on chromosomal short arm and 5'-terminus of this base sequence : 159927302
  Distance between 3'-terminus of neighbour sequence of sequence listing upward to telomere on chrosomal short arm and 5'-terminus of this base sequence : 81028
gtcatttacttaggattgaaatgtctttttgctagaatgcttttggagcttttgaagtctgaagttcactaaaaaattacaattagatattttgtttctataaggtccacctgaaagaattctctttgaatctttaaacgcggtttctttaataacagaaatatcataaaaattttataaaacatttcaagaggtagcatgagaatatttgtaatgccgtgtgtgtgtgtgtgtgtgtgtgtttgtgtgtgtgtgtgttggcagaaatagtaagatctctttttataatgctattgtgccaaacttatcaaaatacatatacttaagttttgttattcatatttaacaaatgactctgattatatctgaattcaggcctgtcagtggtggtaataagactgcagccaccataattcaaaacaatatagacagcattcacagatttc

SEQ ID NO: 6008 - DNA, 125 bp, Homo sapiens
  DISO7_10001260
  Located on chromosome 3
  Distance between a terminus base of telomere on chromosomal short arm and 5'-terminus of this base sequence : 159983363
  Distance between 3'-terminus of neighbour sequence of sequence listing upward to telomere on chrosomal short arm and 5'-terminus of this base sequence : 55615
ctagggatggatgtatactgattctgtgtgtgtgtgtgtgtgtgtgtgtgtgtgtgtgaatatgtgtgtgtgtgtgcaaaatagctacattagctttattaagaatctactttgtcctccttctg

SEQ ID NO: 6009 - DNA, 253 bp, Homo sapiens
  DISO7_10001255
  Located on chromosome 3
  Distance between a terminus base of telomere on chromosomal short arm and 5'-terminus of this base sequence : 160070520
  Distance between 3'-terminus of neighbour sequence of sequence listing upward to telomere on chrosomal short arm and 5'-terminus of this base sequence : 87032
ggccaattatcatccattgatattctactaaattccaggtattctatatgtatatgtatgtgtatgtgtgtatgtatatgtatatgtatatgtatatgtatatgtatatgtatatgtatattctagtatgtattcaaccattgcagcaactttgcatggtagtataactttcctaacttcagcaatgagcagacaaacactcagagtgattaaatggtttgcctaaagcaatggtctgcaaactcacagagcc

SEQ ID NO: 6010 - DNA, 101 bp, Homo sapiens
  DISO7_10001256
  Located on chromosome 3
  Distance between a terminus base of telomere on chromosomal short arm and 5'-terminus of this base sequence : 160106217
  Distance between 3'-terminus of neighbour sequence of sequence listing upward to telomere on chrosomal short arm and 5'-terminus of this base sequence : 35444
cgttctaggcctactgttaggtagacactataagtgctacgcatgtgtttgtgtgtgtgtgtgtgtgtgtgtgtgtaaacttcaaaccattcgattccaat

SEQ ID NO: 6011 - DNA, 147 bp, Homo sapiens
  Z67213
  Located on chromosome 3
  Distance between a terminus base of telomere on chromosomal short arm and 5'-terminus of this base sequence : 160427174
  Distance between 3'-terminus of neighbour sequence of sequence listing upward to telomere on chrosomal short arm and 5'-terminus of this base sequence : 320856
gagaatgtaaaccaaatggggtgtgtgtgtgtgtgtgtgtgtgtgtgtgctgtgttcactgtgttaagatgatgacacaaattcaaaagaatcagagttgtatgaaaccaaatatagttctcaaaattaaaaagccacaaagttcag

SEQ ID NO: 6012 - DNA, 458 bp, Homo sapiens
  chr3.fa.O7frz.177688624
  Located on chromosome 3
  Distance between a terminus base of telomere on chromosomal short arm and 5'-terminus of this base sequence : 160576734
  Distance between 3'-terminus of neighbour sequence of sequence listing upward to telomere on chrosomal short arm and 5'-terminus of this base sequence : 149413
atcaatgtacagactggagtgatacatccacgagccaaagaatgccaaggattgccagaaaccaccagaggctaggagagaggtacagaagagaggaagtagctttggaattgggaaatgagtagaggctggaagaatttttaagccactttatagaaaaaaaagtttagattgccttgaagagatgcttggtggaaatatgaatgttaaaggcaattctgctgagggctcagatagaattaaggaacatggtagagagatcttctatcatcttagtatatctatctatctatctatctatctatctatctatctatctatctatatatagagagagaacagaatgttggtagaaatataagtaaaaggatgtttctggtgtgatctcagaaggaaatgagaggtatgtcatcaaaaaatggaagaaagaaaattctcattataaggtgacagaaatt

SEQ ID NO: 6013 - DNA, 443 bp, Homo sapiens
  AC023482.3_103947
  Located on chromosome 3
  Distance between a terminus base of telomere on chromosomal short arm and 5'-terminus of this base sequence : 160734489
  Distance between 3'-terminus of neighbour sequence of sequence listing upward to telomere on chrosomal short arm and 5'-terminus of this base sequence : 157297
ctgtcttctagctttcaacgatacttttgagaaattggaagacattctgattcctgatcttttgcatataatctgtgtttttctctcccgatgttgatgggatctttctcttgcctcagtattctaaaaaatgttttaatgattgccatagtatgggtctatttttaccaattttcttgcatattcatagccccttctaatcttgtaacttgagtcttttaattcagggaaattttcataaatttctccattaatgacgacttcttcttcttcttcttcttcttcttttctctctctctctctctttaattctggaactcattttttagacgctggatcttcttaatcaatactcttcttgactcctatactgttattttctctcctagtttccatttctttttctttcttttctttttttcttctttgagacaagatctgga

SEQ ID NO: 6014 - DNA, 434 bp, Homo sapiens
  AC023482.3_18063
  Located on chromosome 3
  Distance between a terminus base of telomere on chromosomal short arm and 5'-terminus of this base sequence : 160820495
  Distance between 3'-terminus of neighbour sequence of sequence listing upward to telomere on chrosomal short arm and 5'-terminus of this base sequence : 85563
attgagaaatcagctgttaatcttattgagtatcccttgcatatagtgagttagttatttctcttttgatgctttcaagattttctctttgtgtttgtttcttttctttctttctttctttctttctttctttctttctttctttctttctttctttctttctttttttttgatagagtctcactctgttgcccaggctggagtgcagtggtgtgatcttggctcactgcaatgaccacctcccaggttcaagtgatttttgtgcctcagcttcctgagtagctgggattacaggtgtgtaccaccacacctggctcatttttgtatttttagtagagatgggatttcatcgtgttgacaaggctggtctcaactcctgacatcaagtgatctacctgcctccaccttccaaagtgctaggattataggcatga

SEQ ID NO: 6015 - DNA, 376 bp, Homo sapiens
  AC068498.3_145128
  Located on chromosome 3
  Distance between a terminus base of telomere on chromosomal short arm and 5'-terminus of this base sequence : 161095789
  Distance between 3'-terminus of neighbour sequence of sequence listing upward to telomere on chrosomal short arm and 5'-terminus of this base sequence : 274860
cagtttcgaggtcataatcttattttgattattgtatatctgcttctgcactggtaatatgctccttgaaacagtttagttttcttcaaaaaaaaaaaaacctactctttcctgtttccttcactgtttctttcagcacttattatataacatcacacacacacacacacacacacacacacacacacaaacataaacacacctacttgcattattatttccgtctctcctgctggaatgtaagttccatgagggtaagaatttttatatgcttttattactgctatatctcccatacctgccagtgtttggcaagaggtaaatgctaagtagttgatgaataaatcaaaagataaattatagcagaaactccatg

SEQ ID NO: 6016 - DNA, 150 bp, Homo sapiens
  HUMUT673
  Located on chromosome 3
  Distance between a terminus base of telomere on chromosomal short arm and 5'-terminus of this base sequence : 161189579
  Distance between 3'-terminus of neighbour sequence of sequence listing upward to telomere on chrosomal short arm and 5'-terminus of this base sequence : 93414
gcttgtgtgtcagtcctagatattggtctctccatggtcaggagaaacctgtgaccattcacacacacacacacacacacacacacacacacaccactacctctctcccctaaagggaaatgcagcattttgccagtgcaacactaacta

SEQ ID NO: 6017 - DNA, 433 bp, Homo sapiens
  chr3.fa.O7frz.178183963
  Located on chromosome 3
  Distance between a terminus base of telomere on chromosomal short arm and 5'-terminus of this base sequence : 161280611
  Distance between 3'-terminus of neighbour sequence of sequence listing upward to telomere on chrosomal short arm and 5'-terminus of this base sequence : 90882
caccatcaaacaagaaagttatgatttctaagactccttcctaatgacaattctgtgccacctatcccttcggctgtcttatttttggtatgtatgaatgaggaggcacacacacacacacacacacacacacacacacacacacagagcctaaaaattttatgaactgaaacatttagaatacttcattcctccaattattactgaatgcctgtgctattgctactgtctcagtacagcagcaaagaaaatgggcacatgcctacggtagtcataaaacctgcagtctagtgaggaaattattcaaagcttctcatccctgatggtaaaaaaaaaaaaaaagtttttgacacaggtgtagatgattctgctgtcatacaacttcatgtgtctcatgaagttgtacattgtcatgaatccactgatagtattt

SEQ ID NO: 6018 - DNA, 263 bp, Homo sapiens
  D3S1570
  Located on chromosome 3
  Distance between a terminus base of telomere on chromosomal short arm and 5'-terminus of this base sequence : 161380020
  Distance between 3'-terminus of neighbour sequence of sequence listing upward to telomere on chrosomal short arm and 5'-terminus of this base sequence : 98976
ggcaggggatagttagtttgtgaattcttatcattctgccattctgtatattttaagtggaacattcaagccatttacattcaatgttagtattgagatgtgaggtactattctattcatcatggtatttgttgcctgaataccttggggggttctgtgtgtgtgtgtgtgtgtgtgtgtgtgtgtgtgtgtgtgtaaatgccctatatgtcctgtgatattcatgctttaagaaggttctgttttgctgtatctcaaggatg

SEQ ID NO: 6019 - DNA, 149 bp, Homo sapiens
  D3S3587
  Located on chromosome 3
  Distance between a terminus base of telomere on chromosomal short arm and 5'-terminus of this base sequence : 161623982
  Distance between 3'-terminus of neighbour sequence of sequence listing upward to telomere on chrosomal short arm and 5'-terminus of this base sequence : 243699
catgttttattccagaaggattgaaaaaagtatgtccaggttacagaattacaaataaagtaacacacacacacacacacacacacacacacacacacacccctacaaaacaaacaacccccactccaaacaaaaatggagacttggtt

SEQ ID NO: 6020 - DNA, 466 bp, Homo sapiens
  AC024160.3_21835
  Located on chromosome 3
  Distance between a terminus base of telomere on chromosomal short arm and 5'-terminus of this base sequence : 161636100
  Distance between 3'-terminus of neighbour sequence of sequence listing upward to telomere on chrosomal short arm and 5'-terminus of this base sequence : 11969
agaccttaaggaatcatttcaccctcaagctagctagctcaagctttaaaaaaagactgttacattacttaatttttttttcaaatttctttttagaacacacatcataaattataaaaataggctttcgtgtggcaatactaacattttaatggaagaatagtgagtctatgccttcatttctttattatttgacttatatttagacgattcccattgtctgaatgggataagctaaggtggttcatttttatatcatatacagaattgccaaattacaatactacattctgcgtggtgtgtgtgtgtgtgtgtgtgtgtgtgtgtgtgtgtgttagaagtcccagaaaactgtctccctcaccttacagacaagagaaatgaaatacggtgaggtcatgggcatacccaaagtcatggagctaattagcctcggagccagaaatagaacctacgtctcctgact

SEQ ID NO: 6021 - DNA, 480 bp, Homo sapiens
  chr3.fa.O7frz.179085082
  Located on chromosome 3
  Distance between a terminus base of telomere on chromosomal short arm and 5'-terminus of this base sequence : 161912217
  Distance between 3'-terminus of neighbour sequence of sequence listing upward to telomere on chrosomal short arm and 5'-terminus of this base sequence : 275651
tctatgcattctaacagtccacgcacataccagtatacaaacgcacatagaaacacacacacacacacacacacatacacacacacacacacacgtgtatagctttttcttataaaatggtgacatactatacacattgaccttcgtcttgcttttttatttaataatatatcttaaaatctagtcatatcagtatgtattgcttcatttgttttagaagactattctttgtgtagctatattataattgacgtagagacttcatatcaatgaatatttaaatagttcctagttcttttctgcacacacacacaatagttgtactgaatagcacaacacatgcatttttgtatacagctatgagtatatttataagagatgtaaaattgcagggtcaaaatgaatgtccattttaaattttcatgcacattgacaaattattctttaataagatagcttccaaatacactcctagtgata

SEQ ID NO: 6022 - DNA, 259 bp, Homo sapiens
  D3S1275
  Located on chromosome 3
  Distance between a terminus base of telomere on chromosomal short arm and 5'-terminus of this base sequence : 162007387
  Distance between 3'-terminus of neighbour sequence of sequence listing upward to telomere on chrosomal short arm and 5'-terminus of this base sequence : 94690
gatttcttggcctccataatcacatgagccaattccttataattcctctatacacacacacacacacacacacacacacacacacacacacacacaccctattggttctgtttctctggagaaccctgaggagagattttgttgatttttttttcaaaacatcatgcaagtgtatgtggccaaccagagttaagtatttgtaagtgatataggtaggaagatatggaaaacctaagtaaggagtaatgtggtcacttgc

SEQ ID NO: 6023 - DNA, 415 bp, Homo sapiens
  AC068316.2_95845
  Located on chromosome 3
  Distance between a terminus base of telomere on chromosomal short arm and 5'-terminus of this base sequence : 162227088
  Distance between 3'-terminus of neighbour sequence of sequence listing upward to telomere on chrosomal short arm and 5'-terminus of this base sequence : 219442
acaagactccagatctgtttaacttttattttttgaacaagtattttagctttattgtaggtaatgggggtttctatcaggtctacagagagaaatagggaagccctaaggcacttggagcatctctctaattatcccttttctaatttacagctgctggggagttatgatttgtgctttccacctcttctcagtttgcttcccttgttctgtatacatctattaactgttttgttttgttttgttttgttttgtttttttctggggtttcattttcaaactccctgagacagagaatcaggtatggagagccaaggcctgctcaccaaggtttgcctattatcctctctgtccaaaaatacactagggagagctgcagtgtgacaggactgtgcctgataattggtagataaga

SEQ ID NO: 6024 - DNA, 291 bp, Homo sapiens
  DISO7_00001184
  Located on chromosome 3
  Distance between a terminus base of telomere on chromosomal short arm and 5'-terminus of this base sequence : 162335677
  Distance between 3'-terminus of neighbour sequence of sequence listing upward to telomere on chrosomal short arm and 5'-terminus of this base sequence : 108174
tcagtaagccctggatccacccatccatccaggactctgtctcacaaagagactttgaggcacattgaattgaaggcacagtcacttgtagaaggtgggggttagagacggcagtcatgcttccattgttttagcttcttgaaagtcatctcctaaaagactgtgtgttgatgataatgcggtggtggtggtggtggtggtggtggtggtggtggtggtggtggttgtggtggtggtggtggtggtgatggtggtgtcaggcaaaactaggttggaatcctagtatcctgt

SEQ ID NO: 6025 - DNA, 362 bp, Homo sapiens
  AC024165.3_74430
  Located on chromosome 3
  Distance between a terminus base of telomere on chromosomal short arm and 5'-terminus of this base sequence : 162400801
  Distance between 3'-terminus of neighbour sequence of sequence listing upward to telomere on chrosomal short arm and 5'-terminus of this base sequence : 64833
aggtggaataaggcttcagtattgccctatacagtagtcttcacttatttgtggctgataccttccaagaaccccagtggatgcctaaaacctcagatagtactgaactctacatatgctatgtttttttttcctatgcacctgtggtaaagtttaatttctgcattaggcacagtaagagattaacaataactaataatgaaatagaaaaattataatgacatactgtaataaaagttatgtgaatgtgatttctctctgaaaatatctttacagtatagtatagtgtactatactatactatactatactatactatactatactatactatactatactacaggtaacaaaccatgaaa

SEQ ID NO: 6026 - DNA, 304 bp, Homo sapiens
  AC023008.2_106896
  Located on chromosome 3
  Distance between a terminus base of telomere on chromosomal short arm and 5'-terminus of this base sequence : 162672579
  Distance between 3'-terminus of neighbour sequence of sequence listing upward to telomere on chrosomal short arm and 5'-terminus of this base sequence : 271416
ttaagaatggctgttccatataagcgaatggagtggcatatagcatcacctttcaaagtggggggaaatagctagctattgtattgtattgtattgtattgtattgtattgtattgtattgtattgtattgtattgtattggcaggagcagcagggacctttctgaaggtttacttgtaacaattgaagagaaaggattaccactatttgctaagagtaaaagaaggaatgcaatgcttaaagagatgtagacattctttctattccatccaatttatccgtcctaatgaaggtgaagataaca

SEQ ID NO: 6027 - DNA, 232 bp, Homo sapiens
  D3S1607
  Located on chromosome 3
  Distance between a terminus base of telomere on chromosomal short arm and 5'-terminus of this base sequence : 162891730
  Distance between 3'-terminus of neighbour sequence of sequence listing upward to telomere on chrosomal short arm and 5'-terminus of this base sequence : 218847
aataaacagcagcctgtctataatcatattctttcaaatacttgcttgtgaatttaagcagtcatatagataaactattagtattgaaactttggcatgtagatataaagtcagtgaataacttcacagtaatgatgtaattctccttaataacacacacacacacacacacacacacacacacacacacacaaattctgctataaaggtctcttcattttcgttacgtgca

SEQ ID NO: 6028 - DNA, 155 bp, Homo sapiens
  D3S1605
  Located on chromosome 3
  Distance between a terminus base of telomere on chromosomal short arm and 5'-terminus of this base sequence : 163221915
  Distance between 3'-terminus of neighbour sequence of sequence listing upward to telomere on chrosomal short arm and 5'-terminus of this base sequence : 329953
ctcatttgcttaaggtttggtcatgaaaactggagactccacacacatgcacacacaaacacacacacacacacacacacacacacacacacacacacacacacacacgccccatgcataaatgagataaacaaagaagccagggtggaagtcta

SEQ ID NO: 6029 - DNA, 355 bp, Homo sapiens
  AC026306.10_1755
  Located on chromosome 3
  Distance between a terminus base of telomere on chromosomal short arm and 5'-terminus of this base sequence : 163329756
  Distance between 3'-terminus of neighbour sequence of sequence listing upward to telomere on chrosomal short arm and 5'-terminus of this base sequence : 107686
cacagtgcctagaacatagaaggtgttcaataaatgctcattgggaagaaagaaagaagggaaagagggagaggaagaaaggagaataagagagaaagagagagaatggaaggaggaaataaaggaagaaaactgtagacaaaacaagcagagctctcacttggtaagattattaaggcttacctgcttgttgcaaatcgcagaggaatgtaatttagtgatttctcaacacacacacacacacacacacacacaattacattttggttttatctacgaccaagaaaattgcaaacaacctaattactcaaaaattggtggatgaataagtaaattaggtgcatctactcaatga

SEQ ID NO: 6030 - DNA, 389 bp, Homo sapiens
  AC024109.13_33051
  Located on chromosome 3
  Distance between a terminus base of telomere on chromosomal short arm and 5'-terminus of this base sequence : 163376608
  Distance between 3'-terminus of neighbour sequence of sequence listing upward to telomere on chrosomal short arm and 5'-terminus of this base sequence : 46497
cctttggaaatcatttctactctctggctgcagcttctgtgctcatgattctctgttgatcttccaccagctttatactcctccctgctctgccctgctctgaacccaggaatcaatctctgtggtgccttccttattctttggcttctacttgggtttggtggaagggagtcctccaacaggagatcagagggtttgaggaaagaggttggggagataccacccccttacctttgcatacacacacacacacacacacacacacactctctctctctctctcacacacacatgcacgtgcacacacacacacacaacacactcttccgtggggctgtggtgtggcagtggctgtattcctctatggcctccatgtctgttaggtgact

SEQ ID NO: 6031 - DNA, 463 bp, Homo sapiens
  AC024109.13_55582
  Located on chromosome 3
  Distance between a terminus base of telomere on chromosomal short arm and 5'-terminus of this base sequence : 163432172
  Distance between 3'-terminus of neighbour sequence of sequence listing upward to telomere on chrosomal short arm and 5'-terminus of this base sequence : 55175
cataacagatgtttctagtccattcccacactgctataaagaatacccctttaactagtttacattcacagtgtggagattccttaaggaaataaaagtagaactatcacttgatcaagcaaatctcactactgggtatctacccagaggaaaagaagtcattattcaaaagagatacctgcacacacatgtttatagcagcacaatttacaatagcaaaattgtggaaccgacccaaattcccatcaatcaatgagtgaataaagaaaccctggtgtgtgtgtgtatttatatattataaaaatatatatatataaatatatatacatttgttatatttacatatatatatatatatatatatatgatggaatactactcagccataaaaaggaatgaactaacagcattggcaatgacctggatgatattaaacactgttattccaagtgaagtaattcag

SEQ ID NO: 6032 - DNA, 317 bp, Homo sapiens
  AC063937.8_60241
  Located on chromosome 3
  Distance between a terminus base of telomere on chromosomal short arm and 5'-terminus of this base sequence : 163516544
  Distance between 3'-terminus of neighbour sequence of sequence listing upward to telomere on chrosomal short arm and 5'-terminus of this base sequence : 83909
ttggtaatacatgtctggctacctcacaactgttttttgaatgaggaaataaaagtctccacttaattttttcaatgttgtatgtggtattatcagccaaaaaaatttaagccttgttatcactttatcttttttcagtcattttaactcactacatgtcattggtttgtgtgtgtgtgtgtgtgtgtgtgtgtgtttatttgactaacctagttagtccagatagctgtttctttgccttttttggattctgtccactctataaaaatatctaaagctccataaagacaaatctatacttgatcttaagccatttg

SEQ ID NO: 6033 - DNA, 361 bp, Homo sapiens
  AC055761.5_132910
  Located on chromosome 3
  Distance between a terminus base of telomere on chromosomal short arm and 5'-terminus of this base sequence : 163565317
  Distance between 3'-terminus of neighbour sequence of sequence listing upward to telomere on chrosomal short arm and 5'-terminus of this base sequence : 48456
aattgtctgcaatagatcacaccctgttatgaagaattccactgtgctccctgatatttttcaatgatttaattttaattaatgttttgctataaatcatacgcctagtcggaatacactgaagatgataccaaattgatgcctcatctatgtgtgtgcctgtgtgtgtgtgtgtgtgtgtgtgtgtgtgtgtttccagaactgaagtagcaagtgaagagttattttattccattgggtctcaataaatatttgatgatatgatttggcctagtttacctcagtccccttttataaagtcatgtaacatataggaagaaatcgtagcagctgaagtgaactttcctggcacagtaattag

SEQ ID NO: 6034 - DNA, 391 bp, Homo sapiens
  AC055742.16_267912
  Located on chromosome 3
  Distance between a terminus base of telomere on chromosomal short arm and 5'-terminus of this base sequence : 163572940
  Distance between 3'-terminus of neighbour sequence of sequence listing upward to telomere on chrosomal short arm and 5'-terminus of this base sequence : 7262
gtgaatcaggagcactgactttttaaaaaacacgaaataaaagagaatagaaaaacatcacatgtgctagcgtataagtaattatatgtatatgtgtgtgtgtgtgtgtgtgtgtgtgtgtgtgttcacttggccttaatgtaaaatagtcaaaatagttttaaatccactgctttgaatttcatttcttatgttcaatttcacagtaaaccctctttcttttcatttgaggaggaagcagggaggtctggagttgggacagaccagggtaatggaagacatcaagaatctgaaagatgaatgagatcaagacttagaaacaggcagtcaagggaggaaaaacaagtagcaaagctggatctggcaagtacagtaggtcaaatacgacact

SEQ ID NO: 6035 - DNA, 356 bp, Homo sapiens
  chr3.fa.O7frz.180930714
  Located on chromosome 3
  Distance between a terminus base of telomere on chromosomal short arm and 5'-terminus of this base sequence : 163692521
  Distance between 3'-terminus of neighbour sequence of sequence listing upward to telomere on chrosomal short arm and 5'-terminus of this base sequence : 119190
cgatcactagaaatgaattcaccatgggaagaagaaaaggttagaatttctcaccttgtaagtccattgaccagtgaggagcccggctttctctctagatagatagatagatagatagatagatagatagatagatagatagatggatggatggatggatggatggatggatggatggatagatagatagatagatagatagatagatagatagatagatagatagacacgtgtgtgtatatatatagatatgtgtgtacatatgtatacatgtgtatacattacacacatgtatacatatgtgcgtatatatgtgtatataatgtatatatgtgcaatagtgcatgtcgtgcata

SEQ ID NO: 6036 - DNA, 292 bp, Homo sapiens
  AC069232.9_41057
  Located on chromosome 3
  Distance between a terminus base of telomere on chromosomal short arm and 5'-terminus of this base sequence : 163872858
  Distance between 3'-terminus of neighbour sequence of sequence listing upward to telomere on chrosomal short arm and 5'-terminus of this base sequence : 179981
tgagttcaggtcgacatactagttcatgactataatcccagaacttggggagtctgacacaggaggatcacttgaagctaggagtttaagaccagtctgggcaaaatagtgagaccccgtctatacacacacacacacacacacacacacacacacacacacacacacacacagaaaagaaattagctgagcatggtggcacagctgtagtcccacatctgtagtcccagctacttgggaagctgatgcgggaggatcacttgagtcaaggaatttgaggttgcagtaagat

SEQ ID NO: 6037 - DNA, 191 bp, Homo sapiens
  chr3.fa.O7frz.181025713
  Located on chromosome 3
  Distance between a terminus base of telomere on chromosomal short arm and 5'-terminus of this base sequence : 163886493
  Distance between 3'-terminus of neighbour sequence of sequence listing upward to telomere on chrosomal short arm and 5'-terminus of this base sequence : 13343
ttagcttgtgctaagtaacctaagtgcttcttcacatgggaaaacaacctatgtgcaaaagtaacagtatttagatagatagatagatagatagatagacagagagacagacagacagacaggacacaaagtatatatttataaagcacaaaaagcaaggacagtaagtacagtaatggtaaagcaaggta

SEQ ID NO: 6038 - DNA, 280 bp, Homo sapiens
  DISO7_10001262
  Located on chromosome 3
  Distance between a terminus base of telomere on chromosomal short arm and 5'-terminus of this base sequence : 164002877
  Distance between 3'-terminus of neighbour sequence of sequence listing upward to telomere on chrosomal short arm and 5'-terminus of this base sequence : 116193
gtaacctcttatttctctatgcatgtttttgttattctctctcttccttcttcttctttttcttcttcctcttcctcttcctcctcctcctcctcttcttcctcttcttcctcttcttcttctttgccagaatctcttctctctcttatcttttttctcttcttaactaactagaatatggatttgatgtatattctaaaacagttatggtatattttgcgtggttttaattttattggaatattttatttaaaacattgtaatcacatatgcaatctac

SEQ ID NO: 6039 - DNA, 167 bp, Homo sapiens
  DISO7_10001264
  Located on chromosome 3
  Distance between a terminus base of telomere on chromosomal short arm and 5'-terminus of this base sequence : 164202970
  Distance between 3'-terminus of neighbour sequence of sequence listing upward to telomere on chrosomal short arm and 5'-terminus of this base sequence : 199813
tcaagataatgccagaagagtaagatattatataaaatatatatattttatgtatatatgtatgtgtgtgtgtatatatatatatatatatatcctacaaataaagctacactgtattttactgaatgagtaagcattaaaatgcagaataaggacaatatcaagaa

SEQ ID NO: 6040 - DNA, 295 bp, Homo sapiens
  DISO7_10001265
  Located on chromosome 3
  Distance between a terminus base of telomere on chromosomal short arm and 5'-terminus of this base sequence : 164402557
  Distance between 3'-terminus of neighbour sequence of sequence listing upward to telomere on chrosomal short arm and 5'-terminus of this base sequence : 199420
tcaagtcttgactgtttaccatgtatttttataatttaaaaattggttttaggctggacatggtggctcatgcctgtaatcccagcactttgggaggccaaagtgggaggatcacttgagcccaggagttcgagaccagcatgggcaatattattattttttaatagagaccacctcgtctttatttaaaaaataataataagtgtgtgtgtgtgtgtgtgtgtatatatatatatataaattggttttacttatacacttaaaatgtttttttgagaacaatgccttattctgc

SEQ ID NO: 6041 - DNA, 203 bp, Homo sapiens
  D3S3692
  Located on chromosome 3
  Distance between a terminus base of telomere on chromosomal short arm and 5'-terminus of this base sequence : 164580246
  Distance between 3'-terminus of neighbour sequence of sequence listing upward to telomere on chrosomal short arm and 5'-terminus of this base sequence : 177394
ccatgctcgtggtagaagtctccaatatatatgcatgcatgcatgtgcgcacacacacacacacacacacacacacacacacagtgaacaggcctttagttatacacattcttgtgtagtccattcccaagatgattttggactagtctttataaccaatagaatgagatagaaataattcgtgatgccttctgaggctaggt

SEQ ID NO: 6042 - DNA, 381 bp, Homo sapiens
  AC026611.2_152534
  Located on chromosome 3
  Distance between a terminus base of telomere on chromosomal short arm and 5'-terminus of this base sequence : 164672076
  Distance between 3'-terminus of neighbour sequence of sequence listing upward to telomere on chrosomal short arm and 5'-terminus of this base sequence : 91627
tatctggtactaatgttagctcctctggaatctgggatctccctcccttcggcaccagcttagaccaataagacaccagggcttcaaaactctggtgtcaaagaataaggaagggacaatgagtatgaagaaattcagatgagtgtgagtagtgctgcaaccttcaccagacacacacactggtaggtcatttcacgtgtgtgtgtgtgtgtgtgtgtgtgtgtgtgtgtgtcctctggaactcctcagaacctccagcctctagttagtaagaatctcaagagcaaaggatccatgttttcatggatctttggtcattctctagtattactaattaataaacactccttatacagttggttcttgaagatgcttagtgaa

SEQ ID NO: 6043 - DNA, 469 bp, Homo sapiens
  AC026611.2_191625
  Located on chromosome 3
  Distance between a terminus base of telomere on chromosomal short arm and 5'-terminus of this base sequence : 164744134
  Distance between 3'-terminus of neighbour sequence of sequence listing upward to telomere on chrosomal short arm and 5'-terminus of this base sequence : 71677
tttaaccatctgtgagcagtactagaagaaaaggtggaaacaattcaagcaaattaatagaggatgaaaatgttctttattagaaatgaggccatttcttcgtatctgattctttaaggataaaaaatttcatttaatgatgaatcattgctttatttcctccttcaggtactgatgttgtcttttctacccaaataagataccaagatcttacaactctctatgttacacaatgatttgaaatgcagcaggaactctgtgtgtgtgtgtgtgtgtgtgtgtgtgtctgtgtgtgtatgtgtgtgtacgtctagatagaatatggcagtaagactgaaaaacagaccagaagtcagaagtcaggtgatctgggaatttgttgtggctcaatccttcagccagcaatgttgccaggaacaggtcacttaacattgctgattctcatctatctgttcaccttagaggattt

SEQ ID NO: 6044 - DNA, 317 bp, Homo sapiens
  chr3.fa.O7frz.182185501
  Located on chromosome 3
  Distance between a terminus base of telomere on chromosomal short arm and 5'-terminus of this base sequence : 165040648
  Distance between 3'-terminus of neighbour sequence of sequence listing upward to telomere on chrosomal short arm and 5'-terminus of this base sequence : 296045
gactaacatcttcctatttccttcactccctaggccctggcaactatcgttctactgtctacttctatgggtttgatttttttagatgttatgtataaatgagatcatgccttgtctttctgtgtctggcttatttcacttagcataatttttctgcaggttgatccattgttgttgtaagtggtatgacttccttttttaaggctgagtaatattccattgtgtgtgtgtgtgtgtgtgtgtgtgtgtgtgtgtgtgtgtacataatcaccttttctttatccatttatccattgatggactcttaggtacttcca

SEQ ID NO: 6045 - DNA, 345 bp, Homo sapiens
  AC063955.8_166647
  Located on chromosome 3
  Distance between a terminus base of telomere on chromosomal short arm and 5'-terminus of this base sequence : 165295269
  Distance between 3'-terminus of neighbour sequence of sequence listing upward to telomere on chrosomal short arm and 5'-terminus of this base sequence : 254304
gccaggaactaggatacttaaaaaatgacattaagtgtgtatgtgtatatatatatacacacatgcatatgtacacacacatatatatacacatgtttgtgtataaatacagacatatatacatgtgtgtatatatatatatatatatagatataaaagtcattctatttaatgtcattgaatagaatggcacttttattttttgttttgttttgtttttttattttattattattatactttaagttttagggtacatgtgcacaatgtgcaagttagttacatatgtatacatgtgccatgctggtgtgctgcacccattaactcgtcatttagcattaggta

SEQ ID NO: 6046 - DNA, 167 bp, Homo sapiens
  D3S1553
  Located on chromosome 3
  Distance between a terminus base of telomere on chromosomal short arm and 5'-terminus of this base sequence : 165334989
  Distance between 3'-terminus of neighbour sequence of sequence listing upward to telomere on chrosomal short arm and 5'-terminus of this base sequence : 39375
attgcagtggtctggaaccaaactcaatatctctgaggtatgcctgtaaatataagacacgcaactgaaatatatatatacacacacacacacacacacacacacacacacattcaaaaatatccgttattcttaactcatggaaattaattcaggacaccccacta

SEQ ID NO: 6047 - DNA, 223 bp, Homo sapiens
  D3S3575
  Located on chromosome 3
  Distance between a terminus base of telomere on chromosomal short arm and 5'-terminus of this base sequence : 165389436
  Distance between 3'-terminus of neighbour sequence of sequence listing upward to telomere on chrosomal short arm and 5'-terminus of this base sequence : 54280
actatcaccacactgaaaatgtagacataaaaaacaatctgtcattttggaactcaagacttactgtggggaacagacaattccacagataatttcagcaaaacctgagaaatttcataacaaaagaaaccccggccccagccacacacacacacacacacacacacacacacacacacacacacacacacacacctgactcttctctctgctaagggtggga

SEQ ID NO: 6048 - DNA, 261 bp, Homo sapiens
  DISO7_00004772
  Located on chromosome 3
  Distance between a terminus base of telomere on chromosomal short arm and 5'-terminus of this base sequence : 165464052
  Distance between 3'-terminus of neighbour sequence of sequence listing upward to telomere on chrosomal short arm and 5'-terminus of this base sequence : 74393
accggaaatcagtaagcttccccctgaaccgtttgctctgggaacgacctagggattaggaagatattgctgctgctgctgctgctgctgctgctggttccagagccatgcttcacccatccagggtcacactaacaacaaaaataacaacagcttaaagatgctgctgacaccacacaccttttgacccttacaaagctggtggcaggaacgctgctacaaaaaaccccaaggcaggcttgatctgatcatgcctaccac

SEQ ID NO: 6049 - DNA, 435 bp, Homo sapiens
  AC021654.17_13187
  Located on chromosome 3
  Distance between a terminus base of telomere on chromosomal short arm and 5'-terminus of this base sequence : 165639078
  Distance between 3'-terminus of neighbour sequence of sequence listing upward to telomere on chrosomal short arm and 5'-terminus of this base sequence : 174765
tgctacataatcctagattcaaattagggtttgtctttaaaatgtgtctgtttttaatttgctaacagcttttttcccaccatcttccaatccatagaacttgagtattattattaaaagggggttgattttatttttttagaccgacagacattaaaatttctaaacctgcatggaatcaaagggtaacctgaacatattagatttctccaggaaaaaaatatatatgtgtgtctgtgtctgtgtgtgtgtgtgtgtgtgtgtgtgtgtgtgtgtgtgtgtgtgtgtttatgtatgtatgtatatccaatggataaaagtaaaaaggtggcaaatcccagctcagtagaagaacaaactgcctaatagacaatgtgttgtctcagagagttgattctacatcagggattattgtgacaggacaagcagtattag

SEQ ID NO: 6050 - DNA, 242 bp, Homo sapiens
  D3S3580
  Located on chromosome 3
  Distance between a terminus base of telomere on chromosomal short arm and 5'-terminus of this base sequence : 165655479
  Distance between 3'-terminus of neighbour sequence of sequence listing upward to telomere on chrosomal short arm and 5'-terminus of this base sequence : 15966
gccattgcagagaagtttgattccttgcaatgaaatcggaggaccacaccaacacattttcatcttcaactagagcctctctctctctctctctctctcacacacacacacacacacacacacacacacacacactctttgagcctccaaaaactcccctctgcctccggagtacagatttttctctatttcctctttgagggtagaggcaaacttcagccacccttgtaactgtagcccca

SEQ ID NO: 6051 - DNA, 378 bp, Homo sapiens
  D3S2442
  Located on chromosome 3
  Distance between a terminus base of telomere on chromosomal short arm and 5'-terminus of this base sequence : 165821319
  Distance between 3'-terminus of neighbour sequence of sequence listing upward to telomere on chrosomal short arm and 5'-terminus of this base sequence : 165598
gcacttgtttctgtatgtttctggttctcaactgagctggcaggttcctgctgttgtcattcaggctttcaatagctcagggcctcacactctttacctctgccctctgctggggtcaggaagacaaaataacccagctatattaggtttctccagagaaagagaacccactggatggatagatagatagatagataggcaggcaggcagatagatagataggtgggtagatagatagatagatagatagatagatagatagatagataggcaggctggcaggcaggcagatagatagatagatagatagatagatagatagatagatagatagatagatacacagtcatacatcgcttaacaaacatacattttgag

SEQ ID NO: 6052 - DNA, 467 bp, Homo sapiens
  chr3.fa.O7frz.182932508
  Located on chromosome 3
  Distance between a terminus base of telomere on chromosomal short arm and 5'-terminus of this base sequence : 165886435
  Distance between 3'-terminus of neighbour sequence of sequence listing upward to telomere on chrosomal short arm and 5'-terminus of this base sequence : 64738
ttaagacagctaagatgcagacttctgctgcctttgaaccaaaccaaaccaaaccaaaccaaaccaaacccactcccagctgagcacacccactattagaagcatccccacactcactgtgagccccactgacctccagggatttgggctgtgggtgtctgtggaacccgagtggaacctctgctccagcagctggggctttgtttcacttaatcaaatctttaaatgttatagagatgagacaattattatatttgctttctcacccttttctaccctcagttccactcaccccaccctgaaaactagtttttattcaagataaaacttacattctttgttttctatccataccatttcttcagaatccattttggtcaaaaataatttaaactccactggttgcaccagatacatttcaatataacgtcccaattttaaaactttactatcaacaaatgcaattt

SEQ ID NO: 6053 - DNA, 412 bp, Homo sapiens
  AC079594.8_1707
  Located on chromosome 3
  Distance between a terminus base of telomere on chromosomal short arm and 5'-terminus of this base sequence : 166051738
  Distance between 3'-terminus of neighbour sequence of sequence listing upward to telomere on chrosomal short arm and 5'-terminus of this base sequence : 164836
catactaagttcaagtcaccgttttcatctttttcatttttttacattttagttgacatataataattgtacatatttatgagatacatagtgatgttatgatacctataatgtgtggtgaccagaccagggtaattagcagatcatcatctcaaacatttatcatttgtttgtgttggggacattcagtatcctccttctagctatttgaaactatttatttctgtgtgtgtgtgtgtgtgtgtgtgtgtgtgtgtgtgtgtgtgtcttgctatgttgctcaggctagtctccaactcctttactcaagtgatcctccaaccttggcctcccgaagtgctgggattacagacgtcaacgactgcgccggcctttatttctttaggagttttggtctattggtgcctgtcag

SEQ ID NO: 6054 - DNA, 290 bp, Homo sapiens
  AC024221.10_42119
  Located on chromosome 3
  Distance between a terminus base of telomere on chromosomal short arm and 5'-terminus of this base sequence : 166316416
  Distance between 3'-terminus of neighbour sequence of sequence listing upward to telomere on chrosomal short arm and 5'-terminus of this base sequence : 264266
tgcttgtaatcctagcactttgggagacagagtgagacctcatctctaaaatacatacatatatatatatatatatatatatatatatatatatatatatatatatagtaaacattacccttcttatcatacagttctatgaattttgaaaaatgaatacgtaactaccaccacaatcaaaatataggatttgttcatcaccctcaaaattccccttgggcctctttataggcaatctctccccttcctagtacatggtaaccactgacggaatgttctatccttatagt

SEQ ID NO: 6055 - DNA, 455 bp, Homo sapiens
  chr3.fa.O7frz.183564205
  Located on chromosome 3
  Distance between a terminus base of telomere on chromosomal short arm and 5'-terminus of this base sequence : 166319230
  Distance between 3'-terminus of neighbour sequence of sequence listing upward to telomere on chrosomal short arm and 5'-terminus of this base sequence : 2524
atgaacagtaagaatgatctgaacactcagatttgatttcagaaagatcacgctgtcttcattgcagacatcagaggaagacggtcagagtggctgtgagagaccatctttttgtgtgtgtgtgtgtgtgtgtgtgtgtgtcggagtttcgctcttgttgcccaggttggagtgcaacggcgtgatctcagctcactgcaacctccgcctcccaggttcaagccaattcttctgcctcagcctcccgagtagctgggattacaggcatgcgccaccatgcccagctaatttagtaattttaatagagacagggtttctccatgttggtcaggccggtctcgaactcctgacctcatgtgatccgcctgcctcggcctcccacagtgctgggattacaggcgtgagccactgcgcccggcctgtgagagaccttcttaacagacttacaatggttc

SEQ ID NO: 6056 - DNA, 105 bp, Homo sapiens
  DISD22_0003074
  Located on chromosome 3
  Distance between a terminus base of telomere on chromosomal short arm and 5'-terminus of this base sequence : 166427749
  Distance between 3'-terminus of neighbour sequence of sequence listing upward to telomere on chrosomal short arm and 5'-terminus of this base sequence : 108064
agaggccaaacaacatggaaaagcaaaaaaaaaaaaaaaaaaaatatatatatatatatatatatatatatatatatatatatatacacaaccttggacaaatca

SEQ ID NO: 6057 - DNA, 109 bp, Homo sapiens
  D3S3620
  Located on chromosome 3
  Distance between a terminus base of telomere on chromosomal short arm and 5'-terminus of this base sequence : 166565208
  Distance between 3'-terminus of neighbour sequence of sequence listing upward to telomere on chrosomal short arm and 5'-terminus of this base sequence : 137354
tggaggagcattaggacttcataagaatgagaaggggacacacacacacacacacacacacacacacacacacatatctttgtgcagttacttcatttgctaagaggcc

SEQ ID NO: 6058 - DNA, 249 bp, Homo sapiens
  Z67252
  Located on chromosome 3
  Distance between a terminus base of telomere on chromosomal short arm and 5'-terminus of this base sequence : 166621562
  Distance between 3'-terminus of neighbour sequence of sequence listing upward to telomere on chrosomal short arm and 5'-terminus of this base sequence : 56245
agtgagccacgactgcatcactgcacttcagcctgggcgatagagtgaaactccatcacacacacacacacacacacacacacacacacacacacaaatgctgacagagtgatgggattgtggggctgtttctttttcatcatttcattaatttttattataatggtgctgtgtgatgataaaatcaagggagaaaatttaacaagaaagtaacaagaaaacaaaaaaaggaaaaccttgtgctcatgc

SEQ ID NO: 6059 - DNA, 430 bp, Homo sapiens
  AC021885.4_36564
  Located on chromosome 3
  Distance between a terminus base of telomere on chromosomal short arm and 5'-terminus of this base sequence : 166793491
  Distance between 3'-terminus of neighbour sequence of sequence listing upward to telomere on chrosomal short arm and 5'-terminus of this base sequence : 171680
agcaggttactttgtctttaacaaagtaatttcccagcttctgtaatttcttctactttccaacttggtgttattttccaaactatgggcaccagccaatcagcactgagaaggaagtgtggaaggagaatagaatagaatagaatagaatagaatagaatagaatagaatagaatagaatagaatagaatagaatagaatagaatagaaaagaaacagaacagaacagaacagcatagcataaaatagaatggaggaataagaatagaatagaatggaatagaatatcactttacatacagtaagggtttttttcatgaaacttgttaattatttttctgtgcatcgggctgcaatgttaaaatgcatgtcttactttaaggtcatagttagaaattttaaattgtggtaactgacttgcctgtaaagg

SEQ ID NO: 6060 - DNA, 215 bp, Homo sapiens
  AC023238.14_51401
  Located on chromosome 3
  Distance between a terminus base of telomere on chromosomal short arm and 5'-terminus of this base sequence : 167098666
  Distance between 3'-terminus of neighbour sequence of sequence listing upward to telomere on chrosomal short arm and 5'-terminus of this base sequence : 304745
ttctatgtaaatgaagcaacactaagcattcagaaatgtatttattgacatcaaactattgtatatatatgtgtgtgtgtatatatatatatatatatatatatatatacttttaactcaaagtaatatcttttcatgatcattctttttaatgtgcaccaaattagcagtaaaaatagcagcagatggatcagagtggttgtcaataaaccttt

SEQ ID NO: 6061 - DNA, 189 bp, Homo sapiens
  D3S3656
  Located on chromosome 3
  Distance between a terminus base of telomere on chromosomal short arm and 5'-terminus of this base sequence : 167307077
  Distance between 3'-terminus of neighbour sequence of sequence listing upward to telomere on chrosomal short arm and 5'-terminus of this base sequence : 208196
ttccaggttctttatagatttcccgtgtgtgtgtgtgtgtgtgtgtgtgtgtgtgtgtgtgtctatggggtgggaggggtgaataagactacattatgtgtactatactgtggcattcagccacagaaatttcttagtgggtggttctgttaaagtaataaatacacaggactataaaatgcttagcag

SEQ ID NO: 6062 - DNA, 436 bp, Homo sapiens
  chr3.fa.O7frz.195658993
  Located on chromosome 3
  Distance between a terminus base of telomere on chromosomal short arm and 5'-terminus of this base sequence : 167402860
  Distance between 3'-terminus of neighbour sequence of sequence listing upward to telomere on chrosomal short arm and 5'-terminus of this base sequence : 95594
tgccatttaatgtacttctgaccttgcagatctgtgtgtgcttaacttctccacgtggatctcgcatcctcccagggtgctacgccgaataagagattatacatcaggggaatcactttgcagtcaccgagacagtgttttgaaaacgaaggaagaatgcaaatgtgtagaaactactgaagagattttaccagcaggtagtttataaactcaaaaccaggaatattgcctctaaggattgcagcttgaccaattttttaaagtgtatctttgttatttttttgtgatactctctaccaacatttagctttctttctttctttctttctttctttctttttttttaaatagctgggttacacatacctagaatcacagaacagtggatctggaagggaaattagggatcctcaacttcaacctgttcatgttaaag

SEQ ID NO: 6063 - DNA, 353 bp, Homo sapiens
  AC026321.7_15795
  Located on chromosome 3
  Distance between a terminus base of telomere on chromosomal short arm and 5'-terminus of this base sequence : 167614104
  Distance between 3'-terminus of neighbour sequence of sequence listing upward to telomere on chrosomal short arm and 5'-terminus of this base sequence : 210808
gtatgtgacgtggaggtagataagtggatggtgtggggatgagcccagggcccatggggcccttaaggtgatggcctgcaccctgtggtggtctgctgaaagagcagaacactgctgctgctgctgctgctgctgctgctgctgactcagtgtgtgactcagtgtgtgccgtgatatctgagcaactgcccagcaagcagcagaaggggaaaggtccacgtctgataaaggagacaggaaatgcattttgaacaaagcttttattattttttttaattctctgctctcattcattttccacatactttatccacaatgacctttgaaatctaatcaattgtttggtatcttcc

SEQ ID NO: 6064 - DNA, 316 bp, Homo sapiens
  AC026321.6_143015
  Located on chromosome 3
  Distance between a terminus base of telomere on chromosomal short arm and 5'-terminus of this base sequence : 167708684
  Distance between 3'-terminus of neighbour sequence of sequence listing upward to telomere on chrosomal short arm and 5'-terminus of this base sequence : 94227
gtatctcaccatactgtggtttacacagtttctggctatagacgaggagataaaggaacaatattattttaatgtgctatacaaatattaaaagtgtgtgtgcgtgtgtgtgtgtgtgtgtgtatgtatctcaccacactgtggtttacacagtttctggcttcagaactatgtttcttttctattcaaatcatgttccagataagacagttttattcttctcagatatgagatatgttttcttttctcagtggagaatagaaagcatatttattgtccaaaattttcaaaacactccatgacatttagtttcttg

SEQ ID NO: 6065 - DNA, 200 bp, Homo sapiens
  chr3.fa.O7frz.196027681
  Located on chromosome 3
  Distance between a terminus base of telomere on chromosomal short arm and 5'-terminus of this base sequence : 167729698
  Distance between 3'-terminus of neighbour sequence of sequence listing upward to telomere on chrosomal short arm and 5'-terminus of this base sequence : 20698
aggaattggctcaggtaattatggaggctgagaagttatatttacataatttctctctctctctctctctctctctctctatatatatatatatatctcctattggttctgtttcttgagggaaccctgactaatacaatgtctttaaaggaatttgtccatctatctgggctaatttgttggcatacaactgttcatag

SEQ ID NO: 6066 - DNA, 421 bp, Homo sapiens
  AC008134.3_166899
  Located on chromosome 3
  Distance between a terminus base of telomere on chromosomal short arm and 5'-terminus of this base sequence : 167741096
  Distance between 3'-terminus of neighbour sequence of sequence listing upward to telomere on chrosomal short arm and 5'-terminus of this base sequence : 11198
cgctagtgacaagacactttatttttttgagaatttgagatttatagtttgtatttcattactgtaaacttcaagagctgctataaatcgtctcgttgtagattttgcagcagtgaatactgtcagaaataggaagaattgtggttagggcttagggtgtgtgtgtgtgtgtgtgtgtgtgtaaagagaattttatactatggtggtatcaattatgttggaattggatctgtagcttcttggtcgtttgggacataaccccttttattttgtgcttggcaaatcctttaaaaggagaagatccttctgggcttcagtttcctcatctgcacatgaaagaactggctaaaatcatgactagtccactagaaatgctggccctatttagcactgactttacctatcctctatgtgacttcat

SEQ ID NO: 6067 - DNA, 478 bp, Homo sapiens
  AC073354.5_118221
  Located on chromosome 3
  Distance between a terminus base of telomere on chromosomal short arm and 5'-terminus of this base sequence : 167943878
  Distance between 3'-terminus of neighbour sequence of sequence listing upward to telomere on chrosomal short arm and 5'-terminus of this base sequence : 202361
ctaatcagttgccatgtaactttaatttttcctacaaggcatacccctatgcattccttccttttccatctcactctatacccccttaccacttgccatcacttctcagattttatgcctaggtaactttgatagccaaactgtgggaatctatccattagtgaattataaaatcaatctattgagtagctagcagtatttacaataaatgcatagaatagaatagaataggatagaatagaatagaatagaatagaatagaacagaggagaacagagtagagtggagtggagtggagtggagtggaatggaatagataatattagaatgcaccacattttttatatctgaccaaaatttgtatatcttttatatgcatcataatgcatatgatgcataatgatggttacatattattttggtcagatataaaaatatttataactatgacataaaatgtattcgttattgtggctag

SEQ ID NO: 6068 - DNA, 153 bp, Homo sapiens
  DISO7_10009804
  Located on chromosome 3
  Distance between a terminus base of telomere on chromosomal short arm and 5'-terminus of this base sequence : 168010351
  Distance between 3'-terminus of neighbour sequence of sequence listing upward to telomere on chrosomal short arm and 5'-terminus of this base sequence : 65995
tggaatgattctacttccaagaataaattctaagaaaactaaacagttgtgtgtgtggtgtgtgtgtgtgtgtgtgtgtgtgtgtagttttaagaataaagacatttaagtcatgaaaaaaaatagaaactacctaaacatgcaacataatgg

SEQ ID NO: 6069 - DNA, 121 bp, Homo sapiens
  D3S1574
  Located on chromosome 3
  Distance between a terminus base of telomere on chromosomal short arm and 5'-terminus of this base sequence : 168056859
  Distance between 3'-terminus of neighbour sequence of sequence listing upward to telomere on chrosomal short arm and 5'-terminus of this base sequence : 46355
ccattcccttaatgtcttgtgaaaagagaacttcatgtttctctctatattaaacgtgtgtgtgtgtgtgtgtgtgtgtgtgtgtgtgtgtgtgtgtgtttgcgcacactggggtagggga

SEQ ID NO: 6070 - DNA, 233 bp, Homo sapiens
  G08294
  Located on chromosome 3
  Distance between a terminus base of telomere on chromosomal short arm and 5'-terminus of this base sequence : 168151056
  Distance between 3'-terminus of neighbour sequence of sequence listing upward to telomere on chrosomal short arm and 5'-terminus of this base sequence : 94076
aaggcagaagagtgagagagcccttgaaatagcaagagagggctgaactcactgaactatctaatgagtgggtttgtgataatgaacccactcagatagatagatagatagatagatagatagatagatagatagataaaatagatgatactgatctattcatgagagcaaagacctcatgacctaatcacctcttaaaagttccacctctcaacactgttgcacttgggatt

SEQ ID NO: 6071 - DNA, 289 bp, Homo sapiens
  AC069259.6_97495
  Located on chromosome 3
  Distance between a terminus base of telomere on chromosomal short arm and 5'-terminus of this base sequence : 168151096
  Distance between 3'-terminus of neighbour sequence of sequence listing upward to telomere on chrosomal short arm and 5'-terminus of this base sequence : -193
ggctgaactcactgaactatctaatgagtgggtttgtgataatgaacccactcagatagatagatagatagatagatagatagatagatagatagataaaatagatgatactgatctattcatgagagcaaagacctcatgacctaatcacctcttaaaagttccacctctcaacactgttgcacttgggattaagtttccaacacatgaagcttgggggagaccttcgaaccatagcaggaataaatcaggtaagagggtgtgtgtcttggtccatttgtgtcactat

SEQ ID NO: 6072 - DNA, 141 bp, Homo sapiens
  D12S1028
  Located on chromosome 3
  Distance between a terminus base of telomere on chromosomal short arm and 5'-terminus of this base sequence : 168151104
  Distance between 3'-terminus of neighbour sequence of sequence listing upward to telomere on chrosomal short arm and 5'-terminus of this base sequence : -281
tcactgaactatctaatgagtgggtttgtgataatgaacccactcagatagatagatagatagatagatagatagatagatagatagataaaatagatgatactgatctattcatgagagcaaagacctcatgacctaatc

SEQ ID NO: 6073 - DNA, 403 bp, Homo sapiens
  AC069259.5_56566
  Located on chromosome 3
  Distance between a terminus base of telomere on chromosomal short arm and 5'-terminus of this base sequence : 168168563
  Distance between 3'-terminus of neighbour sequence of sequence listing upward to telomere on chrosomal short arm and 5'-terminus of this base sequence : 17318
ttcaccatgttagccagactggtcttgaactcccaacctcaggtgatccacctgcctcagcctcccaaagtgctgggattacaggcatgagccaccacgcccagcctttgtgggtatattttcgtgtgtgtgtgtgtgtgtgtgtgtgtgtgtgtgtatagtgtgtatatatactatatatactctttatatagtgtgtgtgtatatatattgctgtatatataaatggcttgatacaaattccactcaatgagcttttcataccatagctgtcatttttgtggcctactaatttctctggcggtaggatcattacggatatcaaaaggtattgagagtcatggtctcctcatatccaggagtgatacgaagaattattacattgcatttagaatgctcttaa

SEQ ID NO: 6074 - DNA, 328 bp, Homo sapiens
  AC026312.8_61125
  Located on chromosome 3
  Distance between a terminus base of telomere on chromosomal short arm and 5'-terminus of this base sequence : 168209748
  Distance between 3'-terminus of neighbour sequence of sequence listing upward to telomere on chrosomal short arm and 5'-terminus of this base sequence : 40782
ttcatgtggaatttgtatttagtcatcttgacaagagtagtcactaaagagaaatggtcaaaattgtgtagcttctagtaatattactcacagtgccctgactttactggggtgtgtgtgtgtgtgtgtgtgtgtgtgtgtgtgtgtgtgtgtgttagggaggtgagggggtaggggagtgctgtaacagatggctttagattgcctcaaatagggttgtaaatttgactataagatgagtcagttttctgtgttcatttcatgaccatgcatggcacctctaaccttaagtttctctcaaatgctgtcataaagccatcattactga

SEQ ID NO: 6075 - DNA, 328 bp, Homo sapiens; identical to SEQ ID NO: 6074
  AC069259.5_24419
  Located on chromosome 3
  Distance between a terminus base of telomere on chromosomal short arm and 5'-terminus of this base sequence : 168209748
  Distance between 3'-terminus of neighbour sequence of sequence listing upward to telomere on chrosomal short arm and 5'-terminus of this base sequence : -328

SEQ ID NO: 6076 - DNA, 231 bp, Homo sapiens
  D3S3725
  Located on chromosome 3
  Distance between a terminus base of telomere on chromosomal short arm and 5'-terminus of this base sequence : 168209835
  Distance between 3'-terminus of neighbour sequence of sequence listing upward to telomere on chrosomal short arm and 5'-terminus of this base sequence : -241
tcacagtgccctgactttactggggtgtgtgtgtgtgtgtgtgtgtgtgtgtgtgtgtgtgtgtgtgttagggaggtgagggggtaggggagtgctgtaacagatggctttagattgcctcaaatagggttgtaaatttgactataagatgagtcagttttctgtgttcatttcatgaccatgcatggcacctctaaccttaagtttctctcaaatgctgtcataaagcca

SEQ ID NO: 6077 - DNA, 373 bp, Homo sapiens
  AC069259.6_20509
  Located on chromosome 3
  Distance between a terminus base of telomere on chromosomal short arm and 5'-terminus of this base sequence : 168213678
  Distance between 3'-terminus of neighbour sequence of sequence listing upward to telomere on chrosomal short arm and 5'-terminus of this base sequence : 3612
aagtcttggagcattgatacatcaaaagattcttctttctacctactttatcaaaatcactatgaacactttggtgtatgttcttctagactcttttctttgttaaaaaaacaaacaaacaaacaaacaaacaaaaagcctagttttgcacagagtatcacagcgtgcacttccttgttaacctgttatttccccctacaaacaatgtgttgtgaacaccttcctatgttagcagattgatttctacagcatttaaaattggctgtagagttttgcattgtatggataaaataccttccaagttttcactgtttcatactgtgatgtatgttttcatacattgttctaaaatatcttaagccacatcgtacat

SEQ ID NO: 6078 - DNA, 314 bp, Homo sapiens
  AC069259.6_131942
  Located on chromosome 3
  Distance between a terminus base of telomere on chromosomal short arm and 5'-terminus of this base sequence : 168261681
  Distance between 3'-terminus of neighbour sequence of sequence listing upward to telomere on chrosomal short arm and 5'-terminus of this base sequence : 47630
cggatcatgaggtcaagagattgagaccatcctggccaacatggtgaaaccttgtctcaactaaaaatacaaaaattagctgggcgtggtggcacacacctgtagtcccagctactctggaggctgagggaggagaatcgcttgaacctgggaggtgaaggttgcagtgagccgagatcgtgccactgcactccagtctggtgacagagtgagcctccatctcaaaataaataaataaataaataaataaataaataaataaataaatagtaaatgaggctcattcgtgcttgtcagtgtttgcattgatgtaa

SEQ ID NO: 6079 - DNA, 314 bp, Homo sapiens; identical to SEQ ID NO: 6078
  AC020649.8_166263
  Located on chromosome 3
  Distance between a terminus base of telomere on chromosomal short arm and 5'-terminus of this base sequence : 168261681
  Distance between 3'-terminus of neighbour sequence of sequence listing upward to telomere on chrosomal short arm and 5'-terminus of this base sequence : -314

SEQ ID NO: 6080 - DNA, 461 bp, Homo sapiens
  chr3.fa.O7frz.183813323
  Located on chromosome 3
  Distance between a terminus base of telomere on chromosomal short arm and 5'-terminus of this base sequence : 168346894
  Distance between 3'-terminus of neighbour sequence of sequence listing upward to telomere on chrosomal short arm and 5'-terminus of this base sequence : 84899
  misc_feature (1)...(461): n = A,T,G or C
tttaaagctttaacctgagatctatgggtttcacacacacacacacacacacacacacacacaaatgaaactgctcttgattgcaaatgtacacacacatagacacaatccactcctttctccattgtccccaatactttttactcttaaggaggagagaagaatcagtttaattgaaatctagatattttaaaacttctcccttcctttgtctcttctctcaatgaaggaaaaattaagagatctatggaaaagggaagctcatttgtatgctgatggtatatttgtgcaagaatgcaaaaaatagaaaaggagtataaggtgactttcaggtaaatcaactgtgtttccatttagattcctcttcctttcagtttctggcatctaacttanacataccaatcctttctagggaaaaagaactcaaaacatttataacctttcactgntcagtaccagtc

SEQ ID NO: 6081 - DNA, 478 bp, Homo sapiens
  AC069224.7_44375
  Located on chromosome 3
  Distance between a terminus base of telomere on chromosomal short arm and 5'-terminus of this base sequence : 168361956
  Distance between 3'-terminus of neighbour sequence of sequence listing upward to telomere on chrosomal short arm and 5'-terminus of this base sequence : 14601
caatgtttggaatagtctaggtaaatacagcaaaaaacatgaaaaatatctttgctttttccttcatcaatattaaagggcaaaaaattcccgtgtgtgtgtgtgtgtgtgtgtgtgtgtgtgtgtgtgtatcactaaacatttagtaaaccttaccattcccctgttgaaaaatagacctatttatatatctacgttttctcaaataaattctgtaagcttacctatggcaaagcataacactcactgaacaggcttcatatgcagtaatatataaaaaataaaaactttatgcagtcttatttttaaaaaccacagaacatgtgaactggcttgtatttcaaaaatctgtctcatccaagggtgtttaaatgttgcctaaattgttaatcattgttttctacctaaaacaatacagaaaatacatgaaaagtacagaattataaggatgccagaccttccaaatcttagagtacat

SEQ ID NO: 6082 - DNA, 406 bp, Homo sapiens
  AC069224.7_12367
  Located on chromosome 3
  Distance between a terminus base of telomere on chromosomal short arm and 5'-terminus of this base sequence : 168406175
  Distance between 3'-terminus of neighbour sequence of sequence listing upward to telomere on chrosomal short arm and 5'-terminus of this base sequence : 43741
attctccttgctaaactagcacagtgttttctgggttccggccttgggaacctcacattaagtagcaacaaatatgctgtggatgactctcctttccctaaagtggaccctcagcaccaagaagtctggatccagcagtgcttttggcaacttgagccgcatttgtccagccaggcaccgtggtgtcatcaccacgcccctcgcacccagatcctctcccgctgcgcacacgctgtcctgttgtttatacacacacacacacacacacacacacacacacacacacgagacatacacggacacaaatacaaagccccggggtagctcctacctctcccccgtgcccgtcgaagatcccgaagatggacgggtgcgtcttgttggccagatccgtgagaacttcgaa

SEQ ID NO: 6083 - DNA, 422 bp, Homo sapiens
  AC069224.7_123575
  Located on chromosome 3
  Distance between a terminus base of telomere on chromosomal short arm and 5'-terminus of this base sequence : 168449223
  Distance between 3'-terminus of neighbour sequence of sequence listing upward to telomere on chrosomal short arm and 5'-terminus of this base sequence : 42642
gcatgctatccattaagtatagaaacttctgtgcactgcaaagctgattgggaattctatgtatgtgagcaagtttgccaactgccaggttggctataggttaattacatgttgactttggcattatggtcagaaactcccaactgtcaaaacatggagatcttttttctgagatcattcaatttctttaataaaaaactcttcagtattttgcctgggaataaacatctagttgctgaagacacccagcagaggggtgtgtgtgtgtgtgtgtgtgtgtgtgtgttctgtttattttggcttcttgttaccttctgctgtttttagtcctttatttcaccccttctgtctgccatacctgtcacctcttgtctatctcctctgcatcagcactccaagccttggctttatcctgctatatc

SEQ ID NO: 6084 - DNA, 253 bp, Homo sapiens
  D3S3579
  Located on chromosome 3
  Distance between a terminus base of telomere on chromosomal short arm and 5'-terminus of this base sequence : 168634571
  Distance between 3'-terminus of neighbour sequence of sequence listing upward to telomere on chrosomal short arm and 5'-terminus of this base sequence : 184926
tcactggggatttgacagtattagggtttcagaattttgtgtgtgtgtgtgtgtgtgtgtgtgtgtgtgtgtgtgtgtgcgtgtgcctaggattaggaatggagactaaaactttctgtacatctcctatgtaagactgccctctcaccgggacctgagtcaaacaggttgctcaaaatttcccatatgaatgttaactctctgctataagcaattcctttaagttactttaaatcaaaacccaggtgtccta

SEQ ID NO: 6085 - DNA, 237 bp, Homo sapiens
  HUMUT2054
  Located on chromosome 3
  Distance between a terminus base of telomere on chromosomal short arm and 5'-terminus of this base sequence : 168660016
  Distance between 3'-terminus of neighbour sequence of sequence listing upward to telomere on chrosomal short arm and 5'-terminus of this base sequence : 25192
agggtcttcttaatcaattctttgtctaggccaatgctagaagaatatttcctaggtttttgttttccctttctttcttccttccttccttccttccttccttctttacttccttccttccttccttccttccttccttcctttcctttcctttcctttcctttcctttccctccctccctctctctttctttctctctttcttctttttttgacagagtatcactctgtcatcagg

SEQ ID NO: 6086 - DNA, 104 bp, Homo sapiens
  DISD22_0003082
  Located on chromosome 3
  Distance between a terminus base of telomere on chromosomal short arm and 5'-terminus of this base sequence : 168888688
  Distance between 3'-terminus of neighbour sequence of sequence listing upward to telomere on chrosomal short arm and 5'-terminus of this base sequence : 228435
ccctcacacttctatctcctgtatttaataatataggacaggatggttgtgtgtgtgtgtgtgtgtgtgtgtgtgtgtagtgactaaatggttctgtgttcctt

SEQ ID NO: 6087 - DNA, 386 bp, Homo sapiens
  AC023276.4_154293
  Located on chromosome 3
  Distance between a terminus base of telomere on chromosomal short arm and 5'-terminus of this base sequence : 169023371
  Distance between 3'-terminus of neighbour sequence of sequence listing upward to telomere on chrosomal short arm and 5'-terminus of this base sequence : 134579
caggaatacaatcagcatcttcttccttccctctccccttccctctgtcactccctttctccccttctctctcccttttgtctttcctacctccccttttgtgacaagtggctatgacttattcaatttgtgtgtgtgtgtgtgtgtgtgtgtgtgtgtgtgtgtgtatttgagatggagtcttgctctatctcccaggctggagtcagtggcacaatctcggctcactgcaacctctgtctcctgggttcaagtgattctcgtgcctcaacctcccaagtagctgggattacaggattgcaccaccacacccgcctaatttttgtatttttagtagagacagggtttcatcatgttggccaggcttgtctctaactcctgacctc

SEQ ID NO: 6088 - DNA, 458 bp, Homo sapiens
  AC023276.4_94854
  Located on chromosome 3
  Distance between a terminus base of telomere on chromosomal short arm and 5'-terminus of this base sequence : 169059438
  Distance between 3'-terminus of neighbour sequence of sequence listing upward to telomere on chrosomal short arm and 5'-terminus of this base sequence : 35681
acttgctaaacatttacttagcacctattgtttacaaaatgctggaataaaaattgtggaagattaaaaaagattaagatataattttgccctggttcataatctggggtgtgtgtgtgtgtgtgtgtgtgtgtgtctgtgtgtgtgtgtttgtgtgtgtgtgtatggtgggatggatataatatgcagggtctattcatgttaagtatattaacacacataccaaaaaagagctataggagtttacagaagaatattcatacttagtgtttctttgttattaaaaaaatagattttgaagtaaaaagaaaatgactgaagaggttccagttcctaaaaagctgtggttttctcagtgacattttacaacctggttaacaattacattaagtttcagggaagtttaagtaaggagcatagataggcctgatattctcagtaaattaccactgctattt

SEQ ID NO: 6089 - DNA, 275 bp, Homo sapiens
  AC023276.4_117196
  Located on chromosome 3
  Distance between a terminus base of telomere on chromosomal short arm and 5'-terminus of this base sequence : 169081796
  Distance between 3'-terminus of neighbour sequence of sequence listing upward to telomere on chrosomal short arm and 5'-terminus of this base sequence : 21900
catgtaccaatgctactgaatctattacaaaaaattgagaagggacccctccctaactaattctatgatgccagcataattctgatatcaaaatctggcaaacacacacacacacacacacacacacacacacacacacacacacacagaagaaaaaagcaagaaaactgccggccaatatccttgatgaatatagatgcaaacattctcaacaaaatactagcaaactgaatccagaagcacatcaaaaagttaattcaccatgatcaagtaga

SEQ ID NO: 6090 - DNA, 415 bp, Homo sapiens
  chr3.fa.O7frz.184652669
  Located on chromosome 3
  Distance between a terminus base of telomere on chromosomal short arm and 5'-terminus of this base sequence : 169245313
  Distance between 3'-terminus of neighbour sequence of sequence listing upward to telomere on chrosomal short arm and 5'-terminus of this base sequence : 163242
atcagttgactttaagtaaagcagatcacccttcataatgtgagtgggcctcatcaaatcagttgaaggccataaaagcaaacacagagttcctgaagaagaaattctgtgttcagactgcacaaagagattttgcctaagttttcagggcttagagttaagactgcaacatcaactcttacctcactctccagcccacagtttgccctctcccacatttgcataagccagatccttaaaataaggatctctctttctctctctctctctctctctctctctgtgtgtgtgtgtgtgtgtgtgtgggtgtgtgtgtgtgagagagagagagagagagagagagagagagagagagagacagccagagagagacagagagcgtatatgtaatatgacattctattggttctatttc

SEQ ID NO: 6091 - DNA, 279 bp, Homo sapiens
  chr3.fa.O7frz.184741560
  Located on chromosome 3
  Distance between a terminus base of telomere on chromosomal short arm and 5'-terminus of this base sequence : 169433945
  Distance between 3'-terminus of neighbour sequence of sequence listing upward to telomere on chrosomal short arm and 5'-terminus of this base sequence : 188217
tcttactaagtgtttggcttgattaattgggtagagccacatactgaaatttttaaaaactaggaaaagattagatgtggtatgtggggtgtgtgtgtgtgtgtgtgtttttgtgtatgtgtgtctgtgtgtgtatcaatactttccttttgagcatgatatgcttgagaaatgtataaagcatttaacaagaaatatcaagtaggcatatatataaatatatgagtcaagagctcagtggcaaggctagggctgcagacgtcagatacgtagttagaa

SEQ ID NO: 6092 - DNA, 286 bp, Homo sapiens
  chr3.fa.O7frz.184934878
  Located on chromosome 3
  Distance between a terminus base of telomere on chromosomal short arm and 5'-terminus of this base sequence : 169493689
  Distance between 3'-terminus of neighbour sequence of sequence listing upward to telomere on chrosomal short arm and 5'-terminus of this base sequence : 59465
ttccactagtctatttgaagtacacacacacacatgcatgaatgagacagaataggtataagtatatagagacagaaagagaaaaagagacagccacacacacacacacacacacacacacacacacacacacacacacacaccccacaagcttttgaaacctccatatactgttacaaatagctgtgggatttttaagcttatagatacagctatgataacacccttgaagatcaggcatagatgaacatttgggaatgatttctatgtgactcagaggatgcta

SEQ ID NO: 6093 - DNA, 391 bp, Homo sapiens
  AC024905.9_103282
  Located on chromosome 3
  Distance between a terminus base of telomere on chromosomal short arm and 5'-terminus of this base sequence : 169634561
  Distance between 3'-terminus of neighbour sequence of sequence listing upward to telomere on chrosomal short arm and 5'-terminus of this base sequence : 140586
ttctaatgcatcttaacctaccaccgttcttgtttttagttttttttttcaattttaagctggataatgcctaactgaaacaaaacaacaacaacaacaacaacaacaaaatagaaacttatctccttacaaggtgtattaattcattctcacactgctaataaagacatactggagatgggataatttataaagaaaagaggtttaattgactcacagttcagcccagctggggaggcctcaggaaacttacaatgatggcagaaggggaagaaaacatgtccttcttcacatggcgacagcaaggagaagtggcaagcaaaggggaaaatccccttataaaaccatcagatctcatgagaatgcactcagtatcacaagaatagcatga

SEQ ID NO: 6094 - DNA, 188 bp, Homo sapiens
  HUMUT1708
  Located on chromosome 3
  Distance between a terminus base of telomere on chromosomal short arm and 5'-terminus of this base sequence : 169643960
  Distance between 3'-terminus of neighbour sequence of sequence listing upward to telomere on chrosomal short arm and 5'-terminus of this base sequence : 9008
cctacaactccaagaaatgctgggaactccatctttttatgtttgtttacctattcaaaaatcacattgccttattactttaggaataaccaaagatagatagatagatagatagatagataatttctctgtgtcacccaggctggagtgcagtgacactatctctcacagcaatctctgtctcctga

SEQ ID NO: 6095 - DNA, 468 bp, Homo sapiens
  chr3.fa.O7frz.185368783
  Located on chromosome 3
  Distance between a terminus base of telomere on chromosomal short arm and 5'-terminus of this base sequence : 169718356
  Distance between 3'-terminus of neighbour sequence of sequence listing upward to telomere on chrosomal short arm and 5'-terminus of this base sequence : 74208
ttagttggcagtaaatgcatagaggttcctcaaaaaagtaaaaatagaactatcacaagatccaggaatcccactactgagtatatataaccaaagaaaatagaattagtataataaagagacatctgcacacccatgtttattgcagcaccattcacaatagacaagatatggaaatcaacctaagtgtccatcaacagatgaaaggataaagaaaatgtaatatatatatatatatacacacacacacacacacacgaaacaaagtactattcagccataagaaagctataaaaaataacaaaatactgtcattcatggcaacatgaattaacttggaggacattgttaagtgaaataagtcagtcacggaaagacagatactgcatgttctcattcacatgaggaaactacaaagttgatctcgtagaagtaaagagtatagtctattcgtaatttacttaggca

SEQ ID NO: 6096 - DNA, 312 bp, Homo sapiens
  chr3.fa.O7frz.185254928
  Located on chromosome 3
  Distance between a terminus base of telomere on chromosomal short arm and 5'-terminus of this base sequence : 169790613
  Distance between 3'-terminus of neighbour sequence of sequence listing upward to telomere on chrosomal short arm and 5'-terminus of this base sequence : 71789
atgtattgtgctcctatttcatactttagccctgagtggcactagagatacagaaaaaaaaagagagagagagagagaaagaaagaaagagaaagagaaagaaagaaagaaagaaagaaagaaagaaagaaagaaagaaagaaagaaagaaagaatagattttcactgaaatgcattcagttcagtggagatttaaataaagaagtggattcaattgtgttaccaggacaacacatagttcagcaaattcaaaagctagaacttgtctacaaagatttggtattctttgagtaaattcacttctatgaggca

SEQ ID NO: 6097 - DNA, 309 bp, Homo sapiens
  AC040913.2_70688
  Located on chromosome 3
  Distance between a terminus base of telomere on chromosomal short arm and 5'-terminus of this base sequence : 169888737
  Distance between 3'-terminus of neighbour sequence of sequence listing upward to telomere on chrosomal short arm and 5'-terminus of this base sequence : 97812
ttcttgcagtcaactgtaaatctcttaaggacttagaccatgtctaatacatctgtgtattcctggttcctaaactggatttcagagattatttttagctgaatgaatttgccaggcagtgtatgcaacaatttatatttcttgtgcatcatatcatttaacaccacacacacacacacacacacacacacattcacaagtaggttaaatgaatcaccccaaataaagaacgtgaaattcaaaatacttttctttaatgattaccatattctgagttttacctatgaggctactttggtaaacttagtc

SEQ ID NO: 6098 - DNA, 276 bp, Homo sapiens
  chr3.fa.O7frz.185493020
  Located on chromosome 3
  Distance between a terminus base of telomere on chromosomal short arm and 5'-terminus of this base sequence : 169960736
  Distance between 3'-terminus of neighbour sequence of sequence listing upward to telomere on chrosomal short arm and 5'-terminus of this base sequence : 71690
tcttcactgtctttgcaattactttctttaaaatcaaactatcacataatcagacagctttaatgccaagaagcacacacacacacacacacacacacaacactacactatattcctacaatcattgatattttaaactgttgtgttcgtcttgttgtttttctttgttttgttggtatagatgctttactttttatgaaactattttaggtaagtagaaaaaattaatcaggaaactttaattttgccactctaagtcacagagtaattgaggaa

SEQ ID NO: 6099 - DNA, 251 bp, Homo sapiens
  AC068191.2_77325
  Located on chromosome 3
  Distance between a terminus base of telomere on chromosomal short arm and 5'-terminus of this base sequence : 169976169
  Distance between 3'-terminus of neighbour sequence of sequence listing upward to telomere on chrosomal short arm and 5'-terminus of this base sequence : 15157
tgtatcatgttacctcacaagttacttatagtcttattgcttccattactactgttgctgctgctgcgtgtgtgtgtgtgtgtgtgtgtgtgtgtgtgtgtgtgtacttactgttttcaaggagtgacaatactggtccctagttgattcctttgggaattgactgttctcgtttacgtgcctcgtaaagtttctgtatcagtgcaccctattactggatatctccattgtctagtgctatttaggcatcc

SEQ ID NO: 6100 - DNA, 380 bp, Homo sapiens
  chr3.fa.O7frz.185661443
  Located on chromosome 3
  Distance between a terminus base of telomere on chromosomal short arm and 5'-terminus of this base sequence : 170038880
  Distance between 3'-terminus of neighbour sequence of sequence listing upward to telomere on chrosomal short arm and 5'-terminus of this base sequence : 62460
tcaagcagtggtattcttaaacttcggagaaaaatagcagaggtagttcacatattatattgaatgtttctaaaaatcatattaatgattttaaaatctcatagatcatcaaaattacctgagggcctcttaagcatatgtctttctatcttatacacacagacacaagcagaaagacacacacacacacacacacacacacacacacatattgctgaagccaccagaggcttactgaatcacgatttccagatatttacattttaaagatatttcccaaatgattgtttgtccaaacaggtttggaagccattgccttaaaaaacttggagatatttaatgaaggagatagatgtgttaaacttaaggccaaaatacat

SEQ ID NO: 6101 - DNA, 182 bp, Homo sapiens
  D3S3708
  Located on chromosome 3
  Distance between a terminus base of telomere on chromosomal short arm and 5'-terminus of this base sequence : 170123624
  Distance between 3'-terminus of neighbour sequence of sequence listing upward to telomere on chrosomal short arm and 5'-terminus of this base sequence : 84364
tggataatcgcttgaaccttggaggcagaggttgcagtgagttgagatgaaaccactgcactccatcctgggtgacagagcaagactccatctcgaatacacacacacacacacacacacacacaacctggacccttcctcttccaaaggcaaaatattaatggcacagcattttattagcc

SEQ ID NO: 6102 - DNA, 430 bp, Homo sapiens
  chr16.fa.O7frz.74485514
  Located on chromosome 3
  Distance between a terminus base of telomere on chromosomal short arm and 5'-terminus of this base sequence : 170192004
  Distance between 3'-terminus of neighbour sequence of sequence listing upward to telomere on chrosomal short arm and 5'-terminus of this base sequence : 68198
tgcattacaactgtagtgtaaagtggcaaccatgaatctccatgtatgttggagaggagagatgttaacaacagcttcagccacaggatggggactgtggaagacagagcaggagctcctttcctgtgcacattttgtctattagacttgtgtgtgtgtgtgtgtgtgtgtgtgtgtgtgtaaagaaaaccagaagccggcgttcactttttgtatttaaatattaaaaataattataaatgaaaaaatatagaataattacttaaactagattttacttcagcagatgtcaactaaacataagaaaacttcgcctactgatagggaatgccactgtgttcttacctataattaattctctgtgtaaaagaaacactcttacttgatttttgttttcctattgtgcctatcagccaagttactgtcatat

SEQ ID NO: 6103 - DNA, 182 bp, Homo sapiens
  D3S3650
  Located on chromosome 3
  Distance between a terminus base of telomere on chromosomal short arm and 5'-terminus of this base sequence : 170284314
  Distance between 3'-terminus of neighbour sequence of sequence listing upward to telomere on chrosomal short arm and 5'-terminus of this base sequence : 91880
aatatttaggagggtgctatagaatacagatttctcaaacatatttgaacagaatttattttatttgctaataatttctaaattttatgtgtgtgtgtgtgtgtgtgtgtgtttaataatacgtgagaaagattactttctacaaacagaaatattattttggcttgcttcatgagagtaca

SEQ ID NO: 6104 - DNA, 185 bp, Homo sapiens
  HUMUT434
  Located on chromosome 3
  Distance between a terminus base of telomere on chromosomal short arm and 5'-terminus of this base sequence : 170381301
  Distance between 3'-terminus of neighbour sequence of sequence listing upward to telomere on chrosomal short arm and 5'-terminus of this base sequence : 96805
tgtttttggtgtgcatatgtgaaattgatattcttgtatttctaaaatgttatgcgagccacttggttgtttttattattcataataatgagaagaaacactgtgtgtgtgtgtgtgtgtgcatgtgtatatgtgtgtgtgtttttttaggggaataattttaaagtcattctctatcttgtgat

SEQ ID NO: 6105 - DNA, 341 bp, Homo sapiens
  chr3.fa.O7frz.185957164
  Located on chromosome 3
  Distance between a terminus base of telomere on chromosomal short arm and 5'-terminus of this base sequence : 170450283
  Distance between 3'-terminus of neighbour sequence of sequence listing upward to telomere on chrosomal short arm and 5'-terminus of this base sequence : 68797
cttgctaattattcatggtcatacattcaactgaaatatatcccaaatggagttttgaattaatgcatatatgtatatgaaatgaatatgcatgaaaggaaatatatatgtgaattattatgtatataaatatattcacatatatatttgctttcatgcattatatatatatatatatatatatatatatacacacatgaaaaatgtaacaatgcaagctactagaaaagaaaataataagagaaagacatttccttgtttgtaaaatcaaagttgcaacatctgcttgcttcacctgctgaaaagaatactccagcttgtactttatggctaacaagcct

SEQ ID NO: 6106 - DNA, 346 bp, Homo sapiens
  chr3.fa.O7frz.186108713
  Located on chromosome 3
  Distance between a terminus base of telomere on chromosomal short arm and 5'-terminus of this base sequence : 170601931
  Distance between 3'-terminus of neighbour sequence of sequence listing upward to telomere on chrosomal short arm and 5'-terminus of this base sequence : 151307
aaaataagtaactggcagaatagactatagtttccaaggagcagcaaggcaaacaaaaaactgtgtgtgtgtgtgtgtgtgtgtgtgtgtgtgtgtgtgtgtgtttatgagtatctgtgtttatgtttttctgtttaaaagtatatatatgtgagtgtgtggtgtctgagatagaaatataaaaaatagaaatttagtaagaaacataaatgaaaaatagagggaagatatttaacaaattatagaggctgaattttattgagaactttgaacgaagactacagaagaatttttgagggagcagctatgagtaggaaagattttggatgcttaaatcataagttac

SEQ ID NO: 6107 - DNA, 221 bp, Homo sapiens
  DISD22_0003089
  Located on chromosome 3
  Distance between a terminus base of telomere on chromosomal short arm and 5'-terminus of this base sequence : 170921709
  Distance between 3'-terminus of neighbour sequence of sequence listing upward to telomere on chrosomal short arm and 5'-terminus of this base sequence : 319432
gcttctagcctttgacgaggggattagttctcaaaatttcccagtagattttagaaatattttagtgaatattatcatataagcctagactctagaacagtaactttgaaatcataagaaattttcacttataatgtaatctaggacacacacacacacacacacacgcaaccacgtttccaaaatcaaaacttacctttaccatagaagattcactctga

SEQ ID NO: 6108 - DNA, 199 bp, Homo sapiens
  chr3.fa.O7frz.186551071
  Located on chromosome 3
  Distance between a terminus base of telomere on chromosomal short arm and 5'-terminus of this base sequence : 171078732
  Distance between 3'-terminus of neighbour sequence of sequence listing upward to telomere on chrosomal short arm and 5'-terminus of this base sequence : 156802
tgtcatttctatgtccgtataatcatgcatgagtacacacacacacacacacacacacacttttttagtacataattataagatatccctttacatcaatacattgaaaaaaaaattgctttccttataactgcctacccctaaagttaggtgtatcatatagcatttttgggggaccttgtgctatccatctaagatg

SEQ ID NO: 6109 - DNA, 421 bp, Homo sapiens
  chr3.fa.O7frz.186452700
  Located on chromosome 3
  Distance between a terminus base of telomere on chromosomal short arm and 5'-terminus of this base sequence : 171188609
  Distance between 3'-terminus of neighbour sequence of sequence listing upward to telomere on chrosomal short arm and 5'-terminus of this base sequence : 109678
gttaagtaacttgaacaaggtcagtgtgaattggtttctgaggtagggttagcatacagatcgattatcctcatagctatttctacattctctgggcatagttgttccagacaggccagtgacaaagaatctctttcaattgtgcatcttcattacaaagtttaaacacagccagagacatatttccaattgtacatttctgcatattttgaccaagattttttacagacagattttctgggaggaactactagaaaaaagcctctgtcattcacacacatacacaacacacaaacacagacacaaacacacacacacacacacacatacacatatataaaatactaatattctggtttctaatgtatttaatgtttattgttgtttttagctaaatgtttagaatcatgtttctgtcttg

SEQ ID NO: 6110 - DNA, 460 bp, Homo sapiens
  AC024906.18_59247
  Located on chromosome 3
  Distance between a terminus base of telomere on chromosomal short arm and 5'-terminus of this base sequence : 171360392
  Distance between 3'-terminus of neighbour sequence of sequence listing upward to telomere on chrosomal short arm and 5'-terminus of this base sequence : 171362
aatcttggttcactgaaacttccgcctcctgggttcaagcgattgtcctgtctcagcctcccgagtagctgggattgcaggcatgtgccatgacacccagctaatttttgtatttttagtagagacagggtttcaccatgttgaccaggctggtctcaaactcctgacctcaagtgatctgccagcctcggcctcccaaactgctgggattacaggcatgagccaccgtgcccgggctggacattacttttaataaaaataaggagtctgtgtcaatgactgcagcgtatcttttgtgtgtgtgtgtgtgtgtgtgtgtgtgtgtgtgtgtgcgtattttacgagtttttctaaaggctttttaaagaataagatccattctctttatgctggctcttatgctccaaattcggtttttgcaacactatttcttcctatcacacggtactcaccagaatga

SEQ ID NO: 6111 - DNA, 214 bp, Homo sapiens
  D3S3702
  Located on chromosome 3
  Distance between a terminus base of telomere on chromosomal short arm and 5'-terminus of this base sequence : 171546948
  Distance between 3'-terminus of neighbour sequence of sequence listing upward to telomere on chrosomal short arm and 5'-terminus of this base sequence : 186096
gtatcctgggttttcccccattccttctgtagaatatataactataactctacaatctatttaatatattgctttgggatatattttttaatacatccaaaatgatacataagatcaacatcaaaattccatgggttaaaatattacacacacacacacacacacacacacacacacacataactttattaagaatatcccgtgtgatgtttgg

SEQ ID NO: 6112 - DNA, 470 bp, Homo sapiens
  AC024666.2_167780
  Located on chromosome 3
  Distance between a terminus base of telomere on chromosomal short arm and 5'-terminus of this base sequence : 171561030
  Distance between 3'-terminus of neighbour sequence of sequence listing upward to telomere on chrosomal short arm and 5'-terminus of this base sequence : 13868
cctcacatttcaatactaacgttgaatgtaaatgacctaaatgttccacttaaaatttacagaaccgcacaatggataagaagttagcaaccaactatctgcgaagagactctcctagcacataaggactcacataaaggaaaagggaggaaaaaggcatttcatgcaaaaggacaccaaaagtgagcaggggtagctattgttatatcagacaaaacaaactttaaagcagcagtggtcaaaagagacaaagagggacagtatataatgataaaaggccttgtccaaacatatatatatatatatatatatatatatatatatatatatatatgaattctaaacatatgtgcacctaacactggagcttgcaaatttataaaataattagtactagacctaagaaactagagagagagtgacacaataatactgggggacttcagtactccactaacagcactagacag

SEQ ID NO: 6113 - DNA, 425 bp, Homo sapiens
  chr3.fa.O7frz.187067936
  Located on chromosome 3
  Distance between a terminus base of telomere on chromosomal short arm and 5'-terminus of this base sequence : 171679697
  Distance between 3'-terminus of neighbour sequence of sequence listing upward to telomere on chrosomal short arm and 5'-terminus of this base sequence : 118197
tttctagccttgagatcctaacgcacttgtcaaaatggagaataggtaatcctctgcgatttgcttacattgggtttctgcttaaactaaaatatcagatatattggttctgactgctaatgtgaaatggacactcttgttcaaccattgtctctgtgtctagaccagtgtagccgtgccagtaagtgctcataaaacatttgtcaaaaaaaaataaataaataaataaataaataaataaataaataaatgaataaactgttctaattccaaactaactccatgaggaatattttacattttcttgcttatttcctttcgatctttaaaaaaaaaagacagaaatctttgagttacagtgtattttgtgtggttttgaggatttgtctaatcctggttaagagaacttggaagcctattgtatc

SEQ ID NO: 6114 - DNA, 306 bp, Homo sapiens
  chr3.fa.O7frz.186975812
  Located on chromosome 3
  Distance between a terminus base of telomere on chromosomal short arm and 5'-terminus of this base sequence : 171712957
  Distance between 3'-terminus of neighbour sequence of sequence listing upward to telomere on chrosomal short arm and 5'-terminus of this base sequence : 32835
aacctgtacctcatacatttgtacaaataccaaatatatctatatatctatatctatctatctatctatctatctatctatctatctatctatctatctataaaatcctgattttgaaaggacccatcaaataccaaagaggaaataaaatgacaactcaagacctggaatatgctatggtaatttttgaaaatgtctaaactaaagagaaaatttaaaattattcctaaagaaagggcaactgattatccacaaaggaaaacaatccattgaaaatcacttttatgacgaagatattgtattcca

SEQ ID NO: 6115 - DNA, 251 bp, Homo sapiens
  AC018917.10_8987
  Located on chromosome 3
  Distance between a terminus base of telomere on chromosomal short arm and 5'-terminus of this base sequence : 171979494
  Distance between 3'-terminus of neighbour sequence of sequence listing upward to telomere on chrosomal short arm and 5'-terminus of this base sequence : 266231
ccaaacattggtcataaagtactttagcaatttagaagtcaccattcatatatatatataaagcttttcatatgtgtgtgtgtgtgtgtgtgtgtgtgtgtgtgtgtatagctcaaagcttttaataacaaaagctttaaggactcagaaaagacaaggcagtcatcctggttctcatgagttcatgcttaacattggacttatgtcctcttgaataccagttgtttctccaattaaggtatgtaacactg

SEQ ID NO: 6116 - DNA, 139 bp, Homo sapiens
  D3S1268
  Located on chromosome 3
  Distance between a terminus base of telomere on chromosomal short arm and 5'-terminus of this base sequence : 172053835
  Distance between 3'-terminus of neighbour sequence of sequence listing upward to telomere on chrosomal short arm and 5'-terminus of this base sequence : 74090
tcctgcttgaaaatgtccttggccaattccacaactttaggtatatgtgtgtgtgtgtgtgtgtgtgtgtgtgtgtgtgtgtgtgtgtgtgtgtatgtattattttccacattacttcagtcccagtgttgccaaatat

SEQ ID NO: 6117 - DNA, 405 bp, Homo sapiens
  AC018457.10_162292
  Located on chromosome 3
  Distance between a terminus base of telomere on chromosomal short arm and 5'-terminus of this base sequence : 172129617
  Distance between 3'-terminus of neighbour sequence of sequence listing upward to telomere on chrosomal short arm and 5'-terminus of this base sequence : 75643
attgctgcataattatggtaatagacacacctctttcaaagttgatagaaaatatataatttaatttaaatatttaaaatatatgctgattttcttattgatatttaagtacaaaatattaacaatggtaaatgtatttaaaaaggaaaaaaatgagcgaatcatcttatgcttagaaattattacttacatgctatattaggccattcttgaattgctataactgaatacctgagatggaatacacacacacacacacacacacacacataaacatatataaacatatatataaacatatatatatatatatgtttaattggcttatggttctacaaactgtaaagaaagcctagtggcatctgctcagcttctgaggaagccttaggaaatgtacagtcatgg

SEQ ID NO: 6118 - DNA, 232 bp, Homo sapiens
  AC079309.12_112320
  Located on chromosome 3
  Distance between a terminus base of telomere on chromosomal short arm and 5'-terminus of this base sequence : 172254386
  Distance between 3'-terminus of neighbour sequence of sequence listing upward to telomere on chrosomal short arm and 5'-terminus of this base sequence : 124364
caattctacctgacttgatcaaatctgaaggaaagttccaaattatggggaacaaggcctctcaattggctaaattcttgcagtgagagagagagagagagagagagagagacataaattttgattacctgagggactttatttaaataacaaggccaccttctgctagccaagccaaactgacagagtaatggcagttgcccatcctataattcagtagctaagattctgc

SEQ ID NO: 6119 - DNA, 166 bp, Homo sapiens
  G08291
  Located on chromosome 3
  Distance between a terminus base of telomere on chromosomal short arm and 5'-terminus of this base sequence : 172394225
  Distance between 3'-terminus of neighbour sequence of sequence listing upward to telomere on chrosomal short arm and 5'-terminus of this base sequence : 139607
gtgtgtgtattggtcacagttcttcagagaaatagaaccagtaggagatagatagatagatagatagatagatagatagatagatagatagatagatgacagatgagttgacaggggatttattaggaaactggctcacttgatcatgaagcctgagaagttccac

SEQ ID NO: 6120 - DNA, 432 bp, Homo sapiens
  AC055765.15_155037
  Located on chromosome 3
  Distance between a terminus base of telomere on chromosomal short arm and 5'-terminus of this base sequence : 172446521
  Distance between 3'-terminus of neighbour sequence of sequence listing upward to telomere on chrosomal short arm and 5'-terminus of this base sequence : 52130
ttggaactatctaggcatctaaaggacttccaaagagcttttagagttttagaatttcctattctgttttctattctattctattctattctattctattctattctattctattctattctattatgttctatcctattctattattttattgtattctattcacaaaccactttataaaattttccataatctggatttggcaatttttattatattatgtacttgagccttagtttgatgaactgctgccaatttctgccagctcacatataggatgacccttagtgtatttcatgctgattctatttctttttttattattaaactttaagttgtgggatacatgtgcagaacgtaaaggctcgttacatgggtatacacaggccatggtggtttgctgcacccatcaacctgtcatctacattaggt

SEQ ID NO: 6121 - DNA, 175 bp, Homo sapiens
  Z67267
  Located on chromosome 3
  Distance between a terminus base of telomere on chromosomal short arm and 5'-terminus of this base sequence : 172509641
  Distance between 3'-terminus of neighbour sequence of sequence listing upward to telomere on chrosomal short arm and 5'-terminus of this base sequence : 62688
tcaaatagttgtcttcattggtctccccacatattttagttacattcccatacacacacacacacacacacacacacacacaaattacttcacattggtcaacttagaatttaaaaaaaaatagttcttactactgctttgggtgtttacttatttaccaaggctcccagattat

SEQ ID NO: 6122 - DNA, 253 bp, Homo sapiens
  D3S3668
  Located on chromosome 3
  Distance between a terminus base of telomere on chromosomal short arm and 5'-terminus of this base sequence : 172539597
  Distance between 3'-terminus of neighbour sequence of sequence listing upward to telomere on chrosomal short arm and 5'-terminus of this base sequence : 29781
cttttgggaattaaaaacttcaggagattactgtctctcacacacacacacacacacacacacacacacacacacacacacagtttggaaattgggcaaatgaaaaagtttaaaagtcttttccagaaataataaaatgttttttccatgtaagcaggtaatcttaagttgtcccatttttgtcagaaatgaaatttgataaaaatgtaagttgagattagccagtgagctcatatttccatgttttactgac

SEQ ID NO: 6123 - DNA, 247 bp, Homo sapiens
  chr3.fa.O7frz.188081737
  Located on chromosome 3
  Distance between a terminus base of telomere on chromosomal short arm and 5'-terminus of this base sequence : 172598241
  Distance between 3'-terminus of neighbour sequence of sequence listing upward to telomere on chrosomal short arm and 5'-terminus of this base sequence : 58391
attctaatggctccaataagagaaaaaaaatcttcctcctattacactgtattaatgactactaataccactgatttattaatagatatcagaaatcattgctgtgtgttattttgcatgaatggtttgtaattatttatttatttatttatttatttatttatttactttttgagggacggggtctctctgtgtttcccaggctgaactggaactcctgggcttaagcaattctcctatcttagac

SEQ ID NO: 6124 - DNA, 454 bp, Homo sapiens
  chr3.fa.O7frz.188295782
  Located on chromosome 3
  Distance between a terminus base of telomere on chromosomal short arm and 5'-terminus of this base sequence : 172814247
  Distance between 3'-terminus of neighbour sequence of sequence listing upward to telomere on chrosomal short arm and 5'-terminus of this base sequence : 215759
aaactacatttgcactttgaatggtaaatttaattgtatgtgagttatattttaataaaactgttttctaagtaaaaaatgaaataaacactaaaagttattactgtcttaatggagtctccaaatcatctgttgttgttgttgttgttgttgttgttgttgttgttgttgacagggcctttctctgtcacagagcacagcggcacaatcatggcttactgcagctttgacttccaggaatcaaaggagcctcctacctcagcctccaaagtagctgggactacaggcatgcaccaccatacctggacaatatttttaaaagttttgtagagacagaatcttactgtgatccccaggctggtctcaaattcctggactcaagtaatcctcctgcctcagcctcctaaagtggtggaattacaggagtgagccactgtgctatgccaccaaatta

SEQ ID NO: 6125 - DNA, 480 bp, Homo sapiens
  AC021100.3_47938
  Located on chromosome 3
  Distance between a terminus base of telomere on chromosomal short arm and 5'-terminus of this base sequence : 172940307
  Distance between 3'-terminus of neighbour sequence of sequence listing upward to telomere on chrosomal short arm and 5'-terminus of this base sequence : 125606
tcacatggaactcattctaaattttattttagcatatgattaaaaacagacacttttttatataaatttttaaataacctacctcttcattattaatttgtgaacctttcttcacacacacacatcttctatgcttttgtgccatctcacacacacacacacacacacacacacacacacacaatcttctatgcttttgtgccatcacacatacacacacacacacacacacacaaaatcttccatgcttttgtgccgtctcgtttcaataaacaaccaggcaatgctatctccagttccacactgttttaattgtatgaatttttattctttacccattgctgaattttaacaattgcaaggtgtttattttttcagacaaacttaaaagttattttatgaagtctcaaaagatatttcactaagatttatatgaaaatactttaaaagcagcgactgagctaaagtgaattaacattt

SEQ ID NO: 6126 - DNA, 206 bp, Homo sapiens
  DISO7_10001266
  Located on chromosome 3
  Distance between a terminus base of telomere on chromosomal short arm and 5'-terminus of this base sequence : 173042094
  Distance between 3'-terminus of neighbour sequence of sequence listing upward to telomere on chrosomal short arm and 5'-terminus of this base sequence : 101307
atggtggctagacagaagcaagaaaaataaatgcataaaacagaaattgttatacatgtaataaaaaatgtgtaatttacatataagtaaaattcagcatatataaactatatacatgtatatacaatgtatatacatatataatagtactatatacacacacacacacacacacacacacaatggcccaattatacatgtgttat

SEQ ID NO: 6127 - DNA, 455 bp, Homo sapiens
  chr3.fa.O7frz.189088130
  Located on chromosome 3
  Distance between a terminus base of telomere on chromosomal short arm and 5'-terminus of this base sequence : 173207594
  Distance between 3'-terminus of neighbour sequence of sequence listing upward to telomere on chrosomal short arm and 5'-terminus of this base sequence : 165294
cctacaatttatgtcactggagtcagaaatgtaataaacttacatgctacaatatgtttgtactgataattttgacccatttctttctgaaatgaataagtttctatcctgccttagcaagtaggtgattctgaatataacttatacttcttttttatgattgtgaggcttttcctcttttccaaagaggagattatatatatatatatatatatatatatatatatatatatatatatatatatatatattccaaaaagtattctatgccacatcctttgaggttcagtgctataattattttctctattggtagcaatggcaatttatcttcacccctttatttctaaatatgcttatatcttcctctttctaaactaatcctttggttagagcctccacttttctataaatgttgttcaagttctgccttctttgttaaatgtcaaacatcc

SEQ ID NO: 6128 - DNA, 408 bp, Homo sapiens
  AC073289.5_128630
  Located on chromosome 3
  Distance between a terminus base of telomere on chromosomal short arm and 5'-terminus of this base sequence : 173297028
  Distance between 3'-terminus of neighbour sequence of sequence listing upward to telomere on chrosomal short arm and 5'-terminus of this base sequence : 88979
gctagagttcatctgtaaagtcacatggacctaatgtttaatttgggaatgttcttgaattttctggaatcatttcaaatatctcattattcttcctccaatatctttagaatatttctccttttctctggtattggtaagtctctctctctctctctctctctctctctctctctctgtctctcattgtatttttgatcgattcaccaaatttattaatctacttaaagaacacatttttaattttttatatttctctgttgtttgttttgtattacattaatttctactctactcttacctttatatttcttctcatgtgtttttattatcatccagttcaacatatagatgctcctcaactctgggtggggctatgtcctataaaatgaagtttagcctaatgct

SEQ ID NO: 6129 - DNA, 139 bp, Homo sapiens
  DISO7_10001272
  Located on chromosome 3
  Distance between a terminus base of telomere on chromosomal short arm and 5'-terminus of this base sequence : 173387393
  Distance between 3'-terminus of neighbour sequence of sequence listing upward to telomere on chrosomal short arm and 5'-terminus of this base sequence : 89957
cctctgagaatagcaatgtctcaaaaggctagaatgagatgaatttatttatttatttatttatttatttatttattttctgtttcaggagtgcaattttgaccaattactttttactggaagaacttcaagaatagct

SEQ ID NO: 6130 - DNA, 101 bp, Homo sapiens
  DISO7_10001271
  Located on chromosome 3
  Distance between a terminus base of telomere on chromosomal short arm and 5'-terminus of this base sequence : 173391919
  Distance between 3'-terminus of neighbour sequence of sequence listing upward to telomere on chrosomal short arm and 5'-terminus of this base sequence : 4387
catcatatgacagataacaagccctaaaagaaattgaagtattttaccccaatatatatatatatatatataattgaactgcagatctttctaatagcaga

SEQ ID NO: 6131 - DNA, 421 bp, Homo sapiens
  AC069210.7_52400
  Located on chromosome 3
  Distance between a terminus base of telomere on chromosomal short arm and 5'-terminus of this base sequence : 173442795
  Distance between 3'-terminus of neighbour sequence of sequence listing upward to telomere on chrosomal short arm and 5'-terminus of this base sequence : 50775
gatatttaccgtcaaaggaaatttcaagtatacaataaagtattgttaactatcaatatattattttacattagctctccaggactcaataattttgcataactgaaactttttactctttgaccaagaactccatacttcttccatgcctactttctgctttttaagggttgaatagcattccattgtgtgtgtgtgtgtgtgtgtgtgtatgtgtaaaactgtttttatccacttatctgttgagagacatttattggctgttgtgaataatgctgaaagaaggagagtgcagacatcattttgggatccttgtttcatttccgttggacatatatctagaagtggagttgcagaatcaaaagacagttctatttttaattttttgaagaaatgttatacaaatgttctactggttgtg

SEQ ID NO: 6132 - DNA, 474 bp, Homo sapiens
  AC069210.7_103564
  Located on chromosome 3
  Distance between a terminus base of telomere on chromosomal short arm and 5'-terminus of this base sequence : 173478364
  Distance between 3'-terminus of neighbour sequence of sequence listing upward to telomere on chrosomal short arm and 5'-terminus of this base sequence : 35148
acaagaaacagtctgtacaagtccagaacatcttttttctccaatattttcattctgcatttggttgaatctgtggatgcacaacccatggatgcagtaagccatatatatatatatatatatatatatattagctgcagcatcatattatcatcactactttttaaaagcggagcattttatttgtcaaatgatgctatctctcaggccttattcttacttggaaaaatggtggtgggccattaactggcaagtattatcagtagacatggagattttaaaaatttgtagcaagtttagaatattttgaagattttatattataaacttttaaaaagaaaaaatatctggaaataattcaaagagtacaacagttagtgatgataatgcaaaattgtctggaaaataggatatataaagaagactaaaaatgatggctggcttctgaaagagaattctgaggaatgagttact

SEQ ID NO: 6133 - DNA, 307 bp, Homo sapiens
  AC009811.10_138989
  Located on chromosome 3
  Distance between a terminus base of telomere on chromosomal short arm and 5'-terminus of this base sequence : 173512263
  Distance between 3'-terminus of neighbour sequence of sequence listing upward to telomere on chrosomal short arm and 5'-terminus of this base sequence : 33425
gcttgcagacagcttatcataggacttcccagcctttgtaattatgtgatctaattttcctaataagccctctctttatctgtctgtctatctatctatctatctatctatctatctatctatctatctatctatcttattcgtctgtctctctaatataaattttgataccagaagtggttctagaagaacctaattttaagagtgagtttttgcaattcattttgatgtttcttgagtttattttctaatcttcttagactttaaaatgcaaaaaaatctacttccaatggtactgataatctgt

SEQ ID NO: 6134 - DNA, 224 bp, Homo sapiens
  chr3.fa.O7frz.189505326
  Located on chromosome 3
  Distance between a terminus base of telomere on chromosomal short arm and 5'-terminus of this base sequence : 173720040
  Distance between 3'-terminus of neighbour sequence of sequence listing upward to telomere on chrosomal short arm and 5'-terminus of this base sequence : 207470
aacttattgctccaataacaatagaaaatgccacaattccaaaaccaagtgttataatacatctcaaccaaatagaataaaatttggataaaacaaaaaaatgattataagattagtgtgtgtgtgtgtgtgtgtgtgtgtgtgtgtgttaactgatgttgatttcccagtgagaaaataaaagaaaatagaactaagtactgtggttcttatacctaattcct

SEQ ID NO: 6135 - DNA, 88 bp, Homo sapiens
  D3S3555
  Located on chromosome 3
  Distance between a terminus base of telomere on chromosomal short arm and 5'-terminus of this base sequence : 173904967
  Distance between 3'-terminus of neighbour sequence of sequence listing upward to telomere on chrosomal short arm and 5'-terminus of this base sequence : 184703
aaatagatattggacagtaaagtttgtgtgtgtgtgtgtgtgtgtgtgtgtgtgtgtgtgtgtgtcatgagacatactttcattcatt

SEQ ID NO: 6136 - DNA, 169 bp, Homo sapiens
  D3S1258
  Located on chromosome 3
  Distance between a terminus base of telomere on chromosomal short arm and 5'-terminus of this base sequence : 173961305
  Distance between 3'-terminus of neighbour sequence of sequence listing upward to telomere on chrosomal short arm and 5'-terminus of this base sequence : 56250
tggctgaataaaatgataacactaccttgtatgtgtcttcatgtgtgtgtgtgtgtgtgtgtgtgtaatcttttctttatccatctgtcgatggacattcaggttgattctaacctaattcaactgttataaatagtgatgcagtaaaggatgtgcaagtgcctcttcg

SEQ ID NO: 6137 - DNA, 198 bp, Homo sapiens
  D3S2458
  Located on chromosome 3
  Distance between a terminus base of telomere on chromosomal short arm and 5'-terminus of this base sequence : 174082648
  Distance between 3'-terminus of neighbour sequence of sequence listing upward to telomere on chrosomal short arm and 5'-terminus of this base sequence : 121174
ttaaagtatcagttcaatcttggcaaacttttgtatttttgtaaagaaaaagccataaatcaaatatttatcaaatcataaatcactcttatcaaatcataaatcaccataaatcaaatacctatctatctatctatctatctatctatctatctatccacacaaacactcataggagtgtgtattagtccattctca

SEQ ID NO: 6138 - DNA, 133 bp, Homo sapiens
  DISO7_10001273
  Located on chromosome 3
  Distance between a terminus base of telomere on chromosomal short arm and 5'-terminus of this base sequence : 174284948
  Distance between 3'-terminus of neighbour sequence of sequence listing upward to telomere on chrosomal short arm and 5'-terminus of this base sequence : 202102
cagtcacaaagttgagcaggaaaaacaaatcttgtttcctgaacagtaaaagatgtagcatatgtgagaaagtgagagacagagtgtgtgtgtgtgtgtgtgtatgtgtatcctctacccagttatagtgtgg

SEQ ID NO: 6139 - DNA, 204 bp, Homo sapiens
  DISO7_10001278
  Located on chromosome 3
  Distance between a terminus base of telomere on chromosomal short arm and 5'-terminus of this base sequence : 174378047
  Distance between 3'-terminus of neighbour sequence of sequence listing upward to telomere on chrosomal short arm and 5'-terminus of this base sequence : 92966
aggaactttatgatgacactggggatgagatgcttattttctccaatagtattattctctttgtgtgtgtgtgtgtgtgtgtgtgactgtgtgtgtttgtgtgtgtgtgtatctctccctctcttccctaagctatgattttcatttagatatgtcgttttgtgtttccaatttcaatggaaatgtgttccaaatgaatggcct

SEQ ID NO: 6140 - DNA, 235 bp, Homo sapiens
  AC069439.5_60758
  Located on chromosome 3
  Distance between a terminus base of telomere on chromosomal short arm and 5'-terminus of this base sequence : 174697624
  Distance between 3'-terminus of neighbour sequence of sequence listing upward to telomere on chrosomal short arm and 5'-terminus of this base sequence : 319373
ttaaactgaccatttaataggaacagaaatgtattccttacaattctggagaatgggaagaccaagatcaagctgctgtcagtttcagtgtatgatgagggctgccctctacccaactggtactttctctttgtgtgtgtgtgtgtgtgtgtgttttgatattttcttttcttaacttttatttcaggttctaagttacatgtgaaggtttgttccataggtaaactcatgttac

SEQ ID NO: 6141 - DNA, 240 bp, Homo sapiens
  D3S3643
  Located on chromosome 3
  Distance between a terminus base of telomere on chromosomal short arm and 5'-terminus of this base sequence : 174855476
  Distance between 3'-terminus of neighbour sequence of sequence listing upward to telomere on chrosomal short arm and 5'-terminus of this base sequence : 157617
actccatcctgagcgacagagcaagactccatctcaataaaataaaataaaataaaattttatatatatacacatatatatacatatacacacacacacacacacacacacacacacatatatatatatatagagagagagagagagaggacattcttcctaaagggctttataatctaaaaacaaaaaagactttaccagagccttttcccacttggcggaagggcatagttttcccac

SEQ ID NO: 6142 - DNA, 437 bp, Homo sapiens
  AC069530.6_55545
  Located on chromosome 3
  Distance between a terminus base of telomere on chromosomal short arm and 5'-terminus of this base sequence : 174988369
  Distance between 3'-terminus of neighbour sequence of sequence listing upward to telomere on chrosomal short arm and 5'-terminus of this base sequence : 132653
attagccagatgtcaactgaagtctagataagacatagataagattggtccaaatttccttgtgtcctctgtggaatgttcaatgactacctcaagatttctccaaaatttgggggattggtaggtgcgtatgaatgagtgacttatattatcggggccatatttggttcttatttcttgactacattgattcttgatatgtattaagtgccatctagtcttttactgctactccatcatcaatctaattgtgaaaatttgcccctttcttcaaaaacaatctatctatctatctatctatctatctatctatctatctatctatctatctatcttagaatgtgtatcagattttactcctggttttgataaagtgcacagcggtttatgtgacaaaagttcaaagagcttaactttgaagttagacatcacttcct

SEQ ID NO: 6143 - DNA, 268 bp, Homo sapiens
  D3S1763
  Located on chromosome 3
  Distance between a terminus base of telomere on chromosomal short arm and 5'-terminus of this base sequence : 174988488
  Distance between 3'-terminus of neighbour sequence of sequence listing upward to telomere on chrosomal short arm and 5'-terminus of this base sequence : -318
ggtaggtgcgtatgaatgagtgacttatattatcggggccatatttggttcttatttcttgactacattgattcttgatatgtattaagtgccatctagtcttttactgctactccatcatcaatctaattgtgaaaatttgcccctttcttcaaaaacaatctatctatctatctatctatctatctatctatctatctatctatctatctatcttagaatgtgtatcagattttactcctggttttgataaagtgcacagcggttt

SEQ ID NO: 6144 - DNA, 154 bp, Homo sapiens
  G10094
  Located on chromosome 3
  Distance between a terminus base of telomere on chromosomal short arm and 5'-terminus of this base sequence : 174988600
  Distance between 3'-terminus of neighbour sequence of sequence listing upward to telomere on chrosomal short arm and 5'-terminus of this base sequence : -156
ctccatcatcaatctaattgtgaaaatttgcccctttcttcaaaaacaatctatctatctatctatctatctatctatctatctatctatctatctatctatcttagaatgtgtatcagattttactcctggttttgataaagtgcacagcggt

SEQ ID NO: 6145 - DNA, 239 bp, Homo sapiens
  D3S1264
  Located on chromosome 3
  Distance between a terminus base of telomere on chromosomal short arm and 5'-terminus of this base sequence : 175004683
  Distance between 3'-terminus of neighbour sequence of sequence listing upward to telomere on chrosomal short arm and 5'-terminus of this base sequence : 15929
ccacttgacccagaaatctcactactggaaatacaccaaaaggaaaatgcattcatgtgttatcaccatgctattcacaatagcaaagacatgtaatcaacttaggtactcatcaatgatggattggataaagaaaatgtgatacactcaaacacacacacacacacacacacacaccatggaatactatgcaaccataaaaaatatgaaatcatgtcttttgcagcaatactgatgaa

SEQ ID NO: 6146 - DNA, 137 bp, Homo sapiens
  D3S3673
  Located on chromosome 3
  Distance between a terminus base of telomere on chromosomal short arm and 5'-terminus of this base sequence : 175044730
  Distance between 3'-terminus of neighbour sequence of sequence listing upward to telomere on chrosomal short arm and 5'-terminus of this base sequence : 39808
ggccctagatggttatgtgagtacacagtaaattctggtcactttccaatcaattacctctgtgtgtgtgtgtgtgtgtgtgtgtgtgtgtgtgtgtgtaaaataattaaaatactctattaacgtcacaggctgaa

SEQ ID NO: 6147 - DNA, 225 bp, Homo sapiens
  D3S3682
  Located on chromosome 3
  Distance between a terminus base of telomere on chromosomal short arm and 5'-terminus of this base sequence : 175115925
  Distance between 3'-terminus of neighbour sequence of sequence listing upward to telomere on chrosomal short arm and 5'-terminus of this base sequence : 71058
tggcaaagcaatgtcttcattcctcgcaaaattttttatattagtcaaaaatttgttcaagataaatatttttaaaagatgccacttcatttccaccacacacacacacacacacacacacacacacagagagagagagagacagacagagagagagacagaaatgagaaggtaaatgttgcctttttcttatggaaagaatttcaaccaagagacctgtatggg

SEQ ID NO: 6148 - DNA, 361 bp, Homo sapiens
  chr3.fa.O7frz.191651619
  Located on chromosome 3
  Distance between a terminus base of telomere on chromosomal short arm and 5'-terminus of this base sequence : 175302589
  Distance between 3'-terminus of neighbour sequence of sequence listing upward to telomere on chrosomal short arm and 5'-terminus of this base sequence : 186439
catagaactaacgtcgctaaaccagtctgaaaaagaactgtaaacatggcctttggtgccagatcttgattcaagagggaaaaagtaaatagtcatgcaacattaaaaataaggaagggataaaaatggactttggaagaaatggagatgacaacgtctcagaggtggtagcattgatgatgcggatttgagggaatttgagtatgaaatcaactagttttgtccctgaattagctcagggattacaaaataggtcagcagtcagcacacaggtaagacagagtgtgttactctgtgtgtgtgtgtgtgtgtgtgtgtgtgtgtgtgtgtgtgttaactgtatctaaataccagttctcca

SEQ ID NO: 6149 - DNA, 443 bp, Homo sapiens
  AC024891.11_15815
  Located on chromosome 3
  Distance between a terminus base of telomere on chromosomal short arm and 5'-terminus of this base sequence : 175314406
  Distance between 3'-terminus of neighbour sequence of sequence listing upward to telomere on chrosomal short arm and 5'-terminus of this base sequence : 11456
actagatgttaccatagttgcaatggttctggtaaaagaagtgcctgctgccagctggataactaatttcaaatatatatatatatatatattcctgactggcttgggaactgtgagatcatatgctgttctggcaccagggcagcagcataaggcatctgatcagagaatacatataacctccaatcctctgatactatgtctctgggttgaacatgcagcctcagctttaattggtgagctggtgacaagaatttcctcagttctggaagcctggctccaaattgtgtgtgtgtgtgtgtgtgtgtgtgtgtgtgtgtgtgtgtgtgtgtgtcttaactgtgttacagcacttaacctgtttaaacgctatgggttgtttaagtggaacatctctctggatttatctaatctggccaaagattacgcaattcagattacct

SEQ ID NO: 6150 - DNA, 360 bp, Homo sapiens
  AC026353.7_37972
  Located on chromosome 3
  Distance between a terminus base of telomere on chromosomal short arm and 5'-terminus of this base sequence : 175490143
  Distance between 3'-terminus of neighbour sequence of sequence listing upward to telomere on chrosomal short arm and 5'-terminus of this base sequence : 175294
cctgtatccacagaatattggtaggcttaggcagaaggactgcttgaagccagttgttcgagaccagcctgggcaacaaagtgagactcagtctctataaaagataatttaaaaaaattagctagctgtgacagcatgtgcctgtagtcctctatacatgggagactgaggcaggaggattgcttgagctgaagtttgaggctgcagggagtcatcaacaggccattgtagtcaggtttaggtgacacagggagaccctgtctcttaaaaccaaccaaccaaccaaccaacaacaattaaaaaaccctaatgttgttttttatttcaagaagtgtaccctggtaggcttttcatttatcc

SEQ ID NO: 6151 - DNA, 290 bp, Homo sapiens
  HUMUT571
  Located on chromosome 3
  Distance between a terminus base of telomere on chromosomal short arm and 5'-terminus of this base sequence : 175659807
  Distance between 3'-terminus of neighbour sequence of sequence listing upward to telomere on chrosomal short arm and 5'-terminus of this base sequence : 169304
tcctgaaagaaataaatgaaaggacacacacacacacacacacacacacacacacacatatatatataaataaaataaaatatgagatgtgtgcattgtaagaaagatgaacagggaatttggcaagatagattgatgatttaattattgactgttaaaaagtctcagtgtgtcatttggtagatgaaacatgctatatatttttttttcttgttcaaaggaataaacctaatgaatactctgttttaacacaactgtctgacatatactgggtatactgcaattcaaat

SEQ ID NO: 6152 - DNA, 441 bp, Homo sapiens
  AC061710.11_88137
  Located on chromosome 3
  Distance between a terminus base of telomere on chromosomal short arm and 5'-terminus of this base sequence : 175777186
  Distance between 3'-terminus of neighbour sequence of sequence listing upward to telomere on chrosomal short arm and 5'-terminus of this base sequence : 117089
agtaccttgaatagtgccaatatgtgttggctctaatctttgatatgactctaggcaggatatgagatctgaaactttcactgatggagtatgaaccagattgacaaacttcttagtgaagagaagtttctgctgtgtgtgtgtgtgtgtgtgtgtgtgtgtgtgtgtgtgtgtgtgtgttttcatgattctgggtattttaatgttaaagtatatataggattttatagtttttggactttgggatctagggagaaaaaggatgtatatcctttcctactcaccctacccccaaccaattacctttggcgaggtatcagctgtgttttgctaatgagcattgccggaagacgttctggaagctcacagaacacagggacttgtaagagtcacagtggaatcagacaacctgtcagtctgtttatacatgtatgctggcat

SEQ ID NO: 6153 - DNA, 174 bp, Homo sapiens
  DISO7_10009782
  Located on chromosome 3
  Distance between a terminus base of telomere on chromosomal short arm and 5'-terminus of this base sequence : 175777295
  Distance between 3'-terminus of neighbour sequence of sequence listing upward to telomere on chrosomal short arm and 5'-terminus of this base sequence : -332
ttcttagtgaagagaagtttctgctgtgtgtgtgtgtgtgtgtgtgtgtgtgtgtgtgtgtgtgtgtgtgttttcatgattctgggtattttaatgttaaagtatatataggattttatagtttttggactttgggatctagggagaaaaaggatgtatatcctttcctactca

SEQ ID NO: 6154 - DNA, 149 bp, Homo sapiens
  D3S1614
  Located on chromosome 3
  Distance between a terminus base of telomere on chromosomal short arm and 5'-terminus of this base sequence : 175851638
  Distance between 3'-terminus of neighbour sequence of sequence listing upward to telomere on chrosomal short arm and 5'-terminus of this base sequence : 74169
ttccaagatatgtgtgacttacagaaaatctattaaactgactaatgaatacagccatacacacacacacacacacacacacacacacacacacacacacacacatacacacacacacacaccaagttcagggtcaaggcttaaatatc

SEQ ID NO: 6155 - DNA, 408 bp, Homo sapiens
  chr3.fa.O7frz.192158082
  Located on chromosome 3
  Distance between a terminus base of telomere on chromosomal short arm and 5'-terminus of this base sequence : 175890520
  Distance between 3'-terminus of neighbour sequence of sequence listing upward to telomere on chrosomal short arm and 5'-terminus of this base sequence : 38733
accagctcaacatttaatgagttctgactgaatcactcagagttgttgaccctttgtcccaggctttttccaaagccctttgtctgtgctcttgacacaagtctcacacgttgctttttcccaagcgtaacattgtatgtatgcctctgaggctagcaggtctattctctatgtctatgtgtgtgtgtggatgtgtctatctttccctttctctctttctgtctctctctctctctctctctctgtgtgtgtgtgtgtgtgtgtattttttccttcaagacttcatggggagagtgtgagagatgcagacctcttatttgttctctgtctttcatcatttttagaaatgagagtcaatagctcttgtttcaattatctccaactgtaaagactaggcatttaagcata

SEQ ID NO: 6156 - DNA, 417 bp, Homo sapiens
  AC069243.9_58263
  Located on chromosome 3
  Distance between a terminus base of telomere on chromosomal short arm and 5'-terminus of this base sequence : 175942347
  Distance between 3'-terminus of neighbour sequence of sequence listing upward to telomere on chrosomal short arm and 5'-terminus of this base sequence : 51419
gctaggatactgaattcatagattcatttttacttatattaattatcattttgataaaagacagcaatggtattgttattcttgccaaaatgaagttcagtaacagaaccttaacactgagaaaagaacagtgaagcaaacatgactgagtgaaaatgactgagtccctgggaatattcgtgtccctcatttagctctttagcacgattctaaagaggaaaaaataaagaccttttcccaggaaaggtttctctctctctctctctctctctctctctctctctctctctctccttccctctctctctctgccaataaaaagcaacaccaccacagattctgggaagttggtgtatgaattttcatttgttgaacttgcaccggaggctgtgctagtctcagaatagtggaaggttt

SEQ ID NO: 6157 - DNA, 229 bp, Homo sapiens
  D3S3622
  Located on chromosome 3
  Distance between a terminus base of telomere on chromosomal short arm and 5'-terminus of this base sequence : 176038553
  Distance between 3'-terminus of neighbour sequence of sequence listing upward to telomere on chrosomal short arm and 5'-terminus of this base sequence : 95789
gcaaggggtctttagtcaacaataatttattgtataatttaaagtaactaaaagaacataattggaatgtttgtaacacaatgaaataataaatgcttgaggtgatggataccccatttaccctaatatgattattacacattatgcctgtagcaaattttatacacacacacacacacacacacacacacacacacacacacacacacctgctaggtacgcatgaaag

SEQ ID NO: 6158 - DNA, 343 bp, Homo sapiens
  chr3.fa.O7frz.193396603
  Located on chromosome 3
  Distance between a terminus base of telomere on chromosomal short arm and 5'-terminus of this base sequence : 176282017
  Distance between 3'-terminus of neighbour sequence of sequence listing upward to telomere on chrosomal short arm and 5'-terminus of this base sequence : 243235
ttcaggtactctgttataagcaaggaaaatgaactaagacagatattaaccttttatcataagtataatttgcaaatattttctctcattccataagttgtcttttcgttctgttcattggtgttttttgttttgttttgttttgttgttgttgttgttgttgtgttgttgtttctgtgcaggaggtttttagtttgactcagtcctgtttgtgtatttttgcttttttggccggtgcttttgaggacgtattcaaaaaataattgttcagaccaatgtcaagaagcttttcctctatgtttatttgaatagttttacagttcaggtcgtatacttaaacctt

SEQ ID NO: 6159 - DNA, 334 bp, Homo sapiens
  AC046139.9_156553
  Located on chromosome 3
  Distance between a terminus base of telomere on chromosomal short arm and 5'-terminus of this base sequence : 176426709
  Distance between 3'-terminus of neighbour sequence of sequence listing upward to telomere on chrosomal short arm and 5'-terminus of this base sequence : 144349
actatacaagtgctcatgcaacttgctttctagtgagagagataataataaatataaataataagggaattaataaatttatatatgttatttatacccctctaacatatatatattcttatccttacaggctgcttaagtctgagcgagacttgagactctgagcttcaatgttcttaagagtaacgtgtgtgtgtgtgtgtgtgtgtgtgtgtgtgtgtgtactctagagggagtaaaatctgtggtaagagaaaaaagagcatgaaataaggctggagagcgcagggtgtgttgaaaatttagagtactcaaggtaagtcttattgaaaga

SEQ ID NO: 6160 - DNA, 223 bp, Homo sapiens
  AC026080.3_11984
  Located on chromosome 3
  Distance between a terminus base of telomere on chromosomal short arm and 5'-terminus of this base sequence : 176475607
  Distance between 3'-terminus of neighbour sequence of sequence listing upward to telomere on chrosomal short arm and 5'-terminus of this base sequence : 48564
catattgctggcaaagaacttttttcctgattatataaagaactccatatgtgaataacaaggaggcagacaacccaatagaaaaaaggacaagacaactgaaaaggcactaaacacacacacacatacacacacacacacacacacacacacacagaatgatagacaaatatcaagtaaacacacagaatataggaaaagatattcagcctcattagtaatg

SEQ ID NO: 6161 - DNA, 361 bp, Homo sapiens
  AC046139.9_109571
  Located on chromosome 3
  Distance between a terminus base of telomere on chromosomal short arm and 5'-terminus of this base sequence : 176545517
  Distance between 3'-terminus of neighbour sequence of sequence listing upward to telomere on chrosomal short arm and 5'-terminus of this base sequence : 69687
aaagttcagctcaatgtactaaaggtgtttatgattgaaatgacagaaccacataaaaaatgcaaacatctagtttcaaaaaatggtaagacaaaggattttgtaattggtatatatatatatatatatatatatatataaaacgtgtgtgtttataaaactagattgagctttgatttatagtgagcaaagttttctactgattcatgagaagggcactaggctatagcttgggttcactgataatctaattccgaatataaacattcctctgtttgacagctatcttctgtagttatcaaaaaataaaatcttgggctggtgtgagaaaaattggattctactccaagtgactcagata

SEQ ID NO: 6162 - DNA, 428 bp, Homo sapiens
  AC022332.12_138328
  Located on chromosome 3
  Distance between a terminus base of telomere on chromosomal short arm and 5'-terminus of this base sequence : 176548109
  Distance between 3'-terminus of neighbour sequence of sequence listing upward to telomere on chrosomal short arm and 5'-terminus of this base sequence : 2231
gctatgctgacatagttctcagctggaataccatttatgtgaaaattcaagcagctgccactacaagagagtttatgctgaaggcaaattgtcaaatatgaaatgtaggacctaaaagctggtgttggacagattaaaacccacacaaatatgcacacacacacacacacacaccccaaatagactgcattgtcggctgaagctcattttcagaaatacatggctcagcactaaagtggacagtttaatcagttcctctgcagaaatagcaagattttttacaagggaaagaaaatctacagagatgaagctgtgactggaaaatttgatccacatgttgtatttttagatctgtcaaagattgacctctgtttgcagtttttctagcaacagtttaatgtaaaattagcctatttgtagcacttcta

SEQ ID NO: 6163 - DNA, 144 bp, Homo sapiens
  D3S1282
  Located on chromosome 3
  Distance between a terminus base of telomere on chromosomal short arm and 5'-terminus of this base sequence : 176698992
  Distance between 3'-terminus of neighbour sequence of sequence listing upward to telomere on chrosomal short arm and 5'-terminus of this base sequence : 150455
acaggttttcacttcatttacttccgcaggtacccttgtatgtgtgtgtgtgtgtgtgtgtgtgtgtgtgtgtgtgtatacatatataaaattaaaggcctatccatataaaaattatcccccaataaacttaatctcagaaga

SEQ ID NO: 6164 - DNA, 423 bp, Homo sapiens
  chr3.fa.O7frz.193562450
  Located on chromosome 3
  Distance between a terminus base of telomere on chromosomal short arm and 5'-terminus of this base sequence : 176859632
  Distance between 3'-terminus of neighbour sequence of sequence listing upward to telomere on chrosomal short arm and 5'-terminus of this base sequence : 160496
gcaaattatttgccgaataaaagtttcagatatgctattttcacattatttgtattacaagtaaatacaaattttaattttttaacttgttttatattatgataatataatgttttagcaatcattgttgcaggtaaagaaaacccaaaatcaatataaaacaaacaaatatgaaaacaaatcatttttgtgctgcttaggaaaaaggagttctacataacaactgtgctttccacttcttttcttttcactacttttttgtcttttcttcctgccctccctacctccccgccttccttccttctttccttccttccttctctccttccttccttccttcctccctccctccctcccttccttccttctttctttgtctttaaagcataagagcaaacccagacggtagcaattctgtttact

SEQ ID NO: 6165 - DNA, 351 bp, Homo sapiens
  AC069220.6_39439
  Located on chromosome 3
  Distance between a terminus base of telomere on chromosomal short arm and 5'-terminus of this base sequence : 176864592
  Distance between 3'-terminus of neighbour sequence of sequence listing upward to telomere on chrosomal short arm and 5'-terminus of this base sequence : 4537
gagtaatttaggccaaagaaacctttctatagataacacttttttctgaattataggtatttaggaaatgtatttatgttaggggtgtgtgtgtgtgtgtgtgtgtgtgtgtgtgttgggaagcatagaagctgcaagaaaaggagagtaaagggagagagggtgagaaatggatctcattcctctatgcaaggttgcacttcttcacaagaatttcattctgctgttatactacacacaatcttgtagaattcctgcctccttcattagactataaacccctagaaggtagagattatgttattttttgtctttgctgtttatcgttactcatagtgtcttagcagatcg

SEQ ID NO: 6166 - DNA, 460 bp, Homo sapiens
  chr3.fa.O7frz.193670495
  Located on chromosome 3
  Distance between a terminus base of telomere on chromosomal short arm and 5'-terminus of this base sequence : 176967614
  Distance between 3'-terminus of neighbour sequence of sequence listing upward to telomere on chrosomal short arm and 5'-terminus of this base sequence : 102671
ggtattacgtgcatgtagaaagactttagttgctacaatggacttgtctgcaattatgtcaaatatgcataaaatttttggcagatgggaatatcagaaataaaagatgctttttttagctatgttacacttcttcttctcttcttttttttttttttttaaaaaagggggggtcttgctctgtcacccaggctggagtgcagtggtgcaatctcagtgcactgcaacctccacctctcgggatcaagtgattctcctgccccagcctcctgagtagctgggattacaggcacccaccaccacgcctggctaatgttttgttttgttttgttatgttttgttttgttttgttttgttttgagatggagtctctctctgttgcccaggccggagtgcagtggcacaatctcagctcattgcaacatccacctcacaggtttaagcaattttcctacctcag

SEQ ID NO: 6167 - DNA, 416 bp, Homo sapiens
  AC074033.8_138473
  Located on chromosome 3
  Distance between a terminus base of telomere on chromosomal short arm and 5'-terminus of this base sequence : 177029908
  Distance between 3'-terminus of neighbour sequence of sequence listing upward to telomere on chrosomal short arm and 5'-terminus of this base sequence : 61834
gtaacatagaccatggtgctaaatgaggcatgctagtgaatatcgttcttgtaatagtatcaattgtttcaatatgtaaaactctgtttaaagctatatgttgaatctctactctacttttgggtgtctggccatccaaaaactgaatcccacaagttactaatagacttgaactgaaaactatctctgaaaatagatcaaaaggcacactttgttcaagatgtctcagggaaaaggtgacttctgctctcaaaaaaaaaagaaaaagagaagtgtgtgtgtgtgtgtgtgtgtgtgtgtgtgtgtgtgtgtgtttaaattaaatggctgcacaacctaatggagaagctgcccagacttgccatttggtgggggtgggaatgtgggaggtggttcaaacttattaggctacatca

SEQ ID NO: 6168 - DNA, 337 bp, Homo sapiens
  AC007849.11_140660
  Located on chromosome 3
  Distance between a terminus base of telomere on chromosomal short arm and 5'-terminus of this base sequence : 177099740
  Distance between 3'-terminus of neighbour sequence of sequence listing upward to telomere on chrosomal short arm and 5'-terminus of this base sequence : 69416
aactgcattaatgactgaactaactttaggtcttttcaaaacaaatatagtcatcaagctaaatattcccaagtctccagaacacacatgggtatgcacaaacatgtgtgcacaaacacacacacacacacacacacacacacctctttgctggcaacaagataagcaagtattagccagcattattgggacaggttttagccctaatttacagagcttttgagatcatgccccagtaaatttttttaagctaatgtgttcatacaggagcatcacaagtaagtttatccaagtcactgttaaacccacaccctgtcttactaactcagaccatcta

SEQ ID NO: 6169 - DNA, 431 bp, Homo sapiens
  AC007849.11_105504
  Located on chromosome 3
  Distance between a terminus base of telomere on chromosomal short arm and 5'-terminus of this base sequence : 177160605
  Distance between 3'-terminus of neighbour sequence of sequence listing upward to telomere on chrosomal short arm and 5'-terminus of this base sequence : 60528
tatggaaccatttaatcatagaagactaatctttccctacaacattctctcctaaataagactttcctgagaaacaaactagaatatttttattcttgaaccgaggactcacttatcttatctaggctgacttactggataaggccatagcatcagtctatgtgaatcacccaattttcatattatccaaagatacattcttttcaacagtgcagcctcttcagcaatcagttccaaaatatgtaggtcaaagggggaactgagtgagaggatgcaatggcttaattccatgtgtaatcactcacagaaaagtcacacacacacacacacacacacacacagacaaaaatgtcctctgacagttactggcatcatgtttagatatgagatggtgtgcttagaacacggcttcagaaatcaatacatcaaca

SEQ ID NO: 6170 - DNA, 423 bp, Homo sapiens
  AC078802.4_75530
  Located on chromosome 3
  Distance between a terminus base of telomere on chromosomal short arm and 5'-terminus of this base sequence : 177160605
  Distance between 3'-terminus of neighbour sequence of sequence listing upward to telomere on chrosomal short arm and 5'-terminus of this base sequence : -431
tatggaaccatttaatcatagaagactaatctttccctacaacattctctcctaaataagactttcctgagaaacaaactagaatatttttattcttgaaccgaggactcacttatcttatctaggctgacttactggataaggccatagcatcagtctatgtgaatcacccaattttcatattatccaaagatacattcttttcaacagtgcagcctcttcagcaatcagttccaaaatatgtaggtcaaagggggaactgagtgagaggatgcaatggcttaattccatgtgtaatcactcacagaaaagtcacacacacacacacacacacacacacagacaaaaatgtcctctgacagttactggcatcatgtttagatatgagatggtgtgcttagaacacggcttcagaaatcaata

SEQ ID NO: 6171 - DNA, 102 bp, Homo sapiens
  DISO7_10001281
  Located on chromosome 3
  Distance between a terminus base of telomere on chromosomal short arm and 5'-terminus of this base sequence : 177371494
  Distance between 3'-terminus of neighbour sequence of sequence listing upward to telomere on chrosomal short arm and 5'-terminus of this base sequence : 210466
gtcagaattagagggagttcttatctactggtttttgttttctgttttttgttttgttttgttttgttttgtttttttagttaggaagcgctatgatctact

SEQ ID NO: 6172 - DNA, 185 bp, Homo sapiens
  DISO7_10001280
  Located on chromosome 3
  Distance between a terminus base of telomere on chromosomal short arm and 5'-terminus of this base sequence : 177490054
  Distance between 3'-terminus of neighbour sequence of sequence listing upward to telomere on chrosomal short arm and 5'-terminus of this base sequence : 118458
tggaatattagttcaggaacatgatttagacaatttgaatcagacaatttccataaaatattttataaactaaaaagcagcgtttgtgtgtgtgtgtgtgtatgtgtgtgtagagttatttggcttgagagccctgcctgcccaacaaacttatcttaaactctcatcattattagtctcatgct

SEQ ID NO: 6173 - DNA, 120 bp, Homo sapiens
  DISO7_10001279
  Located on chromosome 3
  Distance between a terminus base of telomere on chromosomal short arm and 5'-terminus of this base sequence : 177495007
  Distance between 3'-terminus of neighbour sequence of sequence listing upward to telomere on chrosomal short arm and 5'-terminus of this base sequence : 4768
tgtgctaccttgtatttaagatggaaagggaaataaccacacatgtacacacacacatgcacaaacacacacacacacacacacacacacacacttatttttgcagaaagatgcacagga

SEQ ID NO: 6174 - DNA, 199 bp, Homo sapiens
  D3S3523
  Located on chromosome 3
  Distance between a terminus base of telomere on chromosomal short arm and 5'-terminus of this base sequence : 177675976
  Distance between 3'-terminus of neighbour sequence of sequence listing upward to telomere on chrosomal short arm and 5'-terminus of this base sequence : 180849
acgctaccgccaaccttgccactatcatgtcatgttgttctctgcctttccccatagactctgtgtgtgtgtgtgtgtgtgtgtgtgtgtgtgtgtgtgtgtgtactaaagacttactcttctgaaatacaatattcacatcttgcattttataagatttataagcctagtagtgtaagtctgctgattttgttttcac

SEQ ID NO: 6175 - DNA, 294 bp, Homo sapiens
  chr3.fa.O7frz.194231545
  Located on chromosome 3
  Distance between a terminus base of telomere on chromosomal short arm and 5'-terminus of this base sequence : 177763655
  Distance between 3'-terminus of neighbour sequence of sequence listing upward to telomere on chrosomal short arm and 5'-terminus of this base sequence : 87480
ggactatgcatttctatacgtaaatgtaaatgggcttttagttaattttgtttgttttcatgtgaggacagtgccatcacacacacacacacacacacacacacacacacacacactctttactaaatatttgggaattttcagatggaaaggattatgtggctgaaaactacaatcataagtctctgagtgacttaagggctatgtatatgtcattctctttccttgttgcattttggcccataactacatgaatccctgatattttggcttcgactcactgtactattctgt

SEQ ID NO: 6176 - DNA, 293 bp, Homo sapiens
  DISO7_10001282
  Located on chromosome 3
  Distance between a terminus base of telomere on chromosomal short arm and 5'-terminus of this base sequence : 177885370
  Distance between 3'-terminus of neighbour sequence of sequence listing upward to telomere on chrosomal short arm and 5'-terminus of this base sequence : 121421
gcttcttcctcctagcatctctcacagtgtgtgtgtgtgtgtgtgtgtgtgtgtgtgtgtgtgtgtgtgtgtatatatttgctggtttatttcattgtcatctgtcatttccagcaatctgtatgtccctcaaggacaggggccatgtcaatttcatttacttttggagtctcagcataagaacaatgcttggcacacagaccctccagaaatatttataaaataaataaataaatgagtggatagacttagctctgtactttgaaaggagagagctcccactggctcatgtt

SEQ ID NO: 6177 - DNA, 178 bp, Homo sapiens
  D3S1564
  Located on chromosome 3
  Distance between a terminus base of telomere on chromosomal short arm and 5'-terminus of this base sequence : 178129213
  Distance between 3'-terminus of neighbour sequence of sequence listing upward to telomere on chrosomal short arm and 5'-terminus of this base sequence : 243550
tcaaaatgttacacaaacagtatcttgttttgtttagactccctttaacctgtctgggaaggggtgtgtgtgtgtgtgtgtgtgtgtgtgtgtgagtgattatgtgcattgcacacttcacagacaggacaacaggacagtgggcacagaaaacataagggaaggtccacagccacac

SEQ ID NO: 6178 - DNA, 138 bp, Homo sapiens
  D3S3723
  Located on chromosome 3
  Distance between a terminus base of telomere on chromosomal short arm and 5'-terminus of this base sequence : 178191809
  Distance between 3'-terminus of neighbour sequence of sequence listing upward to telomere on chrosomal short arm and 5'-terminus of this base sequence : 62418
gggagatgtttttgatccatctggcccagtgtgtgtgtgtgtgtgtgtgtgtgtgtggtgtgtgtgtgtgcacgcacacacatgtgtgcacaagcacgtgcctcttaaatcatgcagtgttggtgcctgacaaattca

SEQ ID NO: 6179 - DNA, 468 bp, Homo sapiens
  AC026094.2_60219
  Located on chromosome 3
  Distance between a terminus base of telomere on chromosomal short arm and 5'-terminus of this base sequence : 178423545
  Distance between 3'-terminus of neighbour sequence of sequence listing upward to telomere on chrosomal short arm and 5'-terminus of this base sequence : 231598
cttcgtctaagaaacaaggttcagaagacgacaagggtgaccgcaggctgtgtagatgtaagctggcagaagcttaggaaaggaaattacattgaaagagcttcccatccacaaagctactaaaacccaaacccagtgcttacaataatgtcttcccaaatgcccccaaatgaaattaactttttctcttcttatgcttcataacattctgatacattacagtccttcacacatcttatctttcattgcacacacacacacacacacacacacacacacacacacacacacacgtgtatatatatccatttccttcattactgttcagattttttaaaggcaggctgtcttacagatcagtgctttttaactggaggttaaaattttgctcccagaggacatttggtaatgtctggagaaagttttgattaacacaacttgtgaggttggaggtatgttgctactatc

SEQ ID NO: 6180 - DNA, 468 bp, Homo sapiens; identical to SEQ ID NO: 6179
  AC026316.8_48446
  Located on chromosome 3
  Distance between a terminus base of telomere on chromosomal short arm and 5'-terminus of this base sequence : 178423545
  Distance between 3'-terminus of neighbour sequence of sequence listing upward to telomere on chrosomal short arm and 5'-terminus of this base sequence : -468

SEQ ID NO: 6181 - DNA, 450 bp, Homo sapiens
  chr3.fa.O7frz.195127199
  Located on chromosome 3
  Distance between a terminus base of telomere on chromosomal short arm and 5'-terminus of this base sequence : 178423749
  Distance between 3'-terminus of neighbour sequence of sequence listing upward to telomere on chrosomal short arm and 5'-terminus of this base sequence : -264
cattctgatacattacagtccttcacacatcttatctttcattgcacacacacacacacacacacacacacacacacacacacacacacgtgtatatatatccatttccttcattactgttcagattttttaaaggcaggctgtcttacagatcagtgctttttaactggaggttaaaattttgctcccagaggacatttggtaatgtctggagaaagttttgattaacacaacttgtgaggttggaggtatgttgctactatcatctagtgagtaaagataaaaaatgctgctaagcatcctacaaagcgcaggacagccccctacaacaaagaattatctgggccaaaatctccatacttccaagagtgagaaaccctgtccttcattagatcattagatgatccattgtgcctaaaacatgcatgaaacaataggcactccataagt

SEQ ID NO: 6182 - DNA, 448 bp, Homo sapiens
  AC026094.2_101557
  Located on chromosome 3
  Distance between a terminus base of telomere on chromosomal short arm and 5'-terminus of this base sequence : 178438518
  Distance between 3'-terminus of neighbour sequence of sequence listing upward to telomere on chrosomal short arm and 5'-terminus of this base sequence : 14319
actattggatggtaggacagtcatgatcatcaattatgagtatctgatctgacatagttatgagaaagagaattgactgatggcaactgttcctagtatttgccattcatacgttacagcatcaagaaaaaatgtgtgtgtgtgtgtgtgtgtgtgtgtgtacaaactatacacagttctcatcactaacagtctattaatcagtgggcccaaaaaatacattggctgccccataattgcaaacagggcctgtggactcagggctagcagctagatggagatcacagtgaagactgggaatgcctattgggaaggtgctccagccaaagaattcaagggaccagaggtcaagaaagagcagagaatcaaagctgggccccttgtggggaggccgaagtcaggcaaaacaagtgacaaagaaggcggtaagtgcaagctgagcaattat

SEQ ID NO: 6183 - DNA, 149 bp, Homo sapiens
  DISO7_10001285
  Located on chromosome 3
  Distance between a terminus base of telomere on chromosomal short arm and 5'-terminus of this base sequence : 178606061
  Distance between 3'-terminus of neighbour sequence of sequence listing upward to telomere on chrosomal short arm and 5'-terminus of this base sequence : 167095
gaggctacactgctaaagagtgttaaatgctaccacagttttcttggtggtggtggtggtggtggtggtggtggtggtggtggtggtggtggtggtggtggtggtggtgatggtggcggtggtgtgtgttaaggctaggattatatgcc

SEQ ID NO: 6184 - DNA, 140 bp, Homo sapiens
  D3S3520
  Located on chromosome 3
  Distance between a terminus base of telomere on chromosomal short arm and 5'-terminus of this base sequence : 178700479
  Distance between 3'-terminus of neighbour sequence of sequence listing upward to telomere on chrosomal short arm and 5'-terminus of this base sequence : 94269
tctaatttatctgtcgtgtgtgtttctttttctaagtttatgtgtgtgtgtgtgtgtgtgtgtgtgtgtgacctactaaaaggtagtataccatacattcataccagactgtcttctgtgttgccttttcaatttaatat

SEQ ID NO: 6185 - DNA, 200 bp, Homo sapiens
  AF178756.1_550
  Located on chromosome 3
  Distance between a terminus base of telomere on chromosomal short arm and 5'-terminus of this base sequence : 178771424
  Distance between 3'-terminus of neighbour sequence of sequence listing upward to telomere on chrosomal short arm and 5'-terminus of this base sequence : 70805
ccactatcagatgtcataagctggcccagctgtatgttgtctctatatcttattcagcatttctttctttccttttcttcctttctttctttctttcttttcttttctattctttccttctttccttctttctttctttctttctttctttctctctttcatgtatttatttatttttttgacagaatctcactttatcg

SEQ ID NO: 6186 - DNA, 159 bp, Homo sapiens
  chr3.fa.O7frz.197115351
  Located on chromosome 3
  Distance between a terminus base of telomere on chromosomal short arm and 5'-terminus of this base sequence : 178796415
  Distance between 3'-terminus of neighbour sequence of sequence listing upward to telomere on chrosomal short arm and 5'-terminus of this base sequence : 24791
catggtctaatttcactaaatcagcagtttataaaatgcatctctgggtttttctgtgtgtatttgtgtgtgtgtgtgtgtgtgtgtgtgtgtgtgtaaagaaaaagggttctccaggaggcagaggttgcagtgagcttagatcatgtcactgcattc

SEQ ID NO: 6187 - DNA, 232 bp, Homo sapiens
  DISO7_00001190
  Located on chromosome 3
  Distance between a terminus base of telomere on chromosomal short arm and 5'-terminus of this base sequence : 179020259
  Distance between 3'-terminus of neighbour sequence of sequence listing upward to telomere on chrosomal short arm and 5'-terminus of this base sequence : 223685
gtaactgaagccatgacaatgaatgagacagaagctgtgtgtgtgtgtgtgtgtgtgtgtgtgtgtgtccgcgcccgcgtgatggggaagggtctagggttgggcagaagaaaagcaggccaaagggtgttggcatttactgtttaggagaagaagaaggagaagttgacaagaggccaagaggaagtggtcagagaggggtctgtctgaactagaggcacggaatagtggt

SEQ ID NO: 6188 - DNA, 167 bp, Homo sapiens
  chr3.fa.O7frz.196876359
  Located on chromosome 3
  Distance between a terminus base of telomere on chromosomal short arm and 5'-terminus of this base sequence : 179073713
  Distance between 3'-terminus of neighbour sequence of sequence listing upward to telomere on chrosomal short arm and 5'-terminus of this base sequence : 53222
tgctttcatgaggtaattctaataagtctagaaagcaagagttgattatttcacagaaatgccatatatatatatatatatttatatatattgctttttattacataccaaggggatatgagagtgaatttggttttaagaggacttgaaataagcatgacatcttc

SEQ ID NO: 6189 - DNA, 480 bp, Homo sapiens
  AC025545.3_142306
  Located on chromosome 3
  Distance between a terminus base of telomere on chromosomal short arm and 5'-terminus of this base sequence : 179109612
  Distance between 3'-terminus of neighbour sequence of sequence listing upward to telomere on chrosomal short arm and 5'-terminus of this base sequence : 35732
accatgctacagaactttaactacatgcgaaggcaaccaactctagacctgaacaagaaagtaatgtctactttaggaagaggactgtggggataactgtacagaactaactagcagagggacagattagtactgagcacttctcacatatgtccagcctgctgcaggagattgtgtgtgtgtgtgtgtgtgtgtgtgtgtgtgtgtgtgtgtgtgtgtgtgtgtttctttctttctacaactgcatgacaacaatgtatcttgctcctatctcttggtgataacaagacaactaagacattttatatttggttcggccttcctcatttcattgaagtgtgtgtactgccagcgttaaagaagatgttgtgtacacatcctgttggcttctcaattctattttcttcatattaacaatctttttcagatactctactgtaacgtgtcataaaagacataatactatcacggaaggtcatt

SEQ ID NO: 6190 - DNA, 101 bp, Homo sapiens
  DISO7_10001286
  Located on chromosome 3
  Distance between a terminus base of telomere on chromosomal short arm and 5'-terminus of this base sequence : 179320918
  Distance between 3'-terminus of neighbour sequence of sequence listing upward to telomere on chrosomal short arm and 5'-terminus of this base sequence : 210826
accaactggaggattattcagctctctctctctctctccctctctctctctctctctctctctatatatatatataaacacaggtagtattggaaagaagc

SEQ ID NO: 6191 - DNA, 427 bp, Homo sapiens
  AC053521.5_32676
  Located on chromosome 3
  Distance between a terminus base of telomere on chromosomal short arm and 5'-terminus of this base sequence : 179365695
  Distance between 3'-terminus of neighbour sequence of sequence listing upward to telomere on chrosomal short arm and 5'-terminus of this base sequence : 44676
gactagctaaatgatagacgtcattgaatttttgtcagaagaaaaggagttagtaatgggcaatgattgcctactccattgattcacccctttctaaaacaatgggatcctgtaaaataatatatattatagtaaatgaaagtttatttttaaaacaaatttgttacctgtggtaaatcttgtgctttttatgatttctatttgtggatactttaaaatttatcttttttattaaagttcacatgatttgatgcttgtgtatgtgtgtgtgtgtgtgtgtgtgtgtgtgtgtgtgtgcttattttattaagccctaaatttgtacactgatgaggctcgaatataagtctattttggtaattatctcaggtttcccaattcgcttgataaataatccatccttctctcgtgatttgatatgccacgt

SEQ ID NO: 6192 - DNA, 238 bp, Homo sapiens
  chr3.fa.O7frz.197777775
  Located on chromosome 3
  Distance between a terminus base of telomere on chromosomal short arm and 5'-terminus of this base sequence : 179382949
  Distance between 3'-terminus of neighbour sequence of sequence listing upward to telomere on chrosomal short arm and 5'-terminus of this base sequence : 16827
tatcacaggtaagtgacaggatgcctaatattgaagacagagtggttactttactatctatctatctatctatctatctatctatctatctatctatctacccacccacctacctgtctatctatattctgtcctaggaagggattaaggtagcttataaaatacttatgatgaagttaaatgaaagtaaaaataactcacaggaaataaataaaaataaacaaatcggactgtatca

SEQ ID NO: 6193 - DNA, 474 bp, Homo sapiens
  AC053521.5_58953
  Located on chromosome 3
  Distance between a terminus base of telomere on chromosomal short arm and 5'-terminus of this base sequence : 179490523
  Distance between 3'-terminus of neighbour sequence of sequence listing upward to telomere on chrosomal short arm and 5'-terminus of this base sequence : 107336
gtcaatttcaatgtatttcaagtcttttctttcaatctggtaatgactctcatatttaacatgatgcttcttcactgttaactacatcagtaaatataaagggtgaggaagttaactgagagatcggaacttttgaaagcctttaattaagccttggccccaatacctaagaaggttcagaagccttctgtgtgtttattcctccattatcttctgctctgagggggatcccatggactctcaacacacacacacacacacacacacacacacacacacacacacacacacacagacacacacacgtctccctaaagaagagaccagatgtattaggtctgggaatgtatgttagagaggactactgcaatcctttctttcttcaccttaaacttaggtttccaaatgtctgttcaacaggaatgagaagtgatttatatcatgtttttgctccttacatcttcaagttaacaa

SEQ ID NO: 6194 - DNA, 334 bp, Homo sapiens
  AC026287.3_102788
  Located on chromosome 3
  Distance between a terminus base of telomere on chromosomal short arm and 5'-terminus of this base sequence : 179534936
  Distance between 3'-terminus of neighbour sequence of sequence listing upward to telomere on chrosomal short arm and 5'-terminus of this base sequence : 43939
ccaattagccttctgtctttagtaattgagagccaaattataatggggtgtgtgtgtgtgtgtgtgtgtgtgtgtgtgtgtgtgtgtgtgtctgtttgtatgtgatctcttcaacccctctaaccttccttagatgatgtatttccctgcatttgcttccctgctgatatggtttggctctgtatccccaccaaaacctcatcttgtagctcccataattcccacatgttgtgagagggacccggtgggacatggttgagtaatgggagtgagggtgagggtgggtctttactgtagtgttctcttgatagtgaataagtctcatgaatctgat

SEQ ID NO: 6195 - DNA, 477 bp, Homo sapiens
  AC068759.5_21673
  Located on chromosome 3
  Distance between a terminus base of telomere on chromosomal short arm and 5'-terminus of this base sequence : 179587478
  Distance between 3'-terminus of neighbour sequence of sequence listing upward to telomere on chrosomal short arm and 5'-terminus of this base sequence : 52208
atcaccgtaggctataatgttcaatacttttcttcatggtgttttatttattttgcttatttatattgtgatatacttcacacttacgagaatattttttaaaagatttcttttctgcatctactatgcagtctaacaaagaaagcattaaaaatacagatgaagctctttcatgcatggtatgataatttcattgcattagatcatgcctcaaggtaaccactatttttaatttgttgtttaacctcctatatatttgcatacttttaccactgaaatgtgtattgctaaataatatatagtatcattttgcatattttagtatcatactatatatatatatatatatatatatatatctcctagcaacttactttttttaacctaacattgttttttggattatttttcccatattgatatatgcggttctactttattttcattgctgtatactattccattgcatgactttac

SEQ ID NO: 6196 - DNA, 346 bp, Homo sapiens
  AC068759.5_11475
  Located on chromosome 3
  Distance between a terminus base of telomere on chromosomal short arm and 5'-terminus of this base sequence : 179597902
  Distance between 3'-terminus of neighbour sequence of sequence listing upward to telomere on chrosomal short arm and 5'-terminus of this base sequence : 9947
tgagtgacttcacttggaataatggtttccaactccatccaggttgctgcgaatgccattatgttgttcctttttatggctgagtagtattccatggtgtgtgtgtgtgtgtgtgtgtgtgtgtgtgtgtatgtgtgtatgtgtgtgtgtatatatatatatacatatgtatatcccattttctttatccactcaattgatgggcatttgggctggttctatatttttccatttgtgaattgtgctactataaacgtgtgtgcaagtatcttttttgtataatgacttattttcctctgggtggctacctgggagtggggttgttgaatcaaatggtagatgtatt

SEQ ID NO: 6197 - DNA, 427 bp, Homo sapiens
  AC068759.5_87776
  Located on chromosome 3
  Distance between a terminus base of telomere on chromosomal short arm and 5'-terminus of this base sequence : 179639979
  Distance between 3'-terminus of neighbour sequence of sequence listing upward to telomere on chrosomal short arm and 5'-terminus of this base sequence : 41731
gaataaggatttgctttaggacttatttaaaggtaaacaaacaaacaaacaaaacaaaacaccacacacacacacacacacaggttttggtaggccaggctgtgctgcttttgaaagtgcaatcgcttcagaacctctttgcttctagtaaatttcatattagtgccccaaaccaaagattcaatctagacagatttttaagcctttcaactcacatttattaaatgaactccacaaaatcagctcagctcatttccctgtctcattttaaatgcagctactggatcacacacacacacacacacacacacacacacacacacacacacgaattaaaaaaaaaaaaaccttaaataagaaggcaatagtcttaatctgatttttgaaactgtgctacctcgaactgtttggtttaaagtgacaattg

SEQ ID NO: 6198 - DNA, 367 bp, Homo sapiens
  AC018456.12_12484
  Located on chromosome 3
  Distance between a terminus base of telomere on chromosomal short arm and 5'-terminus of this base sequence : 179711104
  Distance between 3'-terminus of neighbour sequence of sequence listing upward to telomere on chrosomal short arm and 5'-terminus of this base sequence : 70698
cgtacagatggttagaagtcagctttgtccatattagcattagatgaccttactgacctatttactggtgtacaatattttatatccaactactgagaggaattagtgctctgtgtgtgtgtgtgtgtgtgtgtgtgtgtgtgtgagagagagagaggatatatatatatatatcgagatatatatatatcgagatacatatatcaagatatatatatatcgagatatatatatatcaaaaataacaggaaagtaacagagcagatgacaaattggagtcaaaagagtgaacagccttgttttttggatctgtagttagagggcagaaagaaaaagaggaaaccttcattgtctttacagtaagtcc

SEQ ID NO: 6199 - DNA, 334 bp, Homo sapiens
  AC068759.5_128222
  Located on chromosome 3
  Distance between a terminus base of telomere on chromosomal short arm and 5'-terminus of this base sequence : 179711137
  Distance between 3'-terminus of neighbour sequence of sequence listing upward to telomere on chrosomal short arm and 5'-terminus of this base sequence : -334
ttagcattagatgaccttactgacctatttactggtgtacaatattttatatccaactactgagaggaattagtgctctgtgtgtgtgtgtgtgtgtgtgtgtgtgtgtgtgagagagagagaggatatatatatatatatcgagatatatatatatcgagatacatatatcaagatatatatatatcgagatatatatatatcaaaaataacaggaaagtaacagagcagatgacaaattggagtcaaaagagtgaacagccttgttttttggatctgtagttagagggcagaaagaaaaagaggaaaccttcattgtctttacagtaagtcc

SEQ ID NO: 6200 - DNA, 492 bp, Homo sapiens
  AC012082.6_152972
  Located on chromosome 3
  Distance between a terminus base of telomere on chromosomal short arm and 5'-terminus of this base sequence : 179731690
  Distance between 3'-terminus of neighbour sequence of sequence listing upward to telomere on chrosomal short arm and 5'-terminus of this base sequence : 20219
gtaaccattacctgaataacgtacattttacctattaagtaatttcttgtctctcacccccacccatcctcccaaccttcaagtctccaatgtctatcattccaaactctatatccatgtgtacacattatttagctcctactaataatttacctcccattatttagttctcactgagaacatgtgatatctgactttttgtttctgagttatttgactttagagtaatggcctccagttttatctatattgctgcaaaagaaatgattttattatttttatggctgtatagtgttcaattgtgtgtgtgtgtactttctattttctgtatatatattatatgtgtatctatatatatatacacacacacacacacacacatacacattccattatgtatatatacacgcattccattctgactggtttaagatgatacatcattgtgtttttaatttgtatttctctgatgattagtaaggtttgagcatt

SEQ ID NO: 6201 - DNA, 136 bp, Homo sapiens
  DISO7_10001290
  Located on chromosome 3
  Distance between a terminus base of telomere on chromosomal short arm and 5'-terminus of this base sequence : 179870664
  Distance between 3'-terminus of neighbour sequence of sequence listing upward to telomere on chrosomal short arm and 5'-terminus of this base sequence : 138482
atacagtcagcagcataatgcacttttctgcactttgctttcgcaaatttatctatctatctatctatctatctatctatctatctatctatctatctatctatcatatctatctgtcatctatctccatggtggt

SEQ ID NO: 6202 - DNA, 138 bp, Homo sapiens
  DISO7_10001291
  Located on chromosome 3
  Distance between a terminus base of telomere on chromosomal short arm and 5'-terminus of this base sequence : 179884450
  Distance between 3'-terminus of neighbour sequence of sequence listing upward to telomere on chrosomal short arm and 5'-terminus of this base sequence : 13650
tttctagcacatatgatgaacttgatttttattcacttttatttttcttaaaaattgtatttgtttttacctgtgtgaaatacacacacacacacacacacacacacttctatggaaatcatgttattagtcagtcaa

SEQ ID NO: 6203 - DNA, 220 bp, Homo sapiens
  DISO7_10001292
  Located on chromosome 3
  Distance between a terminus base of telomere on chromosomal short arm and 5'-terminus of this base sequence : 179897135
  Distance between 3'-terminus of neighbour sequence of sequence listing upward to telomere on chrosomal short arm and 5'-terminus of this base sequence : 12547
tcataaagacattgccttcttccaaaaagaaaaagaaaaaaaaggaagcccttatttaattttaagtagtaaagtaccaagattatattacgtgtgtgtgtgtgtgtgtgtgtgtgtgtgtgtgaattactctggctgctgtgtggagaatggtttatagagagcagcagagaaagcagaaagaagactatgcatttatttcagacataaggatgtggca

SEQ ID NO: 6204 - DNA, 205 bp, Homo sapiens
  DISO7_10001295
  Located on chromosome 3
  Distance between a terminus base of telomere on chromosomal short arm and 5'-terminus of this base sequence : 179994884
  Distance between 3'-terminus of neighbour sequence of sequence listing upward to telomere on chrosomal short arm and 5'-terminus of this base sequence : 97529
accatatggctgcaaagtctaaaatatatactatcttaccctttacaagaaaaaaaaagtttgccagtattttatatagatgctttcagtggactgctctctctctctctctctctctctctttctccatatatatatatattttaatgtcatgattttacttctgttctggccaaaatggagtaacagagactggatctacctc

SEQ ID NO: 6205 - DNA, 245 bp, Homo sapiens
  D3S1565
  Located on chromosome 3
  Distance between a terminus base of telomere on chromosomal short arm and 5'-terminus of this base sequence : 180117873
  Distance between 3'-terminus of neighbour sequence of sequence listing upward to telomere on chrosomal short arm and 5'-terminus of this base sequence : 122784
tgcaagggtgccatctgatatttcttgttggataatttccatttctaacttattagaaagaaaatatttttatgtccatctttagataggctttgaaaagatggagaagtgaagaaatgtgccagaaattgctaattgctgtgggtgcatgtgtgtgtgtgtgtgtgtgtgtgtgtgtgtgtgtgtgtgtgtgtgtatgtatgcacacatacatttgtatggaggaggttttttattcagagata

SEQ ID NO: 6206 - DNA, 170 bp, Homo sapiens
  G10259
  Located on chromosome 3
  Distance between a terminus base of telomere on chromosomal short arm and 5'-terminus of this base sequence : 180273656
  Distance between 3'-terminus of neighbour sequence of sequence listing upward to telomere on chrosomal short arm and 5'-terminus of this base sequence : 155538
ttcagatatttctctaggactcaataatttttacttaagatagatggatagatagataggtagatgggtagatggatagacagataggtaggtggatggatagatagatagatagatagatagatagatagatagatagataaatagacgaattattccaggagtaactc

SEQ ID NO: 6207 - DNA, 144 bp, Homo sapiens
  D3S2425
  Located on chromosome 3
  Distance between a terminus base of telomere on chromosomal short arm and 5'-terminus of this base sequence : 180273728
  Distance between 3'-terminus of neighbour sequence of sequence listing upward to telomere on chrosomal short arm and 5'-terminus of this base sequence : -98
tggatagacagataggtaggtggatggatagatagatagatagatagatagatagatagatagatagataaatagacgaattattccaggagtaactcaataggaaacataaaatgttaaagctggtaggttcttaaacagaaa

SEQ ID NO: 6208 - DNA, 150 bp, Homo sapiens
  chr3.fa.O7frz.198778408
  Located on chromosome 3
  Distance between a terminus base of telomere on chromosomal short arm and 5'-terminus of this base sequence : 180314498
  Distance between 3'-terminus of neighbour sequence of sequence listing upward to telomere on chrosomal short arm and 5'-terminus of this base sequence : 40626
ggtctgaatcaatttaacagtaaggcagagagagacagagagagagagagagagagagagagagagtgtgtgtgtgtgtgtgtgtgtgtgtgtgtagactgtatattctcatgacaaatggaacctgtcactttgaacttcaagattcta

SEQ ID NO: 6209 - DNA, 286 bp, Homo sapiens
  AC008120.17_105728
  Located on chromosome 3
  Distance between a terminus base of telomere on chromosomal short arm and 5'-terminus of this base sequence : 180656039
  Distance between 3'-terminus of neighbour sequence of sequence listing upward to telomere on chrosomal short arm and 5'-terminus of this base sequence : 341391
attacagtttccacaaagcaccacgaattgggatcattaagaatacccagatgctgtatcccaggcttcagggcttaaacatgtacttcagattttcaggttgttttgtttgtttgtttgtttgtttgtttgtttttgtctttgttttcagtttcaatgatctatctccaaatgagatactctgagtgtttgagctttgcacctatctatgaaatttactttaagtaggttccttattcaatgctgaaaattaggtcagctagaacttctagtccatttgacttct

SEQ ID NO: 6210 - DNA, 275 bp, Homo sapiens
  AC068637.6_150394
  Located on chromosome 3
  Distance between a terminus base of telomere on chromosomal short arm and 5'-terminus of this base sequence : 180719892
  Distance between 3'-terminus of neighbour sequence of sequence listing upward to telomere on chrosomal short arm and 5'-terminus of this base sequence : 63567
tccttctgactgcaaagactagaatattttgatcaattttgagatttaaagagaatatttaggttattatagaactaagtctttttctctttctttcttttcttctatttatttatttatttatttatttatttatttatttttgagatagggtctcactctgtcgcccaggccggagtgcaatagtgtgatctcggcttagtgcaacctctgattcctgggctcaaatgatccccccatttcagcctcctaagtagctggaactacaatcatgt

SEQ ID NO: 6211 - DNA, 272 bp, Homo sapiens
  AC008120.17_41868
  Located on chromosome 3
  Distance between a terminus base of telomere on chromosomal short arm and 5'-terminus of this base sequence : 180719893
  Distance between 3'-terminus of neighbour sequence of sequence listing upward to telomere on chrosomal short arm and 5'-terminus of this base sequence : -274
ccttctgactgcaaagactagaatattttgatcaattttgagatttaaagagaatatttaggttattatagaactaagtctttttctctttctttcttttcttctatttatttatttatttatttatttatttatttatttttgagatagggtctcactctgtcgcccaggccggagtgcaatagtgtgatctcggcttagtgcaacctctgattcctgggctcaaatgatccccccatttcagcctcctaagtagctggaactacaatcat

SEQ ID NO: 6212 - DNA, 468 bp, Homo sapiens
  AC008120.17_24833
  Located on chromosome 3
  Distance between a terminus base of telomere on chromosomal short arm and 5'-terminus of this base sequence : 180736725
  Distance between 3'-terminus of neighbour sequence of sequence listing upward to telomere on chrosomal short arm and 5'-terminus of this base sequence : 16560
acatcacttgagtaattagcaaactgtatctcttttgagacagcaatttatttaactttcctcattttgtgcctttaacttacccacaggatgttgtttgaatataccgtcagtaatcaaaaagtgtatgcaagtatatatctctctaccaggtctgaagacatgttatttgcttggtcagttggccttaataaagacagctgctatcagtttttcctaatataaaacccagcgtcgtcctctaaattcactctaatgatcagttagtttcagatgatgatatggatggatggatggatggatagatagatagatagatagatagatagatagatagatagatatagatagatagaaagatagatagatgatagataacatacacatgaaatacactagaatcaggagtaagagaaattcagtgctgaagggcaaaaatggagcttgactgagtaatcttggacgttt

SEQ ID NO: 6213 - DNA, 318 bp, Homo sapiens
  AC068637.6_13414
  Located on chromosome 3
  Distance between a terminus base of telomere on chromosomal short arm and 5'-terminus of this base sequence : 180736872
  Distance between 3'-terminus of neighbour sequence of sequence listing upward to telomere on chrosomal short arm and 5'-terminus of this base sequence : -321
accaggtctgaagacatgttatttgcttggtcagttggccttaataaagacagctgctatcagtttttcctaatataaaacccagcgtcgtcctctaaattcactctaatgatcagttagtttcagatgatgatatggatggatggatggatggatagatagatagatagatagatagatagatagatagatagatatagatagatagaaagatagatagatgatagataacatacacatgaaatacactagaatcaggagtaagagaaattcagtgctgaagggcaaaaatggagcttgactgagtaatcttggacg

SEQ ID NO: 6214 - DNA, 103 bp, Homo sapiens
  DISO7_10001297
  Located on chromosome 3
  Distance between a terminus base of telomere on chromosomal short arm and 5'-terminus of this base sequence : 180873903
  Distance between 3'-terminus of neighbour sequence of sequence listing upward to telomere on chrosomal short arm and 5'-terminus of this base sequence : 136713
acattctgtgttgggtcttgaaacatggctgtgtgtgtgtgtgtgtgtatgtgtgtgtgtacacgcacatttactctcttggaagaacttactgcatgtgtag

SEQ ID NO: 6215 - DNA, 443 bp, Homo sapiens
  AC069427.6_93937
  Located on chromosome 3
  Distance between a terminus base of telomere on chromosomal short arm and 5'-terminus of this base sequence : 181122744
  Distance between 3'-terminus of neighbour sequence of sequence listing upward to telomere on chrosomal short arm and 5'-terminus of this base sequence : 248738
tggttattaaccaactgaatctacttcttttccaactctggtggtgacaaatatttaggtaaaaggtataaaagttactagaaaacacttgaagtttcagcttacatacaacgtattgacacttaggttgaaactcaaatttataaaaacccagaaagatttattccatacttaatccacttctcttttctttatttcaaaaagtccagttttgaaatatagttgagccctatttgaaatataaatgggagagtcactactatatatatatatatatatatatatatatatatatatatatatatatgtatatatatatatatatatatatatatatatatgtatatatatatatatatatatatatgatgatatattgccttcttctattaaaatactttaaaagtaacaaattaaattatctttaacaaatcttgaggtca

SEQ ID NO: 6216 - DNA, 457 bp, Homo sapiens
  chr3.fa.O7frz.199713015
  Located on chromosome 3
  Distance between a terminus base of telomere on chromosomal short arm and 5'-terminus of this base sequence : 181229558
  Distance between 3'-terminus of neighbour sequence of sequence listing upward to telomere on chrosomal short arm and 5'-terminus of this base sequence : 106371
ggttccagaaattccaaatggttaaaaatacatatacattacacacacacacacacacacacacacacacacacacaccagaagttctgttaatttcttactctatctacctaaaatctgcttatctatattatctatctatctataacaactatattagtgaactgaagtttttatagtatttgatacttttcatagtttttaaattaggtttatttctttgtaaattattctgatattttaattatatacagtttttaaataaagcatactaaaactacaaaaaagtggttatgtttaattttggcattctcacctgtggtacaatttcaattaatcctgaatttttacttaaatggacattgggcttccttctacctgtatctctctctatctcctctttaaggtcaataattcttagatttgcccttttgaggctactttctagatcctgtag

SEQ ID NO: 6217 - DNA, 188 bp, Homo sapiens
  DISO7_10009789
  Located on chromosome 3
  Distance between a terminus base of telomere on chromosomal short arm and 5'-terminus of this base sequence : 181357103
  Distance between 3'-terminus of neighbour sequence of sequence listing upward to telomere on chrosomal short arm and 5'-terminus of this base sequence : 127088
tgaatgtaatcacccagcactttaaattcgtgtgatattaaaagaaaagttatggttttacaccaacatctatatctgtatgtatgaattctaaccattatagatagtactagaagaaacacactcacgtgcgcgcacacacacacacacacacacacacacacacacacggaggataaggcttctct

SEQ ID NO: 6218 - DNA, 209 bp, Homo sapiens
  chr3.fa.O7frz.200271872
  Located on chromosome 3
  Distance between a terminus base of telomere on chromosomal short arm and 5'-terminus of this base sequence : 181674074
  Distance between 3'-terminus of neighbour sequence of sequence listing upward to telomere on chrosomal short arm and 5'-terminus of this base sequence : 316783
tacgcaacataatgatttcatatatgtagacattgtataattaccacaatcaaattaattaacacattcatcactacccatagttactctgtgtgtgtgtgtgtgtgtgtgtgtgtgtgtgtgtgtggtaaggacactgttctcttaccaaatttcaagtaaataataaaatattattaaccatagtcacgaatttgtacattagattc

SEQ ID NO: 6219 - DNA, 166 bp, Homo sapiens
  chr3.fa.O7frz.200526818
  Located on chromosome 3
  Distance between a terminus base of telomere on chromosomal short arm and 5'-terminus of this base sequence : 182010090
  Distance between 3'-terminus of neighbour sequence of sequence listing upward to telomere on chrosomal short arm and 5'-terminus of this base sequence : 335807
gtattcatattgaaggagcattataaactgtaattatacattctttcatgcacaaacatttaagtacacacacacacacacacacacacttagtattgtatatatttgtgtattatatattatatatttatttcttgatttattctactggagaccttaggatgtt

SEQ ID NO: 6220 - DNA, 192 bp, Homo sapiens
  DISD22_0003112
  Located on chromosome 3
  Distance between a terminus base of telomere on chromosomal short arm and 5'-terminus of this base sequence : 182161961
  Distance between 3'-terminus of neighbour sequence of sequence listing upward to telomere on chrosomal short arm and 5'-terminus of this base sequence : 151705
gccatatcaaactgagtgactcatttaacattttaattatttttatttttctagaaatatatatttatatatgcgcatgtggtgtgtgtgtgtgtgtgtatatatatatatatatatatatatatatatatatatatatatgtatgaaaatgctttatatatataacattgtcatagattcctggacaacat

SEQ ID NO: 6221 - DNA, 314 bp, Homo sapiens
  AC068566.2_160276
  Located on chromosome 3
  Distance between a terminus base of telomere on chromosomal short arm and 5'-terminus of this base sequence : 182357696
  Distance between 3'-terminus of neighbour sequence of sequence listing upward to telomere on chrosomal short arm and 5'-terminus of this base sequence : 195543
gtactcagtctgaaactaaaccactggctctcgtgggtcttcagcttgcagatcacacatcatgggacttctcaagcttcataatcacaggatccaagtctctctatatatctatatctatagatagatatccatatatcaatctctatatatctgtaaaaatatagagagatatatctatgtgtctatgggtatatatgtatacacacacacacacacacacacacacacacatctatatccgtttctcttcctgttagtctacagaatccttactaatacactaatcacttacagactcagtgctattccta

SEQ ID NO: 6222 - DNA, 101 bp, Homo sapiens
  DISO7_10001301
  Located on chromosome 3
  Distance between a terminus base of telomere on chromosomal short arm and 5'-terminus of this base sequence : 182383584
  Distance between 3'-terminus of neighbour sequence of sequence listing upward to telomere on chrosomal short arm and 5'-terminus of this base sequence : 25574
ctggctcagttgaaaccagacttacacatttccttttttgtgtgtgtgtgtgtgtgtgtgtttaatagaagttatgagctctaagaatccaacttaaactg

SEQ ID NO: 6223 - DNA, 238 bp, Homo sapiens
  D3S2427
  Located on chromosome 3
  Distance between a terminus base of telomere on chromosomal short arm and 5'-terminus of this base sequence : 182460372
  Distance between 3'-terminus of neighbour sequence of sequence listing upward to telomere on chrosomal short arm and 5'-terminus of this base sequence : 76687
ctcctcgtcactgcagtcttgtttcatttatctcaggttaggtaactcaggtattcgtctctcttgctccactgcaaaaaatatagatagatagatagatagatagatagatagatagatagatagatatggatatagatatagacatagacatagacatagacatagacatagatatagatatagatatagatatagatatagatatagatatatacatcctgaagagatgaggcag

SEQ ID NO: 6224 - DNA, 480 bp, Homo sapiens
  AC068566.2_12723
  Located on chromosome 3
  Distance between a terminus base of telomere on chromosomal short arm and 5'-terminus of this base sequence : 182489702
  Distance between 3'-terminus of neighbour sequence of sequence listing upward to telomere on chrosomal short arm and 5'-terminus of this base sequence : 29092
cataactgctagaatggctataacaaaaaaagactaaagataacaagtgttggcaaggatctgggaaagagagaacacttgtacattgttgatgggaatgtaaattagtacagccaatatggaaaacagtatgaagattcctcataaaattaaaaatggaactgccatataatccagcaatcccgtttcttggcatctgtcaaaaggaaacaaaatcaatatgttagagggatatctgcacgatcatgttcatggcagcattattcacaatagccaagatacagatcaacctaagtgttcattgactgataaatgggtaaggaaaatgtaatacacacacacacacacacacacacacacacacacacacacagagagagagatagaggaacactcttcagccttaaaaaagaagaaaatcttgtcatttctgacaacatggtagaacctggaggacagtacgttgagtgaaataagctg

SEQ ID NO: 6225 - DNA, 114 bp, Homo sapiens
  DISO7_10001306
  Located on chromosome 3
  Distance between a terminus base of telomere on chromosomal short arm and 5'-terminus of this base sequence : 182609686
  Distance between 3'-terminus of neighbour sequence of sequence listing upward to telomere on chrosomal short arm and 5'-terminus of this base sequence : 119504
ttgagctgactcatgtttgtagatatatatatatatatatatatatatatatatataattattaatagtacactatgttccttgaaaaataatagcagttcagttgactgaggt

SEQ ID NO: 6226 - DNA, 292 bp, Homo sapiens
  DISO7_10001305
  Located on chromosome 3
  Distance between a terminus base of telomere on chromosomal short arm and 5'-terminus of this base sequence : 182625459
  Distance between 3'-terminus of neighbour sequence of sequence listing upward to telomere on chrosomal short arm and 5'-terminus of this base sequence : 15659
agaagtgtgcggtcttctgcattttttttttaaaaaaacaaaacaaaacaaaaaaaacttctgaaggaaaagagatacagaagataactatcagtttaattctagttcttattaaaacacacatacacacacacacacacacacacacaaagaatgttaagttgaattattttcctaaataattattttggaacaagaaaatgatgatgacatgtttattatttcctcattcaagatgataaattataacataattcattaatttaactgtctctgaattgctttagttaag

SEQ ID NO: 6227 - DNA, 117 bp, Homo sapiens
  DISO7_10001302
  Located on chromosome 3
  Distance between a terminus base of telomere on chromosomal short arm and 5'-terminus of this base sequence : 182647149
  Distance between 3'-terminus of neighbour sequence of sequence listing upward to telomere on chrosomal short arm and 5'-terminus of this base sequence : 21398
gaagtgcagaacaaatcagtatgtttatgcaaacacacacacacacacacacacacacacacaaacagaacatgactgctatgattttattaagattcagttctccttagtttgaag

SEQ ID NO: 6228 - DNA, 191 bp, Homo sapiens
  DISO7_10001307
  Located on chromosome 3
  Distance between a terminus base of telomere on chromosomal short arm and 5'-terminus of this base sequence : 182733768
  Distance between 3'-terminus of neighbour sequence of sequence listing upward to telomere on chrosomal short arm and 5'-terminus of this base sequence : 86502
gagcaccaatttcaagagaagaaagaaggaaaggaaggaaggaaggaaggggaaaggaggaaaggagggagggaaggaaggaagggagggaggaaggaagggaggaaggaagggagggaggaaggaagggagggaaggaagggaaatttcagggtttttgtctattacaaataagttaggtaacaattcgc

SEQ ID NO: 6229 - DNA, 173 bp, Homo sapiens
  DISO7_10001308
  Located on chromosome 3
  Distance between a terminus base of telomere on chromosomal short arm and 5'-terminus of this base sequence : 182757551
  Distance between 3'-terminus of neighbour sequence of sequence listing upward to telomere on chrosomal short arm and 5'-terminus of this base sequence : 23592
gacaataacagcaaccgatgatttttcatggggaaaaatggaatagcaatactataacaagattccatttttaaaaaaatagaacaaaactccaaaagagacatctgtgtgcttgagtgtgtgtgtgtgtgtgtgtttgagcatgtttgaataagcaaagatgacatcataga

SEQ ID NO: 6230 - DNA, 227 bp, Homo sapiens
  DISO7_10001310
  Located on chromosome 3
  Distance between a terminus base of telomere on chromosomal short arm and 5'-terminus of this base sequence : 182777652
  Distance between 3'-terminus of neighbour sequence of sequence listing upward to telomere on chrosomal short arm and 5'-terminus of this base sequence : 19928
cctcagcaagtagggaactactaaaagttgcattacagtctggatgacagagtgagaccctatttaaaagaagaagaagaagaggaagaagaagaaggaggaggaggaggaggggagggaggagaaaagaaaagaaaaggaggagaaaagaaaagaaaagaaaccacattaaatgattcccatgggtagtgaaaactagtataagcaagcatctattcactttctaa

SEQ ID NO: 6231 - DNA, 227 bp, Homo sapiens
  DISO7_10001312
  Located on chromosome 3
  Distance between a terminus base of telomere on chromosomal short arm and 5'-terminus of this base sequence : 182804691
  Distance between 3'-terminus of neighbour sequence of sequence listing upward to telomere on chrosomal short arm and 5'-terminus of this base sequence : 26812
ccagatgcagatgcatatgtatgtgtgtgtgtgtgtgtgtgtgtctgtctgtctgtctgttacttcattcaatcattaccatgagaaaatactgtgagaaatgtactgttattatctcaatttttcccatgacagaaactgaaggacaaggaagttaagtaacttacaaaagtacaaatatttagtaaaactttataaagtttagcaatcagtaggtgtacattcca

SEQ ID NO: 6232 - DNA, 421 bp, Homo sapiens
  chr3.fa.O7frz.201585748
  Located on chromosome 3
  Distance between a terminus base of telomere on chromosomal short arm and 5'-terminus of this base sequence : 182927606
  Distance between 3'-terminus of neighbour sequence of sequence listing upward to telomere on chrosomal short arm and 5'-terminus of this base sequence : 122688
tgaccagagctgtactgttaactttcctgattttgaggttttgggacttgcagtgagccatgctaccaacttctccccttccccagcttcttacagacagcctgttgtgggactttgcattgtaattgaattgtgtgagccaattctccctaataaactccatagaacatacacacacatacacacacacacacacacacacacacacacacacacacacacacacacgagatatatcttaagaccctttagaattatgctaaatcaactctgcctttgctctataagtgaaaaaacaaagcctgggtaacagcacatctgctttcaacatggtttactgaatattttaagcccactgttgaaacctgttgctcagaaaaaaaatatttctttcaaaatataactgctcattgataatcca

SEQ ID NO: 6233 - DNA, 274 bp, Homo sapiens
  AC019160.5_133174
  Located on chromosome 3
  Distance between a terminus base of telomere on chromosomal short arm and 5'-terminus of this base sequence : 183065062
  Distance between 3'-terminus of neighbour sequence of sequence listing upward to telomere on chrosomal short arm and 5'-terminus of this base sequence : 137035
taatgtagatacttgatggtgcagcaaaccaccgtggcacgtgtatacctatgtaacaaacctgcatgttctgcacatgtatcccagaacttaaagtataataaataataataataataataataataattctgattgcaggagtcttgtgagtttctgttccacaactcagaagcagatttaaaactaattttatataattcaatcctgatcaagagcagggctttcttatcccactatctttctaagtgttccaccttctgttctaacatac

SEQ ID NO: 6234 - DNA, 171 bp, Homo sapiens
  D3S3676
  Located on chromosome 3
  Distance between a terminus base of telomere on chromosomal short arm and 5'-terminus of this base sequence : 183166947
  Distance between 3'-terminus of neighbour sequence of sequence listing upward to telomere on chrosomal short arm and 5'-terminus of this base sequence : 101611
ccattgaagtaaaactgcctcaagtctcatataatgttgctgtaattattcacttctacaatcctcctaaagagtaacttaagaaattagaaacacacacacacacacacacacacacacacacacacacagagagagagagaggtatatcttgttctattgtgtttcact

SEQ ID NO: 6235 - DNA, 397 bp, Homo sapiens
  G08278
  Located on chromosome 3
  Distance between a terminus base of telomere on chromosomal short arm and 5'-terminus of this base sequence : 183219625
  Distance between 3'-terminus of neighbour sequence of sequence listing upward to telomere on chrosomal short arm and 5'-terminus of this base sequence : 52507
gtgaacctcatccaatcagctgaaggctttaataaaatgaagactgatctccctcaaacaagaaggaattctgccaacagagtgcccttgggcttgaactacaactcttcctgggtctgcagcctgcaagccacccctgtcagattttagactcaccagacttccacaatcacactgactgattccttaaaatccatctatctatctatctatctatctatctatctatctatctatctatctatctatcatctatctatctgtctacatcctgttgatctgtttctcttttcctctggagagccctgcctgatagagatgctaaagagaaaacagaaaaaaaggggaagtttagggtcttagcacaattaaactgtaagatgtgaggactcaccca

SEQ ID NO: 6236 - DNA, 475 bp, Homo sapiens
  AC024233.4_153426
  Located on chromosome 3
  Distance between a terminus base of telomere on chromosomal short arm and 5'-terminus of this base sequence : 183279949
  Distance between 3'-terminus of neighbour sequence of sequence listing upward to telomere on chrosomal short arm and 5'-terminus of this base sequence : 59927
aaatacaccagcttaaggctagccttagaattctttttcgcattaatcaaaactttacagaggaaataaacactgggttttttttttttctttttcaccattcattcaaccatttgcaaagagagagagagagagagagagagaagccagaaatctgactggtaagaaattcttaccctttcgccggcatgccaggcttctgggttccctttccctgaccggccctagtgatcctgcctgcagcaccatcgccctgggggccaagcctcatcataaagaaaaattattattttttgttctggctagagcaaaatatgtgtgataaaacatagacattagccactctgcttagcacccaacatcaaaccggcaaggcttaaatttgcccccagataggccccttctttaatccaaccttccacttggagtttcaacatgtcgtccctgggcaagatggtcatcctgagtaatagaa

SEQ ID NO: 6237 - DNA, 238 bp, Homo sapiens
  chr3.fa.O7frz.202113843
  Located on chromosome 3
  Distance between a terminus base of telomere on chromosomal short arm and 5'-terminus of this base sequence : 183446315
  Distance between 3'-terminus of neighbour sequence of sequence listing upward to telomere on chrosomal short arm and 5'-terminus of this base sequence : 165891
ggtgatatctgattcctaggacttttgtgaggttggaatgcacgtaaaaatgcaaatgtgctttaaagttcaaatacacacacacacacacacacacacagacacgcatacagtcatgtgtggcataatgatgtttcagtcaacaatgaagcacatagtggtcccaaaagatataatagagctgaaaaattcctgtcacctagtgacatcacagctgtcctaacatcacagcataatg

SEQ ID NO: 6238 - DNA, 446 bp, Homo sapiens
  chr3.fa.O7frz.202347813
  Located on chromosome 3
  Distance between a terminus base of telomere on chromosomal short arm and 5'-terminus of this base sequence : 183715767
  Distance between 3'-terminus of neighbour sequence of sequence listing upward to telomere on chrosomal short arm and 5'-terminus of this base sequence : 269214
tgattgttgagcctgaaatgtatgtttataaggctccatttctctttctttctttcttccttttttcctttctttctctcgttctctccttctttctttctttctttctttctgtctttcttttttgacatggtgtcttgctctgtcgcccaggctggagggcagtggcacaatctcggctcactgcaacctctgcctctcgggttcaagccatcctcctgcctcagcctcccaagtagctgggattacaggcatgcaccactactcccagctaatttttgtatttttagtagagacggggcttcaccatattgcccaggctggtctcgaactcctgacctcaagtaatctgcccaccttggcctcccatagtgctgagattgcaagtgtgagccaacgtgcctggccatcaggctccatttctatttgtaactgccaactagaaa

SEQ ID NO: 6239 - DNA, 129 bp, Homo sapiens
  DISD22_0003114
  Located on chromosome 3
  Distance between a terminus base of telomere on chromosomal short arm and 5'-terminus of this base sequence : 183866515
  Distance between 3'-terminus of neighbour sequence of sequence listing upward to telomere on chrosomal short arm and 5'-terminus of this base sequence : 150302
gctggagtatagaatgcttgacaaagagagatagatggatagacacacacacacacacacacacacacacacacacacacacacacagaaagagagagagattgaagggggcaggctgagattctgaga

SEQ ID NO: 6240 - DNA, 427 bp, Homo sapiens
  AC026317.10_114914
  Located on chromosome 3
  Distance between a terminus base of telomere on chromosomal short arm and 5'-terminus of this base sequence : 183948672
  Distance between 3'-terminus of neighbour sequence of sequence listing upward to telomere on chrosomal short arm and 5'-terminus of this base sequence : 82028
atttaactaagcatcctgcattttatgtggcaacccatctgggactgttctgtcactgtaaagcacgtgcttatattctttgctcttctgcctaacactgagctccaccatggctaaggctgcaaagaaacacacacacacacacacacacacacacacacgcacacacttggtagctatgtaaataccaactagcgcagcccaggaagacatcccatgtgggtgttttgtcctgggctggtctttcccagcaactcctccctcccactcagtgcttgctgactgaggagctgcccatagcttggctctccttctcctccctatcatcagtatttccctccctgatagcaaacactccagtcactgcctttcacaatcagtacctggtgcagatgatcctaaggtcagaatgttagagctagaaaga

SEQ ID NO: 6241 - DNA, 386 bp, Homo sapiens
  AC026311.8_72002
  Located on chromosome 3
  Distance between a terminus base of telomere on chromosomal short arm and 5'-terminus of this base sequence : 183948713
  Distance between 3'-terminus of neighbour sequence of sequence listing upward to telomere on chrosomal short arm and 5'-terminus of this base sequence : -386
ggactgttctgtcactgtaaagcacgtgcttatattctttgctcttctgcctaacactgagctccaccatggctaaggctgcaaagaaacacacacacacacacacacacacacacacacgcacacacttggtagctatgtaaataccaactagcgcagcccaggaagacatcccatgtgggtgttttgtcctgggctggtctttcccagcaactcctccctcccactcagtgcttgctgactgaggagctgcccatagcttggctctccttctcctccctatcatcagtatttccctccctgatagcaaacactccagtcactgcctttcacaatcagtacctggtgcagatgatcctaaggtcagaatgttagagctagaaaga

SEQ ID NO: 6242 - DNA, 406 bp, Homo sapiens
  chr3.fa.O7frz.203296039
  Located on chromosome 3
  Distance between a terminus base of telomere on chromosomal short arm and 5'-terminus of this base sequence : 183976650
  Distance between 3'-terminus of neighbour sequence of sequence listing upward to telomere on chrosomal short arm and 5'-terminus of this base sequence : 27551
ctgttatgatctagaaatcaggacaatacatctgccccttttgagaaactatttttcccttcccttattatctcattcaaatgtactcttactctttaatattagccattttatattcagagctctcttcctctttggttttcttcatcgtcaaattgttgtgttactcatttatgtttctcttttcatttgccttctgaaatttaaagatttttcagctgggtatttcaggcttcaatctctggcattgtaaatatcacttgcatggtgaccccagtgaggttaagaaaaggtttactaagtgtgtgtgtgtgtgtgtgtgtgtgtgtgtttgtgtgtgtgtgttggggcgggtagtaacataaaatactttggtattcacctgtcagtgtgcacttaacagaat

SEQ ID NO: 6243 - DNA, 384 bp, Homo sapiens
  AC026355.6_17060
  Located on chromosome 3
  Distance between a terminus base of telomere on chromosomal short arm and 5'-terminus of this base sequence : 184052233
  Distance between 3'-terminus of neighbour sequence of sequence listing upward to telomere on chrosomal short arm and 5'-terminus of this base sequence : 75177
tcatgaagtagagcatcagtattatctgttactggagtcaaaacatatctatctctggacctaactatctatctctccatgtatttaatttccagccagaaatacatatatgcacacacaaatatacactacatatatatatgcacacacaatacatatatatacatatatacacatatattgttaatggatctatatgtatatatgtgtgagcatacatacatacacacacacacacacacacacacacacactaaacgatgcttactccttttgtcattgctctcataataagtcttgtgtttacagctctaacatggcatttattttatttcagtgactgtctacttggttcttcatggctagattctgagtccaggtgat

SEQ ID NO: 6244 - DNA, 262 bp, Homo sapiens
  D3S3511
  Located on chromosome 3
  Distance between a terminus base of telomere on chromosomal short arm and 5'-terminus of this base sequence : 184052271
  Distance between 3'-terminus of neighbour sequence of sequence listing upward to telomere on chrosomal short arm and 5'-terminus of this base sequence : -346
caaaacatatctatctctggacctaactatctatctctccatgtatttaatttccagccagaaatacatatatgcacacacaaatatacactacatatatatatgcacacacaatacatatatatacatatatacacatatattgttaatggatctatatgtatatatgtgtgagcatacatacatacacacacacacacacacacacacacacactaaacgatgcttactccttttgtcattgctctcataataagtcttg

SEQ ID NO: 6245 - DNA, 359 bp, Homo sapiens
  AC026317.10_127779
  Located on chromosome 3
  Distance between a terminus base of telomere on chromosomal short arm and 5'-terminus of this base sequence : 184061469
  Distance between 3'-terminus of neighbour sequence of sequence listing upward to telomere on chrosomal short arm and 5'-terminus of this base sequence : 8936
aagacggagtcttattctagagagttgagagtgtgagcatttactctggggtatgtttctaacaaactctgaaaggtcagcctgcccttcttgaataaaagcgttggtttttaccatatgcatggccctgctgtctctctctccctctttctctttgtgtgtgtgtgtgtgtgtgtgtgtgtgtgtgtgtgtgtgtgtgtgtgaagagttgccgaaataagaagaaaaaaaaatcgggcacttcactgagaatatcttaataatatttgaagttgggcctgtttgttgtctgagtataaagcatacatgatgtagaatgatcaaaacaaaaactgctgtcctattctgaatttgaggtc

SEQ ID NO: 6246 - DNA, 212 bp, Homo sapiens
  G08273
  Located on chromosome 3
  Distance between a terminus base of telomere on chromosomal short arm and 5'-terminus of this base sequence : 184098259
  Distance between 3'-terminus of neighbour sequence of sequence listing upward to telomere on chrosomal short arm and 5'-terminus of this base sequence : 36431
ttgagacatgtaactttttaatacgcttttaaggggtttttgctatctatctatctatctatctatctatctatctatctatctatgtatctatctatctatgtatctacctacctatccatctatctatctgtcagaaaaccaagaaataattttgtttggggtagtaacagttaaagaccaaatagcgttccagatcagaaatgtaagcc

SEQ ID NO: 6247 - DNA, 184 bp, Homo sapiens
  D3S1754
  Located on chromosome 3
  Distance between a terminus base of telomere on chromosomal short arm and 5'-terminus of this base sequence : 184098281
  Distance between 3'-terminus of neighbour sequence of sequence listing upward to telomere on chrosomal short arm and 5'-terminus of this base sequence : -190
acgcttttaaggggtttttgctatctatctatctatctatctatctatctatctatctatctatgtatctatctatctatgtatctacctacctatccatctatctatctgtcagaaaaccaagaaataattttgtttggggtagtaacagttaaagaccaaatagcgttccagatcagaaatg

SEQ ID NO: 6248 - DNA, 337 bp, Homo sapiens
  chr3.fa.O7frz.203019173
  Located on chromosome 3
  Distance between a terminus base of telomere on chromosomal short arm and 5'-terminus of this base sequence : 184114540
  Distance between 3'-terminus of neighbour sequence of sequence listing upward to telomere on chrosomal short arm and 5'-terminus of this base sequence : 16075
atgaaggtctgagaactaggagtgaggagaacatgtttccactagaaagccactgcagtggctctgcattcaaactaacttgatcagtgccacacttctgtttgctactactgcgctgagaatttcaaggcaaaatcacagtatgtttatagagagaaaaaagaggaaggaaggaaggaaggaaggaaggaaggaaggaagggagggagggagggagggaggggaaagaaagggagggaggaaaggaaggagggagtgaaggagggagaggaaaggaaagaaagaaaaggaaagtgagagaaaagataaagtcctattcaagatttcagagtgaaag

SEQ ID NO: 6249 - DNA, 263 bp, Homo sapiens
  AC012031.10_70899
  Located on chromosome 3
  Distance between a terminus base of telomere on chromosomal short arm and 5'-terminus of this base sequence : 184272556
  Distance between 3'-terminus of neighbour sequence of sequence listing upward to telomere on chrosomal short arm and 5'-terminus of this base sequence : 157679
gtgcaaatgataaagcaaatagggtaaatattaacagataaatctgagtaaatagtatgtcagtgttctttgtactattcttattcttgccaatttttgtaagtttgaaattatttacaagcaaaaggctttttaaaaagggagtgaaagaatgagagagagagagagagagagagagagaatctgtgtaccagtgatgattattatagttcaaaatctgactattttactagctgtgggatctttaacaagctaattgctct

SEQ ID NO: 6250 - DNA, 409 bp, Homo sapiens
  chr3.fa.O7frz.203448015
  Located on chromosome 3
  Distance between a terminus base of telomere on chromosomal short arm and 5'-terminus of this base sequence : 184291899
  Distance between 3'-terminus of neighbour sequence of sequence listing upward to telomere on chrosomal short arm and 5'-terminus of this base sequence : 19080
cttctatgttccaggaatactaaacttgctttctcttgccattactctcttgcacagactatccctatcccaagaatagctcccttacacccttgagtgtgtatgcatacacgtgcacacacacacacacacacacacacccctccagcctggaaagttctgctcagccttctttttcaagttcatccagataccacttcctgagaggtgagggtggggtggctcttttgacctatacccccaacccctgctcatttagagtttctgtggtaggaagtctctaagttggccccagtgatcttttcttaaggaatttcttccctttgatgtgagttgaattaatgaaatataaatgactgaaatacactgaaagtatttcctacttataatgtcacttccaagattaggt

SEQ ID NO: 6251 - DNA, 456 bp, Homo sapiens
  chr3.fa.O7frz.203896193
  Located on chromosome 3
  Distance between a terminus base of telomere on chromosomal short arm and 5'-terminus of this base sequence : 184478393
  Distance between 3'-terminus of neighbour sequence of sequence listing upward to telomere on chrosomal short arm and 5'-terminus of this base sequence : 186085
gaaggcagtcattacttagctacctctggctgattgccatgcaggactgatggtccactgtggtaaaatcctctgattttaaaaaagatgctgaaaatctgagtgtgtgtgtgtgtgtgtgtgtgtgtgcgtgactgcgtgtttgcagggaagagagaaagagaacgaaaggaaaagaaggagaaaggaaaggaggaaggaaagaaggaggaaaaaaggaaacaaggaaagaaaaagaaaagagagatcattataatttgaatataagtagttaatacatttatttatttattcaggtcaactatccacagaaattacaaaaacaaaactttgtgtgctaaatttggtttgagacctctaggttttaaccttttatacctactatgaatttattttcctactctatcccctcttagtcctggcatttggatttcaactttcttaaagtatcttcca

SEQ ID NO: 6252 - DNA, 360 bp, Homo sapiens
  chr3.fa.O7frz.203813418
  Located on chromosome 3
  Distance between a terminus base of telomere on chromosomal short arm and 5'-terminus of this base sequence : 184535729
  Distance between 3'-terminus of neighbour sequence of sequence listing upward to telomere on chrosomal short arm and 5'-terminus of this base sequence : 56880
cattatgcatttcttcataagaacctatagtgttctcatggtttcacataaatatacaaatggttatgttcttaccctaagaattttaggggagtaataaataattttaaatacaaatcttcattggaaaatagctatttacttaaagataaatgaggatgtaagatgaatacacacacagacacacacacacacacacacactattttctcactaatattatctcaagagaaaaattactccatcactgacaaacttcaaggaagaaatacagtttttaaaagaggggaaaatattgactcttcagattaagagggaaaaatattgttttaagaggttaagaataatcactcctaggct

SEQ ID NO: 6253 - DNA, 360 bp, Homo sapiens
  chr3.fa.O7frz.204063395
  Located on chromosome 3
  Distance between a terminus base of telomere on chromosomal short arm and 5'-terminus of this base sequence : 184757063
  Distance between 3'-terminus of neighbour sequence of sequence listing upward to telomere on chrosomal short arm and 5'-terminus of this base sequence : 220974
cttccatcagaagatctactcagaggtgtgttatagtctttccaatgtcccagtctctcagtgggagatatttctcctggccacatctagtcagcaatcttggcaattctccatggttctactgacaaaacaaacaaacaacaacaactatatatatatatatatatatatatatatatatatatatatatacgtatatatatatatatatatatgtatattagtttctaagggagagattttaaaatgattgtccaattatttatttcttcctttaatcctgtttttgctttatatgttttaaggtttgttattaggtgtatacatattcatgattatcatatgttccaaatcgattag

SEQ ID NO: 6254 - DNA, 409 bp, Homo sapiens
  AC024220.10_152181
  Located on chromosome 3
  Distance between a terminus base of telomere on chromosomal short arm and 5'-terminus of this base sequence : 184888550
  Distance between 3'-terminus of neighbour sequence of sequence listing upward to telomere on chrosomal short arm and 5'-terminus of this base sequence : 131127
aatctgaaacttcagttgtatgatataactgaatactatatatataatattcagttagtatatatatatagtatatatatagtattcagttatatatgatatgtatatatagtattcagttttatcatattacatatgatatatatgtctcatatgtatgagatacatatatctgagatatataaataaatatatatttatatatttatatttaggactctcttgaatatatatatatatatatatatatgaggaggaactcttgagtaggtttagtttgctcttggcttctaagaatatgtagactctcagagtttcatatatatatatgagatatatatatcaatatatatattcaagagagtcctaaatataaaacaatttttagacctaagtaccttgaaatgtc

SEQ ID NO: 6255 - DNA, 259 bp, Homo sapiens
  AC021975.4_53862
  Located on chromosome 3
  Distance between a terminus base of telomere on chromosomal short arm and 5'-terminus of this base sequence : 184938856
  Distance between 3'-terminus of neighbour sequence of sequence listing upward to telomere on chrosomal short arm and 5'-terminus of this base sequence : 49897
gcttaggaacatgttgacaacattaaagataggctggatgtactcatgaaaagataaatattaaaaatgagctggaggacaggagggaggctttttgtttttcttctgtgtgtgtgtgtgtgtgtgtgtgtgtgtgtgtgtgtgtgtttagcacatgtcattaggcaaacaaacaatgccattttctgttgctttgtttctgaaacaaaaatggtagtgggtagaagaaatcagcaactttacagtcagaatcagacca

SEQ ID NO: 6256 - DNA, 310 bp, Homo sapiens
  AC021975.4_62713
  Located on chromosome 3
  Distance between a terminus base of telomere on chromosomal short arm and 5'-terminus of this base sequence : 184947682
  Distance between 3'-terminus of neighbour sequence of sequence listing upward to telomere on chrosomal short arm and 5'-terminus of this base sequence : 8567
gtatcttgcacttgatcttcacctcaacagtgaccagcttctttgatatctaataaaaagtttagttggaaggtcatgtgtttagctctaaaaattgtgtccagaacttgaattttgttatttacatgcaaacacacacacacacacacacacacacacacacagagagagagagaatgttgtattttgtctccttttgaagttctattttgctggtcgtgtattcagtttgcttggcatactcattttctttctagctgctgaatccccttagatgggttgttattttctttgtcagctgattggtatc

SEQ ID NO: 6257 - DNA, 363 bp, Homo sapiens
  AC021975.4_78186
  Located on chromosome 3
  Distance between a terminus base of telomere on chromosomal short arm and 5'-terminus of this base sequence : 185076761
  Distance between 3'-terminus of neighbour sequence of sequence listing upward to telomere on chrosomal short arm and 5'-terminus of this base sequence : 128769
tcaaataaggttagtggtttctacctcagagagcagtcatgagaattaaatgagatcaaataaggtatataacatgcttagtgtaaagttcagtaaatattagctctccctctctctctctctctctctctctctctctctctctctctctctctctatctctatttctctgggacttagtgaaatgaattacatttaaatacacctttccatgtccaagaaaagaaaatcttgcacaaactaggaatggtacttcagtattaattttaattctctcaaaaatgtaagataattattgtattatgtgttagtaagagtttacccaaattcagatttaaagtagtataaggcagtttcaaatca

SEQ ID NO: 6258 - DNA, 210 bp, Homo sapiens
  Z67051
  Located on chromosome 3
  Distance between a terminus base of telomere on chromosomal short arm and 5'-terminus of this base sequence : 185146100
  Distance between 3'-terminus of neighbour sequence of sequence listing upward to telomere on chrosomal short arm and 5'-terminus of this base sequence : 68976
gcggattcagaggacaggacagaacacttgggcaagtgaatctctgtctgtctgtctgtctctctgtctcattggttggttgatttccattttcttaaggggcacatagctcacaccgtacacacacaagcacacacacacacacacacacacacacgcacacgcacacacgcacacacactccttccttctgcgagttagaacattagt

SEQ ID NO: 6259 - DNA, 226 bp, Homo sapiens
  Z66727
  Located on chromosome 3
  Distance between a terminus base of telomere on chromosomal short arm and 5'-terminus of this base sequence : 185224677
  Distance between 3'-terminus of neighbour sequence of sequence listing upward to telomere on chrosomal short arm and 5'-terminus of this base sequence : 78367
aacaaaactgggggaatcacattaccccagttttttatacacacacacacacacacacacacacacagacatataaatttgcacgtgtttaatttttacagtttacatatacatacctcaatatgtaatatatacatatatataaactgtaaaaattaaactaagtgatttaaaaaatacaatagtattttatctttataaagtgaaggtggattttctgttgctg

SEQ ID NO: 6260 - DNA, 413 bp, Homo sapiens
  chr3.fa.O7frz.204691620
  Located on chromosome 3
  Distance between a terminus base of telomere on chromosomal short arm and 5'-terminus of this base sequence : 185396196
  Distance between 3'-terminus of neighbour sequence of sequence listing upward to telomere on chrosomal short arm and 5'-terminus of this base sequence : 171293
tctgacagtcttgtaaggacacattgaaaatctttgtaaatctgttagaactgtaattttcatgttgcagttctcaagtcttacaccaagtggtgccacatactaaatggtaaccaacggagctgcttttgatgatcaagcatatccagagtttatctagtccaaactttgagtagcccaacttagccactttgtttttcctgttattgctaatgagagtttaaaacaacctcaaaggtgtacttatttgtaataattgctaatcacacacacacacacacacacacacacacacacacacacacacaaaacaatctccttgctggggcaaggtgggggtgaggtgggtcagggtaggtgaacaagactctgtggtgtcttttctggtagactgtatgctctgtgaaggtaga

SEQ ID NO: 6261 - DNA, 412 bp, Homo sapiens
  AC007620.29_137088
  Located on chromosome 3
  Distance between a terminus base of telomere on chromosomal short arm and 5'-terminus of this base sequence : 185650990
  Distance between 3'-terminus of neighbour sequence of sequence listing upward to telomere on chrosomal short arm and 5'-terminus of this base sequence : 254381
gtccactgagaagtcctagaagtgatgacagcacagcttgtggcctttaaatatcatttcccactcaacaaaccaagtttccttggagaaatggaggattccaggtctatgcatatatatacatacacacacacacacacacacacacacacacacacatatacggcaccttgcctttttcattgatattgataagatgatcatgtagaaattgaatcatccttgtcttaggtggtggagatctggagaacatttaatttaacccaaagagattaatttgtaaaatcagaatgcccatttattattttaggtagtgaaataacactacgaaataaactagatattcacactggcattctctgtctgtgggcagatcttgggaagccaaattataagcagaagtagcttctga

SEQ ID NO: 6262 - DNA, 467 bp, Homo sapiens
  AC079618.2_36526
  Located on chromosome 3
  Distance between a terminus base of telomere on chromosomal short arm and 5'-terminus of this base sequence : 185669514
  Distance between 3'-terminus of neighbour sequence of sequence listing upward to telomere on chrosomal short arm and 5'-terminus of this base sequence : 18112
ctcactttacaaatgagcaaacttgaggctttacaaagttaaataggtttcccaaagtataaattcaaatagtttgctcctatcaaaatacaaatttcaaaaagttaaaacatgattttcatacaaatatatagtctaagacttacctacttcatttgtgacaaaaccagctggtttaaagaggaggatagaagattgctgataagtgcgtgtgtgtatgtatgtgtgtgtgtgtgtgtgtgtgtgtgtgtgtgtgtgtacatgtcaccagtagaagaaaagaatgctagataaaattgcagagttatatagagaacagagaactgactaatgtcccacagagcaataaaatcgaaatcttggccaggcgcagtggctcacacccgtaatcccagcactttgggaggctgaggcaggtggatcatgaggtcaggcgatcgagaccatcctggctaacatggtgaaac

SEQ ID NO: 6263 - DNA, 244 bp, Homo sapiens
  D3S3699
  Located on chromosome 3
  Distance between a terminus base of telomere on chromosomal short arm and 5'-terminus of this base sequence : 185720641
  Distance between 3'-terminus of neighbour sequence of sequence listing upward to telomere on chrosomal short arm and 5'-terminus of this base sequence : 50660
gacctttgttagatacatagtttgcaaatattttctcctattctgtaggttgtttgcttactctgttgatagaaattaatgtgtatccagcaaaagaaactaagagtaaaattatatgagtcataatttactatgagagggatcatatctaacaggttttttaaaaattattttatttatatcatatacacacacacacacacacacacacacacacacacattttaaagacagggttggctgg

SEQ ID NO: 6264 - DNA, 399 bp, Homo sapiens
  chr3.fa.O7frz.207902683
  Located on chromosome 3
  Distance between a terminus base of telomere on chromosomal short arm and 5'-terminus of this base sequence : 185778299
  Distance between 3'-terminus of neighbour sequence of sequence listing upward to telomere on chrosomal short arm and 5'-terminus of this base sequence : 57414
gctattgtttattgagtccaatatgcagcaaacatgaactaaacactttgtatattttatcttatttatttatttatttatttatttttgagacagaatcttgctctgttgccaggctggattgcagtggcacgatttcagctcactgtaacctccgactccctggttcaagcgattctcctgcctcagcctcccgagtaactgggattacaggcatgcactgccacgcccagctgatttttgtatttttgatagagatggggtttcacatgttggccaggatggtcttgatctcctgacctcgtgatacgccggcctcagcctcccaaagtgctgagattacaggcatgagccaccacgcctggccatttatttctttagaataggcttcagtgtaga

SEQ ID NO: 6265 - DNA, 471 bp, Homo sapiens
  chr3.fa.O7frz.208394017
  Located on chromosome 3
  Distance between a terminus base of telomere on chromosomal short arm and 5'-terminus of this base sequence : 185810226
  Distance between 3'-terminus of neighbour sequence of sequence listing upward to telomere on chrosomal short arm and 5'-terminus of this base sequence : 31528
tcctatcacaaattactgacaaacaaaccatatatgtgcatatatgtacatggttagtttctgggtggcgataaagggaagctttccctacatacgttattttttccaaaaatgttttcctatattgtacatataattacattttatttttagaatcgatggaatgcaagcacttgtgtgcttttagaggtaaaatttttaaataagggaacaaggttcagaggctctgaaaactcagagtatgcattttggaactgagaaatgctgaaagaaggcttcagtaaaattctgcagtgagaagtctgtccatggtctttcctcatctcaatataaaagaggctccccaaggctttggtggacttccttttccgctgtgtgtgtgtgtgtgtgtgtgtgtgtgtgtgtgtgtgtgtgttttctccctcactctctgtttgtcccagaacactagattaagaatgagttaggcct

SEQ ID NO: 6266 - DNA, 335 bp, Homo sapiens
  AC069201.3_131114
  Located on chromosome 3
  Distance between a terminus base of telomere on chromosomal short arm and 5'-terminus of this base sequence : 185834232
  Distance between 3'-terminus of neighbour sequence of sequence listing upward to telomere on chrosomal short arm and 5'-terminus of this base sequence : 23535
agtctcggccataagaactacagttcctgggcaggtcctggtgctgtgctgggctctgagccagtggacttggggggtcatgcaaccgtatgtgtgtgtgtgtgtgtgtgtgtgtgtgtgtgtgtgtgtgtgtgtgtgtgtgtgtgtgtctattttaagctccccaggtaattttgatgaagattcagctctggaattcctattttggtaatggaaggttacaaagaaatttagcaaagaggggcatgattgggatttttttttttttttttttttttttttttttttttacaaagaccactcctgcatcagagtggaggttagatgaggactag

SEQ ID NO: 6267 - DNA, 331 bp, Homo sapiens
  AC073147.2_17024
  Located on chromosome 3
  Distance between a terminus base of telomere on chromosomal short arm and 5'-terminus of this base sequence : 186075192
  Distance between 3'-terminus of neighbour sequence of sequence listing upward to telomere on chrosomal short arm and 5'-terminus of this base sequence : 240625
aggatgtagaggctacagtgaaccctgatcatgctactgcactccagcctgaatgacagaaggagaccctacctccaaaaagaagaagaagaataagaagaagaagaggaagaggaagaggaagaagaagaagaagaagaggaggaagaagagaaaagaaaaattgtctctacctaaagtattgtaattttaggacaaagagatagatactcccattctgggcttaaaaaataaaatgcatcttccctgaacaaaagagagaggagcttcctctatgcttccccctggattttccttatagccagcagcctaaatgcactgtccactaggt

SEQ ID NO: 6268 - DNA, 442 bp, Homo sapiens
  AC048335.8_100421
  Located on chromosome 3
  Distance between a terminus base of telomere on chromosomal short arm and 5'-terminus of this base sequence : 186164564
  Distance between 3'-terminus of neighbour sequence of sequence listing upward to telomere on chrosomal short arm and 5'-terminus of this base sequence : 89041
ctcctaaaggacttcttactgaacatggaatttcatgcatccctctttcctctagggccacaagcagcctccaagtcaaatttctgaccccctgttaacaaacattcaagatgatatcaagtttctttcagtttgctcatattaccccagatttatttatctcattcgctgtgtgaaaatcattcattttagctttatatttataatatgcaaataaatctttatgggctatgatgagattcacagttagatgaatcaaacatgaatcaaaatgatcaaagtacattggaaagtctcaactgctacagaaataaattcacacacacacacacacacacacacacacacagtctctcatgctcaccgttgctcgtagtgcctgaatagcctgatttcgctgaaatcccatggaggtgatgatagctacgatttcctctggagg

SEQ ID NO: 6269 - DNA, 235 bp, Homo sapiens
  AC007687_113597
  Located on chromosome 3
  Distance between a terminus base of telomere on chromosomal short arm and 5'-terminus of this base sequence : 186178688
  Distance between 3'-terminus of neighbour sequence of sequence listing upward to telomere on chrosomal short arm and 5'-terminus of this base sequence : 13682
gtcaccaagtcctcaactgcaccaaaaaaacaacaaactctgtctgatattttatatatatacatatatatatatatatatacacacatatatatatatatatacacacacatatatatatttattattattattattattttgagacagagttttgctcttgttgcacaggctggagtgcaatggcgtgatctcgggtcactgcaacctctgcctcccggattcaagtgattct

SEQ ID NO: 6270 - DNA, 132 bp, Homo sapiens
  D3S3603
  Located on chromosome 3
  Distance between a terminus base of telomere on chromosomal short arm and 5'-terminus of this base sequence : 186458323
  Distance between 3'-terminus of neighbour sequence of sequence listing upward to telomere on chrosomal short arm and 5'-terminus of this base sequence : 279400
gaccagtggcagcatcaagaggtggggaagtagcaaccctccaggagtactgccgtgtgtgtgtgtgtgtgtgtgtgtgtgtgtgtgtgtgtgtgtgtttgagatggagtctcgctctgtcacccacactgg

SEQ ID NO: 6271 - DNA, 218 bp, Homo sapiens
  AC068760.7_68574
  Located on chromosome 3
  Distance between a terminus base of telomere on chromosomal short arm and 5'-terminus of this base sequence : 186622671
  Distance between 3'-terminus of neighbour sequence of sequence listing upward to telomere on chrosomal short arm and 5'-terminus of this base sequence : 164216
ataaatgttaagatgctgacaaacaccacaaatacgaaatccagaaatatagtaagatacacacacacacgcacacacacacacacacacacacgcacacacatacattttaattatccaaagtccatagtttatattagggctaattcttggtgttgtacattctatgggtttggacaaatgtataatgatatgtagtcagaattagagtagcatgc

SEQ ID NO: 6272 - DNA, 188 bp, Homo sapiens
  DISO7_10001315
  Located on chromosome 3
  Distance between a terminus base of telomere on chromosomal short arm and 5'-terminus of this base sequence : 186968498
  Distance between 3'-terminus of neighbour sequence of sequence listing upward to telomere on chrosomal short arm and 5'-terminus of this base sequence : 345609
aactctgcttacctgtcatccttttctttctccctttaatctctctttctttatacacacacacacacacacacacacacacacacacacatacacacgtatataatatataaaatatacatgtatgcatatgtaaatatgtaactgaataatagcaaatatattgagaatatgactgctgctatgtg

SEQ ID NO: 6273 - DNA, 349 bp, Homo sapiens
  chr3.fa.O7frz.206066542
  Located on chromosome 3
  Distance between a terminus base of telomere on chromosomal short arm and 5'-terminus of this base sequence : 186994588
  Distance between 3'-terminus of neighbour sequence of sequence listing upward to telomere on chrosomal short arm and 5'-terminus of this base sequence : 25902
tttctattcctgagttacttcacttagagtaatggtctccaattccatctaggttgttgcaaatgccgttattttattccttttcatggctgagtagtattccatggggtgtgtgtgtgtgtgtgtgtgtgtgtgtgtgtgtctcacattttctttatccattcattgattgatgggcatttgagctggttccatatttttgcgattgcaaattgtgctgctataaacatgtgtgtgcacatatcttttttgtataatgacctcttttcttttgggtagatacccaggagtgggactgctggatcaaacggtagatctacttttggttatttaaggaatcttcacagtg

SEQ ID NO: 6274 - DNA, 449 bp, Homo sapiens
  AC068638.9_52032
  Located on chromosome 3
  Distance between a terminus base of telomere on chromosomal short arm and 5'-terminus of this base sequence : 187080406
  Distance between 3'-terminus of neighbour sequence of sequence listing upward to telomere on chrosomal short arm and 5'-terminus of this base sequence : 85469
atgcaatataatggtaacattcacaagatgattacaggatttgcaaaaagattttaattcataatacacaacaggtgatgttgaattttgtgtctcctgggtctctcccacccctgtattagggttctccagagaaatggaaccaatgggggtggggggagagagagagagagagagagagagagagagagagagagagagagaagagagaagagagagagagaactttatttctttatttatttagagatggattttcgctcttgttgcccaggctggagtgcaatggtgcaatctcagctcactgcaacctctgcctcccagttcaagcgattctcctgcctcagtctcccaagtagctgggattacatgcccagctaattttttgtatttagtagagactgggtttcaccatgttagtcaggctggtctcaaattcctgacttcaa

SEQ ID NO: 6275 - DNA, 280 bp, Homo sapiens
  DISO7_10001313
  Located on chromosome 3
  Distance between a terminus base of telomere on chromosomal short arm and 5'-terminus of this base sequence : 187245640
  Distance between 3'-terminus of neighbour sequence of sequence listing upward to telomere on chrosomal short arm and 5'-terminus of this base sequence : 164785
aggtatgtaagcacttagggaagagaaatatatatatatatatatatatatatatatatatatataattgtaaactattgttagtatatgaagcttttttcaaagaaatatgcaattcacaaattgactttttcttagtgtttactttgaacaaggtagatagctttttgtctatcttaaatgtttagttctcagatttgttatagccaaattatttgaaacttggagggttaaagtgccctttgatgccattaaatcagtacaaatattcagctggcaa

SEQ ID NO: 6276 - DNA, 159 bp, Homo sapiens
  DISO7_10001314
  Located on chromosome 3
  Distance between a terminus base of telomere on chromosomal short arm and 5'-terminus of this base sequence : 187335432
  Distance between 3'-terminus of neighbour sequence of sequence listing upward to telomere on chrosomal short arm and 5'-terminus of this base sequence : 89512
aatctgtctatgactcaccagcgtgtgtgtgtgtgtgtgtgtgtgtgtgtgtgtgtggtggtggtggtggtggtgtgtgtgtgtgtccttaaggaatgtttttggccaaatggtgcttaaaaatactgacaatattttacctcagcttgaatcttgtga

SEQ ID NO: 6277 - DNA, 369 bp, Homo sapiens
  chr3.fa.O7frz.206365902
  Located on chromosome 3
  Distance between a terminus base of telomere on chromosomal short arm and 5'-terminus of this base sequence : 187629612
  Distance between 3'-terminus of neighbour sequence of sequence listing upward to telomere on chrosomal short arm and 5'-terminus of this base sequence : 294021
actagtccagcatcagtatcatactctttcaattattattattatgtaatgtgttgtttagtaaaagacatttctccacgtcatttaaaaaacaaccttttttgaccctgggcaacatggtgaaatgtaatcatttcccagaagccccaatttcctattggaaaacagtgtcagaaatatttcttctttagttacatctgtttcatttttaaatagttctatttctacaaaacacacacacacacacacacacacacacacacacacacacactagccagatatggtggcatgcagctctagccccagctactcaggaggctgaggtgggaggatcacccgagcccaagaagtcgaagttgcagtgaac

SEQ ID NO: 6278 - DNA, 416 bp, Homo sapiens
  chr3.fa.O7frz.206225164
  Located on chromosome 3
  Distance between a terminus base of telomere on chromosomal short arm and 5'-terminus of this base sequence : 187742997
  Distance between 3'-terminus of neighbour sequence of sequence listing upward to telomere on chrosomal short arm and 5'-terminus of this base sequence : 113016
taaattggttgtggtaatctttacataatgtacacatataccaaattatcacagtgtacaacctgaatatatcccattttgtttgtctattaaacattttaaattttaaaaaatataaaaaataaaatgtattacagtattttgtaaaataaagtgaatcgtgcatttgataaaaatactcaggtagtaaagaaaggctaaaagtaaaatctctttcttccaatccctcctcccaacaaagagtgccactccccagagataactatggttagtagtatcttgtatttatcctttccaataaaaatgtctatcatatatatatatatacacacacacacacacacacacacacacacacatatacatatactttttattttttattgattccagggtacctgtgcaggtttgttata

SEQ ID NO: 6279 - DNA, 146 bp, Homo sapiens
  DISD22_0003116
  Located on chromosome 3
  Distance between a terminus base of telomere on chromosomal short arm and 5'-terminus of this base sequence : 188032682
  Distance between 3'-terminus of neighbour sequence of sequence listing upward to telomere on chrosomal short arm and 5'-terminus of this base sequence : 289269
aattgtgatcaccaggttaaagaaattgattatttcaaatctcatatttgctgtgtgtgtgtgtgtgtgtgtgtgtgtgtgtgtgtgtagtttaaaggctgctttccctcggtcattatgttttacactgccacttcattcttcct

SEQ ID NO: 6280 - DNA, 348 bp, Homo sapiens
  AC007547.18_107546
  Located on chromosome 3
  Distance between a terminus base of telomere on chromosomal short arm and 5'-terminus of this base sequence : 188115640
  Distance between 3'-terminus of neighbour sequence of sequence listing upward to telomere on chrosomal short arm and 5'-terminus of this base sequence : 82812
ggtgacatcagtaaagatcctaagtataagcattaaagaataatagaataagaaaggaattttatgggaaacttcatgtcagtaaatttgacaccttagatgatattaacaaattattattattattattattattattattattattattattattttgagatggagtcttgctctgtcgcccaggctggggtgcagtggcatgatcttggctcactgcaacctccacctcctgggttcaagcgattctcctgcctcacccttccaagtagctgggactacaagtgggtgaccccatgcctggctaatttttgtatttttagtagagaaggagtttcaccatgttgg

SEQ ID NO: 6281 - DNA, 299 bp, Homo sapiens
  AC007547.18_158212
  Located on chromosome 3
  Distance between a terminus base of telomere on chromosomal short arm and 5'-terminus of this base sequence : 188118138
  Distance between 3'-terminus of neighbour sequence of sequence listing upward to telomere on chrosomal short arm and 5'-terminus of this base sequence : 2150
cctgaggtcaggagttcaagaccagcctagccaacatagtgaaaccccgtctctactgaaaatacgaaaattagcagagcatggtggtgcccacctgtaatctcagctactcgggaggctgaggcaggagaatccaggatgattctgttgaacccaggaggcagaggttgcactgagccaaggtcacaccactgcactccagcctgggttccagaacaagactgtctcaaacaaacaaacaaacaaacaaacaaacaaaaccatatatatatatgtatatggaatctcgacaaagattt

SEQ ID NO: 6282 - DNA, 394 bp, Homo sapiens
  chr3.fa.O7frz.206808896
  Located on chromosome 3
  Distance between a terminus base of telomere on chromosomal short arm and 5'-terminus of this base sequence : 188166468
  Distance between 3'-terminus of neighbour sequence of sequence listing upward to telomere on chrosomal short arm and 5'-terminus of this base sequence : 48031
tacgcaaataccatagactgagtagcctgaacagtgaacatttatttctctccatgttggaagctgaaagtctgagatcatggtgccagcttggtctggttcttggtgagggccttcttcctggttatatcctcgtgtggtctttccttggtacctgcatgcacagaggggggggggggagagaaagagagagagagagagagagagagagagggagggagggagagctcttccttcttttataagggcattaatctcatcatggggaccttgccctcatgaccttatctaaacctaataacctcccaaaggttccacctccaaataccatcacattggggattagggcttcaacttatgaattttggaagtatacaaacattcagtccatacc

SEQ ID NO: 6283 - DNA, 146 bp, Homo sapiens
  Z66601
  Located on chromosome 3
  Distance between a terminus base of telomere on chromosomal short arm and 5'-terminus of this base sequence : 188181746
  Distance between 3'-terminus of neighbour sequence of sequence listing upward to telomere on chrosomal short arm and 5'-terminus of this base sequence : 14884
aggcctcatatcattttggtactaggataatgtttttcttaacgtcataacattagtaaaattgatccgtaatggtgtgtgtgtgtgtgtgtgtgtgtgtgtgtgtgtgtgcgatttatgtaatttgagtgttggctaggatagct

SEQ ID NO: 6284 - DNA, 123 bp, Homo sapiens
  DISD22_0003124
  Located on chromosome 3
  Distance between a terminus base of telomere on chromosomal short arm and 5'-terminus of this base sequence : 188292392
  Distance between 3'-terminus of neighbour sequence of sequence listing upward to telomere on chrosomal short arm and 5'-terminus of this base sequence : 110500
gactggagcttcttgtgagacagtgtttgtgtggtgtgtgtgtgtgtgtgtgtgtgtgtgtgtgtgtgtgtgtatgtgtgtgtgtgtctaattacacctcccaaattagcacagaactagatg

SEQ ID NO: 6285 - DNA, 337 bp, Homo sapiens
  HUMUT6562
  Located on chromosome 3
  Distance between a terminus base of telomere on chromosomal short arm and 5'-terminus of this base sequence : 188482519
  Distance between 3'-terminus of neighbour sequence of sequence listing upward to telomere on chrosomal short arm and 5'-terminus of this base sequence : 190004
ggcactaatcccaactgtgacataaaccaattatatcctgaaaaactcttccttccttccttctttccttctttctttctttctctttctttttttctttctttctccttctctctttttctcttccttccttccttccttccttccttccttccttccttccttccttccttccttccttcctttctttctctttctttctttctttctttctttctttctttctttctttctttctttctttctttctttctttctttctgacagagtctcactctgttgcctaggctggagtgcagtggcgcagttttggctcactgcaatctccaattctcct

SEQ ID NO: 6286 - DNA, 416 bp, Homo sapiens
  AC024104.7_115043
  Located on chromosome 3
  Distance between a terminus base of telomere on chromosomal short arm and 5'-terminus of this base sequence : 188518584
  Distance between 3'-terminus of neighbour sequence of sequence listing upward to telomere on chrosomal short arm and 5'-terminus of this base sequence : 35728
catgcttaatctccaaatacagataataacaaaatcattattttgcctaacatgatacaactatcttgaatacaagggaaaaggcgctaatactaatccctcccccaaaagaggaagtgaaagttcttgagtgatgtttattcttcccctgatattccttaaatacaataatataaaaataacagtacttaaatgctgccataaagtcaatacatcttctgttatataataaggaaataagaacagaaagaaaacaaagatatctgtttaatgtgtgtgtatatatatatatatatatatatatatatatatatatatatgtatatacacaagtgtattcataaaaaataaggagaaaattcttatgataattaaagtctcatttatgtaactggtcacatgatcatagctggtat

SEQ ID NO: 6287 - DNA, 214 bp, Homo sapiens
  HUMUT5901
  Located on chromosome 3
  Distance between a terminus base of telomere on chromosomal short arm and 5'-terminus of this base sequence : 188526953
  Distance between 3'-terminus of neighbour sequence of sequence listing upward to telomere on chrosomal short arm and 5'-terminus of this base sequence : 7953
gctgtgctctattgttaagactacaaatcagatgataatgataataataatggtaatgatgacaatggtaatagttaatgcttatccagcacttaatatgtgtcaggtatcattctaaatctatctgtctatctatctatctatctatctatctatctatctatctatctattgctctatctataatctatcattcaaatcccacaacaaacct

SEQ ID NO: 6288 - DNA, 353 bp, Homo sapiens
  chr3.fa.O7frz.207161364
  Located on chromosome 3
  Distance between a terminus base of telomere on chromosomal short arm and 5'-terminus of this base sequence : 188537605
  Distance between 3'-terminus of neighbour sequence of sequence listing upward to telomere on chrosomal short arm and 5'-terminus of this base sequence : 10438
caaagtgctggaaccataggcgtaagccaccatgcctggccctagtcatcttaataaagctacaactaaggccctcttcaacccttgctgcacaataaaaccaccaagagaacttttaaaattaatgaattttaggctttaagagatttttacttatatcatccaggcaggaaccaggcacccatatatgattttgaactgctcactttcctcccttctttccttccttccttccttccttccttccttccttccttccttccttccttccttccctccttccttaaattaagatgaagctcatataatatgaaattaacaattttgaagtgaacaattcagtagcatctagt

SEQ ID NO: 6289 - DNA, 110 bp, Homo sapiens
  DISO7_10001319
  Located on chromosome 3
  Distance between a terminus base of telomere on chromosomal short arm and 5'-terminus of this base sequence : 188624714
  Distance between 3'-terminus of neighbour sequence of sequence listing upward to telomere on chrosomal short arm and 5'-terminus of this base sequence : 86756
ttgctcatgtaggagctccttttttaccgccaatggatgatgtgtgtgtgtgtgtgtgtgtgtgtgtgtgtgtgtgtgtgtgtgtgatctaccaatcatgacacaggatt

SEQ ID NO: 6290 - DNA, 217 bp, Homo sapiens
  Z66718
  Located on chromosome 3
  Distance between a terminus base of telomere on chromosomal short arm and 5'-terminus of this base sequence : 188776225
  Distance between 3'-terminus of neighbour sequence of sequence listing upward to telomere on chrosomal short arm and 5'-terminus of this base sequence : 151401
gcaattcctggtgccacggacctcctatctttcaatgtgaaaacctctccctaatcctggtgtgctctcgttttctctctctctctctctctctctctctctctttctatctctctttttttctctctctctctcacacacagacacacacacacacacacacacacacattatgataacaataatgaaaatgttgcattcttaggaaggcactaca

SEQ ID NO: 6291 - DNA, 363 bp, Homo sapiens
  HUMUT1484
  Located on chromosome 3
  Distance between a terminus base of telomere on chromosomal short arm and 5'-terminus of this base sequence : 188810266
  Distance between 3'-terminus of neighbour sequence of sequence listing upward to telomere on chrosomal short arm and 5'-terminus of this base sequence : 33824
tcccagctactcagaaggctgaggcaggagaatcacttgagtccaggaggcggaggttgtagtgagccgagattgtgccattgcattccagcctgggtgacaagagcgaaactgtctcaaaaaaaagaaagaaagaaagaaagaggaaggaaaaaggaaggaaggaaggtaggaaggaaggaaggagggagggaaggagggagggagggaaagaaggaaggaaggaaggaaggaaggaaggaaggaaggaaggaaggaaggaaggaaggaaggaaggaaggaaggaaaggacagagagagagagaaaaggagagatgggaacctctaaggggtcttgagcacggaagtgttgtgatgggacca

SEQ ID NO: 6292 - DNA, 287 bp, Homo sapiens
  chr3.fa.O7frz.210193652
  Located on chromosome 3
  Distance between a terminus base of telomere on chromosomal short arm and 5'-terminus of this base sequence : 188924036
  Distance between 3'-terminus of neighbour sequence of sequence listing upward to telomere on chrosomal short arm and 5'-terminus of this base sequence : 113407
tcctttattctgttgatgtgatatatcatgtttatcgatttgcaaatgttgaaccacccttgcatccctggtataaatcccactttatcatggttgtttgtttgtttgtttgtttgtttttaatagtttgaggagaattggtgttcttctttgaaagtttggtagaatttggcagtgaagccatctggtcctggacttttctttgtcgggaggattttagttattgattcaatctcattattcattattagtctgtttgggttttctattgctttctgattcaattg

SEQ ID NO: 6293 - DNA, 463 bp, Homo sapiens
  AC036127.2_122000
  Located on chromosome 3
  Distance between a terminus base of telomere on chromosomal short arm and 5'-terminus of this base sequence : 189132671
  Distance between 3'-terminus of neighbour sequence of sequence listing upward to telomere on chrosomal short arm and 5'-terminus of this base sequence : 208348
cttgaggtactcatgaatagacacaatattctgtggttggctgggcacagtggctcacgcctgtaatcccagcaccttgggaggcccaggcgggaggatcacctgaagtcaggagttcaagaccagcctgcccaacatggtgaaaccccgtctctactaaaaatacaaaaattagccaggcatggtggcaggtgcctgtaatcccagctactcgggaggctgaggcagaagaactgcttgaacccgggaggcagaggttgcagtgagccaagatcacatcatcacactccagcctgggggacaagagcgaggcttcacctccaaacaaacaaacaaaaaaactatatatatatatatatatatatatatatattttctgtggtttaagcaacacatttgagagccccagattccctcatctggcccaaacagacagatcgtaaacatcaacttccagattaga

SEQ ID NO: 6294 - DNA, 165 bp, Homo sapiens
  DISO7_10001324
  Located on chromosome 3
  Distance between a terminus base of telomere on chromosomal short arm and 5'-terminus of this base sequence : 189302727
  Distance between 3'-terminus of neighbour sequence of sequence listing upward to telomere on chrosomal short arm and 5'-terminus of this base sequence : 169593
ctacctggtgccagaaccatcctcagggcaggggaatgctcaggaaatagatattgaataaaataagtgtatccatccatccatccatccatccatccatccatccatccatccatccttccatccatccagacatatatacatatgtaaacattctgatggtca

SEQ ID NO: 6295 - DNA, 243 bp, Homo sapiens
  DISO7_10001323
  Located on chromosome 3
  Distance between a terminus base of telomere on chromosomal short arm and 5'-terminus of this base sequence : 189446190
  Distance between 3'-terminus of neighbour sequence of sequence listing upward to telomere on chrosomal short arm and 5'-terminus of this base sequence : 143298
cgaagagaaatgacacaagatagtaattcaaatctataataaggaatgaagaaccccagaaatggtgaataagggggtatgtacacacacacacacacacacacacacacacacatgcacacacacacgtatgtatttctcttaatttgatacatgactatttaaagcaaaaattataataccatagtgggggattaacatatatagatgtgatatttatgataagaatagcacagaggatgg

SEQ ID NO: 6296 - DNA, 140 bp, Homo sapiens
  DISO7_10001321
  Located on chromosome 3
  Distance between a terminus base of telomere on chromosomal short arm and 5'-terminus of this base sequence : 189466807
  Distance between 3'-terminus of neighbour sequence of sequence listing upward to telomere on chrosomal short arm and 5'-terminus of this base sequence : 20374
gcacgtgagtttgcacacatgcacacgtgtgcgcgcacacacacacacacacacacacacattcacagaggaactacatgcccaaaaaggtttatagtgattgattcaaatagaagaaatggggtgattggatcagtcac

SEQ ID NO: 6297 - DNA, 273 bp, Homo sapiens
  AC034274.2_47508
  Located on chromosome 3
  Distance between a terminus base of telomere on chromosomal short arm and 5'-terminus of this base sequence : 189598548
  Distance between 3'-terminus of neighbour sequence of sequence listing upward to telomere on chrosomal short arm and 5'-terminus of this base sequence : 131601
tttcctctgtttctaaggaaagcagaaacagagaacaacaacaacaaaaatggattggtcatttcaaagtcaaaggttaaagcagaagagactttttttatcatgctagctaaaactggcctgtttgggaattggatattttctctctctctctctctctctctctctcccccccacccctcccgcctctcccctactccctttttctctcctgatttctcaaaaagtcagataaataacttagtttcagcttggtagcatggaactttagta

SEQ ID NO: 6298 - DNA, 199 bp, Homo sapiens
  DISO7_00015686
  Located on chromosome 3
  Distance between a terminus base of telomere on chromosomal short arm and 5'-terminus of this base sequence : 189746402
  Distance between 3'-terminus of neighbour sequence of sequence listing upward to telomere on chrosomal short arm and 5'-terminus of this base sequence : 147581
aatcctaggccaatcactgtgccagggaggtggggcacaatgatcagcccagcctaggttaggagtccacccttggctaaagagctgtgcgtgtgtgtgtgtgtgtgtgtgtgtgtgtgtgtgtgtgtgtgtgtgtgtgtttgagagacagagagagagacagaagatagaaaggcggagaggcctgtaatgacgtgag

SEQ ID NO: 6299 - DNA, 413 bp, Homo sapiens
  AC068769.10_95023
  Located on chromosome 3
  Distance between a terminus base of telomere on chromosomal short arm and 5'-terminus of this base sequence : 189927801
  Distance between 3'-terminus of neighbour sequence of sequence listing upward to telomere on chrosomal short arm and 5'-terminus of this base sequence : 181200
catttaaccttccagtaaacaaagagcaagaagcaggagacaacagatgctgtggatttcacaataaaacatcggcatgacaataattgtttatttactttttgagatggagtctcgctctgtcgcccaggctgacgcgatctcggcttagtgcaacctctgcctcccaggttcaagcgattttcttgcctcggcctcccaaagtgctgggattacagacatgagccaccatgcctggtccctatttatttatttatttatttatttatttattgtgttagagacaggctgttgcccaggttgaaaagcgcagtggtacaatcatagctcattgtaaccttgaactcctgggctcaagtgatcctcctgtctcagcttccagagtggctggtactacaggcataccatgacac

SEQ ID NO: 6300 - DNA, 445 bp, Homo sapiens
  AC068769.9_189314
  Located on chromosome 3
  Distance between a terminus base of telomere on chromosomal short arm and 5'-terminus of this base sequence : 189952576
  Distance between 3'-terminus of neighbour sequence of sequence listing upward to telomere on chrosomal short arm and 5'-terminus of this base sequence : 24362
catctgtactgaacatgtacagacttttttcttgtcattattccttaaacaacacagtgtaacaactatttacatagcatatacattgttattacattgttatttacattgttattaggtattaagataacctagagatgatataaagtaaagtacatcagaggatgtacataggttatacgtaaacagtacagcattttacacaggggactgtggattagcatctgtggattttgctatctgcagcagggggtcctggaaccaatcccccacagtactgagaaatgatttgttcgtgtgtgtgtgtgtatgtgggtgtgtgtgtgtgtgtgtgtaaatttaaagctaaatactcacagacctttatgtaaaatgtcccataaaaaagaacaaacatttcaatacacttcttacagcatcaacctaactaggctttcctagacca

SEQ ID NO: 6301 - DNA, 188 bp, Homo sapiens
  D3S1571
  Located on chromosome 3
  Distance between a terminus base of telomere on chromosomal short arm and 5'-terminus of this base sequence : 190039663
  Distance between 3'-terminus of neighbour sequence of sequence listing upward to telomere on chrosomal short arm and 5'-terminus of this base sequence : 86642
acagtggctgatgcctttaattccagcactttgggaggctgaggcaggaggatcgcttgagcccaggaatttgagaccagcctgggcaacataaaccccatctctaaaacacacacacacacacacacacacacgcgggcacacacacacacacacacacaaaaccccacatgtagtgcccacctgtg

SEQ ID NO: 6302 - DNA, 406 bp, Homo sapiens
  AC068644.5_161939
  Located on chromosome 3
  Distance between a terminus base of telomere on chromosomal short arm and 5'-terminus of this base sequence : 190167311
  Distance between 3'-terminus of neighbour sequence of sequence listing upward to telomere on chrosomal short arm and 5'-terminus of this base sequence : 127460
ctgaatctgactacctttgcactgatggaatgtgctggtaagaaaggcagtgaagtcctcaagatggtgtccttgactgacatgaccacaggagagtttccaagttacccgtgaaacttggaagaagccctattagaaccggagtgtaaatcaggttattattattattattattattatttgagatggagtttcgctcttgttgctcaggctggagggcaatagcgcaatctcagctcactgcaacctccgcctcctgggttcaagagattctcctgcttcagcctcccgagtagctggaattacaggcatccaccaccacgcccagctaactttctgtatttttagtagagatgaggtttcaccatgttggccaggctggtcttgaactcctgacgtcaggtga

SEQ ID NO: 6303 - DNA, 240 bp, Homo sapiens
  D3S3578
  Located on chromosome 3
  Distance between a terminus base of telomere on chromosomal short arm and 5'-terminus of this base sequence : 190368403
  Distance between 3'-terminus of neighbour sequence of sequence listing upward to telomere on chrosomal short arm and 5'-terminus of this base sequence : 200686
tctgaaatgtagactgccctttgtcaggccctcctggcccagtggtccacatgagaaactgattatctcactgtgtaaagtgcaaaggagacttgcttccccaggaataaatgcagcattaagtgattagactgttaggctttgtgtgtgtgtgtgtgtgtgtgtgtgtgtgtgttttgctactctgtaaaaggctgtgtgtgtgtgtgtgtgtgtgtgtggctactctgtaacccaatc

SEQ ID NO: 6304 - DNA, 184 bp, Homo sapiens
  D3S3609
  Located on chromosome 3
  Distance between a terminus base of telomere on chromosomal short arm and 5'-terminus of this base sequence : 190406004
  Distance between 3'-terminus of neighbour sequence of sequence listing upward to telomere on chrosomal short arm and 5'-terminus of this base sequence : 37361
cgagagtaacttgtacggtggaaggacagacataagtcctcctggtcactggtgtgtggtaggaaagagtgcctgcctacgaggggtgtgtgtgtgtgtgtgtgtgtgtgtgtgtgtgtgtgtgtttgtgtgtgtgtgtgtgttaggaattcttgtaaacgcagttcagactggttccccagct

SEQ ID NO: 6305 - DNA, 479 bp, Homo sapiens
  AC068634.11_165297
  Located on chromosome 3
  Distance between a terminus base of telomere on chromosomal short arm and 5'-terminus of this base sequence : 190412695
  Distance between 3'-terminus of neighbour sequence of sequence listing upward to telomere on chrosomal short arm and 5'-terminus of this base sequence : 6507
agctgaatgtttcctcttagactaactggttggattgctggagacaggactgccagctgtagagggagggtggtactcccattagtctggaccagtgtttggcaaacacacacacacacacacacacacacacacacgtgccagatccagcccattcatacatcccaggacccagtagtggtttttacattttaaagttgcgaaaaatcaaaaagtgaatggtaatttatgctgtggaaattaaataaaatgtaaatgtcagtgtccatgaagttttattggaacacagtcacagcatgcctttatcatctacagctggtttcatgctactgtggcagaattgagtagttgcaatagagactggccctttattaaaaaagattttctgacccctggactgggccattcactacctgtttggttgcatatggtggtgctggccaagggactcagccgggttggacctatgattctactcc

SEQ ID NO: 6306 - DNA, 289 bp, Homo sapiens
  AC061705.11_43891
  Located on chromosome 3
  Distance between a terminus base of telomere on chromosomal short arm and 5'-terminus of this base sequence : 190617172
  Distance between 3'-terminus of neighbour sequence of sequence listing upward to telomere on chrosomal short arm and 5'-terminus of this base sequence : 203998
tgagccaagattgagctactgcacctccagcctaggcaacagcgagactctgtctctctctcctacacacacacacacacacacacacacacacacacacacacacacacacaaacacaaagaaaaaagaaaaaaagaaaaacaaaagagctgtgctccagagtcagactgtccttgagtcccagccctgccatccagtatgtcaattccctgtatttcctcatgcacaaaacaagggtataattatgccagtcatatagggctgttgtaaggattgactgagttaata

SEQ ID NO: 6307 - DNA, 318 bp, Homo sapiens
  AC061705.11_6572
  Located on chromosome 3
  Distance between a terminus base of telomere on chromosomal short arm and 5'-terminus of this base sequence : 190654490
  Distance between 3'-terminus of neighbour sequence of sequence listing upward to telomere on chrosomal short arm and 5'-terminus of this base sequence : 37029
aaacaatcagctgatcttcagcagctttggggaacctcagacaggtcttactctcccaccatggagctgaatggctggggtttacatagcacttacacacacacacacacacactcataccccaaatggagtcaaacaaataatgactcaaattccaattctaccacttactggccctcttatcttagagaagtttcttaatttctccaagcctttgtctcatcctggtaaaagggatccttaaatgcctggcatgatccaggcatacagtaaaagctaattatattgtccatttttagcaggatccatacactattt

SEQ ID NO: 6308 - DNA, 384 bp, Homo sapiens
  chr3.fa.O7frz.210838022
  Located on chromosome 3
  Distance between a terminus base of telomere on chromosomal short arm and 5'-terminus of this base sequence : 190681040
  Distance between 3'-terminus of neighbour sequence of sequence listing upward to telomere on chrosomal short arm and 5'-terminus of this base sequence : 26232
accatttgatttatcctagaaaaggaaaggctgaagccaactaagtaaaagttttccattaaatgaatgcacgttgtagaaaaggaatgttcaactgccctacaaatccagaggtagaaatgggggaggggagaaggaattaaataggacacacacacacacacacaaacacacacacacacacactcttgggggggtgtttgggtatggaaagtaggtccgattgcagaatttattttaaatgattcccgcaaccttgggaagttgggaagtggtgaatccgctgccgaaaggcatttgtgcttatggtaaatccaggtcttaaaattctgtagactggtagctatatggatatgattttaatagacgagtttcaggaagact

SEQ ID NO: 6309 - DNA, 407 bp, Homo sapiens
  chr3.fa.O7frz.211147735
  Located on chromosome 3
  Distance between a terminus base of telomere on chromosomal short arm and 5'-terminus of this base sequence : 190850180
  Distance between 3'-terminus of neighbour sequence of sequence listing upward to telomere on chrosomal short arm and 5'-terminus of this base sequence : 168756
tctttcctttgaatgttagtgaggctgaatattgtttcaatttatggtgggttttgatgtacagaagtttttgattttttttgtagtcaaatctattaatcttttcctctatggtttctacttttgttgacatgtttagaaagtccttccccatcctaagattataaaatattcactcatattttcttctagtacctttatgatttcatttccttctttatccatctggtattcattttgacaaatggcgtgagctgggaaataacgtgtattatttatttatttatttatttcccagatgggtactcaattctttcatcactgttaaaaagcacgtatttgtgtgtgtgtgtgtgtgtgtgtgtgtgtgtgtgtgtgtgtaactattcctaaagtgaacatcttga

SEQ ID NO: 6310 - DNA, 112 bp, Homo sapiens
  DISO7_10001328
  Located on chromosome 3
  Distance between a terminus base of telomere on chromosomal short arm and 5'-terminus of this base sequence : 191137798
  Distance between 3'-terminus of neighbour sequence of sequence listing upward to telomere on chrosomal short arm and 5'-terminus of this base sequence : 287211
tggttctcaccatttgtgtaccacacacatacacacacacacacacacacacacacacacacagaaagagagagagagagagagagagagaaaagccactgatatggcagaa

SEQ ID NO: 6311 - DNA, 160 bp, Homo sapiens
  DISO7_10001329
  Located on chromosome 3
  Distance between a terminus base of telomere on chromosomal short arm and 5'-terminus of this base sequence : 191164313
  Distance between 3'-terminus of neighbour sequence of sequence listing upward to telomere on chrosomal short arm and 5'-terminus of this base sequence : 26403
tccattgcttaacaatggaggaaaacaggatgaagctggggagtaagaattggagcaaaatgtaagattctatggtaaacacacacacacacacacacacacacacactcaacacataggaactattacaaaatagaactttccacaatgagaataataa

SEQ ID NO: 6312 - DNA, 128 bp, Homo sapiens
  DISO7_10001332
  Located on chromosome 3
  Distance between a terminus base of telomere on chromosomal short arm and 5'-terminus of this base sequence : 191271963
  Distance between 3'-terminus of neighbour sequence of sequence listing upward to telomere on chrosomal short arm and 5'-terminus of this base sequence : 107490
tggctaaactagcaatgaaggatttaaactatttgttttggggaaaaaatttatatgtgtgtgtgtgtgtgtgtgtgtgtgtgtgtattacactcaagtaagaatctctcaatcagctaggaggagac

SEQ ID NO: 6313 - DNA, 255 bp, Homo sapiens
  DISO7_10001333
  Located on chromosome 3
  Distance between a terminus base of telomere on chromosomal short arm and 5'-terminus of this base sequence : 191281689
  Distance between 3'-terminus of neighbour sequence of sequence listing upward to telomere on chrosomal short arm and 5'-terminus of this base sequence : 9598
aacatgtatgctgacagttctgaaggcatacctatttttattttatcaataattttaaaacaaacttgtttagtaaattatacttaagtcacatgaatttgaaattgcttagatttatttacttaatatatgagtgctcttttacttatgtcaacttggtagacatcatataacaataagtgtacatacaaataaccacatctagacatgtatacacacacacacacacacacaaagatccgatagcttggaatg

SEQ ID NO: 6314 - DNA, 331 bp, Homo sapiens
  chr3.fa.O7frz.211766531
  Located on chromosome 3
  Distance between a terminus base of telomere on chromosomal short arm and 5'-terminus of this base sequence : 191476156
  Distance between 3'-terminus of neighbour sequence of sequence listing upward to telomere on chrosomal short arm and 5'-terminus of this base sequence : 194212
ggactgttaagagttcctactttagaccgggcatggtggctgaagcctgtaatctcagcactctgtggggccaaggcaggaggaacaccacaggccagaagttcaagactagcctgggcaacacagtaataccctgtccctcaaaaaagagttcctacttaatgagggttgttatatggaataaataaatatataatagaataaataaataaataaataaataaataaataaacaaattgacaaggcaaaacttattccacttcagcaaagcaagtgtcaatattctacttatggatgagtggaggaacacatgttcagatgaaatcactt

SEQ ID NO: 6315 - DNA, 419 bp, Homo sapiens
  chr3.fa.O7frz.211891496
  Located on chromosome 3
  Distance between a terminus base of telomere on chromosomal short arm and 5'-terminus of this base sequence : 191586041
  Distance between 3'-terminus of neighbour sequence of sequence listing upward to telomere on chrosomal short arm and 5'-terminus of this base sequence : 109554
taacataagaactctgacttccacctcctcttgaaaaatcagatttgggaacactggccctacatttccaaatggcagcagttggctggagctaactaatagctgtccctcctgcactatccagaacacccttgccaccacttacatcatctacccctgtaaacatacggtgatctcttacaaaaatcttactacaaaagttgtgtgcaaaatacgaaaccatgggtctctgaaggccagtctgtgggaggctacagtgatggagcacatggcaggggacggtgctcagagtagggtgtctctctctctctctctctctctctctctctctctctctctctctctccccctctccctgcctgggcatcagaacctctcaggggatctttaacaacacgtagctaaattccaaggacttt

SEQ ID NO: 6316 - DNA, 252 bp, Homo sapiens
  HUMUT871
  Located on chromosome 3
  Distance between a terminus base of telomere on chromosomal short arm and 5'-terminus of this base sequence : 191639027
  Distance between 3'-terminus of neighbour sequence of sequence listing upward to telomere on chrosomal short arm and 5'-terminus of this base sequence : 52567
gaggcatgagaatcgcttgaacctgggaggcggaggttgcagtgagccaaaattgcaccagtgcactttagcctgggtgacagagcgagactctgtctctagatagacagatagatagataggtagataggtacatagatagatagatagatagatagatagatagatagatagatagatagatagatagaggaactatgaccctagaatttctagacacccagaattcattcacgtgtgaaggaaaaagga

SEQ ID NO: 6317 - DNA, 469 bp, Homo sapiens
  chr3.fa.O7frz.212151922
  Located on chromosome 3
  Distance between a terminus base of telomere on chromosomal short arm and 5'-terminus of this base sequence : 191848422
  Distance between 3'-terminus of neighbour sequence of sequence listing upward to telomere on chrosomal short arm and 5'-terminus of this base sequence : 209143
tatgtaagagtgccaagttgacaagaggtgactgtggtgaatttgtattgtatcagcttagctaaagtatatatatatatatgtatatatatatatacgtgtgtgtgtgtatatatatatgtgtatatatatatatatatttttttttctttctttctttttttgagcagagtctcgctctggcacccaggctggaatgcgatggcatgatctcggctcactacaacctccacctcctgggttcaagtgattctcctgcctcagcctcctgagtagctgggactacaggtgcctgccaccgcgcccggctaatttttgtatttttagtagagatggggtttccccatgttggccatgctggtcttgaactcctgacctcaaatgatccacccacctcggccttccaaagttttgagattacaggagtgagtcactgtgcccagccatgtagtgacacttccaattcaaa

SEQ ID NO: 6318 - DNA, 252 bp, Homo sapiens
  D3S1617
  Located on chromosome 3
  Distance between a terminus base of telomere on chromosomal short arm and 5'-terminus of this base sequence : 192048240
  Distance between 3'-terminus of neighbour sequence of sequence listing upward to telomere on chrosomal short arm and 5'-terminus of this base sequence : 199349
tctgtgaaaacaacatgggctataaatgtgtgtgtgtgtgtgtgtgtgtgtaagataaagacagagagaaggaggagggagaggaaaagggtgaggaggaggagagaaaggtatagagtatgtctaggggtgagggggtttgagggttgatgttgggataggagagagggggagaaaagagaagcagaactttgcagaagtctcttgagtggcagagacagatgtcttggaaactgttgttctttgtaccag

SEQ ID NO: 6319 - DNA, 317 bp, Homo sapiens
  AC067790.2_64750
  Located on chromosome 3
  Distance between a terminus base of telomere on chromosomal short arm and 5'-terminus of this base sequence : 192049156
  Distance between 3'-terminus of neighbour sequence of sequence listing upward to telomere on chrosomal short arm and 5'-terminus of this base sequence : 664
ctcaggtacaacttaaatttggagttaaaatgaaaaagaacagaatgcaagtcagtgtctaggcacacagaggaattaatgtttagattgagacatctggtataccaggtgtctgttttaccttaagcatcaatgattcagggtgtgattttggcaattcatgtcatctccatattgtctttacactcttcaactgactagtatttaagatggaatgtgtatgcaccttagtaaaacaggaattcactcactcactcactcactcactcactcactcactcactcattcaacagttactgagtaacaactcagtgcc

SEQ ID NO: 6320 - DNA, 293 bp, Homo sapiens
  D3S1602
  Located on chromosome 3
  Distance between a terminus base of telomere on chromosomal short arm and 5'-terminus of this base sequence : 192195596
  Distance between 3'-terminus of neighbour sequence of sequence listing upward to telomere on chrosomal short arm and 5'-terminus of this base sequence : 146123
agagccttctatggttctacatatcagccctaaatatgttctctgactctgacagttttgtattttgaactgtaactacatcttaaagtcagaaactttgtcataatctgattcgaaagaaatatatttcctaatagcacaatttactgattgattctctttaattacatcttaaaattttgctttaatgtaatttaattgacatatacatatctgcacacacacacacacacacacacacacacacacacacacacacacacacacattaatgtatgtttgaaggttgagct

SEQ ID NO: 6321 - DNA, 164 bp, Homo sapiens
  D3S3570
  Located on chromosome 3
  Distance between a terminus base of telomere on chromosomal short arm and 5'-terminus of this base sequence : 192374106
  Distance between 3'-terminus of neighbour sequence of sequence listing upward to telomere on chrosomal short arm and 5'-terminus of this base sequence : 178217
cactggagagttcttctattgccatccttttctcatctcacacacacacacatacacacacacaaacacacacacacacacacactaatatgccataccttctctcgcttcctctgttaactgttcttttggaaaatccacatcaaaagtgattatcaaagagc

SEQ ID NO: 6322 - DNA, 116 bp, Homo sapiens
  D3S1262
  Located on chromosome 3
  Distance between a terminus base of telomere on chromosomal short arm and 5'-terminus of this base sequence : 192452990
  Distance between 3'-terminus of neighbour sequence of sequence listing upward to telomere on chrosomal short arm and 5'-terminus of this base sequence : 78720
cggccctaggatattttcaattaagaaaagaatgctggatagccaaagtgaaaatacacacacacacacacacacacacacacacacacacacaaaaccccgtccataaaaactgg

SEQ ID NO: 6323 - DNA, 305 bp, Homo sapiens
  chr3.fa.O7frz.213364000
  Located on chromosome 3
  Distance between a terminus base of telomere on chromosomal short arm and 5'-terminus of this base sequence : 192557875
  Distance between 3'-terminus of neighbour sequence of sequence listing upward to telomere on chrosomal short arm and 5'-terminus of this base sequence : 104769
ctataaggaaacctactggattaaggaaaattaatggattaaaacatgagcaggtttttaaagtgagttttaataaaaattactaaaagtaatatatgcttactgtagagaaatttgagaaatcaaaagaaaaaagtgggcacactgtcaaagcactgtttttgaaacttccctctagtcttttacacacacacacacacacacacacacacacacatttaaataaaaaacaagagttgtgatttagtttcatctctatttttcctaatcagcatggtatcctaagcatgtttatggacataaac

SEQ ID NO: 6324 - DNA, 444 bp, Homo sapiens
  chr3.fa.O7frz.213629854
  Located on chromosome 3
  Distance between a terminus base of telomere on chromosomal short arm and 5'-terminus of this base sequence : 192568668
  Distance between 3'-terminus of neighbour sequence of sequence listing upward to telomere on chrosomal short arm and 5'-terminus of this base sequence : 10488
cataaactgtgaagtcttcgaccctcaggtgggttgtctaagcagactttgtcatggcagtgccagattaagtgacatacgtacacaaatagtgttgttgcttcctaaagctctatgagtgggtgtgtgtgtgtgtgtgtgtgagagagagagagagagagagagagagagacagagacagagacagagagagggagacagggagagagagaaagagagagacagacagacatgcaagaaaaaagatacagagagtatcccacaactggggaaaggagtgcaattgccagattacacaaaaagtatgaaaacttttccaagaattgaagaggggtaacaattggcagaaaattaaaatcatgtccaattcaaccaaacttgaaggaatttgaaaatgctctttgtagtcgggactctagtgctgagacttagtcattcctaagc

SEQ ID NO: 6325 - DNA, 335 bp, Homo sapiens
  chr3.fa.O7frz.213081271
  Located on chromosome 3
  Distance between a terminus base of telomere on chromosomal short arm and 5'-terminus of this base sequence : 192955808
  Distance between 3'-terminus of neighbour sequence of sequence listing upward to telomere on chrosomal short arm and 5'-terminus of this base sequence : 386696
ttcaccatgttagccagatggtcttgatctcctgacctcgtgatctgcccgcctcggcctcccaaagtgctgggattacaggcatgagccaccgcgcccagcctaaatgttttatatatatatatacacacacacatatactctatatatatatacacacacacatatatacacatatatatgtgtatatatatatatatatatagagagagagagagagagagagagagagagtatatgtgtatatattttaacaaaaaaagcctgggagaaccattgaatttgaaaccaccaaatctcaacaagccttgaaatctaacactcagtttaaggaa

SEQ ID NO: 6326 - DNA, 244 bp, Homo sapiens
  AC034190.2_77059
  Located on chromosome 3
  Distance between a terminus base of telomere on chromosomal short arm and 5'-terminus of this base sequence : 193043935
  Distance between 3'-terminus of neighbour sequence of sequence listing upward to telomere on chrosomal short arm and 5'-terminus of this base sequence : 87792
aattctgacacagctgtcaaacttttgttggtacaattatttataaatattaaatattctataagcttctttttaatccttccttcctttctctttctcttttctcttctcttttcttcttccttccttccttccttccttccttccttccttcctctctctctctctctttctttcgagacagaatctcactctgtcgcacaggctggagtgcagtggcatggtcttggctcactgtaacctc

SEQ ID NO: 6327 - DNA, 324 bp, Homo sapiens
  AC007488.15_56318
  Located on chromosome 3
  Distance between a terminus base of telomere on chromosomal short arm and 5'-terminus of this base sequence : 193048953
  Distance between 3'-terminus of neighbour sequence of sequence listing upward to telomere on chrosomal short arm and 5'-terminus of this base sequence : 4774
aatagtctccaatctcatccaggtttctgcgaatgccattaattaattcctttttatggctgagtagtattccatcatccatctatcatctatctatctatctatctatctatctatctatctatctatctatctataaaaaacagtttcttcatccactcattgattgatgggcatttgggttggttccacatttttgcaattacgaaatgtgctgctataaacatgtgtgtgcaggtatctttttcgtataatgactttttttcctctgggtagataccccgtagtgggattgctggatcaaatgtagacctatactgaaca

SEQ ID NO: 6328 - DNA, 299 bp, Homo sapiens
  AC026835.3_95794
  Located on chromosome 3
  Distance between a terminus base of telomere on chromosomal short arm and 5'-terminus of this base sequence : 193536418
  Distance between 3'-terminus of neighbour sequence of sequence listing upward to telomere on chrosomal short arm and 5'-terminus of this base sequence : 487141
tttgtgatcctagtgtaagcacaactttcttagaaaaagccattaagaaaaatgaatagtcaaactaaactgggagaaaatgcacacacacacacacacacacacacacatatatatatatacacacacacacatatatacacacacacacatatatatacacacacacatatatatctgacttctattatatatagttataggtaagcaatttttatacttcagtaataaaaagactttacagttatgccttataactcttacgatattttttagttgacaaagtacttttctaccaa

SEQ ID NO: 6329 - DNA, 385 bp, Homo sapiens
  AC018919.10_100146
  Located on chromosome 3
  Distance between a terminus base of telomere on chromosomal short arm and 5'-terminus of this base sequence : 193629665
  Distance between 3'-terminus of neighbour sequence of sequence listing upward to telomere on chrosomal short arm and 5'-terminus of this base sequence : 92948
gtgcatgttatgtaaggaaagtttcatatgaaaaaataatgatgctttatctagggatgctacagattttatattagaattctatgagttggatttatgtaagttgggtttttttttttttcttacttttttggtgtggaggggagaatacctctctctctctctctctttctctctctctctctctctctttccttctttcttttctttctctctctctctctcttctttccccctccctgccttcttccctttcattctttctgtctctttctttttacagttgagttttgaagcataaataagagtgtttcacattaacacagagaaaatcagttcaaacagtgacatccacattttcaaagacatagaggcataatgtctg

SEQ ID NO: 6330 - DNA, 364 bp, Homo sapiens
  chr3.fa.O7frz.214310452
  Located on chromosome 3
  Distance between a terminus base of telomere on chromosomal short arm and 5'-terminus of this base sequence : 193667977
  Distance between 3'-terminus of neighbour sequence of sequence listing upward to telomere on chrosomal short arm and 5'-terminus of this base sequence : 37927
gaggtgctgaacagtaacataggtattccccaggcttagcttttctttcttttccttccttccttccttccttccttccttccttccttccttccttccttccttccttccttccttcttttcctccatccatccttttcctttcttctttgttttgtcttctctttcttcttcttctaatagatcaatctcaacagagaacttagcttcaatatttttgtagctttggctttctcagcccactgcactacccccttacacccctgcacgtgcaattaacaggtgtctcatcagtctccacagtgctgtgcactttactatctccctgagcttgatcacatggtttactttgtctgcactgtct

SEQ ID NO: 6331 - DNA, 422 bp, Homo sapiens
  AC072022.9_4823
  Located on chromosome 3
  Distance between a terminus base of telomere on chromosomal short arm and 5'-terminus of this base sequence : 193695706
  Distance between 3'-terminus of neighbour sequence of sequence listing upward to telomere on chrosomal short arm and 5'-terminus of this base sequence : 27365
aggtgattaggtcaggttagaggccctcataaatgagattagtgctcttgtaaaaaggaccccagagagctcatttgcccccttcagccatgtgagaacatagtaaaaatatggtgtgatattatgagattgtatatgtgtgtgtgtgtgtgtgtgtgtgtgtgtgtgtgttttcatccacagttcccagtttatcactcccatagcccttattacagtcttttgttataatgctggggcactttaggtgtcagaaagcagaagctctctctcactgacctttctcctgccgttttttcacctgcttctttttctcctcaaggcaggatttagaaactaaaaatacactctaatcttcccccacctctggtcataaagaaattttctgacccaccttgtctgattgtagatcataagacctc

SEQ ID NO: 6332 - DNA, 422 bp, Homo sapiens; identical to SEQ ID NO: 6331
  AC018919.10_34118
  Located on chromosome 3
  Distance between a terminus base of telomere on chromosomal short arm and 5'-terminus of this base sequence : 193695706
  Distance between 3'-terminus of neighbour sequence of sequence listing upward to telomere on chrosomal short arm and 5'-terminus of this base sequence : -422

SEQ ID NO: 6333 - DNA, 131 bp, Homo sapiens
  D3S3686
  Located on chromosome 3
  Distance between a terminus base of telomere on chromosomal short arm and 5'-terminus of this base sequence : 193773397
  Distance between 3'-terminus of neighbour sequence of sequence listing upward to telomere on chrosomal short arm and 5'-terminus of this base sequence : 77269
gagggtattcattcccattgccactccacacacacacacacacacacacacacacacacacacacacacacacacacacatatattttctctctctctcttacatgcacagaggccacttggcgtaacctg

SEQ ID NO: 6334 - DNA, 152 bp, Homo sapiens
  DISO7_10001334
  Located on chromosome 3
  Distance between a terminus base of telomere on chromosomal short arm and 5'-terminus of this base sequence : 193773403
  Distance between 3'-terminus of neighbour sequence of sequence listing upward to telomere on chrosomal short arm and 5'-terminus of this base sequence : -125
attcattcccattgccactccacacacacacacacacacacacacacacacacacacacacacacacacacacatatattttctctctctctcttacatgcacagaggccacttggcgtaacctgggctttctagagtcccagtctcaggaa

SEQ ID NO: 6335 - DNA, 189 bp, Homo sapiens
  DISO7_10001338
  Located on chromosome 3
  Distance between a terminus base of telomere on chromosomal short arm and 5'-terminus of this base sequence : 193855890
  Distance between 3'-terminus of neighbour sequence of sequence listing upward to telomere on chrosomal short arm and 5'-terminus of this base sequence : 82335
ctaggctccttgagaagacagatcctttaaaagagctttccattgaagaagaaaacaggaaccaaaaaaaaaaaaaagcaaagagagagagaagacagcagaaacgacagagagagagagagagagagagagagagagagagagagagagagagagaaaatgagagaagagggagaggcgaggttaaga

SEQ ID NO: 6336 - DNA, 156 bp, Homo sapiens
  DISO7_10001339
  Located on chromosome 3
  Distance between a terminus base of telomere on chromosomal short arm and 5'-terminus of this base sequence : 193869182
  Distance between 3'-terminus of neighbour sequence of sequence listing upward to telomere on chrosomal short arm and 5'-terminus of this base sequence : 13103
tgtacgtacagagacacagacacacaaatgtgactccacgggggcacagtgtagggagaaaaaaaaaaacactgtatttgttgcaaacacacacacacacacacacacacacacgcgcgcacacacacacaaacccttggtttctaattacagctg

SEQ ID NO: 6337 - DNA, 252 bp, Homo sapiens
  D3S3651
  Located on chromosome 3
  Distance between a terminus base of telomere on chromosomal short arm and 5'-terminus of this base sequence : 194052377
  Distance between 3'-terminus of neighbour sequence of sequence listing upward to telomere on chrosomal short arm and 5'-terminus of this base sequence : 183039
ttcgatatgaacttgcttattgtttgtattatacacccacattcttgatgcctggtatctctgaaatcatttcagtttccagaaatcatttgagacactcctacacccagggttttgataaacagtccagtttctacagagagtaattactgtgtgtgtgtgtgtgtgtgtgtgtgtgtgtgtgtgtgcgcgcgcttgagagacagagaaagacaagttttggggtagagagagagaaaaccagagcacact

SEQ ID NO: 6338 - DNA, 382 bp, Homo sapiens
  AC066603.3_35900
  Located on chromosome 3
  Distance between a terminus base of telomere on chromosomal short arm and 5'-terminus of this base sequence : 194217226
  Distance between 3'-terminus of neighbour sequence of sequence listing upward to telomere on chrosomal short arm and 5'-terminus of this base sequence : 164597
ggcaatgatactcaaagtacaggtgttttctagacatgctgtgaatgttgtcagaatcaaaatggaatcacttgtgttaagaaccctgaaaatagaattaagaaaggccatgaagaaacggttttcatgcatgaatgcctgataacaagaactatcacaaaagactgcaaaaactacaatcttgcataaatgttattttacacacacacacacacacacacacacacatacacacacacacccaattttttgcagagagtgtttcttttaaagcggaatcgcaacttttctcacatgggtacccttaggaatctgcccagtaactgcctgtctatctttaaactggcaccaccctttttactgatctgtgttgccaagaata

SEQ ID NO: 6339 - DNA, 216 bp, Homo sapiens
  D3S3628
  Located on chromosome 3
  Distance between a terminus base of telomere on chromosomal short arm and 5'-terminus of this base sequence : 194217333
  Distance between 3'-terminus of neighbour sequence of sequence listing upward to telomere on chrosomal short arm and 5'-terminus of this base sequence : -275
ccatgaagaaacggttttcatgcatgaatgcctgataacaagaactatcacaaaagactgcaaaaactacaatcttgcataaatgttattttacacacacacacacacacacacacacacatacacacacacacccaattttttgcagagagtgtttcttttaaagcggaatcgcaacttttctcacatgggtacccttaggaatctgcccagtaa

SEQ ID NO: 6340 - DNA, 452 bp, Homo sapiens
  chr3.fa.O7frz.214951700
  Located on chromosome 3
  Distance between a terminus base of telomere on chromosomal short arm and 5'-terminus of this base sequence : 194265778
  Distance between 3'-terminus of neighbour sequence of sequence listing upward to telomere on chrosomal short arm and 5'-terminus of this base sequence : 48229
tgctattaatgctattagcctaagaaggccatgtgcagtggctcacacctgtaatcccagcactttgggaggctgaggtgggtggatcaccggaggttgggagttcaagaccagcctgaccaacatggagaaaccccatctgtactaaaaatacaaaattagccgggcgtggtggcgcatgcctgtaatcccagctactcaggaggctgaggcaggagaatcgcttgaacctaggaggcagaggttgtgatgagccgagattgtgtcactgcattccagcctgggcaacaagagcaaaactccatctcaaaataaataaataaataaataaataaatgaataaataaaattagcccgagaagatagtcatgatttaggattgtccagggcaacatggatatacagtaccctatttagatagcaacacaccattgccagatcattaatagttg

SEQ ID NO: 6341 - DNA, 329 bp, Homo sapiens
  chr3.fa.O7frz.215073036
  Located on chromosome 3
  Distance between a terminus base of telomere on chromosomal short arm and 5'-terminus of this base sequence : 194388760
  Distance between 3'-terminus of neighbour sequence of sequence listing upward to telomere on chrosomal short arm and 5'-terminus of this base sequence : 122530
tttatgcttctaggaacgtttaaaaatgagagcaaggaatatatttcattgctttaattgttcaaggtcttttaaaagcgtgtgcaataaaatgccttttaagataactgacctttgtattttaatgctttttggaagggaacaatacctagtgttcagctgcagtataactttatatatatatatatatatatatatatatacagtcagcagagcttgttttggaatcagagggctgagggttttgctgccttcccagatattttacctgtttctgtttcaacatcaagttccattcagttgatgtttcttgacctcataatgtctaa

SEQ ID NO: 6342 - DNA, 452 bp, Homo sapiens
  AC069226.13_118468
  Located on chromosome 3
  Distance between a terminus base of telomere on chromosomal short arm and 5'-terminus of this base sequence : 194572447
  Distance between 3'-terminus of neighbour sequence of sequence listing upward to telomere on chrosomal short arm and 5'-terminus of this base sequence : 183358
aagtgaagctaattagtgtcacatttggagtttactcaaaatatgatactcttcagtttgatatgctactgccccttcatgttatcctttttaaaaaatatttttaaattgattgtatattatttttaaattgattgtatattattgcattagcatatttacccaatttatatgagcttcatatatagcatatgtgtgtgttaccttcctggtaacacaccaaatggctcatataaatttagccaatttatatgagctttatatatatatatatatatatatatatatatatatatatatgcatgtgtgtgtgtgtgtgtgtgtgtgtgtgtgtgtgtgtgtgtgtgtgttacttttttgggtgtttatttttaattttgttccaatttagaagcatataaaagtttgtttcaatgtgttttttaaattattcaagttgtaatcaaactgaa

SEQ ID NO: 6343 - DNA, 349 bp, Homo sapiens
  AC063932.9_57427
  Located on chromosome 3
  Distance between a terminus base of telomere on chromosomal short arm and 5'-terminus of this base sequence : 194661937
  Distance between 3'-terminus of neighbour sequence of sequence listing upward to telomere on chrosomal short arm and 5'-terminus of this base sequence : 89038
attgcatgcttcctagtgatacttacatttgccagtatccataacttcaactgggaattgtaaagtgcacctcatgcactacaggtgacctgcagaaattgttttatttctcttccttgtgtttgaaataataataataataataataataataataataataataatgaacacagctttaaagtcagaagagtaatattggatttatattccacatgtcagcagtgagctggcatgggatagcagctgcctttttaacagagtaaactcttcagctttatagttcacatcactttgttgtttcctagacactggcattctcattttctgttcattctccaatttattc

SEQ ID NO: 6344 - DNA, 419 bp, Homo sapiens
  AC063932.9_61519
  Located on chromosome 3
  Distance between a terminus base of telomere on chromosomal short arm and 5'-terminus of this base sequence : 194665879
  Distance between 3'-terminus of neighbour sequence of sequence listing upward to telomere on chrosomal short arm and 5'-terminus of this base sequence : 3593
ttctttgatgactcaagatcagcagaaacccagagttcctattttgaacactttacaaacccaactataaatggagacagtgactgagcaactgggctgatgacaggcatgctctctgctgcagctgtaaagtctgccccaagaaagcagttcaaaatttgcatagtttgaaattgaaaaccaataacattcattaacaaaaaagaatatagacctaactccttaaaagtaactttttttttataagtttcttctttcagtctctttcttggtgaagacacacacacacacacacacacacacacacacacacacacacacacacactatttaaacatcctgaagtctttgaattaaagcaacagggcacaatttcaggagccattgctttcttctaggaaatacctcactattagagc

SEQ ID NO: 6345 - DNA, 226 bp, Homo sapiens
  chr3.fa.O7frz.215568544
  Located on chromosome 3
  Distance between a terminus base of telomere on chromosomal short arm and 5'-terminus of this base sequence : 194792303
  Distance between 3'-terminus of neighbour sequence of sequence listing upward to telomere on chrosomal short arm and 5'-terminus of this base sequence : 126005
tgtagtcgtaaattttaatccaagtctcatatgtgactgtggatgggtacagtctaaagggaacatttctttatttctctgctgcagagtgactacgtctacagtcaaaagttctcaacctatcttaggaatcttactttacttcaccaaaaacgtgtgtgtgtgtgtgtgtgtgtgtgtgtacatttatataccatacatgtacacgctagtatgctttagttaa

SEQ ID NO: 6346 - DNA, 359 bp, Homo sapiens
  AC069430.9_47944
  Located on chromosome 3
  Distance between a terminus base of telomere on chromosomal short arm and 5'-terminus of this base sequence : 194855635
  Distance between 3'-terminus of neighbour sequence of sequence listing upward to telomere on chrosomal short arm and 5'-terminus of this base sequence : 63106
atatccttctgattgaaccagatatcttattcttcatcccgtttcctgccccctaaaatgacctatctttcccttctaaaacttccactaactttaaaattggagctcaaggcttccatctccacagactctgccctgacaacaaattggttggttttattttcttcccaatgaatagaatagccgttagagggaattgtcttcagctcttttcccctcctcctcctcctcctcctcctcttcctcttcctccttcttgcaaatacaaacacagcagggctctatgcagctggttactctaggctctggtaacctaacatagcaggggaggacagaagtcaatagcgtgagaagtctgt

SEQ ID NO: 6347 - DNA, 442 bp, Homo sapiens
  AC069241.5_88992
  Located on chromosome 3
  Distance between a terminus base of telomere on chromosomal short arm and 5'-terminus of this base sequence : 194862728
  Distance between 3'-terminus of neighbour sequence of sequence listing upward to telomere on chrosomal short arm and 5'-terminus of this base sequence : 6734
tcagcgtaggaatattgtacatatttcctaaggtttataatgaagtattccatgttttggggtgcttttacaaatggtgatttaaaaatatgcaatttcaagtattcattgctactgtatagataagattgatctttgtatattgcccatgtgtgctgtaactttgctaaaattatttattctagtagctttttttttattcggggggaggtttaatgaaaaaaattatgttttcaatgtagtgcatctttatatatatatatatatatatatatatatatatatatataaaatggaatacaattcagccataaaaaagaatggaatcatgtcttttgcagcaacatggatagaactaggggtcgttatcctaaatgaaataaattagaaatagaaagccaaatactgcatgtggtcacttataaattggagctaaacaatg

SEQ ID NO: 6348 - DNA, 246 bp, Homo sapiens
  AC069241.5_7123
  Located on chromosome 3
  Distance between a terminus base of telomere on chromosomal short arm and 5'-terminus of this base sequence : 194883914
  Distance between 3'-terminus of neighbour sequence of sequence listing upward to telomere on chrosomal short arm and 5'-terminus of this base sequence : 20744
agtcatagaatagtgaccatctgtgctgcctttgtctttgtataggtgcagtagtcccagcctttctttctctctctctctctctctctctgtgtgtgtgtgtgtgtgtgtgtgtgtgtgtgtgtgtgtgtgtgtgtaggatcactggagtatggtggtgaagaaagctgtcacagcacagaagttcagaaggaggtactgtgaaggtcccaaagcattgagcttagctagttctgaaagcactaa

SEQ ID NO: 6349 - DNA, 145 bp, Homo sapiens
  D3S1580
  Located on chromosome 3
  Distance between a terminus base of telomere on chromosomal short arm and 5'-terminus of this base sequence : 194883927
  Distance between 3'-terminus of neighbour sequence of sequence listing upward to telomere on chrosomal short arm and 5'-terminus of this base sequence : -233
tgaccatctgtgctgcctttgtctttgtataggtgcagtagtcccagcctttctttctctctctctctctctctctctgtgtgtgtgtgtgtgtgtgtgtgtgtgtgtgtgtgtgtgtgtgtgtaggatcactggagtatggtgg

SEQ ID NO: 6350 - DNA, 326 bp, Homo sapiens
  chr3.fa.O7frz.215802955
  Located on chromosome 3
  Distance between a terminus base of telomere on chromosomal short arm and 5'-terminus of this base sequence : 194945195
  Distance between 3'-terminus of neighbour sequence of sequence listing upward to telomere on chrosomal short arm and 5'-terminus of this base sequence : 61123
tcagaattatctagtatgcctgagtagagactcacatgggtggaatctgtgttgtctcatcagagggaataaaaagacaatgaggtggtaaatgtgaaaaaagcagccttttagaaaaacattattttcaaatacctttataaatcatctaatttatcttcacataatataaagaaaaaactaataaaaattttcgtatttcactttacataatatgttctcccatatttagggatcatacaattgtattgtcttcaaaacacacacacacacacatacacacacacacacacacacacacacaccccttccaagaaagctgatcc

SEQ ID NO: 6351 - DNA, 306 bp, Homo sapiens
  chr3.fa.O7frz.216073629
  Located on chromosome 3
  Distance between a terminus base of telomere on chromosomal short arm and 5'-terminus of this base sequence : 195232166
  Distance between 3'-terminus of neighbour sequence of sequence listing upward to telomere on chrosomal short arm and 5'-terminus of this base sequence : 286645
gacggatagctttaggagatatacctaatgctaaatgacgagttaatgggtgcagcacaccagcatggcacatgtatacatatgtaactaacctgcacattgtgcacatgtaccctaaaacttaaagtataataataataaaataaaataaaataaaataaaataaagtgttcccatctatattattggagaatttgtgtagaattggtattatttcttggtcaagaattttttgcgttgaaaagaaaagccagatatttaatcacattaaaatttttactttactattccgtcagctaaaatacc

SEQ ID NO: 6352 - DNA, 190 bp, Homo sapiens
  D3S3549
  Located on chromosome 3
  Distance between a terminus base of telomere on chromosomal short arm and 5'-terminus of this base sequence : 195306400
  Distance between 3'-terminus of neighbour sequence of sequence listing upward to telomere on chrosomal short arm and 5'-terminus of this base sequence : 73928
ctgatccatagaagaccctcaatatatggaggcttctgttgttataatctaagaaaacttcatggcagaattattcctcagttcatgtaaatttcagaagcttcaaacctggtttgtgtgtgtgtgtgtgtgtgtgtgtgtgtgtttgggtgtatatctatctctttcaactaaaacttaatgtttgtga

SEQ ID NO: 6353 - DNA, 261 bp, Homo sapiens
  Z67624
  Located on chromosome 3
  Distance between a terminus base of telomere on chromosomal short arm and 5'-terminus of this base sequence : 195307661
  Distance between 3'-terminus of neighbour sequence of sequence listing upward to telomere on chrosomal short arm and 5'-terminus of this base sequence : 1071
ggtgcatgaaggttgatttgtaaattaggaatagtaactatttaatataaaggaagatacctctactgagtgtgtatgtgtgtgtgtgtgtgtgtgtgtgtgtgtgtttgtgtgcaagagagggagacagagaataatattaaaataaaatctttcttggaaggaaattatttccaaaccacaaaataatttgacacagctttaaaagagcaactgaaagtattgctgggcgtgggactggggccactgggagggcatctg

SEQ ID NO: 6354 - DNA, 437 bp, Homo sapiens
  AC062008.2_92123
  Located on chromosome 3
  Distance between a terminus base of telomere on chromosomal short arm and 5'-terminus of this base sequence : 195393429
  Distance between 3'-terminus of neighbour sequence of sequence listing upward to telomere on chrosomal short arm and 5'-terminus of this base sequence : 85507
gtactttcagtaaactttgaccactgattcaaatttttgcaaaataatctccaggatttgctaccttctctcttttccctagactgaaaaaggtgaggcttgtccctcaacttggaaataggtatttcttaccaatttaaaaacatttgaagataatcaattaattttgataacatttaaaagcatatgaacagttaattcccaccttaaattgaattttgacctgtgctttttttttcttataaaaataaataataaacaagaatcactaagttttcccaagggcatttcttgataatgtaatgagtgtgtgtgtgtgtgtgtgtgtgtgtgtgtgtgtgtgtgtgtgtatgaagtcattattgactaacaattgtaatccacaaaaccatgcattcatcaaatatttattgaggttaaggcactgcatgtattta

SEQ ID NO: 6355 - DNA, 259 bp, Homo sapiens
  chr3.fa.O7frz.218059295
  Located on chromosome 3
  Distance between a terminus base of telomere on chromosomal short arm and 5'-terminus of this base sequence : 195473928
  Distance between 3'-terminus of neighbour sequence of sequence listing upward to telomere on chrosomal short arm and 5'-terminus of this base sequence : 80062
gttgctaacgctgtataagtaaacaattttaattttttttggcattgggtattatttcaccttttgtatgtgtatatgtctgattgctaatttagtgggttaagatgagtgtcaggctgacatctaagatggcccctagtagttcctgcttcctttactctctctctctttctctctccatatatatatatatatatatatatatatatatatatatatatatatatatatatctgtgttatgtttactatcaggtgct

SEQ ID NO: 6356 - DNA, 166 bp, Homo sapiens
  D3S3530
  Located on chromosome 3
  Distance between a terminus base of telomere on chromosomal short arm and 5'-terminus of this base sequence : 195555472
  Distance between 3'-terminus of neighbour sequence of sequence listing upward to telomere on chrosomal short arm and 5'-terminus of this base sequence : 81285
acattgcagagacgaagcacaaattctccaagtcctccatcactggcaatgatggtgaagacactcttacatgctgcagttcctaaactctgtgtgtgtgtgtgtgtgtgtgtgtgtgtgtgtgtgtgtgtaatcctcatgccatggtctgtggcaaatggtttgt

SEQ ID NO: 6357 - DNA, 275 bp, Homo sapiens
  chr3.fa.O7frz.216376121
  Located on chromosome 3
  Distance between a terminus base of telomere on chromosomal short arm and 5'-terminus of this base sequence : 195644070
  Distance between 3'-terminus of neighbour sequence of sequence listing upward to telomere on chrosomal short arm and 5'-terminus of this base sequence : 88432
cctgcactcatatgtttatcacactattcacaatagcaaagacatggaatccacctaaatgtccatgaacagaggacacatatgtgtgtgtgtgtgtgtgtgtatacacactcagccataaaaaagaatgaatactattcagccataaaaaagataaaattatgtcttttgtagcaacatggatggagctagaggtcattatcctaagtgaaataactcagaaacagaaagtcaaatgtcgtatattctcacttgtaagtaggagctaaacaatg

SEQ ID NO: 6358 - DNA, 475 bp, Homo sapiens
  AC069409.7_172100
  Located on chromosome 3
  Distance between a terminus base of telomere on chromosomal short arm and 5'-terminus of this base sequence : 195979720
  Distance between 3'-terminus of neighbour sequence of sequence listing upward to telomere on chrosomal short arm and 5'-terminus of this base sequence : 335375
tcaatgtggaacagatctaaatgtccatcaatcaacgagtggataaagaaactgtggtgtgtatatatatatatatacacacacacacacacacacatatatacacacatatatatatgatggaatatggatatatacatgtggcatatacatacatatatatgatggaatatatatatatgtggtatatacatacatatatatgatggaatactactcagccataaaaaggaatgaatgcatggcattcacaccaacctgtatgggattggtgactattattctaagagaagtaactcaggaatggaaaacaaaacattgtatgttctcactcataagtgggagctgagctatgaggatgcaaaggcataaggatgacacaataaacttcagggactcagggggtaaggatgggaagtaggtaagggataaaagactacaaattgggttcagtgtatactgctcaggtgatggt

SEQ ID NO: 6359 - DNA, 396 bp, Homo sapiens
  AC067718.8_132461
  Located on chromosome 3
  Distance between a terminus base of telomere on chromosomal short arm and 5'-terminus of this base sequence : 196008525
  Distance between 3'-terminus of neighbour sequence of sequence listing upward to telomere on chrosomal short arm and 5'-terminus of this base sequence : 28330
agtgaacatgtgctttattcttaggttttgacaggcatatctaagaattttatatgtattagcttatttaattattataacacttttagaagttgctcattgtacagacatgaaaactgagacttattattatgttcattttacagatgacaaaaccgagtcttacagacattaaatatctaacccaaatttacacacctatacacaggaacttgaagctgactcatgtctcaaagacaaattgtctcaaaacatatatatatatatatatatatatatatatatatatatatatatatggattatcacctcaaaatgttaagcaatgaacctatatctacaccaagaagagttatacaatgttcaacattttgcttacaattctgcaatgtaagc

SEQ ID NO: 6360 - DNA, 318 bp, Homo sapiens
  AC063939.9_41538
  Located on chromosome 3
  Distance between a terminus base of telomere on chromosomal short arm and 5'-terminus of this base sequence : 196084113
  Distance between 3'-terminus of neighbour sequence of sequence listing upward to telomere on chrosomal short arm and 5'-terminus of this base sequence : 75192
gaacactggtctgtatgtcaagatggtcccagttactgagaacttttgagcaaatctcttctcctttctggggcttagattcctcatcggcgaataaagtggctgaaccaaatgatctttaactttgaattttcctgatctaacttttccttttccttttcctccctctgcctcctcctcctcctcctccttctctctctctctctctctctctctctctctgttgcctaggctggagtgcactggtctgaggatggctcactgtaacctcaacctgctgcactcaagtgatcctctgcacctcagcctcctacagat

SEQ ID NO: 6361 - DNA, 403 bp, Homo sapiens
  AC069409.7_51039
  Located on chromosome 3
  Distance between a terminus base of telomere on chromosomal short arm and 5'-terminus of this base sequence : 196179041
  Distance between 3'-terminus of neighbour sequence of sequence listing upward to telomere on chrosomal short arm and 5'-terminus of this base sequence : 94610
tctaggacaataaatggctcacatgtgtgctaaatacatatcaattgctttcttttctgagtctgtttcttcattcataaaatgaaaattaaaatattacttcttataatcataaaacatgttatctttgtcataagtatggtatgattataggattttgaatgtaaacactttatcggtagtcaagatatagcaattcattcattcattcattcattcattcattcattcatgttttttgaatgctcttgttgggttaggccccgtggtgggagctgctgttaaaattttaacagaaccaatccctcccatcccaatgtagctcatagtccaggaaagagagagtgatgaaaacatgattgtaataaatgctgcatgtgtgaagttccaacagctatagttg

SEQ ID NO: 6362 - DNA, 370 bp, Homo sapiens
  AC063939.9_142349
  Located on chromosome 3
  Distance between a terminus base of telomere on chromosomal short arm and 5'-terminus of this base sequence : 196181088
  Distance between 3'-terminus of neighbour sequence of sequence listing upward to telomere on chrosomal short arm and 5'-terminus of this base sequence : 1644
tggtatctgttagttggatcttagtcccacttatgattacttccttaaggtggaaaccaggttcccagagctgctctgtgaagattgaagaggttggtaaacacatagagatacacatgagcacacacacacacacacacacacacacacacaccaggaactgccaagaggatattttaatagggacaattacatctgcaacacttggctatctctgcattaccaaacaaggtgacaacagcaaaatcctactcaaccacaacggcagaagcagatcgctctgataatcagtgcaacaccatgggtttggttactgcaggataactctctgaccttactgggcatcgtttccatacagtagctatacagg

SEQ ID NO: 6363 - DNA, 195 bp, Homo sapiens
  D3S1294
  Located on chromosome 3
  Distance between a terminus base of telomere on chromosomal short arm and 5'-terminus of this base sequence : 196181157
  Distance between 3'-terminus of neighbour sequence of sequence listing upward to telomere on chrosomal short arm and 5'-terminus of this base sequence : -301
gctgctctgtgaagattgaagaggttggtaaacacatagagatacacatgagcacacacacacacacacacacacacacacacaccaggaactgccaagaggatattttaatagggacaattacatctgcaacacttggctatctctgcattaccaaacaaggtgacaacagcaaaatcctactcaaccacaacg

SEQ ID NO: 6364 - DNA, 472 bp, Homo sapiens
  AC063939.9_99301
  Located on chromosome 3
  Distance between a terminus base of telomere on chromosomal short arm and 5'-terminus of this base sequence : 196194207
  Distance between 3'-terminus of neighbour sequence of sequence listing upward to telomere on chrosomal short arm and 5'-terminus of this base sequence : 12855
cacgtgagagttgtagtttcaccaccaagaagcttattctctctaagcttttgaatttgcagcaacttaattgtgtgtgtgtgtgtgtgtgtgtgtgtgtgtgtgtgtgtttgggggaggaggtgaactgggctttgatagatacatgaaatgatgaaaaaccaagaaagagagctgggtgtggtggcacgtgcctgtggtcccagctccccgggaggcttgaaggatcgcctgagcctaagagtttgaggctccagtgtgctatcatcacatctgtgaatagccactgccctatatcctagacaacatggttagaccatgtctctaagaagagagagagagagagagagagagaaaacaacccaaaacaagaaagatagattgatagattgaggcaacacaagcatccttaggaagagaaggaagatctgatgactgacattaacctgttaatttataccatggctctgta

SEQ ID NO: 6365 - DNA, 256 bp, Homo sapiens
  AC067718.8_129684
  Located on chromosome 3
  Distance between a terminus base of telomere on chromosomal short arm and 5'-terminus of this base sequence : 196289354
  Distance between 3'-terminus of neighbour sequence of sequence listing upward to telomere on chrosomal short arm and 5'-terminus of this base sequence : 94675
ttcaggtatcaaggtaattgttactttctcaaagagatttttctggctctctttattctcaatccctctcatagtctattatgcattatactgtcatttgccttcatggcactgaccactacatgtgtgtgtgtgtgtgtgtgtgtgtgtgtgtgtgtgtgtgtgtttatctttctccttgaatactttataagctccatgaatgtaaaaatcacatattttgttcaccgctgtgtaactagcaactagaatcgtt

SEQ ID NO: 6366 - DNA, 427 bp, Homo sapiens
  AC069507.4_85979
  Located on chromosome 3
  Distance between a terminus base of telomere on chromosomal short arm and 5'-terminus of this base sequence : 196430722
  Distance between 3'-terminus of neighbour sequence of sequence listing upward to telomere on chrosomal short arm and 5'-terminus of this base sequence : 141112
caagttctattaactgaggaacagaggatttagggaataatattaatagatctcccagatatctcttttactgatgataaaaaccaactcacttcagaaatttaaaagataccataccagatatgataataaatgctagggcagtgtgtgtgtttgtgtgtgtgtgtgtgtgtgtgtgtgtgtgtgtgtgtgtggtgacgtagttgaaaaataccttgagaatttctacaaagagccatgtagatagtccaaaaaataagtctctcaaggcatcagaacaaaggtgaggatgaagctgtggcatagaagaattcatgggccaaaacatgaatggctgccaacttatcctgtgtatttgcaactgcatttaagagggtgaggtggagtggacaagagagctcagtagtcattagacctgttctcaaca

SEQ ID NO: 6367 - DNA, 455 bp, Homo sapiens
  AC069507.4_12324
  Located on chromosome 3
  Distance between a terminus base of telomere on chromosomal short arm and 5'-terminus of this base sequence : 196473495
  Distance between 3'-terminus of neighbour sequence of sequence listing upward to telomere on chrosomal short arm and 5'-terminus of this base sequence : 42346
tatgcactgtacttgtaaatcctaacacaaagatgaaaaaatgatccttcaagagctgcagttttaggtttaatacttttttcccaatatcttattaaaaggcatttctacccaactccgcgtctcctcccccatcacaccatttctctctcctttgcttggcttcctcccccttctttcctctctctgctctcttctgtcaaggtcgttccatcacttgtctctgcaaggagcctcagagacttttacactctacagattgggaaacagacccagagagcaacatgatttacacacacacacacacacacacacagacacactcacgcacggagcatatccagtacttggctcccctcccaatctgctttccactacatatcaagttgacccaaaatatcccctttgatctatgattgtcctttttgatgtattattgtccttatgaaactgca

SEQ ID NO: 6368 - DNA, 156 bp, Homo sapiens
  D3S1314
  Located on chromosome 3
  Distance between a terminus base of telomere on chromosomal short arm and 5'-terminus of this base sequence : 196524997
  Distance between 3'-terminus of neighbour sequence of sequence listing upward to telomere on chrosomal short arm and 5'-terminus of this base sequence : 51047
tcaatctgtggagtcattggttttctctattttccttccagccctgaaaaacattgtgtgtgtgtgtgtgtgtgtgtgtgtgtgtgtgtgtgtgtgtggttttccctgaagcagagtcagagacccttaatttgcacagggccaaatgtgtaagtt

SEQ ID NO: 6369 - DNA, 386 bp, Homo sapiens
  AC008249.14_71570
  Located on chromosome 3
  Distance between a terminus base of telomere on chromosomal short arm and 5'-terminus of this base sequence : 196672944
  Distance between 3'-terminus of neighbour sequence of sequence listing upward to telomere on chrosomal short arm and 5'-terminus of this base sequence : 147791
agatcgtaagaagtaggctgagcttcggaatcaggctgggtttgaattctagatactgcatgcctagcctgtccagacttagttttctcacctgtaaaatggtaataaacatgcctgccttcctttgcttccttccttccttccttccttccttccttccttccttccttccttccttcctccctccctcccttcgttcctcttccttccttcctattatctatgtatctttctatgtatctatctatgtatctatgtatctatctatctatctatctatctatctatctatctatctatctctatttattaataaggttcaagtaagaaaaaatatattaagcctctagcttttaatagctggcacctagaaggcactcagtaaa

SEQ ID NO: 6370 - DNA, 269 bp, Homo sapiens
  AC008249.14_105077
  Located on chromosome 3
  Distance between a terminus base of telomere on chromosomal short arm and 5'-terminus of this base sequence : 196706550
  Distance between 3'-terminus of neighbour sequence of sequence listing upward to telomere on chrosomal short arm and 5'-terminus of this base sequence : 33220
agcatgatacatatttgctgagtgaattaaaagtagtgtttgaccatctcatcataaattactcctccttccagccttgaagttccctgtcacattctgtgttggatttaatttgcttcctcggtttaaaattatatatatagatagatagagatctgtctatctatctatctatctatctatctatctatctatctatctatctatcttctatagttagttctgtatctttctgtaacctcttcctgttgtcttaaatacgctttaac

SEQ ID NO: 6371 - DNA, 212 bp, Homo sapiens
  D3S2747
  Located on chromosome 3
  Distance between a terminus base of telomere on chromosomal short arm and 5'-terminus of this base sequence : 196713439
  Distance between 3'-terminus of neighbour sequence of sequence listing upward to telomere on chrosomal short arm and 5'-terminus of this base sequence : 6620
tttcacattgcttgcctgtatcaaaacatatctcgtccacacacacacacacacacacacacacacacacacacacacatctgctacataaccacacacacacacaaactaaaaaatttggaaaagaaggagaaaatgctcaatacatgttttattgaataaatgaaagactgatggagagaaaaagatttccccaaggtcataatataaga

SEQ ID NO: 6372 - DNA, 469 bp, Homo sapiens
  chr3.fa.O7frz.218686152
  Located on chromosome 3
  Distance between a terminus base of telomere on chromosomal short arm and 5'-terminus of this base sequence : 196934242
  Distance between 3'-terminus of neighbour sequence of sequence listing upward to telomere on chrosomal short arm and 5'-terminus of this base sequence : 220591
acaaatatcagtgctttgacacacagagacacacacaaatacaagtagttttttggtggtggtggtgttgttttggagacagagtctcgctctgtcgtcgaggctggagtgcagtggcacggtctccgctcactgccctctccacctcctgggttcaagcaattcttctgcctcagctttctgagtagctgggacaataggtgcaggccaccatgcccagctcatttgtgtgtgtgtgtgtgtgtgtgtgtgtgtgtgttttagtagaaacgggttttcaccgcgttgcccaggctggtttcgaactcctgagctcaggcaatccgcccaccttggcctcccgacgtgttgggattacaggcatgagccaccgtgctgggacatagtttttaattaaataaaaaataattatagatacatttaaaataaattcaaaattcaatttctccttctcagtacggtttacctg

SEQ ID NO: 6373 - DNA, 168 bp, Homo sapiens
  G08280
  Located on chromosome 3
  Distance between a terminus base of telomere on chromosomal short arm and 5'-terminus of this base sequence : 196973055
  Distance between 3'-terminus of neighbour sequence of sequence listing upward to telomere on chrosomal short arm and 5'-terminus of this base sequence : 38344
ggaataccacctgaagaacctgcctgaaactgtctcacaggtaaatctgtctatatatctctatctatctatctatctatctatctatctatctatctatctatctataatctaattagaaggactatactctgaagtaaagataaaaagtgtagtatgggccaggcg

SEQ ID NO: 6374 - DNA, 292 bp, Homo sapiens
  chr3.fa.O7frz.218815239
  Located on chromosome 3
  Distance between a terminus base of telomere on chromosomal short arm and 5'-terminus of this base sequence : 197120288
  Distance between 3'-terminus of neighbour sequence of sequence listing upward to telomere on chrosomal short arm and 5'-terminus of this base sequence : 147065
attgcacattgatttactcaagtttatatgtgtttaagttttgtctcagactctcagttcccaagatagcatgtgagctttattcgctgttgtatctctagggtctagcctggtgttttgtacatagcagacacacacacacacacacacacacacacatacacaaatgtagagccttgtttcatcaagattaagagcattgagtaataacatctttattagagatgatttaatgagaaaaataactggataaaggtcattttcaaaggtcataaacatgagtaggacattc

SEQ ID NO: 6375 - DNA, 241 bp, Homo sapiens
  AC026665.5_84899
  Located on chromosome 3
  Distance between a terminus base of telomere on chromosomal short arm and 5'-terminus of this base sequence : 197166189
  Distance between 3'-terminus of neighbour sequence of sequence listing upward to telomere on chrosomal short arm and 5'-terminus of this base sequence : 45609
gatctgtatatggtcgtaactgactgggattcaagaggtttacattctaattacttggcttggtagtcaaagaagcaaaaaagagattattatcatgcattcagagagcaaatatagttgacaaacacacacgagagagagagagagacagagagagagagagagagagagagagagagaattaaatgtgaagatttgatggaaaacaaagaagcattcattcttaatcaagccaagatct

SEQ ID NO: 6376 - DNA, 151 bp, Homo sapiens
  chr3.fa.O7frz.219067867
  Located on chromosome 3
  Distance between a terminus base of telomere on chromosomal short arm and 5'-terminus of this base sequence : 197330713
  Distance between 3'-terminus of neighbour sequence of sequence listing upward to telomere on chrosomal short arm and 5'-terminus of this base sequence : 164283
tcaaagtatggtttcactgaacatgtattgcttttgcaccattgtaaagttgaaaaatcattaagttgaactattgcaagtcaaggctcatctgtgtgtgtgtgtgtgtgtgtgtgtgtgtgtgtgtgtggtcagaaattagagtatgaaa

SEQ ID NO: 6377 - DNA, 313 bp, Homo sapiens
  AC023895.11_133051
  Located on chromosome 3
  Distance between a terminus base of telomere on chromosomal short arm and 5'-terminus of this base sequence : 197451739
  Distance between 3'-terminus of neighbour sequence of sequence listing upward to telomere on chrosomal short arm and 5'-terminus of this base sequence : 120875
tagttataagaatcgcttgatcctgggagattgagcttccagtgagctgagatcgcgccactgcactccagcctgggtgacagagtaagactccgtcttaaacaacaacaacaacaacaacaaactttttgtcttccatcttaaaacaaaacaaaacaccaaataagttttattaggacactcatataatcttctacctactatgtctagtctttccatcccattcaggccaaacttcctaaaataattttctgcctctaatacttttcacatgtttactcttcaatccctttgaatctcactttcatctttc

SEQ ID NO: 6378 - DNA, 436 bp, Homo sapiens
  AC068645.7_141331
  Located on chromosome 3
  Distance between a terminus base of telomere on chromosomal short arm and 5'-terminus of this base sequence : 197587528
  Distance between 3'-terminus of neighbour sequence of sequence listing upward to telomere on chrosomal short arm and 5'-terminus of this base sequence : 135476
tggacaagtaaatcacctgtaggtctgggaggagggcctgggttctgcatttctattaatctcctaagtgatacccttgtcactgctctagggaagacaataaggggcaaaatcagctgaaccctcttattttatagacaaattacttgagagatgtggggacatctacatctacctgtatggcaaagtacatgaccataaacctttacacacacacacacacacacacacacacacacacacacacccctacctacccgggaatctggatgaaatgtaatagagcttgaattaaagtaagagtaatctccaggaacaccaaggaaagtgcactgaaaactattgacctgattttccaaatgagtcttagagaggggaaggtgacttgctcaaaattatatctttgtaagcccagtgtgagcacttgtaccattat

SEQ ID NO: 6379 - DNA, 451 bp, Homo sapiens
  AC023895.11_55027
  Located on chromosome 3
  Distance between a terminus base of telomere on chromosomal short arm and 5'-terminus of this base sequence : 197587578
  Distance between 3'-terminus of neighbour sequence of sequence listing upward to telomere on chrosomal short arm and 5'-terminus of this base sequence : -386
ttctattaatctcctaagtgatacccttgtcactgctctagggaagacaataaggggcaaaatcagctgaaccctcttattttatagacaaattacttgagagatgtggggacatctacatctacctgtatggcaaagtacatgaccataaacctttacacacacacacacacacacacacacacacacacacacacccctacctacccgggaatctggatgaaatgtaatagagcttgaattaaagtaagagtaatctccaggaacaccaaggaaagtgcactgaaaactattgacctgattttccaaatgagtcttagagaggggaaggtgacttgctcaaaattatatctttgtaagcccagtgtgagcacttgtaccattattcaatagaacctgaagaaaatattgacacataacaatggaagaattcctgcattaccacatagta

SEQ ID NO: 6380 - DNA, 368 bp, Homo sapiens
  AC073365.9_125082
  Located on chromosome 3
  Distance between a terminus base of telomere on chromosomal short arm and 5'-terminus of this base sequence : 197675706
  Distance between 3'-terminus of neighbour sequence of sequence listing upward to telomere on chrosomal short arm and 5'-terminus of this base sequence : 87677
atagctccatagtgagtaggagtagtaatcttatttcagatataacacaagaacaaagccatcatggctcctagcatgttaaagtccacgaagagatcaggatgatactggctagtgactttctaagtaggcttccttcacaaaccgggaatctgcaagatcatcatcatcatcatcatcatgaccatcatcatcgtcatcatcgtcatcatagaaaaacttagccaaataggctaaggatatagttacctgccccatctttgggtataaaaatagttatttggggtggggagcatgtttgaaaccttcagtttttgctgaatgaagatatagagtatgaatttcactcgctattcaatgttgataac

SEQ ID NO: 6381 - DNA, 342 bp, Homo sapiens
  AC072023.3_125369
  Located on chromosome 3
  Distance between a terminus base of telomere on chromosomal short arm and 5'-terminus of this base sequence : 197789843
  Distance between 3'-terminus of neighbour sequence of sequence listing upward to telomere on chrosomal short arm and 5'-terminus of this base sequence : 113769
tcatagaatgatcacaggaaaccaaaggatgaggaaatactacaacccatagagtggatgtgattagtagaagggggaaagattaaagttattttctgattgttccaaatttgttccaattataggataaaaattcaaatatgaaaagaaagttaacacacaggtagaatagattgtgatgtatgtgtgtgagaaaatatatatatatatatatatatatatatatatatatatatataaaacctctaataaattacaaacaagaacatatccaataatttatccacaaaaatatcaccaaattttgacgagtataaatgagagttcataatgaaagtcata

SEQ ID NO: 6382 - DNA, 398 bp, Homo sapiens
  AC072023.3_74941
  Located on chromosome 3
  Distance between a terminus base of telomere on chromosomal short arm and 5'-terminus of this base sequence : 197831904
  Distance between 3'-terminus of neighbour sequence of sequence listing upward to telomere on chrosomal short arm and 5'-terminus of this base sequence : 41719
ggttgacttgtaacctaagctctctggagggttgaaaaaaattatacctttttagattattagctttctttattgttagcatggaagggacattctcttgcagttttcattatcctaaaagcataagcatgacttgaacccgtgagtcttgtaggtagtttttgatttgaaatttagtcatcactgggaaatattctctatgcctttctgtatctactctgatgaagtttagtaaaatagaaagcatggaagatatatgttatagtacaacattgtcctgcatcctataaaaagcaagcaaacacacacacacacacacacacacaaaacagaacacacaattactacctggtcaaattagcttgagcattactcacttcaccaaacttcactgagta

SEQ ID NO: 6383 - DNA, 339 bp, Homo sapiens
  chr3.fa.O7frz.219822590
  Located on chromosome 3
  Distance between a terminus base of telomere on chromosomal short arm and 5'-terminus of this base sequence : 197881245
  Distance between 3'-terminus of neighbour sequence of sequence listing upward to telomere on chrosomal short arm and 5'-terminus of this base sequence : 48943
tattgatcttatggaggtagtgagtcgaatgatagtttccagaagttgggaaaaatgtgtgtgtgtgtgtgtgtgtgtgtgtgtgtgtgtgtggtgggccagggtgggtgggggtgtggggaagaagagagtttagttaatggttccaaacatacaattagaagaaaggaataagttcaaatgtacaatggcaaagtaggatgactatagtaaataatgtattgtatatttcaaaatagctacaagagagaacttgaaatgttctcaatacatggtaatgataaatacttgaggtgatggatattctaaagacctaagttagtcgttacgcattctatg

SEQ ID NO: 6384 - DNA, 328 bp, Homo sapiens
  AC067719.8_63744
  Located on chromosome 3
  Distance between a terminus base of telomere on chromosomal short arm and 5'-terminus of this base sequence : 198027441
  Distance between 3'-terminus of neighbour sequence of sequence listing upward to telomere on chrosomal short arm and 5'-terminus of this base sequence : 145857
ttcatccattatggacacttagggtgattatatatcttgcctattgtgaagagtgctgcaataaatatgagagggcagatatctcttcaacatactgatttctttataaaataagtaaataaatgtatgtatgtacacacacacacacacacacacaaaactataacatagcaactgcacccagttgctggatcatatggtagttctacttttaattttttgagacacatccatactgttttccataatggctgtactaatttatattcccacagtgtccaaaatatatagggagttcaaacaactcgattacctactggatatttct

SEQ ID NO: 6385 - DNA, 208 bp, Homo sapiens
  D3S1601
  Located on chromosome 3
  Distance between a terminus base of telomere on chromosomal short arm and 5'-terminus of this base sequence : 198330668
  Distance between 3'-terminus of neighbour sequence of sequence listing upward to telomere on chrosomal short arm and 5'-terminus of this base sequence : 302899
atgtttctagggctggcaaccttgactctctccatgcacaggcacacacacacacacacacacacacacacacacacacacacacacacacaatcttccagtgattaatcaatcctattatccagatctttttttatttttaaaaatttgccctcaaatatattcatattttagaaaacagtattattttcccagaattgaccataag

SEQ ID NO: 6386 - DNA, 358 bp, Homo sapiens
  AC026320.9_128002
  Located on chromosome 3
  Distance between a terminus base of telomere on chromosomal short arm and 5'-terminus of this base sequence : 198396639
  Distance between 3'-terminus of neighbour sequence of sequence listing upward to telomere on chrosomal short arm and 5'-terminus of this base sequence : 65763
gatggtacctgaagttaccatctttattttctcaatctttgcaacgaacattgttctttaagacatattttctcccttgtgaagcttcccttacctcactttaatcctctttgtgtaaattattttcaaacagcattcatatatatatatatagagagagagagagagagagagagagagagagcgagaacagaacatatcacaatatatgattacatcatacatatttctctatattaggtgcactcctcttcaaattaggaatttggttttattttcttttatatcattagaggaaggcaagtcatttgtcctaaataacattggataaattgtatacaagttgtggagcttgtat

SEQ ID NO: 6387 - DNA, 413 bp, Homo sapiens
  AC026320.9_43949
  Located on chromosome 3
  Distance between a terminus base of telomere on chromosomal short arm and 5'-terminus of this base sequence : 198436716
  Distance between 3'-terminus of neighbour sequence of sequence listing upward to telomere on chrosomal short arm and 5'-terminus of this base sequence : 39719
atgaagtaacgagtaacttgctagagacagatccattgtgagggatagcaaatggaataggaacaccagacacacacacacacacacacacacacacacacacacacacacacacaatcctggcatgttaggtttgaataaccaaaaaacaaaatacataaattttgaaggtagactaagaaaaacatacatcacacatgaggaacaaagattagaataaaagtagacttctttttcagaaatcatacaaactagaaaataatagattgacatctttaaaatgttaaagaaaaaataacttattaagccagaattctatactagacaaaattattttacaagaatgaagaagaaatactttccttggaaaaacaaaaactctgggaatttcctgccagtaaacataagctaca

SEQ ID NO: 6388 - DNA, 336 bp, Homo sapiens
  chr3.fa.O7frz.220277004
  Located on chromosome 3
  Distance between a terminus base of telomere on chromosomal short arm and 5'-terminus of this base sequence : 198469676
  Distance between 3'-terminus of neighbour sequence of sequence listing upward to telomere on chrosomal short arm and 5'-terminus of this base sequence : 32547
aatgctgtcaacttagaattctacacagagcaaaaatatctttcaaaaaatgaagttggaataaagacagatttagataaacaaaagctgagatcattcactgctggcaatctcattctagcagaaatttatatatatatataaatacatatatatagtagtatatatatatatagctctagtagagttttacatatatacatataaatgtgtgtgtatacacatacacacacacatatatgtgtgtgtttttttgacacagggtcttgctctgttgctcatgctggagtgtaatggcatgatcatagctcactgtaaactcgaactcctgaactc

SEQ ID NO: 6389 - DNA, 422 bp, Homo sapiens
  AC024692.3_200729
  Located on chromosome 3
  Distance between a terminus base of telomere on chromosomal short arm and 5'-terminus of this base sequence : 198483150
  Distance between 3'-terminus of neighbour sequence of sequence listing upward to telomere on chrosomal short arm and 5'-terminus of this base sequence : 13138
ttatactctgatcaggcagaatacaaattagtaggcaaatatattgcagtaaatgttatagtagagcctgtacacatggttatatgactacatagaagagccctctaacacctacatgaaagcatgaaaggtttcctaggaaaaactaaactgtgattaacagagaatggagatgagtgtgtgtgtgcatatatatatatatatatgatattatattatatattatatataaaaatagtgaaataatgaataatgaatcaatgatgagtatatatatatatatatatatatatatatactcatctccattctttgttaatcacagtttagttttttgtgcatgtacatacatacacacagtatataaatataagcccagaacattagatgtgtattcatatgtcagtaggacagtgatactg

SEQ ID NO: 6390 - DNA, 305 bp, Homo sapiens
  D3S3557
  Located on chromosome 3
  Distance between a terminus base of telomere on chromosomal short arm and 5'-terminus of this base sequence : 198533229
  Distance between 3'-terminus of neighbour sequence of sequence listing upward to telomere on chrosomal short arm and 5'-terminus of this base sequence : 49657
tatgctttagtgggctctctaggtaattctgatgcacactcaacttgtagagttgctgtccttaattcttccatgagaaatacccggatgttctaagaatacacatttgtatctatgtcttgcctctgcagattctaattcataagaagttacacacaaatacacacacacacacaactgattaagtaactaaattgaataactttaaggaatgacaacgcctatttacacacacacacacacacacacacacacacatcacatcacatttgtagtaggaaaagcatgacatctgaagttaccag

SEQ ID NO: 6391 - DNA, 211 bp, Homo sapiens
  D3S3663
  Located on chromosome 3
  Distance between a terminus base of telomere on chromosomal short arm and 5'-terminus of this base sequence : 198535747
  Distance between 3'-terminus of neighbour sequence of sequence listing upward to telomere on chrosomal short arm and 5'-terminus of this base sequence : 2213
tggaaaccatgtatatggccaagtgtgtgtgagtgtgtgtgtgtgtgtgtgtgtgtgttagtactgtctccccactaccaaataaattgggagaaataaatcaatattcctttattccaagtttaatacttctgtatggatggctctcaaatgattcttagttatcttatttggaaatatatttatttctccaggtctcagctcttgaagc

SEQ ID NO: 6392 - DNA, 303 bp, Homo sapiens
  AC025140.2_79351
  Located on chromosome 3
  Distance between a terminus base of telomere on chromosomal short arm and 5'-terminus of this base sequence : 198709678
  Distance between 3'-terminus of neighbour sequence of sequence listing upward to telomere on chrosomal short arm and 5'-terminus of this base sequence : 173720
acttattggtgataacattcagacaaaacttttttcttgatatctcaattttttacatgtaaataaacagagataaacagatggacagatgattgatagatagcttaagctgtaatggatatattttatatccaggtgggaaatacacacacacacacacacacacacacacatatacacacatatatacatactatatatatacaaatatatatacacatatatatatgcacacacacacacatatactcaaaaccattaagaattaatttgacaaaagtaattcaacatcctaagatgaaa

SEQ ID NO: 6393 - DNA, 334 bp, Homo sapiens
  chr3.fa.O7frz.220621384
  Located on chromosome 3
  Distance between a terminus base of telomere on chromosomal short arm and 5'-terminus of this base sequence : 198781264
  Distance between 3'-terminus of neighbour sequence of sequence listing upward to telomere on chrosomal short arm and 5'-terminus of this base sequence : 71283
taggtgtctatcatggattatgagggataagggaagggctgtattaatctttaggtcctcagtgggcagcgtaagtactgtactctacagacggatggatgcatggacggatagatgcatggatggatggatgggagagcgggagagagagagaagagatgaatgaatgaattaatgaatgaagtggtcactcccctcaaggactctacaggctcttttggaataagtgcatctatacatgtaattcttctcctggtcaaaccccggactgatcaaagtagagtgtttttgctgaatatggggcaagaagctattaactgacagagtggttgaa

SEQ ID NO: 6394 - DNA, 291 bp, Homo sapiens
  AC026671.12_84175
  Located on chromosome 3
  Distance between a terminus base of telomere on chromosomal short arm and 5'-terminus of this base sequence : 198812204
  Distance between 3'-terminus of neighbour sequence of sequence listing upward to telomere on chrosomal short arm and 5'-terminus of this base sequence : 30606
atcctgctactaggtatctactcagaggaaaagaagtcattatgtgaaaaagagacttgcacatgcatgtcattacaattagcaattgcaaaaatatggaaccagcccaaatgcccatcaatcaatgagtgcataaagaaaatgtcatacacacacacacacacacacacacacacacacacacacacacacaccatggaatactactcagccctaaaaaggaatgaaataatggcattcacagcaacttggatggagatggagaccgctattctaagtgaggtaactccg

SEQ ID NO: 6395 - DNA, 382 bp, Homo sapiens
  AC027402.2_84580
  Located on chromosome 3
  Distance between a terminus base of telomere on chromosomal short arm and 5'-terminus of this base sequence : 198961921
  Distance between 3'-terminus of neighbour sequence of sequence listing upward to telomere on chrosomal short arm and 5'-terminus of this base sequence : 149426
ataatgccagattgctaatactagagcacaaaaactaagtatgatttcttgttgtctttacaaccccaccccagtaagtctgtgaaaactcagagagttcaagaaatactaagtaggtaagtcaaaatagtacctgtatagacttctttaaaacagatacacacacacacacacacacacacacacacacacacttacatatgttgaagggagaaaggtttataaaagaagtaaaatttttatgtcttataattaaagttacaaaattagataaattttatctttttatatacctttgactatatgcctgaatatctcagtaatagtcattgtttcatataaaagagtttccttttttagctccaactcatgtagcacatac

SEQ ID NO: 6396 - DNA, 448 bp, Homo sapiens
  AC026671.12_22466
  Located on chromosome 3
  Distance between a terminus base of telomere on chromosomal short arm and 5'-terminus of this base sequence : 199033645
  Distance between 3'-terminus of neighbour sequence of sequence listing upward to telomere on chrosomal short arm and 5'-terminus of this base sequence : 71342
agaattataagactcaaagcatgttaaaatatatttcaacacatcttaatacagccgggcatagtggcttatgcctgtaatcccagaactttgggaggctgaggcaggaggatgtcttgagcccaggagtttgagactgtagcctaagcaacatgatgagacctcacctctctaaaatatatatatatgtgtgtgtatatatatatgtatatatatgtgtgtgtatatatatatgtatatatatgtgtgtgtgtgtatatatatatatatatatatatacaggaagaatacatgcaaaaatgtcaaaaatattaactctggacaattagagattctaaaatttcttgactttgtcatgctctctataattgaggtcaagtgttctctttccttccattgaaatattcaactcccatcactctttgtggactttgaagatttctaaaat

SEQ ID NO: 6397 - DNA, 351 bp, Homo sapiens
  AC027042.2_47409
  Located on chromosome 3
  Distance between a terminus base of telomere on chromosomal short arm and 5'-terminus of this base sequence : 199080104
  Distance between 3'-terminus of neighbour sequence of sequence listing upward to telomere on chrosomal short arm and 5'-terminus of this base sequence : 46011
tcacatgcaactgtaagaaataatgtagagagaacccgtgtatactttacgtagtttcccccaatggtaatattttgcaaaactattacagtcttactaccaagatattaacatttatataattcacagacctcagtttgacttgtactctgtgtgtgtgcatgtgtgtgtgtgtgtgtgtgtgtgtgtttagttatatacaattttatcatatgtagaggttcatgtggaggccaccacaatcaaaatgagttttgtcacaggtatcttttatgttgcccttttataaacatactctcctttccttttcccaccctaccaactgatctctaacctctggaaaccactaat

SEQ ID NO: 6398 - DNA, 469 bp, Homo sapiens
  AC027402.2_144282
  Located on chromosome 3
  Distance between a terminus base of telomere on chromosomal short arm and 5'-terminus of this base sequence : 199176196
  Distance between 3'-terminus of neighbour sequence of sequence listing upward to telomere on chrosomal short arm and 5'-terminus of this base sequence : 95741
gaggctggaaatctacctagacaaagaaaaatgtgatataggtgggggtcagtgggaggtgagagtgtgtgtgtgtgtgtgagagagagagagagaggagaggagaggagaggagaggaaaggggaggggagaataggggagaaaggagggaagaggaaaggaggggaggggaggagaggaaggaggggaggggaggagaggaagggagggagggggaaggaagaaagggaggaagggaaaagggagggagaaagggaggaagggaaagggagggaagagggaaagaaggaaggaagaaaggaaggaaggaagaaaggaaggaaggaaagaaggaaggaaggaaggaggaaaggaaggaaaaagcctgtttcctcactccaaatcatgcttctcaaacattaatgtgcatacaaattgcctaggtactttgtcaaaattctaattctgactcaatagacctggagtaaa

SEQ ID NO: 6399 - DNA, 196 bp, Homo sapiens
  D3S3669
  Located on chromosome 3
  Distance between a terminus base of telomere on chromosomal short arm and 5'-terminus of this base sequence : 199236691
  Distance between 3'-terminus of neighbour sequence of sequence listing upward to telomere on chrosomal short arm and 5'-terminus of this base sequence : 60026
ccttcaaaggtagattacagttggggtattggggtgacctcattattttcaaattgtaaatggatatagaaataaatactggtgtgtgtgtgtgtgtgtgtgtgtgtgtgtgtgtgtgcgcgcgcactgtagttctctcaactgagaggacctgagagaagtgacacactaatggcaattagcatacctagcaccg

SEQ ID NO: 6400 - DNA, 209 bp, Homo sapiens
  AC016947.15_149006
  Located on chromosome 3
  Distance between a terminus base of telomere on chromosomal short arm and 5'-terminus of this base sequence : 199310962
  Distance between 3'-terminus of neighbour sequence of sequence listing upward to telomere on chrosomal short arm and 5'-terminus of this base sequence : 74075
cctcagaacctactctcagaagctttcatatgatgctaatgaattttgaccttgcttcatcattgctttttgttttgggttgtgtgtgtgtgtgtttgtttgtttctgaaacagggtcttcctctgtagcccaggccagagtgcagtggcacaatcgtggctcacagcaacctcaacctcctgggattaaacagtccttgcatctagat

SEQ ID NO: 6401 - DNA, 322 bp, Homo sapiens
  chr3.fa.O7frz.221373952
  Located on chromosome 3
  Distance between a terminus base of telomere on chromosomal short arm and 5'-terminus of this base sequence : 199525363
  Distance between 3'-terminus of neighbour sequence of sequence listing upward to telomere on chrosomal short arm and 5'-terminus of this base sequence : 214192
agatgaatcttttagcctagaaatattgaaacattaagaaaaaggcatgtcgggagttcgagaccagcctgaccaacatggagaaaccccgtctctactaaaaatacaaaattagccaggcgtggtggcgcacgcctgtaatcccagctactcgggaggctgaggcaggagaatcgcttgaacccggaaggcagaggttgcagtgagccgagatcgcgccactgcactccagcctgggcgacaagagcgaaactccgtctcgaaataaataaataaataaataaataaataaataaatgaaggtaagttatgaatgcataaa

SEQ ID NO: 6402 - DNA, 430 bp, Homo sapiens
  AC026101.10_89925
  Located on chromosome 3
  Distance between a terminus base of telomere on chromosomal short arm and 5'-terminus of this base sequence : 199548832
  Distance between 3'-terminus of neighbour sequence of sequence listing upward to telomere on chrosomal short arm and 5'-terminus of this base sequence : 23147
ttgtttagaattattggtgcatgctgataataaacagaattttagttgttctgttattgcttttaaattatttatagacaattcacacctttattgtttatacctggggcagaccactctcactcccagcccttagcaggccacattggctggcctaataggaacactccgtgctaagagggcctgggagagactcacatgggatgaatccgaggcctgtcttacctttgatagctttataaatgaagagagagaggctaccaagagggaaaatacacacacacacacacacacacacacacacacacacagagatagagagagagagagacagagagagagagggagagagagagagagaaaggcgttgagggagaaagagaaagattattttggttagcataggacctgataaatgatcctgatcttg

SEQ ID NO: 6403 - DNA, 345 bp, Homo sapiens
  AC068162.2_38445
  Located on chromosome 3
  Distance between a terminus base of telomere on chromosomal short arm and 5'-terminus of this base sequence : 199762680
  Distance between 3'-terminus of neighbour sequence of sequence listing upward to telomere on chrosomal short arm and 5'-terminus of this base sequence : 213418
tttatggacagttgatcttgagagtggtttgtctacatgagaaattaatttttgacatgatagttaacatcagtattggctttttttgaaatttgtttatcagaaaagaaattgtgtctaccaaataagagcttatgtgtatttagctcagatgacatccctgaattatttgctatttgacatccctgaaacacacacacacacacacacacacacacacacacactcttacacgatacttactttggtgtagacccaaccaatccaaagtgtttatttaaggggcaggagctgcataggagaagaacgtgtgtttcagaagactcagcctatctttaaacatct

SEQ ID NO: 6404 - DNA, 390 bp, Homo sapiens
  AC068162.2_75961
  Located on chromosome 3
  Distance between a terminus base of telomere on chromosomal short arm and 5'-terminus of this base sequence : 199776431
  Distance between 3'-terminus of neighbour sequence of sequence listing upward to telomere on chrosomal short arm and 5'-terminus of this base sequence : 13406
atcatgtatctagtttgccttgacattctctatttaagcctggcataattattaatagtgtctcacttcactcctaaagagtgtcccagtctgatcagtaatgatggggcatattctctggcttctttggcctgcggattattattattattattattattattttttgagacagagccttgctctgttgcccaggctggagtgtagtggtgtgatcctggctcactgcagcctcgacctcccaggctcaagcaatcctctcacctcagcctccccaagtagctgagactataggcaagagccaccatgcccagctaatttgtaaaagtgtttttttagagacaaggtctcactgtgttgcccaggctagtctcaaactcctgaactcaa

SEQ ID NO: 6405 - DNA, 211 bp, Homo sapiens
  D3S3590
  Located on chromosome 3
  Distance between a terminus base of telomere on chromosomal short arm and 5'-terminus of this base sequence : 199852913
  Distance between 3'-terminus of neighbour sequence of sequence listing upward to telomere on chrosomal short arm and 5'-terminus of this base sequence : 76092
tcgaactcctaaaatgctgggattataggcatgagccacctcacccagccacaatgcaccttatttcccacacttatgcacccatggaatctttcctctctctctctctgtgtgtgtgtgtgtgtgtgtgtgtgcaaatacatgcacagattatctcctgaccactggaacctccataggaaggctggaacgttctcaatgaccgataggt

SEQ ID NO: 6406 - DNA, 352 bp, Homo sapiens
  AC024447.2_66552
  Located on chromosome 3
  Distance between a terminus base of telomere on chromosomal short arm and 5'-terminus of this base sequence : 199987734
  Distance between 3'-terminus of neighbour sequence of sequence listing upward to telomere on chrosomal short arm and 5'-terminus of this base sequence : 134610
cattgcttaaatttaagctcaggaggtcgagactgtagtgagtgatgatcgtgccactgcactccagcctgggtgacagggcaagatcctgcctcaaaaaaaaaaaaatcctaatagataaagagttccttttaaaaacagatctccagcaaataactgtatagcaaaattgctagatattgtcacttcacacacacacacacacacaaacacaaacacaagtggtgtgttaagtgtctgcaaagctgttcattcttacccatgataagagaaatgaaagttcttccctgcttcctgattgcctgcctgcctgcctttacttcttttcttccttattcagtcttaaagctat

SEQ ID NO: 6407 - DNA, 446 bp, Homo sapiens
  chr3.fa.O7frz.221747079
  Located on chromosome 3
  Distance between a terminus base of telomere on chromosomal short arm and 5'-terminus of this base sequence : 200000376
  Distance between 3'-terminus of neighbour sequence of sequence listing upward to telomere on chrosomal short arm and 5'-terminus of this base sequence : 12290
ttctttaaagatagagcactgtcttactgccagttgaatggaatgtactggctaaaaacaaaggactaagtactcattatttaattgaaaaagcatccaacttctagtgctcttcacccagcaataagtatgttttcttcagcagaaaggaatttcccagcatgctctttccactcagaagagtttttgacactgaactccagcctgggcgacagaacaagactctgtctcaaaataaataaataaataaataaataaataaataaataaataaataaggagtatggtggttcctgctacttcctcataatatttgctgttctaatacatgaaatatgtgggatattgagagtgagtcagtaacagaaacaaacaaaaaacacaattatatttgattccacattattaggaaactattgtgtaaaagaccttctacttgattctgg

SEQ ID NO: 6408 - DNA, 441 bp, Homo sapiens
  chr3.fa.O7frz.221964261
  Located on chromosome 3
  Distance between a terminus base of telomere on chromosomal short arm and 5'-terminus of this base sequence : 200102240
  Distance between 3'-terminus of neighbour sequence of sequence listing upward to telomere on chrosomal short arm and 5'-terminus of this base sequence : 101418
ccttgagcaaatagtgaagtataggataaacataaaaagtaagctaagtaaacccattgtaatagtaattacaaaatatatatgtacgtgtgtgtgtatgtgtgtgtgtgtgtgtatatatatatgtagttctcttggtttcaaaaatttgctagcacaatttaaccaaataaatgaaaataaaattaacattttatcacaaggtcaaaatataaggagtaaagggtttatggggggggtaataaaaatgttctagaactactgatggcttcaaaaatttgtgaacatactaaacctcactgaactctatactttaaaagggtgaattttatgaaatgtgaattatatctcaatgaagagatataacaaatttaaaaatcatacctcaataaaaaattatacctcaaaaaaacctaactgaacatttaacagccttactag

SEQ ID NO: 6409 - DNA, 193 bp, Homo sapiens
  HUMUT6129
  Located on chromosome 3
  Distance between a terminus base of telomere on chromosomal short arm and 5'-terminus of this base sequence : 200252311
  Distance between 3'-terminus of neighbour sequence of sequence listing upward to telomere on chrosomal short arm and 5'-terminus of this base sequence : 149630
ggcaatcactccagcaaagtgcccacaatacagacttctaatatagataaggctggcttgcttgcttgcttgcttgcttgcttgcttgcttgcttgcttgcttgcttgctttctttctttctttctttctgtctttattctttcttcttttttttttttcagggactcactctgtcacccagactggatcaca

SEQ ID NO: 6410 - DNA, 354 bp, Homo sapiens
  chr3.fa.O7frz.222312842
  Located on chromosome 3
  Distance between a terminus base of telomere on chromosomal short arm and 5'-terminus of this base sequence : 200358937
  Distance between 3'-terminus of neighbour sequence of sequence listing upward to telomere on chrosomal short arm and 5'-terminus of this base sequence : 106433
agagtgaggttccatctagaaggaaagaaagaaagaaaggaaggaaggaaggaaggaaggaaggaaggaaggaaggaaagaaagagagagagaaggagaaagagagagagaaagaaagaaagaagaaagaaagaaagaaagaaaaagaaagaaagaaagaaagaagaaagaaaggaaggaaggaaggaaggaaggaaggaaggaaggaaggaaggaaggaaaagaagttagctgtggtgttagctgggccaaactaagaacaccaagtcagttttgtctgtgttttacatctacaattttaaatatcaaatttaaacattgaaaagttttttttttcctttgaactggtgagtg

SEQ ID NO: 6411 - DNA, 222 bp, Homo sapiens
  D3S3562
  Located on chromosome 3
  Distance between a terminus base of telomere on chromosomal short arm and 5'-terminus of this base sequence : 200556775
  Distance between 3'-terminus of neighbour sequence of sequence listing upward to telomere on chrosomal short arm and 5'-terminus of this base sequence : 197484
ccccacttcacagatgagaaaatcggttcaaggcattcaacaagtttgtcaatgtcataatgctagtaagaggcaaactcaagaccctaaacaaggtttgtctgaattccatgctcttattcactgtactgaacaatgctacaatcaacttttcccccagaaaacgaaacacacacacacacacacacacacacacacacacacgcttgcatgtgggcacca

SEQ ID NO: 6412 - DNA, 374 bp, Homo sapiens
  AC024559.10_19680
  Located on chromosome 3
  Distance between a terminus base of telomere on chromosomal short arm and 5'-terminus of this base sequence : 200624889
  Distance between 3'-terminus of neighbour sequence of sequence listing upward to telomere on chrosomal short arm and 5'-terminus of this base sequence : 67892
cgaatccaatttagaactcaggcctttggatacattctttccctatcccatagttccttctcccatcacatctcaccctgcaaccccacactacctcatccgtgacaagtatggaacactcttctcagctcctcaggccagagctacctcttgaaaaggaaacctcattccacagagggtttcactctatcacacacacacacacacacacacacacacaacacagacatatgcacacacagaaacatagaatgactaaggtggcattttccggtgatggctgtgagacaagcatccatagttcagaggctacattaacattagtgatgcatgttcacaagcggccccttcacttggaattctgatatgaacaa

SEQ ID NO: 6413 - DNA, 82 bp, Homo sapiens
  D3S2748
  Located on chromosome 3
  Distance between a terminus base of telomere on chromosomal short arm and 5'-terminus of this base sequence : 200625061
  Distance between 3'-terminus of neighbour sequence of sequence listing upward to telomere on chrosomal short arm and 5'-terminus of this base sequence : -202
cagagggtttcactctatcacacacacacacacacacacacacacacaacacagacatatgcacacacagaaacatagaatg

SEQ ID NO: 6414 - DNA, 338 bp, Homo sapiens
  AC024559.10_140834
  Located on chromosome 3
  Distance between a terminus base of telomere on chromosomal short arm and 5'-terminus of this base sequence : 200685014
  Distance between 3'-terminus of neighbour sequence of sequence listing upward to telomere on chrosomal short arm and 5'-terminus of this base sequence : 59871
ggaatttattggctcatagttctagaggctgggaagtccaagatccaggagctgacatctgctgagggccctcttgctgcatcatcccatggcagaagggcaaagagaggaggagagagagagagagagagaggataaaagggggctgaacttcaccgtttacaacaaacctactccagtgataatagcattaatccattcactccaccttcatggcctaattacctctcattaggccccacttcccaacactgttggctttgggatttagtttccaacacgtgctttctggggaacacattgaaactatggcacccttggagaatgactagttctcc

SEQ ID NO: 6415 - DNA, 307 bp, Homo sapiens
  AC026308.17_19341
  Located on chromosome 3
  Distance between a terminus base of telomere on chromosomal short arm and 5'-terminus of this base sequence : 200829945
  Distance between 3'-terminus of neighbour sequence of sequence listing upward to telomere on chrosomal short arm and 5'-terminus of this base sequence : 144593
ctctagcctggcaacagagctagactctgtctcaaaaaataaaataaaataaaataaaataaaataaaataaaataaaataaaataaaataaaataaaataaaataaaataagacataataaagagagtaaaaagtcaaaccacaaactgggggaaaacattcacaataaatttacctgataaaggtctcatacctggaattataatgaaccagaaaacagaaaaaaagataacccataacaaatgggcaaaaaccatggacgggaacttctcaaagaggatcttcaaatggctaatacgtatatga

SEQ ID NO: 6416 - DNA, 474 bp, Homo sapiens
  AC069244.6_113886
  Located on chromosome 3
  Distance between a terminus base of telomere on chromosomal short arm and 5'-terminus of this base sequence : 201449578
  Distance between 3'-terminus of neighbour sequence of sequence listing upward to telomere on chrosomal short arm and 5'-terminus of this base sequence : 619326
gttcttgaaacctaagaaaggaagtgagacgttgagcaaacaaaatgaatgaaaagtaagtcccgtatccttttatggctgcatgtacattttatttatttatttatttatttatttatttatttatttattagcctgagtctcgctttgttgcccaggctggagtgcagtggcgtgatctctgctcactgcaacctctgcctcccaggttcaagcgattctcctgcctcagcctcctgaatagctgggactacaggcgcccgccaccacacccagctaatttttgtatttttagtagagacacggtttcaccatgttggccaggctggtcttgaactcctggcctcagggtgatccgcccactgtggcctcccaaagtgttgggattacaggcgtgagccaccgcgcccaggcagcgtgtacattttagcaggcaacttctggaagcaaattcttagcacaaagaaatgactc

SEQ ID NO: 6417 - DNA, 281 bp, Homo sapiens
  AC016953.9_69813
  Located on chromosome 3
  Distance between a terminus base of telomere on chromosomal short arm and 5'-terminus of this base sequence : 201658470
  Distance between 3'-terminus of neighbour sequence of sequence listing upward to telomere on chrosomal short arm and 5'-terminus of this base sequence : 208418
cctagtcttagcttgattcgttaatgcttgatctttttctatttttgttttgagacagggtgtcactctgttgccctagctggagtgcagtggcgtgagcttggctcactgcattctccaccaccacccaggctcaagtgagcctcttgagtagctgagatgtccagttaatttttattttttattttattattattattattattattattattattattatttggtagagacagggttttgccatgttggccaggctggtcttcaattgaaactcctgg

SEQ ID NO: 6418 - DNA, 419 bp, Homo sapiens
  AC022503.13_16887
  Located on chromosome 3
  Distance between a terminus base of telomere on chromosomal short arm and 5'-terminus of this base sequence : 201802980
  Distance between 3'-terminus of neighbour sequence of sequence listing upward to telomere on chrosomal short arm and 5'-terminus of this base sequence : 144229
ctgctagagctatcagaaagacacaagacaaaaagcttcttgcatatgtataaactaaatgtgataatctcaaaaaactgttcaaaattataattactttccagtttaaagacttcagtcctaaattaaaaaaaaaacttctatatacaaaccactgatttgcccagaccaaaaaaagaaagaaagaaagaaagagaaatcagcggtaaggtaagcaggacccagaggagctgatattcacagttcttacatggacaactctttcaggaattatccataaagtactttattttacaacctgcttttcttgtaaaactaaaggtgcacgtttttacataaaagttttacacagtgttaaaaccagaactgtgtgtaaaatactgcatgtatatgtttctaaatagtcttgttccagtggt

SEQ ID NO: 6419 - DNA, 278 bp, Homo sapiens
  DISO7_00016124
  Located on chromosome 3
  Distance between a terminus base of telomere on chromosomal short arm and 5'-terminus of this base sequence : 202098268
  Distance between 3'-terminus of neighbour sequence of sequence listing upward to telomere on chrosomal short arm and 5'-terminus of this base sequence : 294869
aaaggctatgtccaatgttctataagggcagggacacacacacacagtgtctctcacacacacacacacacacacacacacacacacacacacacagtgtcacacatacatactagcaacacacagaacgggcataaagtaagatgtattaaggagaaattgcgagcagggagcagtggagtccacatgacccccgagctctcattgcacagagaggtgggtatggtggacacacagcaggatgtggtacaggagagagacctgctcctgtttaacag

SEQ ID NO: 6420 - DNA, 227 bp, Homo sapiens
  DISO7_10000271
  Located on chromosome 3
  Distance between a terminus base of telomere on chromosomal short arm and 5'-terminus of this base sequence : 202152248
  Distance between 3'-terminus of neighbour sequence of sequence listing upward to telomere on chrosomal short arm and 5'-terminus of this base sequence : 53702
tcctgcttaccttaccgctgatttctctttctttctttctttctttctttctttctttctttgctctgggcaaatcagtggtttgtgtatagattttttttttttaatttaggattaaagtttttaaactggaaagtaattataattttgaacagttttttgagattatcacatttagtttatacatatgcaagaagctttttgtcttgtgtctttctgatagctcc

SEQ ID NO: 6421 - DNA, 98 bp, Homo sapiens
  DISO7_10735120
  Located on chromosome 3
  Distance between a terminus base of telomere on chromosomal short arm and 5'-terminus of this base sequence : 202485425
  Distance between 3'-terminus of neighbour sequence of sequence listing upward to telomere on chrosomal short arm and 5'-terminus of this base sequence : 332950
tctccagtaatacaggcgtgcacacacacacacacacacacacacagtctctcttcctctttattgtccccccccaacccacccacatgcaatcataa

SEQ ID NO: 6422 - DNA, 371 bp, Homo sapiens
  chr3.fa.O7frz.226231894
  Located on chromosome 3
  Distance between a terminus base of telomere on chromosomal short arm and 5'-terminus of this base sequence : 202630934
  Distance between 3'-terminus of neighbour sequence of sequence listing upward to telomere on chrosomal short arm and 5'-terminus of this base sequence : 145411
ttatcagcaaggtctttatgacgtgtatcttgtgacctcctatctcatcctgtgacttagaatgcctaaccatctgggaatgcagcccagtaggtcttggccttattttacccagcccctattcaagatggagttgctgtggttcaaatgcctctgacaaagcctctacagtcgtatgagacaatttctaaactctctctttctgtctctctctctccacacacacacacacacacacacacacacacacacacgcgcacacacaccactgtatatagactggttctgtttctttggggaactctgactgatatactcactcagtgtggtctgcttcctagactggagtctgatacaacgttgaaatagat

SEQ ID NO: 6423 - DNA, 386 bp, Homo sapiens
  AC016949.16_135030
  Located on chromosome 3
  Distance between a terminus base of telomere on chromosomal short arm and 5'-terminus of this base sequence : 202884987
  Distance between 3'-terminus of neighbour sequence of sequence listing upward to telomere on chrosomal short arm and 5'-terminus of this base sequence : 253682
agaagccataaagtagcctgtagaggccagcaccggggcttatgcctgtaatcccagcactgtgggaggctgaggtgggtggatcacctgaggtcaggagttcaagaccagcctgggcaacatggtgaaaccctgtttctactaaaaatacaaaattagccgggtgtggtggcgcactcctatagtcccagctacttgggaggctcaggcaggagaatcgcttgaacccaggaggtggaagttgcagtgagctgagatcatgccattgcactccagcctgggcacaaagagtgaaactacatctcaaaataataataataataataataataataataatattcaaaaaggagaatagttgggaagcctataaatttcagcctatc

SEQ ID NO: 6424 - DNA, 360 bp, Homo sapiens
  AC009861.3_94250
  Located on chromosome 3
  Distance between a terminus base of telomere on chromosomal short arm and 5'-terminus of this base sequence : 203003357
  Distance between 3'-terminus of neighbour sequence of sequence listing upward to telomere on chrosomal short arm and 5'-terminus of this base sequence : 117984
gccatctttggagtttaaatactatatagtgtttagcaagtatttgttaaccagagcgtattttgctggaatgagctctgcaggcttgcttccattattattattattattattatttttatttttttgagatggagttttgcttgttgcccaggctggagtgcaatggcgtgatctcggctcactgcaatctctgcctcctgggttcaagcaattctcctgccttagcctcccgagtagctgggattacaggcatgcgccaccacacctggctaattttatatttttagtagagacagggtttctccatgttcgtcaggttggtctcgaactcccaacctcaggtgatacgtatgcctt

SEQ ID NO: 6425 - DNA, 268 bp, Homo sapiens
  D3S1272
  Located on chromosome 3
  Distance between a terminus base of telomere on chromosomal short arm and 5'-terminus of this base sequence : 203274804
  Distance between 3'-terminus of neighbour sequence of sequence listing upward to telomere on chrosomal short arm and 5'-terminus of this base sequence : 271087
tcacaagggaaataactgttttacttagaagtttgttttgcaaaatgaaggtggggggtggcgtgtatacacgcgcatacacacacacacacacacacacacacacacaaataacattccaggatattcatcccatggatgaagtaggaggtaacctctggtgtgaatattttcttatggtattttacatataataatctgatctcaaatgttttatatagaacatgcatcatttttataataaatttattttggagggttacaggaa

SEQ ID NO: 6426 - DNA, 144 bp, Homo sapiens
  D3S1311
  Located on chromosome 3
  Distance between a terminus base of telomere on chromosomal short arm and 5'-terminus of this base sequence : 203276783
  Distance between 3'-terminus of neighbour sequence of sequence listing upward to telomere on chrosomal short arm and 5'-terminus of this base sequence : 1711
ggaagtttcagccaacgacgtgatccatatcctgttttccttactcaaatctagcctacaaagttacacacacacacacacacacacacacacacacacacacacagttagcaagagactaaaatgtaacatcagtgggactaa

SEQ ID NO: 6427 - DNA, 268 bp, Homo sapiens
  D3S3707
  Located on chromosome 3
  Distance between a terminus base of telomere on chromosomal short arm and 5'-terminus of this base sequence : 203336981
  Distance between 3'-terminus of neighbour sequence of sequence listing upward to telomere on chrosomal short arm and 5'-terminus of this base sequence : 60054
agccgtggcagtttgaggcctacagttcactctatgtcattaattgactctgtgtgtgtgtgtgtgtgtgtgtgtgtgtgtgtgtgcatgagagagagacagagagagagagaggataatttgtgagtgaaccctttgttcttcatcccttctccatcttgtgctccccccatagcctaggaacttccccaggttcatggatttcttgaccactcaccgtctgtagacaccgtcttcagacaccatctcagcactgaagacacactgt

SEQ ID NO: 6428 - DNA, 480 bp, Homo sapiens
  chr3.fa.O7frz.224113002
  Located on chromosome 3
  Distance between a terminus base of telomere on chromosomal short arm and 5'-terminus of this base sequence : 203578757
  Distance between 3'-terminus of neighbour sequence of sequence listing upward to telomere on chrosomal short arm and 5'-terminus of this base sequence : 241508
gaagtaatgcagtgaggtaactatatatatgggggtgggagggttggggtgttggggtgtgtgtgtgtgtgtgtgtgtgtgtgtgtgtgtatacacagatgagattttgctaaacgacttgagccccttgtacaaccctagtcatacgcactactagggacaactggtattacactgctttcaggaaaaaaaaaaactgaggctgactgcattccatcattattcaccataaagcattagaaaacggaaatggtactctgcaggccctcttagaaagcaagcctgtggcattacaccaggacatcaggcctgctggatgaccaaaataaagctcaggaaggtaccacttaggtaaaagttggctaaaactaagtgggtaacccaactcaaaaatgccagggagtcctcttcaactccaccagcttcctgtggctcaaggctgagtgaaagactcagagctcctatctgtaaagcacatca

SEQ ID NO: 6429 - DNA, 437 bp, Homo sapiens
  AC046143.11_12795
  Located on chromosome 3
  Distance between a terminus base of telomere on chromosomal short arm and 5'-terminus of this base sequence : 203801202
  Distance between 3'-terminus of neighbour sequence of sequence listing upward to telomere on chrosomal short arm and 5'-terminus of this base sequence : 221965
aaataaccaagtatgctgataaagatttaaccatggccgggctcggtggctcatgcctgtaaccccagcattttgagaggccgaggcagggggatcacttgaggtcaggagttcgagactaccctgatcaacatggtgaaaccccgtctctactaaaaatacaaaaattagctgggcatggtggcaggcgcttgtaatcccagctgctcagggggctgaggtatgagaatcgcttgaacctgggaggcggaggttatagtgagccaagattgcaccactgcactccagcctgggtgacagactgagactctgtcttgaaaaaaaaaaaagtatatatatatatatatatatatatatatatatatatatatgcaaaaaacagagaggcaacagagatgtagataagagcctaagttaatcagagaatttacattgga

SEQ ID NO: 6430 - DNA, 300 bp, Homo sapiens
  chr3.fa.O7frz.223695476
  Located on chromosome 3
  Distance between a terminus base of telomere on chromosomal short arm and 5'-terminus of this base sequence : 204022447
  Distance between 3'-terminus of neighbour sequence of sequence listing upward to telomere on chrosomal short arm and 5'-terminus of this base sequence : 220808
taacagttagaataacctttggactattggatattctatggagagaggcaagtggtaggcagaatatagactctcagaaccagaattgcaattcatgaaagtttacccaccatatgtgtaaacacacacacacacacacacaaacacacacaaagtcatactctcctacaagatagaggtgtgacctacctagccctctctttgagtcctttctttctggcttgaataagagtagataggtagctggggtgttaaaagaatgttctaggttttagcacctgataccttgcaaagacttaa

SEQ ID NO: 6431 - DNA, 206 bp, Homo sapiens
  chr3.fa.O7frz.223622211
  Located on chromosome 3
  Distance between a terminus base of telomere on chromosomal short arm and 5'-terminus of this base sequence : 204066857
  Distance between 3'-terminus of neighbour sequence of sequence listing upward to telomere on chrosomal short arm and 5'-terminus of this base sequence : 44110
ctatagatggagctaggttccttctgtgtgtgtgtgtgtgtgtgtgtgtgtgtgtgtgcatgtgcgtgcacttctccttggatgcctgcttgcttctgtctctcatggaccattcagagagagagagataatctgattggcttggaaacatccatctttctggtttgggcttaaccttttcggctaagccatctcatagaacagtt

SEQ ID NO: 6432 - DNA, 294 bp, Homo sapiens
  AC011325.12_90321
  Located on chromosome 3
  Distance between a terminus base of telomere on chromosomal short arm and 5'-terminus of this base sequence : 204142954
  Distance between 3'-terminus of neighbour sequence of sequence listing upward to telomere on chrosomal short arm and 5'-terminus of this base sequence : 75891
tctaagcctcagtttccatagcagtaaaaccagagggcccttctctagagagttcttcccgccctgacagtctctctctctctctctctctctctctctctcacacacacacacacacacacacacacacacatatctgggtgggtatgttttacagaagtactgtattgctctacattttgtaacatgctcttaagtttttgagaaaatgatatacagaaggatttgtaacttctttgctattcactcaaatgaatccattttgtgttttagtagcttcagatcacttcaaca

SEQ ID NO: 6433 - DNA, 270 bp, Homo sapiens
  chr3.fa.O7frz.223501390
  Located on chromosome 3
  Distance between a terminus base of telomere on chromosomal short arm and 5'-terminus of this base sequence : 204164577
  Distance between 3'-terminus of neighbour sequence of sequence listing upward to telomere on chrosomal short arm and 5'-terminus of this base sequence : 21329
cctcagtgatcaagtactcaaatgccttcgtttaaagaatttttaaattgagtataagtaatacattgacacattatcatggtaaaattatatatatattatatatatatatagagagagagagagagagagagagcaatctattgaatagaaaatgaaaattccactttgcaccttcctctgactctcttactgagggtaaattgatgttcatcattgctacatgatgggtaatttgctacatatctacttgcatatgtaaatgcataa

SEQ ID NO: 6434 - DNA, 333 bp, Homo sapiens
  chr3.fa.O7frz.223378283
  Located on chromosome 3
  Distance between a terminus base of telomere on chromosomal short arm and 5'-terminus of this base sequence : 204287846
  Distance between 3'-terminus of neighbour sequence of sequence listing upward to telomere on chrosomal short arm and 5'-terminus of this base sequence : 122999
tctgctaatgtagtccataggatggatggcccacatctgattcaacattcttactttgatggcattcattttatctctagttttttcacttataaataatgcttccacaaacattctcatttgtacatatggacgcgtgtgtgtatgtgtccttccgagctagtgcttttatttcccaggcatagattcccaagagtaggagtgctgagctgaaggggatgtgtgtgtgtgtgtgtgtgtgtgtgtgtatacactatatatatataggatgtttccagattgttttcccaataaactacagcaattctcacttccattaatagtacatgaagg

SEQ ID NO: 6435 - DNA, 378 bp, Homo sapiens
  chr3.fa.O7frz.223144234
  Located on chromosome 3
  Distance between a terminus base of telomere on chromosomal short arm and 5'-terminus of this base sequence : 204549933
  Distance between 3'-terminus of neighbour sequence of sequence listing upward to telomere on chrosomal short arm and 5'-terminus of this base sequence : 261754
aacaagagtgaaactccaactctaaataaataaataaataaataaataaataaataaataaataaaatgtctctgccttcattgttttcaaaagtttcaagggatgaaattcaaaggtctttcttctctatttattatcttacaaatgttgtaactgctcctacgtgctcaaattgatctactaagcaaacctagctagatccatgagaaattcagtcctgtaataggaaagggagtagtggaaaaacaaactagaaatggaaaccaatattttagtctgtcaactcatacgagcccctgagaaaatcatttaatcacaccagacctcagctctctcactctgaaacagcttgactatcacttcaagacctaacattc

SEQ ID NO: 6436 - DNA, 340 bp, Homo sapiens
  AC069213.6_120478
  Located on chromosome 3
  Distance between a terminus base of telomere on chromosomal short arm and 5'-terminus of this base sequence : 204609913
  Distance between 3'-terminus of neighbour sequence of sequence listing upward to telomere on chrosomal short arm and 5'-terminus of this base sequence : 59602
cgaaacaggaaacatgtataagaggaaaacattatgtaagtattggtgagactctgtggatagagattctcatacaccctattggtaggatcatagaacttttctagtttggcaatatatatccaaattttaaatatgtatatcttttgaatttatcctcagaaaaggacaggacaaataataaggacacacacacacacacacacacacacacagatatggctgtttgctgcaatgttgtttctagagaaaaaaaagatacatcctaaatttttactaatagattggttaaatgaattacagtatatccatacagtagaataccatgtagagcatgtag

SEQ ID NO: 6437 - DNA, 411 bp, Homo sapiens
  AC069213.6_41251
  Located on chromosome 3
  Distance between a terminus base of telomere on chromosomal short arm and 5'-terminus of this base sequence : 204785021
  Distance between 3'-terminus of neighbour sequence of sequence listing upward to telomere on chrosomal short arm and 5'-terminus of this base sequence : 174768
gctgaaatgtcagtattcaaagagactcttcctgaccaccagaccgaagtgggcacccttcacttcctatcacgtcatcctattctcttttctaacctcccagaggagagtcacacagatagacaggaaaaataggtactctccctcctcaacccactctaattaggtatttttcctgtctgtctgtctatctcgcctctgggaggtaagtcccacaagggctgagacattgtctttcttctttaccactatatctgcaggactcagaacagtgccccgcacccccgtgtgtgtgtgtgtgtgtgtgtgtgtgtgtgtgtgtgtgtatacatacagcaacgtagtgttgctatatgttgttgaatgcgtgaatgaatggataaataaattagtaacagagctaggaccaga

SEQ ID NO: 6438 - DNA, 190 bp, Homo sapiens
  D3S1305
  Located on chromosome 3
  Distance between a terminus base of telomere on chromosomal short arm and 5'-terminus of this base sequence : 204788818
  Distance between 3'-terminus of neighbour sequence of sequence listing upward to telomere on chrosomal short arm and 5'-terminus of this base sequence : 3386
ctgctggaacttaaaagtgcattctgaccaaaaaaattaaattagaaaatccacatagcaaaaaaaaaaatgttttggatgaaaatatactttatctttctctcacacatactctctctctctctcgcacacatacccacacacacacacacacacacacacgcgcgcgcgaaaacaatatctcatttct

SEQ ID NO: 6439 - DNA, 129 bp, Homo sapiens
  DISO7_10001345
  Located on chromosome 4
  Distance between a terminus base of telomere on chromosomal short arm and 5'-terminus of this base sequence : 44783
  Distance between 3'-terminus of neighbour sequence of sequence listing upward to telomere on chrosomal short arm and 5'-terminus of this base sequence : 0
tagcaagatggtgcatggacctgcacccacacacacaaacacacacacacacacacacacacacaaaacaccactccaggcacacatggggatgcagtgcagaggctcttgggagggtggtcattgagt

SEQ ID NO: 6440 - DNA, 191 bp, Homo sapiens
  DISO7_10001344
  Located on chromosome 4
  Distance between a terminus base of telomere on chromosomal short arm and 5'-terminus of this base sequence : 132636
  Distance between 3'-terminus of neighbour sequence of sequence listing upward to telomere on chrosomal short arm and 5'-terminus of this base sequence : 87724
ctaggtaaagatgttcatgatgtgttattaattgaagaagtttgagagtaatttgtatagtttgctaccattttggtaaaaaatgtgtaccttcatatatttgtgattttatacacacacacacacacacacacacacacacacacacacacagaaaagagtccaaaaggatactcaccaagagtaattgg

SEQ ID NO: 6441 - DNA, 405 bp, Homo sapiens
  chr4.fa.O7frz.742373
  Located on chromosome 4
  Distance between a terminus base of telomere on chromosomal short arm and 5'-terminus of this base sequence : 426746
  Distance between 3'-terminus of neighbour sequence of sequence listing upward to telomere on chrosomal short arm and 5'-terminus of this base sequence : 293919
aaccatttgaccactacatttattcctatgttttttctttgtgtgtgtgtgtgtgtgtgtgtgtgtgtgtgtagacagagtctcactgtgtcacccagactggagggcagtggtgtgatctcggctcactgcaacctctgcctcctgggttcaagcgattctcctgcctcagcctcccaagtaactggattacaggcacctgccaccacgccaggctaatttttgtttttagtagagacggggtttcaccacgttggctgggctggtttctaactcccaacctctggtgatccgcccgcctcggcctcccaaagtgctgggattacaggcgtgagccagcgcgtccagccgaaggttgcttttttaaagcatttttagtcaaagtcttttgaaagatgaaaggtc

SEQ ID NO: 6442 - DNA, 225 bp, Homo sapiens
  D4S3038
  Located on chromosome 4
  Distance between a terminus base of telomere on chromosomal short arm and 5'-terminus of this base sequence : 635736
  Distance between 3'-terminus of neighbour sequence of sequence listing upward to telomere on chrosomal short arm and 5'-terminus of this base sequence : 208585
gaagaccagcattcggaagacactgcggaagaaagagcccacacggtctgtgatggtttagagaaagagaagcaggaacaacttctacatgttaaacaattttacttacacacacacacacacacacacacacacacacacacacacagtcactcagacacagagaaaagaacacacgcctttttaaacaccaatcaaatatgaacaattactgtgtattaaacc

SEQ ID NO: 6443 - DNA, 366 bp, Homo sapiens
  chr4.fa.O7frz.1302942
  Located on chromosome 4
  Distance between a terminus base of telomere on chromosomal short arm and 5'-terminus of this base sequence : 816062
  Distance between 3'-terminus of neighbour sequence of sequence listing upward to telomere on chrosomal short arm and 5'-terminus of this base sequence : 180101
tatgtactcagtaagcctgcacaaaagaaggcctgcacgctctgcagctcacccgtgttcagtgagagtacgtctgtgggtggacctgtgtgtgtgtgtgtgtgtgtgtgtgtgtgtgtgtaaaatcgatgacgtgtacatgactttccgggtgtctgagctctctggtggcctctgtttttgacgctctgttctgtggtctcaggacacagtctgggcggtgctgattcttgggaggtgactgaggcccctgttgacttagtacttggttttctttcgtcagttccgcgtgtgtgttggagaagggacttcttgcatagtgtattactccgttttcctgctgctgataaggacatacctgagact

SEQ ID NO: 6444 - DNA, 312 bp, Homo sapiens
  chr4.fa.O7frz.1203185
  Located on chromosome 4
  Distance between a terminus base of telomere on chromosomal short arm and 5'-terminus of this base sequence : 848343
  Distance between 3'-terminus of neighbour sequence of sequence listing upward to telomere on chrosomal short arm and 5'-terminus of this base sequence : 31915
caacatggagaagctcagtctctactaaaaatacaaaaaattagccgggtgtggtggtgcatgcctgtaatcccagctacttgggaggctgaggcaggagaatcgcttgaactcaggaggcggaggttgcagtaagccgagatcgcacccattgcactccagcctgggctacaagagtgaaactccgtctcaaacacacacacacacacacacacagagctaacatcatactcagttgtgaaagactgaaagcttttcccctaaggtcaggaacaaggctctcaccactactattcaacagcatactggaag

SEQ ID NO: 6445 - DNA, 228 bp, Homo sapiens
  DISD22_0003242
  Located on chromosome 4
  Distance between a terminus base of telomere on chromosomal short arm and 5'-terminus of this base sequence : 1006384
  Distance between 3'-terminus of neighbour sequence of sequence listing upward to telomere on chrosomal short arm and 5'-terminus of this base sequence : 157729
cagacagcactcaccacacacacccccaccacacacataccacacagaccacacatacactacaccacatacacacaacacacatcccacacacacatcacacaccacacacactacacacacacaacacatagaccacacaccacccatagacgtcacatacacatcacacaccacatacaccacacagagcacacactacacacaccacacagcacatagcacgtg

SEQ ID NO: 6446 - DNA, 153 bp, Homo sapiens
  DISO7_10009862
  Located on chromosome 4
  Distance between a terminus base of telomere on chromosomal short arm and 5'-terminus of this base sequence : 1217215
  Distance between 3'-terminus of neighbour sequence of sequence listing upward to telomere on chrosomal short arm and 5'-terminus of this base sequence : 210603
aactgatgtggtgacgttaatcgtttttaggtagataacgtgtattttgtgtgtgtgtgtgtgtgtgtgtgtgtgagagagagagagagagagagagagagagagagagagagagagagagagagagcgagagcagaccctgtgaagacaaga

SEQ ID NO: 6447 - DNA, 395 bp, Homo sapiens
  AL136360.9_180840
  Located on chromosome 4
  Distance between a terminus base of telomere on chromosomal short arm and 5'-terminus of this base sequence : 1393676
  Distance between 3'-terminus of neighbour sequence of sequence listing upward to telomere on chrosomal short arm and 5'-terminus of this base sequence : 176308
gcaagctttaaaaattgcaactgctgggctgggcgcggtggctcatgcgtgtaatctcagcactttgagaggccaaagtggatgaatcacctgaggtcaggagttcaagaccagcctagccaatatggcgaaaccccatctctacccaaaataaaaaaattagctaggcacagtggcacgcacctgtaattccagctgctcgggaggctgagacatgagaatcgcttcaactcaggaggcagaagttgcagtgagccaagatggtgccatcgcactctagcccgggcaacacagcgagactctgtctcaaaataataataataataataataataataataataacaacaacaacaatttcaactgctccccgttgcctgtagttcagacttgtc

SEQ ID NO: 6448 - DNA, 323 bp, Homo sapiens
  AC007702.1_105980
  Located on chromosome 4
  Distance between a terminus base of telomere on chromosomal short arm and 5'-terminus of this base sequence : 1393747
  Distance between 3'-terminus of neighbour sequence of sequence listing upward to telomere on chrosomal short arm and 5'-terminus of this base sequence : -324
gccaaagtggatgaatcacctgaggtcaggagttcaagaccagcctagccaatatggcgaaaccccatctctacccaaaataaaaaaattagctaggcacagtggcacgcacctgtaattccagctgctcgggaggctgagacatgagaatcgcttcaactcaggaggcagaagttgcagtgagccaagatggtgccatcgcactctagcccgggcaacacagcgagactctgtctcaaaataataataataataataataataataataataacaacaacaacaatttcaactgctccccgttgcctgtagttcagacttgt

SEQ ID NO: 6449 - DNA, 109 bp, Homo sapiens
  Z49237_1880
  Located on chromosome 4
  Distance between a terminus base of telomere on chromosomal short arm and 5'-terminus of this base sequence : 1393963
  Distance between 3'-terminus of neighbour sequence of sequence listing upward to telomere on chrosomal short arm and 5'-terminus of this base sequence : -107
aacacagcgagactctgtctcaaaataataataataataataataataataataataacaacaacaacaatttcaactgctccccgttgcctgtagttcagacttgtct

SEQ ID NO: 6450 - DNA, 158 bp, Homo sapiens
  Z49862.1_24054
  Located on chromosome 4
  Distance between a terminus base of telomere on chromosomal short arm and 5'-terminus of this base sequence : 1441672
  Distance between 3'-terminus of neighbour sequence of sequence listing upward to telomere on chrosomal short arm and 5'-terminus of this base sequence : 47600
gtactccatacctctgaaatcctacacgaacacacaatttgactcttcccacagacggctaaccctatccggtgggtacacgtgaatctgtgtgtgtgtgtgtgtgtgtgtgtgtgtgtgtgtgcgcgcgcgcgcgctacaatttgacgtttagcagg

SEQ ID NO: 6451 - DNA, 374 bp, Homo sapiens
  Z49862.1_19109
  Located on chromosome 4
  Distance between a terminus base of telomere on chromosomal short arm and 5'-terminus of this base sequence : 1446496
  Distance between 3'-terminus of neighbour sequence of sequence listing upward to telomere on chrosomal short arm and 5'-terminus of this base sequence : 4666
agacatctgagtagcacaggagctccagagcactcccagcaccaccaagagtccctcctcctccgagagcaccttcaaaggacaggcagcctgacatgtaccctcggtgccacctcctgcctgctgcttttgtaaacatccttatcatctacaccaggcctccctgatggagtgggcatctcagattcagaagccgagagaaagagagagagagagagagagagagagagagagagagagagagacacacagagagaaacagaaaaagtaacagaaacttctcccaatctgttttgtggatggctttgtgctggggcctccttcattgcttagccaggcttttcacagctctaccttagccttcacttcctact

SEQ ID NO: 6452 - DNA, 454 bp, Homo sapiens
  chr4.fa.O7frz.1860851
  Located on chromosome 4
  Distance between a terminus base of telomere on chromosomal short arm and 5'-terminus of this base sequence : 1561017
  Distance between 3'-terminus of neighbour sequence of sequence listing upward to telomere on chrosomal short arm and 5'-terminus of this base sequence : 114147
aggtcaggagttcgagactagcctggccaacatggtgaaaccccatctctattaaaaacacaaaaattagctgggtgtggtggtgggcacctgtaatcccagctactcagaggctgaggcaggagaatcgcttaacccaggaggcggaggttgcagtgagccgagatcacaccactgcactccagtgcaggtgacagagcgagactccgtctccaaataataataataataataataataataataataataataataataataagaggattgtggatatcaagttgtcaaagtgcatatttaattttcgtgaatatattttaaatggtaatgtaacagtaaaaatgtcaatattaacaatagagcagaaatcatgtactttgcaattttttaaacttgtgataaggattttaaatttcaactttaaaatatgtcaggcagtacagatagtttg

SEQ ID NO: 6453 - DNA, 164 bp, Homo sapiens
  DISO7_10001347
  Located on chromosome 4
  Distance between a terminus base of telomere on chromosomal short arm and 5'-terminus of this base sequence : 1710303
  Distance between 3'-terminus of neighbour sequence of sequence listing upward to telomere on chrosomal short arm and 5'-terminus of this base sequence : 148832
aaaggtgttgaccatctgcaaaaagagagctgtaatcacacacacacacacacacacacacacacacacacacacacaggcacgcacgcacacacagaaaccccgtgctatttgaaaagctgagttagcccctgagctagcgtcccggccattcaggaccagta

SEQ ID NO: 6454 - DNA, 226 bp, Homo sapiens
  DISO7_10001348
  Located on chromosome 4
  Distance between a terminus base of telomere on chromosomal short arm and 5'-terminus of this base sequence : 1789493
  Distance between 3'-terminus of neighbour sequence of sequence listing upward to telomere on chrosomal short arm and 5'-terminus of this base sequence : 79026
atgaacaagaagctcagtgctggccaagcacagtggctcacacctgtaatcccagtgcttcgggaggctgaggcaggaggattgcttgaggccaggaatttgagtccagccggggcaacatagtgagaccctgtctctacacacacacacacacacacacacacacttaaaaatttataaaaagaagctcgctgtgcagttttaaaccaaagcaggaattcaatta

SEQ ID NO: 6455 - DNA, 427 bp, Homo sapiens
  HUMUT943
  Located on chromosome 4
  Distance between a terminus base of telomere on chromosomal short arm and 5'-terminus of this base sequence : 2333439
  Distance between 3'-terminus of neighbour sequence of sequence listing upward to telomere on chrosomal short arm and 5'-terminus of this base sequence : 543720
ctcacgccagtaatcccagcactttgggaggccgaggcgggaggaaagaaggaagggaggaagagatgaaaggagaaaataagaaaggcaggaagtcagtcaggcaggaaagaaagaaaaagagaaagaaagaaagaaagaaagaaagaaagaaagaaagaaagaaagaaagaaagaaagaaagaaagaaagggaaagaaagaaagggaaagaaagaaagaagagaaagaaagagagaaagaaagaaagagagagagcgagagaaagaaagaagaaagaaaggaaggaagaagagagaagaaaaaagaagagagaaaagaaaagaagaaaagaaaagaaaagaaaagaaaagaaaagaaaacggggaggggcatatctctttgactagtgactacccaggatacagctgactgaagcctcgacctgt

SEQ ID NO: 6456 - DNA, 202 bp, Homo sapiens
  DISD22_0003265
  Located on chromosome 4
  Distance between a terminus base of telomere on chromosomal short arm and 5'-terminus of this base sequence : 2598182
  Distance between 3'-terminus of neighbour sequence of sequence listing upward to telomere on chrosomal short arm and 5'-terminus of this base sequence : 264316
accactaccacgagcaaacccaccccgacacacacacaggtacacacgggtgcatgcacacaggaacacatggacacacacacagacacacacacacggacacacacacacggacacacaaagacacacacaaggacacaaggatacaagcacacggacacacatggacacacacaaggacatatagacaaagacacagaca

SEQ ID NO: 6457 - DNA, 143 bp, Homo sapiens
  D4S1614
  Located on chromosome 4
  Distance between a terminus base of telomere on chromosomal short arm and 5'-terminus of this base sequence : 3801371
  Distance between 3'-terminus of neighbour sequence of sequence listing upward to telomere on chrosomal short arm and 5'-terminus of this base sequence : 1202987
ttaccatgagcatatttccatttcaaaatatatatgtgtatatatacatgaatgtgtgtgtgtgtgtgtgtgtgtgaatgggtagacataattataaaattggtaacaagtatctggttaccaagtactgattctcctagatg

SEQ ID NO: 6458 - DNA, 336 bp, Homo sapiens
  Z49208.1_755
  Located on chromosome 4
  Distance between a terminus base of telomere on chromosomal short arm and 5'-terminus of this base sequence : 4292897
  Distance between 3'-terminus of neighbour sequence of sequence listing upward to telomere on chrosomal short arm and 5'-terminus of this base sequence : 491383
agtagatcacctagaagtggatttttaaataattttggtacttactgtgaaactgctcttcaaaaacataccattgttccttccttccttccttccttccttccttccttctttccttcctcccttcctccctcccttccctacttccctctccctttccctttcccttccccttttcccttccccttcccgcctgcctgcctgcctgccttccttccttccttccttcgtttctttctacatatacacatttttttaaatttcaatggtttttggggtacaagtggtttttggttacatggctgaattttggttacatggtgaagtctgagattt

SEQ ID NO: 6459 - DNA, 185 bp, Homo sapiens
  D4S3034
  Located on chromosome 4
  Distance between a terminus base of telomere on chromosomal short arm and 5'-terminus of this base sequence : 4479054
  Distance between 3'-terminus of neighbour sequence of sequence listing upward to telomere on chrosomal short arm and 5'-terminus of this base sequence : 185821
ttgctcaccaaagaggttttctagtttatatttttgtcagtagtgtgtgtgtgtgtgtgtgtgtgagagagagagagagagagagagagagagagagaatgcccccttttttattgaaggagaatttgtgttattttgatgtacagaaaactcaacagtgttcatttcacccagtttattggcag

SEQ ID NO: 6460 - DNA, 366 bp, Homo sapiens
  Z69303.1_6296
  Located on chromosome 4
  Distance between a terminus base of telomere on chromosomal short arm and 5'-terminus of this base sequence : 4550795
  Distance between 3'-terminus of neighbour sequence of sequence listing upward to telomere on chrosomal short arm and 5'-terminus of this base sequence : 71556
actgcatgtctgtagaatggttgttatcagaaaggcaaaagataacaagtgtgggtgaggataggagaagagggaacccttgcactgttggtgggaatgtaaattgtacagccattgtggaaaacagcatggaggttccttgaaaaattaaatatggaactaccatatgatccactactgggtatatctccagaggaaataaaatcagtctctcatagttgtgctcccatgttcatggaagtgttaatcacaatagctaagatatgaaaacctaagggataaaggaaatgtgcgatgtgtgtgtgtgtgtgtgtgtgtgtgtgtgtttagagagagaatgagaatagcatattctgccttaaagga

SEQ ID NO: 6461 - DNA, 237 bp, Homo sapiens
  D4S412
  Located on chromosome 4
  Distance between a terminus base of telomere on chromosomal short arm and 5'-terminus of this base sequence : 4551051
  Distance between 3'-terminus of neighbour sequence of sequence listing upward to telomere on chrosomal short arm and 5'-terminus of this base sequence : -110
ctaagatatgaaaacctaagggataaaggaaatgtgcgatgtgtgtgtgtgtgtgtgtgtgtgtgtgtgtttagagagagaatgagaatagcatattctgccttaaaggaactcctgccatttgcaacaacatggatgaagccaaacatgtgtggcttcacttacatgtggactctaaaaacattgaattcatggacgcagagagtagattggtgcttaccagtgcctggcggtagt

SEQ ID NO: 6462 - DNA, 445 bp, Homo sapiens
  AC074370.3_70297
  Located on chromosome 4
  Distance between a terminus base of telomere on chromosomal short arm and 5'-terminus of this base sequence : 4749084
  Distance between 3'-terminus of neighbour sequence of sequence listing upward to telomere on chrosomal short arm and 5'-terminus of this base sequence : 197796
atccacctgtcctttaacactcccacctacccacccatttattcatccatccatccatccatccatccatccatccatccatttccatcctccatccatccaaccatccgtccgtccgttcatccatccgtccatccatccatccatccatccatcacccacccacctttccattcatcattcatccacccatttccatcctccaatcatccatccatccatccatccatccatccatccatttccatcctccatccatccatccatctgtccgtccatccatccatccatccatccatcacccccccacccacctatccattcatcattcatccacccatttccatcctccaatcatctatccatccatccatttatctacttgtccattcacccattcacctatctacctaggaaatatttattaaaggacctagtaggcagc

SEQ ID NO: 6463 - DNA, 203 bp, Homo sapiens
  Z95704.1_6466
  Located on chromosome 4
  Distance between a terminus base of telomere on chromosomal short arm and 5'-terminus of this base sequence : 5045087
  Distance between 3'-terminus of neighbour sequence of sequence listing upward to telomere on chrosomal short arm and 5'-terminus of this base sequence : 295558
tgtacctaagatcacttatgaccagcaattttaaggaagtaaggttgacttttatgcagacagtgcttacaaagcactctgagaaacgagaaaattcttcttcaaaaattataaaaagtcacaatttcttactatgagattgctatccactatttatatgtgtgtgtgtgtgtgtgtgtgtgtcttccaagtcagttgtccta

SEQ ID NO: 6464 - DNA, 129 bp, Homo sapiens
  DISD22_0003295
  Located on chromosome 4
  Distance between a terminus base of telomere on chromosomal short arm and 5'-terminus of this base sequence : 5177512
  Distance between 3'-terminus of neighbour sequence of sequence listing upward to telomere on chrosomal short arm and 5'-terminus of this base sequence : 132222
cattggttggttgatttccattttcttaaggggcacatacctcacaccgcacacacacaaacacacacacgcgcacacacacacacacgcacacacacgcacacacactccttccttctgcgagttagt

SEQ ID NO: 6465 - DNA, 147 bp, Homo sapiens
  DISD22_0003299
  Located on chromosome 4
  Distance between a terminus base of telomere on chromosomal short arm and 5'-terminus of this base sequence : 5309054
  Distance between 3'-terminus of neighbour sequence of sequence listing upward to telomere on chrosomal short arm and 5'-terminus of this base sequence : 131413
agcaaggcctctgaattggctaaaactcctatggctgcaaacaaacaaacaaacaaataaacagcaacaaaaaactttccagttagcagaaattattttttaaaactttttttttttacataagtggtctcatctacataacaaggc

SEQ ID NO: 6466 - DNA, 101 bp, Homo sapiens
  DISD22_0003300
  Located on chromosome 4
  Distance between a terminus base of telomere on chromosomal short arm and 5'-terminus of this base sequence : 5392636
  Distance between 3'-terminus of neighbour sequence of sequence listing upward to telomere on chrosomal short arm and 5'-terminus of this base sequence : 83435
tagaggcttcactgacaacaccgtctgtgtgtgtgtgtgtgtgtgtgtgtgtgtatacatgtatatgattgagcaggatttattgtaagtcaagacagcct

SEQ ID NO: 6467 - DNA, 102 bp, Homo sapiens
  DISO7_10001349
  Located on chromosome 4
  Distance between a terminus base of telomere on chromosomal short arm and 5'-terminus of this base sequence : 5598859
  Distance between 3'-terminus of neighbour sequence of sequence listing upward to telomere on chrosomal short arm and 5'-terminus of this base sequence : 206122
gtgtgcctgtctttatgtccgtgtgtgtgtgtgtgtgtgtgtgtgtgtctctgggtgatgtgcctgtgtgcatctcttaggtctgtcggctgaaaggcttaa

SEQ ID NO: 6468 - DNA, 115 bp, Homo sapiens
  DISO7_10001350
  Located on chromosome 4
  Distance between a terminus base of telomere on chromosomal short arm and 5'-terminus of this base sequence : 5603405
  Distance between 3'-terminus of neighbour sequence of sequence listing upward to telomere on chrosomal short arm and 5'-terminus of this base sequence : 4444
cagagccatgtcatgtgcgtgtgtgtgtgtgtgtgtgtgtgtgtgtgtgtcacctgccccgccctgcccactaggcactgttgaaaggggtcagggccatgcaccatctagccct

SEQ ID NO: 6469 - DNA, 378 bp, Homo sapiens
  chr4.fa.O7frz.4279615
  Located on chromosome 4
  Distance between a terminus base of telomere on chromosomal short arm and 5'-terminus of this base sequence : 5756209
  Distance between 3'-terminus of neighbour sequence of sequence listing upward to telomere on chrosomal short arm and 5'-terminus of this base sequence : 152689
taccatcaccagctggtacttactttatttatatattattttattctattttattttattttattttattttattttattttattttattttattttattgagatggagtctcactctgttgtccaggctggagtgcagtggcatgatcttggctcactgcaaaccctgcctcctgggttcaagcaattctcctgcctcagcctcctgagtagctgggattacaggcactccacatagcgagacccctgtctctacaaaaatcaattttaagaaaatgagccaggcgtagtagcacacacctgtagtcccagctattcgggtggctgaggtgggaggagctcttgagccccagaatttgaggctgtagtgagctataa

SEQ ID NO: 6470 - DNA, 401 bp, Homo sapiens
  AF276255.1_30961
  Located on chromosome 4
  Distance between a terminus base of telomere on chromosomal short arm and 5'-terminus of this base sequence : 5758326
  Distance between 3'-terminus of neighbour sequence of sequence listing upward to telomere on chrosomal short arm and 5'-terminus of this base sequence : 1739
aatgtctaaacagctgtcatctactgaacacctatcacgtgctctctctaccttgcccatttattccctctctacttagtgtcccaaagacacctcaaacatagcatgtccataggagaaatgtaacatgtcattggttttgtgtccccaccctgctcttccctttggcttcccaatcttgggaaatggtgcaaccattcacccatagactcaggtgccaatgctcggagtcaacctgaaaggaggcagagagagaggaagaacaaaaaaacatggatggatggatggacggacagatggatggatggatggatggatggatggatggatgatgaataagtgaatgatgatagaagctctggggaagaggatgatggttctaggaagttaactgcacttca

SEQ ID NO: 6471 - DNA, 145 bp, Homo sapiens
  D4S3023
  Located on chromosome 4
  Distance between a terminus base of telomere on chromosomal short arm and 5'-terminus of this base sequence : 5834953
  Distance between 3'-terminus of neighbour sequence of sequence listing upward to telomere on chrosomal short arm and 5'-terminus of this base sequence : 76226
tgaacagcagcggtctagatgcctcagaaacagaggtgtgtgtgtgtgtgtgtgtgtgtgtgtgtgtgtgagagagaaactgtgatgagagagtgaagcacagatcaatcagtaagtttcagtcccatttagtttccagtgaggt

SEQ ID NO: 6472 - DNA, 107 bp, Homo sapiens
  DISD22_0003313
  Located on chromosome 4
  Distance between a terminus base of telomere on chromosomal short arm and 5'-terminus of this base sequence : 6062713
  Distance between 3'-terminus of neighbour sequence of sequence listing upward to telomere on chrosomal short arm and 5'-terminus of this base sequence : 227615
aagcactatttgaagttgcttggtgtggtgtgtgtgtgtgtgtgtgtgtgtgtgtgtgtgtgtgtgtgtgtgtatagcaaatatatatgctttatgttgcttggctt

SEQ ID NO: 6473 - DNA, 102 bp, Homo sapiens
  DISO7_10001351
  Located on chromosome 4
  Distance between a terminus base of telomere on chromosomal short arm and 5'-terminus of this base sequence : 6152880
  Distance between 3'-terminus of neighbour sequence of sequence listing upward to telomere on chrosomal short arm and 5'-terminus of this base sequence : 90060
gccaggacacattcacacacatgcacacacacacacacacacacaggcacacaaaggcacacagttgcatatatttatatcatgttacaatccagtgcagcc

SEQ ID NO: 6474 - DNA, 158 bp, Homo sapiens
  DISO7_10001352
  Located on chromosome 4
  Distance between a terminus base of telomere on chromosomal short arm and 5'-terminus of this base sequence : 6228689
  Distance between 3'-terminus of neighbour sequence of sequence listing upward to telomere on chrosomal short arm and 5'-terminus of this base sequence : 75707
aagagtgtttatgaacgtcaggaaattttggaatataaaacatagagagtatatgctatatgtgtgcatgtatgtgtgtgtgtgtgtgtgtgtgtatatatatatatatatatgatttttatattcagcatgtttataaagatggcataattgctgga

SEQ ID NO: 6475 - DNA, 101 bp, Homo sapiens
  DISO7_10001353
  Located on chromosome 4
  Distance between a terminus base of telomere on chromosomal short arm and 5'-terminus of this base sequence : 6247517
  Distance between 3'-terminus of neighbour sequence of sequence listing upward to telomere on chrosomal short arm and 5'-terminus of this base sequence : 18670
ttgcctccagaaggagagagaattacagagattagggagagagagagagagagagagtagctcatgtggaggtccagtggaatagcagaattgatgagcac

SEQ ID NO: 6476 - DNA, 316 bp, Homo sapiens
  AC004664.1_21724
  Located on chromosome 4
  Distance between a terminus base of telomere on chromosomal short arm and 5'-terminus of this base sequence : 6329740
  Distance between 3'-terminus of neighbour sequence of sequence listing upward to telomere on chrosomal short arm and 5'-terminus of this base sequence : 82122
ggaaactgagaaagtgagttacaggcttctgctttagggaggcacatatggtctcagttggctcggactgctataacaaattattacagactgggtggctgaaacaacagacggttatttcacacagttctggagactgaaaggccaagatcagggcacagcatggtccttggtgtgtgcatgcttagaaagagagagagagagagagagagagagagagagaaagagataatctcctgttcttcctctttctttaagggcactaatcccaccatgggggccccaccctcatgacctcatctaaacctaatcacct

SEQ ID NO: 6477 - DNA, 223 bp, Homo sapiens
  Z66874
  Located on chromosome 4
  Distance between a terminus base of telomere on chromosomal short arm and 5'-terminus of this base sequence : 6378788
  Distance between 3'-terminus of neighbour sequence of sequence listing upward to telomere on chrosomal short arm and 5'-terminus of this base sequence : 48732
gagtttacttatagccctaaaacgccacaatatgcctcatttctcaatgtatgcagacctcaaaaatatatatagatacatatatacacacatatataacatatatacacacacatatatataacatacacacacacacacacacacacacacacacacacatatagagtaaagaaaagaggaggaacgctcacttagcctaaggaatcactggcatttttgt

SEQ ID NO: 6478 - DNA, 368 bp, Homo sapiens
  AC005289.15_59631
  Located on chromosome 4
  Distance between a terminus base of telomere on chromosomal short arm and 5'-terminus of this base sequence : 6761172
  Distance between 3'-terminus of neighbour sequence of sequence listing upward to telomere on chrosomal short arm and 5'-terminus of this base sequence : 382161
agtcaatgagtagaatcagctcagaaagctggttaacaggagacatatttcagttgaaggtaaagaaggactttttaacaaaaagagctgaccattcactgattcattcattcattcattcattcatttgcttgtttattcattcactcatttatttgctcatttttaagtacctactatatgccaggcactgtgttcaaggctatggagaatgttgagatgaataaaacccagacacatgtgtcctcaagggccttatatctgagtgagtaaaacagacaagcaagcaagtataatgccagaacagaaggaaatgctgggttacaaagtaacagtgtactaaagagagtcagatgaaggatccattt

SEQ ID NO: 6479 - DNA, 407 bp, Homo sapiens
  AC004624.6_171411
  Located on chromosome 4
  Distance between a terminus base of telomere on chromosomal short arm and 5'-terminus of this base sequence : 6828669
  Distance between 3'-terminus of neighbour sequence of sequence listing upward to telomere on chrosomal short arm and 5'-terminus of this base sequence : 67129
aaagacatggaaatgccatgtgcaagcaggggctgctgctttctgtctccttcattcttctttgcggtttttttgttttgttttgttttgttttgttttgttttgagtcagggtctcactctgttgcccaagctggagagcagtgacgtgatctcggctcactgcagccttgacctcctgggttcaagcaatcttcccccctcagccctcccaagtaactgggactatagacgcatgccatcacgcctgtatgggatttggccatgttgcccaggccggtctcaaactcctgagctcaagcaatccacccgcctcagcctcccaaagtgctgggattacaggtgtgagccaccgtgcctggccctacccagacttttatacaatagaggtggattacatgtctaaca

SEQ ID NO: 6480 - DNA, 101 bp, Homo sapiens
  DISO7_10001357
  Located on chromosome 4
  Distance between a terminus base of telomere on chromosomal short arm and 5'-terminus of this base sequence : 7077016
  Distance between 3'-terminus of neighbour sequence of sequence listing upward to telomere on chrosomal short arm and 5'-terminus of this base sequence : 247940
actgcctctaaggaaaggcacgtgtacacacacacacaaacacacacacacacacacacacacacacacaaaaggcagtggaattataccatgtgcaagtg

SEQ ID NO: 6481 - DNA, 250 bp, Homo sapiens
  D4S431
  Located on chromosome 4
  Distance between a terminus base of telomere on chromosomal short arm and 5'-terminus of this base sequence : 7183537
  Distance between 3'-terminus of neighbour sequence of sequence listing upward to telomere on chrosomal short arm and 5'-terminus of this base sequence : 106420
aggcatactaggccgtattttgtttctttcaatgtttatttacctgtacacacacacacacacacacacacacacacacacacacacatacacaggcaaaacttatgttactgtcccatgcataattctctagatttgggccacatagatctggttttggccattgactggcaacatggcagtagccaactgcagagccaccagggagcagcctcattctgattgagtataacgaagacgctgatgggaa

SEQ ID NO: 6482 - DNA, 299 bp, Homo sapiens
  chr4.fa.O7frz.7201073
  Located on chromosome 4
  Distance between a terminus base of telomere on chromosomal short arm and 5'-terminus of this base sequence : 7256651
  Distance between 3'-terminus of neighbour sequence of sequence listing upward to telomere on chrosomal short arm and 5'-terminus of this base sequence : 72864
gagcattaccagtaacatcaacagctgatgaacatttgaagagactgatgtctacgtggattttatgcatttgtgacatacctaactttttcttttcttatatatatatgtatgtatatatatgtatgtgtgtgtgtgtgtgtgtgtgtgtgtgtgtgtgtgtgtgtgtgtgtatcgtggcagatctccaaaatgttttcagtatatttactgggaaaatcgcacatcaggggacctgcaggttcaagcctgtgttgtgtgagggtcaaggggcaactgtatacgcacttctcattgct

SEQ ID NO: 6483 - DNA, 246 bp, Homo sapiens
  D4S3007
  Located on chromosome 4
  Distance between a terminus base of telomere on chromosomal short arm and 5'-terminus of this base sequence : 7420262
  Distance between 3'-terminus of neighbour sequence of sequence listing upward to telomere on chrosomal short arm and 5'-terminus of this base sequence : 163312
cttcaggttctactagttcatggtagaactagtataaaaactggtctgtggcaaagtaataaaaaaaaaggtcaataaactctgtgtgtgtgtgtgtgtgtgtgtgtgtcactatacaggtgccaaccgtgtttcctttcttcagaactgagatatactgttattacttttcaaaaaattttgctgttaatactcttttgtaaaatatgatgtagatgacagatatgtcaccaatgtagcaaaaat

SEQ ID NO: 6484 - DNA, 448 bp, Homo sapiens
  AC004604.3_192353
  Located on chromosome 4
  Distance between a terminus base of telomere on chromosomal short arm and 5'-terminus of this base sequence : 7469908
  Distance between 3'-terminus of neighbour sequence of sequence listing upward to telomere on chrosomal short arm and 5'-terminus of this base sequence : 49400
gacagtagcatttcctcagtagaggaaagtttatccaggttgcatagaaagcttttcccttttatttagtctcattacacactagatctagctctcatttgttttgttttaatagaagtctgtttagtacttctgaatctatgtagaactgatcgctttcacctacactttatcattacaaaattggtttttcctttttgtctgtctgtctgtctatctatctatctatctatctatctatctatctatctatctatctatttaagacagggtcctgctatgttgcccaagttggccctgtacgcctgggctcaagtgttgttcctgcctcagcttctccaatagctaggattataggcacacaccatggcatccagcttttcttccttatcttttaaacataaagatcaaccagattaaccaaatctgttacaggcttgcaatttat

SEQ ID NO: 6485 - DNA, 255 bp, Homo sapiens
  DISD22_0003318
  Located on chromosome 4
  Distance between a terminus base of telomere on chromosomal short arm and 5'-terminus of this base sequence : 7799282
  Distance between 3'-terminus of neighbour sequence of sequence listing upward to telomere on chrosomal short arm and 5'-terminus of this base sequence : 328926
tccatcttcatcagtggctgaattttgtatctggcacaggcttattgtctcctcctccctcactggagcatcagctcatgagggtggggacctggccactggtttgtctctagcgcctagacagaacctggcaggtgtaggcaccactcacccggtgagggagagaatgaatgaatgaatgaatgaatgaatgaatgactgtctctccaggcgctccttgccaggccccaatccctaccctactctaggctcttg

SEQ ID NO: 6486 - DNA, 105 bp, Homo sapiens
  DISD22_0003321
  Located on chromosome 4
  Distance between a terminus base of telomere on chromosomal short arm and 5'-terminus of this base sequence : 7870239
  Distance between 3'-terminus of neighbour sequence of sequence listing upward to telomere on chrosomal short arm and 5'-terminus of this base sequence : 70702
tcatggtgcccattacagggctcggtgtaaagtagaccttcagggattgaagaaagaatgaatgaatgaatgaatgaatgaatgaaggcataaagtgactcgtcc

SEQ ID NO: 6487 - DNA, 118 bp, Homo sapiens
  DISD22_0003326
  Located on chromosome 4
  Distance between a terminus base of telomere on chromosomal short arm and 5'-terminus of this base sequence : 7944164
  Distance between 3'-terminus of neighbour sequence of sequence listing upward to telomere on chrosomal short arm and 5'-terminus of this base sequence : 73820
tttggtgccttctcattgcatttttcttctgtgcaaagaaaaggaccttagtgtatatgcgcacacacacacacacacacactcacacacagagtttggaattattctttgtgcacct

SEQ ID NO: 6488 - DNA, 286 bp, Homo sapiens
  chr4.fa.O7frz.6572597
  Located on chromosome 4
  Distance between a terminus base of telomere on chromosomal short arm and 5'-terminus of this base sequence : 8014829
  Distance between 3'-terminus of neighbour sequence of sequence listing upward to telomere on chrosomal short arm and 5'-terminus of this base sequence : 70547
cagttggacttaaccatgtaatttcccatttattttgtctctcatctgtcttctcagtaaagctaagctcattttgtccgtttgttcactgctgtgcccccagctttgagagcagtgtccggcatctagtagacagtccacatatgtgtgtgtgtgtgtgtgtgcgcgcgcgtgtgtgtgtgtttgtaggagtgttctcctatacctttttacgcacaagggtattgtatagcattttatggtatcaataaacaagaatatcatctaattagcacctcaaagttcc

SEQ ID NO: 6489 - DNA, 281 bp, Homo sapiens
  chr4.fa.O7frz.6495982
  Located on chromosome 4
  Distance between a terminus base of telomere on chromosomal short arm and 5'-terminus of this base sequence : 8094731
  Distance between 3'-terminus of neighbour sequence of sequence listing upward to telomere on chrosomal short arm and 5'-terminus of this base sequence : 79616
taagattctttgactaatccaaaggcacaaagatttcttcccccttgttttcttctagaagttttacagtttcagagtctacatttaggtctaggatcccttttaagttgatttttgtctgtggtgcaaggttaggattgagattctttctttctttctttctttctttctttctttctttctttctttctttctttctttctttcttttttgcagagagacgttcaattgatcagcaccatttgtgggaaccactataatgactaaagtattggaaagag

SEQ ID NO: 6490 - DNA, 113 bp, Homo sapiens
  DISO7_10001370
  Located on chromosome 4
  Distance between a terminus base of telomere on chromosomal short arm and 5'-terminus of this base sequence : 8282112
  Distance between 3'-terminus of neighbour sequence of sequence listing upward to telomere on chrosomal short arm and 5'-terminus of this base sequence : 187100
tgaatgggcatcttactccattatatatcagtgttggcttgaatattaaaatcacacacacacacacacacacacattttcaccaaaaaatctttatgtcaagctggtgatct

SEQ ID NO: 6491 - DNA, 152 bp, Homo sapiens
  DISO7_10001364
  Located on chromosome 4
  Distance between a terminus base of telomere on chromosomal short arm and 5'-terminus of this base sequence : 8317510
  Distance between 3'-terminus of neighbour sequence of sequence listing upward to telomere on chrosomal short arm and 5'-terminus of this base sequence : 35285
agggaattcctagcctggcgtttttagattacgatatacatatatatatacacacacacacacacacacacacacacacacacacacacacgattaaaatgctatatattatgtatttcttgtaaatcaaatcgttctgtcattatattagc

SEQ ID NO: 6492 - DNA, 226 bp, Homo sapiens
  DISO7_10001363
  Located on chromosome 4
  Distance between a terminus base of telomere on chromosomal short arm and 5'-terminus of this base sequence : 8333173
  Distance between 3'-terminus of neighbour sequence of sequence listing upward to telomere on chrosomal short arm and 5'-terminus of this base sequence : 15511
gccaacccactcacatatacatacacacacatccatccatccatccatctgtcatctgtccattcacccatccaccatccacctattcatccacctatctacccattcaccatccactcatccataatccatctatccatccatccatccacttatcctccatccatccatccacccatctaccattcattcatccatcctctagcccctgagctacccttcatcc

SEQ ID NO: 6493 - DNA, 101 bp, Homo sapiens
  DISO7_10001360
  Located on chromosome 4
  Distance between a terminus base of telomere on chromosomal short arm and 5'-terminus of this base sequence : 8372077
  Distance between 3'-terminus of neighbour sequence of sequence listing upward to telomere on chrosomal short arm and 5'-terminus of this base sequence : 38678
ccatggcattcctctttcttgtgcgtgtacacacacacacacacacacacacagtgctagcctttctctttcttatcccacgtgtggaacagaccattgca

SEQ ID NO: 6494 - DNA, 222 bp, Homo sapiens
  AC004169.3_29620
  Located on chromosome 4
  Distance between a terminus base of telomere on chromosomal short arm and 5'-terminus of this base sequence : 8460102
  Distance between 3'-terminus of neighbour sequence of sequence listing upward to telomere on chrosomal short arm and 5'-terminus of this base sequence : 87924
atttgctttagtctttgagttgacagaaagaggcatggacttgtctatcccaattgatgctccagcctcaaaagctgtgcattcactatagctagccactgagtgtccacaccttctctgaaacttcaactctaatagctggaaaagaacactctttcttctcactctcacatggttagagagagagagagagagagagaggtggatgaacatactttacag

SEQ ID NO: 6495 - DNA, 116 bp, Homo sapiens
  D4S2935
  Located on chromosome 4
  Distance between a terminus base of telomere on chromosomal short arm and 5'-terminus of this base sequence : 8564204
  Distance between 3'-terminus of neighbour sequence of sequence listing upward to telomere on chrosomal short arm and 5'-terminus of this base sequence : 103880
gctcacagaagtgcccaataaatggcagttctgaaaaaatacacagcacacacacacacacacacacacacacacacacacagaacagaggcaaagagattaaacttcacccaggg

SEQ ID NO: 6496 - DNA, 241 bp, Homo sapiens
  AC004480.7_75625
  Located on chromosome 4
  Distance between a terminus base of telomere on chromosomal short arm and 5'-terminus of this base sequence : 8689024
  Distance between 3'-terminus of neighbour sequence of sequence listing upward to telomere on chrosomal short arm and 5'-terminus of this base sequence : 124704
tcagagctcaagaatggtagagaaggcatccccatggtgggaagtagagggggtcagagcctggtgtgggagtcagagtcctctgagcagggtgaagagggtatctgtgtgtgtatggttttgctttttttttatttttatatttatttatttatttatttatttatttatttattttggcagtggatggtctccagtgtggacagaccagatttgagcagtgtgagcaggacatccattt

SEQ ID NO: 6497 - DNA, 352 bp, Homo sapiens
  AC067804.2_26325
  Located on chromosome 4
  Distance between a terminus base of telomere on chromosomal short arm and 5'-terminus of this base sequence : 8935122
  Distance between 3'-terminus of neighbour sequence of sequence listing upward to telomere on chrosomal short arm and 5'-terminus of this base sequence : 245857
acaaggactcatgcatttaagttctcacatggggtctgaaccagcttagaaaacctgggaggtggcattagggctccttcctgggcttggggctggagtagtctctctctgcttcctttggccttaggttttcctcctgcagagtcgggacatgggactggatgatttctaaggcctcctataccacaggcactgctcccagtctggtctgtgatgaatatgattattttaattaagctctccatccatctatccttccattcatccatccatccatccatccatccatccatccatccatccattcattcaatgtttatcttttggcagtgataggtgagctgtgcatctt

SEQ ID NO: 6498 - DNA, 477 bp, Homo sapiens
  chr4.fa.O7frz.9079828
  Located on chromosome 4
  Distance between a terminus base of telomere on chromosomal short arm and 5'-terminus of this base sequence : 9162516
  Distance between 3'-terminus of neighbour sequence of sequence listing upward to telomere on chrosomal short arm and 5'-terminus of this base sequence : 227042
ggtttgctcaattctagttctcaaggacactccattaggaagcagctgtcagcctccccggcggctggccaggtcctcttgctctgagatactctattttgagaggtggactttcactgttgagctagggctgtgagcggtattgacatgttacaagcacagggatctcgtgtgtgtgtgtgtgtgtgtgtgtgtgtgtgtgtgtgtgtgtgtatgagtgtgtagtctggggataatttagtctacggttataaaagagagggagttctgctctggagcaaaatccatggttgccaatgagaaattaggagctggcctgagatttcatgtcctcagctggaatgctagcacccagcagggctccagcagagagctaaatatatcctgggtgtgctggcaacctcaggaacccccggcgctcaccagagtgggatccaaagggagtgattgatttgtctaatgaaaatcaatacctgg

SEQ ID NO: 6499 - DNA, 140 bp, Homo sapiens
  DISD22_0003336
  Located on chromosome 4
  Distance between a terminus base of telomere on chromosomal short arm and 5'-terminus of this base sequence : 9343610
  Distance between 3'-terminus of neighbour sequence of sequence listing upward to telomere on chrosomal short arm and 5'-terminus of this base sequence : 180617
ggttacattagcattaggcatgcacacgcacacacacacacacacacacaaaaacaaaaaaaaaacaaaaaacaatatctttatggggaaaagttaagaagggaaaagtaatcatagtatattacacagctctgctctga

SEQ ID NO: 6500 - DNA, 320 bp, Homo sapiens
  AC069497.2_139646
  Located on chromosome 4
  Distance between a terminus base of telomere on chromosomal short arm and 5'-terminus of this base sequence : 9417224
  Distance between 3'-terminus of neighbour sequence of sequence listing upward to telomere on chrosomal short arm and 5'-terminus of this base sequence : 73474
aacaagaatgaaactcggtctcaaagaaaacaaaacaaacaaacaacaacaacaacaaaaacacagaaaaatatggtcaacatcattagccaccaggaaaatgcaaaccaaaaacccaatgagagaccacttcacatccactaggatggcaatgagcaaaaagatactaaaatactaaatgccggctatagtggcacgtgcctgtggtcccagctactctggggaggctaaggcaggaggacagcttgagcccaggagtttgagaccagcctgggtgatacagcaagaccttatctcttaaagaaccagataaataggcc

SEQ ID NO: 6501 - DNA, 239 bp, Homo sapiens
  AC069497.2_91992
  Located on chromosome 4
  Distance between a terminus base of telomere on chromosomal short arm and 5'-terminus of this base sequence : 9432240
  Distance between 3'-terminus of neighbour sequence of sequence listing upward to telomere on chrosomal short arm and 5'-terminus of this base sequence : 14696
aaacttgcctagttcataagacaggaggaaagagagaaagcaaaaagttagaaagaaacaaaagtaagataaatagccagacaaccttggcaccaccacgtggccctaggagttaaaataataataataataataataacatcaacccctgacctaaactacttgtgttatctttaaattccagacattgtatgaaaaagcattgcaaaactttctgttctgttagctgatccatgtag

SEQ ID NO: 6502 - DNA, 281 bp, Homo sapiens
  chr4.fa.O7frz.9482859
  Located on chromosome 4
  Distance between a terminus base of telomere on chromosomal short arm and 5'-terminus of this base sequence : 9579726
  Distance between 3'-terminus of neighbour sequence of sequence listing upward to telomere on chrosomal short arm and 5'-terminus of this base sequence : 147247
taaaccaatgagtgaaagaataagagtgagtgaatgagtttgtgagtgaatgaatgagagaatgagtgagtgaaaaagtgagtgaataagtgcatgagtgaatggatgaatgactgagaaaattagtgtgtgaatgaataagagaatgagtgagtgatgagtgaatgagtgacaatgagtgagtaagtgaatgagtaagtgagtgagggagtgagtgaatgcctgagtgaatgggtgagtgaatgagtgagggagtgggtgaatgagtaaatgagtgaatg

SEQ ID NO: 6503 - DNA, 303 bp, Homo sapiens
  chr4.fa.O7frz.9809275
  Located on chromosome 4
  Distance between a terminus base of telomere on chromosomal short arm and 5'-terminus of this base sequence : 9691058
  Distance between 3'-terminus of neighbour sequence of sequence listing upward to telomere on chrosomal short arm and 5'-terminus of this base sequence : 111051
tcattgactattctcaggtcagaaagcacacttccgaattcttgtccttcggtcactgagaggatgatggtagctgccaaaagtacatacttggaagttcatcccagcacaaacacacatacacacacgcccccccccacacacacaaacacactcacacacacacacacacacacggtttccaaggtaaagatttcttccctgccattgctttacctaaaataaggcaactgtgtggccactgtcccaacccggttacactcctattatatgtgcttatcatcctgaggagtaatctgattc

SEQ ID NO: 6504 - DNA, 268 bp, Homo sapiens
  chr4.fa.O7frz.9914967
  Located on chromosome 4
  Distance between a terminus base of telomere on chromosomal short arm and 5'-terminus of this base sequence : 9848237
  Distance between 3'-terminus of neighbour sequence of sequence listing upward to telomere on chrosomal short arm and 5'-terminus of this base sequence : 156876
tgtattgaattacatggacgtagggggcagtgcctgaaaataaccttgtgttgatttgtgtgtgtgtgtgtgtgtttgtgtgtgtgtgtgtgatttgatttcttaaacacttaaaaatctgctgccacacaaaaatttgaattttttggtgttcttgaaaaatctgagactattgggtgcacctacatgacaaaaggctggaggtgagtagcccgctcccctttacaagttctagagcatgcaagtttcagtttatttcacctcatta

SEQ ID NO: 6505 - DNA, 300 bp, Homo sapiens
  chr4.fa.O7frz.10188799
  Located on chromosome 4
  Distance between a terminus base of telomere on chromosomal short arm and 5'-terminus of this base sequence : 10152545
  Distance between 3'-terminus of neighbour sequence of sequence listing upward to telomere on chrosomal short arm and 5'-terminus of this base sequence : 304040
attggtctaagccaaggacctttgatatcaagggtaagtccgctaccctttgctggagatgggcacggagtgggcatgtgaagagtgccagaccaggcattgacaaactatggctcatgagaagaatggagtgtacattttgaaagggtcatctctctctctctctctctctctctcacacacacacacacacacacacacacacacacacacacacacagagagagagagaatatgctgcagggatcatacacgacccgaccaacctaaaatactatctgttcctttataggaaatgct

SEQ ID NO: 6506 - DNA, 367 bp, Homo sapiens
  AC068403.2_68633
  Located on chromosome 4
  Distance between a terminus base of telomere on chromosomal short arm and 5'-terminus of this base sequence : 10250599
  Distance between 3'-terminus of neighbour sequence of sequence listing upward to telomere on chrosomal short arm and 5'-terminus of this base sequence : 97754
cactgctccaatttctacattatctgccatataggggctcctcttggcatatggggcctctataccaatagtttctggtataggggctcaataaatatggataagtgaatgaatgaatgaatgaatgaatgaatgaatctggctgtgtcctcatccggagagtcttattcatctttgcatcccctgggtctagtatggaaccaagtatgtcgtaggtgcttaaaaactacttgctgaattaatgattaaagtacagacacatctttcacattttgatcaaatccttcctctgcttcaaatctccaatggcttcccatggtattgaaagtaaaattcctgattccttaccacggagttatgagatctt

SEQ ID NO: 6507 - DNA, 471 bp, Homo sapiens
  AC005674.10_183105
  Located on chromosome 4
  Distance between a terminus base of telomere on chromosomal short arm and 5'-terminus of this base sequence : 10433344
  Distance between 3'-terminus of neighbour sequence of sequence listing upward to telomere on chrosomal short arm and 5'-terminus of this base sequence : 182378
ttatggaaacagaaagcagaagggtggttaacaacagccagagggaagagagaaggggaagtagcgtctagtggatatagtttcatggttgcaagatgaaaacattataaagatctgttgcacaataatgtgaatatactcaacactactgaactgtacacataaaagtggttaagaaagtttattttattttttattttatttattttgtatttatttatttatttatttattttatttatttatttttttttgagacggagtctcgctctgttgcccaggctggagttcagtggcgtgatcacggctcactgcaggctccgcctcctgggttctagcgattctctcccctccagcctcccgagtagctgggactacaggtatgcgctgccatgcctgtctaattttttgtgtttttagtagagatggggtttcaccatgttgaccaggcttgtcttgaactcctgacct

SEQ ID NO: 6508 - DNA, 146 bp, Homo sapiens
  DISO7_10001371
  Located on chromosome 4
  Distance between a terminus base of telomere on chromosomal short arm and 5'-terminus of this base sequence : 10491691
  Distance between 3'-terminus of neighbour sequence of sequence listing upward to telomere on chrosomal short arm and 5'-terminus of this base sequence : 57876
cattgtggtagcactgggaaaggagcagcgggtaaagatgacacaaaacaaaacatccattcacacatacacacacacacacacacacagacacacacacacacacacacacacacacacacacggcccacaagggctccaacata

SEQ ID NO: 6509 - DNA, 132 bp, Homo sapiens
  DISO7_10001372
  Located on chromosome 4
  Distance between a terminus base of telomere on chromosomal short arm and 5'-terminus of this base sequence : 10633544
  Distance between 3'-terminus of neighbour sequence of sequence listing upward to telomere on chrosomal short arm and 5'-terminus of this base sequence : 141707
acagagctcacagtagatgattgttttttcactttgaagcatatcccatatatatatatatatataatatatatattttaggtattagaatatatagatcagtgggaaatgccaatgaaactgtcatggtga

SEQ ID NO: 6510 - DNA, 380 bp, Homo sapiens
  AC005599.5_46741
  Located on chromosome 4
  Distance between a terminus base of telomere on chromosomal short arm and 5'-terminus of this base sequence : 10875089
  Distance between 3'-terminus of neighbour sequence of sequence listing upward to telomere on chrosomal short arm and 5'-terminus of this base sequence : 241413
agattgtttgaattgatgtgatgccagcattgctggttgtaaagagaaaactggctggccgtgttgcttcacacctgtaaatccagcactttgagaggataaggcgggcggactgcctgaggccaggagtttgagaccagcctggacaggagtgttagagagacccctgtctctacttaaaaaaaagaaagaaagaaagagaaagaaagaaagaaagaaagaaagaaagaaagaaagaaagaaagaaagaaaaaatggaaagccatagttaggcaagtgggtgttttgtttcttaaatattgggtgcttcatttaaattatattttggctgaaccctgcacctttggccattgagtgtactgaagcttaaaggacatatg

SEQ ID NO: 6511 - DNA, 199 bp, Homo sapiens
  D4S2928
  Located on chromosome 4
  Distance between a terminus base of telomere on chromosomal short arm and 5'-terminus of this base sequence : 10950761
  Distance between 3'-terminus of neighbour sequence of sequence listing upward to telomere on chrosomal short arm and 5'-terminus of this base sequence : 75292
atagacgtgttcctggtggtttaatttataggtggtcatgcctgaaagattctggatgcgtgatagaaaacaacataaaaaagcaacacacacacacacacacacacacacacacacacacacacacacacacgtatgaatcctcaaaataaaaacttgatttgtacctggtaagtagacaccccataaatagcctgag

SEQ ID NO: 6512 - DNA, 277 bp, Homo sapiens
  Z67366
  Located on chromosome 4
  Distance between a terminus base of telomere on chromosomal short arm and 5'-terminus of this base sequence : 11015884
  Distance between 3'-terminus of neighbour sequence of sequence listing upward to telomere on chrosomal short arm and 5'-terminus of this base sequence : 64924
actgggtcaaggctcaagaataaggtctatattaaggcttaaggctttcttttatcattaaaacaggaaaaaaggaaaagaatataaaacccacacaatacacatctgactttttctgcacaatcacatcacacatatccaaaatggtgaatgatttttggaattgagaaagggagcatgtgtgtatatttggagaagagagccagaagagtgtgtgtgtgtgtgtgtgtgtgtgtgtgtgtctatgtgtgtgtgtgtttgcacacacataggagct

SEQ ID NO: 6513 - DNA, 112 bp, Homo sapiens
  D4S1582
  Located on chromosome 4
  Distance between a terminus base of telomere on chromosomal short arm and 5'-terminus of this base sequence : 11040008
  Distance between 3'-terminus of neighbour sequence of sequence listing upward to telomere on chrosomal short arm and 5'-terminus of this base sequence : 23847
ttggttgaaacttgtggatataaaggactgactgtgtgtgcatatgtgtgtgtgtgtgtgtgtgtgtatatatatatttcctattggctctgtttgtgtggagaaccctgat

SEQ ID NO: 6514 - DNA, 142 bp, Homo sapiens
  D4S1599
  Located on chromosome 4
  Distance between a terminus base of telomere on chromosomal short arm and 5'-terminus of this base sequence : 11251261
  Distance between 3'-terminus of neighbour sequence of sequence listing upward to telomere on chrosomal short arm and 5'-terminus of this base sequence : 211141
caaggttgtcctgtgtctgcaagaagtatcagatcacaagtaaaagagccattcccgttttgtttaacaaatgtgtgtgtggttatgtgtgtgtgtgtgtgtgtgtgtgtgtgtgtgtgtgctttactggatactttaaagc

SEQ ID NO: 6515 - DNA, 297 bp, Homo sapiens
  DISO7_10009904
  Located on chromosome 4
  Distance between a terminus base of telomere on chromosomal short arm and 5'-terminus of this base sequence : 11260094
  Distance between 3'-terminus of neighbour sequence of sequence listing upward to telomere on chrosomal short arm and 5'-terminus of this base sequence : 8691
gccagtaccagtcattaatgtcatctatagaatcaattaacaaaatggaaaaaaacccatatatcccatatatatatatatatatatatatatatatatatatatatatatatatatatgttttgtgtgagtgtgtttggagaaggaaaaatatcaggaaatttaacttaggagataaaataatccatccctaaaaggcgtgtgtgtgtttgtgtgtctgtgtgtgtgtgtgtgtgtgtgtgtgtgtgtatgttttcttttcctatcaggaatatgaggggatggcagatgggatag

SEQ ID NO: 6516 - DNA, 404 bp, Homo sapiens
  HUMUT5114
  Located on chromosome 4
  Distance between a terminus base of telomere on chromosomal short arm and 5'-terminus of this base sequence : 11309908
  Distance between 3'-terminus of neighbour sequence of sequence listing upward to telomere on chrosomal short arm and 5'-terminus of this base sequence : 49517
ataccctgcaaacagggcagcccaaagggcgtcttatataacaggatggcaccatatccacatgggctgagattgctgtgtgtctcttctttaaacacatccttttcttcaatctttctttctttctttctttctttctttctttctttctttctttctttctttctttctttctttctttcttttctttctttctttctttccttccttccttcctacctccctctttctttctttcttccttccttcctttctttcttccttccttcctttctttttcttttcctttctttctctctttctttccctttctttctttctttctttctttctttctttctttctttctttcactttctttcctttcttttttctttcccttgcagaattggatggagaagcca

SEQ ID NO: 6517 - DNA, 258 bp, Homo sapiens
  Z66694
  Located on chromosome 4
  Distance between a terminus base of telomere on chromosomal short arm and 5'-terminus of this base sequence : 11439587
  Distance between 3'-terminus of neighbour sequence of sequence listing upward to telomere on chrosomal short arm and 5'-terminus of this base sequence : 129275
ccatgaacaagataattttcaagtagactcttatttaattgtgactacagtcattctagtagttattggcttatcttaaaaaatacacacacaaacacacacacacacacacagagagagagagagagagagagagagagaaacagaagttcatgaaaaatataggtatcaagcaactggggtttgaacctgggtcagtccaactctagataatacaagcgctgcccccttcgccatgctgtgttccattctgggatt

SEQ ID NO: 6518 - DNA, 128 bp, Homo sapiens
  D4S1605
  Located on chromosome 4
  Distance between a terminus base of telomere on chromosomal short arm and 5'-terminus of this base sequence : 11439637
  Distance between 3'-terminus of neighbour sequence of sequence listing upward to telomere on chrosomal short arm and 5'-terminus of this base sequence : -208
tcattctagtagttattggcttatcttaaaaaatacacacacaaacacacacacacacacacagagagagagagagagagagagagagagaaacagaagttcatgaaaaatataggtatcaagcaact

SEQ ID NO: 6519 - DNA, 458 bp, Homo sapiens
  AC027625.3_131139
  Located on chromosome 4
  Distance between a terminus base of telomere on chromosomal short arm and 5'-terminus of this base sequence : 11456944
  Distance between 3'-terminus of neighbour sequence of sequence listing upward to telomere on chrosomal short arm and 5'-terminus of this base sequence : 17179
tagaatgcactctattcgcatcacacaggttgataaagaccaggggtcatttccaagttcatactgctactgtgtggtaaaaatgcattttgggccttgggctttctcagtgtaaacaaatgtattttcctttatattccagcttagttgattgcttttgatatattagaatacatatgtattctaattatatctatattataaatatagatattttaaagactgatgaaagaagagaaggaaagaaaaaggaagggaaagaaggaaggaaggaaggaaggaaagaaagaaagaaagaaagaaagaaagaaagaaagaaagaaagaaagaaaaaatgaaagaaagaaaggaaggaaggaaaagaaagaaagacagaagaaagaaagaaaaagaaagaagaaagaaagaaagaaaactagttccttaagaaagtagtgaattgaataaaggcagttgta

SEQ ID NO: 6520 - DNA, 273 bp, Homo sapiens
  D4S3009
  Located on chromosome 4
  Distance between a terminus base of telomere on chromosomal short arm and 5'-terminus of this base sequence : 11524303
  Distance between 3'-terminus of neighbour sequence of sequence listing upward to telomere on chrosomal short arm and 5'-terminus of this base sequence : 66901
aatcctttgaagacggccccaagaagaccattgaggtgtctcatgatcttttctctctcgcccctaagacaccacgatatatatatgtgtgtgtgtgtgtgtgtgtgtgtgtgtgtgtgtgtgtgtgtgtgtatgtgtgtatatatatgtgtatatatgtatgtgtgtatatatatgtgtatatatacatatatatatatttttagttaaatgtagtttattctgagtaagccacagcacatgagcattctgaggggttgattcacaggccat

SEQ ID NO: 6521 - DNA, 303 bp, Homo sapiens
  AC073991.1_148811
  Located on chromosome 4
  Distance between a terminus base of telomere on chromosomal short arm and 5'-terminus of this base sequence : 11745362
  Distance between 3'-terminus of neighbour sequence of sequence listing upward to telomere on chrosomal short arm and 5'-terminus of this base sequence : 220786
cactcaggaatactcagcctacactattttatcatggataaatgtgaggttttcactggggacatataatagaaatagttgaaggaagcctgaattgctctctttgggagccccttaatgtactcaagtccaggtttgaggaatattaaccttgaaccaattttggtatcctgttggattttctacagcagcatttgatccttttgatcctgtcttcattattattattattattattattattattattattattattattattgcttgaaaccctctttcttctaccttgtcttcctggac

SEQ ID NO: 6522 - DNA, 181 bp, Homo sapiens
  AC006230.11_79411
  Located on chromosome 4
  Distance between a terminus base of telomere on chromosomal short arm and 5'-terminus of this base sequence : 11819092
  Distance between 3'-terminus of neighbour sequence of sequence listing upward to telomere on chrosomal short arm and 5'-terminus of this base sequence : 73427
taaggaatccaatcagattgtaaggtgtcaaattttctccatataagactgcatatatatatatatatatatatacacacacacatatacatatatacacttaactctatgtgacgttaaatatagtcagttttatttccaattatataacacttttcacttgctatctagcaggaagttg

SEQ ID NO: 6523 - DNA, 155 bp, Homo sapiens
  D4S2949
  Located on chromosome 4
  Distance between a terminus base of telomere on chromosomal short arm and 5'-terminus of this base sequence : 12014164
  Distance between 3'-terminus of neighbour sequence of sequence listing upward to telomere on chrosomal short arm and 5'-terminus of this base sequence : 194891
ccttacggataggggcaggaggacttttagcacattctttccctgccacacctgcccttaatttctggtctcatacacacacacacacacacacacacacacacacgagggggcactaatacaataaaacaaatagccgtagacctggacattag

SEQ ID NO: 6524 - DNA, 247 bp, Homo sapiens
  chr4.fa.O7frz.12219884
  Located on chromosome 4
  Distance between a terminus base of telomere on chromosomal short arm and 5'-terminus of this base sequence : 12340209
  Distance between 3'-terminus of neighbour sequence of sequence listing upward to telomere on chrosomal short arm and 5'-terminus of this base sequence : 325890
tacttgctatggtacctacatgtaaatatagatagatagtagatagatagatagatagatagatagatagatagatagatagatatagatgatagtaccccactatgtgactgaattctctaattagttgcaattatttttcagttgattatcttcagctttccagataaacaataattttcctgccagtagtgactgttttaattcctactttctcatttgtatacttgtaaatgatttccatgac

SEQ ID NO: 6525 - DNA, 395 bp, Homo sapiens
  chr4.fa.O7frz.12328272
  Located on chromosome 4
  Distance between a terminus base of telomere on chromosomal short arm and 5'-terminus of this base sequence : 12375544
  Distance between 3'-terminus of neighbour sequence of sequence listing upward to telomere on chrosomal short arm and 5'-terminus of this base sequence : 35088
  misc_feature (1)...(395): n = A,T,G or C
tcagactagaagttgtcctgttacctttcctgattttgaggtttttggagttggactgagccatgctactagcttccttgggagccacgttatgggcttctctcattctccaccttgcaatcgcgtctcgtgggactttgtaatcatgtgagccagttcttcctaataaactccctttttcacacacacacacacacacacaccccacacacacacatgcacacacacacatgcacacacacacacaaatgtttatataaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctctggagaaccctaattgaaacctcattcaatg

SEQ ID NO: 6526 - DNA, 178 bp, Homo sapiens
  chr4.fa.O7frz.12408360
  Located on chromosome 4
  Distance between a terminus base of telomere on chromosomal short arm and 5'-terminus of this base sequence : 12501948
  Distance between 3'-terminus of neighbour sequence of sequence listing upward to telomere on chrosomal short arm and 5'-terminus of this base sequence : 126009
cctttgctgttctaaagtacttactgttagttattttgattaaaatgcagctgcttattcattgtgtgtgtgtgtgtgtgtgtgtgtgtgtgtgtagggaaacagtgctaggagcttttggttggctatcttcctcaaagctaacacaattttggtgttaatttacaaggcattcatg

SEQ ID NO: 6527 - DNA, 405 bp, Homo sapiens
  chr4.fa.O7frz.12517719
  Located on chromosome 4
  Distance between a terminus base of telomere on chromosomal short arm and 5'-terminus of this base sequence : 12612214
  Distance between 3'-terminus of neighbour sequence of sequence listing upward to telomere on chrosomal short arm and 5'-terminus of this base sequence : 110088
aaatcaatgagtatgtttcagaactgtagtttctaacacaggatttaccttagatataatcacagctgctgcacaaagttccagaaaaggcttgttgaactcatctacaatgaactggctctaagagcaaaggccaatgctctgaccgtgctaaatgtgtgtgtgtgtgtgtgtgtgtgtgtgtgtgtgtgtgtgttgtggaggtggtgatgacatatttcttggccacatttagacagctcagctctgctgtcagcaaagagtaaggctgaaggagagtatgaatacatagagatttagcttcctagaaataactcgggggttctgatcatacctttcacatatgatttcatcattttctttaatatgccctttcttgtgccaggcactacattagctatttca

SEQ ID NO: 6528 - DNA, 174 bp, Homo sapiens
  D4S3036
  Located on chromosome 4
  Distance between a terminus base of telomere on chromosomal short arm and 5'-terminus of this base sequence : 12753550
  Distance between 3'-terminus of neighbour sequence of sequence listing upward to telomere on chrosomal short arm and 5'-terminus of this base sequence : 140931
agcttcttgctgtgtcctcacatggcctttcctctgtggacatgtacacacacacacacacacacacacacacacacacacacacacacacacagaatgagagagagagaggtctctttttggtctcttactctttttataaagactagtcctgtagtatagagccccaccctt

SEQ ID NO: 6529 - DNA, 296 bp, Homo sapiens
  chr4.fa.O7frz.12752647
  Located on chromosome 4
  Distance between a terminus base of telomere on chromosomal short arm and 5'-terminus of this base sequence : 12846406
  Distance between 3'-terminus of neighbour sequence of sequence listing upward to telomere on chrosomal short arm and 5'-terminus of this base sequence : 92682
cttacatttagatcttcaatccatttgaattattttatatggtttaatgtaggggtagaaattacagatagatatatagacagacaaatagatagataggtagatagatagatagatagatagatagatagatagagatatccagttgttccagcatcatttgttaaaaaaaaaattatttcttcactccattttcttggcatcgtgagtgaaaatcacttgaccatggaaatacaggtttatttatggagtcttaattgtattccattgatctacatgttaaacctgataccact

SEQ ID NO: 6530 - DNA, 101 bp, Homo sapiens
  DISD22_0003360
  Located on chromosome 4
  Distance between a terminus base of telomere on chromosomal short arm and 5'-terminus of this base sequence : 12967541
  Distance between 3'-terminus of neighbour sequence of sequence listing upward to telomere on chrosomal short arm and 5'-terminus of this base sequence : 120839
acacagtctcaagatcgcctactttggaagtgtgtgtgtgtgtgtgtgtgtgtgtgtgtgtgtgtgtgtgtagttacctttgccgacttctgtttgaagct

SEQ ID NO: 6531 - DNA, 101 bp, Homo sapiens
  DISD22_0003363
  Located on chromosome 4
  Distance between a terminus base of telomere on chromosomal short arm and 5'-terminus of this base sequence : 13056650
  Distance between 3'-terminus of neighbour sequence of sequence listing upward to telomere on chrosomal short arm and 5'-terminus of this base sequence : 89008
ttgcacatcgatttgaatgttgtgtgtgtgtgtgtgtgtgcttatactctcacaatgatgaccacaggcagcataattatacacttagaatggccatagcc

SEQ ID NO: 6532 - DNA, 172 bp, Homo sapiens
  D4S2906
  Located on chromosome 4
  Distance between a terminus base of telomere on chromosomal short arm and 5'-terminus of this base sequence : 13180791
  Distance between 3'-terminus of neighbour sequence of sequence listing upward to telomere on chrosomal short arm and 5'-terminus of this base sequence : 124040
aattagagatgcccgtgaaacactgaggctgagatatagataaagcaattgtattctctgtgtgtgtgtgtgtgtgtgtgtgtgtgtgtgtataaaagacgtaagatagtcactaattctttactactccctccattgaaaaacagagtctaattcctttgaatctagactg

SEQ ID NO: 6533 - DNA, 486 bp, Homo sapiens
  chr4.fa.O7frz.13175984
  Located on chromosome 4
  Distance between a terminus base of telomere on chromosomal short arm and 5'-terminus of this base sequence : 13279086
  Distance between 3'-terminus of neighbour sequence of sequence listing upward to telomere on chrosomal short arm and 5'-terminus of this base sequence : 98123
agttctgagctcatagaagtacagagtaaaataattgttaacaagggttggggtagtttggatgaggggagagttcaggagatgctgattaaagaatacaaaattacagttaggtagaaggaataagttcaagagatctattgtacaacatggtaactatagttaacaatatattgtattattgaagaatgtgaagaatgaatgtagagtgttctcatcacaaaaataataactatgtgagataatgcatatgttaattagctagatttagctattacataatgtctacatacttcaaaacattatgttgtacatggcaaatacgtacaatgttacctgccaatcaaagaaaaagaaagaaggaaggaaagaaagaaagaaagaaagaaagaaagaaagaaagaaagaaagaaagaaagaaagaaagtttttttttttttcttgtaagtttgtgtaagttatttgtagattccggatattagtgct

SEQ ID NO: 6534 - DNA, 406 bp, Homo sapiens
  chr4.fa.O7frz.13305526
  Located on chromosome 4
  Distance between a terminus base of telomere on chromosomal short arm and 5'-terminus of this base sequence : 13408756
  Distance between 3'-terminus of neighbour sequence of sequence listing upward to telomere on chrosomal short arm and 5'-terminus of this base sequence : 129184
cctaatgaccataatgacaattactaataataaacatggcaaactatatatatatatatatataatatatatattctctaaaatattacaagacagtgaaaatgactgaaatataattccttgcacaaaacatagtttattctgggaaatataatctagagtaaagaagtcactgaagaacatacagaatatccaccatttataaaaagctcaaaaataagtgacattagacaacatgttatttattttatatatatatatgtatatatatggcattaaattattttatgaaaaaggaagaacaaagataaacacagtgattacctggtcttggttaccatggagttgagttaggacagggacccacaggtgcatggaaaggctttgttaatgtactagaccttgg

SEQ ID NO: 6535 - DNA, 414 bp, Homo sapiens
  chr4.fa.O7frz.13421378
  Located on chromosome 4
  Distance between a terminus base of telomere on chromosomal short arm and 5'-terminus of this base sequence : 13654384
  Distance between 3'-terminus of neighbour sequence of sequence listing upward to telomere on chrosomal short arm and 5'-terminus of this base sequence : 245222
gtaagatcattgctgtattaggattctctagagagacagaactaataggatatatatatatatatatatatatggaagtgtattaagtattaacttacatgatcacaaggtcccacaataggctgtctgcaagcttgaggagcaaggcgaaccagtccgagtctcaccactgaagaacttggagtccaatgttcgagggcaggaagcatccagcatgggagaaagatgtaggctgggaggctaggccttttcatattttttctgcgtgctttatatttgctggcagctgattaaatggtgctcatcagattaagggtgggtctgccctccccagcccactgactcaaatgtttatctcctttggcaacaccctcacagagacacccaggatcaatactttgcatcctttaatcc

SEQ ID NO: 6536 - DNA, 278 bp, Homo sapiens
  AC006226.4_2474
  Located on chromosome 4
  Distance between a terminus base of telomere on chromosomal short arm and 5'-terminus of this base sequence : 13774948
  Distance between 3'-terminus of neighbour sequence of sequence listing upward to telomere on chrosomal short arm and 5'-terminus of this base sequence : 120150
atagtaccatggcatacagtaaacactcaaattacatgtaaaacacaaaagaaagagagaggaaggaaggaagacagaaaagaaaatgggaagggaagggaggggagggaagggaagggaagggaagggaagggaagggaagggaagggaagggaagggaagggaaaagaaaggaaaggaaaggagagaagcctgttacccaagctcacctctgagttcttcccttcatttccactctctgcctgggtcagtaacactacttgttctttgtgcaattc

SEQ ID NO: 6537 - DNA, 224 bp, Homo sapiens
  AC006226.4_89997
  Located on chromosome 4
  Distance between a terminus base of telomere on chromosomal short arm and 5'-terminus of this base sequence : 13862464
  Distance between 3'-terminus of neighbour sequence of sequence listing upward to telomere on chrosomal short arm and 5'-terminus of this base sequence : 87238
ccagactggaactattccactggcttttcctaggtctccagcatgcagacagcagatatgggacttctcagtctccctaatcatgtgaaccaacctcataataaatctcttagtgtgtgtgtgtgtgtgtgtgtgtgtgtgtgtgtgtgtgtgtgtcccattgtttctgtttctctggaaaaccttgactaataacaatttctttatcctgtggtcactttctc

SEQ ID NO: 6538 - DNA, 226 bp, Homo sapiens
  AC006226.4_109363
  Located on chromosome 4
  Distance between a terminus base of telomere on chromosomal short arm and 5'-terminus of this base sequence : 13881812
  Distance between 3'-terminus of neighbour sequence of sequence listing upward to telomere on chrosomal short arm and 5'-terminus of this base sequence : 19124
caagacttagaccaaatgacaccactgactttgctgattctcctccttgaagacagtagtaccttggggtgtctcagcctccattatcacatgagcggattcccataattaatctcctagattatctgtcatctatctatctatctatctatctatctatctatctatctatctatctatctaattggctctgtttctctggagactcctgactaagacaccaaga

SEQ ID NO: 6539 - DNA, 373 bp, Homo sapiens
  AC006226.4_134987
  Located on chromosome 4
  Distance between a terminus base of telomere on chromosomal short arm and 5'-terminus of this base sequence : 13907408
  Distance between 3'-terminus of neighbour sequence of sequence listing upward to telomere on chrosomal short arm and 5'-terminus of this base sequence : 25370
ttagcactgtatttggccataccaagtgctaaaacaaatgtctttgaatgatgggaattaaaactagcaaacttttagagtttcaaatgttttaatcaagtcttagaaacagccatatcagtgtaacaatttcaaatatttgcttcaattgttttaaaacacacacacacacacacacacacacagagagagagagagaccatgagaaaaagatacagaactaactctaaaagaattcaagaaaaatttaaggatgggaaaagataattatacttttttagttgcacagggtgcgaatggggtggaagaaattgagcaaaaatgtaattagtttgttacttctaaccaaaccacttctgaagcataactttat

SEQ ID NO: 6540 - DNA, 391 bp, Homo sapiens
  AC006445.11_122801
  Located on chromosome 4
  Distance between a terminus base of telomere on chromosomal short arm and 5'-terminus of this base sequence : 14144489
  Distance between 3'-terminus of neighbour sequence of sequence listing upward to telomere on chrosomal short arm and 5'-terminus of this base sequence : 236708
accgcagaatctgttcaaccttctttcctttcctggagctccagtctctgccttaccctggtgaagtggtggggactgcagtgtgtgtgtgtgtgtgtgtgtgtgtgtgtgtgtgtgtgtgtgttggggctgaagcattgggattgagtgcccagaactgggaaacttgccaatcaggcattgagcaaggaggccagaatctctgaaactgaggagggtgagcacggagcaactgatgtgccttgctgggccttgtaccctccttcctgtcaccccaggtaggaggaacggccctgggtcctccgccttgcctgtgaggcccgccagagctacctgcacactaggatctgcactgtcaccaaggagtggcacgtggtaaatgaagccagga

SEQ ID NO: 6541 - DNA, 146 bp, Homo sapiens
  D4S2944
  Located on chromosome 4
  Distance between a terminus base of telomere on chromosomal short arm and 5'-terminus of this base sequence : 14144545
  Distance between 3'-terminus of neighbour sequence of sequence listing upward to telomere on chrosomal short arm and 5'-terminus of this base sequence : -335
cctggtgaagtggtggggactgcagtgtgtgtgtgtgtgtgtgtgtgtgtgtgtgtgtgtgtgtgtgttggggctgaagcattgggattgagtgcccagaactgggaaacttgccaatcaggcattgagcaaggaggccagaatct

SEQ ID NO: 6542 - DNA, 169 bp, Homo sapiens
  AC006445.11_98630
  Located on chromosome 4
  Distance between a terminus base of telomere on chromosomal short arm and 5'-terminus of this base sequence : 14168654
  Distance between 3'-terminus of neighbour sequence of sequence listing upward to telomere on chrosomal short arm and 5'-terminus of this base sequence : 23963
gtggctttcacatttcaactagtgtacataatgctgcaatgaacatggatgtacaaatatccctttgagaccctgctttcatctgtgtgtgtgtgtgtgtgtgtgtgtgtgtgtgtgtgtgtgtgtgtgtatacccagaaatgcaattgcttgatcatacgataattct

SEQ ID NO: 6543 - DNA, 380 bp, Homo sapiens
  HUMUT7738B
  Located on chromosome 4
  Distance between a terminus base of telomere on chromosomal short arm and 5'-terminus of this base sequence : 14187763
  Distance between 3'-terminus of neighbour sequence of sequence listing upward to telomere on chrosomal short arm and 5'-terminus of this base sequence : 18940
gcacaagaatcagataaggaattctgattccagtaaaaactctgaaaaaggaacttgtttagctggtgtatttttcaatttgaggctcagtaatgaggatgcacactgaagaacaatatccagaaaataaggtagaacagtcctcttctggattcattagaccacacttggtatacagagtttgcttctatctatctgtctgtctgtctgtctgtctgtctatctatctatctatctatctatctatctttctttctttctttctttcttttgagaaagagcctctatctatctatctttctttctttctttcttttgagaaagagcctcgctctgtcacccaggctggagtgcagtggtacaatctcttctcactgcaa

SEQ ID NO: 6544 - DNA, 438 bp, Homo sapiens
  AC006445.11_68392
  Located on chromosome 4
  Distance between a terminus base of telomere on chromosomal short arm and 5'-terminus of this base sequence : 14198786
  Distance between 3'-terminus of neighbour sequence of sequence listing upward to telomere on chrosomal short arm and 5'-terminus of this base sequence : 10643
gaaacctatttgctctgttatcagcacatcaacactgaggcttcactgagacactcatgctgcactgccattttcagctcaggacctcttcaagtgctctgtgtgtgtgtgtgtgtgagagagagagacagagtgtgtgagatggagagagtcagcatgtgtgcgtgtgtggcggggagagaaagagagagagagtgtgtgtgtgtgtgtgtgtgtgtgtgtgtgtgtgtgtgtgttggagcgagtttaggagcaggcagaagtttttggggtcttctccctcatttcagccagaacatctacacttttatctgtttcatatagtgggctgaagatgtcctgcacaaaagtcttcaaaccattggacgaactgcatttctgtttttgaactggctctttcagagccaacacttggtcctgtaagcacttaatcagatc

SEQ ID NO: 6545 - DNA, 268 bp, Homo sapiens
  AC006445.11_5222
  Located on chromosome 4
  Distance between a terminus base of telomere on chromosomal short arm and 5'-terminus of this base sequence : 14262075
  Distance between 3'-terminus of neighbour sequence of sequence listing upward to telomere on chrosomal short arm and 5'-terminus of this base sequence : 62851
tttctcattctgaattctggatgattttattgttgagggaagacagtagatattgcatatctactttcttttttctgttttgtgtgtgtgtgtgtgtgtgtgtgtgtgtgtgtgtgtttacagttttatttaaacacaaaacatgcgcatgagctgcttactcattttcttcactgcacagcctggcattggggttggtgactctgatggccagcggggtggccctttccatgatggctttgcggttcaattaaatgtagcctcatct

SEQ ID NO: 6546 - DNA, 274 bp, Homo sapiens
  AC007126.6_24742
  Located on chromosome 4
  Distance between a terminus base of telomere on chromosomal short arm and 5'-terminus of this base sequence : 14326389
  Distance between 3'-terminus of neighbour sequence of sequence listing upward to telomere on chrosomal short arm and 5'-terminus of this base sequence : 64046
attaacaggcatcagaatcctaatcctggaaattagtagcacagatttctaagctctctttgatctgttggatgagaataatctaggagtagggcctgggaaaccggggaattcaggcgattttgacacaggtggtgattaatttgaggaagatggaaaaatattggtccagtgtatgagtgtgtgtgtgtgtgtgtgtgtgtgtactctctcgatggagagaaagaatcatggagaaagggaataaaaaacctcagaatccaaggaataacct

SEQ ID NO: 6547 - DNA, 368 bp, Homo sapiens
  AC007126.6_51765
  Located on chromosome 4
  Distance between a terminus base of telomere on chromosomal short arm and 5'-terminus of this base sequence : 14353353
  Distance between 3'-terminus of neighbour sequence of sequence listing upward to telomere on chrosomal short arm and 5'-terminus of this base sequence : 26690
ggatctgtattagtcagtgttcacgctgctgataaagacatacccaagactgggaagaaaaataggtttaatggacttacagttccacatggctgaggaggcctcacgatcttggcagaaggcaaggaggagcaagttacatcttacatggatggcagcaggcaaagacagagagtttgtgcagtggaactttttgtttctttgtttctttgtttctttctttctttgtttctttctcctttctttctttctttctttctttctttctttctttctttctttctttctttctttctttcctctttctctctttctttctttaagttctgagatacatgtgctgaatgtgcaggtttgttacataggta

SEQ ID NO: 6548 - DNA, 221 bp, Homo sapiens
  D4S403
  Located on chromosome 4
  Distance between a terminus base of telomere on chromosomal short arm and 5'-terminus of this base sequence : 14363860
  Distance between 3'-terminus of neighbour sequence of sequence listing upward to telomere on chrosomal short arm and 5'-terminus of this base sequence : 10139
aggtggccctgagtaggagtaactttgtcattacacacccagcacacatctttcaattgccaactcccccccagacacacacacacacacacacacacacacacacgaattactagtgtttcagaggttttgagttatgagtaactttttgatgagacaagtcagtactgggaattttttttgtataaagttcaaaaagtcacccaaatcattccctcaaa

SEQ ID NO: 6549 - DNA, 151 bp, Homo sapiens
  D4S2942
  Located on chromosome 4
  Distance between a terminus base of telomere on chromosomal short arm and 5'-terminus of this base sequence : 14383996
  Distance between 3'-terminus of neighbour sequence of sequence listing upward to telomere on chrosomal short arm and 5'-terminus of this base sequence : 19915
gggtctagtctcatccacatcactgcagatgctgttaattcattcctttttatggctgcttagtattccattgtgtgtgtgtgtgtgtgtgtgtgtatatatatgtatatatcacagtttctttattcactagttgattgatgggcatttg

SEQ ID NO: 6550 - DNA, 397 bp, Homo sapiens
  AC007126.6_174593
  Located on chromosome 4
  Distance between a terminus base of telomere on chromosomal short arm and 5'-terminus of this base sequence : 14476127
  Distance between 3'-terminus of neighbour sequence of sequence listing upward to telomere on chrosomal short arm and 5'-terminus of this base sequence : 91980
cactattctaaattatctcgccacagagtagttctgccgtttcttgagattaatataagtgaaatcattcaatatcaactcttttgtgtctggattcctttgcttgttatagctatgaaatttttccacattatagcatggaatagtggtatagtggttcatttttattgctatatagtattctattgtgtgaatgtaccataatctattcattttcctttagttgacttttagattgtagttttgagttgctctgaataatgactgtttacttatgtgtcttttgataaatacacacacacacacacacacacacacacacacaaatttttcttgaatacatacctaggagtggaattgctctgatgtaaataatgtgcatattcagcattagctg

SEQ ID NO: 6551 - DNA, 430 bp, Homo sapiens
  AC007126.6_212557
  Located on chromosome 4
  Distance between a terminus base of telomere on chromosomal short arm and 5'-terminus of this base sequence : 14514250
  Distance between 3'-terminus of neighbour sequence of sequence listing upward to telomere on chrosomal short arm and 5'-terminus of this base sequence : 37726
ctgtactcaggactaggtcaagaccagcttccttttcctgagttaaaagtgaggaatactgggcaggctttgccttcagtgtcaattttactgtcagcttggcctataatcaagttcttgaggaaacacacatacacacacacacacacacacacacacacacacacacacacacacacacacaaatccaatctgggactatgcagagtcagagatggattagacaaaatctttgtcctaaggaactcacagtctagtgggaggagaaagaaagataaattgataaatgcctcattattggtagatgccataaaataatcatagtacttgttaaatcaagtttagcctgaagctgccttcttacatattttaagttcagcccaaggttttctctgtacatcgtgaactatagcaacagatggtagcctac

SEQ ID NO: 6552 - DNA, 127 bp, Homo sapiens
  D4S2984
  Located on chromosome 4
  Distance between a terminus base of telomere on chromosomal short arm and 5'-terminus of this base sequence : 14563735
  Distance between 3'-terminus of neighbour sequence of sequence listing upward to telomere on chrosomal short arm and 5'-terminus of this base sequence : 49055
gatcttgaaattgtcccattttattatgatagaagacagtgttagtcacatttgtgtgtgtgtgtgtgtgtgtgtgtgtgtgtatccagcatgctttctaacactttttcatctgattcctttgggg

SEQ ID NO: 6553 - DNA, 267 bp, Homo sapiens
  chr4.fa.O7frz.14508383
  Located on chromosome 4
  Distance between a terminus base of telomere on chromosomal short arm and 5'-terminus of this base sequence : 14653587
  Distance between 3'-terminus of neighbour sequence of sequence listing upward to telomere on chrosomal short arm and 5'-terminus of this base sequence : 89725
ggagtggcaccaatagtctagatgtagatcacttcaataacaagagacaggctgcgaaattcgatctgtccaccatggtggtacatggtggcagggaggggagatttgaaagacacgttcatccttcatttttatttccttttttctttctttgtttctctctcccttccttccttccttccttccttccttccttccttccttccttccttccttccttccttcttcttccttcattcctacttccttcgttctacttattgctga

SEQ ID NO: 6554 - DNA, 235 bp, Homo sapiens
  chr4.fa.O7frz.14686300
  Located on chromosome 4
  Distance between a terminus base of telomere on chromosomal short arm and 5'-terminus of this base sequence : 14798151
  Distance between 3'-terminus of neighbour sequence of sequence listing upward to telomere on chrosomal short arm and 5'-terminus of this base sequence : 144297
aactacatatttggaacttgtcaccatctgtaattgtgtgagtcaattccttataatacacacacacacacaaacagacacacacacacacacacacacacacacatcctactagttctgtcttcctggagaactccgacttaaacaaatgagggtactgaaaaacagagacggaagtttcccaaagttatgctagtgcccaaggaagaagaaaggatagttcttggttctcagt

SEQ ID NO: 6555 - DNA, 371 bp, Homo sapiens
  AC006296.8_125081
  Located on chromosome 4
  Distance between a terminus base of telomere on chromosomal short arm and 5'-terminus of this base sequence : 15040079
  Distance between 3'-terminus of neighbour sequence of sequence listing upward to telomere on chrosomal short arm and 5'-terminus of this base sequence : 241693
aaccaacattctttcaacagactattgctgctatagtgctgcataggctgctcagttgattctctctctctctttttcacacacacacacacacacacacacacacacacacacaaacacacaccactacttagtgagactttctcacttgacagaaataaaatggaagactcagaaaggagaaagaagaccataaggctggttggtggtagtactaaaattggaacccagctgtctacctgagctctttcttgtctacctgtctctcacctatgatatatataaatccaagctgatttcccagaaatctaacctggaatgactctgtttcctcaatggttagttttttcttattccaagaatcctaaggc

SEQ ID NO: 6556 - DNA, 249 bp, Homo sapiens
  AC006296.8_134981
  Located on chromosome 4
  Distance between a terminus base of telomere on chromosomal short arm and 5'-terminus of this base sequence : 15049948
  Distance between 3'-terminus of neighbour sequence of sequence listing upward to telomere on chrosomal short arm and 5'-terminus of this base sequence : 9498
actgacatcttagctctacattgactgcaaacaacttctcaaagaaaaaacaacaaatacagtactacaatgtacaagagaaattataagattagattaatctaaaatcacacacacacacacacacacacacacacgcacgcacacacacacaaataagcttttggtccaaagaagcaacttggtttccgaagtctgagttctgcaaaacaaagaaatagtttggtccaaggttcaacttaatttatg

SEQ ID NO: 6557 - DNA, 223 bp, Homo sapiens
  D4S1602
  Located on chromosome 4
  Distance between a terminus base of telomere on chromosomal short arm and 5'-terminus of this base sequence : 15085933
  Distance between 3'-terminus of neighbour sequence of sequence listing upward to telomere on chrosomal short arm and 5'-terminus of this base sequence : 35736
tgtggactgagtagagagtgccacatgctatatccagtgtgtttgaaaagacctaagtgtatgtgcgttttaggggggatggtggtggtggggtgtgtgtgtgtgtgtgtgtgtgtgtgtgtgtgtgttttaggggatggtggtagagccacacatcgcgtggacagcagtggataggcaaccatgcatgttgaaaacagtgtttcatttggaacccatctgg

SEQ ID NO: 6558 - DNA, 458 bp, Homo sapiens
  chr4.fa.O7frz.15028198
  Located on chromosome 4
  Distance between a terminus base of telomere on chromosomal short arm and 5'-terminus of this base sequence : 15199031
  Distance between 3'-terminus of neighbour sequence of sequence listing upward to telomere on chrosomal short arm and 5'-terminus of this base sequence : 112875
tccaatagtttgtaagatgcatgtaacaaggcacaaaaaagcaaagatgatgtcatatttgacagcataaatgtagtcccagtgttacatatgtagttgacagggaaacaaatgtcatatatgaaggtatttgaaataaaagagaggaagaaagaaaggaaagaagggaggggggcaaagagaaaagaagggagggagggaagaaggaaggaaggaaggaaggaaggaaggaaggaaggaaggaaggaaaggtaataaaaaattatggtaaagactaaggtgtagtgggtgggctggatgtccattctagtcctgattcttctctcatcaacaagttgagagtcctaataaatgtttatactatttgagcataagttttgcatctttaaaataagatagaaagaattcctagggttcatttaaacttgaaaattctgattctgtaactcattatcagc

SEQ ID NO: 6559 - DNA, 418 bp, Homo sapiens
  chr4.fa.O7frz.15110255
  Located on chromosome 4
  Distance between a terminus base of telomere on chromosomal short arm and 5'-terminus of this base sequence : 15280772
  Distance between 3'-terminus of neighbour sequence of sequence listing upward to telomere on chrosomal short arm and 5'-terminus of this base sequence : 81283
cttacgtcattggttcttcagggtctcccacttggtgaccacagatattgagacatttcagcctccacaatcatgggagcccattccttacagcaaatctctctctctctctctctctctctctatatatatatatatatatatatgtgtgtgtgtgtgtgtgtgtgtgtgtgtgtattatagacatagtctacatatatgtatacatacatacatatatacatgtgtgtatatatatatatagtacgtgtgtgtgtgtgtgtgtggagagaggtgtatacagaacatatatgtatacacacacaccacatcctgttggttttctctgaagagctttgattaatatagccatcaaaaataaaaaatacttgcttggtgtggtgatatgtacatatagtcctaattactggaaagtttg

SEQ ID NO: 6560 - DNA, 459 bp, Homo sapiens
  AC025514.2_44307
  Located on chromosome 4
  Distance between a terminus base of telomere on chromosomal short arm and 5'-terminus of this base sequence : 15460738
  Distance between 3'-terminus of neighbour sequence of sequence listing upward to telomere on chrosomal short arm and 5'-terminus of this base sequence : 179548
ccagctactcagtacggctgaggcaggagaattgcttgaacctgggaagcggaggttgcggtgagccgagatcacaccattgcactccagcctgcgcaagaggagagaaattcggtcttaaaaataataataataataataatacaaaattagcccagcatggtggggcatgcctgtaatcccaactacaagggaggctgaagcaggagaatctcttgaactccgggagacagaggttgcagtaagccgagatcgcgccattgcactccagcctgggcagcaagagcaaaactccggctcaaaaacaaacaaacaaaaaaagtatttagatcaaagggagaaagaggcaggcaagtggcatttcagacagaagaaaaggcaggtacaaaggcatgaagccacagaaaaggaggaaaagttctttgcagaaaaaagagattaggtgaagtaaacatggag

SEQ ID NO: 6561 - DNA, 408 bp, Homo sapiens
  AC019310.3_136546
  Located on chromosome 4
  Distance between a terminus base of telomere on chromosomal short arm and 5'-terminus of this base sequence : 15712261
  Distance between 3'-terminus of neighbour sequence of sequence listing upward to telomere on chrosomal short arm and 5'-terminus of this base sequence : 251064
agtaagtggcaactagtgaaagagccatggcttctattttactcattttgaaagccaagcttgaggagttgtcattatgtatatttaaaaataaaaagaggagaaaagagttctcaaatagtctccaaagaatacacagtgatgaaagaaagaaagagacagaaagagagaaagaaggaaaagatgacagaaggaaggagaaggaaggaaggaaggaaggagaaagggaaagggaaggaaaggaaaagaaaggaaaggaaagggagaaagaaagaagaaagaaaggaaagaaggaaagaaagagagagaaagaaagaaagagagaagaaagagaaagaaagaaagaaagaaaaagaaagaaagaaagctgcaaaaataaagctgaagtgaaatcatttgctgtggtat

SEQ ID NO: 6562 - DNA, 102 bp, Homo sapiens
  DISD22_0003369
  Located on chromosome 4
  Distance between a terminus base of telomere on chromosomal short arm and 5'-terminus of this base sequence : 15856807
  Distance between 3'-terminus of neighbour sequence of sequence listing upward to telomere on chrosomal short arm and 5'-terminus of this base sequence : 144138
ctgaacgtgtagaacacaactgtatatataagtatatatatatatatatatatatatatatatatagtataaatttaaaaaagcaacagagaagttggaaga

SEQ ID NO: 6563 - DNA, 136 bp, Homo sapiens
  Z67830
  Located on chromosome 4
  Distance between a terminus base of telomere on chromosomal short arm and 5'-terminus of this base sequence : 15968612
  Distance between 3'-terminus of neighbour sequence of sequence listing upward to telomere on chrosomal short arm and 5'-terminus of this base sequence : 111703
agctgcttatttatttcttatgggagatttttatatattttagataatattctctctctcacacacacacacacacacacacacacacacacacacacacacacacacatacagtcttacagccacatccctgaaa

SEQ ID NO: 6564 - DNA, 239 bp, Homo sapiens
  D4S2960
  Located on chromosome 4
  Distance between a terminus base of telomere on chromosomal short arm and 5'-terminus of this base sequence : 16014519
  Distance between 3'-terminus of neighbour sequence of sequence listing upward to telomere on chrosomal short arm and 5'-terminus of this base sequence : 45771
aaggctttatcattaagaatcctattaatggatattaagttgctttagttttggttgctattatgtcattattgtaagaaacacttttgtgcgcacacacacacacacacacacacacacacacacacacacctgcatacttgaacgataaatttttataaatgaaacttcaatgttaaaggataaattgtaatagaaactggtaacatgtcatttaaaagatggtaactataccctca

SEQ ID NO: 6565 - DNA, 230 bp, Homo sapiens
  AC005598.6_144159
  Located on chromosome 4
  Distance between a terminus base of telomere on chromosomal short arm and 5'-terminus of this base sequence : 16073100
  Distance between 3'-terminus of neighbour sequence of sequence listing upward to telomere on chrosomal short arm and 5'-terminus of this base sequence : 58342
ggttcaaatgagcttcctagactgggcaacctctaaggcagtgtttaaaagaatgttttccaaagggtggtacccagagaggggcagatacaaatgcatgtgtgtgtgtgtgtgtgtgtgtgtgtgtgtgtgtgagagagagagagagagacagagagagaaacagagagcagagagagattttagtaatgatttatttttatggttgctatgtatttatggcaagtggc

SEQ ID NO: 6566 - DNA, 330 bp, Homo sapiens
  AC005598.6_64773
  Located on chromosome 4
  Distance between a terminus base of telomere on chromosomal short arm and 5'-terminus of this base sequence : 16152390
  Distance between 3'-terminus of neighbour sequence of sequence listing upward to telomere on chrosomal short arm and 5'-terminus of this base sequence : 79060
tagttggtacctggcacagccttccttccacctggatatcctgagtcctgagaagacctagtagggctggaactaaagccaggctgagcttcggcagccactgtgtgtgtagcagtgagagccttccagaagagggcatcaccccaggtggggagcagaggaagcttccaagaagtggtgccaaaccttcaagacaagtcagtcaatttgtcaggttgagaaagggtaaagggcaggtgttttttttgtttgtttgtttgtttgtttgttttggcctcattctgtcacctagaccggattgcactggtgtaattatagctcactgtagcc

SEQ ID NO: 6567 - DNA, 358 bp, Homo sapiens
  AC005674.10_7891
  Located on chromosome 4
  Distance between a terminus base of telomere on chromosomal short arm and 5'-terminus of this base sequence : 16167062
  Distance between 3'-terminus of neighbour sequence of sequence listing upward to telomere on chrosomal short arm and 5'-terminus of this base sequence : 14342
tgtaaattcataaagatttcggaggaataattgaggttctttttctggttggttacagttaatttattggaaggaaggaaaaaaggaaggaaggaaggaaagaaggaaggaaggaaggaaggaaagaaagaaggaaggaaggaaaagctttgaaaactgtaactactcaggttatttggtgcagagaaattctaaatgcaaggtatgcatgcatttaatctgtaatgatctacagccatacatagcattttaagatgacaccaaattttagttgctgaataattccattgtttagaaatcgactgaacatttaaactcatggcatcatggaacactatgtagagcatgattggagact

SEQ ID NO: 6568 - DNA, 250 bp, Homo sapiens
  D4S3048
  Located on chromosome 4
  Distance between a terminus base of telomere on chromosomal short arm and 5'-terminus of this base sequence : 16193602
  Distance between 3'-terminus of neighbour sequence of sequence listing upward to telomere on chrosomal short arm and 5'-terminus of this base sequence : 26182
aagcctgatttattgttccagtgacccaaagttttttgtttgtttggtgtgtgtgtgtgtgtgtgtgtgtgtgtgtgtgtgtgtgtgtgtgtgaaaatttggtttgaagacccaaagttttaaaaaacaaattaatcaaattaatgtacagcatctgctctccagcccgctcactcacagccccgtgctagtgacttaagtggataaatgagagaacacgactcaggttttggttcttcactccccaaag

SEQ ID NO: 6569 - DNA, 132 bp, Homo sapiens
  D4S1601
  Located on chromosome 4
  Distance between a terminus base of telomere on chromosomal short arm and 5'-terminus of this base sequence : 16207963
  Distance between 3'-terminus of neighbour sequence of sequence listing upward to telomere on chrosomal short arm and 5'-terminus of this base sequence : 14111
aactggcttccccaccctttcctggcagccacataacagaaaatacttgagtgttaaaaatacacacacacacacacacacacacacattttaaaaatgtttccgtgttgagtctagccaaaagtagcccga

SEQ ID NO: 6570 - DNA, 139 bp, Homo sapiens
  DISO7_10009905
  Located on chromosome 4
  Distance between a terminus base of telomere on chromosomal short arm and 5'-terminus of this base sequence : 16228558
  Distance between 3'-terminus of neighbour sequence of sequence listing upward to telomere on chrosomal short arm and 5'-terminus of this base sequence : 20463
agaaccacttcatcacattctcctaaaatagaaatgtatgtgatcacagttttgctacattcacacacacacacacacacacacacacatcagttaaagagtttcactgcaaataccttaaacagatattgagaaggaa

SEQ ID NO: 6571 - DNA, 428 bp, Homo sapiens
  chr4.fa.O7frz.15664266
  Located on chromosome 4
  Distance between a terminus base of telomere on chromosomal short arm and 5'-terminus of this base sequence : 16454343
  Distance between 3'-terminus of neighbour sequence of sequence listing upward to telomere on chrosomal short arm and 5'-terminus of this base sequence : 225646
gaattatctgattgtatgccatgtgtctcttccaacagctttcagagaccatttgtttgtttgtttgtttgtttgtttgtttttttggtttttttgagatggagtctcgctctgtcacccaggctggagtacagtggcgtgatctcagctcactgcaacctctgcttcccgggttcaagtgattctcctgcctcagcctcttgagtagccgggactacaggcatgcaccatcacacccagctaatttttgtatttttagtagagactgggtttcaccatattggccaggctggtcttgaactcctgacctcaggtgatccatccttctcagcctcccaaagagctgggattacagatgtgagccactgcgccaggccagctttcagaaactttttaatacaagtgtcaaactctagaatgtttctaca

SEQ ID NO: 6572 - DNA, 304 bp, Homo sapiens
  AC006427.13_149631
  Located on chromosome 4
  Distance between a terminus base of telomere on chromosomal short arm and 5'-terminus of this base sequence : 16468352
  Distance between 3'-terminus of neighbour sequence of sequence listing upward to telomere on chrosomal short arm and 5'-terminus of this base sequence : 13581
atgaaatctgtatgagctgattagcaaaatggcttccatgatccacctactggatagcttatgtgaaggcatttaaaaaaataaggtatattagcaagggttctccagagaaatagaagcaacagaattacatattgctatctttatatgtctatgtctgtgtctatgtctatgtctatgtctatgtttatatctatctttgttgctatctatctatctatctatctatctatctatctatctgggtttattttaaggaattggctcatgtggttgtggagggttagtgagtccaaaacctgtt

SEQ ID NO: 6573 - DNA, 397 bp, Homo sapiens
  AC006427.13_138557
  Located on chromosome 4
  Distance between a terminus base of telomere on chromosomal short arm and 5'-terminus of this base sequence : 16479434
  Distance between 3'-terminus of neighbour sequence of sequence listing upward to telomere on chrosomal short arm and 5'-terminus of this base sequence : 10778
tttagtttctaagccactcatgacagaaaaacaatataaactgcaaatgtgaaaatgtgattgttctaggaaaattttatttaaaaattccacagcacgaattacccatctcatcttcctcttctcttcaatatttctccttcctccaatctgataaatgaagcaaatatcataggctgccaagggaattgagatatttttgtgtgtgagtgtgtgtgtgtgtgtgtgtgtgtgtataatttaagtaaaccaaatgtataggaaaaatctgagtttgcattaaaaacaaaacaaagcaaacaactggggacttaacctttactttacaaaaggattcttttaaaaacggtctttaaatcccaaagtgcccctggtgcggtgaaattactatttaatc

SEQ ID NO: 6574 - DNA, 355 bp, Homo sapiens
  AC006427.13_48154
  Located on chromosome 4
  Distance between a terminus base of telomere on chromosomal short arm and 5'-terminus of this base sequence : 16569825
  Distance between 3'-terminus of neighbour sequence of sequence listing upward to telomere on chrosomal short arm and 5'-terminus of this base sequence : 89994
caatctgagttcctgacaatacatgttagcacatggtcctacagctcctttggtaaatcattcctttctttacttagcaggattgccacttaccttgtcatttctggctgagatttgtctctacttatgggtctggtggccagtaggaaaggaggaaagagattctgatgaaggcaactattacattgtaaagcacctgcttcattttatttatttatttatttatttatttatttatttatttattatactttaagttctagggtacatgtgcacaacgtgcaggtttgttacatatgtatacatgtgccatgttggtgtgctgcacccgttaactcgtcatttacattaggta

SEQ ID NO: 6575 - DNA, 345 bp, Homo sapiens
  AC006427.13_43213
  Located on chromosome 4
  Distance between a terminus base of telomere on chromosomal short arm and 5'-terminus of this base sequence : 16574784
  Distance between 3'-terminus of neighbour sequence of sequence listing upward to telomere on chrosomal short arm and 5'-terminus of this base sequence : 4604
ggttgtactagtttgcattcctaccagcagcgtagaagtgttcgcttttcaccacatccaccccaacgtctattatgttttggttttttgcttatgaccatacttgcaggagtaaggtggtaccacattgtgatttttatttacttttccctgatcattagtatctttttaaaattatttatttatttatttattgtgtgtgtgtgtgtgtgtgtgtgtgtgtgtgtgttttattattatactttaagttctagggtacatgtgcacaacgtgcaggtttgatacataggtatacatgtgccatgttggtttgctgcacccatcaactcgtcatttacattaggt

SEQ ID NO: 6576 - DNA, 310 bp, Homo sapiens
  AC006427.13_27699
  Located on chromosome 4
  Distance between a terminus base of telomere on chromosomal short arm and 5'-terminus of this base sequence : 16590274
  Distance between 3'-terminus of neighbour sequence of sequence listing upward to telomere on chrosomal short arm and 5'-terminus of this base sequence : 15145
ttaatacaccatgcgagtagagcactaaacacaggctttctaatcctccacttagaaagtcataatgcagagttatttgtaaaggttctgagaagtcctttaataaatattgtttaattctgtgtttgcctaacataaaagatggtggaatttctcttttctctccctcccgacttgtccctctctgcactacctaccttcctaccttccttccttccttccttccttccttccttccttccttccttccttctccttccctccctccctccctgcctcttaagatctcaaaggactagacttgtttaga

SEQ ID NO: 6577 - DNA, 114 bp, Homo sapiens
  D4S1567
  Located on chromosome 4
  Distance between a terminus base of telomere on chromosomal short arm and 5'-terminus of this base sequence : 16661518
  Distance between 3'-terminus of neighbour sequence of sequence listing upward to telomere on chrosomal short arm and 5'-terminus of this base sequence : 70934
gctccttgccacttaatgtaaaagtcagcctttggagatgagaatacacacacacacacacacacacacacacacacacacacacacacacactttagaatcaggcagacctag

SEQ ID NO: 6578 - DNA, 242 bp, Homo sapiens
  G10243
  Located on chromosome 4
  Distance between a terminus base of telomere on chromosomal short arm and 5'-terminus of this base sequence : 16725484
  Distance between 3'-terminus of neighbour sequence of sequence listing upward to telomere on chrosomal short arm and 5'-terminus of this base sequence : 63852
tgagcttgctctcctatgcttctgacctcttttttctggagattctggccccaacactgaccctttggtatgaaattttgtaatcacaacaggaacttgatgaatgagtggatggatggatggatggatggatggatggatggatggatggatggataatagatagcttggccagatttatagcaaggagtcatttgttaatgacagacaaatcaggcatggtcctgtgtgctctgaagtga

SEQ ID NO: 6579 - DNA, 374 bp, Homo sapiens
  chr4.fa.O7frz.17495079
  Located on chromosome 4
  Distance between a terminus base of telomere on chromosomal short arm and 5'-terminus of this base sequence : 16871231
  Distance between 3'-terminus of neighbour sequence of sequence listing upward to telomere on chrosomal short arm and 5'-terminus of this base sequence : 145505
acttgaataagtcaatatggtcacattgatactcagcttatttcatgtaaaatgcatggcttgaaagctgcttaaagtgcttgaaatatacatacacacacacacacacacacacgttttatttatatatttaaagagcttaacagtcccttaactctactgctaccatattttccattattcatttgtaagcaaactgttttcagccccatagagaaaataatttcacactaaatcagattcctataattctgaatttgaggtgttcaaaaagcagagatcctaccacaactacaatatgctgttcgcaacagcctctccttgccacctccctccaaactcttttttgccagttctagcttcacaaaggtacc

SEQ ID NO: 6580 - DNA, 410 bp, Homo sapiens
  chr4.fa.O7frz.17637356
  Located on chromosome 4
  Distance between a terminus base of telomere on chromosomal short arm and 5'-terminus of this base sequence : 17018661
  Distance between 3'-terminus of neighbour sequence of sequence listing upward to telomere on chrosomal short arm and 5'-terminus of this base sequence : 147056
ataaatttcttatcgtggcatcacaaactcagctcgggaaatcactttacaaagttgtccggagaacttgattgtggaccctactttgtctgttggtcaataattttaaacgcataaaaatgacattctgtgtatttaaattgtaattttcaatctccccccatatgtaaacacgtacacacacacacacacacacacacacacacacacacagagtttttgaattagtctttagttatgacagaacaaatgtttatttaggaaaggaataaaagtaatagagatttaagacaaaaattactaagtgttgggtataggccattcttgtgttggctgtatatgaaggaagcttattatggaaagagcacatgtttgagggcccagggttaatgttagtatcgtaatccaga

SEQ ID NO: 6581 - DNA, 235 bp, Homo sapiens
  AC005690.8_102365
  Located on chromosome 4
  Distance between a terminus base of telomere on chromosomal short arm and 5'-terminus of this base sequence : 17106280
  Distance between 3'-terminus of neighbour sequence of sequence listing upward to telomere on chrosomal short arm and 5'-terminus of this base sequence : 87209
gaaatgagttcaagatggagatagatacttaggagaaatgatataggtaatagttaaaaccataagtgtgtgtgtgtgtgtgtgtgtgtgtgtgtattggggagtgggagatgacacccagggagaatgtgttaagtgaggggaaaacttgttcagaagggctatctagaaaatatccacaattatgagggtcagtggaagcagtggggtgctagtgaatagtaaacagcctgct

SEQ ID NO: 6582 - DNA, 257 bp, Homo sapiens
  AC005690.8_26557
  Located on chromosome 4
  Distance between a terminus base of telomere on chromosomal short arm and 5'-terminus of this base sequence : 17182090
  Distance between 3'-terminus of neighbour sequence of sequence listing upward to telomere on chrosomal short arm and 5'-terminus of this base sequence : 75575
gcacttccacctacttagtttctctttcttttctttctttttctttctttctttctttctctctctctctctttctttctttctttctttcttctttctttctttctctctccctccctctctccctccctcccttcctcctttccttccttccttccttcctgcttgctttctctttcttctttctttctgagtaaagtggaagcaagtttattagagaagtagagaaacaaaagaattgctagtccataggcaga

SEQ ID NO: 6583 - DNA, 384 bp, Homo sapiens
  chr4.fa.O7frz.17922598
  Located on chromosome 4
  Distance between a terminus base of telomere on chromosomal short arm and 5'-terminus of this base sequence : 17307861
  Distance between 3'-terminus of neighbour sequence of sequence listing upward to telomere on chrosomal short arm and 5'-terminus of this base sequence : 125514
gattatgcttaagctattagcaacacaatgacataaaacattatgttggagaaaatataaaatatagtccatcgaaaattttatcttattttggcttctttttaattgaggtatcatttacagacgataaattacacagattttaaatgtctggttcaatcaaccacttttaaacttctatcacaaagattccttttatcattttcttgtattttatataaatgtaattatacagtacatcgtgtgtgtgtgtgtgtgtgtgtgtgtgtgtgtgtacttggctttttttttctcaacataatgtgtgtaaaatttatctgtgttgtttctatcagtagtttgttcctttttactgtgtactcatgtgccactgtagaaatttag

SEQ ID NO: 6584 - DNA, 409 bp, Homo sapiens
  chr4.fa.O7frz.18037341
  Located on chromosome 4
  Distance between a terminus base of telomere on chromosomal short arm and 5'-terminus of this base sequence : 17418740
  Distance between 3'-terminus of neighbour sequence of sequence listing upward to telomere on chrosomal short arm and 5'-terminus of this base sequence : 110495
aggattagtcttgctcaactaatccttttatcatctttaaaaaatcctggagtaaagaacctatcaagatattgctgtattaagatatcaagcctgggagggcactatttgatttttgctaggtcaaaactctagcacccagaaggtacaaaccacgaaagcaccttttaaatacacacacacacacacacacacacacacacacacacacacacacacggatttctgctgggcatgctggctgcatgtcacaaaatgtctcctgaacagcaggaattttaattaaatcaggggagatctaatttggcctaaattggcttgctacaaaaggtgctaaggagaacaaaaattgttctgcaatatggatgtttgtgaaagggttgggctgtatccattgacaatggtaatg

SEQ ID NO: 6585 - DNA, 470 bp, Homo sapiens
  chr4.fa.O7frz.18247996
  Located on chromosome 4
  Distance between a terminus base of telomere on chromosomal short arm and 5'-terminus of this base sequence : 17629158
  Distance between 3'-terminus of neighbour sequence of sequence listing upward to telomere on chrosomal short arm and 5'-terminus of this base sequence : 210009
ccttaatttcagcacttcaagaggccgagacgggtggatcacctgaggtcaggaatttgagaccagtctggccaacatggtgaaaccctgtgtctactaaaaatacaaaaattagctgggcatgatggtgtgcgcctgtaatcccagctactcaggaggctgaggcagaagaatggcttgaacctgggagatggaggttgcagtaagccgagattgcgccattgtactccagcctgggcgacagagtgagactccatctcaaaaacataaatcaaataaaaaaataaaaaataaaataaaatccacctccaaaaggcagagcttgtgacatatccctctttatgttcccaataccatacaaaaagctagaatagttaccccatccttacctcctcttccttccccacacacatgcctacacacacacacacacacacacacacacagtctgatgaaccagtttctaaaca

SEQ ID NO: 6586 - DNA, 400 bp, Homo sapiens
  AC006160.9_79623
  Located on chromosome 4
  Distance between a terminus base of telomere on chromosomal short arm and 5'-terminus of this base sequence : 17905805
  Distance between 3'-terminus of neighbour sequence of sequence listing upward to telomere on chrosomal short arm and 5'-terminus of this base sequence : 276177
tcaaggtcagtttaccactcacaaaataccaaacatccttctgctggttaaaacgagtgacagctgccgtgtgtgtgtgtgtgtgtgtgtgtgtgtgtgtgtgtatgtgtatatgcgtatatatgtgtatgtatgtgtgtatatatatatgtgtgtgtgtatatatatatatgcaattatacctttatccctactctagtccaccttcctataaataagatgtattgagatgctcagtgcccccattctgacagcatccaatcgagtgaatcctcacttccttgaaatcacccaaccagggccagaatcctaaaagaggttctttgtgacaccctctgtctgagaagtcctatggttctctgtgatgaatagacccaacttgttcaaatacaggcatttc

SEQ ID NO: 6587 - DNA, 413 bp, Homo sapiens
  AC005768.17_163581
  Located on chromosome 4
  Distance between a terminus base of telomere on chromosomal short arm and 5'-terminus of this base sequence : 18001589
  Distance between 3'-terminus of neighbour sequence of sequence listing upward to telomere on chrosomal short arm and 5'-terminus of this base sequence : 95384
acaaggtacaatcttgttccaggtttgtttcagaatcacacatgccaccactatacaatgtatccatgtaatcaaaaaccacttgtacccctgaagctaatgaaatcttttaaaaagagggaggcaaaaaaacaaaatctcacacacacacacacacacacactcacacacacactcttacatacacatgcatatgtatcgacaaaggaaagggtcaagaatacaccaaaacatgaccgtggttatctttagatggtaagattatgggtgatcaatttttcttcttctttttgtttttatgcattctctaatttttctatgatgcacatggcacttcatttatcatcaagttgtattttttaaggctaaaggtataccatcaaaatactctccatcagttaatccacaagtac

SEQ ID NO: 6588 - DNA, 108 bp, Homo sapiens
  D4S2946
  Located on chromosome 4
  Distance between a terminus base of telomere on chromosomal short arm and 5'-terminus of this base sequence : 18029407
  Distance between 3'-terminus of neighbour sequence of sequence listing upward to telomere on chrosomal short arm and 5'-terminus of this base sequence : 27405
gtcaagagggctgattctggccctaaaaacaaggcacacacacacacacacacacacacacacacacacacacacacaaaagaaccaggcacgcaagttcagacaggt

SEQ ID NO: 6589 - DNA, 406 bp, Homo sapiens
  chr4.fa.O7frz.18731549
  Located on chromosome 4
  Distance between a terminus base of telomere on chromosomal short arm and 5'-terminus of this base sequence : 18111021
  Distance between 3'-terminus of neighbour sequence of sequence listing upward to telomere on chrosomal short arm and 5'-terminus of this base sequence : 81506
agctgagattgcgctattatgctccaggctgggcaacagagtgacactccatctcaaaaaaaaaaaatatatatatatatttttgttgttgttgttgttgttgttgttatatatatcttatttttcctactggattttaaatttggatagacatttttattttacttttttaatatcttaattaaatcctaactttcactatcatacttaatttctcactatatatatatattttttgtaatataaatactgagctctgtatttttttcatggctttgaaatttggtgggcatttttaaacttaagatagactcatacaaagtgctgtgtttcgtgatttacgtcttttcataaaggagtctagttgaaaactgagtttactgttaaggaattctaaattcattga

SEQ ID NO: 6590 - DNA, 198 bp, Homo sapiens
  chr4.fa.O7frz.18941338
  Located on chromosome 4
  Distance between a terminus base of telomere on chromosomal short arm and 5'-terminus of this base sequence : 18316920
  Distance between 3'-terminus of neighbour sequence of sequence listing upward to telomere on chrosomal short arm and 5'-terminus of this base sequence : 205493
ctgcaattctgtggtagaatacctaactctcaaaactctgtggtttacaataacagcaaacctctctctctctctctctctctctctctctctctttcctctctctctgcccccactctgtctctctcaacttgatggatttgtgtagtttttctagattcaggtagacgtggctacaagttgcaagtcaggtttacg

SEQ ID NO: 6591 - DNA, 433 bp, Homo sapiens
  chr4.fa.O7frz.19053032
  Located on chromosome 4
  Distance between a terminus base of telomere on chromosomal short arm and 5'-terminus of this base sequence : 18428342
  Distance between 3'-terminus of neighbour sequence of sequence listing upward to telomere on chrosomal short arm and 5'-terminus of this base sequence : 111224
gctactgctatctgttgatcactgtattacacagagcttatgacaattcttgaaacataacacattgaaaaaatatttgctgaatggatcaataaatgatttaaaaatcattgtggtgtaatggagaaatgtaagaccagtaaagttaaaaattctaggattatttccttcttgagtgtgctcctcatgggctgtgcagtcttggtaacgtcacctacttctgaatgttagcttccctccctatgaaaaaggagaaagcaaagtaaatgctcaaatattattgtgaatattaaatgaagtaaaatgtgtcaaaaccacacacaaatacacacacacacacacacacacacacacacacaacataccaagatctctgggatgcagcaaaagcagtattaagaggaaagttgataatgttaaatgcctacctcag

SEQ ID NO: 6592 - DNA, 317 bp, Homo sapiens
  AC007102.4_98309
  Located on chromosome 4
  Distance between a terminus base of telomere on chromosomal short arm and 5'-terminus of this base sequence : 18567130
  Distance between 3'-terminus of neighbour sequence of sequence listing upward to telomere on chrosomal short arm and 5'-terminus of this base sequence : 138355
agcctgactaatatggtgaaaccccgtctctactaaacatacaaaaattagccgggtgtggtggtgcacacctgtaatctctgctactcagaaggatgaggcaggagaatcgcttgaactcaggaggcggaggttacagtcagccgaggtgttgccactgtactccagcctgggtgacagaatgagactctgtgtcaaaaaaaaaaaaaagaaaagaaaagaaaagaaaagaaaagaaatacccgaatgcataatttataggaaaagaggtttaattgactcatggttctgcagtctgtacaggaaacagtaatgac

SEQ ID NO: 6593 - DNA, 187 bp, Homo sapiens
  AC007102.4_95733
  Located on chromosome 4
  Distance between a terminus base of telomere on chromosomal short arm and 5'-terminus of this base sequence : 18569819
  Distance between 3'-terminus of neighbour sequence of sequence listing upward to telomere on chrosomal short arm and 5'-terminus of this base sequence : 2372
agttaccatgatcaaagttgagataagaaatagcaccgtgtagcgtgaaaccataagcagtttggtattcttggggtatgacaattgtgtgtttgtgtgtgtgtgtgtgtgtgtgtgtgtgtgtgtaggggtgggtggaaagataaggagaacatgttaagaaaatttgatcctgaatggaaataga

SEQ ID NO: 6594 - DNA, 270 bp, Homo sapiens
  AC007102.4_20902
  Located on chromosome 4
  Distance between a terminus base of telomere on chromosomal short arm and 5'-terminus of this base sequence : 18644604
  Distance between 3'-terminus of neighbour sequence of sequence listing upward to telomere on chrosomal short arm and 5'-terminus of this base sequence : 74598
actctccaaggctaagcagggagtttggaccattgtgcactctatgaatcagcattgtctgaagcaacagagaacttctcccagaaaacaaggatcatatatacacacacacacacacacacacacacacacacatacatacatacatacatacatacatacatacatacatggctgcagcctgctcttacccataagtgccatctactggcttgtaggttaaactgcacagcccaatatataataaaactgtccgacagaagtgcatag

SEQ ID NO: 6595 - DNA, 386 bp, Homo sapiens
  chr4.fa.O7frz.19489695
  Located on chromosome 4
  Distance between a terminus base of telomere on chromosomal short arm and 5'-terminus of this base sequence : 18678451
  Distance between 3'-terminus of neighbour sequence of sequence listing upward to telomere on chrosomal short arm and 5'-terminus of this base sequence : 33577
gagatcacgctattgcactcctgactgggggacaaaagcgagacttcgtctcaaaaaaaaatagtttttttctcattataaaatttatatatatactcatatatatgcatatctatctatctatctatctatctatctatctatctatatacatatgttcatttttgggtagaaaatttagaaagtgtaggtatgtggaaagaagaaaacaatcaccaggattgtcaagtagccactactcacctagtctgttctcattgttttcacagatatacatatacatgttagagaggaagtagaatatcgtgtttatgagtttaggtggaagagttcaaatcccagcttcacaactttctagctttgtgattctagccaaattacttaaa

SEQ ID NO: 6596 - DNA, 101 bp, Homo sapiens
  DISD22_0003393
  Located on chromosome 4
  Distance between a terminus base of telomere on chromosomal short arm and 5'-terminus of this base sequence : 18961336
  Distance between 3'-terminus of neighbour sequence of sequence listing upward to telomere on chrosomal short arm and 5'-terminus of this base sequence : 282499
ttgtggaagttcttcaaactgcttgtattttatttatttatttatttatttatttatttatttatttatttttaatgccaggacacttggaaaggctcaca

SEQ ID NO: 6597 - DNA, 263 bp, Homo sapiens
  DISD22_0003401
  Located on chromosome 4
  Distance between a terminus base of telomere on chromosomal short arm and 5'-terminus of this base sequence : 19111413
  Distance between 3'-terminus of neighbour sequence of sequence listing upward to telomere on chrosomal short arm and 5'-terminus of this base sequence : 149976
ctcctcatctgtccctgcctttctgtgcccctgctcagctatccccaggtcggcctgcctggggggtttctctctgtctctctctctctctctctctctctctctctctctctctctctctctctctctctctccattcagcctcagtccgcctggcacctgccctgtggctctcccaggctgtggctggagcagtcctggtccctccccattcaagggaacccagaagagcgtccagcggaggggctgctgatggctttctt

SEQ ID NO: 6598 - DNA, 232 bp, Homo sapiens
  D4S419
  Located on chromosome 4
  Distance between a terminus base of telomere on chromosomal short arm and 5'-terminus of this base sequence : 19210735
  Distance between 3'-terminus of neighbour sequence of sequence listing upward to telomere on chrosomal short arm and 5'-terminus of this base sequence : 99059
tgagtgccaaatggtaacaggactgtgtggcccccaaggcttaaaatacatagtgtctggacctttatagaaaacatttggcaactcctggactagagagttgagttggattttgaagcagtgtttagaggcacaaggtggtcgtaaatttgaaggaaaactagtaaacattaatatatgcgtgtgtgtgtgtgtgtgtgtgtgtgtgtgtgtggctagatggaggagaagg

SEQ ID NO: 6599 - DNA, 183 bp, Homo sapiens
  G08401
  Located on chromosome 4
  Distance between a terminus base of telomere on chromosomal short arm and 5'-terminus of this base sequence : 19214325
  Distance between 3'-terminus of neighbour sequence of sequence listing upward to telomere on chrosomal short arm and 5'-terminus of this base sequence : 3358
aaggttccaggacacattcagggttctccagagaaattggagattggatacatgattgatagatggtagatagataaatagatagatagatagatagatagatagatagatagatagataggtagatagatagatttttttttaaatgaggaattgactcgtatgattatggagctttgcaag

SEQ ID NO: 6600 - DNA, 223 bp, Homo sapiens
  G08394
  Located on chromosome 4
  Distance between a terminus base of telomere on chromosomal short arm and 5'-terminus of this base sequence : 19214325
  Distance between 3'-terminus of neighbour sequence of sequence listing upward to telomere on chrosomal short arm and 5'-terminus of this base sequence : -183
aaggttccaggacacattcagggttctccagagaaattggagattggatacatgattgatagatggtagatagataaatagatagatagatagatagatagatagatagatagatagataggtagatagatagatttttttttaaatgaggaattgactcgtatgattatggagctttgcaagtctaggtatctgtctgctgtttgtaagctggagatccagg

SEQ ID NO: 6601 - DNA, 447 bp, Homo sapiens
  AC068110.2_77348
  Located on chromosome 4
  Distance between a terminus base of telomere on chromosomal short arm and 5'-terminus of this base sequence : 19220710
  Distance between 3'-terminus of neighbour sequence of sequence listing upward to telomere on chrosomal short arm and 5'-terminus of this base sequence : 6162
ggttactcagtttggaactagaattaaaaagattataaagctaaaaaagtgtaattttgaagctacttattgtcatcttctccagtatgtagaaaagaatgatcaggagaaagagagagaaagagagagaaagagagagagacagagagagagagagacagagagagaaaagaagaagaagaagaagaagaagaagaagaagaagaggaagaggaagaggaagaagaagaagaagaagaagaagaagaagaagaagaagaagaagaagaagaagaagaagaggaagaagaagaagaaaaagaagaagaagaagaagaacaacaacaacagcagcaggaggaggaggaggtagaaaaggaatcagaaaaagacttcatgacctcatttgaataatttgtctcattcatgattggagtcagctttacctctgaactcagatcgagctag

SEQ ID NO: 6602 - DNA, 433 bp, Homo sapiens
  AC006840.17_154574
  Located on chromosome 4
  Distance between a terminus base of telomere on chromosomal short arm and 5'-terminus of this base sequence : 19466429
  Distance between 3'-terminus of neighbour sequence of sequence listing upward to telomere on chrosomal short arm and 5'-terminus of this base sequence : 245272
ggtctattaggatcacaaggacataagaaacttactagagttaaaaagatgtgagataaaaatataatgcaaataatgaaatttaaatatggccttaagagatgggcataattttgaaaggcaactgttggtattttggcagagtaaatttatttatttatttatttatttatttatttatttatttatttattttagagaaagggtctcactgttctgctcaggctggactagaactcctgggttcaagtgatgttcctgctgcagcttcttcagtagctgtgactacaggtgcataccaccacccctctcaaataatggcatggacataagaatgtggcagggtgatacatggagaggatgaggtcgaatttggtgggatacatgtttgagataaaaaaacaaagtcagctagaaaggctgatttgagttt

SEQ ID NO: 6603 - DNA, 243 bp, Homo sapiens
  D4S1608
  Located on chromosome 4
  Distance between a terminus base of telomere on chromosomal short arm and 5'-terminus of this base sequence : 19598678
  Distance between 3'-terminus of neighbour sequence of sequence listing upward to telomere on chrosomal short arm and 5'-terminus of this base sequence : 131816
gaaaatgctgcctgggaatttctgtgcatttcttgcttacaggccgctgcaatggatagggtttcatggtgctccagagacttttttctcaggaaatagaactgcattttctcaatttaaagatactttatacacaaacacaccacacataccacacacacacacacacacacacacacacacacacacatacattatttatttcaggattttgtatttacctttatgggctagtaattcctt

SEQ ID NO: 6604 - DNA, 297 bp, Homo sapiens
  G12429
  Located on chromosome 4
  Distance between a terminus base of telomere on chromosomal short arm and 5'-terminus of this base sequence : 19787142
  Distance between 3'-terminus of neighbour sequence of sequence listing upward to telomere on chrosomal short arm and 5'-terminus of this base sequence : 188221
gagttgatctgtacttgttgaagcttaagtcattcaagaaatattattttaatgaacacagcattcatacttgtttgggttaacatatcatttttcagtccattaagatcaatcctagtaaaaagatgcaagatttagcaaatacaagtagagaatatctagttaaatttaaatttcaaatacacaaaaatacaactttagtatatctctatctctatctatctgtctgtctatctatctatctatctatctatctatatatatatatatatatctcccaaatattgcatgggacat

SEQ ID NO: 6605 - DNA, 352 bp, Homo sapiens
  chr4.fa.O7frz.20742742
  Located on chromosome 4
  Distance between a terminus base of telomere on chromosomal short arm and 5'-terminus of this base sequence : 19938055
  Distance between 3'-terminus of neighbour sequence of sequence listing upward to telomere on chrosomal short arm and 5'-terminus of this base sequence : 150616
agaatcatgtgactcaaatgagacgaggcatgtgtaaaaatgttttaaaacactgaaacaatacttgatgttactgaacagattttccatttgaaagaaggaaaggcggagaatttagcaattatttaaattatttaaatgatttagcaattactcagtactttccttggcttcaggaattgcccacatgctactccattgaatctgaacaacaacataatttatctatctatctatctatctatctatctatctatctatctatctatcatctgtgtacttaacaacaatctgtcgtgcatctttcccaatgtcattgcatatgtcaaaatcaagatccaaacttaggtct

SEQ ID NO: 6606 - DNA, 221 bp, Homo sapiens
  DISO7_10001374
  Located on chromosome 4
  Distance between a terminus base of telomere on chromosomal short arm and 5'-terminus of this base sequence : 19965412
  Distance between 3'-terminus of neighbour sequence of sequence listing upward to telomere on chrosomal short arm and 5'-terminus of this base sequence : 27005
agtccttgtgaattggccgagattgttttttttggggaaaagaaggaggaaggagaaagagaagaggaaggagaaggaaaaggaggagatggagaagaggaagaagaaaaagaaggagaaggaggaagaggagaagaagtgtgtgtgtgtgtgtgtgtgtgtgtgtgtatagagagagagagagagagagagagagacaacaataagatcatgaaagctta

SEQ ID NO: 6607 - DNA, 290 bp, Homo sapiens
  HUMUT1298
  Located on chromosome 4
  Distance between a terminus base of telomere on chromosomal short arm and 5'-terminus of this base sequence : 20076577
  Distance between 3'-terminus of neighbour sequence of sequence listing upward to telomere on chrosomal short arm and 5'-terminus of this base sequence : 110944
atgtttcttcattggctgtccaggacctcacattcttacttttacttgtaaattgctggccattagttactcagggattgatgcttcaatatgtcttttctgaattctaatacttgcaatggtaatgacatccagtttcatggctttgatatcatctgtcagtcaatctctgtctctatgtatctctgtctgtctgtctatctatctatctatctatctatctatctatctatctatctacctcctacctacctataattggtctatcccagaactcttgcctgggttcc

SEQ ID NO: 6608 - DNA, 472 bp, Homo sapiens
  chr4.fa.O7frz.19787100
  Located on chromosome 4
  Distance between a terminus base of telomere on chromosomal short arm and 5'-terminus of this base sequence : 20181660
  Distance between 3'-terminus of neighbour sequence of sequence listing upward to telomere on chrosomal short arm and 5'-terminus of this base sequence : 104793
agtggactgatgttaattcactaggagctgcccttgttgcttgtgagttaatgaagtagggggatgcaccaaatctataaatttccttagtcagtttcagtcacaaataaaaacagagcaccactaactacaaaagaatatgcaaaaacaacgtggatgatatagttgtagcatttccatattatcaaaaaagaaaatacaatgaggaaatgaaatttggtaagatgttttcagattataaagcaaggtacttggatgatataatggctaaaacacatcttaaaagcaggagtggagtgttcattgagagaaataaagaacatatatatttctgtgtttgtggacacattgtatagtatgaaaactgacaaagtacatatatatatatatatatatttaaatgcatgtattccatatatgtgtaggtatatcttaagattttctgaagtgaggtaattgtttattctttctg

SEQ ID NO: 6609 - DNA, 299 bp, Homo sapiens
  HUMUT878B
  Located on chromosome 4
  Distance between a terminus base of telomere on chromosomal short arm and 5'-terminus of this base sequence : 20273071
  Distance between 3'-terminus of neighbour sequence of sequence listing upward to telomere on chrosomal short arm and 5'-terminus of this base sequence : 90939
gcatggcattcctatgacacacagtaatttccctttctttctttccttctttctttctttccttctttctttctttctttctttctttctttctttctttctttctttctttctttctttctttctctttctctctctctttctctttctctctttctttctctttctctctttctctctctttccctcccttcctcccttcctttcctcctcccttcctcccttccttccctcccttccttccttccttgcttcattccttccttcctttctttcttcctttccatctgatattccaa

SEQ ID NO: 6610 - DNA, 248 bp, Homo sapiens
  DISO7_10009910
  Located on chromosome 4
  Distance between a terminus base of telomere on chromosomal short arm and 5'-terminus of this base sequence : 20288014
  Distance between 3'-terminus of neighbour sequence of sequence listing upward to telomere on chrosomal short arm and 5'-terminus of this base sequence : 14644
tcataattggatgcccatagaaataatctggaaagttgtctctctctctctctctctctctcaatatatttagatatatatcttttttacactctctgggcctcatcactagagattttgaatcagctgatctggagtagagttgcaagcattggaaatctgaaataactatccttgatagcctaatgaacacccatggctgagattcagcgttttatataaaggcccacctctgggttgcttggagt

SEQ ID NO: 6611 - DNA, 296 bp, Homo sapiens
  DISO7_00016246
  Located on chromosome 4
  Distance between a terminus base of telomere on chromosomal short arm and 5'-terminus of this base sequence : 20471112
  Distance between 3'-terminus of neighbour sequence of sequence listing upward to telomere on chrosomal short arm and 5'-terminus of this base sequence : 182850
aaggattgtttccatgcagccctttgattttcttagcatttttttttttttggtgcctgctttctgaccccttcttcctttgtctcctaatgcacccccaccccgctcctaattcttccctcccccaacacacacacacacacacacacacacacacacacacaaaaacgtcaggaggagaaaatcagtgtatccacccacagatttctcactttgatcctttcctgtctcaccgcctggaacccagcttcagagaccaggattctggctcgttttggggtgacccagtcacttcc

SEQ ID NO: 6612 - DNA, 438 bp, Homo sapiens
  chr4.fa.O7frz.4859420
  Located on chromosome 4
  Distance between a terminus base of telomere on chromosomal short arm and 5'-terminus of this base sequence : 20541892
  Distance between 3'-terminus of neighbour sequence of sequence listing upward to telomere on chrosomal short arm and 5'-terminus of this base sequence : 70484
tggaatcactattgcattaaacagtggtgtgctaatactgtgggtgatttggaagccactgaaacaatgatgcacaagatagcatgataacatgtcaagttgctcacggtatattgttatatgacaaaaataggtctccaaacagtttgcacaatatgatgagttcctgaaaattcacttcatgcattttatttaaaagccaagaaggttattctccaattgttaataatagttactgctagggggaagttttcagggatgatttttctttcttcttttgctcactattttctaagctgttagtagtagtagtagtagtaataataataataataataataataataataatagctaagcactcctgagggcccacaaagctcggtgccagcctcattctctgtgttaattcatgtatttaaatcctcatagtcctcc

SEQ ID NO: 6613 - DNA, 218 bp, Homo sapiens
  Z67501
  Located on chromosome 4
  Distance between a terminus base of telomere on chromosomal short arm and 5'-terminus of this base sequence : 20570157
  Distance between 3'-terminus of neighbour sequence of sequence listing upward to telomere on chrosomal short arm and 5'-terminus of this base sequence : 27827
gcctggaaaacagagtgatagcctatctctaaacacacacacacacacacacacacacacacacacacaaaattaacagttcaaaagagggtaccatgtttaatcattgttaataaaattcagactaatgaagtaaacactggtatagcaatgtggataaaagtttttatattatatagatgtgggttgaagttcagatcttcccacgaggtgacttt

SEQ ID NO: 6614 - DNA, 153 bp, Homo sapiens
  D4S2925
  Located on chromosome 4
  Distance between a terminus base of telomere on chromosomal short arm and 5'-terminus of this base sequence : 20680172
  Distance between 3'-terminus of neighbour sequence of sequence listing upward to telomere on chrosomal short arm and 5'-terminus of this base sequence : 109797
tcagaaacccctacaggaaaacaccatctccacctagcccctcattcataaaagacaaacacacacacacacacacacacacaccctaggaagaagaagaccacagaacacacacagaatccacacagtaactcctccgaataactcatcaaa

SEQ ID NO: 6615 - DNA, 380 bp, Homo sapiens
  chr4.fa.O7frz.4774212
  Located on chromosome 4
  Distance between a terminus base of telomere on chromosomal short arm and 5'-terminus of this base sequence : 20787322
  Distance between 3'-terminus of neighbour sequence of sequence listing upward to telomere on chrosomal short arm and 5'-terminus of this base sequence : 106997
ggaactagctccattccagtgcacagaggccagctgtctcacccagccccaactcctcagctgatggacaggatctccctgaagaggagatatgagtgtgtgtgtgtgtgtgtgtgtgtgtgtgtgtgtgtgtgtgtggtggggataaggtggggggtcttttcgtgcctttaatccccagctatccccttctggagggactcagacaggtgaagtcaccaggttcgggtctcccacaggttacatccaatttcctgcttcccatgtgccaagcccagtagtacttacagggacccacaccacagtcacccttctttgaaacctggcttctggtgcaggcttggtgccgaggactctacgcatgccattcatacaatgct

SEQ ID NO: 6616 - DNA, 151 bp, Homo sapiens
  chr4.fa.O7frz.5109115
  Located on chromosome 4
  Distance between a terminus base of telomere on chromosomal short arm and 5'-terminus of this base sequence : 20947777
  Distance between 3'-terminus of neighbour sequence of sequence listing upward to telomere on chrosomal short arm and 5'-terminus of this base sequence : 160075
ttgatagcattccacagactaccggagattctgttcatttgtaaatatatatatgtgtgtgtgtgtgtgtgtgtgcgcgtgcgtgaaatatatttccttatttggcttcagtttggatacagtttttattcatctatcaagttcacagatc

SEQ ID NO: 6617 - DNA, 286 bp, Homo sapiens
  HUMUT5936
  Located on chromosome 4
  Distance between a terminus base of telomere on chromosomal short arm and 5'-terminus of this base sequence : 20975927
  Distance between 3'-terminus of neighbour sequence of sequence listing upward to telomere on chrosomal short arm and 5'-terminus of this base sequence : 27999
atgagctcctctgagaggtgaacaagctcctgcgtctgcaccaccggaggtgttcaaaccaagagagggtggccattggctagagaggcagccctgtaggagcactgctgtgagaggacaaagttctttctttccttcttctccttccttgcttccttccttccttccttccttccttccttccttccttccttccttccttccttccctccctccctccctccctccttccttctttctttctttactttctttctttctttttgatgagtcttgccctctttcc

SEQ ID NO: 6618 - DNA, 247 bp, Homo sapiens
  chr4.fa.O7frz.5196521
  Located on chromosome 4
  Distance between a terminus base of telomere on chromosomal short arm and 5'-terminus of this base sequence : 21055456
  Distance between 3'-terminus of neighbour sequence of sequence listing upward to telomere on chrosomal short arm and 5'-terminus of this base sequence : 79243
cagtgaggcattaatctgataggactgtggtcttataaaaagaagagaaagatggagagtgagacacacacacacacacacacacacacacacacacacacagagatctcattaaggatgcagcaagaaagttgcctctgctggcaccctgagttcagatatccagcttttagaactgtgagaaataaatttctattgctggaggcccccaatctatggttttatgtatggtaacctaaggtgacta

SEQ ID NO: 6619 - DNA, 143 bp, Homo sapiens
  D4S1647
  Located on chromosome 4
  Distance between a terminus base of telomere on chromosomal short arm and 5'-terminus of this base sequence : 21126246
  Distance between 3'-terminus of neighbour sequence of sequence listing upward to telomere on chrosomal short arm and 5'-terminus of this base sequence : 70543
tatttccaacacccctgctacttttattcataaaaagcaaatagatagatagatagatagatagatagatagatagatagatagatagtatatatcaagttcctagacaattcttaaattgacactttcaatcctctttgctt

SEQ ID NO: 6620 - DNA, 102 bp, Homo sapiens
  DISD22_0003407
  Located on chromosome 4
  Distance between a terminus base of telomere on chromosomal short arm and 5'-terminus of this base sequence : 21404100
  Distance between 3'-terminus of neighbour sequence of sequence listing upward to telomere on chrosomal short arm and 5'-terminus of this base sequence : 277711
tgtctcaatacccattaaccagtataactgtcacaaacacagacacacacacacacacacacacacacacacacacacacacaccccttcacctccagtacc

SEQ ID NO: 6621 - DNA, 306 bp, Homo sapiens
  D4S2399
  Located on chromosome 4
  Distance between a terminus base of telomere on chromosomal short arm and 5'-terminus of this base sequence : 21533266
  Distance between 3'-terminus of neighbour sequence of sequence listing upward to telomere on chrosomal short arm and 5'-terminus of this base sequence : 129064
cacaggcagcctttatttcacacaaaagatatccaactgaatgtggaaaacagacctttgcaagtgtttattttatttattattattattattattattattattattattattatttttactttaagtcctgggatacatgtgcagaacgtgcaggtttgttacctaggtatacacatgccatgggggtttgctgcacctatcaacccatcatctaggtttaagcctcctgatgctctccctcccctttccccccaccgcctgacaggccccagtgtgtgatgtttccctccctgtgtccatgtg

SEQ ID NO: 6622 - DNA, 206 bp, Homo sapiens
  chr4.fa.O7frz.21388963
  Located on chromosome 4
  Distance between a terminus base of telomere on chromosomal short arm and 5'-terminus of this base sequence : 21763984
  Distance between 3'-terminus of neighbour sequence of sequence listing upward to telomere on chrosomal short arm and 5'-terminus of this base sequence : 230412
tacatacgagtatttggctgaggaggaggagaatggggcctgaaatccagcatgcactctgaccattatggtatgtctgctcctaagaaacctcatatatatatatatatatatatatatatatatatatatatatatatttttttttttttttttttttttttttttttacagcaatgctatgtgtaattgcatggtcctaaatg

SEQ ID NO: 6623 - DNA, 347 bp, Homo sapiens
  chr4.fa.O7frz.21690122
  Located on chromosome 4
  Distance between a terminus base of telomere on chromosomal short arm and 5'-terminus of this base sequence : 21846179
  Distance between 3'-terminus of neighbour sequence of sequence listing upward to telomere on chrosomal short arm and 5'-terminus of this base sequence : 81989
ataatgactgcattaagctgaggaacgtgttccctcatccaatctctctctctctctctcgcccccccccacttctgtctctctctctctctctctctctctctctgtctctacccagccatcccagatccaacccgcacttgcaaaaatacatacatacacacagtatgcaaacacatacccatagtcagcaccctttctgtctttctgagttaaggctgtgatggcccttggggtttgctcggaaacagtcacttccaagatccagaaaggctttgtaaacatgggtcctacctgcacacaagtcagactgtgatcattcccttgtagattatcaaacattccat

SEQ ID NO: 6624 - DNA, 265 bp, Homo sapiens
  chr4.fa.O7frz.21830869
  Located on chromosome 4
  Distance between a terminus base of telomere on chromosomal short arm and 5'-terminus of this base sequence : 21985068
  Distance between 3'-terminus of neighbour sequence of sequence listing upward to telomere on chrosomal short arm and 5'-terminus of this base sequence : 138542
ccggttgatataatgtaaagtaataaaacactttcaggattatttttatacttaatgatagtatatatatatattatacgtgtgtgtgtgtgtgtgtgtgtgtgtatgcacataagtagttaataattgcagctgttaaagttcaagatcatctgcaaacttaccataaagctgatggcacaggcattcgactcactttctcttcttcaagacacagtagtctatgattctcttgcctttgctgtctttaagaccttgaagagga

SEQ ID NO: 6625 - DNA, 428 bp, Homo sapiens
  chr4.fa.O7frz.21939576
  Located on chromosome 4
  Distance between a terminus base of telomere on chromosomal short arm and 5'-terminus of this base sequence : 22093798
  Distance between 3'-terminus of neighbour sequence of sequence listing upward to telomere on chrosomal short arm and 5'-terminus of this base sequence : 108465
ttgatttacaaatagaagtccaatccatatgcatcactctacaacttcctttttttctctcttatttatttatttatttatttatttatttatttatttattatttttttgagacagagtcttgctctgtcgcccaggctggagtgcagtggcgcaatctgggctcactgcaagctctgcctcccaggttcacgccattctcctgcctcagcctcctgagtagctgggactacaggcgcccaccaccatgcccagctaattttttgtatttttagtagagacagggtttcactgtgttagccaggatggtctcgatctcctgacctcttaatccacctgcctcggcctcccaaagtgctgggattacaggcgtgagccactgcaacgggccctttttttctctcttaaaacagatcgtggacatcaat

SEQ ID NO: 6626 - DNA, 148 bp, Homo sapiens
  D4S1546
  Located on chromosome 4
  Distance between a terminus base of telomere on chromosomal short arm and 5'-terminus of this base sequence : 22169390
  Distance between 3'-terminus of neighbour sequence of sequence listing upward to telomere on chrosomal short arm and 5'-terminus of this base sequence : 75164
ctaccgactagaatcacatgggaattggacacacacacacacacacacacacacaaccccatgaacaaacagcaataatttgcttccctcatgaatccaatcgtcattctgaaaattaccagtggacattgaggcgtttggacaggtc

SEQ ID NO: 6627 - DNA, 479 bp, Homo sapiens
  chr4.fa.O7frz.22154509
  Located on chromosome 4
  Distance between a terminus base of telomere on chromosomal short arm and 5'-terminus of this base sequence : 22266631
  Distance between 3'-terminus of neighbour sequence of sequence listing upward to telomere on chrosomal short arm and 5'-terminus of this base sequence : 97093
tcacctaattggaatgcttattatcagcattaaccatattattactacagcatcatgaatggccccttatggtaggagttattattattattattattattattattattattattgagatggagtcttactctgtcacccaggctggagtgcaatagtgtggtctcagctcattgcaacctccacctcctgggttcaagcaattcttctgcctcagcctcccaagtagctgggactacaggcatgtgccaccacacctggctaatttttgtatgtttagtagagacggggtttcgctatgttggccaggctggtctcaaactcctgacctcatgatccacctgcctctgcctcccaaagtgctgggataacagacatcagccactgcacctggatgagttattattttttaggtggtagggtcttaattgatttttggtaaataagaaaaacaaaaattatactgccagtcattatgc

SEQ ID NO: 6628 - DNA, 192 bp, Homo sapiens
  HUMUT1692
  Located on chromosome 4
  Distance between a terminus base of telomere on chromosomal short arm and 5'-terminus of this base sequence : 22415779
  Distance between 3'-terminus of neighbour sequence of sequence listing upward to telomere on chrosomal short arm and 5'-terminus of this base sequence : 148669
tctctctcttgctcttcccccccaccgccacatagagagataaggagatagatagatagatagatagatagatagatagatagatagatagatagatagatagacagacagacagatagatagatatagatctatagataggtatatcgcatacacacatacaacacacatacaacacacatacaagcctga

SEQ ID NO: 6629 - DNA, 149 bp, Homo sapiens
  D4S2994
  Located on chromosome 4
  Distance between a terminus base of telomere on chromosomal short arm and 5'-terminus of this base sequence : 22569802
  Distance between 3'-terminus of neighbour sequence of sequence listing upward to telomere on chrosomal short arm and 5'-terminus of this base sequence : 153831
gcagcaattatgggctgtactcctcaaattcacattttgggaatgcagaagccttgtgtgtgtgtgtgtgtgtgtgtgtgtgcgttggaaggggcagtttatatgtaataccatgcagatccatagtctatgaacatcaccaaggttaa

SEQ ID NO: 6630 - DNA, 420 bp, Homo sapiens
  AC027110.2_106725
  Located on chromosome 4
  Distance between a terminus base of telomere on chromosomal short arm and 5'-terminus of this base sequence : 22711965
  Distance between 3'-terminus of neighbour sequence of sequence listing upward to telomere on chrosomal short arm and 5'-terminus of this base sequence : 142014
ctccataattatgtgagccaattgtttgaaataaatctctagactgatagatgatagataggtgatgatgatgatgatagatagatagatagatagatagatagatagatagatagatagactggcagaaagatagatagatagatatcctactggttgtggccctaattaatgtatccccaatgctttactcattaaattttaaataaactttttctttttcattttacatatcagaaaagaaaagccttctaagttgtgtaaggaacggtgtcctggttttaaaaaaaaaatcaaacaaaaccttggaagagtaatttgacattgtaatcctttcatttcacagcaactccatgaactcaagattgcaatgtagttaccatctacagagatccagagtcagtttggattctacaattg

SEQ ID NO: 6631 - DNA, 327 bp, Homo sapiens
  chr4.fa.O7frz.23039744
  Located on chromosome 4
  Distance between a terminus base of telomere on chromosomal short arm and 5'-terminus of this base sequence : 22775986
  Distance between 3'-terminus of neighbour sequence of sequence listing upward to telomere on chrosomal short arm and 5'-terminus of this base sequence : 63601
ggagctaagtttccagtcatagatttatacctagattataagaaaaaaggatgagacgtgtcctcaagcccaatattccataaaattaggctgacattatcctgaaacacacacatacacacacacacacacacacacacacacacacacacggataatgtcagctaatatacatatacaaaatcaacttatgagaaattctctttttcccactctttggtgggtcatttagaataaggaactggggttctaatttcacactggaacataatatcatattgtttacctttactcagatgcattttctcagctattaaacagtcatgc

SEQ ID NO: 6632 - DNA, 190 bp, Homo sapiens
  D4S3017
  Located on chromosome 4
  Distance between a terminus base of telomere on chromosomal short arm and 5'-terminus of this base sequence : 22916684
  Distance between 3'-terminus of neighbour sequence of sequence listing upward to telomere on chrosomal short arm and 5'-terminus of this base sequence : 140371
gggcactcatcccattgctgaagttaacaatccttaagaagtaaaaattaattccaaaacccagaagaaaagttgttgtatccagtttgttttattatgttctgttgtgtgtgtgtgtgtgtgtgtgtgtgtgtgtgtgtgtgtgtgtgtttgttttggtttggtttggtttggttttggtttgtcacat

SEQ ID NO: 6633 - DNA, 324 bp, Homo sapiens
  chr4.fa.O7frz.22701425
  Located on chromosome 4
  Distance between a terminus base of telomere on chromosomal short arm and 5'-terminus of this base sequence : 22959975
  Distance between 3'-terminus of neighbour sequence of sequence listing upward to telomere on chrosomal short arm and 5'-terminus of this base sequence : 43101
caactgttttaggtacaggaaagatttgaagtatttttttttctttttcttttctttctttattttttatttatttatttatttatttatttatttatttatttatttattttttgagacagtctcactctgttatccaggctggagtgcagtggtgtgatcttggctcactgcacccttcaggttcaagggattctcatgtctcagcctccagagtagctgggattacaggtgcacaccaccatgcccagctaatctttgtatttttagtaaagatggggttccatcatattgaccaggctggtcttgaactcttgacctcaa

SEQ ID NO: 6634 - DNA, 285 bp, Homo sapiens
  HUMUT7818
  Located on chromosome 4
  Distance between a terminus base of telomere on chromosomal short arm and 5'-terminus of this base sequence : 23122680
  Distance between 3'-terminus of neighbour sequence of sequence listing upward to telomere on chrosomal short arm and 5'-terminus of this base sequence : 162381
ggaaaagaggaacatgctaatccagtggaatcaggcttctgatacctagtgcaatgatagagcaaaacagaaatgaggtttacttgcataaaaataacatcaaaacaaacaacaacaaatctatcctttctctgtatctatctatctatctatctatctatctatctatctatctatctatcatctatatcatctatctatctacctgaagttgtagtgggtgagaatcattaggactctaagatcatagtcaagtttaagataatgtctatccttaagaatgga

SEQ ID NO: 6635 - DNA, 266 bp, Homo sapiens
  G10112
  Located on chromosome 4
  Distance between a terminus base of telomere on chromosomal short arm and 5'-terminus of this base sequence : 23122719
  Distance between 3'-terminus of neighbour sequence of sequence listing upward to telomere on chrosomal short arm and 5'-terminus of this base sequence : -246
tgatacctagtgcaatgatagagcaaaacagaaatgaggtttacttgcataaaaataacatcaaaacaaacaacaacaaatctatcctttctctgtatctatctatctatctatctatctatctatctatctatctatctatcatctatatcatctatctatctacctgaagttgtagtgggtgagaatcattaggactctaagatcatagtcaagtttaagataatgtctatccttaagaatggaacttgaaaggttagcatgta

SEQ ID NO: 6636 - DNA, 169 bp, Homo sapiens
  chr4.fa.O7frz.22447917
  Located on chromosome 4
  Distance between a terminus base of telomere on chromosomal short arm and 5'-terminus of this base sequence : 23180973
  Distance between 3'-terminus of neighbour sequence of sequence listing upward to telomere on chrosomal short arm and 5'-terminus of this base sequence : 57988
taatgctaccaaattcagtcacagtcttggaaattctctatttggttttgtttgggtttcatatgtatgtagtcatactttatatttgtgtgtgtgtgtgtgtgtgtgtgtgtgtgtgtgtgtgtgtgtgttttatagtgcagccctctccttaggcttctgatatgag

SEQ ID NO: 6637 - DNA, 154 bp, Homo sapiens
  D4S1593
  Located on chromosome 4
  Distance between a terminus base of telomere on chromosomal short arm and 5'-terminus of this base sequence : 23273507
  Distance between 3'-terminus of neighbour sequence of sequence listing upward to telomere on chrosomal short arm and 5'-terminus of this base sequence : 92365
aattacatgaggcaattcctcaaaataaatacatctctttctcacacatgtgtgtgtatctgtgtgtgtgtgtgtgtgtgtgtgtgtgtgtgtgtgtattgcttttttcctctggagaaccctaactagtacaacagtaaccagtcaacaagtt

SEQ ID NO: 6638 - DNA, 121 bp, Homo sapiens
  D4S3020
  Located on chromosome 4
  Distance between a terminus base of telomere on chromosomal short arm and 5'-terminus of this base sequence : 23290534
  Distance between 3'-terminus of neighbour sequence of sequence listing upward to telomere on chrosomal short arm and 5'-terminus of this base sequence : 16873
tatcctgctgattgaaagtttggcaaagcgcccaagactgtgtgtgtgtgtgtgtgtgtgtgtgtgtgtgtgtgcacgtgcgcttatgtgcattgtgcaatgtctaaacactcaaacagga

SEQ ID NO: 6639 - DNA, 110 bp, Homo sapiens
  D4S1562
  Located on chromosome 4
  Distance between a terminus base of telomere on chromosomal short arm and 5'-terminus of this base sequence : 23313097
  Distance between 3'-terminus of neighbour sequence of sequence listing upward to telomere on chrosomal short arm and 5'-terminus of this base sequence : 22442
tatacaagcatttgtgatgtgttaaagactggcaccaaaagatgtgtgagtgtgtgtgtgtgtgtgtgtgtgtgtgtgtgtgtgtaatgctgttaaaatttagttaagct

SEQ ID NO: 6640 - DNA, 250 bp, Homo sapiens
  D4S2905
  Located on chromosome 4
  Distance between a terminus base of telomere on chromosomal short arm and 5'-terminus of this base sequence : 23339298
  Distance between 3'-terminus of neighbour sequence of sequence listing upward to telomere on chrosomal short arm and 5'-terminus of this base sequence : 26091
gcataagtaacccaacacttgatagtgactttttaaaagatttctcgccctttctgcattaatgttagatacaagaaagttctgtgcccctgccgtgtgagtgtgtgtgtgtgtgtgtgtgtgtgtgtagcagataagtatgaagcggcagtgagagaaaagggacactgttgtgacagtttgccaaaattttcttctctgcaatgcattctcacgtaactactgaggagggtgagaggctgtttcaggc

SEQ ID NO: 6641 - DNA, 377 bp, Homo sapiens
  chr4.fa.O7frz.23568094
  Located on chromosome 4
  Distance between a terminus base of telomere on chromosomal short arm and 5'-terminus of this base sequence : 23573610
  Distance between 3'-terminus of neighbour sequence of sequence listing upward to telomere on chrosomal short arm and 5'-terminus of this base sequence : 234062
ggacctccttcactacataaaggaagttaaatgtacattcaatatctagtcaataggtaggtaggtagatagacaggtagaatggatagatagatagatagatagatagatagatagatagatagatagatagatgatagagacagatgggtggatggatggatagaaagatagatagatagatagatagatagatagatagatagatagatagatagatagatagatagatgatagagacagatgggtggatggatggatagatagatagatagatagatagatagatagagaaaaatgatagattagatagatacatagatagatagatagatagatagatagatagatagatagatctccagtatttcctttct

SEQ ID NO: 6642 - DNA, 211 bp, Homo sapiens
  DISD22_0003412
  Located on chromosome 4
  Distance between a terminus base of telomere on chromosomal short arm and 5'-terminus of this base sequence : 23689406
  Distance between 3'-terminus of neighbour sequence of sequence listing upward to telomere on chrosomal short arm and 5'-terminus of this base sequence : 115419
tagacaatgcgggttgacttttccttttgcgagataaattgatagatagaaagatgatagatagatagatagatagatgattgatagatagatagatagatagatagatagatagatagatagatagatagatacaatgtgtgtgtgtctgatctttcagactttgggtcatcctgaattaaaacctattttggtgctgatggagctcaga

SEQ ID NO: 6643 - DNA, 366 bp, Homo sapiens
  chr4.fa.O7frz.23906629
  Located on chromosome 4
  Distance between a terminus base of telomere on chromosomal short arm and 5'-terminus of this base sequence : 23827653
  Distance between 3'-terminus of neighbour sequence of sequence listing upward to telomere on chrosomal short arm and 5'-terminus of this base sequence : 138036
tgatgttcatcttaattccaacttcatcaaaggtaaaagttaaatatttgatatttaaacatttaacaaacatatactaccagacacacacacacatacacacacgcacagatctgagacatcatttaactcgatctcgtttcttaacatttaactttatgcacttaaaaacaaaaagccatttatagaaccactgcacccactaaatgctaaagaaattctccacaataagaaacgcatgggcttttgttactacgatgtcttaagatgactggattacctgcttggccacctagagatttctgcaagatgccaatgggtctttttttgacccactggcgcaggtctaaacactcaatgcatttc

SEQ ID NO: 6644 - DNA, 102 bp, Homo sapiens
  DISO7_10001381
  Located on chromosome 4
  Distance between a terminus base of telomere on chromosomal short arm and 5'-terminus of this base sequence : 23876951
  Distance between 3'-terminus of neighbour sequence of sequence listing upward to telomere on chrosomal short arm and 5'-terminus of this base sequence : 48932
gtgtctatgcatttctggatataacagaaaaaaaaaaaaaaaatatatatatatatatatatacaccagatcattaatacaagttatctcaggatgatgtga

SEQ ID NO: 6645 - DNA, 104 bp, Homo sapiens
  DISD22_0003423
  Located on chromosome 4
  Distance between a terminus base of telomere on chromosomal short arm and 5'-terminus of this base sequence : 24165041
  Distance between 3'-terminus of neighbour sequence of sequence listing upward to telomere on chrosomal short arm and 5'-terminus of this base sequence : 287988
tgtcaagacaagattgttctctgaaatgcagtgtgtgtgtgtgtgtgtgtgtgtgtgtgtgtgtgtgtcttagcattctccctcagctacataaataagcaatt

SEQ ID NO: 6646 - DNA, 146 bp, Homo sapiens
  D4S2953
  Located on chromosome 4
  Distance between a terminus base of telomere on chromosomal short arm and 5'-terminus of this base sequence : 24431190
  Distance between 3'-terminus of neighbour sequence of sequence listing upward to telomere on chrosomal short arm and 5'-terminus of this base sequence : 266045
ctcattgatgggctactcattaatggtttggatatggagaggagtgtgtgtgtgtgtgtgtgtgtgtgtgtgtgtatgtgtgtgtgtgtgtaagggaactggcaagtcaaggatgactcttaactttctgaccttgtttttttgga

SEQ ID NO: 6647 - DNA, 101 bp, Homo sapiens
  DISD22_0003435
  Located on chromosome 4
  Distance between a terminus base of telomere on chromosomal short arm and 5'-terminus of this base sequence : 24596360
  Distance between 3'-terminus of neighbour sequence of sequence listing upward to telomere on chrosomal short arm and 5'-terminus of this base sequence : 165024
aagttggctataatttgaattcacaaatgctcctctgtgtgtgtgtgtgtgtgtgtgtgtgtgtgtgtgtgtgtgtggtttagtggcagttgatggaaagt

SEQ ID NO: 6648 - DNA, 261 bp, Homo sapiens
  AC007016.5_64747
  Located on chromosome 4
  Distance between a terminus base of telomere on chromosomal short arm and 5'-terminus of this base sequence : 24777921
  Distance between 3'-terminus of neighbour sequence of sequence listing upward to telomere on chrosomal short arm and 5'-terminus of this base sequence : 181460
tcaaagctcagtaaatattggtaggatgaatgaatgaatgaatgaatgaatgaatgaagaaatgtctatataaatgaatgaattatttggacaattgttggagatcttttctatttgtttttcttctcttgtgaataaagaggtaacgggatgggagagggtaaaggggagcagctgggggacacagaaccaccttgtaccaaaagaagcctgagttttaagaccaacactttttgcacaactaccatgacttaggcaaag

SEQ ID NO: 6649 - DNA, 144 bp, Homo sapiens
  D4S2362
  Located on chromosome 4
  Distance between a terminus base of telomere on chromosomal short arm and 5'-terminus of this base sequence : 24777932
  Distance between 3'-terminus of neighbour sequence of sequence listing upward to telomere on chrosomal short arm and 5'-terminus of this base sequence : -250
taaatattggtaggatgaatgaatgaatgaatgaatgaatgaatgaagaaatgtctatataaatgaatgaattatttggacaattgttggagatcttttctatttgtttttcttctcttgtgaataaagaggtaacgggatggg

SEQ ID NO: 6650 - DNA, 289 bp, Homo sapiens
  AC007016.5_108527
  Located on chromosome 4
  Distance between a terminus base of telomere on chromosomal short arm and 5'-terminus of this base sequence : 24821659
  Distance between 3'-terminus of neighbour sequence of sequence listing upward to telomere on chrosomal short arm and 5'-terminus of this base sequence : 43583
ggaccatgataaagtgtacttacacaaacctagattgtgtgtgtgtgtgtgtgtgtgtgtgtgtgtgtatatatatatatatatatatatatgtattttttaaatatggaaaaccaaatgtcccagcatcattactgaatatcagttatttctcctacttgatctgcaaagccaatatcaggtgccatagatcagatctctacatatgctccattataatcctattggaccacctttgtatatggggtctgccattgaccaaaacatccttgtgcagtacataactgta

SEQ ID NO: 6651 - DNA, 150 bp, Homo sapiens
  G09468
  Located on chromosome 4
  Distance between a terminus base of telomere on chromosomal short arm and 5'-terminus of this base sequence : 24844752
  Distance between 3'-terminus of neighbour sequence of sequence listing upward to telomere on chrosomal short arm and 5'-terminus of this base sequence : 22804
ttgaaaagcagtacaaacatccctcttccttctctctctttcctttgtccttccttccttccttccttccttttttattacttccatccttaactaaaaaatacttaactaaaagtctactatattcttagctgtgctaaattctgggaa

SEQ ID NO: 6652 - DNA, 224 bp, Homo sapiens
  DISO7_10001383
  Located on chromosome 4
  Distance between a terminus base of telomere on chromosomal short arm and 5'-terminus of this base sequence : 25050652
  Distance between 3'-terminus of neighbour sequence of sequence listing upward to telomere on chrosomal short arm and 5'-terminus of this base sequence : 205750
cactgcctcttaccctgtcattttcttttatggtatatatcactacctactatgattatgatgtaaatttccatcataacatacacacacacacacacccacacacacacacacacacaaacacaaacttatatacataccatatggtatgtggtgcttaattttttgtgtcaacttggctgtgctatggtgctcagttgtcattgtattaagccatgacaact

SEQ ID NO: 6653 - DNA, 379 bp, Homo sapiens
  DISO7_10001384
  Located on chromosome 4
  Distance between a terminus base of telomere on chromosomal short arm and 5'-terminus of this base sequence : 25053504
  Distance between 3'-terminus of neighbour sequence of sequence listing upward to telomere on chrosomal short arm and 5'-terminus of this base sequence : 2628
cttcacctccattctcagtgtgcagatctgttcagttttgaaagccttaaaatgtttcaaagggttcatttgttttgaggacttcctttggatagatagagggatgtagaacatttcctgtctcctcattgttcaagctacctgctttcatttatcacagtctgcttgagagggtctatctttatacatatacacacacacacacacacacacacacacacacacatacacacatatgtatctatacacatatgtatatatatgtatctatatgtatatacatatatgtatatatataattcctacatatttatatatataaaacaagatatatatatatatatgtctctgttgttttcgtcagtccagtttcgttata

SEQ ID NO: 6654 - DNA, 219 bp, Homo sapiens
  D4S2933
  Located on chromosome 4
  Distance between a terminus base of telomere on chromosomal short arm and 5'-terminus of this base sequence : 25053662
  Distance between 3'-terminus of neighbour sequence of sequence listing upward to telomere on chrosomal short arm and 5'-terminus of this base sequence : -221
agtctgcttgagagggtctatctttatacatatacacacacacacacacacacacacacacacacacatacacacatatgtatctatacacatatgtatatatatgtatctatatgtatatacatatatgtatatatataattcctacatatttatatatataaaacaagatatatatatatatatgtctctgttgttttcgtcagtccagtttcgtta

SEQ ID NO: 6655 - DNA, 442 bp, Homo sapiens
  chr4.fa.O7frz.25028129
  Located on chromosome 4
  Distance between a terminus base of telomere on chromosomal short arm and 5'-terminus of this base sequence : 25270534
  Distance between 3'-terminus of neighbour sequence of sequence listing upward to telomere on chrosomal short arm and 5'-terminus of this base sequence : 216653
aatttaacagttataattggcagtgatttttcttccttaatgaaacaaacaaatggtgcatcttataataaatgacatcacagattcagaaaatatattaatattctattttctgtcttgctaacttctcttctgctttctgtgctccaaaatgttgttgtcctctctggtttaccaatagttcccctggtccttttatttcattttcctgttctcattttagtgagatttttggaaggagttgtggtaagtgtgtgttccatctgctgtgtatagctaagctcatcatgttgtttatgaggttctgtatttgtagatagagactcagtgctgatggctacctaaaaactagtgtgtgtgtgtgtgtgtgtgtgtgtgtgtgtgtgtgtttgcatcattacctaggtcttatttctttactttagtgataccacgttagtgc

SEQ ID NO: 6656 - DNA, 427 bp, Homo sapiens
  AC006052.5_133867
  Located on chromosome 4
  Distance between a terminus base of telomere on chromosomal short arm and 5'-terminus of this base sequence : 25349661
  Distance between 3'-terminus of neighbour sequence of sequence listing upward to telomere on chrosomal short arm and 5'-terminus of this base sequence : 78685
tttcaaatagtctgccttcaagctcactaattctttcttctgcttaatcaattctcttattaacagactctgatgcattcttcagtatgtcaattgcatttttcacctccagaatttctgcttgattctttttaattgtttcaatctctttgttaaatttatctgataggattctgaattctttctctatgttatcttaaatttctttgagtttcctcaaaacaggtgctttgaattctctgaaaagccacatctctctctctctctctctctctctctctctctctctctttctctctctctctcactctttctctgggatttgttcctggggtcttattatgtttatttgatgaggtcatgttttcctgaatggtcttgatgcttgatgatattcattcgtgtctggacattgaacagttatgta

SEQ ID NO: 6657 - DNA, 300 bp, Homo sapiens
  AC006052.5_111419
  Located on chromosome 4
  Distance between a terminus base of telomere on chromosomal short arm and 5'-terminus of this base sequence : 25372126
  Distance between 3'-terminus of neighbour sequence of sequence listing upward to telomere on chrosomal short arm and 5'-terminus of this base sequence : 22038
ccaatcttcaccttgataacttagtaggtgttttgaaggtagaactgacaaaagtataggggccttccgaagactagactcctggagcttttaatatccaagctagttcacactggcctctacaatcaattacaatttaagtgttcatatgagtactggctttagcaaaggctgtctgttttgggcacctgttgtaggtacacagaaggttatgtgatttggtgtgtgtgtgagtgtgtgtgtgtgtgtgtgtgtgtgtgtgtgtgtgtgtgtggggtgagaacaggagtaatgactttc

SEQ ID NO: 6658 - DNA, 302 bp, Homo sapiens
  AC006052.5_111224
  Located on chromosome 4
  Distance between a terminus base of telomere on chromosomal short arm and 5'-terminus of this base sequence : 25372411
  Distance between 3'-terminus of neighbour sequence of sequence listing upward to telomere on chrosomal short arm and 5'-terminus of this base sequence : -15
ggagtaatgactttccaagctcttcatgttaccccagaaaccacacaccttatttctttatgagcctctttatttcttctgtagatttgtgttcctttggtgttagctattgaattctacaacatctgggtccagaatgcatatatatatatatgtgtgtgtgtgtgtgtgtgtgtgtgtgtgttgtatatgtatatatatatagacatacagaaacatatagaaatatgttgaattcttaaaaggctcattttaagggttcatttcttaaaagaggactgtcatttgcttctgctagacat

SEQ ID NO: 6659 - DNA, 178 bp, Homo sapiens
  AC006052.5_21426
  Located on chromosome 4
  Distance between a terminus base of telomere on chromosomal short arm and 5'-terminus of this base sequence : 25462240
  Distance between 3'-terminus of neighbour sequence of sequence listing upward to telomere on chrosomal short arm and 5'-terminus of this base sequence : 89527
gattcactcgaagtttgttagaattctattgagatttagcagaagtgctttttttatattaaaatattatagataaattatatagaaaactttatgtagctattgcagtggttattctagacattacattgtgtgtgtgtgtgtgtgtgtgtgcatgtatgtgcctgtctatggtgtt

SEQ ID NO: 6660 - DNA, 227 bp, Homo sapiens
  HUMUT736
  Located on chromosome 4
  Distance between a terminus base of telomere on chromosomal short arm and 5'-terminus of this base sequence : 25498474
  Distance between 3'-terminus of neighbour sequence of sequence listing upward to telomere on chrosomal short arm and 5'-terminus of this base sequence : 36056
agattacaggcagggaggcaaactcatgacactaaaaatgctccattataacaagcactcttctaaacaacacacacacacacacacacacacacacacacacacacacacacaagcacatacattcctttagtttaagaaaacctgctcaccttggagtctttttccagtagttgattttgataaaagagaatgcttctattctttctgaagactttttgtccaga

SEQ ID NO: 6661 - DNA, 474 bp, Homo sapiens
  chr4.fa.O7frz.25297714
  Located on chromosome 4
  Distance between a terminus base of telomere on chromosomal short arm and 5'-terminus of this base sequence : 25515445
  Distance between 3'-terminus of neighbour sequence of sequence listing upward to telomere on chrosomal short arm and 5'-terminus of this base sequence : 16744
ataattcaatgccacttgtactagtaaggtttctccagagaaacagaataaaaagggtgcatgtgtctgtgtgtggtatatatatataagtgtgtgtgtgtgtgtgtgtgtgtgtgtagtaagttacaaagagagacgttttaaggaagtggctcacatgactgtggaggccagcaaatccaaaatctgaaacataggccagcagcctagagattcaatggagagttgatgttgcagttccagtctaaaggcagtctgctggcagaattccccttttcttgagaaagacaagtcttttttttaaattaaggccttgaactgcttggatgagccccactcacatatggaagataatatgttttactcaagtctaaggatttaaatgttaatctcatctaaaaaatacctttacagaaacacttagaattgttccagacttgtctactggtagttctttaagtggtctatcatgac

SEQ ID NO: 6662 - DNA, 184 bp, Homo sapiens
  D4S425
  Located on chromosome 4
  Distance between a terminus base of telomere on chromosomal short arm and 5'-terminus of this base sequence : 25606101
  Distance between 3'-terminus of neighbour sequence of sequence listing upward to telomere on chrosomal short arm and 5'-terminus of this base sequence : 90182
caactgtgtatatgtagttcatcatagactgaactatggtacatgactacctacacacacacacacacacacacacacacacacacacacacacacacgctgagaagtatcaggatctgctgtctgcaagcgggagacccaggaaagccaaagagataatttagtctgagtccccaggcttcag

SEQ ID NO: 6663 - DNA, 442 bp, Homo sapiens
  chr4.fa.O7frz.25375532
  Located on chromosome 4
  Distance between a terminus base of telomere on chromosomal short arm and 5'-terminus of this base sequence : 25621022
  Distance between 3'-terminus of neighbour sequence of sequence listing upward to telomere on chrosomal short arm and 5'-terminus of this base sequence : 14737
tggttaacattgtcttcgttattatttttcacctccataggtcttgaagtaaggtttttgtttgtttgtttgtttgtttgtttgttgagacagagtcccggtctgtcgcccaggctggagtgcagtggcgcgatcttggctcactgcaagctccgcctcccgggttcacgccattctcctgcctcagcctcccgagtagctgggtctacaggcgcccgccaccacgcccggctaattttttatatttttagtagagacggtgtttcaccgtgttaatcaggatggtcttgatctcctggcctcgtgatccacccgcctcagcctcccaaagtgctgggattacaggcatgagccaccgcgcccaacctgaaataagttttgattggaaagggaggacagactgttagaggatggaaaaacatgaagtcacatgtctaacacc

SEQ ID NO: 6664 - DNA, 424 bp, Homo sapiens
  chr4.fa.O7frz.25452934
  Located on chromosome 4
  Distance between a terminus base of telomere on chromosomal short arm and 5'-terminus of this base sequence : 25699643
  Distance between 3'-terminus of neighbour sequence of sequence listing upward to telomere on chrosomal short arm and 5'-terminus of this base sequence : 78179
aatgcatagtcttcatattcaaagggactatttctttttccaaaatgaaagctaagagacatatatagttttcacttcgaaatccatcatgcgcatctttccatttcaataaatatagatctactctaccatttttagcaatccataaatgtatccataatttggacagtctgtttcttctataaatatatatatatatatatatatacacacacacacacacacactcgtagataatgtacacatttgcagtttttttcgtatctccaaatttatccatgaggccctcattctgtcctcaagttttccatatttcctcagtcgcacctgacatctgtgccttctgctgccccgaactgtctgatcatcacaagttacccatcccaggccctactccttaagacagtatctgcttggtgataac

SEQ ID NO: 6665 - DNA, 385 bp, Homo sapiens
  chr4.fa.O7frz.25858633
  Located on chromosome 4
  Distance between a terminus base of telomere on chromosomal short arm and 5'-terminus of this base sequence : 25752771
  Distance between 3'-terminus of neighbour sequence of sequence listing upward to telomere on chrosomal short arm and 5'-terminus of this base sequence : 52704
ctatggttcgtgaaaggattcagggtaggcctggaaggcaaaatcaggttacaaacacacacacacacacacacacatgaatcataaacacatgtagacacatacaatacctgcatacatacacacacaaagacacatgatagccacacacatctgcataacacacgcacacacaaagcacaatactacacacatacatgtttaatattcacacaacacacacagacacacacaatatccacagagatacacacaatacatgcactcacaaaatataaagctgcatgcacacacaacacacatacagaaatcatgaacacatgtggaaacacacaatatccacatacatacctaccacaattttcagcacctgagtagatagtac

SEQ ID NO: 6666 - DNA, 164 bp, Homo sapiens
  D4S3013
  Located on chromosome 4
  Distance between a terminus base of telomere on chromosomal short arm and 5'-terminus of this base sequence : 25847540
  Distance between 3'-terminus of neighbour sequence of sequence listing upward to telomere on chrosomal short arm and 5'-terminus of this base sequence : 94384
ttaagtgacctggttcaataaattatagagatgtgtgtgtgtgtgtgtgtgtgtgtgtgtgtgtgtgtgtgtgtgtatatatatatacacacacatatttatatttaatattatcattaaaatcagttgtaaaatatatttaatagcataatgggagagtgttc

SEQ ID NO: 6667 - DNA, 406 bp, Homo sapiens
  chr4.fa.O7frz.25657759
  Located on chromosome 4
  Distance between a terminus base of telomere on chromosomal short arm and 5'-terminus of this base sequence : 25953351
  Distance between 3'-terminus of neighbour sequence of sequence listing upward to telomere on chrosomal short arm and 5'-terminus of this base sequence : 105647
tacaaactcatcctgtcttcagagagagctaactccatgtgacaacacaaggaaagctgttaaagaactgtaaactcctgcagctgggtaccagcctttaattagactgtggcaccgaaacagacgttcttcaagtacccagagagatataatgagtctattagtccaagaagtaagagatataatcggccaaatcatacatctatcaaaaacataccaagaaatgggggaagggcacagagaatcagccaaacatcctggccgtcaggaagtcattgaatgtggcttgtaattctgtttcacacaaattggatgataaattcacacacacacacacacacacacacacacagagagagagagagagagagagagagagaacttgaagacaaacatttctggaagt

SEQ ID NO: 6668 - DNA, 207 bp, Homo sapiens
  Z67217
  Located on chromosome 4
  Distance between a terminus base of telomere on chromosomal short arm and 5'-terminus of this base sequence : 26043410
  Distance between 3'-terminus of neighbour sequence of sequence listing upward to telomere on chrosomal short arm and 5'-terminus of this base sequence : 89653
ggtggacaatgggtcattcttatgcttgtggtgtaaaggtcagaagagggaagtgtgcaggcttgctctatgcttgagaaatatgcatttctatgtgtgctcccgtcttctccttgccccaatacacacacacacacacacacacacatatgctcacacacacaccagaatttgcattgttctgccaggttgcatcagtgggctggt

SEQ ID NO: 6669 - DNA, 255 bp, Homo sapiens
  AC006229.17_43075
  Located on chromosome 4
  Distance between a terminus base of telomere on chromosomal short arm and 5'-terminus of this base sequence : 26079965
  Distance between 3'-terminus of neighbour sequence of sequence listing upward to telomere on chrosomal short arm and 5'-terminus of this base sequence : 36348
gaacagtgcctcataaattctaagtactaaatacgtgacattttagattattatgatttggttgaaagagtgactcatgcttccaatcctgagaagttgcatgtcagtaacagaaagaactaaagctgatgtcagctcccagggctgaaatcaacattccagcctgtcacagtgtgtgtgtgtgtgtgtgtgtgtgtgtgtgtgtgtgtgtgtgtgtgtgcacgcgcatctgtgtacaatggtatggacgcatat

SEQ ID NO: 6670 - DNA, 338 bp, Homo sapiens
  chr4.fa.O7frz.26312855
  Located on chromosome 4
  Distance between a terminus base of telomere on chromosomal short arm and 5'-terminus of this base sequence : 26237624
  Distance between 3'-terminus of neighbour sequence of sequence listing upward to telomere on chrosomal short arm and 5'-terminus of this base sequence : 157404
tatgacacttagcatcttccagaattttggtcgtctctactgagaacatttccagcagatgaacaccaaagaaaaaggcacacaggtcaggacgccatctgttgctcagttggaacagaccattctgctcagaaaccacggaagtgtgatattgcccttcacttcccactccctgaccaacacaattcctaacaaatcttcaagtgtgtgtgtgtgtgtgtgtgtgtgtgtgtcttatgcaacaacacaaacccaggaaacatcacaccctaaacaaataatccccttccccttagcagcatcctagatacacaaagtatgcaatagaatccaaagaa

SEQ ID NO: 6671 - DNA, 101 bp, Homo sapiens
  D4S404
  Located on chromosome 4
  Distance between a terminus base of telomere on chromosomal short arm and 5'-terminus of this base sequence : 26292752
  Distance between 3'-terminus of neighbour sequence of sequence listing upward to telomere on chrosomal short arm and 5'-terminus of this base sequence : 54790
ttcctcatttacctgcactaagaggacacacacaaacacatacacacacacacacacacacacacacacacacacacatatacacacccaaggtttagtaa

SEQ ID NO: 6672 - DNA, 336 bp, Homo sapiens
  chr4.fa.O7frz.26521905
  Located on chromosome 4
  Distance between a terminus base of telomere on chromosomal short arm and 5'-terminus of this base sequence : 26489864
  Distance between 3'-terminus of neighbour sequence of sequence listing upward to telomere on chrosomal short arm and 5'-terminus of this base sequence : 197011
agtagaaacttgcaggagctactgaggtggtcgggccggcgctggagctgggggcctggagaagcacgatcggggcccggagggtgcccggctgcccgtggccggcgccggtggcttccttcaggctatcctgccccgcctggcgggccttgggtgctctccacgcttccttgcatccgcccaggattgccgagagccaacgacccctccggctccgcaaactccagctctccaggagcgggcgtccgcgtgcctgcctgtgtgagagtgtgtgtgtgtgtgtgtgtgtgtgtgtgtgtgtgtgtgtgtgtctgtgtctgtcgatgagtcagaaac

SEQ ID NO: 6673 - DNA, 126 bp, Homo sapiens
  D4S3052
  Located on chromosome 4
  Distance between a terminus base of telomere on chromosomal short arm and 5'-terminus of this base sequence : 26726120
  Distance between 3'-terminus of neighbour sequence of sequence listing upward to telomere on chrosomal short arm and 5'-terminus of this base sequence : 235920
cccagtcccactcacaagttaatctctctctctctctctgtgtgtgtgtgtgtgtgtgtgtgtgtgtgtgtgtgtgtgtgtgtgtgtacgtgtgtatgtatatgcttcttgctctggcatctgtga

SEQ ID NO: 6674 - DNA, 190 bp, Homo sapiens
  AC006390.8_164328
  Located on chromosome 4
  Distance between a terminus base of telomere on chromosomal short arm and 5'-terminus of this base sequence : 26750418
  Distance between 3'-terminus of neighbour sequence of sequence listing upward to telomere on chrosomal short arm and 5'-terminus of this base sequence : 24172
ctttgaaagtggactcaagaagactatagtgtgtgtgtgtgtgtgtgtgtgtgtgtgtgtgtgtgtgtgtgtatggtgtgttggaggggagcagttcttggggaaatgtttttagatgttaccaaattgcttgacaaatgatggtgactttcatcattgctgggagttgttggttattagaaggagccat

SEQ ID NO: 6675 - DNA, 189 bp, Homo sapiens
  D4S2911
  Located on chromosome 4
  Distance between a terminus base of telomere on chromosomal short arm and 5'-terminus of this base sequence : 26763657
  Distance between 3'-terminus of neighbour sequence of sequence listing upward to telomere on chrosomal short arm and 5'-terminus of this base sequence : 13049
atttgggtgcatttggtcattttctctctttctctctctctctttctctctctctctctgtgtgtgtgtgtgtgtgtgtgtgtgtgtgtgtgagagagagagagagagagagagagagagttcttagtataattttagtcatactgcatagaaacgttagtattcttttttcccccacttaacatggca

SEQ ID NO: 6676 - DNA, 293 bp, Homo sapiens
  AC006390.8_125530
  Located on chromosome 4
  Distance between a terminus base of telomere on chromosomal short arm and 5'-terminus of this base sequence : 26789158
  Distance between 3'-terminus of neighbour sequence of sequence listing upward to telomere on chrosomal short arm and 5'-terminus of this base sequence : 25312
atcacagatgtaggaacattgttacacgttgcagaaattctaagctccattttaattcaaacttgttagattatatttcctttttaggttttatatatatatatatatatatatatatatatatatatattccccaagctgaaccttggggatatatgcctcagcaatttatctagaaaccttagaaatccaagccatgtttggtattgggcaaggagaagagtgggcagatgcaaggaacatttctgaatgtcttagtcagttcaggctgctgtaacagactaccatagact

SEQ ID NO: 6677 - DNA, 244 bp, Homo sapiens
  AC006390.8_98004
  Located on chromosome 4
  Distance between a terminus base of telomere on chromosomal short arm and 5'-terminus of this base sequence : 26816673
  Distance between 3'-terminus of neighbour sequence of sequence listing upward to telomere on chrosomal short arm and 5'-terminus of this base sequence : 27222
caagataattgcttgaactcacgaggcagaggttgcagtgagctgagatcatgccactgcactccagcctgagcaacagagcaggactccatctcaaaataaataaataaataaataaataaataaataaataaataaatagcatggatattgaggggcatatgtaaactttatgcaaacatgaatgtctacatagaaaagtctgggccaagtgcaatggtacatgcctgtaatctcaacactt

SEQ ID NO: 6678 - DNA, 113 bp, Homo sapiens
  HUMUT715
  Located on chromosome 4
  Distance between a terminus base of telomere on chromosomal short arm and 5'-terminus of this base sequence : 26826395
  Distance between 3'-terminus of neighbour sequence of sequence listing upward to telomere on chrosomal short arm and 5'-terminus of this base sequence : 9478
gtttctctgtgcagcctgccagagatttatgtttttgttttctttcttttttctttctttttctttcttttttttttttgagatggtgtctcactctgtcacccaggctagag

SEQ ID NO: 6679 - DNA, 282 bp, Homo sapiens
  AC006390.8_61517
  Located on chromosome 4
  Distance between a terminus base of telomere on chromosomal short arm and 5'-terminus of this base sequence : 26853139
  Distance between 3'-terminus of neighbour sequence of sequence listing upward to telomere on chrosomal short arm and 5'-terminus of this base sequence : 26631
tcagactacagatggtgtatttgtgggaccttgtgatcgtgtgagttattatttaataaactctcctttatatatatctatatatctattccattaattctgttcctctagagaaccctaatacacacacacacacacacacacacacacacacacacacacccctcttattggttttatttctctggagaaccctgactgatacaggggtactagctcttcttattatcacttttacccttttttttttagagctaagaagccttactcagaagctctatt

SEQ ID NO: 6680 - DNA, 174 bp, Homo sapiens
  D4S1551
  Located on chromosome 4
  Distance between a terminus base of telomere on chromosomal short arm and 5'-terminus of this base sequence : 26853165
  Distance between 3'-terminus of neighbour sequence of sequence listing upward to telomere on chrosomal short arm and 5'-terminus of this base sequence : -256
gaccttgtgatcgtgtgagttattatttaataaactctcctttatatatatctatatatctattccattaattctgttcctctagagaaccctaatacacacacacacacacacacacacacacacacacacacacccctcttattggttttatttctctggagaaccctgact

SEQ ID NO: 6681 - DNA, 266 bp, Homo sapiens
  AC006390.8_243
  Located on chromosome 4
  Distance between a terminus base of telomere on chromosomal short arm and 5'-terminus of this base sequence : 26914508
  Distance between 3'-terminus of neighbour sequence of sequence listing upward to telomere on chrosomal short arm and 5'-terminus of this base sequence : 61169
agtaaactgaatcagccatcagggaagaggcaagggtgtgtgtgtgtgtgtgtgtgtgtgtgtgtgtagtgcatgcaaagaggagatgtgagtgttggagaagggagctgctgccacactggctttcctgttatgatactaccactgggcttgttggtcacaccagctgcgcttcccaaagctcattccttcccggcctgtaccgacaaattgcattgatttgcaaaacagacaactctgcaattgcctgagtacatttaatcttt

SEQ ID NO: 6682 - DNA, 330 bp, Homo sapiens
  AC007073.2_181316
  Located on chromosome 4
  Distance between a terminus base of telomere on chromosomal short arm and 5'-terminus of this base sequence : 26977209
  Distance between 3'-terminus of neighbour sequence of sequence listing upward to telomere on chrosomal short arm and 5'-terminus of this base sequence : 62435
tgtggttgaggactaaattctgacctttttcttttcttttcttttcttttcttttcttttcttttttgagacaaggctctctgtcacccaggctggagtgcagtggtgccatctcagctcactgcagcctcaacctcccttgctcaagccatcctcccacctcagcctcccaagtagctgggactacaggcacgcactaccacgcccagataatttttgcattttttgtagagatggggtttttccgtgttgcccagtctagtctcaaacccctgagctaaagcaagccgctcccctcggcctcccaaatgctagaattacagacacgag

SEQ ID NO: 6683 - DNA, 295 bp, Homo sapiens
  AC007073.2_172129
  Located on chromosome 4
  Distance between a terminus base of telomere on chromosomal short arm and 5'-terminus of this base sequence : 26986216
  Distance between 3'-terminus of neighbour sequence of sequence listing upward to telomere on chrosomal short arm and 5'-terminus of this base sequence : 8677
ttctcaaggtagatttgcagagcaatgaaatgagatatatgaagaccccaagatatatatatatatatatagatagatagatagatagatagatattcacacacacacacatacactcaggcactgcacacacacatgcacaaacataataggcatagaagatatagaaactacccatatgcccatatgtattattatgggtatgtgtgtgtgtgtgtgtgtgtgtgtgtgtgtgtgtgtgtgtggtttcttggtaaaagcactggggtaagactatggagcgttcatatgctag

SEQ ID NO: 6684 - DNA, 270 bp, Homo sapiens
  AC007073.2_163055
  Located on chromosome 4
  Distance between a terminus base of telomere on chromosomal short arm and 5'-terminus of this base sequence : 26995402
  Distance between 3'-terminus of neighbour sequence of sequence listing upward to telomere on chrosomal short arm and 5'-terminus of this base sequence : 8891
tctatgcctaaggaacattcaaggaatagcaaggacaaggctggagtggctagagccaagcaagcagaggaaatagtttaggagatgaggtcagaaaggatgtgtgtgtgtgtgtgtgtgtgtgtgtgtgtgttgtgtcagagaaacaaagacagaaagagtagtttatgttcttgtaagctattgtagaaatttggctcttgctctatgaatgatgggaagccctgacttttcctgaaccgcctgatctgactcacactttaacaggat

SEQ ID NO: 6685 - DNA, 168 bp, Homo sapiens
  AC007073.2_146606
  Located on chromosome 4
  Distance between a terminus base of telomere on chromosomal short arm and 5'-terminus of this base sequence : 27011861
  Distance between 3'-terminus of neighbour sequence of sequence listing upward to telomere on chrosomal short arm and 5'-terminus of this base sequence : 16189
gtgaaacagaaggaattcctttcccggctctgtaacacactctgtccaggttagccatggagttgtcagtagcagacagatcactgtgtgtgtgtgtgtgtgtgtgtgtgtgtgtgtgtgtgtaggaagagggattataggttggaacatacttagcctgcagaaatc

SEQ ID NO: 6686 - DNA, 142 bp, Homo sapiens
  D4S2948
  Located on chromosome 4
  Distance between a terminus base of telomere on chromosomal short arm and 5'-terminus of this base sequence : 27011881
  Distance between 3'-terminus of neighbour sequence of sequence listing upward to telomere on chrosomal short arm and 5'-terminus of this base sequence : -148
ttcccggctctgtaacacactctgtccaggttagccatggagttgtcagtagcagacagatcactgtgtgtgtgtgtgtgtgtgtgtgtgtgtgtgtgtgtgtaggaagagggattataggttggaacatacttagcctgca

SEQ ID NO: 6687 - DNA, 163 bp, Homo sapiens
  AC007073.2_107860
  Located on chromosome 4
  Distance between a terminus base of telomere on chromosomal short arm and 5'-terminus of this base sequence : 27050664
  Distance between 3'-terminus of neighbour sequence of sequence listing upward to telomere on chrosomal short arm and 5'-terminus of this base sequence : 38641
cgacagaacgagagtctgttacacacacacacacacacacacacacacacacacacacacacacaccacacaaatctccatttaaatctcatgtctttgggagaagattttcctgaattccctaagtaggccaggtctccttgtcttcggtgcttatagtatc

SEQ ID NO: 6688 - DNA, 337 bp, Homo sapiens
  AC007073.2_76737
  Located on chromosome 4
  Distance between a terminus base of telomere on chromosomal short arm and 5'-terminus of this base sequence : 27081729
  Distance between 3'-terminus of neighbour sequence of sequence listing upward to telomere on chrosomal short arm and 5'-terminus of this base sequence : 30902
cattaggattacctagaagctctaaaaagcttctgtgcacccagacacatgaaatcagaatctccaagggtggaagtcaggtagcaatgtttttttgtttgtttgtttgtttgtttgtttgttttttgagatggagccttgctctgttacccgggctggagtgcagtggtgggatctcagctcaatgcaacctccgccttctgggttcaagcgattctcctgcctcagcctcccaaagtgctaggattacaggcatgagccaccatgcccagcccaggtggcaattttttttacgttccccagatgaatccaaagtgagaaccagtaggaatggcat

SEQ ID NO: 6689 - DNA, 174 bp, Homo sapiens
  D4S2970
  Located on chromosome 4
  Distance between a terminus base of telomere on chromosomal short arm and 5'-terminus of this base sequence : 27322858
  Distance between 3'-terminus of neighbour sequence of sequence listing upward to telomere on chrosomal short arm and 5'-terminus of this base sequence : 240792
gtaccagccagatgtatttatcttgaggtttcatttctatgcgtttataagaagcagtcacgtatacacacacacacacacacacacacacacacacacacacacacacacacgttctctcctgcacttcattctcagctttcacgccagagaggcatcatattcaggcaggaa

SEQ ID NO: 6690 - DNA, 101 bp, Homo sapiens
  DISO7_10001391
  Located on chromosome 4
  Distance between a terminus base of telomere on chromosomal short arm and 5'-terminus of this base sequence : 27479511
  Distance between 3'-terminus of neighbour sequence of sequence listing upward to telomere on chrosomal short arm and 5'-terminus of this base sequence : 156479
atagcaatttctgccacttgtatttggttgctgcttctgtgaatgaatgaatgaatgaatgaatgagggagagaattctttgatgccaagaactttgcata

SEQ ID NO: 6691 - DNA, 101 bp, Homo sapiens
  DISO7_10001392
  Located on chromosome 4
  Distance between a terminus base of telomere on chromosomal short arm and 5'-terminus of this base sequence : 27482424
  Distance between 3'-terminus of neighbour sequence of sequence listing upward to telomere on chrosomal short arm and 5'-terminus of this base sequence : 2812
gtaacaatttcatatggttcaacctaatactccaacttaagtttcttacacacgtgtgtgtgtgtgtgtgtgtgtataaagattactgaaggtgttggcat

SEQ ID NO: 6692 - DNA, 420 bp, Homo sapiens
  AC006393.6_131986
  Located on chromosome 4
  Distance between a terminus base of telomere on chromosomal short arm and 5'-terminus of this base sequence : 27655070
  Distance between 3'-terminus of neighbour sequence of sequence listing upward to telomere on chrosomal short arm and 5'-terminus of this base sequence : 172545
tatttgataacactggcctcacattttcacatggcaataattggctgccctgtttagacaaatttcctcaatttgccacagtacccattgtacttactatatattatattatattatattatattatattatattatattatattatatcatatcatagttggcccacttctgtcacttacgttacatggaagtggttgagtttgtgaccctcggtctaactgcaaattgtaaacttctcagaagctggaatagtggtctagattctataactaccactcatgcatttatttttgtaacttgtttctttttttctgattataaaagttactcatgctgattctagaaaacttggaaatacaaaaaagtatgaaaaataaaacaacagtgacatgcatggtaaccgcaatttagtgatgac

SEQ ID NO: 6693 - DNA, 141 bp, Homo sapiens
  D4S3022
  Located on chromosome 4
  Distance between a terminus base of telomere on chromosomal short arm and 5'-terminus of this base sequence : 27685927
  Distance between 3'-terminus of neighbour sequence of sequence listing upward to telomere on chrosomal short arm and 5'-terminus of this base sequence : 30437
gccaagatagcgccactgcactcaagcctgggcaacagagccagactctgtctcaaaaaaaagaatatacacacacacacacacacacacacacacacacacacacacacacacacacacaaagggttcgggacagactat

SEQ ID NO: 6694 - DNA, 385 bp, Homo sapiens
  AC006393.6_49725
  Located on chromosome 4
  Distance between a terminus base of telomere on chromosomal short arm and 5'-terminus of this base sequence : 27828153
  Distance between 3'-terminus of neighbour sequence of sequence listing upward to telomere on chrosomal short arm and 5'-terminus of this base sequence : 142085
catggtgtgatcatagctcactgcagccttgaacttctgggtgcaaaaaattctcctgcctcagcctccctagtagccaggactgcaggcatgtgcaatgacacctggctaatttttattttattttattttattttattttattttagaaatggggtctcgctatgttgcccaggttggtctcaaacccctgagctcaagtgatcctccctcctgggcctgtcaaaatgttggaattatagcagtaagccactgcgtctggtctcctggtctttatttctttatttgggcaagctacttcgcctctctgcctcagtttcctcatctgtaaagtaaagggcatagaattaaataatttttatgattgatcctatccagacatagc

SEQ ID NO: 6695 - DNA, 395 bp, Homo sapiens
  AC020706.4_16414
  Located on chromosome 4
  Distance between a terminus base of telomere on chromosomal short arm and 5'-terminus of this base sequence : 27863575
  Distance between 3'-terminus of neighbour sequence of sequence listing upward to telomere on chrosomal short arm and 5'-terminus of this base sequence : 35037
gtttcaacatatgcctgagaaggaaggagggaaagaaggaaggagggaaagaaggaaggaaggaaggaaggaaggaaggaaggctgatgcaggacgaggagaataagaagcaacggagggacagaaagtgtagcgagggatggagaagagacagaggaatgggaaagcggtgaggtgcggagagacgggaagctagggagaaagatgtggagagggtatgcagggaaggagggagggaatgaaggaaggaagaaaggagggaaggaaggaaggaaggaaatatccaaatgatataagcacgcaaaagacatgacattattcttaaaccagcaattgctcaagaaaacctatatgaataattgaaatatgaggtgtgcctacaatgacataaggtc

SEQ ID NO: 6696 - DNA, 354 bp, Homo sapiens
  chr4.fa.O7frz.28082865
  Located on chromosome 4
  Distance between a terminus base of telomere on chromosomal short arm and 5'-terminus of this base sequence : 28048359
  Distance between 3'-terminus of neighbour sequence of sequence listing upward to telomere on chrosomal short arm and 5'-terminus of this base sequence : 184389
gcctaggagcaataagctatactatacagcctaggcttgtgtaagtacactgcgatagtcgcatggcaaaattgcccagtgacgcacttagcacgtattcctgtcatgaactgacacattgatgtaatttttagcttctaatgactttttaaactcagataaaatactttgatttttaaaaataattagacattatatgtatatatatatacacacacacatatatagaggcatttttgtctgtgtgtgtatatatatatatatattatatatacaaaatgttttggctgtgctgcaatgtactagcccaggccttttttttttttcttcccaagatggagtcttgctttattg

SEQ ID NO: 6697 - DNA, 442 bp, Homo sapiens
  chr4.fa.O7frz.28199836
  Located on chromosome 4
  Distance between a terminus base of telomere on chromosomal short arm and 5'-terminus of this base sequence : 28102191
  Distance between 3'-terminus of neighbour sequence of sequence listing upward to telomere on chrosomal short arm and 5'-terminus of this base sequence : 53478
gaatggtgatgtgctgaaggtcctgctgttataaatgttcatgtgtgaggccaggcgtggtggctcacacctgtaatcccagcactttgggaggccgaggcgggcggatcacctgagattgggagttccagatcagcctgaccaacatggagaaaccaacatggagaaaccccatctctactaaaaatataaaattagcggggcgtggtggcaggtgcctgtaatcccagctactccggaggctgaggcaggagaatcgtttgaacccgggaggcggagttcgcagtgagacgagatcgcaccattgcactccagcctgagcaacaagagaacaagagtgaatctctgtctcaaaattaaataaataaataaataaataaatgcccgtgtgtgtgtgtgtgtgtgtgtgtgtatgcatgtgtatgcatttaatacggaattg

SEQ ID NO: 6698 - DNA, 120 bp, Homo sapiens
  DISD22_0003446
  Located on chromosome 4
  Distance between a terminus base of telomere on chromosomal short arm and 5'-terminus of this base sequence : 28174204
  Distance between 3'-terminus of neighbour sequence of sequence listing upward to telomere on chrosomal short arm and 5'-terminus of this base sequence : 71571
ctctgaagacacatgcacatacagtgtgtgtgtgtgtgtgtctgtgtgtatctatgtttgtgtgtctctgtgtatgtgtgtttgtagtctggggaaaataagtgtgcatgtgaacctctg

SEQ ID NO: 6699 - DNA, 147 bp, Homo sapiens
  DISD22_0003450
  Located on chromosome 4
  Distance between a terminus base of telomere on chromosomal short arm and 5'-terminus of this base sequence : 28270987
  Distance between 3'-terminus of neighbour sequence of sequence listing upward to telomere on chrosomal short arm and 5'-terminus of this base sequence : 96663
ctgaatatcctgcagcccaaaagggagctaataattttccttgtgacttttaagaagactttctccctctctctctttctctctctctctctctctctctctctctctctctctcaatttagtccctttcagaatgcagatactatg

SEQ ID NO: 6700 - DNA, 232 bp, Homo sapiens
  Z67691
  Located on chromosome 4
  Distance between a terminus base of telomere on chromosomal short arm and 5'-terminus of this base sequence : 28372793
  Distance between 3'-terminus of neighbour sequence of sequence listing upward to telomere on chrosomal short arm and 5'-terminus of this base sequence : 101659
gtatatggccgttgtccaggaagaaagggtgcatcagtgtgtgtgtgtgtgtgtgtgtgtgggtgtgtgtgtgtgcatgggtgtgtgtgggtcttccacacatgcacatacgtgtgagggagaaagatgcttcttcccttccattcacggcatgaattgttttatctcattgtaagtagttaatgctagtagttgttgcagtagtagtagtagtggacatattagtgcccaa

SEQ ID NO: 6701 - DNA, 444 bp, Homo sapiens
  AC044869.2_137286
  Located on chromosome 4
  Distance between a terminus base of telomere on chromosomal short arm and 5'-terminus of this base sequence : 28380666
  Distance between 3'-terminus of neighbour sequence of sequence listing upward to telomere on chrosomal short arm and 5'-terminus of this base sequence : 7641
aggaaatagaaacgcttgaatctgggaggtggaggctgcagtgagctgagatcacaccactgcactccagcctgggtgacagactgcaaccctgtcaaaaaataaataaataaataaataaataaataaataaataataaatgaataaatatatatatatataatccatatgaaatatatatgtaatccatatgaaatatatatatatatataatctttatgaaatatatataataatctcagagccgagtgcagtggcctacatctgtaatcccaggagtctgaggccagaggatttcttgagcccaggagttcaaggctacagtgagctgtgattgtgccactgcactccagtctgaaaaaaaaaaaaaaagaaagaaaaaaaagaatataaagaaatataatcttgaacttactatgaagctagaaggtaagtcaactagc

SEQ ID NO: 6702 - DNA, 369 bp, Homo sapiens
  AC044869.2_90592
  Located on chromosome 4
  Distance between a terminus base of telomere on chromosomal short arm and 5'-terminus of this base sequence : 28532901
  Distance between 3'-terminus of neighbour sequence of sequence listing upward to telomere on chrosomal short arm and 5'-terminus of this base sequence : 151791
gcaaaactcatttgttcttgattacactacttttcaaacccttaagccagctttctttcttttttctttctttctttctttctttctttctttctttctttctttctttctttctttctttccttctttccttctttccttctttccttctttctttccttctttacttctttacttctttccttctttccttctttctttctttctttctttctttctttctttctttctttctttctttctttctttctttcttttctcctgtgtgtctggctcttttattggtgtgccagtgaaaagcctagttatgggtactttcaaccgaagagcctggatgaaagctttttctgaagtactaggcattctcca

SEQ ID NO: 6703 - DNA, 107 bp, Homo sapiens
  Z67448
  Located on chromosome 4
  Distance between a terminus base of telomere on chromosomal short arm and 5'-terminus of this base sequence : 28842197
  Distance between 3'-terminus of neighbour sequence of sequence listing upward to telomere on chrosomal short arm and 5'-terminus of this base sequence : 308927
tactgtggagttaagtacaaaccgataaggtgaggacatcccctttgacacacacacacacacacacacacacacacacacgaaggatgtatcaaagttgttagccc

SEQ ID NO: 6704 - DNA, 331 bp, Homo sapiens
  chr4.fa.O7frz.29008132
  Located on chromosome 4
  Distance between a terminus base of telomere on chromosomal short arm and 5'-terminus of this base sequence : 28987674
  Distance between 3'-terminus of neighbour sequence of sequence listing upward to telomere on chrosomal short arm and 5'-terminus of this base sequence : 145370
gtcatagccattacttctacaaactctcatgaacatgcattgcatttattttaaatacatacacacacacacacacacacacacacacacacacatttactatggaaaccatttataagactgatgttaacagagtgagcaagctcagcattctttcataagccttcatgataaaggaggtcatatgtctgatattattgtctgagtgtacgtaataatgaatcttattagatgagggttctactaaatagacattttctttctaaaagaaaaaatcatactcagttagtgcagtatttcctgaagtgttatactcaggagcactcataag

SEQ ID NO: 6705 - DNA, 274 bp, Homo sapiens
  AC006928.15_161961
  Located on chromosome 4
  Distance between a terminus base of telomere on chromosomal short arm and 5'-terminus of this base sequence : 29058347
  Distance between 3'-terminus of neighbour sequence of sequence listing upward to telomere on chrosomal short arm and 5'-terminus of this base sequence : 70342
ttatgcagaagttgatcctgacctcaaatagaatttcagcaatgactttaatgcagtgtgtgtgtgtgtgtgtgtgtgtgtgtgtgtgtgtgtgtgtatgtgtgtctgtgtctgtgtgtagagagaatgcttggtcaagttgcacatggcagctgtctaatgcaaatgaaagccatttaaaaactagtgttagatttcagatagattttgataaactggatacattgtgagaattactgaatgtatttaaatagtagccagatacctaatgcag

SEQ ID NO: 6706 - DNA, 463 bp, Homo sapiens
  chr4.fa.O7frz.29219515
  Located on chromosome 4
  Distance between a terminus base of telomere on chromosomal short arm and 5'-terminus of this base sequence : 29148961
  Distance between 3'-terminus of neighbour sequence of sequence listing upward to telomere on chrosomal short arm and 5'-terminus of this base sequence : 90340
gttagctcagattagtcataccatgccttcaatgcagaaggtcacagaggtccaaatttgcagagaaaaagcgtatttcttcatttatgaatatctttaaagaaaatgtttctgatctgtgcacatgtgcgtgtatcagaaagcatgcattctgtgtgtgtgtatgtgtgtgtgtgaagcccactcatcttaccaacagggctatccttattgtggttcacactgctgagcgtgtgtattgcacatgtgagtatatctgtaatttgtgtgtctgtgtctccctggtcatatataagtacagctctgtggatgaacagctgctgattcttgctttttctgctgctctctttagaactggaaggtggtcacctccccaccccaccactggaaggtggacacctctccctcaccactgaaatgtggtcaccttcctccaactggaaggtcgccttctagtgacctt

SEQ ID NO: 6707 - DNA, 308 bp, Homo sapiens
  AC006568.7_186642
  Located on chromosome 4
  Distance between a terminus base of telomere on chromosomal short arm and 5'-terminus of this base sequence : 29295478
  Distance between 3'-terminus of neighbour sequence of sequence listing upward to telomere on chrosomal short arm and 5'-terminus of this base sequence : 146054
tggttaagatggaatcgtttacagtcatcctcaaggatccgtctgcaggaaactaaatgttgagttaaatgaagatattctttaggaaaggttggtattagtatccatcattactgctgggatgcaatattggcttttttgtttgctttttgttttgctgtgtgtgtgtgtgtgtgtgtgtgtgtgtgtgtgtgtgtgtgtgtgttgtgtatatttaatttggtttggtttggttttggttttacactatcttggctgaggtcaagggcattttcagaaacttccactcagccttctccagtatgata

SEQ ID NO: 6708 - DNA, 173 bp, Homo sapiens
  D4S1609
  Located on chromosome 4
  Distance between a terminus base of telomere on chromosomal short arm and 5'-terminus of this base sequence : 29295583
  Distance between 3'-terminus of neighbour sequence of sequence listing upward to telomere on chrosomal short arm and 5'-terminus of this base sequence : -203
catcattactgctgggatgcaatattggcttttttgtttgctttttgttttgctgtgtgtgtgtgtgtgtgtgtgtgtgtgtgtgtgtgtgtgtgtgtgttgtgtatatttaatttggtttggtttggttttggttttacactatcttggctgaggtcaagggcattttcaga

SEQ ID NO: 6709 - DNA, 248 bp, Homo sapiens
  AC006568.7_180889
  Located on chromosome 4
  Distance between a terminus base of telomere on chromosomal short arm and 5'-terminus of this base sequence : 29301242
  Distance between 3'-terminus of neighbour sequence of sequence listing upward to telomere on chrosomal short arm and 5'-terminus of this base sequence : 5486
gtgccatactttagatttgcaggaataagagattgcaaattccagagaggtacaaggaggagggatcacaaatgagttttttctggacctggaagaatgagcacattaatatgttaacataaataacaacacaacatatctactctagaaacctgtgtgtgtgtgtgtgtgtgtgtgtgtgtgtgtgtgtgtgtatatatatatatatatacaatcaactatcacttgacattaagtttatctgtggc

SEQ ID NO: 6710 - DNA, 171 bp, Homo sapiens
  AC006568.7_160339
  Located on chromosome 4
  Distance between a terminus base of telomere on chromosomal short arm and 5'-terminus of this base sequence : 29321846
  Distance between 3'-terminus of neighbour sequence of sequence listing upward to telomere on chrosomal short arm and 5'-terminus of this base sequence : 20356
agattaacacaggaattctgacagtggcatgtcatttgtatgacaagctgagcctgaggtttttaagagcctctttctatataatctttggaaacacacacacacacacacacacacacacacacacacacacacacacaatctgaaagctaggactggtcctgttaggtt

SEQ ID NO: 6711 - DNA, 428 bp, Homo sapiens
  chr4.fa.O7frz.29544874
  Located on chromosome 4
  Distance between a terminus base of telomere on chromosomal short arm and 5'-terminus of this base sequence : 29425561
  Distance between 3'-terminus of neighbour sequence of sequence listing upward to telomere on chrosomal short arm and 5'-terminus of this base sequence : 103544
cttgaattctgagaattatgctataaaaccaacacaatttaaatgatgttaaatatgcagaagaggctgggcgcagtggctcatgcctaaaatctgagcacattgggaggccgaggggggcggatcacctgaggtcaggagtttgagaccaatctggccaacatggtgaaaccccacctcagctaaaaatacaaaaattagctgggcgtggtggcgggcacctgtaatcccagctactcgggaggctgaggcaggagaatcacttgaacttgggaggtggaggttgcagtgagccgagagcatgccattgcactccagcctgggcaacaagagtgaaactccattacaaatatatatatatatatatatatatatatacatgcagaagatgccttagagacaaaatgatttggagtaaacaaccaaga

SEQ ID NO: 6712 - DNA, 137 bp, Homo sapiens
  D4S2397
  Located on chromosome 4
  Distance between a terminus base of telomere on chromosomal short arm and 5'-terminus of this base sequence : 29511382
  Distance between 3'-terminus of neighbour sequence of sequence listing upward to telomere on chrosomal short arm and 5'-terminus of this base sequence : 85393
gcaacaaacctgcacattctgcatatgtatcccagaacttaaagcataataataataataataataataataataataataatgaaatcatagtggaaaatgaggaatgaaaagtgtttcttgttttggtgtgcatg

SEQ ID NO: 6713 - DNA, 187 bp, Homo sapiens
  chr4.fa.O7frz.29360003
  Located on chromosome 4
  Distance between a terminus base of telomere on chromosomal short arm and 5'-terminus of this base sequence : 29594724
  Distance between 3'-terminus of neighbour sequence of sequence listing upward to telomere on chrosomal short arm and 5'-terminus of this base sequence : 83205
aatcctcttccaagtgatatctactttgcattttttaggctttcatttattgctttgtaaagtagaatgtattaatttaatgtctattattaattaattaattaaatgtctctgtgtatttgtgtgtgtgtgtgtgtgtgtgtgtgtgtcctatcctctgcatgtgaacagattctagcagtatttc

SEQ ID NO: 6714 - DNA, 167 bp, Homo sapiens
  D4S391
  Located on chromosome 4
  Distance between a terminus base of telomere on chromosomal short arm and 5'-terminus of this base sequence : 29706199
  Distance between 3'-terminus of neighbour sequence of sequence listing upward to telomere on chrosomal short arm and 5'-terminus of this base sequence : 111288
actgttgtcaaatcaggctcgctctctctctcactctctctctctctctctgtgtgtgtgtgtgtgtgtgtgtgtgtgtgtgtgtgtgtgtgaaatctggtgtgtttgtgcttcagtgttcccatttacctttctttccttatgttcccagcaagggaagttatgtg

SEQ ID NO: 6715 - DNA, 435 bp, Homo sapiens
  chr4.fa.O7frz.29869057
  Located on chromosome 4
  Distance between a terminus base of telomere on chromosomal short arm and 5'-terminus of this base sequence : 29808863
  Distance between 3'-terminus of neighbour sequence of sequence listing upward to telomere on chrosomal short arm and 5'-terminus of this base sequence : 102497
tccttaatggaaggagaattagtcagagttctatagagatatagaagcagtagatctatctatctatctatctatctatctatctatctatctatctatctatctagagaggacagagagtgagcaatttattatgaagaattggctgagaattctgaaaatctacagtcagcaactagagagtgaagagggttgatggtataagtttcagcctgaaagttggctggcttgagacacaaaaagagctgatgtttcagttcaagtctgaagaagggaaaagactgatgtcccacctcaagaaattaaacaggaggagttcctgcttacttgtgggaaggccaatctttttgttctgttcaagccttctactgattgggtgaaccccattcatattaggcaggataatctgtttatctagtccaccaaatctaatgt

SEQ ID NO: 6716 - DNA, 407 bp, Homo sapiens
  AC007106.6_47084
  Located on chromosome 4
  Distance between a terminus base of telomere on chromosomal short arm and 5'-terminus of this base sequence : 30049883
  Distance between 3'-terminus of neighbour sequence of sequence listing upward to telomere on chrosomal short arm and 5'-terminus of this base sequence : 240585
atcttcctgaattccaatagtctctagctcattctatgggccaaacttaacaggatgctatctggcaaaggacaagggtaacttttagagtcccggccctagttgcacacagacgcgcgcgcgcgcgcacacacacacacacacacacacacacacacactggattgaaaaatgagactaaatttggaactgagggacaaaaccttaaaagcatgtggaaatgtcaaccttaagacattacacaattgctttcttgaaatttctgttctcagtcctttcgtcttcagaatttctataagtgatttaaataataacacaattaatattatgactatatgtaaatcaaatatggcagtttttcttgccatggtaattgacaataagggtttatagacatcgtcaacgga

SEQ ID NO: 6717 - DNA, 278 bp, Homo sapiens
  AC007106.6_134198
  Located on chromosome 4
  Distance between a terminus base of telomere on chromosomal short arm and 5'-terminus of this base sequence : 30137059
  Distance between 3'-terminus of neighbour sequence of sequence listing upward to telomere on chrosomal short arm and 5'-terminus of this base sequence : 86769
ccactatacctcacaaccataaagacagattctttatggcagggttttcttctttttaggacagaatatatatatatatatatatatatatatatatgtatatacacacattttctttatttatccattcatggacacagattgttttcatatcttgttgcttatgaatcatgatgcaatgaacatgggagtgcagatgcgtctttgagatagagatctctggccagggctactgtctgtgtagagtttgcaagatctcaccatgtccttggatatta

SEQ ID NO: 6718 - DNA, 230 bp, Homo sapiens
  chr4.fa.O7frz.30470798
  Located on chromosome 4
  Distance between a terminus base of telomere on chromosomal short arm and 5'-terminus of this base sequence : 30378638
  Distance between 3'-terminus of neighbour sequence of sequence listing upward to telomere on chrosomal short arm and 5'-terminus of this base sequence : 241301
ctgagttctaatttgattgcactgtggtctgagaggctgtttgttattatttcagttctttcacatttgctcaggaatgccaacccaaatgcccatcaatcaaagagtggataaagaaactgggatatatatatatatatatatatgtaatatacataaatatatatgatatacatatttatatatatgatatatacataatgggatactactcagccatagaaaggaat

SEQ ID NO: 6719 - DNA, 358 bp, Homo sapiens
  chr4.fa.O7frz.30573531
  Located on chromosome 4
  Distance between a terminus base of telomere on chromosomal short arm and 5'-terminus of this base sequence : 30390182
  Distance between 3'-terminus of neighbour sequence of sequence listing upward to telomere on chrosomal short arm and 5'-terminus of this base sequence : 11314
gcttatagtggcacaattcacaattgcaaaaatatggaaccagccaaaatgcccatcaatcaatgagtggataaagaaaatgtggtgtgtgtatatatatacacacacacacacacacacacacacacacatgcactgatatggtttggctgtatccccatccaactctcatcttgaattgttgctcccataattcttacatgtagtgggggggatcgagtgggaggtaattgaatcatgggagtgggtctttctcacgctgttctcgtaatagtgaataagtctcatgaggtccgatggttttataaatggaaattcccctgcacaagctctcttgtctgctaccatgtaagttgtg

SEQ ID NO: 6720 - DNA, 451 bp, Homo sapiens
  chr4.fa.O7frz.30606876
  Located on chromosome 4
  Distance between a terminus base of telomere on chromosomal short arm and 5'-terminus of this base sequence : 30487722
  Distance between 3'-terminus of neighbour sequence of sequence listing upward to telomere on chrosomal short arm and 5'-terminus of this base sequence : 97182
aatttactgtgctttagtgcactaataatgataactaacacttctatatggttttcgtagcttatccttttctaagtactttacataataattcatttaatctttacaaacctttgaggaaataccactttaaatgaataattatccttttaataagtgagatttcaaaattaatgaacagatatggttatgatatttaatgtgacctcatgaaataaattaataaacgtagagctataaaaattaggctttctgattttaaaaaaatcattttcccttcccttccttctttccttccttccctccttccttctttccttctttccttccttccttccttccttccttctgagacagcacctctctgtcagccaagatggagtgagtggcgtcatcacagctcactgcagccctaacctacgaggctcaatgaatccttccaggaatatag

SEQ ID NO: 6721 - DNA, 373 bp, Homo sapiens
  chr4.fa.O7frz.30693035
  Located on chromosome 4
  Distance between a terminus base of telomere on chromosomal short arm and 5'-terminus of this base sequence : 30572528
  Distance between 3'-terminus of neighbour sequence of sequence listing upward to telomere on chrosomal short arm and 5'-terminus of this base sequence : 84355
atattacgagtttccaaaccagagagaaagagagagagagaggaagagtgaatgtgtgtgtgtgtgtgtgtgtgtgtgtgtatgtgtgtgtgtgtgtgtgaaagacagaaaggtgctactgaacagaatcacataatcaatatacagccttcctctctagcactttacaaaggagagaaggccagtgctgaccgattgatgtattctattttaacatattgcttctttgcaagttggttttttaaagtaagctacaggctttgattttttagaataacccttgcactattatcaatttatcttgccagaattttgacttcctcatgaaagcccagaagtcctttttgtagagtgcattggaacatagtcttag

SEQ ID NO: 6722 - DNA, 413 bp, Homo sapiens
  AL359970.10_19079
  Located on chromosome 4
  Distance between a terminus base of telomere on chromosomal short arm and 5'-terminus of this base sequence : 30642141
  Distance between 3'-terminus of neighbour sequence of sequence listing upward to telomere on chrosomal short arm and 5'-terminus of this base sequence : 69240
tctgcttcaatctaagtccagtacctctgtttgtatgcttgtatcctggatgtcattgcttctcattcaatggattgtgtcttcaatttttttccttccttccttccttccttccttccttctttctttctttctttttctttctttctttctttctctctttctttctctctttctttctttctttttctttccttctttcctttctttcttcctttcttccttccctccttccctcctacctttctttcccctttctttctgctttctttttctttttctttccctttcttgctcaatcacccaggctggagttcagtggcacaatcacacctcactgcagcctgaacatcctggatgcaagtgatcctcctacctcagccttctgagtagctgaaacctcaagtatgaac

SEQ ID NO: 6723 - DNA, 393 bp, Homo sapiens
  chr4.fa.O7frz.30980144
  Located on chromosome 4
  Distance between a terminus base of telomere on chromosomal short arm and 5'-terminus of this base sequence : 30908902
  Distance between 3'-terminus of neighbour sequence of sequence listing upward to telomere on chrosomal short arm and 5'-terminus of this base sequence : 266348
cggttattctgattcctttatccatgaaagaaaggggaagtgtctcatgtctggattagggagatgacaatagtataaataggaaaaaatgagagtttagtgaaataagaaatatcatgtggttgagaatccacatggttacagagagaaagaagaaccatgtgaagggagggaggaaaggggagagaaacagagggagggggagagagagactgagagagagagagagagagagagagagagagagattttaaaaaccaggactctaggaataataatgctattcactgacataggtaaacagatgagacaggaaaaaaatttacttaggacttaactggagattttcttgaatcctttgtcacaatgctgtctgaatttaggattatcaac

SEQ ID NO: 6724 - DNA, 474 bp, Homo sapiens
  chr4.fa.O7frz.31316708
  Located on chromosome 4
  Distance between a terminus base of telomere on chromosomal short arm and 5'-terminus of this base sequence : 31156532
  Distance between 3'-terminus of neighbour sequence of sequence listing upward to telomere on chrosomal short arm and 5'-terminus of this base sequence : 247237
gctaagattatgcaggacctagtgtgtgctcctgaggacgaaaacagaagcagcaagttctgcttctgactatcttcaatatctcctggagtgtgattaagccaacctcacaaatctgctgctcctggaatacacatagcaagatggttaactcatagtgatatggaaatactttatatacataaaaattattttatttttatttcaatttaagaactgtaatagcttttttttttctggagctctacacacacacacacacacacacacacacacacacacacacacacacatacagagttaaaaattggctctaattccagtaatgtacaatcatattgaggaatatttgatgtatgagaaatattttatggtaaaaatatgattaattatatttattttcaaagcgggtattgctatgttctgctatatatttcaggtcaccgcaagtttcattagcatgactaatctatg

SEQ ID NO: 6725 - DNA, 140 bp, Homo sapiens
  DISD22_0003473
  Located on chromosome 4
  Distance between a terminus base of telomere on chromosomal short arm and 5'-terminus of this base sequence : 31295478
  Distance between 3'-terminus of neighbour sequence of sequence listing upward to telomere on chrosomal short arm and 5'-terminus of this base sequence : 138472
ggacctatgtaaatggtctgcaaaactggtgtgtgtgtgtgtgtgtgtgtgtgtgtgtgtgtgtgtttgcttgtatgtgtatgtgagtgatttccaggaagaacattcataattttcataagattgtcatcagattgtca

SEQ ID NO: 6726 - DNA, 349 bp, Homo sapiens
  chr4.fa.O7frz.31612968
  Located on chromosome 4
  Distance between a terminus base of telomere on chromosomal short arm and 5'-terminus of this base sequence : 31404237
  Distance between 3'-terminus of neighbour sequence of sequence listing upward to telomere on chrosomal short arm and 5'-terminus of this base sequence : 108619
tctccactgtgcaatagaataccagaatttattcctcctaacagtgacattatattcattgtccaacttctctttcgtctcacacgcctcccccagcctctggtaaccactattttactctctattcctatgaattcagctttattagattccacacatgagtgcaagcatgtagaatttttatctctgtgccttttcctctgttcagtgtaaaaagcttcaactgatctttctgcttttaggtcattgtcttacctcttccctttggtggggtcctggtgtgtgtgtgtgtgtgtgtgtgtgtgtgtgtgtgtgtataagttgatagtctaaagacgttttattggac

SEQ ID NO: 6727 - DNA, 433 bp, Homo sapiens
  chr4.fa.O7frz.31705438
  Located on chromosome 4
  Distance between a terminus base of telomere on chromosomal short arm and 5'-terminus of this base sequence : 31496875
  Distance between 3'-terminus of neighbour sequence of sequence listing upward to telomere on chrosomal short arm and 5'-terminus of this base sequence : 92289
tcctatccagttaactcaggactggacaagtgatcctggttggtccaaagacacaacccaagatattcactagaactctttgaattacagatttattaagctagttggaggtggacattgccagtcattgtcacaccaaagagtgagagaatgcttgaaaatcaagccaatttaaagaatccagaagtgggggggtcagggcagagacaggaagagagagagagagagagagagagagagaaagagagagagaggaagagaagagaagagagaagagaggagagagagaagagagaagagagagagagagagagagagagagagagacatccacacagagaaacacttaatctccatgaaatcgtttatgcagctagaaccagccctgtatagaataacaaatctattcctagaacgttcacttacatgaaat

SEQ ID NO: 6728 - DNA, 346 bp, Homo sapiens
  HUMUT1049
  Located on chromosome 4
  Distance between a terminus base of telomere on chromosomal short arm and 5'-terminus of this base sequence : 31570526
  Distance between 3'-terminus of neighbour sequence of sequence listing upward to telomere on chrosomal short arm and 5'-terminus of this base sequence : 73218
agcctgggcaaaaagagcaaaactccatctcaaaaaggaagaaaggagaggagaggggaggggagggaaggggaggggaggaagaaagggaaataatgggaaagaaaaggaaggaaggaaggaaggaaggaaggaaggaaggaaggaaggaaggaaggaaggaaggaaagaaggaatgaaaggagggaaggagggaaggagggaaggaaggaaggacagataaccttaacctgcctaatatacaagcagtaaacacaactaatgaaaggagattttaacattgttgtattaaaatagacaatcccaaagtgtgatagtttcccactcaggaagagttaacctgagt

SEQ ID NO: 6729 - DNA, 229 bp, Homo sapiens
  G10039
  Located on chromosome 4
  Distance between a terminus base of telomere on chromosomal short arm and 5'-terminus of this base sequence : 31645377
  Distance between 3'-terminus of neighbour sequence of sequence listing upward to telomere on chrosomal short arm and 5'-terminus of this base sequence : 74505
ccaaaccacacttggctaacaggaggtaataaatacatactagttaaatgctagaatcaatcaatagaatatcaagctattttaacatttatttttacttctgtattagttaggattctccaatgagatagaaccaataggatagatagatagatagatagatagatagatagatagatagatgagaaggaatatttttaggagaaattggctcacacatttatggaag

SEQ ID NO: 6730 - DNA, 259 bp, Homo sapiens
  D4S1618
  Located on chromosome 4
  Distance between a terminus base of telomere on chromosomal short arm and 5'-terminus of this base sequence : 31808736
  Distance between 3'-terminus of neighbour sequence of sequence listing upward to telomere on chrosomal short arm and 5'-terminus of this base sequence : 163130
acgcccggtcaacaaattatatatagatatatatgtgtgtatatatacacatgtgtgtgtgtgtgtgtgtgtgtgtgtgtatatatatatatatatatatatatatatatatattattgactccattccttccacatgaataccagattttgtcttatgaaattactttcattgaagaaaaagacacattaacaaaatattatgaggctctactaaaagagtttttatgtgagtataatggatggtgtatgcttgggag

SEQ ID NO: 6731 - DNA, 288 bp, Homo sapiens
  G08358
  Located on chromosome 4
  Distance between a terminus base of telomere on chromosomal short arm and 5'-terminus of this base sequence : 32053704
  Distance between 3'-terminus of neighbour sequence of sequence listing upward to telomere on chrosomal short arm and 5'-terminus of this base sequence : 244709
atcactcaaaccccagaggtggaggttgcagtgagccaagattgtgtcactgcactccagcctgggtgacagagcgagactctgcctaaaaataaagatagatcgatagatagatagatagatagatgatagatagatagatagatagatagatagatagatagatagatataattatatataattttatatctaaatatatatataggaatatacatgaaagaaatacatggatgagatgatatttaccaacagcctaaacattttcaatgccccagaacttgtgta

SEQ ID NO: 6732 - DNA, 134 bp, Homo sapiens
  DISO7_10009928
  Located on chromosome 4
  Distance between a terminus base of telomere on chromosomal short arm and 5'-terminus of this base sequence : 32151906
  Distance between 3'-terminus of neighbour sequence of sequence listing upward to telomere on chrosomal short arm and 5'-terminus of this base sequence : 97914
tgcgcatgtggaattaagtaaattgtgtgtgtgtgtgtctgtgtgtctgtgtgtctgtgtgtctgtgtgtgtataattgtattcaggtttaaattataagtcattaaaattaggtcatcaaataatgtgcaatt

SEQ ID NO: 6733 - DNA, 462 bp, Homo sapiens
  chr4.fa.O7frz.32534787
  Located on chromosome 4
  Distance between a terminus base of telomere on chromosomal short arm and 5'-terminus of this base sequence : 32332970
  Distance between 3'-terminus of neighbour sequence of sequence listing upward to telomere on chrosomal short arm and 5'-terminus of this base sequence : 180930
ttcagatagctatacttgccagtcattttcatactccagaattggtgaagtaaaagttcatgtgaaggggactatttaatcataaaattcacaaagtgattcatccaagagtgtaaaaaaattacactaatttatacataagcatatatttgaaactattagcctgtgtgtgtgtgtgtgtgtgcatgtgtaaaagagatgccagaactgtgctaaacacttactttttcgctacaaattctctcagggctattttgccataaccagaataaatgtgaaattcttaactaaactgctacaaatgtatgagtcttctttgagtgttgcaatgggccaaactgtatattaacaagaggtttaatttatttctctgttatggcacgtaagaaatgttcttgtacaatttttatcgcagattataattcaataaatctataaatgttaagaaagcatgttgattca

SEQ ID NO: 6734 - DNA, 301 bp, Homo sapiens
  AC012056.3_109294
  Located on chromosome 4
  Distance between a terminus base of telomere on chromosomal short arm and 5'-terminus of this base sequence : 32443324
  Distance between 3'-terminus of neighbour sequence of sequence listing upward to telomere on chrosomal short arm and 5'-terminus of this base sequence : 109892
ttctgaaagtgaagtacctaggagagcaaccagcagagccagaccatctcagaggtataagaaaagacaaattcccatgatgcaaggtcactagttttcttttcttttcttttctttttgacggagtttccctcttgttgcccttttcttttctcttttcttttcttttcttttcttttcttttcttttcttttcttttcttttcttttcttttctttccttttctttttgacggagtttccttcttgttgcccaggctggagtgcagtggcacgatctcggcttaccgtaaactccgcct

SEQ ID NO: 6735 - DNA, 186 bp, Homo sapiens
  G08331
  Located on chromosome 4
  Distance between a terminus base of telomere on chromosomal short arm and 5'-terminus of this base sequence : 32496097
  Distance between 3'-terminus of neighbour sequence of sequence listing upward to telomere on chrosomal short arm and 5'-terminus of this base sequence : 52472
agcctccttcatcatgtgagtcaattctgcagagatagatgatagatagatgatagatgatagatgatagatagatagatagatagatagatagatagatagatagatagatagaaagatagatagatattccattggctctgtttctctggagaacatggactaaaacagccatttatccatcca

SEQ ID NO: 6736 - DNA, 355 bp, Homo sapiens
  AC023874.2_129945
  Located on chromosome 4
  Distance between a terminus base of telomere on chromosomal short arm and 5'-terminus of this base sequence : 32657410
  Distance between 3'-terminus of neighbour sequence of sequence listing upward to telomere on chrosomal short arm and 5'-terminus of this base sequence : 161127
gtcaggtgttcgagaccagcctgactaacatggcaaaacctcatctctactaaaatataaaaattagccaggtgtgatggcgggcgcctgtaatcccagctactcaggaggctgaggcagggagaactgcttgaacttgggaggtgaaggttgcagtgagctgagatcgtgccactgcactccatcctagaggacagagggagactctgtctcaaataaataaataaataaataaataaataaataaataaataaataaataatatatatacacacacacacacatatgatctcattttacttttttgaagcacatattgttaaggataaagtgattatcataatgcattgtttg

SEQ ID NO: 6737 - DNA, 383 bp, Homo sapiens
  AC023874.2_19290
  Located on chromosome 4
  Distance between a terminus base of telomere on chromosomal short arm and 5'-terminus of this base sequence : 32662309
  Distance between 3'-terminus of neighbour sequence of sequence listing upward to telomere on chrosomal short arm and 5'-terminus of this base sequence : 4544
taatgacatttctgtcaagaacagatcacgtatacattagtagtttcatatgattataatgccatattataatatttagttcagtaacattccatacacctttgtagtctagaagcaatagtctatactacatagtctaggtgtgtagtaggctataccatctaggtttgtgtaagtacgctctatgatgttctcacagtgaagtaatcacctaaggacaaatttctcagatcatattcttgtcattaaatagcatgaatatattgtcatcttatccatattcttattttaaccttttgtgtggtttgttgttgttgttgttgttgttgttgttgtttttggtcttttcaaatatcagtctcaatgttcacttgagacctatt

SEQ ID NO: 6738 - DNA, 127 bp, Homo sapiens
  Z66642
  Located on chromosome 4
  Distance between a terminus base of telomere on chromosomal short arm and 5'-terminus of this base sequence : 32821915
  Distance between 3'-terminus of neighbour sequence of sequence listing upward to telomere on chrosomal short arm and 5'-terminus of this base sequence : 159223
ctattcaaaactgtcaagatttgctgcaaacactaggtgtgtgtgtgtgtgtgtgtgtgtgtgttttttctggagggaggaggaagtagtagaagaggttactattagcctccaccatgactcatta

SEQ ID NO: 6739 - DNA, 460 bp, Homo sapiens
  AC016893.4_33023
  Located on chromosome 4
  Distance between a terminus base of telomere on chromosomal short arm and 5'-terminus of this base sequence : 32832402
  Distance between 3'-terminus of neighbour sequence of sequence listing upward to telomere on chrosomal short arm and 5'-terminus of this base sequence : 10360
ttaactttgaaataccagccttaggtttcactagatctttattggtatatgagatgaagacctaagtctaattctacctaatgcacacaattgacctgattatatgtttggtgtttgtttgtttgtttgtttgtttgttttgacagagacttgctctgtcaccaggctggagcacagtggcgcgatctcagctcactacaacctccccctccctggttcaagctattctcctacctcagcctccagagtagcttggattataggcacacaccaccacacccagctaatttttgtgtttttactagagacgaggtttcaccacgttggtcaggatggtctctatctcctgacgtcgtgatctgcccaccttggcctcccaaagtgctgggattacagacgtgagccaccgcgccctgcctggtcttttttgttttatctgtattcttgcacatatgatctg

SEQ ID NO: 6740 - DNA, 339 bp, Homo sapiens
  AC016893.4_99115
  Located on chromosome 4
  Distance between a terminus base of telomere on chromosomal short arm and 5'-terminus of this base sequence : 32897983
  Distance between 3'-terminus of neighbour sequence of sequence listing upward to telomere on chrosomal short arm and 5'-terminus of this base sequence : 65121
atatcagtcatagcaaaggcagagccactcttgatggttggctgtctgatagtctgtaattaaagcggggtttcttttctttctttctttctttctttctttctttctttctttctttctttctttctttctttctttctttctttctttctttctttttgcttccctcatatatgtgattctccttctatcttctgggaaatctttctcttttagctcttcttcataaagctgacctcatattttctgtagtcattgcccaccaagtgtagcctgtgtgtgttctccctccattcaaaaatttaaacacaagctctgaaatctgatttaatgttctcc

SEQ ID NO: 6741 - DNA, 376 bp, Homo sapiens
  AC026262.4_65721
  Located on chromosome 4
  Distance between a terminus base of telomere on chromosomal short arm and 5'-terminus of this base sequence : 33069981
  Distance between 3'-terminus of neighbour sequence of sequence listing upward to telomere on chrosomal short arm and 5'-terminus of this base sequence : 171659
gatggtactgaggatgtctgactgaaacactaccctaggaagctgtcttgtaggaaaatagaataaaacacacagaccagaagaaattgtcaagaagcaaacagccatccaaaaacagtcatgagaaatctaaagacctaaataatcttaggtatatgctctcagtgagaaataagaaaatgtgtccttaagcaaaaataaataaataaataaataaataaataaataataaaaagtgagcatgatcatgaatatagtaaatcttgtgagttgtgacctaggtgaaggtgtaatgataacatctggaggaagcatcatttgttcagctacctagggtttactttcagacttttcctacagtttaaagcacttgcgt

SEQ ID NO: 6742 - DNA, 174 bp, Homo sapiens
  D4S2968
  Located on chromosome 4
  Distance between a terminus base of telomere on chromosomal short arm and 5'-terminus of this base sequence : 33095035
  Distance between 3'-terminus of neighbour sequence of sequence listing upward to telomere on chrosomal short arm and 5'-terminus of this base sequence : 24678
cattttgtgatttgatgttagtcagtaaacctgtgattatatgctacccacagtgaaggtgaattccatatatccaatgaagtttttcaggtaaaaattttatatatatatatatatatgtgtgtgtgtgtgtgtgtgtgcctttattatgctacagtgaattacttgtagatc

SEQ ID NO: 6743 - DNA, 410 bp, Homo sapiens
  chr4.fa.O7frz.33534609
  Located on chromosome 4
  Distance between a terminus base of telomere on chromosomal short arm and 5'-terminus of this base sequence : 33312298
  Distance between 3'-terminus of neighbour sequence of sequence listing upward to telomere on chrosomal short arm and 5'-terminus of this base sequence : 217089
tggttactgtaggctaattgacataaacaagacgtatgtccctatggcatacttctggtcattaaaacatatccaaacttccaaataaataccaaaataccagggcaacacacacacacacacacacacacacaccctaactcagactgggagtatatagacatgccaatgaaccaaatgtgcatatctttgagatgtgggaggaaaccagagtgcctggagaaacccacacatatgtggggagaacttgtaccctccacacagatgatggccctggccaggaattgctttttttattttcatcctcaaccattataacaaaataacatttaacaaaatgatgttgaaggagaggacattattcaaggtcctgctgcactttcctgttctaacaagtccattttcacctt

SEQ ID NO: 6744 - DNA, 240 bp, Homo sapiens
  chr4.fa.O7frz.33646183
  Located on chromosome 4
  Distance between a terminus base of telomere on chromosomal short arm and 5'-terminus of this base sequence : 33464479
  Distance between 3'-terminus of neighbour sequence of sequence listing upward to telomere on chrosomal short arm and 5'-terminus of this base sequence : 151771
gagcataagtgaaggtcaaatataaacttttatttttcttatttctaatttagcatagtttattataaacaatagcaacaatgtattcatgtatgcatacttctgcatgtgtgtatatatgtatatatattatatatatatgcttatgtataagtgaaacgaatgacaataatgataaaagggatggatgtgaagaattagaaatattttgttattataaggtatttgtactccagatga

SEQ ID NO: 6745 - DNA, 438 bp, Homo sapiens
  AC041018.2_148749
  Located on chromosome 4
  Distance between a terminus base of telomere on chromosomal short arm and 5'-terminus of this base sequence : 33504110
  Distance between 3'-terminus of neighbour sequence of sequence listing upward to telomere on chrosomal short arm and 5'-terminus of this base sequence : 39391
gcaatttcaataggagaaatgtacttaaaaataagtacagatatccagtaaaaaattctgctttagaatattcataacaacacaatttataatggctgaaatctgaagcctacctggatgtttgtcaacagttaaataaataaataaataaataaataaataaataaattttagatacaatcaggcagcgggaaggctatagagcaacacagatgactggattacaactactagcaacaacttagattgatctcacaaaatgatattaaggaaaagaagccagacaaaaatagttttttgtatgttttcattgctgtatgtttataaacatgcatcagcagtcaaaatttgatttcagaagccagcaaatcaattacatttgattggagtaatgaacagaaagaaaaagcttagggctcctggactgctagtaagtga

SEQ ID NO: 6746 - DNA, 306 bp, Homo sapiens
  AC041018.2_106272
  Located on chromosome 4
  Distance between a terminus base of telomere on chromosomal short arm and 5'-terminus of this base sequence : 33534827
  Distance between 3'-terminus of neighbour sequence of sequence listing upward to telomere on chrosomal short arm and 5'-terminus of this base sequence : 30279
gagatggcttgagtctcagaggtggaggttgcagtaagccgtgatcacactactgcactccagcctggggacagagcaaatctctgtctcaaaaaaaggaaaaaaagaaagagagaaagagagagagaggaaggaaggaaggaaggaaggaaggaaagaaggaaagaaagatgtttctagaaaatctaggattcaaagaatagtaattctgcagttctctatacctaatgctaaatacctgtgtgatttggggcaagagattttgtttctctgactctgtttctttctagatggcttacttcacag

SEQ ID NO: 6747 - DNA, 321 bp, Homo sapiens
  AC007103.4_137163
  Located on chromosome 4
  Distance between a terminus base of telomere on chromosomal short arm and 5'-terminus of this base sequence : 33554228
  Distance between 3'-terminus of neighbour sequence of sequence listing upward to telomere on chrosomal short arm and 5'-terminus of this base sequence : 19095
ggaaagcattaatcacaagttaacacagtagacaagtaaggaaacaaaggaattcttgttgcactacacaggaacaaagatacctaagttctaactactatgataaatatagtgtgtttgtgtgtgtgtgtgtgtgtgtgtgtgtgattttgtgtgtttatgacacagtgagagagagaaagggagagaaagtgcctatataagtgattcatgattgaatttatagtcttcatattataaagtaaatccaagccattttattttccctttacccttggagtttgtcttaatccatttgtattgctataacgaagttcctga

SEQ ID NO: 6748 - DNA, 357 bp, Homo sapiens
  AC007103.4_122300
  Located on chromosome 4
  Distance between a terminus base of telomere on chromosomal short arm and 5'-terminus of this base sequence : 33568997
  Distance between 3'-terminus of neighbour sequence of sequence listing upward to telomere on chrosomal short arm and 5'-terminus of this base sequence : 14448
tatctgccacctcatgagatactataagtaaaagcccactcatgaatgtctcacttgaacttttcatatgcagatgaaaaactaaggactccagaaggaagactgtccacactttacatgatatataatgtacttctttcctttctgtctactcccattgaattatacactttctttcatatcttcaatgcggaaacacacacacacacacacacacacacacacacacacacacacacaaaataagaccaatcaaatggggaaagcaaagggtattaattcatattttgttgtggcaagggagtcattcaccttcactttcattttgcccaaaactcaaatgaaggcatagaagtg

SEQ ID NO: 6749 - DNA, 153 bp, Homo sapiens
  AC007103.4_35767
  Located on chromosome 4
  Distance between a terminus base of telomere on chromosomal short arm and 5'-terminus of this base sequence : 33655674
  Distance between 3'-terminus of neighbour sequence of sequence listing upward to telomere on chrosomal short arm and 5'-terminus of this base sequence : 86320
agatgtggatctcaggtttaaatctttctgataatgttattaccttgatattctgacttgtatctccctgtgtgtgtgtgtgtgtgtgtgtgtgtgcatgcacatgcacacgcatttaattttacttttgtcctctgacagattaatgttgat

SEQ ID NO: 6750 - DNA, 366 bp, Homo sapiens
  AC007103.4_34973
  Located on chromosome 4
  Distance between a terminus base of telomere on chromosomal short arm and 5'-terminus of this base sequence : 33656349
  Distance between 3'-terminus of neighbour sequence of sequence listing upward to telomere on chrosomal short arm and 5'-terminus of this base sequence : 522
taggtcttaatttggctggataatattctttctttagtacattgacttacttttatgttcctgagtaacctctcctccccacagctatatacattttaacattctatttggaaacctaaactaggaaaacaaattgcagtcagcttttttattcttctttataatatgaagaggttttatatatatatatatatatatatatatatatatatatacacacacacatatatatatacacacacatatatatatacacacatatatatacacacatatatatatatacacacacacacatatatatataaacacacatatatatgtagttgaaaaaacaataacataattagatgttgctttaggctt

SEQ ID NO: 6751 - DNA, 229 bp, Homo sapiens
  AC007103.4_10828
  Located on chromosome 4
  Distance between a terminus base of telomere on chromosomal short arm and 5'-terminus of this base sequence : 33680554
  Distance between 3'-terminus of neighbour sequence of sequence listing upward to telomere on chrosomal short arm and 5'-terminus of this base sequence : 23839
tatttctgatatccttctgcttctgtagagatcaacacctgggttagatcagggaaaaacaaagaataaggaagatgaggacaaataaaaatggagcacttaggggtataatgcgtgtgtgtgtgtgtgtgtgtgtgtgtgtgtgtgtgtgtgtgcgagagagagagagagagagatgaacatcaagtccacatggtaataaaaaatagaggccattacttcacagtga

SEQ ID NO: 6752 - DNA, 222 bp, Homo sapiens
  D4S2912
  Located on chromosome 4
  Distance between a terminus base of telomere on chromosomal short arm and 5'-terminus of this base sequence : 33760870
  Distance between 3'-terminus of neighbour sequence of sequence listing upward to telomere on chrosomal short arm and 5'-terminus of this base sequence : 80087
tctagttaattctccgtttcattatctatattcgtaattacatattctgcactttgggggggaggggcaggtgtgtgtgtgtgtgtgtgtgtgtgtgtgtgtatgtgtgtgtgtgagagagagacagaggcagaaatagggaaacaggaacaaagacaaagattgctcagtgatcagaacccactaaattttgagcaggcagcatgccataatggtttagct

SEQ ID NO: 6753 - DNA, 308 bp, Homo sapiens
  chr4.fa.O7frz.34582205
  Located on chromosome 4
  Distance between a terminus base of telomere on chromosomal short arm and 5'-terminus of this base sequence : 33996825
  Distance between 3'-terminus of neighbour sequence of sequence listing upward to telomere on chrosomal short arm and 5'-terminus of this base sequence : 235733
aggtcactatgaaggattgatcaggagaatatatattttaaagttcatcttcttgttaactaaaatataattatgaattttatttatttatttatttatttatttatttatttttgagatggaatttccctcattttgccctggctggagtgcaatggcatgatcttggctcactgaaacctctgcctcccgggttcaagtgattctcctgcctcagactcctgagtagctgggattacagacatgcaccaccaagcccagctaattttgtgtttttagtaaagacggggtttcaccatgttgaccag

SEQ ID NO: 6754 - DNA, 275 bp, Homo sapiens
  Z67127
  Located on chromosome 4
  Distance between a terminus base of telomere on chromosomal short arm and 5'-terminus of this base sequence : 34070854
  Distance between 3'-terminus of neighbour sequence of sequence listing upward to telomere on chrosomal short arm and 5'-terminus of this base sequence : 73721
ctttttggaataaatatgtgtctgtgatatttttatgtatatgagtgtgtgtgtgtgtgtgtgtgtgtgtgtgtgtgtgtgtattccagcatatacatgtatgtcctggaatctgtgaaggatatcttttcaacattcactagtctactattaaaagatcagtatattcttggaaaaaataatcctttcagcgttttaagcagttctttcctaactgtagtgggaaacactgtaaataagtttcctagaattagtcacaaaagtgtaagatgtca

SEQ ID NO: 6755 - DNA, 175 bp, Homo sapiens
  Z66891
  Located on chromosome 4
  Distance between a terminus base of telomere on chromosomal short arm and 5'-terminus of this base sequence : 34254744
  Distance between 3'-terminus of neighbour sequence of sequence listing upward to telomere on chrosomal short arm and 5'-terminus of this base sequence : 183615
acatcgtcattaagcctgtgacatatatatatgtgtgtgtgtgtgtgtgtgtgtgtgtgtgtgtgtctgtgtgtgtgtatatatggacttcattgctttaattaacatggggcatttttttttccactattcagttaaagtggatcctcaggtgatattttactttgtatgaacg

SEQ ID NO: 6756 - DNA, 166 bp, Homo sapiens
  DISO7_10001401
  Located on chromosome 4
  Distance between a terminus base of telomere on chromosomal short arm and 5'-terminus of this base sequence : 34370629
  Distance between 3'-terminus of neighbour sequence of sequence listing upward to telomere on chrosomal short arm and 5'-terminus of this base sequence : 115710
gcccttatcttccaacattccccctaattatttctgaaaactttacacacacacacacacacacacacacacacacacacacacagaggatatttatttaaaaagtattttcaactgcaaaattcaccttttcattcattaactacttaagctctgatctcttgct

SEQ ID NO: 6757 - DNA, 265 bp, Homo sapiens
  DISO7_10001400
  Located on chromosome 4
  Distance between a terminus base of telomere on chromosomal short arm and 5'-terminus of this base sequence : 34378411
  Distance between 3'-terminus of neighbour sequence of sequence listing upward to telomere on chrosomal short arm and 5'-terminus of this base sequence : 7616
tcctttgaccatattattcacacatacacagatgtcttcactttcttatttataatgtttctataatatagaaacaaactgtcatacactgaggggtgtgtgtgtgtgtgtgtgtaaaaataattattgaggttttctttcaaagggtaaaggtatatttacatatattgttatatattatatatctatctatattagatagatataaaatgtatctgttatatagaaagaacagtccctttgacctgtttgatacctgactctc

SEQ ID NO: 6758 - DNA, 101 bp, Homo sapiens
  DISO7_10001399
  Located on chromosome 4
  Distance between a terminus base of telomere on chromosomal short arm and 5'-terminus of this base sequence : 34391081
  Distance between 3'-terminus of neighbour sequence of sequence listing upward to telomere on chrosomal short arm and 5'-terminus of this base sequence : 12405
tgcttcagcagaacatatacaacagtacatatacatatacatatacatatacatatacatatacagcagaacacatatacagcgggtcaattatgtagtat

SEQ ID NO: 6759 - DNA, 194 bp, Homo sapiens
  Z67295
  Located on chromosome 4
  Distance between a terminus base of telomere on chromosomal short arm and 5'-terminus of this base sequence : 34603112
  Distance between 3'-terminus of neighbour sequence of sequence listing upward to telomere on chrosomal short arm and 5'-terminus of this base sequence : 211930
tcatacaccgagtcggccgtgtgtgtgtgtgtgtgtgtgtgtgtgtgtggccaggatttcaggggtgaggagtagcatgttggggtttagtttataaggagtcccagaacagaagaaaacaactggtaattggaaaatgagtacttttaataacatttaacctattttcttgacacatctgtgccttttactga

SEQ ID NO: 6760 - DNA, 220 bp, Homo sapiens
  D4S3001
  Located on chromosome 4
  Distance between a terminus base of telomere on chromosomal short arm and 5'-terminus of this base sequence : 34606212
  Distance between 3'-terminus of neighbour sequence of sequence listing upward to telomere on chrosomal short arm and 5'-terminus of this base sequence : 2906
cattgctaatgctatcccagctgtggaatgctctcaaacatgacagaattttaaatattggttctttctttctcctgtggggtgtgtgtgtgtgtgtgtgtgtgtgtgtgtgtgtgtgtgtgtgtgttgtatgtatgtgctgtgtttatgtagtgtttattcttggaggtatttactacctgactttcctttttctagatatctgacctctgacctccat

SEQ ID NO: 6761 - DNA, 419 bp, Homo sapiens
  chr4.fa.O7frz.35284912
  Located on chromosome 4
  Distance between a terminus base of telomere on chromosomal short arm and 5'-terminus of this base sequence : 34669615
  Distance between 3'-terminus of neighbour sequence of sequence listing upward to telomere on chrosomal short arm and 5'-terminus of this base sequence : 63183
tacttgcttagctacaatgaatttggactccatatcgctatatactagatacatatattacatattatatacatatatatacatatatatatatatatactcaaaacattatcattagactatgccattcatttagcaagactagtcttatatgaaagcatgtaacattttggaataaaaataaatcattcttttacttatcccaaagaatcaaccatctattttttatttgcattttggtagcaaaaagacatagacaatgggaataaatctcagggcatgtataagacagaaagcatgggaagagtgatgtgctctatctggagtttggggagacagattctgtcatgtcttctatgttagggcaaacaacaggtgaggggccaatgcaggtgctttcacaaatattcataagcagt

SEQ ID NO: 6762 - DNA, 439 bp, Homo sapiens
  chr4.fa.O7frz.35481435
  Located on chromosome 4
  Distance between a terminus base of telomere on chromosomal short arm and 5'-terminus of this base sequence : 34728333
  Distance between 3'-terminus of neighbour sequence of sequence listing upward to telomere on chrosomal short arm and 5'-terminus of this base sequence : 58299
caacttgtcaaacataaagagttctcaaaatagctttattttttagtggataaagcaattacattagtaatttttcttttagcaggaagacaaaatctgagatttgggcattttacttcatgcttaaaatgatgatgtgatgaaattgaaggaaaattcatttaaagtgaacgcaaatatttgtgaacttgaacaaatagaacgaattcctagaaatcgttaataattctgattcaaaatctattacaaaaatgttctaatttatatattccagaaaatatatggtcaaaaatcactaaatatgcaattttaagtttaattcctcttataatgtgaataatgcttcaaaatttaaaaggagggtgctattttgatatacagtgcatatatatatatatatatatatatacgcaatttaatcttgtcaatgactgaaatc

SEQ ID NO: 6763 - DNA, 474 bp, Homo sapiens
  chr4.fa.O7frz.35629231
  Located on chromosome 4
  Distance between a terminus base of telomere on chromosomal short arm and 5'-terminus of this base sequence : 34875890
  Distance between 3'-terminus of neighbour sequence of sequence listing upward to telomere on chrosomal short arm and 5'-terminus of this base sequence : 147118
catgtaattagaggaaatgcagtcatattttttaaaagaaaaatgtatctacacacataaaaaagtcacaaaaaagaaatcaaacattgaaaatccaactaccatagatgatacactgataaaaaagcagagattccttaggaaagtaaagaaagtactaaaatgaggcaataaaaaggagaataaaattggtcaataaatacatgaaaatatatttaagtatattttaatttaaaaagcaaattgaagctctttgatgaattttttcattggtgaaattggtaaagcatatacaaattatcaaaactggagaagaacagtttttattacgcttcaggagatgataaaaaataaatataaattctatctctctctctctctctctcacacacacacacacacacacacacacacagagagagagagagagacagagagagaaagagatgttctctaatcatttggcaaggatta

SEQ ID NO: 6764 - DNA, 461 bp, Homo sapiens
  chr4.fa.O7frz.35974650
  Located on chromosome 4
  Distance between a terminus base of telomere on chromosomal short arm and 5'-terminus of this base sequence : 35206693
  Distance between 3'-terminus of neighbour sequence of sequence listing upward to telomere on chrosomal short arm and 5'-terminus of this base sequence : 330329
actgaaatttcctacatctcctcctccctccctctcttaattgctttcattttaaaaacttctgctgtatgaatttagattatctaaagagaaaccagaaaaatatgggtcttgattcatcactgtaacaaaaaacagtcacaataaaagcaatgtaaacacttgaatcaagcataaataatgtccctgagagactaatactgaagtaagtagctctcaaaatgtaaaagatgaaactaaatagcgcgtttaagtagggctgtacaatcacaagccatatgacagaagcacaacaaaaatgcaaaattacacacacacacacacacacacacatcttctgccatgatgaacccctagacctctagcagagataagaggttttatttaaattccaattgttttaggggtacaggtggtttctggttgcatggattaattgatgaattatacagtggcaaagt

SEQ ID NO: 6765 - DNA, 288 bp, Homo sapiens
  chr4.fa.O7frz.36100558
  Located on chromosome 4
  Distance between a terminus base of telomere on chromosomal short arm and 5'-terminus of this base sequence : 35322462
  Distance between 3'-terminus of neighbour sequence of sequence listing upward to telomere on chrosomal short arm and 5'-terminus of this base sequence : 115308
atttattgtcgacatagtgcagggaatttgaaagcatttttgcaagcagaaggaaagtaatactagatagatctacaaactggtaagtccacatatatatatatatatatatatacacacacagtatatcaaacactgataaaattaaaataacttgaaaaattcacaattacattaggaaactgtaatactcctccagtagttaatgaaactagaaaaacaacactttaaatattataataaaaatattatcgatgagattaaatacattaacatttatggaaagct

SEQ ID NO: 6766 - DNA, 407 bp, Homo sapiens
  chr4.fa.O7frz.36310203
  Located on chromosome 4
  Distance between a terminus base of telomere on chromosomal short arm and 5'-terminus of this base sequence : 35508576
  Distance between 3'-terminus of neighbour sequence of sequence listing upward to telomere on chrosomal short arm and 5'-terminus of this base sequence : 185826
tcttcactggctataaacttaaatgtaaaaccttaatctataaaaatcctcaatcccagcactttgggaggccaaggcgggcagatcacctgaagtcaggagttcgagaccagcctggccaacacggtgaaagcccacctctctaaaaatacaaaaattagctgggtatggtggcgagcacctgtaatcccagctactctggatgctgaggcaggagaatcgctagaacccgggaggcagaggttgcagtgagctatcgtgccactgcactccagcctgggtgacagagaaagactccatctcaaataaataaataaataaataaataaataaataaataaataaataaataaaaaaaaataaaaataaaaatcctcaaagaaaacctaggaaatttccttctggac

SEQ ID NO: 6767 - DNA, 102 bp, Homo sapiens
  DISO7_10001402
  Located on chromosome 4
  Distance between a terminus base of telomere on chromosomal short arm and 5'-terminus of this base sequence : 35714917
  Distance between 3'-terminus of neighbour sequence of sequence listing upward to telomere on chrosomal short arm and 5'-terminus of this base sequence : 205934
tggacctcttgtgtagatgtgtttttgtgtgtgtgtgtgtgtgtgtgtgtggtgtgttgggggtgtggtcactgtgcagctggtgctgacatccctgacaca

SEQ ID NO: 6768 - DNA, 101 bp, Homo sapiens
  DISO7_10001403
  Located on chromosome 4
  Distance between a terminus base of telomere on chromosomal short arm and 5'-terminus of this base sequence : 35730143
  Distance between 3'-terminus of neighbour sequence of sequence listing upward to telomere on chrosomal short arm and 5'-terminus of this base sequence : 15124
agtccttgacaatttattgatgacaatttaccagacacacacacacacacacacacacacacagacacacacacactcacagtgcagtcattgttagatag

SEQ ID NO: 6769 - DNA, 326 bp, Homo sapiens
  chr4.fa.O7frz.36785279
  Located on chromosome 4
  Distance between a terminus base of telomere on chromosomal short arm and 5'-terminus of this base sequence : 35839704
  Distance between 3'-terminus of neighbour sequence of sequence listing upward to telomere on chrosomal short arm and 5'-terminus of this base sequence : 109460
aaggttcactcatgattacattatgttctcactcccagttataccattcatattccatttcttgattcatagggataatagtcaggatccagtcaggagacacaatccactccagttatactaatagaaaagtgaaggaattgttaactaggtattggagaactggaaaggtaaaaaggtgtatactataatgttacagaggtagtaattacagaaaataggacagaagaaagactgggaagaggttttcattatttttattattattattattattattattattattattattattattattgagatggagtttcactcttgtt

SEQ ID NO: 6770 - DNA, 218 bp, Homo sapiens
  DISO7_10001407
  Located on chromosome 4
  Distance between a terminus base of telomere on chromosomal short arm and 5'-terminus of this base sequence : 36188859
  Distance between 3'-terminus of neighbour sequence of sequence listing upward to telomere on chrosomal short arm and 5'-terminus of this base sequence : 348829
atgtgtattcggtgggaactcaataaataggtatagttaaataaatgcattaggaatatttacatttcccttgttataaaatataacatttatttctctcttttttctctctctctgtgtgtgtatatatatatatatatgtatatatatatatatatctgtatatatatatatatatatatctctgtgtgttaccatcttaaggtataagttggaca

SEQ ID NO: 6771 - DNA, 425 bp, Homo sapiens
  chr4.fa.O7frz.37204817
  Located on chromosome 4
  Distance between a terminus base of telomere on chromosomal short arm and 5'-terminus of this base sequence : 36249906
  Distance between 3'-terminus of neighbour sequence of sequence listing upward to telomere on chrosomal short arm and 5'-terminus of this base sequence : 60829
gatcatgtttcatgtgctaaacaattcacatatattttatattatcttgcataatatcaaatatagtaattcaattcaattatctatctacttttctggaccccctaattttacccatgtatacatattttagacagctttacatatatatatgtatatatatgtgtatatatgtgtgtatatatatgtatatatgtgtatatatgtgtgtatatatatgtatatatgtgtatatatgtgtgtatatatatgtatgtgtgtgtgtgtgtgtgtgtgtgtgtgtgtatatatatatatatatatatatatatatatatgagtaaaattagaagctccttaaaagctcattgcaagagaattatcagtattttatctgtctggtggtttcccggaatatctcacttatgaagctatttgtattggac

SEQ ID NO: 6772 - DNA, 467 bp, Homo sapiens
  chr4.fa.O7frz.37300694
  Located on chromosome 4
  Distance between a terminus base of telomere on chromosomal short arm and 5'-terminus of this base sequence : 36345835
  Distance between 3'-terminus of neighbour sequence of sequence listing upward to telomere on chrosomal short arm and 5'-terminus of this base sequence : 95504
tagcaggtcaaatcatttagtaacaagaaaaaagaaatactaacattgatagcttattttactgtgatttgtgtctgtcaaatagaaaactttctttcccaacaaaatattatgtgaaacaccccagtcttagccccatttaggggatatggctcctggcagtcaatctttataagtttatataaatatgagtattatatattttcacaatacccatctaaattggatataatacattttcattaaacaatattttagtgaatgtggcaaccacggcaaaatcatcatcatcatcacacacacacacacacacacacacacacaaacacacacagtctctctctctggagaaattggcattccttcaccttgcaatagaagattatcccagaggctttcactgagcaatcaaaaaggaagatacttgtacccctcagacaaagcactactctggaaagaactggaac

SEQ ID NO: 6773 - DNA, 379 bp, Homo sapiens
  chr4.fa.O7frz.37492703
  Located on chromosome 4
  Distance between a terminus base of telomere on chromosomal short arm and 5'-terminus of this base sequence : 36648268
  Distance between 3'-terminus of neighbour sequence of sequence listing upward to telomere on chrosomal short arm and 5'-terminus of this base sequence : 301966
aacctttctgaagctcactaatttttttctctgaaataaagatgatgttcctaactcaaagtgtgaatatccatacaactcctaataaaatgtttgagacaggcaggtgttacacaaataacatttaccgttatttaacatcaaatatagttttagcttaatgtatttatgaattttaacatactgaaaagttaggttttatttttactctctaacattcgggaagtgataagaaaaagagaaatgttcagttctaactgtgtatgtgtgtgtgtgtgtgtgtgtatttctaatagcaagtagaactgtacctagctatgtttttaccacttacataacaaaaataacgtgttatcttgattcagtgattgttatcttt

SEQ ID NO: 6774 - DNA, 440 bp, Homo sapiens
  chr4.fa.O7frz.37578811
  Located on chromosome 4
  Distance between a terminus base of telomere on chromosomal short arm and 5'-terminus of this base sequence : 36668814
  Distance between 3'-terminus of neighbour sequence of sequence listing upward to telomere on chrosomal short arm and 5'-terminus of this base sequence : 20167
gattaatggttaagttcttgtcaagaaaaatggagtccagaagacagtggaatgacatattcggaatgctgaaagaaaagtagtttgcttctacatttcaaaagtagtttattttaactagtattagcaatggttctatgtgtttagccccatgaagacaaatgtgtgtgtgtgtgtgtgtgtgtgtgtgtgtgtgtatgatttctgttttagtccattctcatgctgctgataaaaagacatacccaagactgggtcatttacaaagaaaagaggtttaatggactcacggttctacgtggctggggaggcctcacaatcacggcagaagacgaaagaagagcaaagggacttctacatggtgacaggcaagagagcatatgcaggagaactccgctttataaaaccatcagatctcctgagacttactcactataagg

SEQ ID NO: 6775 - DNA, 456 bp, Homo sapiens
  chr4.fa.O7frz.37701758
  Located on chromosome 4
  Distance between a terminus base of telomere on chromosomal short arm and 5'-terminus of this base sequence : 36751937
  Distance between 3'-terminus of neighbour sequence of sequence listing upward to telomere on chrosomal short arm and 5'-terminus of this base sequence : 82683
gtggtagaaagcacctgtagtcccagctacttgggagactgaggcaggagaatggtgtgaacctgggaggcagagcttgcagtgagcaaagatggcgtcactgcactccagcctgggtgacagagggagactccgtctcaaataataataataataataataataataataataataaaagtgggatctaaatgataagaacacatggacacagggaggggaacagcacacactgaggcctatcagagggtgaaggatgagagaaggaagaaggtcagaaaaattaactaatggatattaggcttaacacctcggtgaagaagtaatctgtacaacaaaccctaatgatacatgtttacatatgtaacaaacctgcacatcctgcaaatctacctctatacttaaaactaaagttaaaaataattacaaaaaaagttcaagtccaaattctcatct

SEQ ID NO: 6776 - DNA, 234 bp, Homo sapiens
  D4S1587
  Located on chromosome 4
  Distance between a terminus base of telomere on chromosomal short arm and 5'-terminus of this base sequence : 36870543
  Distance between 3'-terminus of neighbour sequence of sequence listing upward to telomere on chrosomal short arm and 5'-terminus of this base sequence : 118150
ttctactctgccacaactgaagataaattcaatgtataataactaagaaaacaaggaaggaaaggcaaagtctttcctacaaacctaattaaagtatgatatacatctattttccaccagatctgaatgtacacgtgtatacgtgtgtgtgtgtgtttgtgtgtgtgtgtgtgtgtgtgtgtgtgtgtgtgttgggaggaggtacagagaggagtttccaaagattttagtaaa

SEQ ID NO: 6777 - DNA, 371 bp, Homo sapiens
  AC055882.3_99813
  Located on chromosome 4
  Distance between a terminus base of telomere on chromosomal short arm and 5'-terminus of this base sequence : 36889253
  Distance between 3'-terminus of neighbour sequence of sequence listing upward to telomere on chrosomal short arm and 5'-terminus of this base sequence : 18476
ggttgtacttcagacatctcctagaaaaactatttgagtcattgtagctaaaaattttagttttccatgttgctgtttcccttgggaaatgatagtgtcggcagcaacccttagatattggctagttcttttgttttggagcagaagtttatactcaggtaaaacagttacatagatagatagatagatagatagatagatagatagatagacagaaatgttgctgtgcaacttaccaaactacttgaaggaaattgtaaaattattcgcttaatcttctcactcctcaggctcactccatgttccatgaagagaagtattcttttcattttattcactagcacatatggtaagatacctggctccttgag

SEQ ID NO: 6778 - DNA, 386 bp, Homo sapiens
  AC009580.3_180853
  Located on chromosome 4
  Distance between a terminus base of telomere on chromosomal short arm and 5'-terminus of this base sequence : 36995386
  Distance between 3'-terminus of neighbour sequence of sequence listing upward to telomere on chrosomal short arm and 5'-terminus of this base sequence : 105762
gaggtatggtgagtttaatgttctttttcaacaccatcctcaatgttgtatgtgaaaatcaagccagaagcttgtcctcagaagcagagcacctacactctttggtacagatagtcttaaatagtctatacagtagataaatgtagctgtgggtacaagtgcaaatgtagctctatctcctgtctggctatctgtctgtctgtctatctatctatctatctatctatctatctatctatctatctgtctatctgtctgtctctctagcatctatatacctatttattatctatatgtctatctatttgtcatctaatagaatcatgggttatgtacattaacttttaaccaggttttctttgttatactgcagattgatagtgctg

SEQ ID NO: 6779 - DNA, 266 bp, Homo sapiens
  AC009580.3_132504
  Located on chromosome 4
  Distance between a terminus base of telomere on chromosomal short arm and 5'-terminus of this base sequence : 37146496
  Distance between 3'-terminus of neighbour sequence of sequence listing upward to telomere on chrosomal short arm and 5'-terminus of this base sequence : 150724
gaacaggaataagttgcatcagcaagtgaaaattgaagttgtgactcaggtccaacagatgtgaagcaagatagatagatagatagatagatagatagaaggtctatcatactcaaattcctagattggttacagcctggaattaaatcaccaatgtgatcacggaaatgcaaacactacctgaacattatgcaagcccccagaggagcaacttttttttggtaaatcctgtacattgctttcagtaagttacaaatcctgtgcca

SEQ ID NO: 6780 - DNA, 122 bp, Homo sapiens
  G08391
  Located on chromosome 4
  Distance between a terminus base of telomere on chromosomal short arm and 5'-terminus of this base sequence : 37146528
  Distance between 3'-terminus of neighbour sequence of sequence listing upward to telomere on chrosomal short arm and 5'-terminus of this base sequence : -234
ttgaagttgtgactcaggtccaacagatgtgaagcaagatagatagatagatagatagatagatagaaggtctatcatactcaaattcctagattggttacagcctggaattaaatcaccaa

SEQ ID NO: 6781 - DNA, 224 bp, Homo sapiens
  D4S2400
  Located on chromosome 4
  Distance between a terminus base of telomere on chromosomal short arm and 5'-terminus of this base sequence : 37195387
  Distance between 3'-terminus of neighbour sequence of sequence listing upward to telomere on chrosomal short arm and 5'-terminus of this base sequence : 48737
gtcatactaggccctgggatatatcagaacaaggcagtcaaaacctgtcttcttatctaatgtacctctagtggagaagaaaaaataacacacaaatagcatgtattaattagggttctccagaggaagaggaccaataagatagatagatgatagatgatagatagatagatagatagatagatagatagatagatagatagataattaggttggcgcaaaag

SEQ ID NO: 6782 - DNA, 301 bp, Homo sapiens
  chr4.fa.O7frz.38262272
  Located on chromosome 4
  Distance between a terminus base of telomere on chromosomal short arm and 5'-terminus of this base sequence : 37320605
  Distance between 3'-terminus of neighbour sequence of sequence listing upward to telomere on chrosomal short arm and 5'-terminus of this base sequence : 124994
ccagactgacaagtctactcaggatttttgacctctatggcaagaagttagtgtccacctacaaaatttgagaaaatgtccacacaagatcactctcatttctgacaccaactgcaagtttggtgggtatattagccaaggtttcccagagaaatagaaccaatagagtgtgtgtacacacacacacacacacacacacacacacaaaagagtgagaaggagagacaaagaaagcaagaaagagattttaagaaactagctcacgcaattgtggaggcttagtacgtccaaactctgaaag

SEQ ID NO: 6783 - DNA, 304 bp, Homo sapiens
  AC068272.2_87543
  Located on chromosome 4
  Distance between a terminus base of telomere on chromosomal short arm and 5'-terminus of this base sequence : 37422142
  Distance between 3'-terminus of neighbour sequence of sequence listing upward to telomere on chrosomal short arm and 5'-terminus of this base sequence : 101236
agcaagacttcacctcaaaataaaataaaataaaataaaataaaataaaataaaataaaatataaaaaaaagaatatgggaacagtacaaggcatattaaaacttaataaataatgaatgctattaatgagtacagagccagagccagaacaagtgtctctctctttttttttttctctctctctccctagtcctgttttctttccattattatgtactgaccacatatgactgcttttcttttagcattgggaaaattgtggaccacagaagcactttactttcaatgagttaagttttccaa

SEQ ID NO: 6784 - DNA, 181 bp, Homo sapiens
  D4S2995
  Located on chromosome 4
  Distance between a terminus base of telomere on chromosomal short arm and 5'-terminus of this base sequence : 37509285
  Distance between 3'-terminus of neighbour sequence of sequence listing upward to telomere on chrosomal short arm and 5'-terminus of this base sequence : 86839
atatacctggctcgtaatttgtgtgagagtgtgtgtgtgtgtgtgtgtgtgtgtgtgtataaaacagttgttgaaaaaagtcaacaagttaacattcctacttctcagatgaggacatttgggctctgaactttaactcataaaaagggttaaatctgcagaggtatctcaattatcaaaa

SEQ ID NO: 6785 - DNA, 441 bp, Homo sapiens
  chr4.fa.O7frz.38528731
  Located on chromosome 4
  Distance between a terminus base of telomere on chromosomal short arm and 5'-terminus of this base sequence : 37574563
  Distance between 3'-terminus of neighbour sequence of sequence listing upward to telomere on chrosomal short arm and 5'-terminus of this base sequence : 65097
cttagaaaccaagtcctaggactaacaaaaacaattatattaaaactgcaatataataaccatgaagcataaacaatcatatttgagcctagtctatgacaagaaccagaagtgccttcacaaataatagatcaataaacttgaccacataaaaaataaatatgctcatataaaaaagattttaaacaaaactgaaaagcaaatgaaatactctacaaatatggctggaaaagataatatcctaaggatttatacaaaaataaaatagtaagtcttccacagaaatacggttatcagccatggaaaggtaagtcacagaaagaattagccgatgtaaccacaaaccagtctaagaatcaaatatatgtgtgtgtgtgtgtgtgtgtgtgtgtgtgtgtgtgcgtgtctgtgtatctcagtcctatcacacctaagattcac

SEQ ID NO: 6786 - DNA, 135 bp, Homo sapiens
  DISD22_0003602
  Located on chromosome 4
  Distance between a terminus base of telomere on chromosomal short arm and 5'-terminus of this base sequence : 37847413
  Distance between 3'-terminus of neighbour sequence of sequence listing upward to telomere on chrosomal short arm and 5'-terminus of this base sequence : 272409
gtctgtaatcaattgtgagaactgtttttatttatttattcatttatttatttatttatttttaacattttgtgaaatgatgatccacatatttgttgtttctttttttatttggctgccttgtctaagtagtaa

SEQ ID NO: 6787 - DNA, 424 bp, Homo sapiens
  chr4.fa.O7frz.39596137
  Located on chromosome 4
  Distance between a terminus base of telomere on chromosomal short arm and 5'-terminus of this base sequence : 37916083
  Distance between 3'-terminus of neighbour sequence of sequence listing upward to telomere on chrosomal short arm and 5'-terminus of this base sequence : 68535
gttgctaagtgatcattatgctatttaaaaagctataatccttaacagggagaagacaagagcaaatggtcttaaaaaatctttggaaaagaaaatataggccaggcatggtggctcacacctgtaatcccagcactttgggaggcccaggcgggtggatcacgaggtcaggagatcgagaccatcctggctaacacggtgaagccccatctctactaacagcacaaaaaaatagccaggcgtggtggcgggcgcctgtagttccagctacttgggatacacacacacacacacacacacacacacacacacacacacacacacacagtcttctgaatattatggccaagaacatcactgaaaaatggtcaggagtcacacattgcccaaattcagctagacttgataagaaatctttcatgtc

SEQ ID NO: 6788 - DNA, 260 bp, Homo sapiens
  G08389
  Located on chromosome 4
  Distance between a terminus base of telomere on chromosomal short arm and 5'-terminus of this base sequence : 37942015
  Distance between 3'-terminus of neighbour sequence of sequence listing upward to telomere on chrosomal short arm and 5'-terminus of this base sequence : 25508
ttcactttaattcaacaaataggcattgaattcacactctgaaaagtgttacataaaaattttaaaaatctactatgatgataattaaaaactgaatgtagttttatagatatatagattagataggtatgtagattgttagaaaaatggatagatagatacatagatagatagatagatagatagatagatgatagatagatagatagccttcctatgcttacatagattaggagcaccaaagagtgagtgataccaca

SEQ ID NO: 6789 - DNA, 210 bp, Homo sapiens
  D4S2955
  Located on chromosome 4
  Distance between a terminus base of telomere on chromosomal short arm and 5'-terminus of this base sequence : 38044807
  Distance between 3'-terminus of neighbour sequence of sequence listing upward to telomere on chrosomal short arm and 5'-terminus of this base sequence : 102532
atgcatcctatgtgctcatatgtctttggaaattatccttgacacttgatttatgaaataaaaaacacagacttcacagggtatattgtaatagtgcatgcacacacacacacacacacacacacacacacacacagagagttttacattttagaattgtaatttgtctgttgctacaaaataataaagggaattttttgtttgtaatag

SEQ ID NO: 6790 - DNA, 388 bp, Homo sapiens
  chr4.fa.O7frz.39158015
  Located on chromosome 4
  Distance between a terminus base of telomere on chromosomal short arm and 5'-terminus of this base sequence : 38128668
  Distance between 3'-terminus of neighbour sequence of sequence listing upward to telomere on chrosomal short arm and 5'-terminus of this base sequence : 83651
ataactagtgctgagattagcaagcttgtttattagaatgttttctaattgttgcttagcatcaatttctgtaattaaaaaaaaacctaaactaacataataaacattacaatttagctatttgccatggtatcagatgagatctcaggagctcactacaaattttacttatttcagccaaactgaaaattacagtactgtgtgtgtgtgtgtgtgtgtgtgtgtgtgtgtgtgtgtgtgtgtgtttgtgtgtgttgtgtgtaatggggagagagaaaggacaaaaagagaaaaagaaaaattaatttggtacagagatttggccaaaaactagagttgggtcagttttgtacattttaatatattctgagtcttcatccttaagtta

SEQ ID NO: 6791 - DNA, 195 bp, Homo sapiens
  DISD22_0003606
  Located on chromosome 4
  Distance between a terminus base of telomere on chromosomal short arm and 5'-terminus of this base sequence : 38237120
  Distance between 3'-terminus of neighbour sequence of sequence listing upward to telomere on chrosomal short arm and 5'-terminus of this base sequence : 108064
ttcctccagcaacctcacacactcaaatatgtatgcaaacacgcaaacacacacacacacacacacacacacacacacatatatttcccctctgctgtttcttttctctcttaagctagaaaaaaaaaaatccaagctctctcatacttaaatgcaaagtgaaaaaccttttctttcttcattctcctctcactg

SEQ ID NO: 6792 - DNA, 158 bp, Homo sapiens
  DISD22_0003610
  Located on chromosome 4
  Distance between a terminus base of telomere on chromosomal short arm and 5'-terminus of this base sequence : 38319516
  Distance between 3'-terminus of neighbour sequence of sequence listing upward to telomere on chrosomal short arm and 5'-terminus of this base sequence : 82201
gatagggaacggagacaatggaagaagaaagaaaaacagcaagaaaaaaaggaagaaaaaagagaaaatgtgaaagaggaagagaaacagaaagcaaatgaggccacatttacacacacacacacacacactcaccaatcttagttgcaatcctagaa

SEQ ID NO: 6793 - DNA, 101 bp, Homo sapiens
  DISD22_0003614
  Located on chromosome 4
  Distance between a terminus base of telomere on chromosomal short arm and 5'-terminus of this base sequence : 38485796
  Distance between 3'-terminus of neighbour sequence of sequence listing upward to telomere on chrosomal short arm and 5'-terminus of this base sequence : 166122
ccaagtcccttgaagctcaatctctgccaaacccttgcttgtttttttttgttgttgttgttttttgttgttgttgttgttctgtgctttagcttgtctgg

SEQ ID NO: 6794 - DNA, 215 bp, Homo sapiens
  D4S2988
  Located on chromosome 4
  Distance between a terminus base of telomere on chromosomal short arm and 5'-terminus of this base sequence : 38603603
  Distance between 3'-terminus of neighbour sequence of sequence listing upward to telomere on chrosomal short arm and 5'-terminus of this base sequence : 117706
aaaacacctcctaccaggcttcacctccagccttggggattgcaattcaacatgagatttgggcagggacaaatatccaaactatctctctctctctctctctttctctctctctctcctctctctctctctcacacacacacacacacacatacacatacacatacacacacatatatacacagtgctttatagttttcaggatgcaatgttga

SEQ ID NO: 6795 - DNA, 234 bp, Homo sapiens
  chr4.fa.O7frz.39719612
  Located on chromosome 4
  Distance between a terminus base of telomere on chromosomal short arm and 5'-terminus of this base sequence : 38674447
  Distance between 3'-terminus of neighbour sequence of sequence listing upward to telomere on chrosomal short arm and 5'-terminus of this base sequence : 70629
taaagtgttatcaccataggtgacacctcctttattggtatttgtgtgctaagaaatcaatatctggtgttaggatgtcagatgcttgcaagctgaagaatgtggaagaagattgtttttgcatgtacatgcgtgtgtgtgtgtgtgtgtgtgtgtgtgtgtgtgtatgtgtgtgtgttttgagggaggtgagtaattggtatccttcttaggtagaatactccaaagacagca

SEQ ID NO: 6796 - DNA, 311 bp, Homo sapiens
  AC022463.2_54611
  Located on chromosome 4
  Distance between a terminus base of telomere on chromosomal short arm and 5'-terminus of this base sequence : 38802580
  Distance between 3'-terminus of neighbour sequence of sequence listing upward to telomere on chrosomal short arm and 5'-terminus of this base sequence : 127899
tcctggattctactcattcttaagactcttcctatctaacctcatgttgtgcccccttgctcaatggcccacagccctgtgggcctcttttggatccctgaacaccttaagcccattcatacttgagaattttactctggctgttctgtcttgcagaatactcactgcctttatcttcacacagctgctttcttattgtccctcaggtctccactgaaatgtcacccctagagatgcttttctttttattattattattacactttaagttctggtatacgtgtgcagaatatgcaggtttgttacatagg

SEQ ID NO: 6797 - DNA, 412 bp, Homo sapiens
  chr4.fa.O7frz.39928217
  Located on chromosome 4
  Distance between a terminus base of telomere on chromosomal short arm and 5'-terminus of this base sequence : 38839166
  Distance between 3'-terminus of neighbour sequence of sequence listing upward to telomere on chrosomal short arm and 5'-terminus of this base sequence : 36275
ctgtcagcattgagtaaagaagcagcagagaccaaaagaatgggcatatcaccattgttgcttgagtataagcagatgtcagagcagacttctacctccacttacacacacacacacacacacacacacacacacactgccatcagtggcacagctagcagggaacagagaatgggtcatgctcatacccaccacaggcagctcctggcagtggaccctaagcccagtatgcacaaagtaagaagaaagaagcccagagagctacattttgaacggggccatattttaaaccaaaaatatgacaacttaagggattgaactgtgaaatctgttgttattcagcaagtttgttttttcactaggcagaagagtaaagacaagacaaagtgtgtagctgtaactgacaaagact

SEQ ID NO: 6798 - DNA, 448 bp, Homo sapiens
  AC036185.2_21078
  Located on chromosome 4
  Distance between a terminus base of telomere on chromosomal short arm and 5'-terminus of this base sequence : 39161189
  Distance between 3'-terminus of neighbour sequence of sequence listing upward to telomere on chrosomal short arm and 5'-terminus of this base sequence : 321611
ggacagaatctgtaactagtccacctagttatacctactaggtgtactagtccacctagtagcctctcagtcctactttggtagagctaggacctattatctagtcagtagctaacagcttactactagtgcaaaacaacctgttttaagttaattctgtttgtttgtttgtttgtttgtttgttgtttgagacagagtcactctgtcacctacgccagagtgcagtagcacaatctcagctcactgcaacctctgcctcccaggttgaagcaattctcctgcctcagcctccagagtatctgggattacaggcgcacgctgccacacctggctaattttttgtattttagtagagacggagtttcaccatgttgcccaggctggtctcaaattcctgagctcaggcaatccacccaccttggcctttcaaagtgctaggattacagg

SEQ ID NO: 6799 - DNA, 179 bp, Homo sapiens
  D4S3040
  Located on chromosome 4
  Distance between a terminus base of telomere on chromosomal short arm and 5'-terminus of this base sequence : 39255963
  Distance between 3'-terminus of neighbour sequence of sequence listing upward to telomere on chrosomal short arm and 5'-terminus of this base sequence : 94326
tgattggaaccaagatgtatatatgtgtatgggtgtgtgtgtgtgtgtgtgtatacacacatgcgtactccaggatgtctttatatttcaaataaagcaatctctaatcaaattccagtctgtgtggtgtacgctggattgtgataggcttaggctgggattttcagcctctgcactgt

SEQ ID NO: 6800 - DNA, 130 bp, Homo sapiens
  D4S2950
  Located on chromosome 4
  Distance between a terminus base of telomere on chromosomal short arm and 5'-terminus of this base sequence : 39501666
  Distance between 3'-terminus of neighbour sequence of sequence listing upward to telomere on chrosomal short arm and 5'-terminus of this base sequence : 245524
tccagcctagcgacagagtgagactctgtctaaacacacacacacacacacacacacacacacatacacacacacacgttttaatattgatatgcatagaggtgtttgctgaaaatgtttgttcatctgc

SEQ ID NO: 6801 - DNA, 214 bp, Homo sapiens
  D4S1581
  Located on chromosome 4
  Distance between a terminus base of telomere on chromosomal short arm and 5'-terminus of this base sequence : 39599843
  Distance between 3'-terminus of neighbour sequence of sequence listing upward to telomere on chrosomal short arm and 5'-terminus of this base sequence : 98047
gcacaagtgttgtcacattcaaaaaagtattttctttgtttgaaaaatgaaaaatatatatatatgtgtgtgtgtatatatatgtgtgtgtgtgtgtatatatgtgtgtgtgtatatatacgtgtgtgtgtatatgtgtgtgtgtgtgtgtgtgtgtgtgtgtatatatgtgtatatatataccatttttcccacctaaaatggagcatggcaa

SEQ ID NO: 6802 - DNA, 386 bp, Homo sapiens
  AC009595.3_83032
  Located on chromosome 4
  Distance between a terminus base of telomere on chromosomal short arm and 5'-terminus of this base sequence : 39639006
  Distance between 3'-terminus of neighbour sequence of sequence listing upward to telomere on chrosomal short arm and 5'-terminus of this base sequence : 38949
gagaagcaaagtgctgatgtagagggtccatatggcctcagaatgacctgtgagtctcaccagttcctataacaaacgccacagatgcctcatgtgaagagcaagttttgtaaggaagctctggcattgagtgaagtcagcaaaattaggagtggtgccaagaaggattctcctgtatgaggagcactccttttcctttccatccatccatccatccatccatccatccatccatctgccccagaaacactggggaaatcaggcaggaaggatgggaaagaaatggaaattaaattctattagtcactggctatgtcatcaaaggcaatgctgattgattgctagtggctgcctggagtgctgtgttgagaaggattctgaggtct

SEQ ID NO: 6803 - DNA, 386 bp, Homo sapiens; identical to SEQ ID NO: 6802
  AC044902.2_73664
  Located on chromosome 4
  Distance between a terminus base of telomere on chromosomal short arm and 5'-terminus of this base sequence : 39639006
  Distance between 3'-terminus of neighbour sequence of sequence listing upward to telomere on chrosomal short arm and 5'-terminus of this base sequence : -386

SEQ ID NO: 6804 - DNA, 385 bp, Homo sapiens
  AC044902.2_135513
  Located on chromosome 4
  Distance between a terminus base of telomere on chromosomal short arm and 5'-terminus of this base sequence : 39724556
  Distance between 3'-terminus of neighbour sequence of sequence listing upward to telomere on chrosomal short arm and 5'-terminus of this base sequence : 85164
accatattaacagcttgagcaaaggcaggggtggggctgggggcagtggctcacacctgtaatcccagcactttgggaggcagaggtaggcagatcacctgaggtcaagagttcgagaccagcctggccaacatggtgaaaccccgtttctacgaaaaatatgaaaaattagctgggcatggtggcacacacctgtaatcccagctactcgggaggctgaggcaggagaatcacttgaacctaggaggtggaggttgcagctagctgagatcgtgccactgcactccagcctgggtgacagagtgagagtctgtctcaataaataaataaataaataaataaataaaataggcagaggcgggtgattagagaaaggacttgatca

SEQ ID NO: 6805 - DNA, 361 bp, Homo sapiens
  AC024023.2_68126
  Located on chromosome 4
  Distance between a terminus base of telomere on chromosomal short arm and 5'-terminus of this base sequence : 39876901
  Distance between 3'-terminus of neighbour sequence of sequence listing upward to telomere on chrosomal short arm and 5'-terminus of this base sequence : 151960
taaattccacctaaatgcttctagtaatgggaacgatgaagctttattgagtgcttcctgtgtgaacagaactgtataactcatcagccttcacaacaaccttatgatagggtaggtgttattattattattattattattattggagatggagtctcgttctgtcgcccaggctggagtacagtagtgtgatctctgctcactgcaacctccgcctcctgggttcaagcaattctcctgccttggcctcccaagtagctgggactacaggcgcacaccccatgcctggctaattttttgtattttagtagagacggggtttcactgtgttgcccaggctttctcgatctcctgagctcag

SEQ ID NO: 6806 - DNA, 333 bp, Homo sapiens
  chr4.fa.O7frz.41897833
  Located on chromosome 4
  Distance between a terminus base of telomere on chromosomal short arm and 5'-terminus of this base sequence : 39915860
  Distance between 3'-terminus of neighbour sequence of sequence listing upward to telomere on chrosomal short arm and 5'-terminus of this base sequence : 38598
actgtttgagtaccactaattcagaaaaaaacaaatttaatggtttatgactctcacgtatagactggaagagacagaaaatatttacaattggtggggaacagccccctgcccttatcctgtgaaggtcatggatgcatggatagatggatggatggagggatggatggatggatggatggatggatggatggatggatgaaaccttacaccaggtttcaactgcataacagggccatgccaccgttgctaactttcccatcagttaaatgaagaattccatttatcccacaatcgcaagagagggaagtaatgactacaggacattaacgt

SEQ ID NO: 6807 - DNA, 269 bp, Homo sapiens
  AC024659.3_17065
  Located on chromosome 4
  Distance between a terminus base of telomere on chromosomal short arm and 5'-terminus of this base sequence : 40006724
  Distance between 3'-terminus of neighbour sequence of sequence listing upward to telomere on chrosomal short arm and 5'-terminus of this base sequence : 90531
ctggctaacacggtgaaaccgcatctcttctaaaaaaaatacaaaaaaattagccaggcatggtggtgggcacctgtagtcccagctacttgggaggctgaggcaggagaatggcgtgagcccgggaggcggagcttgcagtgagccaagatcatgccactgcactgcagcgtgggtgacagaacgagactgtgtctcaaaaataataataataataataataatggcttcaggaattggcaaatggggacttggtgaggataaatcca

SEQ ID NO: 6808 - DNA, 310 bp, Homo sapiens
  AC024659.3_101313
  Located on chromosome 4
  Distance between a terminus base of telomere on chromosomal short arm and 5'-terminus of this base sequence : 40217294
  Distance between 3'-terminus of neighbour sequence of sequence listing upward to telomere on chrosomal short arm and 5'-terminus of this base sequence : 210301
ttaggtgctcaaggaaagtttattagatagctaatggatggatggatggatggatggatggatggatggacagacagtaggaacaatataatagaagagaataaacgtgatacctgaaagtgagcatttgatcttgtagaacagagaagaaatctaatggagatagacagaattgtcatgaagggttttgtaggatggtaatttgtaactagtttaagtgcaaataagttttcccccagttaattcatgattgaaacttcatctcaaaggtcaactttctgaaagagaccttgagcatcagtctagatta

SEQ ID NO: 6809 - DNA, 168 bp, Homo sapiens
  DISO7_10016005
  Located on chromosome 4
  Distance between a terminus base of telomere on chromosomal short arm and 5'-terminus of this base sequence : 40431222
  Distance between 3'-terminus of neighbour sequence of sequence listing upward to telomere on chrosomal short arm and 5'-terminus of this base sequence : 213618
agtgccattaagtgcttgctaaataaacacacacacacacacacacacacacacacacacacacacacacacacaccactatagatgctttaagggaaaaaaatcaccaaaccctgctgacttttgctattcatcttttgttttcctgggaccaagtggaggagtatg

SEQ ID NO: 6810 - DNA, 122 bp, Homo sapiens
  DISO7_10001413
  Located on chromosome 4
  Distance between a terminus base of telomere on chromosomal short arm and 5'-terminus of this base sequence : 40673068
  Distance between 3'-terminus of neighbour sequence of sequence listing upward to telomere on chrosomal short arm and 5'-terminus of this base sequence : 241678
agctccaagatgtgtaattgagtgaaaaaaaaaagaagctgtagtatgatatttgtctacaataacatctttgtacacacacacacacacacacacacacacccctagaagatccggaagga

SEQ ID NO: 6811 - DNA, 161 bp, Homo sapiens
  DISO7_10001412
  Located on chromosome 4
  Distance between a terminus base of telomere on chromosomal short arm and 5'-terminus of this base sequence : 40691823
  Distance between 3'-terminus of neighbour sequence of sequence listing upward to telomere on chrosomal short arm and 5'-terminus of this base sequence : 18633
taggacagccctcctcacacactgtgtgtgtgtgtttgtgtgtgtgtgtgtgtgtgtatacatgcatgcatgtctgtctctgtctctgtctctctgggtttctttcccctttagtcttaaagacagtagcagggccccactcttcctagtctcagggtgct

SEQ ID NO: 6812 - DNA, 106 bp, Homo sapiens
  DISO7_10001410
  Located on chromosome 4
  Distance between a terminus base of telomere on chromosomal short arm and 5'-terminus of this base sequence : 40781810
  Distance between 3'-terminus of neighbour sequence of sequence listing upward to telomere on chrosomal short arm and 5'-terminus of this base sequence : 89826
aatgcctatagcactctggtcattccaacaactaaaaatctaccaccaccaccaccaccaccaccaccaccaccaccacctattttccagaagcctttaggagcag

SEQ ID NO: 6813 - DNA, 421 bp, Homo sapiens
  chr4.fa.O7frz.42450463
  Located on chromosome 4
  Distance between a terminus base of telomere on chromosomal short arm and 5'-terminus of this base sequence : 40826832
  Distance between 3'-terminus of neighbour sequence of sequence listing upward to telomere on chrosomal short arm and 5'-terminus of this base sequence : 44916
tgctaggattatacttgcgagccactgcaccaggcttaaaatttattttcaaagtcattttttaatgggttgaattaggtgaaccccttaagttttctgccccctttgacatattatgcattacatatatatgtatatatgtaaaattagagatatacatatatcataaacatgtatatacagtatgtgtatatattatatatgtatattttaatgtgtatttatatgtttatatatatacacatataaaatgtgtatatgcacatatatacatataaataacatgcatgcatatttatatacacatatatgtgtgtatatatgtatacacacacacacacacacacacacacacatataaaatctccaaaagctagtactggtggggcacaatatataacatatgagtggaacaatctgt

SEQ ID NO: 6814 - DNA, 293 bp, Homo sapiens
  chr4.fa.O7frz.42884020
  Located on chromosome 4
  Distance between a terminus base of telomere on chromosomal short arm and 5'-terminus of this base sequence : 41075251
  Distance between 3'-terminus of neighbour sequence of sequence listing upward to telomere on chrosomal short arm and 5'-terminus of this base sequence : 247998
aagaactggatttaagaaccacctgtatcattttccctcttcctatccttgatggttgtaatcaccagtttttatcactttttatccctacaacctacctctctttattgcctgagagaaatgcctataaaagtactttgtaaagtgttaagaaaagttagcaattatttcctagatcctgacaataattgtcatactcttacaatgtcaaaaatcccaaataagtgtgacacacacacacacacacacaaataactgtggctaagccaataaacaaagcagataattgaagt

SEQ ID NO: 6815 - DNA, 142 bp, Homo sapiens
  chr4.fa.O7frz.42973216
  Located on chromosome 4
  Distance between a terminus base of telomere on chromosomal short arm and 5'-terminus of this base sequence : 41164138
  Distance between 3'-terminus of neighbour sequence of sequence listing upward to telomere on chrosomal short arm and 5'-terminus of this base sequence : 88594
gtgtttacaacttgctggttacaaccagttacagatttctgttccttctctactcccactgcttcatttggctagcccaaacataaataaataaataaataaataaataaataaataaataaataaagatgaatggtttgcc

SEQ ID NO: 6816 - DNA, 258 bp, Homo sapiens
  chr4.fa.O7frz.43270334
  Located on chromosome 4
  Distance between a terminus base of telomere on chromosomal short arm and 5'-terminus of this base sequence : 41471672
  Distance between 3'-terminus of neighbour sequence of sequence listing upward to telomere on chrosomal short arm and 5'-terminus of this base sequence : 307392
gaatcgcttaaacctggaggggcagaggttgcagtgagccgagatcgcctcactgcactgcagcctgggctctacagagcgagactcccatctcagtaaaataataataataataataataataaatcttgaaatttattttatttatttacttattgtagagatggggtcttgctatgttgcccaagctggtctcaagcacctggcctcaagtgatccttccaccttggcctcctgaagtgctaagattacagactt

SEQ ID NO: 6817 - DNA, 330 bp, Homo sapiens
  chr4.fa.O7frz.43442575
  Located on chromosome 4
  Distance between a terminus base of telomere on chromosomal short arm and 5'-terminus of this base sequence : 41594207
  Distance between 3'-terminus of neighbour sequence of sequence listing upward to telomere on chrosomal short arm and 5'-terminus of this base sequence : 122277
aagtaatgctaaccttgactaaatatattagtaataaattatatatcaagtagtctatgctggtgtattagaaaaacaggtcattgaatttttcccaaagaataatttgttgaaattgaatgaaattgaaagaaatattttgatgctttgttgtctttgttgctttattaatagtacttagtattgtgagatatatgtatatatgtgtgcgtgcgtgtgtgtgtgtgtgtgtgtgtgtgtgtgtgtgtgtgtgtgtgtgtgtatttgcatagtttttgccaaatgcaaattttggaggcatttctgttctcagacttggtcaattactga

SEQ ID NO: 6818 - DNA, 244 bp, Homo sapiens
  D4S2382
  Located on chromosome 4
  Distance between a terminus base of telomere on chromosomal short arm and 5'-terminus of this base sequence : 41703226
  Distance between 3'-terminus of neighbour sequence of sequence listing upward to telomere on chrosomal short arm and 5'-terminus of this base sequence : 108689
tctagccaccatttgctttctcaaaagcaattaatggagcagtttgttctatcttcttcttgagatattctatgtatatgtgataaaagccatccatccatccatccatccatccatccatccatccatccatcccatccatcccatccatcatcatatctttctacctacctacctatctatatttatctatcttttcctcctctccattttttttacactaatggcagcataccatacacac

SEQ ID NO: 6819 - DNA, 427 bp, Homo sapiens
  chr4.fa.O7frz.43643304
  Located on chromosome 4
  Distance between a terminus base of telomere on chromosomal short arm and 5'-terminus of this base sequence : 41807624
  Distance between 3'-terminus of neighbour sequence of sequence listing upward to telomere on chrosomal short arm and 5'-terminus of this base sequence : 104154
tgtcagcttaaaggtctattgtctgtgtttgatgtttgaaggaaaccacatataaatccaacaaaggatttaagaagaataggtgataaaatgaaagaaagatttgttatggctaatctgcctggtataaaggattagaaattgaatctatctatctatctatctatctatctatctatctatctatctatctatcttttttttgagacaaagtcttgctctgtcgcccaggctggagtgcagtagcaccatctcagcccactgcaacctctgccttccgggttcaagcgattctcgtgcctctcagcctcccgagtagctgggattacaggcgcgcgtcaccacacccagctaatttttgggttttttgtagagacggggtttcaccatgttggccaggctagtctcttaactcctgacctcaagt

SEQ ID NO: 6820 - DNA, 237 bp, Homo sapiens
  chr4.fa.O7frz.43773172
  Located on chromosome 4
  Distance between a terminus base of telomere on chromosomal short arm and 5'-terminus of this base sequence : 41881383
  Distance between 3'-terminus of neighbour sequence of sequence listing upward to telomere on chrosomal short arm and 5'-terminus of this base sequence : 73332
atgccaaatattagttggaatatcatataactctttgaaaagttgattcgtttagtgaaaaagacttttcctcttaaacggagtgaaatctcgtgtctgatttgtgtaatattcctgattacattgtgtgcgtgtgtgtgtgtgtgtgtgtgtgtgtgtgtgtgtttctgtgtttctttccggcttggtttaacaataattcatgatcataagaggacagctattgcttgtaatgaa

SEQ ID NO: 6821 - DNA, 294 bp, Homo sapiens
  chr4.fa.O7frz.44173929
  Located on chromosome 4
  Distance between a terminus base of telomere on chromosomal short arm and 5'-terminus of this base sequence : 42078250
  Distance between 3'-terminus of neighbour sequence of sequence listing upward to telomere on chrosomal short arm and 5'-terminus of this base sequence : 196630
gcacatttcaagtgcttaatagacatatgtggctactggctactatcctgatagcagcaaagatacagaaactttccaccattacagagttatacgagatggccctgttttattatttctttctttattatttatttatttatttatttatttatttatttattttttttttgagacggagtctcgctctgtcgcccaggctggagtgcagtggcgggatctcggctcactgcaagctccgcctcccgggttcacgccattctcctgccttagcctcctaagtagctatggcca

SEQ ID NO: 6822 - DNA, 201 bp, Homo sapiens
  DISO7_10001417
  Located on chromosome 4
  Distance between a terminus base of telomere on chromosomal short arm and 5'-terminus of this base sequence : 42110861
  Distance between 3'-terminus of neighbour sequence of sequence listing upward to telomere on chrosomal short arm and 5'-terminus of this base sequence : 32317
tgaatgtctgcatagacaagtgattttttttttccagccttggctacacattagactcacctggctggggtggtgttagagggtgcttttaaaaactattgcggcccaggaccctacaaagattctaggtttttctctctttgtgtgtgtgtgtgtgtgtgtgtgtgtgtgtgtgtttaagttctccagccaagatacaga

SEQ ID NO: 6823 - DNA, 248 bp, Homo sapiens
  DISO7_10001416
  Located on chromosome 4
  Distance between a terminus base of telomere on chromosomal short arm and 5'-terminus of this base sequence : 42198253
  Distance between 3'-terminus of neighbour sequence of sequence listing upward to telomere on chrosomal short arm and 5'-terminus of this base sequence : 87191
ttcactggatgaaactatgacccagtattcttactgtattttacatatgcctgtaaattatttgcaaaaaagaagaagaagaggaagaaagaaaagaaagaaaagaaagaaagaaagaaagaaagaaagaaagaaagaaagaaagaaagaaagaaagaaagaaaaagaaagaaagaataaaaaaaaatgataacatggcaaccaccaaactcccttaaaaacaaacattggtgacatggccaattaag

SEQ ID NO: 6824 - DNA, 251 bp, Homo sapiens
  DISD22_0003623
  Located on chromosome 4
  Distance between a terminus base of telomere on chromosomal short arm and 5'-terminus of this base sequence : 42457828
  Distance between 3'-terminus of neighbour sequence of sequence listing upward to telomere on chrosomal short arm and 5'-terminus of this base sequence : 259327
gactccatcagctttctgatctttccattttgagcattagaaaacaaacaaacaaacaaacaaacacacatgatctatagctgtgccatctgatataagagccaccagtcacctgtggctcttgaaatgtggctggcgcaactgagttgaatcttttattttaattaatttgaatttaaaaactgaagccatgtacatttttttttgttaaacacaactttattgggaagcttgtaagtacatttgaggca

SEQ ID NO: 6825 - DNA, 358 bp, Homo sapiens
  chr4.fa.O7frz.44420464
  Located on chromosome 4
  Distance between a terminus base of telomere on chromosomal short arm and 5'-terminus of this base sequence : 42600249
  Distance between 3'-terminus of neighbour sequence of sequence listing upward to telomere on chrosomal short arm and 5'-terminus of this base sequence : 142170
ctgcttgtcctctatcataattattccaactgctataatttattcatccccagacaagcttccatgttataaggtacccagattgaaatggctggaagctcaagtcactcctgccccttcccatctgctgaaaatactgactgcagaaggaatattttctatgcatatatatatatatatatatatatatatatttttttttttttcaaaaccaaaccaaagttatctcaaaactcaagttctctgacaaacatgttgttaagctttcaagttcacaattctgcagctggaagaagggggcagagaatcctatcagaaactcagtatttagttctactttacagctataaggaaatgg

SEQ ID NO: 6826 - DNA, 213 bp, Homo sapiens
  D4S2919
  Located on chromosome 4
  Distance between a terminus base of telomere on chromosomal short arm and 5'-terminus of this base sequence : 42787846
  Distance between 3'-terminus of neighbour sequence of sequence listing upward to telomere on chrosomal short arm and 5'-terminus of this base sequence : 187239
tgtctcaagtttccaatgctttttctcatcacacacacacacacacacacacacacacacacacacaattcagcaccactacagaaaaaaaaaaattggtacattttgccacgtaaaaattaaaaccatctgtttagaaaaaaagtgactataaacacgataaaagcaaaaaacagactgaagaaaaaattaccaccacagatgacataaaag

SEQ ID NO: 6827 - DNA, 150 bp, Homo sapiens
  D4S2386
  Located on chromosome 4
  Distance between a terminus base of telomere on chromosomal short arm and 5'-terminus of this base sequence : 43058433
  Distance between 3'-terminus of neighbour sequence of sequence listing upward to telomere on chrosomal short arm and 5'-terminus of this base sequence : 270374
tactggaggagataaaaatgggagaaataagttcaatcaagatttttttgtccttaatacaaaaagatgttattattgacactcaatagaatgcttatttattattattattattattattattattagggctagtcaagtgaagcagtg

SEQ ID NO: 6828 - DNA, 121 bp, Homo sapiens
  D4S3045
  Located on chromosome 4
  Distance between a terminus base of telomere on chromosomal short arm and 5'-terminus of this base sequence : 43115304
  Distance between 3'-terminus of neighbour sequence of sequence listing upward to telomere on chrosomal short arm and 5'-terminus of this base sequence : 56721
ggcaaggacttccaggtagggtgtgtgtgggtagggtgtgtagggtgtgtgtgtgtgtgtgtgtgtgtgtgtgtgtttccatctctgcgtccccagcgcctggcccagtgcctgacgcata

SEQ ID NO: 6829 - DNA, 118 bp, Homo sapiens
  D4S2974
  Located on chromosome 4
  Distance between a terminus base of telomere on chromosomal short arm and 5'-terminus of this base sequence : 43216811
  Distance between 3'-terminus of neighbour sequence of sequence listing upward to telomere on chrosomal short arm and 5'-terminus of this base sequence : 101386
ccagctaataatgccaggacagaagctaaggggtaggggtgtgtgtgtgtgtgtgtgtgtgtgtgtgtgtgtgtgtgtgtcttcttggagggcagggcagggaatacaggccccgttg

SEQ ID NO: 6830 - DNA, 148 bp, Homo sapiens
  chr4.fa.O7frz.45209538
  Located on chromosome 4
  Distance between a terminus base of telomere on chromosomal short arm and 5'-terminus of this base sequence : 43359454
  Distance between 3'-terminus of neighbour sequence of sequence listing upward to telomere on chrosomal short arm and 5'-terminus of this base sequence : 142525
acaatacttggttcttagcattagtgtgaggatcagagaatacacacacacacacacacacacacacacacacacaccctgcacagggcatgatacatgtattagttttctgtggttgctgtaacaaattaccacaaatttattggct

SEQ ID NO: 6831 - DNA, 353 bp, Homo sapiens
  chr4.fa.O7frz.45316049
  Located on chromosome 4
  Distance between a terminus base of telomere on chromosomal short arm and 5'-terminus of this base sequence : 43532004
  Distance between 3'-terminus of neighbour sequence of sequence listing upward to telomere on chrosomal short arm and 5'-terminus of this base sequence : 172402
cctaatcagttcatgcactaagccaccagccgcagagagcaggggagggctgcagaggaagtggggagggtgaaaggcgaacctacacacacacacacacacacacacacacacacacacacacaaacacacacagctgcctctcttcctcccttctggcttagcaagggctagatcagcatcagccaccacagatgtctgggtactcagcatgggacccgggtattcccttccacagggcagagagagagggagcaaaggcccaaaaacagcaaaaataactagtccatcgcttggcaggccttactcagtgttagagcatcttttggctgtcttcctacatatgagaaggc

SEQ ID NO: 6832 - DNA, 308 bp, Homo sapiens
  AC007799.4_171787
  Located on chromosome 4
  Distance between a terminus base of telomere on chromosomal short arm and 5'-terminus of this base sequence : 43556870
  Distance between 3'-terminus of neighbour sequence of sequence listing upward to telomere on chrosomal short arm and 5'-terminus of this base sequence : 24513
ccttcattaagcgatgtatgactatataatgtgaccagtctctagggctctgaagtatgacagacctggttgccatcactttgtagctgtgtgacctgtttttcctctgtaaaatgggaataacaataccccatactttgtgaaatggtaaaatgagctgaaacatatagtgtttagcatagtatttcacataatgctcagtaattttggctgtcatcatcatcatcatcaatggtatggtttggcttgtgtccccacccaaatttaatcttgaattgtagttctcataatccaatttgagtgacctg

SEQ ID NO: 6833 - DNA, 446 bp, Homo sapiens
  chr4.fa.O7frz.45747612
  Located on chromosome 4
  Distance between a terminus base of telomere on chromosomal short arm and 5'-terminus of this base sequence : 43846063
  Distance between 3'-terminus of neighbour sequence of sequence listing upward to telomere on chrosomal short arm and 5'-terminus of this base sequence : 288885
atatggctcattatagcctgaccttccgggctcaagagatcctcccacctcagcctcccaagtagctgggactacaggcgcacaccaccacatttggctgtatttatttatttatttatttatttatttatttatttatttattttgcagagacggggttttgccatgttgcccaggctggtcttgaactcctgagctcaactgatgcactgaccttggcctcccaaagagctggaattaaaagcgtgagccaccacacgaacctatatttctaatgtactgaactctagatgttggcattatttctcagatgcacccagaaaatgttctgatagtctaaacagaactaaccctgaaaagcaaataaaaatttctaagcacttcacgcagtgcttggcacataataagtacttattaagtatttgtagacatgatcaagcaaattg

SEQ ID NO: 6834 - DNA, 183 bp, Homo sapiens
  DISO7_10001421
  Located on chromosome 4
  Distance between a terminus base of telomere on chromosomal short arm and 5'-terminus of this base sequence : 44236449
  Distance between 3'-terminus of neighbour sequence of sequence listing upward to telomere on chrosomal short arm and 5'-terminus of this base sequence : 389940
agaagccctgcatagcacagggccctgtacagattgcctctctctctctctctctctctctctctctctctctctctctctctatatatatatatatatatatatatatatatatatatatatatggaagggagtttaagagaaacactcaaagagagtttggcctgatctatttctcttgga

SEQ ID NO: 6835 - DNA, 259 bp, Homo sapiens
  DISO7_10001419
  Located on chromosome 4
  Distance between a terminus base of telomere on chromosomal short arm and 5'-terminus of this base sequence : 44267020
  Distance between 3'-terminus of neighbour sequence of sequence listing upward to telomere on chrosomal short arm and 5'-terminus of this base sequence : 30388
ggccagagactggatttctctcacacttagttatctaaaaacagacataataagaataataataataataataataataataataataatagtaataacttttctgttcactttataaacttttgggcacaattaattaaaataatatatgtgaaatccctgtgtaaaatgcaaaataacattttattcctcattactgaaaaattttagaaaaattatttactttctttaaaaattagccattgttacttcatgctaa

SEQ ID NO: 6836 - DNA, 207 bp, Homo sapiens
  DISO7_10001418
  Located on chromosome 4
  Distance between a terminus base of telomere on chromosomal short arm and 5'-terminus of this base sequence : 44310156
  Distance between 3'-terminus of neighbour sequence of sequence listing upward to telomere on chrosomal short arm and 5'-terminus of this base sequence : 42877
aggcttaataattgaaagtcctgaatatatatatgcacacatatgtatttgtatatattgttttgatacagaagcttaagaatatatacatacacacatatatacatatatatacacacacacacacacacacacacacacatatatatatatatatatatatatatatacacatgtatgtatgtatgtaagcttcttaagcaggtg

SEQ ID NO: 6837 - DNA, 425 bp, Homo sapiens
  chr4.fa.O7frz.46159079
  Located on chromosome 4
  Distance between a terminus base of telomere on chromosomal short arm and 5'-terminus of this base sequence : 44389338
  Distance between 3'-terminus of neighbour sequence of sequence listing upward to telomere on chrosomal short arm and 5'-terminus of this base sequence : 78975
gacaacgtcatttactatggagaggatatttcctgtcatagctcaagtgtggatcagcctcatgttctctgcctccagaccctgttttcctgcctcaaaatgagatcctggtctaaagtaagatgagctacttatgtaacctcttacacagaaagttgagataataatggtaccttcctcatttagtgtgaaataacctgtgctttttgcttagaactgtgcccagcccttgggattagctgttatgattcagtatgcctgttgtttttatttgcttatttatttatttatttatttattttctcgagacatggtctatgctctgttgcccaggctggagtgcagtggtgtgattacagcttactgtaacctcgaagtcctgggtttaagtgtcaaaggcatcctaaccagagtgattccatctt

SEQ ID NO: 6838 - DNA, 243 bp, Homo sapiens
  DISO7_10001420
  Located on chromosome 4
  Distance between a terminus base of telomere on chromosomal short arm and 5'-terminus of this base sequence : 44509361
  Distance between 3'-terminus of neighbour sequence of sequence listing upward to telomere on chrosomal short arm and 5'-terminus of this base sequence : 119598
ttgtacagttatctctaacagcccctattttcatcttccaccagaaacacacacacacacacacacacacacacacacacacacacacacacactttggccttaggggcaaacattaggtaaactaatattcaatatgttaattaagcagtctcaggaaaaatcagactacagtagctttttgctttgcaaggcacatatatgcaaaccccaaacaattttcatctgtgacatattagccaca

SEQ ID NO: 6839 - DNA, 308 bp, Homo sapiens
  chr4.fa.O7frz.46626567
  Located on chromosome 4
  Distance between a terminus base of telomere on chromosomal short arm and 5'-terminus of this base sequence : 44676972
  Distance between 3'-terminus of neighbour sequence of sequence listing upward to telomere on chrosomal short arm and 5'-terminus of this base sequence : 167368
tttagtaaagtcttgcaccaacaagaaatcattcctctgtgtgtgtgtgtgtgtgtgtgtgtgcttgcacatgcatgtgtcttttatcttacatgaaagccaatagcaataaatgttcctctgccaaatttttaacttacttgctaaatctgctgttgctagctcaggtttccatacctattacaatattttatgttggccataatatacttaccacagtggccaattaccttgctgaagagaagctggcaatctgtcattttatgtgaaatctcatgcattctctctggagtgtagctttgattata

SEQ ID NO: 6840 - DNA, 264 bp, Homo sapiens
  Z66817
  Located on chromosome 4
  Distance between a terminus base of telomere on chromosomal short arm and 5'-terminus of this base sequence : 44883631
  Distance between 3'-terminus of neighbour sequence of sequence listing upward to telomere on chrosomal short arm and 5'-terminus of this base sequence : 206351
agctgctgaattaaacagggatgttctctaaggacacacacacacacacacacacacacacacacacacacactcaactttaataggcatcatcaaaacattgcctgctttttttctcttaattaatctttagttgcaacccactttaaatattatacagagaaattttcattttgatttcatagatgtagtacaattactcattgattaatctgacaaaataaatctgtttcaaatttagaaactcctcaaacttttccagtt

SEQ ID NO: 6841 - DNA, 387 bp, Homo sapiens
  chr4.fa.O7frz.46823735
  Located on chromosome 4
  Distance between a terminus base of telomere on chromosomal short arm and 5'-terminus of this base sequence : 44960360
  Distance between 3'-terminus of neighbour sequence of sequence listing upward to telomere on chrosomal short arm and 5'-terminus of this base sequence : 76465
cctatcatgttatagcatagaggttgtattagttagagttctccaggggaatagaaccaacaagagatatagatagacaggtagacaggtaggtaggtaggtagatagatagatagatagatagatagatagatagatagatagaaataaatagatagatagaagaggagatttattatgggaattggcacacacaattatggagcctgagaggtcccacggtatgccatttgcaagctatagatgtaggaaagccagtgatataattaattcctaggctgaaggcctaagaagagggttggttggggtctggtgttggagggttggttggtgtaagtcttgaagtcaaaaggaccaaggactgagacattcaatgttcaaagtcag

SEQ ID NO: 6842 - DNA, 124 bp, Homo sapiens
  D4S3025
  Located on chromosome 4
  Distance between a terminus base of telomere on chromosomal short arm and 5'-terminus of this base sequence : 45085031
  Distance between 3'-terminus of neighbour sequence of sequence listing upward to telomere on chrosomal short arm and 5'-terminus of this base sequence : 124284
attgggttaagatttaatgaaacactgtgtgtgtgtgtgtgtgtgtgtgtgtgtgtgtattgctagtgctttataacatcactattatttatttatttatatagcgttgtggacactatgagct

SEQ ID NO: 6843 - DNA, 143 bp, Homo sapiens
  DISD22_0003626
  Located on chromosome 4
  Distance between a terminus base of telomere on chromosomal short arm and 5'-terminus of this base sequence : 45209302
  Distance between 3'-terminus of neighbour sequence of sequence listing upward to telomere on chrosomal short arm and 5'-terminus of this base sequence : 124147
aaggtcaacctttccaaggtatttgagccttttattcttgttaaacacatatttgacaaatatgtctataatagatagatagatagatagatagatagatagatagatagatagatagatatagtgcatatcattcatgtggg

SEQ ID NO: 6844 - DNA, 295 bp, Homo sapiens
  chr4.fa.O7frz.47230254
  Located on chromosome 4
  Distance between a terminus base of telomere on chromosomal short arm and 5'-terminus of this base sequence : 45459899
  Distance between 3'-terminus of neighbour sequence of sequence listing upward to telomere on chrosomal short arm and 5'-terminus of this base sequence : 250454
acttactgcaattgctatacaaacacttgttgaatatattcttagtaattgaattattttgtcttctagcttagtttaaagaatgccaaatgtgttgaataaagaccttaaacatgtacccctttatcttattaaacaaaacaaaacaaaacaaaacaaaaaacccatatcagtttaattagacatttagataggcacacatcactgtttatattacataaaaaagaaaatgctattataaacaagaacaaatgaacagtatgacaatttcacagttcaacttagaactcagatt

SEQ ID NO: 6845 - DNA, 434 bp, Homo sapiens
  chr4.fa.O7frz.47356739
  Located on chromosome 4
  Distance between a terminus base of telomere on chromosomal short arm and 5'-terminus of this base sequence : 45588244
  Distance between 3'-terminus of neighbour sequence of sequence listing upward to telomere on chrosomal short arm and 5'-terminus of this base sequence : 128050
ggtataagcacattcctgattaagaaagaaaatcttcaagtttaaagtcccatcattcattatacttttgctttgttttataaagaaattttatattttttcttcttaacattaaatgataagagagatacttaaattgaaggttgtattcctgtttgtctgtaaagaaaacacaaatacattatatatacatatatatatatataaacatatatatgtgttgttaatgtcatgcattagtgttatatttcatttcaggcctactatttgtctcccagcataaatattgacatctagtatctatttttaggtaacacaaatattattttttgacttaatccatttgttacctcgatatattgtgtgctactgaggtttgggttatgaatgattccgtcatccaggtagcgagcatagtacgcaatagttaagtt

SEQ ID NO: 6846 - DNA, 413 bp, Homo sapiens
  AC024524.3_179980
  Located on chromosome 4
  Distance between a terminus base of telomere on chromosomal short arm and 5'-terminus of this base sequence : 45752154
  Distance between 3'-terminus of neighbour sequence of sequence listing upward to telomere on chrosomal short arm and 5'-terminus of this base sequence : 163476
ataagtcaatgccaaatatcgaattaaagatttttaaaagttttacaactttttggaattatggaaatattctatctcttcattatggtgttgattatatgactgtatacatttgtgaaaactgatagaactgtatgccttaaatggctgagcttttatgtatgtaaattataccttgactaacctgactccccctcctgaaaaacacaaacaacaaagaaacataaagtatatatgtctacatctatctatctatctatctatctatctatctatctatctcagggaaagtcttaagcaatatttcaaacttcctttgtctgcaatatgataaaaccaggacaaatgctaatgcttataattgcttagtaaggaaatacaccattacatttcagaagtatttgcaaccaaat

SEQ ID NO: 6847 - DNA, 179 bp, Homo sapiens
  G08393
  Located on chromosome 4
  Distance between a terminus base of telomere on chromosomal short arm and 5'-terminus of this base sequence : 45752331
  Distance between 3'-terminus of neighbour sequence of sequence listing upward to telomere on chrosomal short arm and 5'-terminus of this base sequence : -236
gactaacctgactccccctcctgaaaaacacaaacaacaaagaaacataaagtatatatgtctacatctatctatctatctatctatctatctatctatctatctcagggaaagtcttaagcaatatttcaaacttcctttgtctgcaatatgataaaaccaggacaaatgctaatgct

SEQ ID NO: 6848 - DNA, 443 bp, Homo sapiens
  chr4.fa.O7frz.47459064
  Located on chromosome 4
  Distance between a terminus base of telomere on chromosomal short arm and 5'-terminus of this base sequence : 45858503
  Distance between 3'-terminus of neighbour sequence of sequence listing upward to telomere on chrosomal short arm and 5'-terminus of this base sequence : 105993
agtcattcagaatatccagctaagataattgaggaaagtggctacaaaaacaacacattttattattattattattattattattattattattattattattattattgagacagagtcttgctctgtcacccaggctggagtgcaatctcagctcactgcaacctccgcctcccaggtccaagatattctcccgcttcagcctcccaagtagttgggattacgggcatatgccaccatgcccggctaatttttgtatttttagtagagacaaggttttgccatgttggccagactggtctcaaactcctgacctcaggtgatctgcccactgtggcctcccaaagtgcttggattacaagcatgagacaccatgcctggcccagattttcaatgtgaataaaacggtggaagaagatgtcatctgacattttcatagctag

SEQ ID NO: 6849 - DNA, 202 bp, Homo sapiens
  HUMUT2203
  Located on chromosome 4
  Distance between a terminus base of telomere on chromosomal short arm and 5'-terminus of this base sequence : 45942158
  Distance between 3'-terminus of neighbour sequence of sequence listing upward to telomere on chrosomal short arm and 5'-terminus of this base sequence : 83212
acagagatgtagccatgcggattagcctacttcatcaaattagcagcagcagcagcagcagcatcaatattgtagccacagttccttgtagtaggatttggaattacaaatatcattaccaatttctggaaacctcattaagcaacacagtcttcctcttactacccttctgtcatttgtatagtcctagaaatcccaccgt

SEQ ID NO: 6850 - DNA, 216 bp, Homo sapiens
  AC013336.7_139897
  Located on chromosome 4
  Distance between a terminus base of telomere on chromosomal short arm and 5'-terminus of this base sequence : 46096738
  Distance between 3'-terminus of neighbour sequence of sequence listing upward to telomere on chrosomal short arm and 5'-terminus of this base sequence : 154378
atgtttggcacatgtatcctagaacttaaagtataataataataataataataataataataataataatagaaagtgtttggcacttccccttttactagtgctgtctcctgttctgccatgggaagatgtgccttgcttcctcttctccttctgtcatgattgtaagtttcctgaggcctcccagttgtgcttcctgttaagcttacagaactg

SEQ ID NO: 6851 - DNA, 430 bp, Homo sapiens
  chr4.fa.O7frz.48084299
  Located on chromosome 4
  Distance between a terminus base of telomere on chromosomal short arm and 5'-terminus of this base sequence : 46366638
  Distance between 3'-terminus of neighbour sequence of sequence listing upward to telomere on chrosomal short arm and 5'-terminus of this base sequence : 269684
atcctagaatattagagttggcactaggtctctttaaagcagtgttttaaaactggttgtcacccattattatatcataaaatcaatatagccagtcacgtgcaacattttccttttgttaatgaaatgcaatgtcatagaaaacagcttgtatggttcctagtaagggtaagtatgatttcatggaattcttgtcttaattatattttatatgtttgtgttgtatatgtgtatatatatatatatatatactagattgcaatatcaaatgttatttcttacaagggttacagtcagaagtttgaaaaaaaaaaactgttgccctagacattatcttatccaatccacacatttttataagtgaggaaactctcctacagaaaggtctactagttaattgccctatctggactacaaccaagtaaattaa

SEQ ID NO: 6852 - DNA, 390 bp, Homo sapiens
  chr4.fa.O7frz.48269505
  Located on chromosome 4
  Distance between a terminus base of telomere on chromosomal short arm and 5'-terminus of this base sequence : 46493794
  Distance between 3'-terminus of neighbour sequence of sequence listing upward to telomere on chrosomal short arm and 5'-terminus of this base sequence : 126726
tgaggcttaagaaatgttataacttcctgtagaaatgattccacatgaattgtctgtggttcccttgctgtgatagtgacaggaaacttcctctgatttctgtgctctacttttcttctttgtttagtaggatgaggtgtttccaatttcctcttcagcatctgcattagtcagggttctctggagggacagaactaatagaatatgtgtgtgtgtgtgtgtgtgtgtgtgtgtgtgtgtgtgtgtgtttaagtattaactcacatgatcataaggtcccacaataggtcatctgcaagctaaggagcaatgagagccagtccgtgcaagctaaggagcaaggagagccagtccaagtttgaaaactgaagaacttggagtctgatgttt

SEQ ID NO: 6853 - DNA, 403 bp, Homo sapiens
  chr4.fa.O7frz.48190309
  Located on chromosome 4
  Distance between a terminus base of telomere on chromosomal short arm and 5'-terminus of this base sequence : 46555698
  Distance between 3'-terminus of neighbour sequence of sequence listing upward to telomere on chrosomal short arm and 5'-terminus of this base sequence : 61514
taggacagttagcaaacttatgtcaacatcccaccccctacacacagacacacacacacacacacacacacacacacacacacacacaccacaggagtgactttgtcttaatatttcacattttgctacagaataacaaaacctttaccttggactggtcaacagatgagatgatctctcatgcttttagggtctatgattttataattttaataatgttttattttattctattctttctactttttttattctatgcagtaatctacttcacttttaattatttatttcctaaacatggattatcatataaattttcaaattccaagcagcctccctcttcccgtgctactttttaaaattgaaattcttatagagatagttgtagatttatgtgcaatcg

SEQ ID NO: 6854 - DNA, 231 bp, Homo sapiens
  chr4.fa.O7frz.48406895
  Located on chromosome 4
  Distance between a terminus base of telomere on chromosomal short arm and 5'-terminus of this base sequence : 46703930
  Distance between 3'-terminus of neighbour sequence of sequence listing upward to telomere on chrosomal short arm and 5'-terminus of this base sequence : 147829
ttatgtcctaaatatttcatggagcatacttatatcataattattcagatatttttctagtatatgtcccaaatattgcataagacatatatatatatatatatatatatatatatatatatatatataaaatgatgtttatctgaaatgaatatattacctgagtgtcctatctttttatttggtaaatctaataataaaagcaagctccttacactgttctacaaagtc

SEQ ID NO: 6855 - DNA, 122 bp, Homo sapiens
  DID22N_0022703
  Located on chromosome 4
  Distance between a terminus base of telomere on chromosomal short arm and 5'-terminus of this base sequence : 46938646
  Distance between 3'-terminus of neighbour sequence of sequence listing upward to telomere on chrosomal short arm and 5'-terminus of this base sequence : 234485
aatgttcacaacattgaagaggaaaatgcacacacacatatacacacacacacacatgcgcgcgcacacacacacacacacacacacacacacacacacacagaaaccagtaacagcaatgc

SEQ ID NO: 6856 - DNA, 193 bp, Homo sapiens
  chr4.fa.O7frz.48578151
  Located on chromosome 4
  Distance between a terminus base of telomere on chromosomal short arm and 5'-terminus of this base sequence : 47001814
  Distance between 3'-terminus of neighbour sequence of sequence listing upward to telomere on chrosomal short arm and 5'-terminus of this base sequence : 63046
actatacgcaatagccaagatatgaaatcaacctgagttcatcaacagatgaatgaataaataagatgtgatatatatatatatatatatctcataaataaatattcagtcataaataaagattgaaatcttgtcatttgctgtgacttggatgagcctggaggaaattaggttaagtgaaataagtcaggca

SEQ ID NO: 6857 - DNA, 239 bp, Homo sapiens
  chr4.fa.O7frz.48770857
  Located on chromosome 4
  Distance between a terminus base of telomere on chromosomal short arm and 5'-terminus of this base sequence : 47148694
  Distance between 3'-terminus of neighbour sequence of sequence listing upward to telomere on chrosomal short arm and 5'-terminus of this base sequence : 146687
ttcagtgtatactgctcaggagatgagtgcaccagaatctcacaaatcaccactgaagaacttactcatgtaatcaaataccacttgttctccaaaaacctatggaaatatatatatatagttgtgtatatgtgtgtgtgtgtgtgtgtgtatatatatagttgttttcttatgttttcacccatttttattattttgatttgatttttagtggagttagtttcaatgagttactccac

SEQ ID NO: 6858 - DNA, 227 bp, Homo sapiens
  Z67669
  Located on chromosome 4
  Distance between a terminus base of telomere on chromosomal short arm and 5'-terminus of this base sequence : 47220606
  Distance between 3'-terminus of neighbour sequence of sequence listing upward to telomere on chrosomal short arm and 5'-terminus of this base sequence : 71673
cttctggaagccctggctcaccttcctggattcgcattaacagtttatttactgctctcctcattaatacatgacttctacccttttggctctagaaaaagcttttttttgtctctttatctggaatctctctctctctacacacacacacacacacacacacacacacacacacacatttaaagtgcctctttttgatgcttcacagtgaaatgtcattgttttct

SEQ ID NO: 6859 - DNA, 277 bp, Homo sapiens
  chr4.fa.O7frz.49155738
  Located on chromosome 4
  Distance between a terminus base of telomere on chromosomal short arm and 5'-terminus of this base sequence : 47322343
  Distance between 3'-terminus of neighbour sequence of sequence listing upward to telomere on chrosomal short arm and 5'-terminus of this base sequence : 101510
gtattccatcacttaagtatgcactgcagatagatgtatacacatatacctcaggagatgtgtacacaatgtttatatcatctctgttcataatatcaaaaaatcagaaatcatccaaatgccaacttgaaagagaatgaataaatatatatatatatatatatgctatagactgaatgtttgttttcttaaaaagtcatattttgaagtcctaaccccaatgtgatggtattaggtggtagaaattttggaggtgattaatttatgatagtggagc

SEQ ID NO: 6860 - DNA, 278 bp, Homo sapiens
  D4S2381
  Located on chromosome 4
  Distance between a terminus base of telomere on chromosomal short arm and 5'-terminus of this base sequence : 47509383
  Distance between 3'-terminus of neighbour sequence of sequence listing upward to telomere on chrosomal short arm and 5'-terminus of this base sequence : 186763
gggcaacacacctgtagtcccagttacttgagaggctgaggagggaggatcacttgagtgcaggagttcgagggtgcaataaggtataagctatgatcatgccactgcattccagcctaggcgacatggagaccttgtcacaaaaaagaaaagaagggaggcagggaggaaggaaggaaggaaggaaggaaggaaggaaggaaggaaggaaggaaggaaggaaaaaagaaagagagagaccatatcttttatccaccaattcctcctcttctgcattt

SEQ ID NO: 6861 - DNA, 266 bp, Homo sapiens
  D4S1536
  Located on chromosome 4
  Distance between a terminus base of telomere on chromosomal short arm and 5'-terminus of this base sequence : 47679182
  Distance between 3'-terminus of neighbour sequence of sequence listing upward to telomere on chrosomal short arm and 5'-terminus of this base sequence : 169521
agtttgaacaacagtgtggggcatccctcaaggaactgttggcatgtctctatcagccttttattctgaatgtcttacttcccgtttctgcaattttgactaagtatatcctctagctttgattttggctgtgtgtgtgtgtgtgtgtgtgtgtgtgtgtgtgtgtgtatttagtgtttagactttccttaaaatattaagtttggtttatctctctggctctttttgctcctctttgctttaaattagtatcccttgccatagcc

SEQ ID NO: 6862 - DNA, 478 bp, Homo sapiens
  AC069182.2_7795
  Located on chromosome 4
  Distance between a terminus base of telomere on chromosomal short arm and 5'-terminus of this base sequence : 47926781
  Distance between 3'-terminus of neighbour sequence of sequence listing upward to telomere on chrosomal short arm and 5'-terminus of this base sequence : 247333
cacctgaggtctggctaacatggtgaaactctgtctctactaaaaatacaaaaattagcgggcatggtggtgggcccctgtaatctcagctactcgggaggctgagacaagagaattgcttgaacccaggaggtggaggttgaagaaagccgagatcacgccactgcacaccagcctgggcaacaaacagtgaaactccgtctcaaaataataataataataataataataataataataataataatgaatctatataaggattgtaaaagtaaacaacatagaggatttctccagagatctagatctgattatgtttttctttttcttactcatattaaagattttctagtaaatcctcatcttaatgtcctcccttagaacaataatttaagatttttaaactatctcttaaagtcttgctaacaaaattattacaatagataatattctaaactccaatggtcttgataatgtg

SEQ ID NO: 6863 - DNA, 450 bp, Homo sapiens
  AC013490.3_23463
  Located on chromosome 4
  Distance between a terminus base of telomere on chromosomal short arm and 5'-terminus of this base sequence : 48016039
  Distance between 3'-terminus of neighbour sequence of sequence listing upward to telomere on chrosomal short arm and 5'-terminus of this base sequence : 88780
ttatcaatgttggtgagcattatccaaacccttaagagcctgaatagagatagaccaaattctctctcttcttgagccaggacatttatattttcctgctttcagacatcagagcccctgaattaaagccctttgaaaccagaccagaagttactcaatcacttcctctggttgtcaggccttcaagttctgactgaattacactaactctcctggttattcagcttgtccgttggatatctttggacttcttggcctccctaatcacacaagccaattcccataataaatgttcttctatctatctatctttctatctatctatctatctatctatctatctatctaatcagctgtctgtctatctatctatcttgtagctatatcttagatcaatacatagatatatagatcaatacatagatagatagatcctatttggtctgttcc

SEQ ID NO: 6864 - DNA, 435 bp, Homo sapiens
  AC069182.2_174148
  Located on chromosome 4
  Distance between a terminus base of telomere on chromosomal short arm and 5'-terminus of this base sequence : 48049408
  Distance between 3'-terminus of neighbour sequence of sequence listing upward to telomere on chrosomal short arm and 5'-terminus of this base sequence : 32919
accgtgatttaaacatacttcaagaggctgggcatggtggctcacgcctgtaatcccagcactttcggaagctgaagtgggtggatcacaaggtcaggagttcaagaccagcctggccaagatggtgaaaccccatctctattaaaaatacaaaaattagcccagcatggtggcaggtgcctgtaatcccatctacttgggaggctgaggcagggagttgcttaaacccgggagacagaggttgcagtgaaccgagatcacgatgctacactccagcctgggcgacagagcaaaagtccgttgaaagaaagaacgaaagaaagaaagagagagagaaagaaagaagaaagaaagaaagaaagagagagagagagagagggagggagggagggagagagagaaagaaagaaagatacgttgctttcctctgagact

SEQ ID NO: 6865 - DNA, 227 bp, Homo sapiens
  D4S396
  Located on chromosome 4
  Distance between a terminus base of telomere on chromosomal short arm and 5'-terminus of this base sequence : 48102534
  Distance between 3'-terminus of neighbour sequence of sequence listing upward to telomere on chrosomal short arm and 5'-terminus of this base sequence : 52691
aacaccttgtaaccatcacctagcagaaatgtcatcacaaatcttattgaagcccttcctcttctgtttatcccttctcaatcacagccccctagtctctgaggaaataagtatcttgagtttagtgtacacccttcccatacatgtactttcacatttagtacatatatacacacacacacacacacacacatatatatatagtgtgtcacattttaaacattcat

SEQ ID NO: 6866 - DNA, 188 bp, Homo sapiens
  D4S401
  Located on chromosome 4
  Distance between a terminus base of telomere on chromosomal short arm and 5'-terminus of this base sequence : 48114990
  Distance between 3'-terminus of neighbour sequence of sequence listing upward to telomere on chrosomal short arm and 5'-terminus of this base sequence : 12229
tttttgggacaattacactacttaatgattccaagatagcagagtgtgtgtgtgtgtgtgtgtgtgtgcgcacacgcatgtgtgtgtgtgtttgcatattcttttggttcataattctttttgctatgctgctttttttctctcaggctaatgtcataacaaatctacatcactgacctgaataagag

SEQ ID NO: 6867 - DNA, 286 bp, Homo sapiens
  DISD22_0003646
  Located on chromosome 4
  Distance between a terminus base of telomere on chromosomal short arm and 5'-terminus of this base sequence : 48292332
  Distance between 3'-terminus of neighbour sequence of sequence listing upward to telomere on chrosomal short arm and 5'-terminus of this base sequence : 177154
cttacccaactggaatctctgttttcttctcatgcataaaaagaggatacattagcatgcatatatatatatacatatatatatatgcataattatgtatgcatgtataatatatatattacacacatatatattccatatatatacatatatgtgtgtgtgtatatatatacacacatatatatgcgtgtgtgtatatatgttatatatacacacacacatatatatatacacatatatatatacacatatatatatatatatacccctcctaaggttatggtgt

SEQ ID NO: 6868 - DNA, 103 bp, Homo sapiens
  DISO7_10001425
  Located on chromosome 4
  Distance between a terminus base of telomere on chromosomal short arm and 5'-terminus of this base sequence : 48457955
  Distance between 3'-terminus of neighbour sequence of sequence listing upward to telomere on chrosomal short arm and 5'-terminus of this base sequence : 165337
gtatgtgtaattggaatcctggataaaagaaaagagagagagagagagagagagagaagacagcaggaaaaagtatttatgagataatggtcagtcatgagaa

SEQ ID NO: 6869 - DNA, 162 bp, Homo sapiens
  DISO7_10001424
  Located on chromosome 4
  Distance between a terminus base of telomere on chromosomal short arm and 5'-terminus of this base sequence : 48464244
  Distance between 3'-terminus of neighbour sequence of sequence listing upward to telomere on chrosomal short arm and 5'-terminus of this base sequence : 6186
aactccagggaagacttggaaaattttaatgaagttgaaatgaaaataaagagagaaggaagaaagaaatttgactgaaaaacatgtgtgtgtgtgtgtgtgtgtgtgtgtgtgtgtgtgtgtttgtactaaaaactactttccagggaaccttgatagttg

SEQ ID NO: 6870 - DNA, 144 bp, Homo sapiens
  DISO7_10001427
  Located on chromosome 4
  Distance between a terminus base of telomere on chromosomal short arm and 5'-terminus of this base sequence : 48527237
  Distance between 3'-terminus of neighbour sequence of sequence listing upward to telomere on chrosomal short arm and 5'-terminus of this base sequence : 62831
catgctcaccaaacatgcaaaatgaaataactgtgtgcgtgtgtgtgtgtgtgtgtgtgtgtgtgtgtgtgttgtgtgtgtgtgtgtataagcataggtactggtactaaattacattttttttctttgtacgatgccatgttc

SEQ ID NO: 6871 - DNA, 103 bp, Homo sapiens
  DISO7_10001426
  Located on chromosome 4
  Distance between a terminus base of telomere on chromosomal short arm and 5'-terminus of this base sequence : 48537332
  Distance between 3'-terminus of neighbour sequence of sequence listing upward to telomere on chrosomal short arm and 5'-terminus of this base sequence : 9951
ccttcaggctttggaatcttgtgtgtgtgtgtgtgtgtgtgtgtgtgtgtgtgtgtgtgtgtgtgtgttaatttaatttagttaccaggaatattaacctgct

SEQ ID NO: 6872 - DNA, 101 bp, Homo sapiens
  DISO7_10001430
  Located on chromosome 4
  Distance between a terminus base of telomere on chromosomal short arm and 5'-terminus of this base sequence : 48582567
  Distance between 3'-terminus of neighbour sequence of sequence listing upward to telomere on chrosomal short arm and 5'-terminus of this base sequence : 45132
tgctctaaggtgtccttgtcaactctccctacacacacacacacacacacacacacacacacacacacacaggctgagtctgatgactcttaaagaagtcc

SEQ ID NO: 6873 - DNA, 360 bp, Homo sapiens
  AC012681.2_108439
  Located on chromosome 4
  Distance between a terminus base of telomere on chromosomal short arm and 5'-terminus of this base sequence : 48737931
  Distance between 3'-terminus of neighbour sequence of sequence listing upward to telomere on chrosomal short arm and 5'-terminus of this base sequence : 155263
aagcgagatgttaatgattgactctgaaggtgagattatgaatttttactttttattttgtgtttctagctttgtttccatgtaccacttttataacaagaagaaataccacacacacacacacacacacacacacacacacacacacacaagtgttctgtgagtggagacagatgatagctagaaagctagcaaggtggatggatgatgatgatagatagatagatagatagatagatagatagatagatcgatcgatctatctccacatcagggaggcacatcaagccagatgtttaggaacacagtgtttaatgagccttatggggtatcattagtaacaggttaatgaaaacaggc

SEQ ID NO: 6874 - DNA, 267 bp, Homo sapiens
  chr4.fa.O7frz.50781614
  Located on chromosome 4
  Distance between a terminus base of telomere on chromosomal short arm and 5'-terminus of this base sequence : 48856131
  Distance between 3'-terminus of neighbour sequence of sequence listing upward to telomere on chrosomal short arm and 5'-terminus of this base sequence : 117840
gctttattgaggcattcttaacaaataaaaattgtacatatttaaggggtgtaatgtaatgtttgatatatgtataccttgtgaaatggctaccacaatcaagctaagaagcatatctatcaccacatagttacgtgtgtgtgtgtgtgtgtgtgtgtgtgtgtgtgtgttaagaacactaaggccaagaatcttagcaaatttcaagtatacaatttagcatcgttaactatagtcaccatgttgtacattagatctccggaactt

SEQ ID NO: 6875 - DNA, 437 bp, Homo sapiens
  AC013535.4_126636
  Located on chromosome 4
  Distance between a terminus base of telomere on chromosomal short arm and 5'-terminus of this base sequence : 49148825
  Distance between 3'-terminus of neighbour sequence of sequence listing upward to telomere on chrosomal short arm and 5'-terminus of this base sequence : 292427
ttggcataggtgcttaatagatgcttccaaaaaagtgaccacaataatatctatgttcaggctgggcatggtggctcatgcctgtaatcccaacactttgggaggccgaggcaggcagatcacttgaggtcaggagttcgtgaccagcctggccaatatggcaaaaccctgtctctactaaaaatacaaaaaaaaaattagcctggtgtggtggtgcacacatgtagtcccagctacctgggaggctgaggcaagagaatcacttgaacccagaaggcagaggttgcagtgagctgagattgtgccactgcgttccagcctgtgcaacagagtgagactccatctctaaataaataaataaataaataaataaataaataaataaataaaatctatgttcatttgttagacaagttatgcagttccaaagtgtaaat

SEQ ID NO: 6876 - DNA, 217 bp, Homo sapiens
  chr4.fa.O7frz.51048794
  Located on chromosome 4
  Distance between a terminus base of telomere on chromosomal short arm and 5'-terminus of this base sequence : 49162689
  Distance between 3'-terminus of neighbour sequence of sequence listing upward to telomere on chrosomal short arm and 5'-terminus of this base sequence : 13427
agtgctactgcagtactccagcctgggcaaggcattgagactccatctcaaaaaaacaaacaaacaaataaaaaaaatatatatatatatatacacacacacacacacacacacacacacacatatatatataatatatataattgtccctcacatctaagaaatgttttttaattacccaatttggatctagcattcatgaaagtactcagaccag

SEQ ID NO: 6877 - DNA, 306 bp, Homo sapiens
  chr4.fa.O7frz.51222051
  Located on chromosome 4
  Distance between a terminus base of telomere on chromosomal short arm and 5'-terminus of this base sequence : 49258539
  Distance between 3'-terminus of neighbour sequence of sequence listing upward to telomere on chrosomal short arm and 5'-terminus of this base sequence : 95633
catcactgtttatccttgctaggtcaagcagatttcctttcctgttccttgaattccaactttcttacctgcagctgtccagatgaaaaattctggacagacaagagggaggaaagagtgactaaaagagaaaacaaaaattaaattctaaagcatgaagttctttaaaaggaaaattgtagataaagttggaaactaaaaaacatttaccaacatgaaaacttgcagtgtatttggtaatcacacacacacacacacacacacacacacacacacacacacaaagacttgaatgttgcctattaa

SEQ ID NO: 6878 - DNA, 343 bp, Homo sapiens
  chr4.fa.O7frz.51329177
  Located on chromosome 4
  Distance between a terminus base of telomere on chromosomal short arm and 5'-terminus of this base sequence : 49362612
  Distance between 3'-terminus of neighbour sequence of sequence listing upward to telomere on chrosomal short arm and 5'-terminus of this base sequence : 103767
tatcctatcattaggcctcattttgcaccactgaattgttttgtgttcagtctgtctgtgttctttctcaacaggccacaacaattaaaacagatctcaaacacaaacccaaagcagactgctgaaatggcatgtttagcaacaaaggaccaggcagacaaaaaaaatacacacacacacacacacacacacacacacacacacattaaatattattgagggataaaatatttcatcaaattaagaagacaaaatttagaacttgcggtcttcaacacatgcatagcactaaacctgtggctaacattcattgcattccctcacgacaatttgtatttagttt

SEQ ID NO: 6879 - DNA, 136 bp, Homo sapiens
  DISD22_0003652
  Located on chromosome 4
  Distance between a terminus base of telomere on chromosomal short arm and 5'-terminus of this base sequence : 49695612
  Distance between 3'-terminus of neighbour sequence of sequence listing upward to telomere on chrosomal short arm and 5'-terminus of this base sequence : 332657
gccaaagctgagacacagagagagagagagagggagtgtgtgtgtgtgtgtgtgtgtgtgtgtgtgtgtgtgtgtgtgtgtaaatatacaaacatacattacaggaactattaagattcatgagatatctccaccc

SEQ ID NO: 6880 - DNA, 451 bp, Homo sapiens
  chr4.fa.O7frz.51723597
  Located on chromosome 4
  Distance between a terminus base of telomere on chromosomal short arm and 5'-terminus of this base sequence : 49879662
  Distance between 3'-terminus of neighbour sequence of sequence listing upward to telomere on chrosomal short arm and 5'-terminus of this base sequence : 183914
gtaaatcagaagattcctgaactagggcacgccatgtactcctgaaagaggaggcaccttacaaagaacaggggcattaaatgaaaatgcacatgctaaaatttgagactgcaccccccccaacatccttcttaccccactgggcttccagaaagtttgaagcctgtgtatatgtgtgtgtataaatataaacagtccaaaggggtgtgtgtgtgtgtgtgtgtgtgtgtgtgtgtgtgtgtgttcacacacaccctctgcaggcaaatgactagaaagagttttctctagggaatctgataaatctaggagaaaagacctacagacgttggcatctctgaaatcatggtgcgacaaagcacacagacaacaagttccatatatacttatagaacttatatttttttaatattctactctttatgaaaagacagatctagaattggtaggc

SEQ ID NO: 6881 - DNA, 218 bp, Homo sapiens
  D4S3002
  Located on chromosome 4
  Distance between a terminus base of telomere on chromosomal short arm and 5'-terminus of this base sequence : 49926090
  Distance between 3'-terminus of neighbour sequence of sequence listing upward to telomere on chrosomal short arm and 5'-terminus of this base sequence : 45977
aattcttgtgtatctacggttttgctttctgtggtttacccaaggtcaaccatggtttgaaaatactaagactgtgtgtgcacgtgtgtgtgtgtgtgtgtgtgtgtgtgtgacaccacatgcatacagttttattacagtatattgttacaactgttctatttttatttatttatttttgagacagtctcgctctgtcacccaggctggatagagtg

SEQ ID NO: 6882 - DNA, 370 bp, Homo sapiens
  AC068037.2_131625
  Located on chromosome 4
  Distance between a terminus base of telomere on chromosomal short arm and 5'-terminus of this base sequence : 49993958
  Distance between 3'-terminus of neighbour sequence of sequence listing upward to telomere on chrosomal short arm and 5'-terminus of this base sequence : 67650
caaacaattcaaggagactcttagctgatgatactcctgcatctcctcatttctcatttctccacatagtaaccagaatgatcttttaaaaatatagccaggcatggtagctcacacctgtaatcacaatactttgggaggccaagacaggaggactgtttgaacccaggagtttgagaccagcccaggcaatatagtaagaccccaactctacaaaaaaaaaaataaataaaataataataataataataataataataacaaaaaaaattaggtgggtgtggtggcacacacctgtaatcccagctacttgggaggttgagacaggagggctgcttgagcccaggaggtccagacgttagtaagccat

SEQ ID NO: 6883 - DNA, 467 bp, Homo sapiens
  AC020593.4_38448
  Located on chromosome 4
  Distance between a terminus base of telomere on chromosomal short arm and 5'-terminus of this base sequence : 50203172
  Distance between 3'-terminus of neighbour sequence of sequence listing upward to telomere on chrosomal short arm and 5'-terminus of this base sequence : 208844
ctatgattggtaggtgtggttaacagtgcctgtgggggccgggcgaggtggctcacgcctgtaatcccagcactttgggaggccgaggcaaggcgcctgtaatcccagctactccggaggccgaggcactagaattgcttgaacacaggaggtggatgttgccgtgagccaagttcgtgccattgcactccagcctgggcaacaagagtgaaactccgtctcaaaacaacaacaacaacaacaacaacaacaacaacaacaacaacaaaacaaaaacaaaaaacaacagtgcctgtgagtgccaccttgtcttcaattttttccgctcaatgtccagatcttcctgactgctggccctactgaccagccatgaaccaggcccaccataagatgctctgctgtgagctcacagaggcggaagccacaaagagccttccatagacttctatgccagcactttcatagtt

SEQ ID NO: 6884 - DNA, 297 bp, Homo sapiens
  HUMUT5941
  Located on chromosome 4
  Distance between a terminus base of telomere on chromosomal short arm and 5'-terminus of this base sequence : 50225517
  Distance between 3'-terminus of neighbour sequence of sequence listing upward to telomere on chrosomal short arm and 5'-terminus of this base sequence : 21878
tgttatgtgaagggcaggtaagcacttttagtgcaaaaagccagaattttcttttcttttccttttccctttcctttcctttcctcttctctcctctcctttccttccttcctccttcctctttcctccttcctccttccttcttcctccttcccttcccttctcctccctccctccctccctccctccctccctcccttccttccttccttccttccttcctcccctcttctattttcagacaaagtctcactctgttgcctaagttggagtgtagttgctcaatcttggctctac

SEQ ID NO: 6885 - DNA, 189 bp, Homo sapiens
  DISO7_10016011
  Located on chromosome 4
  Distance between a terminus base of telomere on chromosomal short arm and 5'-terminus of this base sequence : 53387053
  Distance between 3'-terminus of neighbour sequence of sequence listing upward to telomere on chrosomal short arm and 5'-terminus of this base sequence : 3161239
ttggtgttgagccatttgtttgttaggagtctttctctctctctctctctctctctctctctctctctctctctctcttttcttttcttctttcttttttttttcttttttttttttttgctgtaaatctgtttgcaaggggtaatatcttaactcatctatatttctcccctaaccgagaacagcaag

SEQ ID NO: 6886 - DNA, 234 bp, Homo sapiens
  AC068526.2_77397
  Located on chromosome 4
  Distance between a terminus base of telomere on chromosomal short arm and 5'-terminus of this base sequence : 53568827
  Distance between 3'-terminus of neighbour sequence of sequence listing upward to telomere on chrosomal short arm and 5'-terminus of this base sequence : 181585
acctaatgctagatgacgagttagtgggtgcagcgcaccagcatggcacatgtatacatatgtaactaacctgcacattgtgcacatgtaccctaaaacttaaagtataataataataataataataataataataaagaaaaaaaaacaaaaacaaaaaaacaaaaaaaaagtgacagaagaaattatttttaagctcctaattgtgtactctttatgctctaagcatttcac

SEQ ID NO: 6887 - DNA, 121 bp, Homo sapiens
  D4S1577
  Located on chromosome 4
  Distance between a terminus base of telomere on chromosomal short arm and 5'-terminus of this base sequence : 53746171
  Distance between 3'-terminus of neighbour sequence of sequence listing upward to telomere on chrosomal short arm and 5'-terminus of this base sequence : 177110
cactggagatacactttaaaaatggtatagaaaaatagcatgtatgtgtgtgtgtgtgtgtgtgtgtgtgtatatatatatataaaacaaatatgaccaagtgggtaggtatataattgct

SEQ ID NO: 6888 - DNA, 382 bp, Homo sapiens
  AC022904.3_64616
  Located on chromosome 4
  Distance between a terminus base of telomere on chromosomal short arm and 5'-terminus of this base sequence : 53857254
  Distance between 3'-terminus of neighbour sequence of sequence listing upward to telomere on chrosomal short arm and 5'-terminus of this base sequence : 110962
attagacctatcggacctttctagattcaagcatccctgagaatcaacttcctcttcctcatgagacagaagacaaaatctcatggtattttcaccttgataaagtacttttaccaagcccgtattttaaacattatttctttatagtatgtgtatatatattaaaaaatagacccactgttgtatttaatcatctattaatttttctttcttttttttcttttttttcagattgtgatttaggtctattctattattattattattattattattattatacttaaagttttagggtacatgtgcacaatgtgcaggttacatatgtatacatgtgccatgctggtgtgctacacccattaactcatcgtttagcattagg

SEQ ID NO: 6889 - DNA, 261 bp, Homo sapiens
  DISO7_10016021
  Located on chromosome 4
  Distance between a terminus base of telomere on chromosomal short arm and 5'-terminus of this base sequence : 54007345
  Distance between 3'-terminus of neighbour sequence of sequence listing upward to telomere on chrosomal short arm and 5'-terminus of this base sequence : 149709
ttcaacaaatatccatgcatcaagtggcaggactgcctctaaaatgtcccccaaccatctctgcctcctggtacttatatattctcctacacttgagtgtaggctgggcctagtgacttgcttttggcaacaagagtgcagctaaagtgatggcatgtcacttacaagattggtagcttataaaagactaacttctctactgttcgcattctctctctctctctctctctctctctgtctgtctttctctgtatcttcttg

SEQ ID NO: 6890 - DNA, 132 bp, Homo sapiens
  DISO7_10016038
  Located on chromosome 4
  Distance between a terminus base of telomere on chromosomal short arm and 5'-terminus of this base sequence : 54210389
  Distance between 3'-terminus of neighbour sequence of sequence listing upward to telomere on chrosomal short arm and 5'-terminus of this base sequence : 202783
tgtttcaagtagaatcaagattctgtttttttttttaatctgtaatcttgactagaggtcacttgtttgattttgcatgtgtgtgtgtgtgtgtgtttgtgtgtgttgccaatacactaagttcctaacttt

SEQ ID NO: 6891 - DNA, 217 bp, Homo sapiens
  DISD22_0003661
  Located on chromosome 4
  Distance between a terminus base of telomere on chromosomal short arm and 5'-terminus of this base sequence : 54303590
  Distance between 3'-terminus of neighbour sequence of sequence listing upward to telomere on chrosomal short arm and 5'-terminus of this base sequence : 93069
aatggaattatttaaccagatcatctagctttataaacatgaatacacttactttttataactaaggtgccaaaaatatttcaaataaaaacatataaaacatttttaagttatttttatgagctgccttttagattgtcttattgcaaaaattttagacacacacacatgcacacacacacacacacacacaacaaccaactaaacctgtcatatg

SEQ ID NO: 6892 - DNA, 296 bp, Homo sapiens
  HUMUT884B
  Located on chromosome 4
  Distance between a terminus base of telomere on chromosomal short arm and 5'-terminus of this base sequence : 54521275
  Distance between 3'-terminus of neighbour sequence of sequence listing upward to telomere on chrosomal short arm and 5'-terminus of this base sequence : 217468
agggggaaatatatgagaagccatttttagcaactacagcccctatcacaatacacacacacacacacacacacacacgcaagcacatatgcacacacattcttcggactctggtcttctgctctctcttcatcttagaatttcacatattccattccaaatacaaacctcctctacctgtgagtcacagaaaagataaagaggggagataaaggctgagaataaaggggactttgccctgggtaactagacagtagagcctactgagaaatgggcagcagatttagagttgtggg

SEQ ID NO: 6893 - DNA, 145 bp, Homo sapiens
  D4S2971
  Located on chromosome 4
  Distance between a terminus base of telomere on chromosomal short arm and 5'-terminus of this base sequence : 54531342
  Distance between 3'-terminus of neighbour sequence of sequence listing upward to telomere on chrosomal short arm and 5'-terminus of this base sequence : 9771
ggtaatgaaaatcaagcccaagaaactaaatgattcaaagcaaaattccccttgacagcttttgtcatgtctctgtgtgtgtgtgtgtgtgtgtgtgtgtgtgtgtatgttaaactagtactttagcctacatcattattttacc

SEQ ID NO: 6894 - DNA, 217 bp, Homo sapiens
  chr4.fa.O7frz.56535235
  Located on chromosome 4
  Distance between a terminus base of telomere on chromosomal short arm and 5'-terminus of this base sequence : 54635678
  Distance between 3'-terminus of neighbour sequence of sequence listing upward to telomere on chrosomal short arm and 5'-terminus of this base sequence : 104191
tagacaatggtatcagttcagatcccatcttgcaatggaaaaagcctcgcagaaatgacattaattacatgattcctaatctgaaaggcaaaatgtatggtggtgactaaatgaataaaacaaaacacaaacacacacacacacacacacagtgctgttgccatctatttcataatgatcattcactcagacagcatgtattgaacaccgtctacat

SEQ ID NO: 6895 - DNA, 476 bp, Homo sapiens
  chr4.fa.O7frz.56746857
  Located on chromosome 4
  Distance between a terminus base of telomere on chromosomal short arm and 5'-terminus of this base sequence : 54828326
  Distance between 3'-terminus of neighbour sequence of sequence listing upward to telomere on chrosomal short arm and 5'-terminus of this base sequence : 192431
ctaagcagtactggataaagctaaaaccttaatctcatgcttactcagcagcaaaaagaaaaagcaaagcaaacattaattatggaagatttagtgatctgtatggttatagttgtagaaacacttccaatctgtgtttacccacgctgtaactcattgctttctgcaaatttaaagaaaccttttgcctgacagttcaaatgcttggttacagctaagggaacaatagttcaaccactttgaaaataggctagaggacaaagtcctcacacttcaaaactggtgtgtgtgtgtgtgtgtgtgtgtgtgtgtgtgtgtgtgtgtgtgtttagtggctttccaacttcataataaatctacgaaagggccaacttcataagggagccagtctgaatacaaatatatttagccccatcctccctacatggcaaggaaggagcaggcacatcactatgtaactagattgcacgttcatt

SEQ ID NO: 6896 - DNA, 390 bp, Homo sapiens
  chr4.fa.O7frz.57287848
  Located on chromosome 4
  Distance between a terminus base of telomere on chromosomal short arm and 5'-terminus of this base sequence : 55180403
  Distance between 3'-terminus of neighbour sequence of sequence listing upward to telomere on chrosomal short arm and 5'-terminus of this base sequence : 351601
ttattggcaattacagcttaagagtcctgaccaacacacacacacacacacacacacacacacacaaacacatgcacacacagaaaacaacacgagaaaacttagaaaaccaaaacttaggcactgaactgacacaatctaggagataagggcactggagctggagctggactgagaaacacaatagctaccttcccccaggcattaacttcagagacaggaggacagaatctgcctgggagcaggcagtggggacggcagcatagttgaggagacaaggtacttctaattttccctagtccagagaactagaggccattgcaacagaaaaactgggtaacgtgggtgctgatttttaaggcaaccaagctactgctttacattcacata

SEQ ID NO: 6897 - DNA, 446 bp, Homo sapiens
  chr4.fa.O7frz.57177106
  Located on chromosome 4
  Distance between a terminus base of telomere on chromosomal short arm and 5'-terminus of this base sequence : 55304199
  Distance between 3'-terminus of neighbour sequence of sequence listing upward to telomere on chrosomal short arm and 5'-terminus of this base sequence : 123406
ctactgtggaatgaaacaaagtctgtgtgtgaatgtgttttaaatgacgataaagaataatgtcacataaacccagttactgttagtgggaatacttacatttttactgacctgtctggcaagtcattttcatttgtgaaagtaaagaagcttttaatgaaggccactgcagaaaaaaatagggtataaagagcgcaaatgccctgaggcctttctagtgttttgaaaaagatacctagatatttccatcttttagactctcctcaatttgatgtgtgtgtgtgagagagagagagagagagagagagagagagagacagagaaagagataggggtgagagctggaggctgagtgggcagaggtgaagtttttttttaaattgtatgagattctacctggtggaggaaccgggccatcttacctttgctgtattgcggatcagttc

SEQ ID NO: 6898 - DNA, 308 bp, Homo sapiens
  chr4.fa.O7frz.57070751
  Located on chromosome 4
  Distance between a terminus base of telomere on chromosomal short arm and 5'-terminus of this base sequence : 55451220
  Distance between 3'-terminus of neighbour sequence of sequence listing upward to telomere on chrosomal short arm and 5'-terminus of this base sequence : 146575
cagatactcagagattcacttgagcccaagaggcagaggttgcagtgagccaagatcaagccactgcactccattctcggtgacagagtgagcccccatctcaaaaaaaaaaaaaaaaatatatatatatatatatatatatatatgcatgcaataatggcacacctaaatatataaagcaaatatttaaaaatctgaaggagatatagactgcaatagaataatagtgtaggggacttcaatataccacttttggtaatggacaaatcatgcagagagaaaataaacaagtaaacatcggacttaaa

SEQ ID NO: 6899 - DNA, 359 bp, Homo sapiens
  AC069068.9_133208
  Located on chromosome 4
  Distance between a terminus base of telomere on chromosomal short arm and 5'-terminus of this base sequence : 55586408
  Distance between 3'-terminus of neighbour sequence of sequence listing upward to telomere on chrosomal short arm and 5'-terminus of this base sequence : 134880
ggcacattaatgtaccaaatctacaaatgcactccactgctttcttttttgttgttttttgatttttttgttttgttttgttttacagccagaggtcttttattttattttattttattttattttattttattttattttattaacacctatgatgccatgaattcacagggaataggttccagcagctcaggctccttcccacaagctttcacaaagtgcgcttctctgggtggagcaggctggtgcttcacttgaacccaggtaccttcctctttggcttctttctttttctgatcattttccttcacacatttcaggaagctatctcggctcttacagtgcttaatgtgctcaat

SEQ ID NO: 6900 - DNA, 243 bp, Homo sapiens
  D4S1594
  Located on chromosome 4
  Distance between a terminus base of telomere on chromosomal short arm and 5'-terminus of this base sequence : 55612584
  Distance between 3'-terminus of neighbour sequence of sequence listing upward to telomere on chrosomal short arm and 5'-terminus of this base sequence : 25817
gttctacctaagagtcactcaggttaagaagaggttgagatatactagccaataaagtagaaaagaaagaaatttgaaaagtatgaattcaaaaagtagacatattcagaaaaaaaatcacataaatataagaaaaaattaaaaatagggaagaaacaccatagtaaggccagtgtgtgtgtgtgtgtgtgtgtgtgtgtgtgtgtttgtgtgttgtaggtggagatggcagtgggagaacat

SEQ ID NO: 6901 - DNA, 480 bp, Homo sapiens
  chr4.fa.O7frz.57509713
  Located on chromosome 4
  Distance between a terminus base of telomere on chromosomal short arm and 5'-terminus of this base sequence : 55675660
  Distance between 3'-terminus of neighbour sequence of sequence listing upward to telomere on chrosomal short arm and 5'-terminus of this base sequence : 62833
gttaagtgatattccattatgcacacacacacacacacacacacacacacacacacactccacatcacattttctttattgagaggacagattaatcatccaggaaatgtaaaccaaaatcacaatgagggttgggggtagtggctcacacctgtcatcccggcactttgggaggctgagacaggggcattacttgaggccaggatttcgagaccagcctggccaatatggtgaaaccctacctctactaaaaataaaaaatatatacaaaaattagccagtcatggtggcacacacctgtagtcccagctactcgggtggctgaagcacaagaattgctcgaatctggaagacagaggcttcagtgagcctagatcacgccactgccctccagcctgggtgacagagcaagactccatctccaaaacacacacacacacacacacacacacacacagtgagatatcaccttacaactgt

SEQ ID NO: 6902 - DNA, 155 bp, Homo sapiens
  DISD22_0003667
  Located on chromosome 4
  Distance between a terminus base of telomere on chromosomal short arm and 5'-terminus of this base sequence : 55924015
  Distance between 3'-terminus of neighbour sequence of sequence listing upward to telomere on chrosomal short arm and 5'-terminus of this base sequence : 247875
ttgtattagctgcaccatttcaaataggggactcaagtctctagtgagagggaggcaaggggagagaggagagagaagacaagagagagagagagagagagagagagagagagagagagagagagagaatgtagtaatatttagcctgtgagcac

SEQ ID NO: 6903 - DNA, 146 bp, Homo sapiens
  D4S1630
  Located on chromosome 4
  Distance between a terminus base of telomere on chromosomal short arm and 5'-terminus of this base sequence : 56001782
  Distance between 3'-terminus of neighbour sequence of sequence listing upward to telomere on chrosomal short arm and 5'-terminus of this base sequence : 77612
caacatcttcatttgaatgtcaaatagttgatctatctatctatctatctatctatctatctatctatctatctattatctatctgttatctatctatctatcagctatatatatctgttttagagatggggtctcactacattgc

SEQ ID NO: 6904 - DNA, 431 bp, Homo sapiens
  AC025013.6_158931
  Located on chromosome 4
  Distance between a terminus base of telomere on chromosomal short arm and 5'-terminus of this base sequence : 56057522
  Distance between 3'-terminus of neighbour sequence of sequence listing upward to telomere on chrosomal short arm and 5'-terminus of this base sequence : 55594
tcacagatcctcttgctattctgcagagaatatgttgctgtctatttggtgtgtggtttccgctgctcctttcttcctaaaatttcagcggaggctcttcttacttcactatgttgaagatactgactaaaaagaaaatggcgcactgctttccaattgaatgagcagattttttcagtgtctgggaaaacaataaaatcctcttctcttctcttctcttctcttctcttctctctctcttcctctctctctctctctctctctgacaggatctgtcacccaggctggagtgcagtggtgtgatcacagctcactgccgccttgaactcctgggctcaagcgattctcctgccttagcctcccaaagtggtgggtttacaggcgtgaggacagtgcccagccaaaaatctcactatttcagaatggagctt

SEQ ID NO: 6905 - DNA, 244 bp, Homo sapiens
  D4S2996
  Located on chromosome 4
  Distance between a terminus base of telomere on chromosomal short arm and 5'-terminus of this base sequence : 56109351
  Distance between 3'-terminus of neighbour sequence of sequence listing upward to telomere on chrosomal short arm and 5'-terminus of this base sequence : 51398
gttgcttttacggaatccatatcagtaggttaagaaaacatccattgtccatattaaagaattgtgtctctgtgtgtgtgtgtgtgtgtgtgtgtgtgtgtgtgtgtgtgtgtatttatgtatgtcgataggagagaaatggaacatagggcaaaatccttgaaagcccccccttggtgccagcaacctccatcagagagacctgataatttatgaatcagaaatagccccaaataccctgagt

SEQ ID NO: 6906 - DNA, 226 bp, Homo sapiens
  G08377
  Located on chromosome 4
  Distance between a terminus base of telomere on chromosomal short arm and 5'-terminus of this base sequence : 56259265
  Distance between 3'-terminus of neighbour sequence of sequence listing upward to telomere on chrosomal short arm and 5'-terminus of this base sequence : 149670
gtagccctctgtctcagggtccccaggtcttctgagaaaaagagagttaccctcaggaacagttagactaatgagctcagagttgagaagaaaggaaaggatgataggtaggcagatagatgatagatagatagatagtagatagatagatagatagatagatagatagatagatagatagttgtagatagatagaggtgatagcccatttacttgctattatttg

SEQ ID NO: 6907 - DNA, 345 bp, Homo sapiens
  AC006552.7_56687
  Located on chromosome 4
  Distance between a terminus base of telomere on chromosomal short arm and 5'-terminus of this base sequence : 56259321
  Distance between 3'-terminus of neighbour sequence of sequence listing upward to telomere on chrosomal short arm and 5'-terminus of this base sequence : -170
gaacagttagactaatgagctcagagttgagaagaaaggaaaggatgataggtaggcagatagatgatagatagatagatagtagatagatagatagatagatagatagatagatagatagatagttgtagatagatagaggtgatagcccatttacttgctattatttgagattctttgaacagtgagcaaagcctttcgttttgccattagaagtaaaaaagattaacatgcaaattcctgagagaaacacacattgacaagatagagtttggggcaaagtatacatgataatagtggattctttcccattttggaagggaaacgaggtagaaggttataaga

SEQ ID NO: 6908 - DNA, 358 bp, Homo sapiens
  AC006552.7_133546
  Located on chromosome 4
  Distance between a terminus base of telomere on chromosomal short arm and 5'-terminus of this base sequence : 56336190
  Distance between 3'-terminus of neighbour sequence of sequence listing upward to telomere on chrosomal short arm and 5'-terminus of this base sequence : 76524
aaatggaacaatagtgcactatagtcccgtggtgcagagggaggcagcagtgtggaggtttgcctgggttctttctattctattctattctattctattctattctattctattctattctattctattctattctattctatttttctttttctttttttttttgagacgaagtctcgctttgttgcccaggctggagtgcagtggtgtgatctctgctcactgcaacctccatctcccgggttcaaacaattctcctgcctcagcctcccgagtagctgggattacaggcgcctaccacaatacccagctaatttttgtatttttagtagagatggagtttcaccatgttggctag

SEQ ID NO: 6909 - DNA, 195 bp, Homo sapiens
  D4S428
  Located on chromosome 4
  Distance between a terminus base of telomere on chromosomal short arm and 5'-terminus of this base sequence : 56456725
  Distance between 3'-terminus of neighbour sequence of sequence listing upward to telomere on chrosomal short arm and 5'-terminus of this base sequence : 120177
ccagcatttggactctaaagaaatgctccatatgcatttgaaaagtacatgtattctacagttgtgtgtgtgtgtgtgtgtgtgtgtgtgtgtgtgtgtgtgtgtaggtcaatgtatctatttatacatttatttatatctatttatatttataaattaggtaaatgttattagtagtgttgttcgagcctctta

SEQ ID NO: 6910 - DNA, 242 bp, Homo sapiens
  DISO7_00016608
  Located on chromosome 4
  Distance between a terminus base of telomere on chromosomal short arm and 5'-terminus of this base sequence : 56545488
  Distance between 3'-terminus of neighbour sequence of sequence listing upward to telomere on chrosomal short arm and 5'-terminus of this base sequence : 88568
aaggatctatgggagcattctccctggaggaggcagaaaaagcttctcagaaggatgagctcaccagaatgactgggggagagagagagagagagagagagagaagcaacagcagcatgggcaaaggcatggcactgccagtagtctaccatgactggaatataaggttggagggtagatggcctgggaaggtagagaaatagtcaagaaccatgtgtgctgtgcttaggagcttcagcttg

SEQ ID NO: 6911 - DNA, 362 bp, Homo sapiens
  D4S2379
  Located on chromosome 4
  Distance between a terminus base of telomere on chromosomal short arm and 5'-terminus of this base sequence : 56928687
  Distance between 3'-terminus of neighbour sequence of sequence listing upward to telomere on chrosomal short arm and 5'-terminus of this base sequence : 382957
tcaggaggctgagatgagaggattgcttgagcctgggaggttgaggttgcaatgagcctcactgcacttcagcctaggtgacagagtgagaccctgtcgaaagaaaagacaaagagagagaaagaaagaaaaagaaagaaggaaggaaggaaggaaggaaggaaggaaggaaggaaggaaggaaagaaggaaggaagggagggagggagacaaaaaaggaaaaagtatgggagactggtctttgttcagtccccatcacttacttccccacctgtttaatgaatgaatttgagaaaggaaattgaaaccataaggctcagtagattctgggctgttgcttttacaggaaaggctggagttct

SEQ ID NO: 6912 - DNA, 462 bp, Homo sapiens
  AC053519.2_151845
  Located on chromosome 4
  Distance between a terminus base of telomere on chromosomal short arm and 5'-terminus of this base sequence : 56973378
  Distance between 3'-terminus of neighbour sequence of sequence listing upward to telomere on chrosomal short arm and 5'-terminus of this base sequence : 44329
tttaagttaacctcagtcatgaagaatgcaaaccaggtgatggtttcaatgcctaaggacagtgaagtctggagcccaaagtacagtttcagcaaagctgtttgaaactctccattccatttctataccccacaagttttcactgaatgagcatggcagtgccactcaagaaaatgaatctccaaagtatcttcaaagaataaatactaatggcagatctgcgatttctgggtccactttctgagatgctttctaaaaccaaccaactgataaaaagtagatgagacttctccaagctgcttcacaagcaaactaaccgaaaaaccgaaaatatacaaacagcttcacacacacacacacacacacacacacacacacacacacacaaaggaagatcatcaatggctgcggtagcctagtaggaatggactatataataatatagcaggtgctcaataactg

SEQ ID NO: 6913 - DNA, 227 bp, Homo sapiens
  DISO7_10825117
  Located on chromosome 4
  Distance between a terminus base of telomere on chromosomal short arm and 5'-terminus of this base sequence : 57197360
  Distance between 3'-terminus of neighbour sequence of sequence listing upward to telomere on chrosomal short arm and 5'-terminus of this base sequence : 223520
taacagctgcctgtgcagtcttaacctcattaaacaggttttcaacaatccagtcctaaaaaaatgttcattttgtacactttcatgagaaacaaccagacacacacacacacacacacacacacacacacaccccaatttacctttcactggggttcatgtttgatttcctcaaaagaaagaaaagtttcccaacctgaaaagcaaactaacctagacaatcaagt

SEQ ID NO: 6914 - DNA, 112 bp, Homo sapiens
  DISO7_10016064
  Located on chromosome 4
  Distance between a terminus base of telomere on chromosomal short arm and 5'-terminus of this base sequence : 57363403
  Distance between 3'-terminus of neighbour sequence of sequence listing upward to telomere on chrosomal short arm and 5'-terminus of this base sequence : 165816
cccgaattaataagaacaataatgttatacatttaatatgcaacattttatatatatatatatatatatatatatatattataataataataatgtaggaccaggacctgga

SEQ ID NO: 6915 - DNA, 145 bp, Homo sapiens
  D4S1619
  Located on chromosome 4
  Distance between a terminus base of telomere on chromosomal short arm and 5'-terminus of this base sequence : 57446312
  Distance between 3'-terminus of neighbour sequence of sequence listing upward to telomere on chrosomal short arm and 5'-terminus of this base sequence : 82797
gactttacaaggttgcttcatatatgtttatgtgtgtgtgtagtcttgtgtgtgtgtgtgtgtgtgtgtgtacagagagaaagagagattcattatttttacattgtcttctaggatttttactgtattcttgcacagagagcac

SEQ ID NO: 6916 - DNA, 303 bp, Homo sapiens
  AC016812.4_77009
  Located on chromosome 4
  Distance between a terminus base of telomere on chromosomal short arm and 5'-terminus of this base sequence : 57526436
  Distance between 3'-terminus of neighbour sequence of sequence listing upward to telomere on chrosomal short arm and 5'-terminus of this base sequence : 79979
acatggtgaaaccctgtatctacagaaaatgcaaaattagccgggagcggtggcacatgcctgtagtcccagctactcaggaggctgaggcagaaggactgcttgagcccaggaagttgaggctgcagtgagctgtgatcacatcactgcattccagcctgggtgtcagagtgagaccctgcctaaaaaaacaaaaacgaaaacaaaaacaaaacaaaacacaatacaacaacaacaacaacaaaaaccctatggtaagttttaaattttaagatggtactttagaatgctagttcaccatct

SEQ ID NO: 6917 - DNA, 109 bp, Homo sapiens
  DISO7_10016068
  Located on chromosome 4
  Distance between a terminus base of telomere on chromosomal short arm and 5'-terminus of this base sequence : 57661160
  Distance between 3'-terminus of neighbour sequence of sequence listing upward to telomere on chrosomal short arm and 5'-terminus of this base sequence : 134421
gatctggtgtaggtgagggagtgtgtgtgtgtgtgtgtgtgtgtgtgtgtgtgtgtgtgtgtattgggggtggtaagtggtggtggtggagagggagtggttagaatac

SEQ ID NO: 6918 - DNA, 269 bp, Homo sapiens
  D4S2978
  Located on chromosome 4
  Distance between a terminus base of telomere on chromosomal short arm and 5'-terminus of this base sequence : 57661160
  Distance between 3'-terminus of neighbour sequence of sequence listing upward to telomere on chrosomal short arm and 5'-terminus of this base sequence : -109
gatctggtgtaggtgagggagtgtgtgtgtgtgtgtgtgtgtgtgtgtgtgtgtgtgtgtgtattgggggtggtaagtggtggtggtggagagggagtggttagaatacaaaggataaggcagttttagaaaaagattcttagtaaatatcctgtggcaaatttttgattcattaagttgtgagttaaatcaatgtttcctttaaaaatcacctatagtaattgtggaattatataaaaaatggctcacagttctttggcattgtttgt

SEQ ID NO: 6919 - DNA, 209 bp, Homo sapiens
  DISO7_10016072
  Located on chromosome 4
  Distance between a terminus base of telomere on chromosomal short arm and 5'-terminus of this base sequence : 57799506
  Distance between 3'-terminus of neighbour sequence of sequence listing upward to telomere on chrosomal short arm and 5'-terminus of this base sequence : 138077
cagctcatttgtatctgtctagcctctctctctctctctctctctctctatctctctatttctctctctctctctctctctctctctcacacacacacacacacacacacacagagagagagagagagagagagaggggttaacattttccacctggcttataatttttggtaaatatgtcatatcccctactaagtgaccacctcctt

SEQ ID NO: 6920 - DNA, 162 bp, Homo sapiens
  DISO7_10016075
  Located on chromosome 4
  Distance between a terminus base of telomere on chromosomal short arm and 5'-terminus of this base sequence : 57876277
  Distance between 3'-terminus of neighbour sequence of sequence listing upward to telomere on chrosomal short arm and 5'-terminus of this base sequence : 76562
actgagcagtgtactcaggggtatagaggaggggtgtgtgtgtgtgtgtgtgtgtgtgtgtgtgtgtgtgtgtatgaaatatatggtaccaaagaaaagaaaacatgttttaaagaaataatgaaggctgtttcccaaagtgtgttcacaggaaccctagtc

SEQ ID NO: 6921 - DNA, 153 bp, Homo sapiens
  D4S3000
  Located on chromosome 4
  Distance between a terminus base of telomere on chromosomal short arm and 5'-terminus of this base sequence : 57996202
  Distance between 3'-terminus of neighbour sequence of sequence listing upward to telomere on chrosomal short arm and 5'-terminus of this base sequence : 119763
tagaaagtcccccatatacctcaagttcttgacacttctcacacacacacacacacacacacacacagttggggggggtgaaagcagggaatgcatttaagttaccccaatacaaactggctcatatagaaaatgggcaaaaacaggctaaat

SEQ ID NO: 6922 - DNA, 425 bp, Homo sapiens
  chr4.fa.O7frz.60145477
  Located on chromosome 4
  Distance between a terminus base of telomere on chromosomal short arm and 5'-terminus of this base sequence : 58051683
  Distance between 3'-terminus of neighbour sequence of sequence listing upward to telomere on chrosomal short arm and 5'-terminus of this base sequence : 55328
gtctttgatgccacgatagcttggggtgtgtgtacgtgcgtgtgcgtgtttaagtagtctttgatgtcatgggtgtgtatgtgtgtgcgcgcgcgtgttgaagtagtctgattccatgatggctggggaggggggctgtttttaggtagtctttgatgccatgatggtgtgtgtgtgtgtgtgtgtgtgtgtgtgtgtgtgtgtgtgttcgttccagtagtctttgatgccacgatggctttgaagaactccaaaacctttaggcaaaaaagttgcactatcaggaaagattgttcttgctatttatgctggaaaaaaacaaatgctggttttttccacacacccagttgctatatgtatagtgaggcaaattgcttttgtggctgctgggtacattcttttccacatagaaagtaactgaattc

SEQ ID NO: 6923 - DNA, 178 bp, Homo sapiens
  HUMUT5228
  Located on chromosome 4
  Distance between a terminus base of telomere on chromosomal short arm and 5'-terminus of this base sequence : 58117252
  Distance between 3'-terminus of neighbour sequence of sequence listing upward to telomere on chrosomal short arm and 5'-terminus of this base sequence : 65144
ttgggtcagctgaatggtctctgtgctcctggagttcctgagctggctccttggcttagagctgcgctctggttctaaacaattatgaatgattaacacagttgtgtgtgtgtgtgtgtgtgtgtgtgtgtgtgtgtgtgtgtgtgtgttcttttttgagacagggtcttactctgcc

SEQ ID NO: 6924 - DNA, 157 bp, Homo sapiens
  HUMUT614
  Located on chromosome 4
  Distance between a terminus base of telomere on chromosomal short arm and 5'-terminus of this base sequence : 58117277
  Distance between 3'-terminus of neighbour sequence of sequence listing upward to telomere on chrosomal short arm and 5'-terminus of this base sequence : -153
ctcctggagttcctgagctggctccttggcttagagctgcgctctggttctaaacaattatgaatgattaacacagttgtgtgtgtgtgtgtgtgtgtgtgtgtgtgtgtgtgtgtgtgtgtgttcttttttgagacagggtcttactctgcctctc

SEQ ID NO: 6925 - DNA, 252 bp, Homo sapiens
  D4S3019
  Located on chromosome 4
  Distance between a terminus base of telomere on chromosomal short arm and 5'-terminus of this base sequence : 58285648
  Distance between 3'-terminus of neighbour sequence of sequence listing upward to telomere on chrosomal short arm and 5'-terminus of this base sequence : 168214
acccaggtccccaattacttgaaagggctgccgaaagcaataaagatcaagcaagggggcaagtgggaggaagcagagaagcagagaaaagagcctatagccagaagacacaatggctcgtgtgtgtgtgtgtgtgtgtgtgtgtgtgtgtgtgtgtcttacgcctgtaatctcagcattttgagaggccgagataggaggatcacttaagcccaggagttcaagaccagcctgggcaacatagagcgacct

SEQ ID NO: 6926 - DNA, 256 bp, Homo sapiens
  AC022483.4_175054
  Located on chromosome 4
  Distance between a terminus base of telomere on chromosomal short arm and 5'-terminus of this base sequence : 58297673
  Distance between 3'-terminus of neighbour sequence of sequence listing upward to telomere on chrosomal short arm and 5'-terminus of this base sequence : 11773
gtgaagtgagctctgtgctaagtgccaaggatattcttgttgattctacatcagggaaaataatctccagcacatctcaatatagattagcaggactttagtgctagagcttgaaaagcaatgggtaaataataataataataataatatgtccccgggttccccttacagttttcacagaggatgaaactggactgccgtgaaatgtcccttcactacactgaagacacaactgcagatacaagaataaatcacc

SEQ ID NO: 6927 - DNA, 397 bp, Homo sapiens
  AC055850.4_71317
  Located on chromosome 4
  Distance between a terminus base of telomere on chromosomal short arm and 5'-terminus of this base sequence : 58323819
  Distance between 3'-terminus of neighbour sequence of sequence listing upward to telomere on chrosomal short arm and 5'-terminus of this base sequence : 25890
ttgttagactaatgcttatcctcagccacttctctacccaattaactcagcccaagcccctctgccatgtcacactttcataattcactactctttgtctaattcagcatataatgttcaactctgtgtctttgagcgtttatttatttatttatttatttatttatttttgagacagagtctcgctctgctgcccaggctggagtgcagtggtgtgatttcagctcactgcaacctccgcctcctgggttcgagcgattgtcctgcctcagcctcccgagtagctgggactacaggcatgtgccaccacacccagttaatttttgtatttttaggagagacgaggtttcaccatgctggccaggatggtcttgatctcttgagctcatgatacgcc

SEQ ID NO: 6928 - DNA, 119 bp, Homo sapiens
  DISO7_10001434
  Located on chromosome 4
  Distance between a terminus base of telomere on chromosomal short arm and 5'-terminus of this base sequence : 58476710
  Distance between 3'-terminus of neighbour sequence of sequence listing upward to telomere on chrosomal short arm and 5'-terminus of this base sequence : 152494
agtaagacagcaagggcacagcacattacacacacacacacacacacacacacacacacacactgctctgagacaaatgctcagggagaaattatatatggtagaattcaaaggaagcc

SEQ ID NO: 6929 - DNA, 203 bp, Homo sapiens
  chr4.fa.O7frz.60862883
  Located on chromosome 4
  Distance between a terminus base of telomere on chromosomal short arm and 5'-terminus of this base sequence : 58753071
  Distance between 3'-terminus of neighbour sequence of sequence listing upward to telomere on chrosomal short arm and 5'-terminus of this base sequence : 276242
tctaagcttggtatgtgctaacattttcatgaatttgtgtgtatatgtatatatttataatagataaatcttcccttttgattttcccttataaaagcacatggggtagagtggaggggaagagagagtaagagagttaagagagacagtgagagagagagagagagagagagagagagagaaagactttaatctaggagacc

SEQ ID NO: 6930 - DNA, 440 bp, Homo sapiens
  chr4.fa.O7frz.60936004
  Located on chromosome 4
  Distance between a terminus base of telomere on chromosomal short arm and 5'-terminus of this base sequence : 58826164
  Distance between 3'-terminus of neighbour sequence of sequence listing upward to telomere on chrosomal short arm and 5'-terminus of this base sequence : 72890
ctgtttctaatgtcatagccagtcttttgctgcaggctggagaacaggacagagttatgtcacttgtcaggggagtcaggcactcggtgactcgttttctctcgtatgattgaattgccttggagaaatctaccgcagcctcagaagcagatggtgcgatttttactttaaccaattaaaaacaaaacaaaacaaaacaaaacaaaatcctgaaccctacgacatctccccaaaacactgagataaagttttgtaaaattttaagagttagacttttggttctcctggtaatacatacatttttagtgagaaataagaaaattttggagatacttgtaatcataaaaccttctgattagaatacattttggaattaagaatcagctgaagaattttaacaagaatatacattctcatatcctaaccgaaatatgttaatc

SEQ ID NO: 6931 - DNA, 458 bp, Homo sapiens
  chr4.fa.O7frz.61033191
  Located on chromosome 4
  Distance between a terminus base of telomere on chromosomal short arm and 5'-terminus of this base sequence : 58923350
  Distance between 3'-terminus of neighbour sequence of sequence listing upward to telomere on chrosomal short arm and 5'-terminus of this base sequence : 96746
gcatgtaaagtacatagactagcacctacctggcacagggtacacacccattaactatcagatattatatatacaactgaaaaattaaagatttacagtggtaccacatttcaatcctgttcatttataatctgttgtgaaacttaccagataatatctttaattgatggtattttgtagttgtcactcagcttcgggatttgttctcgagtcttccttgaaaagcatttgtgtgtgtgtgtgtgtgtgtgtgtgtgtgtgtgtaaaagcctctgctaatgaacgttgatgcagtgcatctgcccaccagatggcgcagtgctcccgctgttccgaggctcagctaccctgagggaggcagggaattttgatcagcttctgaagaatcacctcatctctccccgcagagagcacagagcacaggacttcacgttatgtcaagtacatgtcgctagttc

SEQ ID NO: 6932 - DNA, 227 bp, Homo sapiens
  chr4.fa.O7frz.61120899
  Located on chromosome 4
  Distance between a terminus base of telomere on chromosomal short arm and 5'-terminus of this base sequence : 59052313
  Distance between 3'-terminus of neighbour sequence of sequence listing upward to telomere on chrosomal short arm and 5'-terminus of this base sequence : 128505
caacctcaaatatcagtgctactgatatttgggccagataattcttcattgtgaaggctgtcctgtgtgttgtaagttgtttattattattattattattattaatattattattattatactttaagttttagggtacatgtgcacaatgtgcaggtttgttacatatatacacatgtgacatgtcggtgtgctgcacccattaactcgtcatttagcattaggta

SEQ ID NO: 6933 - DNA, 255 bp, Homo sapiens
  G08398
  Located on chromosome 4
  Distance between a terminus base of telomere on chromosomal short arm and 5'-terminus of this base sequence : 59227687
  Distance between 3'-terminus of neighbour sequence of sequence listing upward to telomere on chrosomal short arm and 5'-terminus of this base sequence : 175147
ccatcaaatgcagaaccttttatcatccttgtaaaattttatgtctttagatttacttcaacctctcatatctgtcagaattcttttgtgttcctggcagtatcgtccaatgtattcaatatctcaaaaaagttcatgccttccataaatataaaaacaatctattaagttacactctacaatctatctatctatctatctatctatctatctatctatctatcatctttcatgtatcttcatcaatccatttat

SEQ ID NO: 6934 - DNA, 311 bp, Homo sapiens
  AC036195.2_75612
  Located on chromosome 4
  Distance between a terminus base of telomere on chromosomal short arm and 5'-terminus of this base sequence : 59227784
  Distance between 3'-terminus of neighbour sequence of sequence listing upward to telomere on chrosomal short arm and 5'-terminus of this base sequence : -158
cagtatcgtccaatgtattcaatatctcaaaaaagttcatgccttccataaatataaaaacaatctattaagttacactctacaatctatctatctatctatctatctatctatctatctatctatcatctttcatgtatcttcatcaatccatttataagtgccaaatattatcagtcatctattcacatgtcccgagagccatcagagatgagaatttcactaaagtgcaagttaaatgcttgttgtctgtagcttcccttccaatatatattttttaatttttcatgtgctaatgaagctccataatg

SEQ ID NO: 6935 - DNA, 329 bp, Homo sapiens
  chr4.fa.O7frz.61692664
  Located on chromosome 4
  Distance between a terminus base of telomere on chromosomal short arm and 5'-terminus of this base sequence : 59567267
  Distance between 3'-terminus of neighbour sequence of sequence listing upward to telomere on chrosomal short arm and 5'-terminus of this base sequence : 339172
agtaaatctgtttcttaatgctgtttcttaactctaaaccgagtattataaaatagaaatggcaagaatacattttctcatcatagagcatgtccactccagacccacttatttcctttacattcccaggcaacttccaggatcctccaaagggaagattctggaaaagactgggacataattttcattaggaattccctgtgagttcatttggagatacatatgcatgcattctggggtgtgtgtgtgtgtgtgtgtgcacgtgtgtgtatgtttgtgtgttctattgcatactatagtagaatgatctccagaatagattgcaaata

SEQ ID NO: 6936 - DNA, 461 bp, Homo sapiens
  chr4.fa.O7frz.61808134
  Located on chromosome 4
  Distance between a terminus base of telomere on chromosomal short arm and 5'-terminus of this base sequence : 59682752
  Distance between 3'-terminus of neighbour sequence of sequence listing upward to telomere on chrosomal short arm and 5'-terminus of this base sequence : 115156
ctacatagctaagcatggctacagaataaaatacaagcctgctggctaacgctattttatttatgagtacaaatttcaagctgctcaagaattctactctatttacctaatcaattcaccctcttacctcttcatatctccccaccccatctctctcacattatcctgacttacctttctactagcttcattacatcatcacacaagcatgctgtaacatccaccatcttaaaacacacatacacacagagagagagagagagagagagagagacaaaaaagcccttactctgcagctacttctcccataatcatctagcttttctagtaaaattctgccaaacaattctttagacacactgtctctacttcctgtttttcccttctctcttaatcccactataaagagcctttcctttgtcttgtcaggatcaccaattaccatcaggttactaaatcaa

SEQ ID NO: 6937 - DNA, 458 bp, Homo sapiens
  chr4.fa.O7frz.61894559
  Located on chromosome 4
  Distance between a terminus base of telomere on chromosomal short arm and 5'-terminus of this base sequence : 59773602
  Distance between 3'-terminus of neighbour sequence of sequence listing upward to telomere on chrosomal short arm and 5'-terminus of this base sequence : 90389
cctagtggccattaaaagttactaatacaggaaaccacatggatgcattttaaaagcattaaacaagtgaaaagggccacatacaaaagatgcgattctttaaaattttattagtatgaattctactaaaggcaattccacaatgatgcaaagctgggtctgggcttgtgcgaggggattgattgccaaggccatgatgaaattttatgtgatcatgaaattgctgtgtaacttcattttggcagtggttttatcaaattcattgacttacagagttaacattggggaattttctctctctatatatgtatgtgtatatatatatatatatatatatatatgctttaataaggctacttgtaaaaattaaaaagaagtgagtttataaaacagagaaatattgtatgtctttagatacaatataaaagaaaacctacacatgagcttatcgtcaatgg

SEQ ID NO: 6938 - DNA, 456 bp, Homo sapiens
  chr4.fa.O7frz.61983486
  Located on chromosome 4
  Distance between a terminus base of telomere on chromosomal short arm and 5'-terminus of this base sequence : 59873519
  Distance between 3'-terminus of neighbour sequence of sequence listing upward to telomere on chrosomal short arm and 5'-terminus of this base sequence : 99459
ataccttcaataacaggttcactaataaccctcaggatgtatgtaaatcctatgtgtgtgtgtgtgtgtgtgtgtgtgtgtatgtgtgtgtgtgaagacagagagagtgcaatcctatcttttattaatttacaatcagtatgactcccaaaagtttaaaatgtttggttctagtttatttttggatggccgtggaatgtgtatgcctgcacctgtgtgctttgtgtgcctatttatttaaaaaataagagatatatttgctaatttgaaaaatgttgtgggggaaggaaagattagtacaaaattctgggttcaaaagaagcaagaaagagaagtcaatcttcagaaagtgaaactggccctgtttcagaagtatccttatttggaagtttctgaaaacataatttgtttatgcattattcatgcacttgcatgtacatgtacacgcctacagat

SEQ ID NO: 6939 - DNA, 294 bp, Homo sapiens
  chr4.fa.O7frz.62095162
  Located on chromosome 4
  Distance between a terminus base of telomere on chromosomal short arm and 5'-terminus of this base sequence : 59973600
  Distance between 3'-terminus of neighbour sequence of sequence listing upward to telomere on chrosomal short arm and 5'-terminus of this base sequence : 99625
ggtcatacaggtaaagacaattagtacatcatttggcattgtgcttgttcaataactattgttcttagttccatttttgttgttagtctaatttttggtgtttaaatcataaatttttggtaaacttaaatttatcaggaattcatatatatataaaacatatactcattactcatatactcattatgagtatatatatatatatatatacacacacatacacacttatatttggagacaaaaacacaaatttacattgtatagggatgtgtgttatgttaaccatggatcaga

SEQ ID NO: 6940 - DNA, 427 bp, Homo sapiens
  chr4.fa.O7frz.62338227
  Located on chromosome 4
  Distance between a terminus base of telomere on chromosomal short arm and 5'-terminus of this base sequence : 60217857
  Distance between 3'-terminus of neighbour sequence of sequence listing upward to telomere on chrosomal short arm and 5'-terminus of this base sequence : 243963
ggccttaggaagattacaatagtggcaaaaggcaaagggggatccacctgtgtattgccttgtgggataacagggggtgagagagaaatggggggaggtgtcacacctttaaacaaccagctctcacatgagctgatagaatgagagctcactcattaccatgaagacagcaccaagccattcgtaagggatctactcccatgacccaaacacctcccaccagaccccacctgtgacactggggatcacatttcaacatgagatttggaagggataaacatccaaatgatatcaatgaggatatggagaaattggaaccatcatacattttgtgtgtgtgtgtgtgtgtgtgtgtgtgtgtgtgtgtgtgtagtaatgtaatgtggcacagttgcttttgaaaaaatcctgatggttctttaaactc

SEQ ID NO: 6941 - DNA, 281 bp, Homo sapiens
  D4S1569
  Located on chromosome 4
  Distance between a terminus base of telomere on chromosomal short arm and 5'-terminus of this base sequence : 60303689
  Distance between 3'-terminus of neighbour sequence of sequence listing upward to telomere on chrosomal short arm and 5'-terminus of this base sequence : 85405
cacctctcgcctctacatctatacagtctttgtctgatcccatctgcaattctactgatgttcctctacccacttagtactcacttaaatcttctaatgatttctccaaaagtctatgagagttcctctttcccccaacataatatacatttatgtatgtgtatgtatgtttatatgtataacatagtatatggtgtgtgtgtgtgtgtgtgtgtgtgtgtgtgtgtagacaaagacttcccgtgacataactttagtcagactctgctaaaccctcaaag

SEQ ID NO: 6942 - DNA, 452 bp, Homo sapiens
  chr4.fa.O7frz.62797753
  Located on chromosome 4
  Distance between a terminus base of telomere on chromosomal short arm and 5'-terminus of this base sequence : 60563371
  Distance between 3'-terminus of neighbour sequence of sequence listing upward to telomere on chrosomal short arm and 5'-terminus of this base sequence : 259401
acattagactttgaacattgaaatactaaaaagaggaaaattattagttttgaggtgcctttgaaataaatgactagtgaaatagcaattttataactatatatattcataatgaaaatttttggactccttaagttgtcatgcaagaatagaaaacagtttgctgtcaggttgagctaaatgatatttttggaactctcataagatacacactccttgctcctaaagattgtgtgtgtgtgtgtgtgtgtgtgtgtatgaaaaatctctatatactttttgccctttatagctgctgctttcatctctttcagctaccttttatatgttgtacaatatctcaaccttttttcccataatgcttgttgcaaatcaacacctttgttttattttctttcctttatactccctttgttaactgaggttttcttaacagtcttgatcagtcatac

SEQ ID NO: 6943 - DNA, 349 bp, Homo sapiens
  chr4.fa.O7frz.62985825
  Located on chromosome 4
  Distance between a terminus base of telomere on chromosomal short arm and 5'-terminus of this base sequence : 60715797
  Distance between 3'-terminus of neighbour sequence of sequence listing upward to telomere on chrosomal short arm and 5'-terminus of this base sequence : 151974
ctgtaatgaagtctgaatccattgttgatgtttgactgttggcagttttcaagcctcgtcattctgtgttcttctcttgtcccacatcctggctacctaataagaaaggccacactattctgtccttgatgccaaaggaaagttaaaatcatgcaagatccagactacaagaatacagaatgcttattttaacctgaccccttaacacttacacacacacacacacacacacacgcacaggcacaatcagttgctgctcctcaattagttgctgctcccttctctctcaggcaatttttgaacctgtttgaatgtcttccctgctctctgtagaaagcctcactatgtg

SEQ ID NO: 6944 - DNA, 334 bp, Homo sapiens
  chr4.fa.O7frz.63415325
  Located on chromosome 4
  Distance between a terminus base of telomere on chromosomal short arm and 5'-terminus of this base sequence : 60928080
  Distance between 3'-terminus of neighbour sequence of sequence listing upward to telomere on chrosomal short arm and 5'-terminus of this base sequence : 211934
ttgataatacatcaattggtcataattttaatagctgatatttaccttattataatataaagttggtaattttgtaagcattctcattttataagcaaaggaactgaggcttagagatggtgtatacacacacacacacacacacacacatatatatgtatacacacacaccatttttggaagtgccattcatctatttttccatctatctatcctactgcactatttatgagtttatagtctgcagctagactatatttgaattgggattgacataaatacagcagagttctctttgtgaggattaaattagttgatacatgtacagctccta

SEQ ID NO: 6945 - DNA, 432 bp, Homo sapiens
  chr4.fa.O7frz.63527772
  Located on chromosome 4
  Distance between a terminus base of telomere on chromosomal short arm and 5'-terminus of this base sequence : 61041009
  Distance between 3'-terminus of neighbour sequence of sequence listing upward to telomere on chrosomal short arm and 5'-terminus of this base sequence : 112595
agccatttaatttggactataatttttgatgacaaaacaagttacattcatcatgaaaacctgcatgctaaaatgggtcttatgtaattttaatgaccaattccagccaggcacttcactagaaaacacatacacatacacacagctgaaggttttcaaattttctttcgtcctcctctccctccctccatcccgcccttcctccttcttttccttccttccttccttccttccttccgtccatcaatcatctgtcaatttattcatccatccatctaccttactacccagtcatccatctatctatctacctaacaattttagtgagtaacattgtattcatcattcctacttgtcctcttcacatcaacacacatctatcattaacaagtgcttagtatacatatggtagtcaagaaatgcttaattgaa

SEQ ID NO: 6946 - DNA, 445 bp, Homo sapiens
  chr4.fa.O7frz.63187376
  Located on chromosome 4
  Distance between a terminus base of telomere on chromosomal short arm and 5'-terminus of this base sequence : 61123721
  Distance between 3'-terminus of neighbour sequence of sequence listing upward to telomere on chrosomal short arm and 5'-terminus of this base sequence : 82280
aaatgaatcatatggtagtcgtatttttaatttttaggggaaccaccatactgttttccatagcaactacaccatttcacattcttaccaccagtttaaaaggatctcaaatcctccacaacctcaccagcacttgttattctttgttttctggataatgaccatcataataggtttgaagtgtgatctcattgtagtctttgtttgaattttcctgatgattagtcacgacgaacaccttttcatgtatctgttgcccatttgtgtctctttgaagaaacaccatccacaccctctgtccattgcttaggttattgattttttgctttttgcttatgtctgtttgtgtgtgtgtgtgtgtgtgtgtgtgtgtgtgtttctgttgagttgtaagagagtcttacattttttagacattaacctcttaccagacatatggcttgta

SEQ ID NO: 6947 - DNA, 464 bp, Homo sapiens
  chr4.fa.O7frz.63743338
  Located on chromosome 4
  Distance between a terminus base of telomere on chromosomal short arm and 5'-terminus of this base sequence : 61391597
  Distance between 3'-terminus of neighbour sequence of sequence listing upward to telomere on chrosomal short arm and 5'-terminus of this base sequence : 267431
tccatttagattcagtgttcttatagattactgggacttatttctgccatttgttttgtgtgtgtgtgtgtgtgtgtgtgtgtgtgtgtgtgtgttctctttcttcctttcttccttcctgtgttcctttttgtaaaagtgattttctctgacggtatgttttaatttctttcttttttcctgtactgttgtaggtattttgatttgagattaccatgaggcttgcaaataatgtcttataacccactatattaaacttaaccctgattacataagcaaacaaacaaaacaataaacaagcaaagagaaaggaattaaaaactctatactttatccgtcttaattcttcaccttttgttgttttgatttatatcttattatactttctatgtcttgaaaaattgttcttattatttttcaagatgtagattcatcttttatgcctcttactcaagatattagtt

SEQ ID NO: 6948 - DNA, 410 bp, Homo sapiens
  chr4.fa.O7frz.63649051
  Located on chromosome 4
  Distance between a terminus base of telomere on chromosomal short arm and 5'-terminus of this base sequence : 61424765
  Distance between 3'-terminus of neighbour sequence of sequence listing upward to telomere on chrosomal short arm and 5'-terminus of this base sequence : 32704
tgtccgtatgaaatctaatgacaaaattctcccaagggatacaataaagtgttttatccaaaacagcacacaaaatcattttttgtaatgcatttatcatagatttctgaagtttgacagatccagacataaacttgagctcaatcacttggtgtaaacttgattgagttactatttgtatctttaagtttagggttttttttttctgtaatttgggatgacaagagaacttactttatatgtttgctataattttaagtgctgaagaaaatattgcatgtaaaatttctggcccaaggatgataattctgtatgtatgcatgagtgtgtgtgtgtgtgtgtgtgtgtgtgtaagggcaatcaagtttcagtatattgagtagaacaagtcctcatcagtcttggatagt

SEQ ID NO: 6949 - DNA, 205 bp, Homo sapiens
  DISO7_10001436
  Located on chromosome 4
  Distance between a terminus base of telomere on chromosomal short arm and 5'-terminus of this base sequence : 61712293
  Distance between 3'-terminus of neighbour sequence of sequence listing upward to telomere on chrosomal short arm and 5'-terminus of this base sequence : 287118
tcaggaggatatctgcctgccattagatagataggtagatagatagatagatagatagatagatagatagagagatagataatttgagacaagttctctctctgttgcccaatctgaaggtcagtggcacactcacaactcactgcattctgggcttgctgggcttaagcaatcctcccaccttcaaatgaggactctgaggttc

SEQ ID NO: 6950 - DNA, 219 bp, Homo sapiens
  DISO7_10001437
  Located on chromosome 4
  Distance between a terminus base of telomere on chromosomal short arm and 5'-terminus of this base sequence : 61781297
  Distance between 3'-terminus of neighbour sequence of sequence listing upward to telomere on chrosomal short arm and 5'-terminus of this base sequence : 68799
cactcaattgtctcctccacaaaagggaattttaccactgaatatgtggggtgtgtgtgtgtgtgtgtgtgtgtgtgtgtgcctttacagaaaataaatggaagtatgttcttaataaacaaagagattttccaagtaaattaaatctggcttaattaaaatggcatctttaattacatttctaaattttagaaaacataattgtgatgtaagggagaa

SEQ ID NO: 6951 - DNA, 353 bp, Homo sapiens
  chr4.fa.O7frz.64250571
  Located on chromosome 4
  Distance between a terminus base of telomere on chromosomal short arm and 5'-terminus of this base sequence : 61927444
  Distance between 3'-terminus of neighbour sequence of sequence listing upward to telomere on chrosomal short arm and 5'-terminus of this base sequence : 145928
gtacataagcaggattgttacaaggacatgtgtgatgctgaggtttggagtaggaattaatttatctctcaggtagagaaactaagaatactaaatacacatattagaaaaaatcctcaaaacaataatctaaagtaccttcttaagaaactagaaaaagaacaaaatgggtccaaaacaaggaaaagaaagaatataataaagataatagcagaaaatataattgaaaataaaaaattagagaaaaattattgaaacaaatagctggtccattgaaaagatttccctacacacacacacacacacacacacacacacacacacgacaaagctctaacaagacttacaaagaa

SEQ ID NO: 6952 - DNA, 454 bp, Homo sapiens
  chr4.fa.O7frz.64618447
  Located on chromosome 4
  Distance between a terminus base of telomere on chromosomal short arm and 5'-terminus of this base sequence : 62070711
  Distance between 3'-terminus of neighbour sequence of sequence listing upward to telomere on chrosomal short arm and 5'-terminus of this base sequence : 142914
tcagttatcgtggctatgtaatttaattctaaaatatattaaaactctagaagtcattattattattaatttattagcaaataggtctaaccattgatttacccccatattggatttaatcacatattcaaccttttattgcccttccttccttccttctttccctcccccctccctccctccttccttccttctttccttccttccttccttccttctcttctcttctcttctcttctcttctcttctcttctcttctcttctcttctcttcccttctcttctctccttcctttccttctatggataaatctggaataattttctttgttgaagaactccttcaatatttccattactatgaatcagctgctgtttaactctccaatgtttttgttttaaaactatatttatcatttttaatttcgaaagatacagtcacttggtgtacaatt

SEQ ID NO: 6953 - DNA, 378 bp, Homo sapiens
  chr4.fa.O7frz.64542547
  Located on chromosome 4
  Distance between a terminus base of telomere on chromosomal short arm and 5'-terminus of this base sequence : 62146829
  Distance between 3'-terminus of neighbour sequence of sequence listing upward to telomere on chrosomal short arm and 5'-terminus of this base sequence : 75664
atagtggctcagctcctaatacagtcacactggaagttaaggcttcaaaatatgaattttggcgggggggacacagttcattccataatacaatattctgaggactaaataagattatatatatatatatatatatatatatatatatatatacacacatacaatttatagcatggtaacttaagcctagaaatagtcaagatggtttatctttattatataattatcacatcacaatcgtcattactctgtcatctagagatgacacttataaattgaataatatgaatataacattaattccatatcagaatgaataatacaaacaaatgaacaacaccatacattgctgcaatgtatgctttgttaccatgtagg

SEQ ID NO: 6954 - DNA, 399 bp, Homo sapiens
  chr4.fa.O7frz.64439206
  Located on chromosome 4
  Distance between a terminus base of telomere on chromosomal short arm and 5'-terminus of this base sequence : 62241737
  Distance between 3'-terminus of neighbour sequence of sequence listing upward to telomere on chrosomal short arm and 5'-terminus of this base sequence : 94530
gttctgtccattactcaaattactaatatgcttcccattgcaagtatgtgttgtttgcagtacttggaaatcttttactcctatttttcccttttcattctttattcatattattcccaagctattcattcaacaaatgaatagcatgaggataatatggacacacactaaataccaggcattagaaatgcagcagtgaatacaaaacaaaaaaacaaacaaacaaaaaagtctaggacctcttagagcttgcattttagagtaatggaaacaatacattaacgatatagttattgcaatagaatgccatgaagtgataagtgcaatacaaaaaaaatcaggatagaaaatagaatggaaagcaagtgcaatttaaaatagattgtctagcgaagacct

SEQ ID NO: 6955 - DNA, 114 bp, Homo sapiens
  DISD22_0003702
  Located on chromosome 4
  Distance between a terminus base of telomere on chromosomal short arm and 5'-terminus of this base sequence : 62429880
  Distance between 3'-terminus of neighbour sequence of sequence listing upward to telomere on chrosomal short arm and 5'-terminus of this base sequence : 187744
tcttagagtatgtcaaaggctcagtttgatttaatagaatgggaagatttcacacacacacacacacacacacacacacacacacacacacaaatgaattggcttccaaagagg

SEQ ID NO: 6956 - DNA, 378 bp, Homo sapiens
  chr4.fa.O7frz.64947251
  Located on chromosome 4
  Distance between a terminus base of telomere on chromosomal short arm and 5'-terminus of this base sequence : 62535617
  Distance between 3'-terminus of neighbour sequence of sequence listing upward to telomere on chrosomal short arm and 5'-terminus of this base sequence : 105623
ctcattcaacctacagtatctatgaatattttacatagtttttaattcctaaatttggctattttttcaatactgtttttacttacacaaacattatagtaagaaatattctatatattcacaataagattctggactgcaagttagtgaaatagccagactggactcaggataaacaggaaaatattgttatgtatatatatatatatatatacacactcctgtaatatttatagaagtggggtttcaaccaagactctacattggagtcatctaaggagcttttcaagattacctaatgcataggacccatcctagaacaaaggaatcagaatttttaaagttgggacaaaaatgtacgaggttgtactaatggtg

SEQ ID NO: 6957 - DNA, 466 bp, Homo sapiens
  chr4.fa.O7frz.65169669
  Located on chromosome 4
  Distance between a terminus base of telomere on chromosomal short arm and 5'-terminus of this base sequence : 62822596
  Distance between 3'-terminus of neighbour sequence of sequence listing upward to telomere on chrosomal short arm and 5'-terminus of this base sequence : 286601
gagcacaaactaagtactgcagcaaatagaaccaccgtgtcctccttacattgcctctttagatcttctttatgagagaggtttaaaattattaaaatacttattcactgtggtactacattttaacaaattgaggattcacttaagatacaaatattttgaactcccttatactctctgttatctctataaggttctgttttcgaggtttatctaaatacttcatagtgaaacttaaacattagttttattaaagggtaaattctaatgtgtggtgtgtgtgtgtgtgtgtgtgtgtgtgtgtgtgtatgcacgtgtgtatttctctggacatgtccacagtcttggtttctggattgtgcttacagcagtaatacccactgtatatccaaagttattttgagcatcaacctaaaattgatgagccccaattacagacagtcagtggagttaagacttggagttt

SEQ ID NO: 6958 - DNA, 133 bp, Homo sapiens
  D4S398
  Located on chromosome 4
  Distance between a terminus base of telomere on chromosomal short arm and 5'-terminus of this base sequence : 62965676
  Distance between 3'-terminus of neighbour sequence of sequence listing upward to telomere on chrosomal short arm and 5'-terminus of this base sequence : 142614
tcaatttatgtgcagccaatacagacagtttccaataaacaagtttgtgtgtgtgtgtgtgtgtgtgtgtgtgtgtgtgtgtgtgtttaattaagaaatggaaatgatttgtttacccagtcagcatttcatg

SEQ ID NO: 6959 - DNA, 403 bp, Homo sapiens
  chr4.fa.O7frz.65559971
  Located on chromosome 4
  Distance between a terminus base of telomere on chromosomal short arm and 5'-terminus of this base sequence : 63203636
  Distance between 3'-terminus of neighbour sequence of sequence listing upward to telomere on chrosomal short arm and 5'-terminus of this base sequence : 237827
gtaatctaccagttgtgcatagaccgtacaaagttttatcatgagtatgtcagcctcctcatggatgtccttgttttgtctacttttttaaattgtaatctttcatgaaaaacttcctccaataccttttttttctagttttaatttatcaactctgttaagaaatcagaggcaagaaaattattttctttggaaggagatattgatattattttttaaagaaatttccatgctactcagcacagacatttgaaatgttccatttttgtttcattgctttattgctaggtttttggagaatgtgagatacacacacacacacacacacacacacacacactctaatcataacctcctgtgtgtgtgtatttatgtatttgttatactttcgatttacagcaac

SEQ ID NO: 6960 - DNA, 272 bp, Homo sapiens
  chr4.fa.O7frz.65632967
  Located on chromosome 4
  Distance between a terminus base of telomere on chromosomal short arm and 5'-terminus of this base sequence : 63237479
  Distance between 3'-terminus of neighbour sequence of sequence listing upward to telomere on chrosomal short arm and 5'-terminus of this base sequence : 33440
tttaaggttaaatgaggtcataagggcagggttctaatacaataggattagtggccttataagaagagaaagagaaagcctctctctctctctctctctgtctctctctctctctctctcacacacacacacacacacacacacacacacacacacagagccatatgagaacatagaaagaatgcaactgtttgcaagccaggtagagagccctcaccagaaaccaagcctgctgggccttgcactgggacttgtagctttcagaactgtaa

SEQ ID NO: 6961 - DNA, 328 bp, Homo sapiens
  chr4.fa.O7frz.66081719
  Located on chromosome 4
  Distance between a terminus base of telomere on chromosomal short arm and 5'-terminus of this base sequence : 63486491
  Distance between 3'-terminus of neighbour sequence of sequence listing upward to telomere on chrosomal short arm and 5'-terminus of this base sequence : 248740
gtaagtctgtgctaaagcactaagttaaaactgttgtgttgctttggctttattttctagtattcttttccttttccttcctcctttcctccctccctcccttcctccctccctccctccttgtctctttctttctccttccttccttccttctttctttctctctttctctctttctttcttctttctttctttcctctttcttttttttcattacaacatattttattacttcacatttgactaaattctgaactcagctaaattacaatttaaagctatctattttccagagtttgaaaatgtaacctgattaagtcacaggtaa

SEQ ID NO: 6962 - DNA, 129 bp, Homo sapiens
  D4S399
  Located on chromosome 4
  Distance between a terminus base of telomere on chromosomal short arm and 5'-terminus of this base sequence : 63530282
  Distance between 3'-terminus of neighbour sequence of sequence listing upward to telomere on chrosomal short arm and 5'-terminus of this base sequence : 43463
ctttcccatatttgtacatatgtacatatgcatacacacacacacacacacacacacacacacacagagatatatttctcttttgccaagaaagggagatcatttaatctgccaagtgataggaagatg

SEQ ID NO: 6963 - DNA, 356 bp, Homo sapiens
  AC041038.2_57567
  Located on chromosome 4
  Distance between a terminus base of telomere on chromosomal short arm and 5'-terminus of this base sequence : 63551770
  Distance between 3'-terminus of neighbour sequence of sequence listing upward to telomere on chrosomal short arm and 5'-terminus of this base sequence : 21359
caagtggacagaattcattaaaagaaaaaccatgttatatggtataagacctcttacatatccaaaaagtgtcttgttttgctttgtcttcattcttgtttctaattggttgtaagtttattaatgctaatgttgtaaaggtttctttctttctttctttctttctttctttctttctttctttctttattagaaaccacaacactaactgctgtgagggattgtgttagttcattttcacactgctataaagaataactgagactgggtaatttgtaaaggaaagagatttaattgactcacagtttcacatgcctggggaggcctcaggaaacttataatcatggcagaaggtg

SEQ ID NO: 6964 - DNA, 137 bp, Homo sapiens
  D4S1600
  Located on chromosome 4
  Distance between a terminus base of telomere on chromosomal short arm and 5'-terminus of this base sequence : 63625463
  Distance between 3'-terminus of neighbour sequence of sequence listing upward to telomere on chrosomal short arm and 5'-terminus of this base sequence : 73337
tgaaaatgttgtggaggcatgagttatacacacacacacacacacacacacacacacacacacatggatatatatcacagtataggaaatatacatgtgtatatgtgtatatatttctgtttcttcaaacactagtt

SEQ ID NO: 6965 - DNA, 259 bp, Homo sapiens
  HUMUT7665
  Located on chromosome 4
  Distance between a terminus base of telomere on chromosomal short arm and 5'-terminus of this base sequence : 63697824
  Distance between 3'-terminus of neighbour sequence of sequence listing upward to telomere on chrosomal short arm and 5'-terminus of this base sequence : 72224
ttgaggaataaaatatgggacacacacacacacacagatagatagatagatagatagatagatagatagatagatagacagatatgttgtcaagaattactcttgcattcaatgagtaatgagattaagaaaatgttaaaacatttagtaggaaacatttaattaataaaactaaatagttaaatataacactcaggctcctgcacctactggtttctacaggccctgaaaccagcccattttctgtaccatgactctg

SEQ ID NO: 6966 - DNA, 389 bp, Homo sapiens
  chr4.fa.O7frz.66407422
  Located on chromosome 4
  Distance between a terminus base of telomere on chromosomal short arm and 5'-terminus of this base sequence : 63980892
  Distance between 3'-terminus of neighbour sequence of sequence listing upward to telomere on chrosomal short arm and 5'-terminus of this base sequence : 282809
atttaattgttccacattgtgtacatatatcaaaacatcacatcataccatagaaatgatatatttttgtcagtgaaaaagaaacaagtagcttttaaaattaaaaatgtgcatatatacatgtgtaccctatggtttgatattacattacctcaattacttatttgaagaactgacattctaaattataatgtagagaaatttacccttcccccatgcttgtagataagtgttttctgtaacttgtttagaagtttctttctctctctctctctctctctcacacacacacacacacacacacacacacacacatacacacacagaaattctgttgggattattgagaataaatgaatcttcagaacttagattggaaatggacatct

SEQ ID NO: 6967 - DNA, 257 bp, Homo sapiens
  chr4.fa.O7frz.66589977
  Located on chromosome 4
  Distance between a terminus base of telomere on chromosomal short arm and 5'-terminus of this base sequence : 64162703
  Distance between 3'-terminus of neighbour sequence of sequence listing upward to telomere on chrosomal short arm and 5'-terminus of this base sequence : 181422
gaagcatactccagtagattgtacaccaggaggcagatcagcaatacaatgtatttcaggttgaaattctcactgggaccataattgaaactaaagcttggtacttagaggaaaagtacagacacacacacgcacacagacacacacaggcgcgcgcacacacacacacagcagtagtataactatccttttcttacaacaaaattgaaaactaccaatgcatggtagtttcagtgtaacaattacatgcaccagat

SEQ ID NO: 6968 - DNA, 208 bp, Homo sapiens
  chr4.fa.O7frz.66760092
  Located on chromosome 4
  Distance between a terminus base of telomere on chromosomal short arm and 5'-terminus of this base sequence : 64286614
  Distance between 3'-terminus of neighbour sequence of sequence listing upward to telomere on chrosomal short arm and 5'-terminus of this base sequence : 123654
atagctaagttttggaagcaacctaagtgttcagcagaggaatggataaagaaaatgtgatatacacacacatgcacacacacacacacacacacacacacacacacacacaatggagtactattcagccataaaaacaaatgagatcttgtcatttgcaacaacatggatggaactggagactattatgttaagtgaaataagccag

SEQ ID NO: 6969 - DNA, 349 bp, Homo sapiens
  chr4.fa.O7frz.67085594
  Located on chromosome 4
  Distance between a terminus base of telomere on chromosomal short arm and 5'-terminus of this base sequence : 64663262
  Distance between 3'-terminus of neighbour sequence of sequence listing upward to telomere on chrosomal short arm and 5'-terminus of this base sequence : 376440
gagcttgcagtgaatcaagattgcgccactgaactccagcctgggtgacagagcgagactccgtctacaaaaaataaataaataaaaaagaagtataatatccccttaaaatagattaaaagtatacacacacacacacacacacacacacacacacatatatatgtatacatatatacatatctatgtaagtatatatatacacacacaggcacacagtttaaatgtgtatatatatatatttgtgtatatctaatgtatatatattttaaggtaaattgtgacaaaatgaaaagtaaactataattttatgttgcattatttaattagaaacagctgtttgaagttt

SEQ ID NO: 6970 - DNA, 414 bp, Homo sapiens
  chr4.fa.O7frz.67184237
  Located on chromosome 4
  Distance between a terminus base of telomere on chromosomal short arm and 5'-terminus of this base sequence : 64759324
  Distance between 3'-terminus of neighbour sequence of sequence listing upward to telomere on chrosomal short arm and 5'-terminus of this base sequence : 95713
tacagtagaatcattcgaggatacttactaaaatgccactgctagaaatattaaaaagtgatagaaataagcataaaacaaggcaaggagtagaataaaactaagttaaaaagagagatatagataattggattacaagattaggaagttttaaaatgtggttagttgtaaagaaagaaacacagagagtgaacaaaatgctaaggcattttgaagagggtttaaatatatatacatacacacacacacacacacacacacacacacacatatatatatatactacagtgtgtgaaataccaagtatcttttcctaccacaatggtatgaaactagaaatcaatgatagacaggattttggaaaatttacaaatgtgtggaaattacacaatatgcacttaagcaactaatgag

SEQ ID NO: 6971 - DNA, 211 bp, Homo sapiens
  DISO7_10001442
  Located on chromosome 4
  Distance between a terminus base of telomere on chromosomal short arm and 5'-terminus of this base sequence : 64875401
  Distance between 3'-terminus of neighbour sequence of sequence listing upward to telomere on chrosomal short arm and 5'-terminus of this base sequence : 115663
cagcttctttcaggtggcccaatttatccacaaaactacaaaattgctctaactctgatatatatatatatatatatatatatatatatatatatatatatatatatatcagaggtgtacagctttattttattgtgtatatatgtatatattattgattggatatatatccaatcaaataatcactctctcatcattcatattgtccttt

SEQ ID NO: 6972 - DNA, 172 bp, Homo sapiens
  DISO7_10001443
  Located on chromosome 4
  Distance between a terminus base of telomere on chromosomal short arm and 5'-terminus of this base sequence : 64884113
  Distance between 3'-terminus of neighbour sequence of sequence listing upward to telomere on chrosomal short arm and 5'-terminus of this base sequence : 8501
ctcaatgatatgaccaagtggatatatatatatacacacacacacacacacacacacacacacacacacacatatatacacacacatatatacgtatatatgtacgtatgtatacatatatatatatatatgacctactaagtatttgtgatgtgttcttactcttgaaatt

SEQ ID NO: 6973 - DNA, 111 bp, Homo sapiens
  DISO7_10001444
  Located on chromosome 4
  Distance between a terminus base of telomere on chromosomal short arm and 5'-terminus of this base sequence : 64886891
  Distance between 3'-terminus of neighbour sequence of sequence listing upward to telomere on chrosomal short arm and 5'-terminus of this base sequence : 2606
ttgtatctgctctaggctgggttttcagtaagagcagtgaaggtagtattttttgtttgtttgtttgtttgtttgtttgtttgttttgtattattccaccaagattctgaa

SEQ ID NO: 6974 - DNA, 101 bp, Homo sapiens
  DISO7_10001445
  Located on chromosome 4
  Distance between a terminus base of telomere on chromosomal short arm and 5'-terminus of this base sequence : 64890273
  Distance between 3'-terminus of neighbour sequence of sequence listing upward to telomere on chrosomal short arm and 5'-terminus of this base sequence : 3271
ctgacaatattaaatcgcgctagagaaaatataacttttatatatatatataagtatatatatatatacttcaaatgctatcatcagtgagtaaatctgtc

SEQ ID NO: 6975 - DNA, 107 bp, Homo sapiens
  DISO7_10001449
  Located on chromosome 4
  Distance between a terminus base of telomere on chromosomal short arm and 5'-terminus of this base sequence : 65193782
  Distance between 3'-terminus of neighbour sequence of sequence listing upward to telomere on chrosomal short arm and 5'-terminus of this base sequence : 303408
ttaggttaacctctatacccgcacaatttcaagtagagtgtgtgtgtgtgtgtgtgtgtgtgtgtgtgtgtgtgtattaaaagttttcagatgcagtgatcttgctt

SEQ ID NO: 6976 - DNA, 220 bp, Homo sapiens
  DISO7_10001448
  Located on chromosome 4
  Distance between a terminus base of telomere on chromosomal short arm and 5'-terminus of this base sequence : 65219149
  Distance between 3'-terminus of neighbour sequence of sequence listing upward to telomere on chrosomal short arm and 5'-terminus of this base sequence : 25260
aggctttcagcattctgggatttcatcctatacagtttagaggagaatattaaaaaaaagtaatgatacaagttaattaaaatatatgtgtatacacacacacacacacacacacatattgtgaagtatagtacagtaaagacaaaattataattactttaatctataataaaaagtataataagtaaccaataaatgcataaagaatgaatattggaca

SEQ ID NO: 6977 - DNA, 220 bp, Homo sapiens
  DISO7_10001447
  Located on chromosome 4
  Distance between a terminus base of telomere on chromosomal short arm and 5'-terminus of this base sequence : 65230659
  Distance between 3'-terminus of neighbour sequence of sequence listing upward to telomere on chrosomal short arm and 5'-terminus of this base sequence : 11290
catgaggacaacaaagaaggggtgtgtgtgtgtgtgtgtgtgtgtgtgtgtgtatttttaattttcaatagattgaatagaaaccaaagtaaaaacaaattagagtctgattatttataatagcaatgatcattttgtgcctatagattttgaatctcctgtatttgttaatatctcttcttactcagacacaagctgcccttgtgtttgacaaccagct

SEQ ID NO: 6978 - DNA, 104 bp, Homo sapiens
  DISO7_10001452
  Located on chromosome 4
  Distance between a terminus base of telomere on chromosomal short arm and 5'-terminus of this base sequence : 65322236
  Distance between 3'-terminus of neighbour sequence of sequence listing upward to telomere on chrosomal short arm and 5'-terminus of this base sequence : 91357
aagaccttcttgcatgcacattgaccactaaccaaactcagtgggttttgttttgttttgttttgttttgttttgctaaacctagagtggtctttaccacatat

SEQ ID NO: 6979 - DNA, 253 bp, Homo sapiens
  DISO7_10001454
  Located on chromosome 4
  Distance between a terminus base of telomere on chromosomal short arm and 5'-terminus of this base sequence : 65391858
  Distance between 3'-terminus of neighbour sequence of sequence listing upward to telomere on chrosomal short arm and 5'-terminus of this base sequence : 69518
gtagattaattcatccaagtttgggatttggggattagaattttaatgttcacttctttttttctgaatgatttgtttgtgggcgggcagaggaaggcatgtgtgtatgtttgtgtgtgtatgtgtgtgtgtgtgtgtgtgtgtatctgtgtttgagagagaaagagacttagtcactttcttagatcaatatgagtattatgctataacacattttttgcctggcattttagctttctagtgctagattggc

SEQ ID NO: 6980 - DNA, 437 bp, Homo sapiens
  chr4.fa.O7frz.67891682
  Located on chromosome 4
  Distance between a terminus base of telomere on chromosomal short arm and 5'-terminus of this base sequence : 65448587
  Distance between 3'-terminus of neighbour sequence of sequence listing upward to telomere on chrosomal short arm and 5'-terminus of this base sequence : 56476
tatctatgcctcaatgtgaaactcctcacattaattactcaatagtttaaagtccaaaatattccctttgttttacttagttttagcaaggaggaaatgggaaaaaacttggttctcttcagcagaaacagtacccagagaatatgttcccccttcagcatcctcatcaggtactttaaggttttgaattaatccaacaccaagtcccatatattaccatttgaagattcaaattcaatttcacaaaatcaatctcataacaagcacaattgctgaggctctctctctctctctctctctgtctctctctctctatttagttcggatctgagagaaagacatacaatggttgcaagacattaggaccttcctttttatggtataagaataagatatgcttcccatgtccttattaatatccaccttaagatacttgg

SEQ ID NO: 6981 - DNA, 415 bp, Homo sapiens
  chr4.fa.O7frz.68069513
  Located on chromosome 4
  Distance between a terminus base of telomere on chromosomal short arm and 5'-terminus of this base sequence : 65612027
  Distance between 3'-terminus of neighbour sequence of sequence listing upward to telomere on chrosomal short arm and 5'-terminus of this base sequence : 163003
attcttgaaccaattaggttctcagcatttgccaaaggggtgtgcgtgtgtgcgcgcctatgcttgcgtttgtgtgtgtgtgtgtgtgtgtgtgtgtgtgtgtgtgtatgagtctgtgtcctgatgattataattttggcaatcatttgtgccctcattatgacaaacagtttttgtttggccaaactttatttaggtttctgaaacttctaggctcatctgtgttctcctttgtaaaattcagttttaggagagaaccctgctaagtcagttatcaggattccccaacctttatatctgatcatccttaatatctgatcagattcttcattttccaccatcttttaggtgatatctgatcaccaggcctgttttcagcaagaatcctcttaagtgagtttagccagaatcttct

SEQ ID NO: 6982 - DNA, 399 bp, Homo sapiens
  chr4.fa.O7frz.68180261
  Located on chromosome 4
  Distance between a terminus base of telomere on chromosomal short arm and 5'-terminus of this base sequence : 65717451
  Distance between 3'-terminus of neighbour sequence of sequence listing upward to telomere on chrosomal short arm and 5'-terminus of this base sequence : 105009
aggagtacctgtactatagaagcatcatactcttacttgaaggtatatataaattagtttatatatatatatatatatatatatatatatactaaatatttaaactaatattttaactaaatatatatatttagactaaatatagatagatagatagatagatagatagatagatagatagatagatagaggtatataattagtagggcaagacaatagcagaggggcaggcaagactttctaccttattctaggggccagaattaccctaatacaaaaaacaacaaaaaaaagggtatcatgagaagaaaaaatgacagaccaatacatctcattaacttagacataaaaatacttaaaataaatataaaaaaagtttacattccatgactaaatgat

SEQ ID NO: 6983 - DNA, 247 bp, Homo sapiens
  G08344
  Located on chromosome 4
  Distance between a terminus base of telomere on chromosomal short arm and 5'-terminus of this base sequence : 65717472
  Distance between 3'-terminus of neighbour sequence of sequence listing upward to telomere on chrosomal short arm and 5'-terminus of this base sequence : -378
gcatcatactcttacttgaaggtatatataaattagtttatatatatatatatatatatatatatatatactaaatatttaaactaatattttaactaaatatatatatttagactaaatatagatagatagatagatagatagatagatagatagatagatagatagaggtatataattagtagggcaagacaatagcagaggggcaggcaagactttctaccttattctaggggccagaattacc

SEQ ID NO: 6984 - DNA, 302 bp, Homo sapiens
  chr4.fa.O7frz.68272065
  Located on chromosome 4
  Distance between a terminus base of telomere on chromosomal short arm and 5'-terminus of this base sequence : 65778404
  Distance between 3'-terminus of neighbour sequence of sequence listing upward to telomere on chrosomal short arm and 5'-terminus of this base sequence : 60685
cttgacattagttcacctttaaagatgattttggagctttgtggttttgctcctttggggataaagacacacacacacacacacacacacacacacacacacacacaaatttaatttctatgatggctggtgaaagttagattagacaaatgtcttcagtgaacattttgaatattaaaatttgtcctcatatattgctgctcagttggcttagagattggtatttccagaaggcagattatctttttcacttatacttgaatttatcttaaatccatgttaattcagttggacattcttaa

SEQ ID NO: 6985 - DNA, 169 bp, Homo sapiens
  chr4.fa.O7frz.68387391
  Located on chromosome 4
  Distance between a terminus base of telomere on chromosomal short arm and 5'-terminus of this base sequence : 65939102
  Distance between 3'-terminus of neighbour sequence of sequence listing upward to telomere on chrosomal short arm and 5'-terminus of this base sequence : 160396
gatacaattggtactgcaaaatacaaaatagatacacacagttttcaatgacaacttttaaaacccagggatccttcacacacaatgtcttccatgtgtgagtacctttgtgtgtatgtgtgtgtgtgtgtgtgtgtgtgtgtgtgagtgattctttaggaacttagga

SEQ ID NO: 6986 - DNA, 436 bp, Homo sapiens
  chr4.fa.O7frz.68592621
  Located on chromosome 4
  Distance between a terminus base of telomere on chromosomal short arm and 5'-terminus of this base sequence : 66159298
  Distance between 3'-terminus of neighbour sequence of sequence listing upward to telomere on chrosomal short arm and 5'-terminus of this base sequence : 220027
gctcaattaaggtcattacataatgataaagggttcaattcaaaaagaagacttcactgtcctaattatatatccacccaatattggagcacccaggtctatgaaacaagtacttctagacctacaaaaacacttagccacacaatagttgtggggaacttcaacaccccactgtcttatttcttaattgcaaaattgcaagaaggctaatggaaaatgtgtgtgtgtgtgtgtgtgtgtgtgtgtgtgtgtgtgtgtgtgttagataagcttcattaaagttatggtgttgacagtcataattttaatgaacccacaatattgattaagcaaagtggccttaaacggaaacacatgaaaaacaaggctatgtactgattggtcaatgaaaatgttgctcccagtggcacacgagaagctaaatctgtatttcctc

SEQ ID NO: 6987 - DNA, 272 bp, Homo sapiens
  D4S3004
  Located on chromosome 4
  Distance between a terminus base of telomere on chromosomal short arm and 5'-terminus of this base sequence : 66318868
  Distance between 3'-terminus of neighbour sequence of sequence listing upward to telomere on chrosomal short arm and 5'-terminus of this base sequence : 159134
cagatgcaaaaatcactgtctacttcattacactttcaagtatggacatggtcaagaatttacaatctgtgtgtgtgtgtgtgtgtgtgtgtgtgtgtgtgtgtgtggtgcataactatttccattgaattctaaaatttacttgcattaggacattttgttgattatgttaattacacctgaggttttactttagtttttttttcagttcagaataaaaaagagaatattagaacatacttgttacaaaatggggttgctgaatctgatag

SEQ ID NO: 6988 - DNA, 132 bp, Homo sapiens
  DISO7_10001455
  Located on chromosome 4
  Distance between a terminus base of telomere on chromosomal short arm and 5'-terminus of this base sequence : 66497273
  Distance between 3'-terminus of neighbour sequence of sequence listing upward to telomere on chrosomal short arm and 5'-terminus of this base sequence : 178133
gcagtgaggatttggagagaaattgtgtgtgtgtatgtatatatatacatatatatatatatatataatatatgtccacagacacacacacatacacaaatatacacccaagtcattcatttcattatatca

SEQ ID NO: 6989 - DNA, 170 bp, Homo sapiens
  DISO7_10001456
  Located on chromosome 4
  Distance between a terminus base of telomere on chromosomal short arm and 5'-terminus of this base sequence : 66526774
  Distance between 3'-terminus of neighbour sequence of sequence listing upward to telomere on chrosomal short arm and 5'-terminus of this base sequence : 29369
tatctgactctgaagtctttgttgtttccaatatatttgctattagccaactatatattgtatatatacaatatatagttgtatatatatatatatatatatatactatatatatattgtatagttggctaataaataccacatatataagccaactataccacggacca

SEQ ID NO: 6990 - DNA, 113 bp, Homo sapiens
  DISO7_10001457
  Located on chromosome 4
  Distance between a terminus base of telomere on chromosomal short arm and 5'-terminus of this base sequence : 66543368
  Distance between 3'-terminus of neighbour sequence of sequence listing upward to telomere on chrosomal short arm and 5'-terminus of this base sequence : 16424
ggtagatatttggatgaatgacactttgaaatacgtatattgaaacacaaatcatacacacacacacacacacacacacacacgtaatacgtgatcattaatctatgacattg

SEQ ID NO: 6991 - DNA, 133 bp, Homo sapiens
  DISO7_10001459
  Located on chromosome 4
  Distance between a terminus base of telomere on chromosomal short arm and 5'-terminus of this base sequence : 66573094
  Distance between 3'-terminus of neighbour sequence of sequence listing upward to telomere on chrosomal short arm and 5'-terminus of this base sequence : 29613
atcaagagctcaaattgcctgtgtgtgtgtgtgtgtgtgtgtgtgtgtgtgtgtgtgtgtagattaaaatgtttattacacatgcacatggggctttcctcaaattcaggagaaacatatcatattaggatcc

SEQ ID NO: 6992 - DNA, 207 bp, Homo sapiens
  DISO7_10001458
  Located on chromosome 4
  Distance between a terminus base of telomere on chromosomal short arm and 5'-terminus of this base sequence : 66578203
  Distance between 3'-terminus of neighbour sequence of sequence listing upward to telomere on chrosomal short arm and 5'-terminus of this base sequence : 4976
tgaagatgtcctgggttattcaaaatcaaaaagtttttcttcccatttaaatataggtgtcttttcttcttcttgttcttcttcttcttcttcttcttcttcttcttcttcttcttcttcttcttcctcttcttcttcttcttcttcttcttcttcttcttcttattattattattattatttcgtggttaggagatgctactgttt

SEQ ID NO: 6993 - DNA, 98 bp, Homo sapiens
  DISO7_10001460
  Located on chromosome 4
  Distance between a terminus base of telomere on chromosomal short arm and 5'-terminus of this base sequence : 66681321
  Distance between 3'-terminus of neighbour sequence of sequence listing upward to telomere on chrosomal short arm and 5'-terminus of this base sequence : 102911
caggaatgtgcttggaatatacatatattccttgaagtataagatatatatatatatatatatgtattccttttcaagacacatgcaataaacatatg

SEQ ID NO: 6994 - DNA, 184 bp, Homo sapiens
  DISO7_10001462
  Located on chromosome 4
  Distance between a terminus base of telomere on chromosomal short arm and 5'-terminus of this base sequence : 66774238
  Distance between 3'-terminus of neighbour sequence of sequence listing upward to telomere on chrosomal short arm and 5'-terminus of this base sequence : 92819
gaagtagtccgtgaatctgaaagattaataaatgcatgtggtttaaatgtttaaatgcaattttcaagaaagagcaaatttcacattggaaatttaaaagactgaaacagaacaatctatgtatctatctatctatctatctatctatctatctatctatacttaaattctgataatgccaaca

SEQ ID NO: 6995 - DNA, 174 bp, Homo sapiens
  D4S2987
  Located on chromosome 4
  Distance between a terminus base of telomere on chromosomal short arm and 5'-terminus of this base sequence : 66774871
  Distance between 3'-terminus of neighbour sequence of sequence listing upward to telomere on chrosomal short arm and 5'-terminus of this base sequence : 449
ttaggtttatactgaactttgcagtttgctaaactcttttatagataatatcacattttgttcttataagtctaaaagactaaaaaaattgtcttacacacacacacacacacacacacacacacacacacacacaggcttactttaaaattaagaacgatagtacatgttcca

SEQ ID NO: 6996 - DNA, 280 bp, Homo sapiens
  AC018683.3_77912
  Located on chromosome 4
  Distance between a terminus base of telomere on chromosomal short arm and 5'-terminus of this base sequence : 66880688
  Distance between 3'-terminus of neighbour sequence of sequence listing upward to telomere on chrosomal short arm and 5'-terminus of this base sequence : 105643
aatcattgaaactgaccaagagttgtagaatccaagatgactggtttaagtccaagatttttgttttgttgttgttgttgttaaacatccaggtacagaaatcttgagctgaagaactgataattttttatgtgtcatttttttcaaaagcataagaattttcatgaggctactagttcctaaaataattacttacatccaagggcggcattatccttaaaagatgaatattctttggtcaaagacactcattttagattacatagcaatgaggctaagg

SEQ ID NO: 6997 - DNA, 190 bp, Homo sapiens
  D4S1574
  Located on chromosome 4
  Distance between a terminus base of telomere on chromosomal short arm and 5'-terminus of this base sequence : 66914236
  Distance between 3'-terminus of neighbour sequence of sequence listing upward to telomere on chrosomal short arm and 5'-terminus of this base sequence : 33268
tgttcttttctaagttgtagattctgcttattctgcttcagagataatttatctatgttaaaaactataattgacactaaagtagaatagacaattcaatgaccatttttagtttttcatagcacagaaacacacacacatacacacacacacacacacacacacacactgtaaagccaaactttatact

SEQ ID NO: 6998 - DNA, 153 bp, Homo sapiens
  D4S1541
  Located on chromosome 4
  Distance between a terminus base of telomere on chromosomal short arm and 5'-terminus of this base sequence : 67103759
  Distance between 3'-terminus of neighbour sequence of sequence listing upward to telomere on chrosomal short arm and 5'-terminus of this base sequence : 189333
tggcacattttacagagcctattcagatttcacatattataaagtgctcatgtgtaagtgtgaatgtgtgtgtgtgtgtgtgtgtgtacctgaatctatgtaattttatttcatgggtacccttgtgtaaccatcaggaaactcaggataccc

SEQ ID NO: 6999 - DNA, 455 bp, Homo sapiens
  chr4.fa.O7frz.69555433
  Located on chromosome 4
  Distance between a terminus base of telomere on chromosomal short arm and 5'-terminus of this base sequence : 67194365
  Distance between 3'-terminus of neighbour sequence of sequence listing upward to telomere on chrosomal short arm and 5'-terminus of this base sequence : 90453
ccagtagaatcaaacatgaaacactctctcaaaggcctatagaacccagggtctgtggtattcctatgaaataaatagctgctgaggataagctcgtgattaaaaattataaaaaaaataaggaaaaaacacattaagagaaagtggcacaatttaataatataatggctaaaattactttctaatagaaaaaatactgaatcttcagattgaataatcatctctaatcccaagcaaggaaaataaaaccaaagcccatggctgagtatcttcagaatatcaacgttaaaaatacacacacacacacacacacagacacacacacacacacacactcacacatatgtatgtatgtatgtaaacacggagttcctaaaaaggaaagtctctgattgactgcaggcttatcatgagcaacggaggccagaattatctgaagatgtaatgcatcaact

SEQ ID NO: 7000 - DNA, 211 bp, Homo sapiens
  D4S416
  Located on chromosome 4
  Distance between a terminus base of telomere on chromosomal short arm and 5'-terminus of this base sequence : 67213880
  Distance between 3'-terminus of neighbour sequence of sequence listing upward to telomere on chrosomal short arm and 5'-terminus of this base sequence : 19060
atgtgtcttaggtggtttccttcttgtgacctataattgtattgccagatggtgatttataaatgtaaatctctattgttttcaaaccccttgaaacgatctcttaatttattgtatcttctttgcccctctcttctctctacacacacacacaaacacacacacacaccacacacacacacacacacacacacagaatcatacaaaccag

SEQ ID NO: 7001 - DNA, 379 bp, Homo sapiens
  chr4.fa.O7frz.69719086
  Located on chromosome 4
  Distance between a terminus base of telomere on chromosomal short arm and 5'-terminus of this base sequence : 67394584
  Distance between 3'-terminus of neighbour sequence of sequence listing upward to telomere on chrosomal short arm and 5'-terminus of this base sequence : 180493
gaatctgattgagctaagttgtatttttcacttatttatatttcccccgtgttttcttttttctggcttaaagccattttttattttttatcctccttgctatctttattctaccaatatttcaaaaccaaaacccaatatttcttctcacctatgaaatgtttctgagtgtatatacatacatatgtatgtgtatgcatgtgaaactgattatgtgtatgtatatatatatatatatatatatatatatatatatatacatcactccatatccttgaccttccaagaataggaggaacttccaagaatgacataattcacagatgctcaaatcccttaaataaaatggcatagtatctgcatgtaacctatgcatatt

SEQ ID NO: 7002 - DNA, 110 bp, Homo sapiens
  DISD22_0003717
  Located on chromosome 4
  Distance between a terminus base of telomere on chromosomal short arm and 5'-terminus of this base sequence : 67600554
  Distance between 3'-terminus of neighbour sequence of sequence listing upward to telomere on chrosomal short arm and 5'-terminus of this base sequence : 205591
actgacgaacacccttggggcttgtttgtaactgtgtattgtgtgtgtgtaactgtgtattgtgtgtgtgtgtgtgtgtgagtttcttttgtgggtaacagacagcagaa

SEQ ID NO: 7003 - DNA, 300 bp, Homo sapiens
  chr4.fa.O7frz.70253092
  Located on chromosome 4
  Distance between a terminus base of telomere on chromosomal short arm and 5'-terminus of this base sequence : 67854665
  Distance between 3'-terminus of neighbour sequence of sequence listing upward to telomere on chrosomal short arm and 5'-terminus of this base sequence : 254001
caagtgaatagttgttagcttcacatgtatctactacagcaaagtacacaaattaaaaaaaaaaaacaagcaaacagctcctcacagatatagatatgccatgtataccatatatatatatatatatatatatacatatatatatatattcttttttcttacatgccatcatgcatacaagtatcttaaaaatatgtggcagttgcatagagttgaagactgtaaggaaaattagggtaaaattttactgaatggaaaactatgcattgtatatagcagacctttagaattacctgattc

SEQ ID NO: 7004 - DNA, 320 bp, Homo sapiens
  G08366
  Located on chromosome 4
  Distance between a terminus base of telomere on chromosomal short arm and 5'-terminus of this base sequence : 67930137
  Distance between 3'-terminus of neighbour sequence of sequence listing upward to telomere on chrosomal short arm and 5'-terminus of this base sequence : 75172
ctcagggaatcttagggagccaagttacataaggctgttttctagatagatagatagatagatagatagatagatagatagataacatatatattgataacatgataacatgtgtgtgtgtgtctctctctctttatatatatatagtgttatcaagcctaaattatgtctttgtcctaagcctgccatattgaggttttctttcttgtcataatttaggaccaatctcagtcaattttttcctcttacatttagagggaacttaagaatctgattgtagtgcttactacccatgcagccatatgggaggcaagtgtcac

SEQ ID NO: 7005 - DNA, 184 bp, Homo sapiens
  DISD22_0003727
  Located on chromosome 4
  Distance between a terminus base of telomere on chromosomal short arm and 5'-terminus of this base sequence : 68007454
  Distance between 3'-terminus of neighbour sequence of sequence listing upward to telomere on chrosomal short arm and 5'-terminus of this base sequence : 76997
ctctgtcttctttgagatcctgtatatatatatatatattgtgtatatatatatatatatatacacatacatatatatacacctatatgtatgcgcatatatatatacacctatatatatgcgcatatatatatacacctatatatatgcgcatatatatatacaccctcccatccagacacat

SEQ ID NO: 7006 - DNA, 134 bp, Homo sapiens
  D4S1568
  Located on chromosome 4
  Distance between a terminus base of telomere on chromosomal short arm and 5'-terminus of this base sequence : 68171602
  Distance between 3'-terminus of neighbour sequence of sequence listing upward to telomere on chrosomal short arm and 5'-terminus of this base sequence : 163964
gtttctttttcttggtgccccacccacctccacacacacacacacacacacacacacacacacacacaccatcagatgcatgccctaattaatactcatttgaaaacttgaggagaaccctctgcttgtctcca

SEQ ID NO: 7007 - DNA, 389 bp, Homo sapiens
  chr4.fa.O7frz.70691934
  Located on chromosome 4
  Distance between a terminus base of telomere on chromosomal short arm and 5'-terminus of this base sequence : 68536875
  Distance between 3'-terminus of neighbour sequence of sequence listing upward to telomere on chrosomal short arm and 5'-terminus of this base sequence : 365139
agtggtagacctgctaagttactacttttcttggctagcccaaccctggatttgccacgtaggggaaggaaagaaaaaaggaaaagaaaaggaaaggaaagcaaagaaaagaaaagaaagagagagagagagaaaggaagaaaagaaagaaagaaagaaagaaagaaagaaagaaagaaagaaagagaaagaaagaaagaaaagagaggaagagagggagggagggaggaaggaagggagaaggagagaaagagagaaaggaaagaagaaagaagagagaaagaaaaaaagcagacagaaagagagaaataaagaaagaaagaaaagtaaagaaaagaaaagaaaagaaaaagaaaagaaaaagtataaagatcttagaaaccaaggat

SEQ ID NO: 7008 - DNA, 406 bp, Homo sapiens
  chr4.fa.O7frz.71165166
  Located on chromosome 4
  Distance between a terminus base of telomere on chromosomal short arm and 5'-terminus of this base sequence : 68622070
  Distance between 3'-terminus of neighbour sequence of sequence listing upward to telomere on chrosomal short arm and 5'-terminus of this base sequence : 84806
acaaagactttgtaaagtaggtgataatcctatttctctctctctttcacacacacacacacacacacacacacacacacacacacacacacacacagagagagagagagagagacagaattaaaggcagagccaagctatttctactacacaatcctgagtgatttatgggagtatattataatgagagattttttctcactcagcaaggtaaaggaatttatgtagggttggcttcatatttggtatttaaaaaaatgagaaaggatatcacgaatcattctatctttatttgaatagtcattaaagatgctatttgaagtgcctgtcacaactcctaggtgcacagtgggctcggggaccatacttaaacacaatttctctgtagcttgtattgatactccat

SEQ ID NO: 7009 - DNA, 280 bp, Homo sapiens
  HUMUT1242
  Located on chromosome 4
  Distance between a terminus base of telomere on chromosomal short arm and 5'-terminus of this base sequence : 68700079
  Distance between 3'-terminus of neighbour sequence of sequence listing upward to telomere on chrosomal short arm and 5'-terminus of this base sequence : 77603
agatatccgatacttgtgggttgaaagacttaaataaaaagatatgccatacttgtggattgaaagacttaatattgttaaggtagttatattaactagagttctccagggagacagaaccaactggaacagtagatggattgatagatagaagatagatagatagatagatagatagatagatagacagacagatagatgaaaggggatttattagaattggcccaagcaattatggaggctgagaagttccacaacaggtgtattagtccattcttca

SEQ ID NO: 7010 - DNA, 267 bp, Homo sapiens
  AC025934.3_30232
  Located on chromosome 4
  Distance between a terminus base of telomere on chromosomal short arm and 5'-terminus of this base sequence : 68700202
  Distance between 3'-terminus of neighbour sequence of sequence listing upward to telomere on chrosomal short arm and 5'-terminus of this base sequence : -157
ctggaacagtagatggattgatagatagaagatagatagatagatagatagatagatagatagacagacagatagatgaaaggggatttattagaattggcccaagcaattatggaggctgagaagttccacaacaggtgtattagtccattcttcatactgctataaagaactgcccaagactgggtaatttatgaaggaaagaggtttaattgattcacagttccacatggctgggaaggccttaggaaacttataatcacggtg

SEQ ID NO: 7011 - DNA, 279 bp, Homo sapiens
  D4S409
  Located on chromosome 4
  Distance between a terminus base of telomere on chromosomal short arm and 5'-terminus of this base sequence : 68741566
  Distance between 3'-terminus of neighbour sequence of sequence listing upward to telomere on chrosomal short arm and 5'-terminus of this base sequence : 41097
cttgccttcagactcaaactaaaccactggctcttcctgggactcacccctgccaccctttggactggaacaccaccatctcctaggtctctagtttgccaattcactctgtagataatgggacttgccagcatccacaatcacatgaatcaatcccttataataaatatctctctctctctctctctctctggatacacacacacacacacacacacacacacacacacaccctttgttggttctatttctctggagggccctaacattgaaaggttg

SEQ ID NO: 7012 - DNA, 395 bp, Homo sapiens
  chr4.fa.O7frz.71281835
  Located on chromosome 4
  Distance between a terminus base of telomere on chromosomal short arm and 5'-terminus of this base sequence : 68785128
  Distance between 3'-terminus of neighbour sequence of sequence listing upward to telomere on chrosomal short arm and 5'-terminus of this base sequence : 43283
gttggaaacctactgataggaggaaattaaaaatgaacggcgtgactgaaacagagagtaagggagaagatgttcatcagggtattgcttcccctttctctgatccctcacaccaacattctgcctatttcctttcaactgaaagaaaataattcaccaagtctgtcacaaatacatatacatacctgcgcatgtgtctgtgtgcatgtgtgtggtgtgtgtctgtgtgtgtgtgtgtgtgtgtgtgtgtgaaataaggaaaatgagcagtagctctttggttcttaaaatcagggccagtcatatactttgcagggctcagtgcaaaactgaaaatgtggagtttcttatttagaaagcaggggtgggaggaaatgctgttaaagatactgaaa

SEQ ID NO: 7013 - DNA, 461 bp, Homo sapiens
  chr4.fa.O7frz.71552106
  Located on chromosome 4
  Distance between a terminus base of telomere on chromosomal short arm and 5'-terminus of this base sequence : 69032325
  Distance between 3'-terminus of neighbour sequence of sequence listing upward to telomere on chrosomal short arm and 5'-terminus of this base sequence : 246802
gtcttccttaccaaatttctactctttaccttctcttagaaagcattctttgaagcagaatgaatacctataggcataaatatttccaatgaaattaacttgtgtttctatttgaatttatagtaaagtatctttgtgtgtgtgggtgtgtgtctgtgtgtgtgtgtgtgtgtgtgacagtgtctcctctgttgcccaagctggagtgcaatggtgcaatcactagtcatgcagccttgacatccccggctccggtgattctcctgcctcagcctcctgagtagctgggactacaagcgcataccacacccggctaacgtttgtattgtttatagagacagggtttcatcacgttgttcaggttggtctcaaactcctgggctcaagcaacctgcccaccttggcctcccaatgtgctagaattacaggcatgggcctctgagttagaccactaagtacct

SEQ ID NO: 7014 - DNA, 259 bp, Homo sapiens
  AC023984.2_101748
  Located on chromosome 4
  Distance between a terminus base of telomere on chromosomal short arm and 5'-terminus of this base sequence : 69111820
  Distance between 3'-terminus of neighbour sequence of sequence listing upward to telomere on chrosomal short arm and 5'-terminus of this base sequence : 79034
agacctttgttcacttgtttatctgctgaccttccctccactattgtcctatgaccctgccaaatccccctatgcgagaaacacccaagaatgatcaatataaataaataaataaataaataaataaataaaaagaaatttaggctgaaactgaaaggatgaagaaaaaaagctaaactagatgaagagtagataggtagattagagatcaggaatgttaaagcaagaaaaacagaacttcctgaggctgaagaatact

SEQ ID NO: 7015 - DNA, 199 bp, Homo sapiens
  D4S3018
  Located on chromosome 4
  Distance between a terminus base of telomere on chromosomal short arm and 5'-terminus of this base sequence : 69240556
  Distance between 3'-terminus of neighbour sequence of sequence listing upward to telomere on chrosomal short arm and 5'-terminus of this base sequence : 128477
gctttcaataccagcagggaacctttagcaaggatgcctttagaatctgtaccaaccagtggtccaccagagtcaccctagagagaacacacacacacacacacacacacacacacacacacacacacatatatatacttattattttcatctactgatctttaggccattttcccagaatgatggaacacctcggcat

SEQ ID NO: 7016 - DNA, 414 bp, Homo sapiens
  chr4.fa.O7frz.71872221
  Located on chromosome 4
  Distance between a terminus base of telomere on chromosomal short arm and 5'-terminus of this base sequence : 69331015
  Distance between 3'-terminus of neighbour sequence of sequence listing upward to telomere on chrosomal short arm and 5'-terminus of this base sequence : 90260
gtggaaatgtaaactagtgcagccattatggaaaacggtattgagatttctcataaaactaaaatagaactactatatgatccagcaatcccactactggatatttatccaaaggaaaagaaatcaccatgtcaaagagatatttgtacttgggtgtttatcgcagcactgttcacaatagccaagatgtggaatcaacctatgtgtccatcaacaaatgaacggataaagaaaatatggtatatatatatatatatatatatatatatatatatatatatatatatatatacacacacacacacacacacacacatacacaatggaatactatttggccataaaaagaatgaaatcttgtcatctgcagcaacatggatggaattggaggtcattgtgttaaatgaaataagc

SEQ ID NO: 7017 - DNA, 447 bp, Homo sapiens
  chr4.fa.O7frz.71948119
  Located on chromosome 4
  Distance between a terminus base of telomere on chromosomal short arm and 5'-terminus of this base sequence : 69406795
  Distance between 3'-terminus of neighbour sequence of sequence listing upward to telomere on chrosomal short arm and 5'-terminus of this base sequence : 75366
ccagtattaggtcaaatttgttactcagtttatgtcaccaaggtaggagaagcaaagccactgcttttagtccatatgcacagctttaatctactgccacggtattgtgatgctgtggtctctcacacctggcattcggcttgcagtatcccctagcactcacttggtagaaatagtgtcatctcaatgtgggtaaggtactacagttcatgttggacagaagaaccaaatgtgcgcacaaaatatcctaaattctcaaggaatgagaagaaaaaccaacttgcatgactgaaacacacacacacacacacacacacaaatatagggaaagctgtttcagggatcaagaaacaagttataacttccttagcatgctcaggaattcataaatacctcatcaggaaccacattatttgttatcttctttaactctaatgacaattctgc

SEQ ID NO: 7018 - DNA, 317 bp, Homo sapiens
  chr4.fa.O7frz.72249618
  Located on chromosome 4
  Distance between a terminus base of telomere on chromosomal short arm and 5'-terminus of this base sequence : 69755642
  Distance between 3'-terminus of neighbour sequence of sequence listing upward to telomere on chrosomal short arm and 5'-terminus of this base sequence : 348400
tacctatgttacaaacctgcactatctgcacatgtattccagaacttaaagtaaaatgaaaataataataataataataataataataaagaacacatctatggtcacttcttaatctcatttactttttcaaaagaactttaaattttgtagtttttaggtttagtccaaagttttctctcttcttgctctatcgtctctctctactggagcttacccactcactcagcttaaaataccacctatatggtgacaataataaaatgtatatcttaagatcaaactgcaattcttggtaccagattcacttgttcaac

SEQ ID NO: 7019 - DNA, 427 bp, Homo sapiens
  chr4.fa.O7frz.72732087
  Located on chromosome 4
  Distance between a terminus base of telomere on chromosomal short arm and 5'-terminus of this base sequence : 70199355
  Distance between 3'-terminus of neighbour sequence of sequence listing upward to telomere on chrosomal short arm and 5'-terminus of this base sequence : 443396
tgtaagtctttaatccatcttgagttaatttttgtataaggtgtaagaaaggggatcagtttctgttttctgcatatagctagcaagttttcccagttttcccgttgcttgtttttgtcagttttgtcaaagatcagattgttgtagatgtgtggtgttatttctgaagcctctgttctgttccattggtctatatatctgtcttggtaccagtaccatgctgtttttgttactgtagctttgtagtacagtttgaagtcaggtagagtgatgcctccagccgcttttttttgttttgttttgttttgttttgcttggggttgccttggctatacaagctcttttttccttccatataaaatgtaaagtagtttttctagttgtgagaagaaagtcaatggtagcttgatttgaatagcattgaatc

SEQ ID NO: 7020 - DNA, 401 bp, Homo sapiens
  chr4.fa.O7frz.72805233
  Located on chromosome 4
  Distance between a terminus base of telomere on chromosomal short arm and 5'-terminus of this base sequence : 70272564
  Distance between 3'-terminus of neighbour sequence of sequence listing upward to telomere on chrosomal short arm and 5'-terminus of this base sequence : 72782
tagtcacttatgccttagtctgactcagtaaatctgcattttttccataaacaatggtgaagggatggctttgagttctgtcctcttttgtccctcacctgtgaagataagctatcaatttacatttccagggtgaaattcaacagaaatgtttcaggttaaagattttgaggcccacaaggaatttcctcttgggaagattgtaagggaggtatgtaacttaaaaacaacaacaacaacaacaacaacaaaaacccaactttgtagctattttatttaggaataaaatgggaggcaggtttggctgatacagtttccagcttgacttccctttgacttagtgactttgggttttcaagattatttttctttcagacctgtagccacatttaatggaactt

SEQ ID NO: 7021 - DNA, 153 bp, Homo sapiens
  D4S3050
  Located on chromosome 4
  Distance between a terminus base of telomere on chromosomal short arm and 5'-terminus of this base sequence : 70350413
  Distance between 3'-terminus of neighbour sequence of sequence listing upward to telomere on chrosomal short arm and 5'-terminus of this base sequence : 77448
tgacatcataaccattagccacctcaaaacatttttgaatacatatattcacacacacgcagacacacacacacacacacacacacagagcccagaaaacaaaaagtattgaagataatatatataaataggaactcctgtgcattgttggta

SEQ ID NO: 7022 - DNA, 429 bp, Homo sapiens
  chr4.fa.O7frz.72990470
  Located on chromosome 4
  Distance between a terminus base of telomere on chromosomal short arm and 5'-terminus of this base sequence : 70521937
  Distance between 3'-terminus of neighbour sequence of sequence listing upward to telomere on chrosomal short arm and 5'-terminus of this base sequence : 171371
ctgacagttccatagctgtaacagaaggcatgactgggagacctcagaaaactaaaaatctggagaaagtaaagggggaagcaaacacatcttccatggtggcaggacaccgagagagagacagagggacagagagagagagagagagagagagagagagagagagaaagcaaaggcagaagtaacacaaaattttaaactatcagatctcatgaaaattcactcactatcaagagaacagcaaggaggaaatccacctccacgatctagtcacctcccaccaggccccttttccaattcaatatgagatttgtacaggaatacaaattcaaaccatagcacccagcctaatttattactttatagcaatgctaaaaatagcctaacacagaaaattgataccaagtgtagcatgttggcatagagata

SEQ ID NO: 7023 - DNA, 399 bp, Homo sapiens
  AF135419.1_56147
  Located on chromosome 4
  Distance between a terminus base of telomere on chromosomal short arm and 5'-terminus of this base sequence : 70693442
  Distance between 3'-terminus of neighbour sequence of sequence listing upward to telomere on chrosomal short arm and 5'-terminus of this base sequence : 171076
tcctaccaatatgtgatgtcaaccccggtggcccaactgtaaaatacctctctttgtactctctatctctatatctcagccagccaacacttatggaaaatagagagagactccattgagatattgagggtgggttcccctgatacacacacacacacacacacacacacacacacacacacatacacatatacacacacatgcatatagatactatatatacatatataccatggaatactactaagctgtaaaaagaaacaaactaatggcattaacagcaacttgcatgaagtggcagagcattattctaagtgaagtaattcaggaatagaaaactcaacatcatcagttgtcacttataagtgggatctaagctattaggatgcaaaggcataa

SEQ ID NO: 7024 - DNA, 439 bp, Homo sapiens
  AF135416.1_22601
  Located on chromosome 4
  Distance between a terminus base of telomere on chromosomal short arm and 5'-terminus of this base sequence : 70734026
  Distance between 3'-terminus of neighbour sequence of sequence listing upward to telomere on chrosomal short arm and 5'-terminus of this base sequence : 40185
tctacttagactccacgtagctctgtgtgtcacacttaaggccctggtggagtgggctcatgagggaacttcctgacccgagggttgcagagatctgtgggagaagcatgttacctggggcttcacattgactcatcacttccctgggaggttcatttgcctctgcattgctcctgggtgggacatcatcctgccttgtctctctttcccttccttccttcttttctttctttctttctctctctttctttctttctttctttctttctttctttctttctttctttctttctttctttctctttctttctttcttctttcttttcttcattcagttgttatttattaataatttatttttgttgttgttcattgtatttgttttattttaagttccaggatacatgtccaggatgtgaaggtttgttacataggtaaa

SEQ ID NO: 7025 - DNA, 97 bp, Homo sapiens
  D4S392
  Located on chromosome 4
  Distance between a terminus base of telomere on chromosomal short arm and 5'-terminus of this base sequence : 70890007
  Distance between 3'-terminus of neighbour sequence of sequence listing upward to telomere on chrosomal short arm and 5'-terminus of this base sequence : 155542
tcggtaaacattcatccagagtttatattaatacaaatacacacacacacacacacacacacacacaccacatcctgctgattggtccattttgaca

SEQ ID NO: 7026 - DNA, 200 bp, Homo sapiens
  D4S2421
  Located on chromosome 4
  Distance between a terminus base of telomere on chromosomal short arm and 5'-terminus of this base sequence : 70892885
  Distance between 3'-terminus of neighbour sequence of sequence listing upward to telomere on chrosomal short arm and 5'-terminus of this base sequence : 2781
atcatagtgggggacttcaatactccactgacagcactagacagatcatcaagacagatagtcaccaaggaagccatggatttaaactacaccttggaacaaatggacttaatagatagatagatagatagatagatagatagatagatagatagatagaacatttcatccaacaactgcagaatgcacattttattcaa

SEQ ID NO: 7027 - DNA, 222 bp, Homo sapiens
  AC027059.2_100236
  Located on chromosome 4
  Distance between a terminus base of telomere on chromosomal short arm and 5'-terminus of this base sequence : 70892903
  Distance between 3'-terminus of neighbour sequence of sequence listing upward to telomere on chrosomal short arm and 5'-terminus of this base sequence : -182
aatactccactgacagcactagacagatcatcaagacagatagtcaccaaggaagccatggatttaaactacaccttggaacaaatggacttaatagatagatagatagatagatagatagatagatagatagatagatagaacatttcatccaacaactgcagaatgcacattttattcaacagtgcatggaattttcttcaagttaaaccatgtgatagg

SEQ ID NO: 7028 - DNA, 404 bp, Homo sapiens
  chr4.fa.O7frz.73605026
  Located on chromosome 4
  Distance between a terminus base of telomere on chromosomal short arm and 5'-terminus of this base sequence : 71107877
  Distance between 3'-terminus of neighbour sequence of sequence listing upward to telomere on chrosomal short arm and 5'-terminus of this base sequence : 214752
gtgcaaattgtattggaataaatatcaatttctttcttatttttgtcattacatatcattatatattatcactatatatgtataattatatataatcactatatatgcataattatatataatcattacatatatgtataattacatataatcatataaactggggactgtctgtatgcatatatgtgtgtgtgtgtgtgtgtgtgtgtgtaaacagatggtccccaagttatgagggtttgacttaacgatttttccactttacgatgggtttatcatgatatggtcccattgtaagtttagagttctttaaaaattacaatggaattgcagttgctattgaatgaataacacattctgcatcataataaaattgaaaaattgtaagtcaaaccattgtaaat

SEQ ID NO: 7029 - DNA, 243 bp, Homo sapiens
  DISD22_0003744
  Located on chromosome 4
  Distance between a terminus base of telomere on chromosomal short arm and 5'-terminus of this base sequence : 71207668
  Distance between 3'-terminus of neighbour sequence of sequence listing upward to telomere on chrosomal short arm and 5'-terminus of this base sequence : 99387
actacctgctggacaaagcttttccagtaattatttatctacccatactataattgaagtataattctttttataactgtgatatgctaaatcaaattggaagattaattaaaaaaatgaatctccttttaatattaactatgaactagcctcatactatatatatatatatatatatatatatatatatatatgcataaaattagctattatattttcttaaactcatgaaggctatatgtc

SEQ ID NO: 7030 - DNA, 115 bp, Homo sapiens
  DISD22_0003746
  Located on chromosome 4
  Distance between a terminus base of telomere on chromosomal short arm and 5'-terminus of this base sequence : 71367828
  Distance between 3'-terminus of neighbour sequence of sequence listing upward to telomere on chrosomal short arm and 5'-terminus of this base sequence : 159917
tagtgttgggcatgaagctcacatatatatatatatatatatatatatatatatatatatatatatgtatatatatatgtgtgtgtgtgtgtgtaattgcaaacattaaggtaca

SEQ ID NO: 7031 - DNA, 349 bp, Homo sapiens
  chr4.fa.O7frz.74043480
  Located on chromosome 4
  Distance between a terminus base of telomere on chromosomal short arm and 5'-terminus of this base sequence : 71515524
  Distance between 3'-terminus of neighbour sequence of sequence listing upward to telomere on chrosomal short arm and 5'-terminus of this base sequence : 147581
acctccattagagctatttcagataaaagaaattgaagtagaataaattgaacgacaggttttaggtaaggaaatggataatacacacacacacacacacacacacacacacacacacacacacctgtcatccccatccctggggaaatgtactatgagccccaaattggtcaaaatatgtacaataacataacaggtttaatatattaagtttctgattcaggcagttttctttaaatcattgagataagattaaacgttgagttataggtgaaggaagtagtttaatgtttctctggctttgtgctgatttttctaaccttctgttaacagtgacagtataaggcac

SEQ ID NO: 7032 - DNA, 449 bp, Homo sapiens
  chr4.fa.O7frz.74237281
  Located on chromosome 4
  Distance between a terminus base of telomere on chromosomal short arm and 5'-terminus of this base sequence : 71721167
  Distance between 3'-terminus of neighbour sequence of sequence listing upward to telomere on chrosomal short arm and 5'-terminus of this base sequence : 205294
aagaaagctcaaattcttaaagactgttgatgtttgtttgataactcctggaaaatattagccctgaaatagaaaacttaacacttcaggaaatgaagttttgttttgttttgttttgttttgttttggtttggtttggttttgagacagagtctcactctgtcaccaggttggagtgcagtggcgcaatctcggctcactgcaacctctgcctcccaggttcaagcaattctccagcctcagtcttccaagtacctgggactacgggcatgcaccaccacacctggctaatttttgtattttttagtagagatgaggtttcaccatgttggccaggctggtcttgaactcctgacctcagataatccacccgcctccacctcccaaagtgctgggattacaggcatgagccaccgcacctggccagaaatgaagtttctaagatcaaa

SEQ ID NO: 7033 - DNA, 192 bp, Homo sapiens
  DISO7_10000284
  Located on chromosome 4
  Distance between a terminus base of telomere on chromosomal short arm and 5'-terminus of this base sequence : 71954506
  Distance between 3'-terminus of neighbour sequence of sequence listing upward to telomere on chrosomal short arm and 5'-terminus of this base sequence : 232890
gatgactcagctgggaccacaacacacacacagacacacacacactcacacacacacaccaaaaaaataaatacaacctcctcaccaaaaaaacccaatacaaagctctgaaacaaagctttcaggaaaagggtgggggaggtttaaaaaaaaaaaaaaggaaaaataccttataggttaagaacaaactgc

SEQ ID NO: 7034 - DNA, 197 bp, Homo sapiens
  chr4.fa.O7frz.74818077
  Located on chromosome 4
  Distance between a terminus base of telomere on chromosomal short arm and 5'-terminus of this base sequence : 71956065
  Distance between 3'-terminus of neighbour sequence of sequence listing upward to telomere on chrosomal short arm and 5'-terminus of this base sequence : 1367
ttctaagcagattaaaccatgttatatttttaaaatcctcccattcgataagatactgaagacaattatattttcttaatacacacacacacacacacacacacacacacacacacacacacacacggccctatattatccaatgaggcatttataccttggtagcaaaagggcaggtacttgctttatgaactaca

SEQ ID NO: 7035 - DNA, 193 bp, Homo sapiens
  DISO7_10000283
  Located on chromosome 4
  Distance between a terminus base of telomere on chromosomal short arm and 5'-terminus of this base sequence : 71959398
  Distance between 3'-terminus of neighbour sequence of sequence listing upward to telomere on chrosomal short arm and 5'-terminus of this base sequence : 3136
gcactctatcctaactcttcctcatccccggatgttaaattttattcagagaaaataaaaagacatttaaaacacacacacacaaacacacacacacacacgcaaagtctcttcatgaaatttcctaaagatgagtttcaacaaatttaagatttgaagaaattttttttatcagcctccatactttacacct

SEQ ID NO: 7036 - DNA, 234 bp, Homo sapiens
  D4S2969
  Located on chromosome 4
  Distance between a terminus base of telomere on chromosomal short arm and 5'-terminus of this base sequence : 72083598
  Distance between 3'-terminus of neighbour sequence of sequence listing upward to telomere on chrosomal short arm and 5'-terminus of this base sequence : 124007
gggttgtgatatccacagttttgaagtaaaaaaggtgagtgtcagtcatcattaaacaataaaacaggcagtagactagtagtgcattctatatagtaaaggtgaatgctgtttcgtgaatgtgtgtgtgtgtgtgtgtgtgctaagctgcatgaaaaatgtagttgctattgtgagttgtgttaaaaatgtttgaaaaaccactagtgtagtaggttaaaaaatggcattgga

SEQ ID NO: 7037 - DNA, 394 bp, Homo sapiens
  chr4.fa.O7frz.75163293
  Located on chromosome 4
  Distance between a terminus base of telomere on chromosomal short arm and 5'-terminus of this base sequence : 72294321
  Distance between 3'-terminus of neighbour sequence of sequence listing upward to telomere on chrosomal short arm and 5'-terminus of this base sequence : 210489
gagttcaacatctgatcaacatggtgaaaccccgtccccactaaaaatacaaaaattagccaggcatggtggtgggcgcctgtagtcccagctactcgggaggctgaggcaggagaattgcttgaacctgggaggaggttgcagtgagccaagattgccattgcactccagcctggcgacagagcgagactccatctctaaataaataaataaataaataaataaataaataaataaataaataaatagcaatcccgtcaacctgcccctgtttccccttacctatcttaccctacttcatgtttgcttattgtttttatcacaacctaacaaattatatttttgtttatttatttattgtctttcttcctcagctacagtgtaaactccactg

SEQ ID NO: 7038 - DNA, 168 bp, Homo sapiens
  Z66631
  Located on chromosome 4
  Distance between a terminus base of telomere on chromosomal short arm and 5'-terminus of this base sequence : 72401138
  Distance between 3'-terminus of neighbour sequence of sequence listing upward to telomere on chrosomal short arm and 5'-terminus of this base sequence : 106423
atgtaggcccattcaattcccaaggaggcaggaagccagtgggatacaaaggaaaaaacacctttctgtgtctgggaagttgctagtctgatcacgtgtatgtacatttcacacacacacacacacacacacacacactctctctcacattatgagagtccaagggcc

SEQ ID NO: 7039 - DNA, 160 bp, Homo sapiens
  D4S1543
  Located on chromosome 4
  Distance between a terminus base of telomere on chromosomal short arm and 5'-terminus of this base sequence : 72408866
  Distance between 3'-terminus of neighbour sequence of sequence listing upward to telomere on chrosomal short arm and 5'-terminus of this base sequence : 7560
ttccagcaatagggatggagtctcctttactcagttctgtctatgtatgtttacacacacacacacacacacacacacacacacacacacacacacagacacaactcatttgtagaggtggctgatttaattttgtcggaagccatattaactactttcg

SEQ ID NO: 7040 - DNA, 110 bp, Homo sapiens
  D4S2931
  Located on chromosome 4
  Distance between a terminus base of telomere on chromosomal short arm and 5'-terminus of this base sequence : 72516011
  Distance between 3'-terminus of neighbour sequence of sequence listing upward to telomere on chrosomal short arm and 5'-terminus of this base sequence : 106985
gctttctggcttgatacacacacacagacaaacacacacacacacacacacacacacacacacacacacacactctttggcaaaagaaatgaatgtattggtgaatcttt

SEQ ID NO: 7041 - DNA, 263 bp, Homo sapiens
  HUMUT677
  Located on chromosome 4
  Distance between a terminus base of telomere on chromosomal short arm and 5'-terminus of this base sequence : 72535574
  Distance between 3'-terminus of neighbour sequence of sequence listing upward to telomere on chrosomal short arm and 5'-terminus of this base sequence : 19453
tagacagggctgtaacagggttgtgtgtgtgtgcgtgtgtgtgtgtgtgtgtgtgtgtgtgtgtgtactgtcagatgattttattcgtatttttctagtgttcacccatcatttgaagcttaggcacatgcaactctaggaggtgagtttagtccctgaaatgagtatcttttttgaaagttgcttgacaagtgtgaagaaaatcattttccaaagcattaacgtcaattttatacaaaattctgcctgcgtgtgtttatatg

SEQ ID NO: 7042 - DNA, 425 bp, Homo sapiens
  chr4.fa.O7frz.75575767
  Located on chromosome 4
  Distance between a terminus base of telomere on chromosomal short arm and 5'-terminus of this base sequence : 72793295
  Distance between 3'-terminus of neighbour sequence of sequence listing upward to telomere on chrosomal short arm and 5'-terminus of this base sequence : 257458
ttgacaagctttattctgtttaacaactaccaaaattagaattcttaacaactgatggtgaaaaatttacaactgatttttagaaaaattatagattatttatttctaccataaaacaatttagtgaaactaaaagtttaattcaaatggctgccccacattacacacacacacacacacacacacacatacacacacaaacacagcaaaggggattattatttattatgcatttttcttgggccagaaactctgtcaggtgcttttagatatgtcctctctaatcttcactccaaatcctcatgtgataggaacaagctcaaaaacagaaagaagttcaatttgaccaataattacttttaagaaactaaattccaaatttttcccaggatttcagaaatgttgaattatggtatgatactggt

SEQ ID NO: 7043 - DNA, 234 bp, Homo sapiens
  AC073514.1_119944
  Located on chromosome 4
  Distance between a terminus base of telomere on chromosomal short arm and 5'-terminus of this base sequence : 72894797
  Distance between 3'-terminus of neighbour sequence of sequence listing upward to telomere on chrosomal short arm and 5'-terminus of this base sequence : 101077
atcttgccatcttcactgtactcatttgtcatcatcttcaattttgcaggattgtaaacacagtgaaaaatttcaatatacattcagtaattttaaaatgacaatgagagaaagaaagaaagatagaaagaaggaaggaaggaaggaaggaaggaaggcaggcaagcattaaaacttttaaacccaaacaaaaatacacaaaaggaatctggctgcttgtttggatacataggt

SEQ ID NO: 7044 - DNA, 409 bp, Homo sapiens
  AC073514.1_73866
  Located on chromosome 4
  Distance between a terminus base of telomere on chromosomal short arm and 5'-terminus of this base sequence : 72934479
  Distance between 3'-terminus of neighbour sequence of sequence listing upward to telomere on chrosomal short arm and 5'-terminus of this base sequence : 39448
aggtagttgagtcttcaacatcacagcattcaccaaggctttttagggttggctcaagtaccttactgaggaatacttccggaagatgagtccttctgcttagttcaaatgtatacctagcatgagggagaaaaggagatatgtgttatatatttcctatttatttatttatttatttatttattttttgtgacagagtctccctctgtcacccaggttggagtgaagtggtgccatcttggctcgctgtaacctctgcctcctgggttcaagcgattctcatgcctcagcctcccgagtacctgggattataggcgcccaccaccatgcccggctaagttttgtatttttagtggagacagggtttcaccatgttggctagggtggtctggaacttctgacctcaagt

SEQ ID NO: 7045 - DNA, 80 bp, Homo sapiens
  D4S2389
  Located on chromosome 4
  Distance between a terminus base of telomere on chromosomal short arm and 5'-terminus of this base sequence : 72958355
  Distance between 3'-terminus of neighbour sequence of sequence listing upward to telomere on chrosomal short arm and 5'-terminus of this base sequence : 23467
caggaaacagaatattgctgtcagttattattattattattattattattattattggctaaatccagttcatgatcatt

SEQ ID NO: 7046 - DNA, 246 bp, Homo sapiens
  DISD22_0003761
  Located on chromosome 4
  Distance between a terminus base of telomere on chromosomal short arm and 5'-terminus of this base sequence : 73114534
  Distance between 3'-terminus of neighbour sequence of sequence listing upward to telomere on chrosomal short arm and 5'-terminus of this base sequence : 156099
gctaaccatatacataataatggccatatatatatggtctattatatataaaatatctattatatatatagaagttgtctatttacatatatatttgtataaatagacaactaatgagtaaaaggaaaagtgtctatttacttatatatatatatatatatatatatatgatgagttattttaattaaaaagttcccagttctcctctttactaccccaaccaatttgcagaaaccaggactctca

SEQ ID NO: 7047 - DNA, 467 bp, Homo sapiens
  chr4.fa.O7frz.75843695
  Located on chromosome 4
  Distance between a terminus base of telomere on chromosomal short arm and 5'-terminus of this base sequence : 73190833
  Distance between 3'-terminus of neighbour sequence of sequence listing upward to telomere on chrosomal short arm and 5'-terminus of this base sequence : 76053
ttacttggcataatttcctctagatttatccatgttgtcacaaatggcaggaatccttttctcttttttgaagctgaacaatggtacagtatgcatgtgtgtatgtgtgtgtgtgtgtgtgtgtgtgtgtatttcacattttagttatccattcacttgttgattattcgttctctttgctattgagttgtttgagtttcttatatatttggtaaattaatatcagatgtatagtttgcaaatatattctaccattttgtaagttttctcttcactctattagttgattcttttggtgtagacgttttttaatttgatgcgatccgcttgtctatttgcctttgttgtctgtgcttttgggatcacatccaaaaaaatcattgctcatgccagtgtcacaaagcttttccacaattatttattctagtattttacgttttcaggtcttaccttcaagtctttaatcc

SEQ ID NO: 7048 - DNA, 101 bp, Homo sapiens
  DISD22_0003769
  Located on chromosome 4
  Distance between a terminus base of telomere on chromosomal short arm and 5'-terminus of this base sequence : 73295193
  Distance between 3'-terminus of neighbour sequence of sequence listing upward to telomere on chrosomal short arm and 5'-terminus of this base sequence : 103893
gcacagagttattgcctgttagatgttaaacacacacacacacacacacacacacacacaaatatatgtctatttccaaaaccctcactattccatgttca

SEQ ID NO: 7049 - DNA, 434 bp, Homo sapiens
  chr4.fa.O7frz.76170296
  Located on chromosome 4
  Distance between a terminus base of telomere on chromosomal short arm and 5'-terminus of this base sequence : 73435985
  Distance between 3'-terminus of neighbour sequence of sequence listing upward to telomere on chrosomal short arm and 5'-terminus of this base sequence : 140691
tcactgtaggtttccttaaattatatcatctcctttttaaaggattttaacttttaagtgtaaagaattataattaaaattaaaggattaaaatttttaaattaaaatttttaaatttttaaattttttgaatttttaaatttaaaaattttggtgcattttaaaattgtcttcaacggaaattgttgtgttgtgatgataaagatagtaatgttccctccagaaaatatatacattatggaaaaatagaaagaaaacgaaaaatcataattctacctaactagagaaaaccagtcacttttattattgtgatagtccctcaagatatttgcattctgtgtgtgtgtgtgtgtgtgtgtgtgtgtgtgtgtgtgtgtgtgtgtacagacatatttactttcctggctttgtttatttcatgtaacatgcacatt

SEQ ID NO: 7050 - DNA, 428 bp, Homo sapiens
  AC011819.3_93489
  Located on chromosome 4
  Distance between a terminus base of telomere on chromosomal short arm and 5'-terminus of this base sequence : 73508616
  Distance between 3'-terminus of neighbour sequence of sequence listing upward to telomere on chrosomal short arm and 5'-terminus of this base sequence : 72197
aattaatgcttacaagcgacacatcttaaatactaaaatgcaaaagataaaaaatgaaagggtaaagaaaatgcaccaagctgacactaaaagtaaataaataaataaataaataaataaataaataaagtagatgcagctataacaatattagataagctaccctttaaagtgagaagcattactaaaaacaaaaaatatatatatttataagattaaaaaactcaacccactgggaagacacagcaattgtaaatttgcatgcaactacttagctttacaatatataaagcaaaaattatcagaactaaaattaaactgagaaaacagttataattatagttgaagatttcagcacaacgaacactaaagaacaaacattttaaaagtcagtacatttctagatgatatgaataacgcaattaaca

SEQ ID NO: 7051 - DNA, 368 bp, Homo sapiens
  chr4.fa.O7frz.76445892
  Located on chromosome 4
  Distance between a terminus base of telomere on chromosomal short arm and 5'-terminus of this base sequence : 73716138
  Distance between 3'-terminus of neighbour sequence of sequence listing upward to telomere on chrosomal short arm and 5'-terminus of this base sequence : 207094
caaaacagatttaaggaactgactgaggttatccgttaaagaaaagaaggttgaaggaccatttggttgatgctattattgaaggaataaccggccgcgcgcagaggctcacacctgtagtcccagcactttgagaggccatagcgggcagatgccttgagcccaggaattccacacccaccttggcaacaaagtaagaccttgtctctacacacacccacacacacacacacacacacacacacacacacactacaaaaattagcccgacatggtggcgtgtggctatggacaccactgtactccagtccgggtgacagagcaagaccctgtctcgaaaaaaagataagcataagatactcctaggc

SEQ ID NO: 7052 - DNA, 177 bp, Homo sapiens
  chr4.fa.O7frz.76571907
  Located on chromosome 4
  Distance between a terminus base of telomere on chromosomal short arm and 5'-terminus of this base sequence : 73842371
  Distance between 3'-terminus of neighbour sequence of sequence listing upward to telomere on chrosomal short arm and 5'-terminus of this base sequence : 125865
aaactcatatgtcactacaaggacagcaatgacacattagttaaggagtatcataaatctgaatagtatttacagttaatcacacacacacacacacacacacacccttcaaatcttacagctcatatgtaaaagaaagatgagaaaggttttctcaaatttgatagcagttctaaa

SEQ ID NO: 7053 - DNA, 450 bp, Homo sapiens
  chr4.fa.O7frz.76650140
  Located on chromosome 4
  Distance between a terminus base of telomere on chromosomal short arm and 5'-terminus of this base sequence : 73951529
  Distance between 3'-terminus of neighbour sequence of sequence listing upward to telomere on chrosomal short arm and 5'-terminus of this base sequence : 108981
cctatcagattggtaacaattaaaaagagtgatggtattctagtctactgagaacacagaacattatcatcatttgccacaacattttgcaaaaatatctggcaaaatctaatgattattaaaacatacacacatttgactcatttagccctcttttggcacctgccatgacaacccatagaaaaattccatatatatgcactttattttagtactttgtagcaaaacacacagatacacacacacacacacacacacacacacaccctgaaaacaatctgaaagtccaccaacagtggaaagtttgattacgttacaacacattatattggggaataatatgtagccacgaaaaagattggattaaatctttgtgattgtaaaactggattgttgtctatgatgtattattaaataaaaatacaagttgcaaagtaatagatgaggtac

SEQ ID NO: 7054 - DNA, 129 bp, Homo sapiens
  DISD22_0003775
  Located on chromosome 4
  Distance between a terminus base of telomere on chromosomal short arm and 5'-terminus of this base sequence : 74043795
  Distance between 3'-terminus of neighbour sequence of sequence listing upward to telomere on chrosomal short arm and 5'-terminus of this base sequence : 91816
ttgctgcacttaacattatagaacacctttatcaccttagtgttgtgtgtgtgtgtgtgtgtgtgtgtttcaaaatctatgtagtgattatcagagctttcttttcctcttcacctatagtcatctgtg

SEQ ID NO: 7055 - DNA, 430 bp, Homo sapiens
  chr4.fa.O7frz.77127818
  Located on chromosome 4
  Distance between a terminus base of telomere on chromosomal short arm and 5'-terminus of this base sequence : 74466254
  Distance between 3'-terminus of neighbour sequence of sequence listing upward to telomere on chrosomal short arm and 5'-terminus of this base sequence : 422330
gaggtcaggagatcgagaccatcctggctaacacggtgaaaccctgtctctactaaaaatacaaaaaaaaattagccgggcatggcagcgtggcctatagtcccagctacttgggaggctgaggcaggagaatcacttgaacccaggaggtggaggttgcagtgagccaggatcacaccactgcactccagtctgtgtgacagagtgagactccatcttgaaggaaagaaaggaaggaaagaaggagagaaagaaagaaggagaaagaaagaaaggaagaaaaagaaagaaagaaagaaagaaagaaagaaagaaagagagagaaagaaagaaagaaaagtagaacatgtcattcctctactcagaaccctccactggcctataatctcactcacagtaaaagctgaaatccttacaagatctgcctagt

SEQ ID NO: 7056 - DNA, 380 bp, Homo sapiens
  chr4.fa.O7frz.77047370
  Located on chromosome 4
  Distance between a terminus base of telomere on chromosomal short arm and 5'-terminus of this base sequence : 74514642
  Distance between 3'-terminus of neighbour sequence of sequence listing upward to telomere on chrosomal short arm and 5'-terminus of this base sequence : 47958
catactgaaggaatatctgcactcccacccatgttcacggcaccattgttcacaaccaccaagatacggaataaaccggagtatccatcaatggatgaatggataagaaaaatgtggcctatatacacaatagaacagaaagaaagagagagagagaaagaaagtgagagagagagagagagagagagagagagataaagagaaagggaggcaggcagggagggagggaaagatagaaagaaatcttgtctcttgcaacaacatggaggaacctggagaacactgtgctcaatgaaacaagccaggcacagaaatgcaagcactgcatgatgtcacttatatgtagaatctaaaaaagctgaattcatagaagcagtgag

SEQ ID NO: 7057 - DNA, 254 bp, Homo sapiens
  chr4.fa.O7frz.77331209
  Located on chromosome 4
  Distance between a terminus base of telomere on chromosomal short arm and 5'-terminus of this base sequence : 74719868
  Distance between 3'-terminus of neighbour sequence of sequence listing upward to telomere on chrosomal short arm and 5'-terminus of this base sequence : 204846
ttgaagtttattgaaacaggatacaatctttctgaaaaatttaagatagacaaattatttaatgtattacgaagatatgtatatatggttgttataattgatttcgttttagtcagcaacattatattgccaaaatttaaccatttatgcacacacacacacacacacacacacttaacccttttttccacatacttaaagaatgacagagacaagaccatcatgtgcaaattgagcttaattggttaattaga

SEQ ID NO: 7058 - DNA, 470 bp, Homo sapiens
  AP002825.1_73830
  Located on chromosome 4
  Distance between a terminus base of telomere on chromosomal short arm and 5'-terminus of this base sequence : 74804772
  Distance between 3'-terminus of neighbour sequence of sequence listing upward to telomere on chrosomal short arm and 5'-terminus of this base sequence : 84650
ctagtcaggatgttcctgtgactttttcttgaccataaatggaaactctgcaactgatctttgtataccccatgtgaactgttgcagcaccatcattgcatttgctcagtatgttcaggaagcaacctttgaagaaatggaaaagctggtgaaagacatggtagaatacaaagacagatgtatggctgacaagacgctcccagagtgttcaaaattacctgtaagtaaattgcttgtgtttcttttccttttatcttatgtctttctttctctttctttctttctttctttctttctttctttctttctttctttctttctttctttcattctttctttcttctttctttctttctttccttcttttttttttcttgaaacagagtctcgctctgtcacccaggctggagtgcagtggcaatcttggctcactgcaacctccacttcctgggttcaggcaattctcatgc

SEQ ID NO: 7059 - DNA, 245 bp, Homo sapiens
  HUMUT5137
  Located on chromosome 4
  Distance between a terminus base of telomere on chromosomal short arm and 5'-terminus of this base sequence : 74804953
  Distance between 3'-terminus of neighbour sequence of sequence listing upward to telomere on chrosomal short arm and 5'-terminus of this base sequence : -289
atggctgacaagacgctcccagagtgttcaaaattacctgtaagtaaattgcttgtgtttcttttccttttatcttatgtctttctttctctttctttctttctttctttctttctttctttctttctttctttctttctttctttcattctttctttcttctttctttctttctttccttcttttttttttcttgaaacagagtctcgctctgtcacccaggctggagtgcagtggcaatcttg

SEQ ID NO: 7060 - DNA, 350 bp, Homo sapiens
  AC074250.3_182432
  Located on chromosome 4
  Distance between a terminus base of telomere on chromosomal short arm and 5'-terminus of this base sequence : 74909081
  Distance between 3'-terminus of neighbour sequence of sequence listing upward to telomere on chrosomal short arm and 5'-terminus of this base sequence : 103883
agtgcattctagtgctcagaatacatgaaacctgacaaatgtttatttttacggcaggtcaaaactcaattttattttatttatctggtcttaaacaagtttcttatcccctctgtgcctgtgtcctcatctgtaaaataaaaatgataatagcatgaggtaggatagggttgttttgaggattaaaagagttaatttgtataaaattcttgaatcagtgccctgaaaatagtaagcattcaatatagattaacaataattataattatcctcatctccattgtcatcatcatcatcatcatcatcatcatcatcatcaccagcatctgtatctatttcattcctgatgg

SEQ ID NO: 7061 - DNA, 453 bp, Homo sapiens
  AL136327.2_165906
  Located on chromosome 4
  Distance between a terminus base of telomere on chromosomal short arm and 5'-terminus of this base sequence : 74936562
  Distance between 3'-terminus of neighbour sequence of sequence listing upward to telomere on chrosomal short arm and 5'-terminus of this base sequence : 27131
ctgttatccaaccatgagttaattaaatggttacatatctaaaagtggaaaattgggttcactcgtttgtaaattcaacaaatatttcacgagttccttctctgcacctgctaccgtgctaggcacagaaagtatagcctgtatctatatctatagcctcttatttctgaggccacaaggtgcacaaagtgtcataatgctaatgattttacaaagaactaatatatatacatatatctatatctatctatctatctatctatctatctatctatctatctatctatacatatatatacaggtgctaacttccctgtatttcccagccaaagacaatttctcttgcttctgaaatttcacaggaaattttctgtagctttctaattacttactgctttctctctctaaccatattttattttacttaatttgattactaggtcctttaggaca

SEQ ID NO: 7062 - DNA, 154 bp, Homo sapiens
  D4S2405
  Located on chromosome 4
  Distance between a terminus base of telomere on chromosomal short arm and 5'-terminus of this base sequence : 74936735
  Distance between 3'-terminus of neighbour sequence of sequence listing upward to telomere on chrosomal short arm and 5'-terminus of this base sequence : -280
cacaaggtgcacaaagtgtcataatgctaatgattttacaaagaactaatatatatacatatatctatatctatctatctatctatctatctatctatctatctatctatctatacatatatatacaggtgctaacttccctgtatttcccagc

SEQ ID NO: 7063 - DNA, 244 bp, Homo sapiens
  chr4.fa.O7frz.77952611
  Located on chromosome 4
  Distance between a terminus base of telomere on chromosomal short arm and 5'-terminus of this base sequence : 75167019
  Distance between 3'-terminus of neighbour sequence of sequence listing upward to telomere on chrosomal short arm and 5'-terminus of this base sequence : 230130
aaatatttgcactcttatgttcactgcagcattattcacaatagctaagatattgaaacaacctaaatgttcatcaacagatcaatagagaaagaaaacatgtaatatgtatacacacacccacaccccacaccctccacacacacacacacacacacacacagatatatatatataaagtgaaatattattcagcctttaaagagaggaaatcctgctatttgtaacaatgcagatagacata

SEQ ID NO: 7064 - DNA, 373 bp, Homo sapiens
  chr4.fa.O7frz.78165944
  Located on chromosome 4
  Distance between a terminus base of telomere on chromosomal short arm and 5'-terminus of this base sequence : 75266718
  Distance between 3'-terminus of neighbour sequence of sequence listing upward to telomere on chrosomal short arm and 5'-terminus of this base sequence : 99455
gttatgcttcatctttcacaactcacagacaggcacctgtcattttgaaagagtaaatattttctttgctatatgcatagcattttatagctctaagctgccagaagtctcattgccttttattctgcctagtgaatttctgttcattctgtgggatgaaacccgactcattcatgtacttttcagagtcagaggaaaagagctattacttcctctccaatgatgctctctctctctgtttttatttttcaatctatctgtgtctcttacacacgtaaacacacacacacacacacacacactgtctccttttctaaacagatagacatgtacatatacatacatacatgtatctaatattgcactagcaagc

SEQ ID NO: 7065 - DNA, 439 bp, Homo sapiens
  AL133124.3_104623
  Located on chromosome 4
  Distance between a terminus base of telomere on chromosomal short arm and 5'-terminus of this base sequence : 75431216
  Distance between 3'-terminus of neighbour sequence of sequence listing upward to telomere on chrosomal short arm and 5'-terminus of this base sequence : 164125
cttatggtcataaacaaggcagaggctgagtaactatttttcctaccatagaatgtcatgtaaccattaaaaagaatgggggaagactgcatcaaagtagcataaaaggatgctgaacccatatttttatttatttatttatttatttatttatttattttgagatggggtttcactcttgttgcccaggctggagtgcaatggcccggttgaacccatattttgaaagacaaaagtaagttgtataataatctatataaagggatcccatttatataaaaaagaccttcatatacctctgtgaatagtatacatgtatctttacatattaaacatgtttctctctgtatatgcataaatatgtgcatataaatctacatagaatagaaaactaatcccaaattgtcaccaatggttaccactgaagagcagtaatatg

SEQ ID NO: 7066 - DNA, 407 bp, Homo sapiens
  chr4.fa.O7frz.78200539
  Located on chromosome 4
  Distance between a terminus base of telomere on chromosomal short arm and 5'-terminus of this base sequence : 75632692
  Distance between 3'-terminus of neighbour sequence of sequence listing upward to telomere on chrosomal short arm and 5'-terminus of this base sequence : 201037
tcaccttacataagctagttaatgtaggtgaattgccaagcataatgcctggtgaaagactgtgtgtgtgtgtgtgtgtgtacgcgcgagggtacattgctcacgttttctctccattcccacgaaagtattaacccagaagtatacaacttcacgcttcagttaccaccatcctcctcattacttttctggcctaaactctcttccagtgtagtctgttctctttgcccaactctcatatgaatcaactttaaagcactcatgcttattcccatcttctcctgactctccttacaggtttaatttgccttactcattttgctcttaatgctatactgcgttgcacttttacttagttgttcctaactagattggatgcctctgtaagattagcttcctgtcttaca

SEQ ID NO: 7067 - DNA, 322 bp, Homo sapiens
  chr4.fa.O7frz.78324373
  Located on chromosome 4
  Distance between a terminus base of telomere on chromosomal short arm and 5'-terminus of this base sequence : 75731044
  Distance between 3'-terminus of neighbour sequence of sequence listing upward to telomere on chrosomal short arm and 5'-terminus of this base sequence : 97945
tcttgtaatagaaggagccacattagttataaaattctaggtgttggtatttaaaaatcctaggagttaggattgattgattgattgattgattgattgattttgagatggagtctcactctattgcccaggcaggaatgcagcggcacgatctcggctcaccacaacctccgcctcctgggttcaagcgattctcctgcctcagcctcccgggtagctaggactacagtcacgtgccaccatgcccggctaatttttgtatttttagtagagacagggtttcaccatgttggccagactggtctcaaactcatgaccttgt

SEQ ID NO: 7068 - DNA, 233 bp, Homo sapiens
  DISO7_10001467
  Located on chromosome 4
  Distance between a terminus base of telomere on chromosomal short arm and 5'-terminus of this base sequence : 75791949
  Distance between 3'-terminus of neighbour sequence of sequence listing upward to telomere on chrosomal short arm and 5'-terminus of this base sequence : 60583
ttgatccatgggctgtagtttcctgacccctggtataaaccattattttttgtgcatgctcctgcttgctctctctctctctctctctctctctctttctttctatatatatatgtatgtgtgtgtgtatgcattttttaaaaactcctttaaaaaaggacctaaaggtaatttttgcataatctttcacattgttttaacctcctccccgcttacctcccacaagcagctag

SEQ ID NO: 7069 - DNA, 164 bp, Homo sapiens
  DISO7_10001468
  Located on chromosome 4
  Distance between a terminus base of telomere on chromosomal short arm and 5'-terminus of this base sequence : 75830384
  Distance between 3'-terminus of neighbour sequence of sequence listing upward to telomere on chrosomal short arm and 5'-terminus of this base sequence : 38202
gacattgtgttctcaataccgtataagtttgtctatatataaatactataagtttgcatatgtatatatatacacacacatatgtattcttcatgtatatatacatatatatatatatatatatatatatgtgaaggaaagtccataaatagcattctcaactt

SEQ ID NO: 7070 - DNA, 444 bp, Homo sapiens
  chr4.fa.O7frz.78947217
  Located on chromosome 4
  Distance between a terminus base of telomere on chromosomal short arm and 5'-terminus of this base sequence : 75981633
  Distance between 3'-terminus of neighbour sequence of sequence listing upward to telomere on chrosomal short arm and 5'-terminus of this base sequence : 151085
tcagctcatttacggctactgcataccataaacttaaacctttgctgtccttttttaggccacaaaaggctaaataaatcaattaaaaaacaatgctggccaggcatggtgactcacacttgtaatcccagcactttggaaggccgaggcaggtggataacttgaggtcagtatttcaagaccagcttgggcaacatagtgaaaccctgtctctactaaaaatacaaacattagccaagtgtggtggcatatgcctacagtcctgaggcaggagaattgcttgaacccaggaagcaaaggttgcaatgagctgagatcacaccagtgcactccagcctgggtgacagagcaagactctgtctcaaaaaatataaataaataaataaataaataaataaataaataaatggcaatgtaaatgatgcataagattgtcactacaat

SEQ ID NO: 7071 - DNA, 239 bp, Homo sapiens
  AC018935.5_123677
  Located on chromosome 4
  Distance between a terminus base of telomere on chromosomal short arm and 5'-terminus of this base sequence : 76125471
  Distance between 3'-terminus of neighbour sequence of sequence listing upward to telomere on chrosomal short arm and 5'-terminus of this base sequence : 143394
ctaatgaccattccttgacaagaatgaccattccttgacacggaaaaccagtaataaatgaataataataataataataataactaatctagttgtggtaggagttttggttatgcagagctcattttgtttttctcagcagttgtaaaatgaaatcataaagcatttttgctctaccattcagatgtgtaaaataaaaatagaacttctttattttctatgttggatcagaaggaatg

SEQ ID NO: 7072 - DNA, 278 bp, Homo sapiens
  D4S1558
  Located on chromosome 4
  Distance between a terminus base of telomere on chromosomal short arm and 5'-terminus of this base sequence : 76151124
  Distance between 3'-terminus of neighbour sequence of sequence listing upward to telomere on chrosomal short arm and 5'-terminus of this base sequence : 25414
ggaaataaaaaccgacctcaactaagataaggctatttatagtcttaatcgattccatttagtatggatgtttgtttcactgcagaaggttaatgtttgattatggggtgctgccctagactcttctaagggtattacatattttcacacacacacacacacacacacacacacacacacaatcaaaaaaaaaatctgaattctgaaacacatctgatcccagaacttcagaggagatactgtagagcagtatttattaatgggggtttaagagagct

SEQ ID NO: 7073 - DNA, 154 bp, Homo sapiens
  DISO7_10001469
  Located on chromosome 4
  Distance between a terminus base of telomere on chromosomal short arm and 5'-terminus of this base sequence : 76191850
  Distance between 3'-terminus of neighbour sequence of sequence listing upward to telomere on chrosomal short arm and 5'-terminus of this base sequence : 40448
gcagaggctaaagaggattgttttgggggcaccagtgtgtgtgtgtgtgtgtgtgtgtgtgtgtgtgtgaaagagagagagaattggaaagagatgggtatggaacaaagctagaaataatgaaaagaaaatgatgatgaggagataccttgaa

SEQ ID NO: 7074 - DNA, 101 bp, Homo sapiens
  DISO7_10001470
  Located on chromosome 4
  Distance between a terminus base of telomere on chromosomal short arm and 5'-terminus of this base sequence : 76225768
  Distance between 3'-terminus of neighbour sequence of sequence listing upward to telomere on chrosomal short arm and 5'-terminus of this base sequence : 33764
agcaataagatgcatgagacactagtgtttgtgtgtgtgtgtgtgtgtgtgtgtgtgtgtgtgtgtgagatggtggaaatgcgatgagagtgggcattgag

SEQ ID NO: 7075 - DNA, 198 bp, Homo sapiens
  chr4.fa.O7frz.79159121
  Located on chromosome 4
  Distance between a terminus base of telomere on chromosomal short arm and 5'-terminus of this base sequence : 76361528
  Distance between 3'-terminus of neighbour sequence of sequence listing upward to telomere on chrosomal short arm and 5'-terminus of this base sequence : 135659
gtatcaccattttcactgttaaacaatgcctagagcctgaagaatctcatgtgcatgcacgtgtgtgtgtgtgtgtgtgtgtgtgtgtgtgtgtgtgtgtgttttactaaagcatggagcccaggacaggggcccctctagttcagtctaaaggcagaactgcttcccttcttgtaatggctttccttagaattacat

SEQ ID NO: 7076 - DNA, 376 bp, Homo sapiens
  chr4.fa.O7frz.79293582
  Located on chromosome 4
  Distance between a terminus base of telomere on chromosomal short arm and 5'-terminus of this base sequence : 76485757
  Distance between 3'-terminus of neighbour sequence of sequence listing upward to telomere on chrosomal short arm and 5'-terminus of this base sequence : 124031
tctttatcgaagttatggatttacaaagtagaatttttgtttgggagagaggggcaagaggcagtaaaataaaacatatcatccatagaccagaatatttagtcgtctggagaggatcccatcctctagagaccaacctgggcacaacagtaagtaaaaagccttgatttcttcccactgccattttgccacctgcttacccaaactgcaggcaaacaaacacatgcacatgcatgtgcacgcacacacacgcacacacacacacacacaccataccctggttcagccttctttggaaaattacctgttccagaaaaatcaaccctacttgcatttaacattccctccaaaactcttagttcctcgaaatctaatc

SEQ ID NO: 7077 - DNA, 229 bp, Homo sapiens
  AC022059.2_135959
  Located on chromosome 4
  Distance between a terminus base of telomere on chromosomal short arm and 5'-terminus of this base sequence : 76565441
  Distance between 3'-terminus of neighbour sequence of sequence listing upward to telomere on chrosomal short arm and 5'-terminus of this base sequence : 79308
tctaccgcaattgcatatagactttggtatgcaacaaaaacaaatagattagagagagagagagacagagagagagagataattgatagatagatgacagttaatagatagaagatagagagatagatgatagatgatagatagatagatagatagatagatagatagataatacagggaaaaacaaaatttactcaggttgaacatttgcataacatatgacttagca

SEQ ID NO: 7078 - DNA, 209 bp, Homo sapiens
  D4S3042
  Located on chromosome 4
  Distance between a terminus base of telomere on chromosomal short arm and 5'-terminus of this base sequence : 76825620
  Distance between 3'-terminus of neighbour sequence of sequence listing upward to telomere on chrosomal short arm and 5'-terminus of this base sequence : 259950
ccatgctaagtttatgatgtctgtttagacacctaaacagagatgtcagacaagtgactggatatgtgaattgggagttcactggaccaggtagggatgatgagaaagagtgtgtgtgtgtgtgtgtgtgtgtgtgtttgtgtgtgtgtgtgtgtgtatgtcacataatttaaagacatagactatgtatgggtggagagtagttagct

SEQ ID NO: 7079 - DNA, 201 bp, Homo sapiens
  AC055843.2_49892
  Located on chromosome 4
  Distance between a terminus base of telomere on chromosomal short arm and 5'-terminus of this base sequence : 76858976
  Distance between 3'-terminus of neighbour sequence of sequence listing upward to telomere on chrosomal short arm and 5'-terminus of this base sequence : 33147
gcgacagagcaagactgtctcaaaataataataataataataataataataataatgaacaaacttgacctactagatatagacaaacagaatatcactttctttgagaatttccatggtgcatttagtacctaccagaacacacacacgagcatcttagattaactgaaaaagtaagttgtccaagaatagtgattaacc

SEQ ID NO: 7080 - DNA, 189 bp, Homo sapiens
  D4S2958
  Located on chromosome 4
  Distance between a terminus base of telomere on chromosomal short arm and 5'-terminus of this base sequence : 76868463
  Distance between 3'-terminus of neighbour sequence of sequence listing upward to telomere on chrosomal short arm and 5'-terminus of this base sequence : 9286
tgtagcaacctgcatgtttaccaggaatctctaaagaatctgtagcaccagccctggacctttcattcactattctcttttgtgtgtgagtgtgtgtgtgtgtgtgtgtgtgtcagagtctctagcccaggctaaagtgcagtggtacgatctcggctcactgcaacctctgcctcccaggttcaaatg

SEQ ID NO: 7081 - DNA, 223 bp, Homo sapiens
  HUMUT7943
  Located on chromosome 4
  Distance between a terminus base of telomere on chromosomal short arm and 5'-terminus of this base sequence : 76884934
  Distance between 3'-terminus of neighbour sequence of sequence listing upward to telomere on chrosomal short arm and 5'-terminus of this base sequence : 16282
gaactcccaattcaggcaggtgatcagcctgcctcgggctcccaatgtgctgggattacaggcgtgagccaccgcacctggcttctctgtttcttttctttctttctttctttctttctttctttctttctttctttctttctttctttctttctttctttctttctttctttctttctttctttcttttttcagggtctccctctgttgctcaggctggagt

SEQ ID NO: 7082 - DNA, 395 bp, Homo sapiens
  AC053517.6_115921
  Located on chromosome 4
  Distance between a terminus base of telomere on chromosomal short arm and 5'-terminus of this base sequence : 76966373
  Distance between 3'-terminus of neighbour sequence of sequence listing upward to telomere on chrosomal short arm and 5'-terminus of this base sequence : 81216
acatgttaaatcatgctcatacacaaagatacaattcataacaggacctcatttattactacccacattattcaactgaaacccatgcccaaacatagatattaaggtacactccttttctgccaaatactcacacaaaacaaaacaaaacaaaacaaaacaaaaatagcactttccccacacacaacaaaaacgaatcctcagtggtagctgtagcatatggattatattcagaataatccataatatttcatttaaaatatttcaaattataaaattatacttactattgcacattttaaataatctagtataaaaatcatcatcagattctttcatatgctgattaattaaagacaaaattcttaatcctgaattctacttcctttgaaatg

SEQ ID NO: 7083 - DNA, 306 bp, Homo sapiens
  chr4.fa.O7frz.79655608
  Located on chromosome 4
  Distance between a terminus base of telomere on chromosomal short arm and 5'-terminus of this base sequence : 77154427
  Distance between 3'-terminus of neighbour sequence of sequence listing upward to telomere on chrosomal short arm and 5'-terminus of this base sequence : 187659
gctacatttaaagtaacaaagcactgggctgtggctcacgcctgtaatcccagcactttgggacgtcgaagtgggcagactgcttgagcttaggagctgaagaccagcctgggcaacaaggcaaaaccccatctaaaattagccagacatggtggtgcacacctgtagtcacaaacacacaaacacacacacacacacaaacacacaaacaaacacacacacacacacacacacacacacagctaagcaactaacatttttattttgaataatgagggtgggtaaagaacagtagacttacctggt

SEQ ID NO: 7084 - DNA, 177 bp, Homo sapiens
  D4S2990
  Located on chromosome 4
  Distance between a terminus base of telomere on chromosomal short arm and 5'-terminus of this base sequence : 77321572
  Distance between 3'-terminus of neighbour sequence of sequence listing upward to telomere on chrosomal short arm and 5'-terminus of this base sequence : 166839
ttctcgtctatgaatacaggagtaaatgtgtattatacacacacacacacacacacacacacacacacacacatatgtgtgtatgtctcctctatgtatatctgatacctttacaattaataatataataaactctcaaataacctgtagaaagaagtttgccaaaagtgactgagg

SEQ ID NO: 7085 - DNA, 397 bp, Homo sapiens
  chr4.fa.O7frz.80441910
  Located on chromosome 4
  Distance between a terminus base of telomere on chromosomal short arm and 5'-terminus of this base sequence : 77693861
  Distance between 3'-terminus of neighbour sequence of sequence listing upward to telomere on chrosomal short arm and 5'-terminus of this base sequence : 372112
gttcactgcaatgtcatacttttcatgaatcaggtgactgtatacatatggttgttttcttgtatgctatgttctatcccactggtctatcttcttgtctatccttgtgccaatattatacaatcttgattattatggctttataatgactcttgataactggaagtggaagtcttccagctttgttcttgaagattgcctcagctattcttggtcctttgcattttcatatgtattttagaaatagtttgtcaacttccacacacacacacacacacacacacacacacacacacacacacacatgcctagagtttggtgaagattgtgatgaatctataaattcatagaaaattaacatctaaacatttcaattcatgaacgttatgtttaggtc

SEQ ID NO: 7086 - DNA, 214 bp, Homo sapiens
  D4S2915
  Located on chromosome 4
  Distance between a terminus base of telomere on chromosomal short arm and 5'-terminus of this base sequence : 77694096
  Distance between 3'-terminus of neighbour sequence of sequence listing upward to telomere on chrosomal short arm and 5'-terminus of this base sequence : -162
ttttagaaatagtttgtcaacttccacacacacacacacacacacacacacacacacacacacacacacatgcctagagtttggtgaagattgtgatgaatctataaattcatagaaaattaacatctaaacatttcaattcatgaacgttatgtttaggtcttctttaattttcccagtaatattttgtggttatcagtgtaaagttcttata

SEQ ID NO: 7087 - DNA, 108 bp, Homo sapiens
  D4S2393
  Located on chromosome 4
  Distance between a terminus base of telomere on chromosomal short arm and 5'-terminus of this base sequence : 77772105
  Distance between 3'-terminus of neighbour sequence of sequence listing upward to telomere on chrosomal short arm and 5'-terminus of this base sequence : 77795
gtgagcttttaacttggccaggaataaaaattattattattattattattattattattattattattattgccaaccagcagaagtgggtttgtaaggaagacaagg

SEQ ID NO: 7088 - DNA, 292 bp, Homo sapiens
  chr4.fa.O7frz.80724919
  Located on chromosome 4
  Distance between a terminus base of telomere on chromosomal short arm and 5'-terminus of this base sequence : 77970332
  Distance between 3'-terminus of neighbour sequence of sequence listing upward to telomere on chrosomal short arm and 5'-terminus of this base sequence : 198119
gtggaattctaccaaacatttaaagaaggactaataccaattcttctcaaactcttccagataattgaagaggaagaaattcttccaaactcgttctgtgagcccagtattgatatcaaaaccagacaaggatggacagacacacacacacacacacacacacacacacacccctataggccaatattcctgatgaacatagatacaaaaatgctcaacaaaataatagcaaactgaatctggcagcacattaaaaacatcattcaccatacataatcaagccagatttatc

SEQ ID NO: 7089 - DNA, 339 bp, Homo sapiens
  chr4.fa.O7frz.81149385
  Located on chromosome 4
  Distance between a terminus base of telomere on chromosomal short arm and 5'-terminus of this base sequence : 78145495
  Distance between 3'-terminus of neighbour sequence of sequence listing upward to telomere on chrosomal short arm and 5'-terminus of this base sequence : 174871
cagctgaagatcttaatagaacactgatctcccctgagcaagaaggaattcagctagcagactgattatggcctcgaaactgccactcttccctgggtctccagcctagactgcagatcttggatttaccaagcctccacaattgcatgagccaattccttaaaataaatctctctctctctctgtctctctctctctctgtctctctctctctctctctctctctctctctctctccacacacaggcacacccaccctccctgttggctatgtttctcaggagaaccccaacatagagataaaatcaaatattctataatcagaaatatggtttcagg

SEQ ID NO: 7090 - DNA, 395 bp, Homo sapiens
  chr4.fa.O7frz.80939707
  Located on chromosome 4
  Distance between a terminus base of telomere on chromosomal short arm and 5'-terminus of this base sequence : 78213297
  Distance between 3'-terminus of neighbour sequence of sequence listing upward to telomere on chrosomal short arm and 5'-terminus of this base sequence : 67463
agagtttgaatgagtggtctaagaggagaaattgtttccagttgaaatggaaaacctggttccagttatcgagatgttggaaggtatttatttttagaaggtccacttttttctaattttcttatatatggaaaaaagtaaaggccttggtaatatatatgtgtgtgtatatatattatatgtgtatatattatatattattatataattatatcatatattagtaatatatgatataattaatatatattattttatatatatattgtgtgtgtgtgtgtgtgtgtgtgtgtgtgtgtgtgtgtatacattttcccttttcatcatcaaaagcaaaactcaggccaggggaaatggatccaagtggggaggggagacatggataaagcatgctc

SEQ ID NO: 7091 - DNA, 254 bp, Homo sapiens
  chr4.fa.O7frz.80822990
  Located on chromosome 4
  Distance between a terminus base of telomere on chromosomal short arm and 5'-terminus of this base sequence : 78279796
  Distance between 3'-terminus of neighbour sequence of sequence listing upward to telomere on chrosomal short arm and 5'-terminus of this base sequence : 66104
accagtgagtaggagaattcactctgacttcaattcattgtggctgcctaactcttatctctctctgtctctgtctctgtctctctctctctctctcacacacacacacacacacacacacacacacacatcattctactatgcccagctagaatcagagcaggccaaatagagggagaaaaatccttacagacagggatacaattttaaaaataaagacttggcttcatagtagattccttgactaggaatct

SEQ ID NO: 7092 - DNA, 101 bp, Homo sapiens
  DISO7_10001471
  Located on chromosome 4
  Distance between a terminus base of telomere on chromosomal short arm and 5'-terminus of this base sequence : 78707727
  Distance between 3'-terminus of neighbour sequence of sequence listing upward to telomere on chrosomal short arm and 5'-terminus of this base sequence : 427677
agctggagatggatgtgagatcactggagttggggcgtgtgtgtgtgtgtgtgtgtgtgtgtaagactaatggaatgctattgaaatgacctaatggagag

SEQ ID NO: 7093 - DNA, 101 bp, Homo sapiens
  DISO7_10001472
  Located on chromosome 4
  Distance between a terminus base of telomere on chromosomal short arm and 5'-terminus of this base sequence : 78741331
  Distance between 3'-terminus of neighbour sequence of sequence listing upward to telomere on chrosomal short arm and 5'-terminus of this base sequence : 33503
ctctgactttctaatccacttcccctggatgccttcccaacacacacacacacacacacacacacacacacacagtcatgccatacaagatctcagaccta

SEQ ID NO: 7094 - DNA, 241 bp, Homo sapiens
  DISD22_0003784
  Located on chromosome 4
  Distance between a terminus base of telomere on chromosomal short arm and 5'-terminus of this base sequence : 78888863
  Distance between 3'-terminus of neighbour sequence of sequence listing upward to telomere on chrosomal short arm and 5'-terminus of this base sequence : 147431
aggagcagctctcacctgcgaggctcgggagccgcagccacaaagcgggagggacacgccactctggggtcccggccccgggccacccccgacacacacacacacacacacacacaccccggaaccttcgcccgcctctgaagagacgcgggtcagccccgccgccccctccagtcacccgacacacacccactcgccgtgggtcctcgggccgcctccccgcccgccaaagtctcaattc

SEQ ID NO: 7095 - DNA, 236 bp, Homo sapiens
  AP002822.1_61218
  Located on chromosome 4
  Distance between a terminus base of telomere on chromosomal short arm and 5'-terminus of this base sequence : 79104006
  Distance between 3'-terminus of neighbour sequence of sequence listing upward to telomere on chrosomal short arm and 5'-terminus of this base sequence : 214902
aggcagactgttgaatctgtagaggagttgtaataaaggtcagcagagccctggtggcatcagggaatgtgcaactggggccttggtaaggacagttaagatagttaactgtaggcagatagatgatagatagatagatagatagatagatagatagatagatagatagataactaaggacagttaagctagataagagcatgggtgctagggtaaagcagtacagttagtgctca

SEQ ID NO: 7096 - DNA, 250 bp, Homo sapiens
  G08402
  Located on chromosome 4
  Distance between a terminus base of telomere on chromosomal short arm and 5'-terminus of this base sequence : 79104084
  Distance between 3'-terminus of neighbour sequence of sequence listing upward to telomere on chrosomal short arm and 5'-terminus of this base sequence : -158
ggccttggtaaggacagttaagatagttaactgtaggcagatagatgatagatagatagatagatagatagatagatagatagatagatagataactaaggacagttaagctagataagagcatgggtgctagggtaaagcagtacagttagtgctcactaaatagatatgtcttcccctatgtgtcctatcctcccttgtaagtagataggggtcacaatactcattcttgtcattgaactgtgacagg

SEQ ID NO: 7097 - DNA, 213 bp, Homo sapiens
  G08390
  Located on chromosome 4
  Distance between a terminus base of telomere on chromosomal short arm and 5'-terminus of this base sequence : 79238564
  Distance between 3'-terminus of neighbour sequence of sequence listing upward to telomere on chrosomal short arm and 5'-terminus of this base sequence : 134230
cagccagggttctaccagagaaacagaaccagtaggacagtctatctgtctgtctatctatctatctatctatctatctatctatctatctaatctatctatctatatttaggttggtgcaaaggtaattgaggttttgaccattacttttaatgtcaaaaactgcaattacttttgcatcaacctaatatttcagggaattggctcatctga

SEQ ID NO: 7098 - DNA, 479 bp, Homo sapiens
  chr4.fa.O7frz.82424655
  Located on chromosome 4
  Distance between a terminus base of telomere on chromosomal short arm and 5'-terminus of this base sequence : 79301975
  Distance between 3'-terminus of neighbour sequence of sequence listing upward to telomere on chrosomal short arm and 5'-terminus of this base sequence : 63198
tagcaggctagctcatttaaccctcagaagagcccactggtgaagggaatgttgtcataccattttattattatagatcaagaaactgagagtgaaaaagattaagtcacttacctatagtttccaaggcaggaagggctgagctgggatctgtgaatgtgcatgtggccaagtaaatccttggtctgtgcaactcagtgcttgggtacatcatttcctgcttgtcctccctgttggctatcacactttcttcagggccatgagatcactggaacagttgagagagagagagagagagacagaaaggggggagtggaatatgggaactaatcaggataaaaagtaaagtcaaagaaaggaaacaggatcagagagagctactgaaaaggatatagtcattatgaagaacacagtaaacatatgtgtatttgaattggggctttatagaatgttttaaatggtaggagattaggttattt

SEQ ID NO: 7099 - DNA, 294 bp, Homo sapiens
  AC025806.3_133317
  Located on chromosome 4
  Distance between a terminus base of telomere on chromosomal short arm and 5'-terminus of this base sequence : 79587425
  Distance between 3'-terminus of neighbour sequence of sequence listing upward to telomere on chrosomal short arm and 5'-terminus of this base sequence : 284971
aaggcagtatcgaactcaactaaagaagacataggtgtgtaaaaaccaacttccatagcaggtgaaatgacagcaagaatgccacttgttgttgttgttgttgttgttttgtttttccttttcttcctacattgttctcactctatcattcagctttctcccttaggccttgtgccaggatgataagggatgggaacgggctcagttgcccatccctcatctctgaagtgttagcagacttcagaggttacagctgtgtaggccctggacctgacatacttcaggtacttgtga

SEQ ID NO: 7100 - DNA, 391 bp, Homo sapiens
  chr4.fa.O7frz.82772806
  Located on chromosome 4
  Distance between a terminus base of telomere on chromosomal short arm and 5'-terminus of this base sequence : 79707086
  Distance between 3'-terminus of neighbour sequence of sequence listing upward to telomere on chrosomal short arm and 5'-terminus of this base sequence : 119367
ttgtctgatgtacagaaaggagtatttagacaatgattgtttccttccccccaaaactatccaaataaagttaactttttttttccaaaactcaggcaaacaaaataaataaataaataaataaataaataaataaataaaattccaaccagataagatgctagaaattaaaatgccttactctctgcatttgtctcaggccattgatcattttgcttttgttcaagacaaatgttgagcataaatattgagtaaaataacttttgtttcatttaggaactgatgagaaaatgctcatcagcattctgactgagaggtcaaatgcacagcggcagctgattgttaaggaatatcaagcagcatatggaaaggtaaggtcacattaacatga

SEQ ID NO: 7101 - DNA, 205 bp, Homo sapiens
  DISO7_10001475
  Located on chromosome 4
  Distance between a terminus base of telomere on chromosomal short arm and 5'-terminus of this base sequence : 79871754
  Distance between 3'-terminus of neighbour sequence of sequence listing upward to telomere on chrosomal short arm and 5'-terminus of this base sequence : 164277
tggagttcatcttctgaaagtcttttcattggccataatgtaaacttttatacacacacacacacacacacacgcacacacacacaccccatatgtagttatatatatatatgtagttttatatatatagttttatatacagttatatatagttttatatatatatatatatatatatatctgtgtaattgttcaggataggtga

SEQ ID NO: 7102 - DNA, 201 bp, Homo sapiens
  Z67445
  Located on chromosome 4
  Distance between a terminus base of telomere on chromosomal short arm and 5'-terminus of this base sequence : 79890156
  Distance between 3'-terminus of neighbour sequence of sequence listing upward to telomere on chrosomal short arm and 5'-terminus of this base sequence : 18197
agctgatgaagtgagactgtgtctcaaaaataaataaataaataatcacatttccgtctctttttatttttgttttgttgtcgttcttgttgttggtggtggtggtggtggtggtgctggtggtggtggtggtggggtgtgtgtgtgtgtgtgtgtgtgtgtgtgtgtgtgtgtgtgtgatgggtctcatgctattgctca

SEQ ID NO: 7103 - DNA, 235 bp, Homo sapiens
  D4S2947
  Located on chromosome 4
  Distance between a terminus base of telomere on chromosomal short arm and 5'-terminus of this base sequence : 79977704
  Distance between 3'-terminus of neighbour sequence of sequence listing upward to telomere on chrosomal short arm and 5'-terminus of this base sequence : 87347
agagagatccctcatcccttgcactacataaggttagagtgagaagatggccatctgtgaggaaacaagccctctccaggcactgaatttcccagcaccttgctcttggacttcccagtctccataacagtaagaaattctgttgcttataagccacccaatgtgtgtgtgtgtgtgtgtgtgtgtgtgtgtgtgtgtgtgtgtgtgttttgagacacggtctctattggctagg

SEQ ID NO: 7104 - DNA, 251 bp, Homo sapiens
  D4S3003
  Located on chromosome 4
  Distance between a terminus base of telomere on chromosomal short arm and 5'-terminus of this base sequence : 79992707
  Distance between 3'-terminus of neighbour sequence of sequence listing upward to telomere on chrosomal short arm and 5'-terminus of this base sequence : 14768
aataggtggcccaatcctagatactcaagtgagaaatgaattcacttgccatgtcttttctgtgaattatctttattgcctggatggttgaagtagctgtgtgtgtgtgtgtgtgtgtgtgtgtgtgtgtgtgtgtcataagtaacagagaaataactttccattgtaagataaacagtgtaaggcaaaagttgtttaaccttccctacccctactcccctcttaacagtcgctatgtattgttttgagac

SEQ ID NO: 7105 - DNA, 252 bp, Homo sapiens
  D4S2963
  Located on chromosome 4
  Distance between a terminus base of telomere on chromosomal short arm and 5'-terminus of this base sequence : 80220861
  Distance between 3'-terminus of neighbour sequence of sequence listing upward to telomere on chrosomal short arm and 5'-terminus of this base sequence : 227903
ttgatgggcatttcgattgattccatgtctttgctattatgaatagtggtgtgacgaacatatgaatgcatgagtctttctggtagaatgatttattttcctttgggtaaatagtattgggataaacactacatattagtcaacatttgtaagtacacacatgcatacacacacacacacacacacacacacacacacacacacaataaaaacagccctttgtccttcaaacttactttacagaacagagct

SEQ ID NO: 7106 - DNA, 181 bp, Homo sapiens
  DISO7_10001476
  Located on chromosome 4
  Distance between a terminus base of telomere on chromosomal short arm and 5'-terminus of this base sequence : 80391891
  Distance between 3'-terminus of neighbour sequence of sequence listing upward to telomere on chrosomal short arm and 5'-terminus of this base sequence : 170778
tcctgttctcttgaggccttttatatatatatatatatatatatatatatatatatatatatatatacctcccaacataaatattttcaaaaagcatgcaaaaaagcagtcctaactgggaaagaaacaacataagagataaatgtacaggtcagtttttactgctaacatggaccatctg

SEQ ID NO: 7107 - DNA, 112 bp, Homo sapiens
  DISO7_10001477
  Located on chromosome 4
  Distance between a terminus base of telomere on chromosomal short arm and 5'-terminus of this base sequence : 80462816
  Distance between 3'-terminus of neighbour sequence of sequence listing upward to telomere on chrosomal short arm and 5'-terminus of this base sequence : 70744
ttacttcactttccagtggtgaaacaaaacaaaacaaaacaaaacaaaacaaaacgaaatgaaacaaaacacctttgatgataaccatgaaatgccaccgaacatgtacttt

SEQ ID NO: 7108 - DNA, 106 bp, Homo sapiens
  DISO7_10855122
  Located on chromosome 4
  Distance between a terminus base of telomere on chromosomal short arm and 5'-terminus of this base sequence : 80584270
  Distance between 3'-terminus of neighbour sequence of sequence listing upward to telomere on chrosomal short arm and 5'-terminus of this base sequence : 121342
gatggttaggagtacagtgccaatgagagagaaagagagagagagagagagagagagagagagagagagacacctctgtttggaccgggcatctttgctgtttgaa

SEQ ID NO: 7109 - DNA, 137 bp, Homo sapiens
  DISO7_10001491
  Located on chromosome 4
  Distance between a terminus base of telomere on chromosomal short arm and 5'-terminus of this base sequence : 81060996
  Distance between 3'-terminus of neighbour sequence of sequence listing upward to telomere on chrosomal short arm and 5'-terminus of this base sequence : 476620
aattctaggcagcaattcggaatttgcctggggtactaaccagaaaagagaaggaaatacacacacacacacacacacacacacagagagagagagagagagagagagagagagaacaaggaagaacatgaacttca

SEQ ID NO: 7110 - DNA, 119 bp, Homo sapiens
  DISO7_10001489
  Located on chromosome 4
  Distance between a terminus base of telomere on chromosomal short arm and 5'-terminus of this base sequence : 81064805
  Distance between 3'-terminus of neighbour sequence of sequence listing upward to telomere on chrosomal short arm and 5'-terminus of this base sequence : 3672
gtaagggaagtctataggctggtttaaaaaattatatatatgtatatatatatatatgtgtgtgtgtgtgtgtgtgtgtgtgtgtacatatatatataattctgcctggaacttcacct

SEQ ID NO: 7111 - DNA, 186 bp, Homo sapiens
  DISO7_10001484
  Located on chromosome 4
  Distance between a terminus base of telomere on chromosomal short arm and 5'-terminus of this base sequence : 81082539
  Distance between 3'-terminus of neighbour sequence of sequence listing upward to telomere on chrosomal short arm and 5'-terminus of this base sequence : 17615
tattcaggtaggtagcttcagcaatttatatacatttatatatatatatatatatatatatatataaatgtatataaacatgcagtacctcttttaaatatatataaaataatgcagtacctcttttaaatatatatttatatatattttatatatatataatttgaaacaacagttggatgtgac

SEQ ID NO: 7112 - DNA, 396 bp, Homo sapiens
  AC021127.5_183924
  Located on chromosome 4
  Distance between a terminus base of telomere on chromosomal short arm and 5'-terminus of this base sequence : 81165195
  Distance between 3'-terminus of neighbour sequence of sequence listing upward to telomere on chrosomal short arm and 5'-terminus of this base sequence : 82470
tgtttgtcttcaaagtctgctaaggtcttctgcccacttttaaattggattattattattattattattattattattatttttgcattgagttccctttatataccggatattaaccccttgtcacatgtatagtttacatatattttctcctatcctgtaggttttattttcactcttgtttcattcactgtatgaaagctttttcatttgatgtaatcccgtttgtctatttttgcttttgttgcctgtgcttttgaggtcttacttaaaaaattttcacccagcccaatgtcgtgaagtgtttctcctataaaaattatgctgtgaagcatttcttccagtagttttatagtttcaggtaatatttattgattgaatgagtacggtcagttt

SEQ ID NO: 7113 - DNA, 188 bp, Homo sapiens
  DISO7_10001494
  Located on chromosome 4
  Distance between a terminus base of telomere on chromosomal short arm and 5'-terminus of this base sequence : 81333111
  Distance between 3'-terminus of neighbour sequence of sequence listing upward to telomere on chrosomal short arm and 5'-terminus of this base sequence : 167520
ttggacagaacagtgaattaaagaaattctcaaatatctgattctctcctttggtactaattagtagttattttccatgtatatttaggttttttattattaagtgatatatatatagatattaagtgagatatatatatatatatatatatatatatatatatatgacaagctgaggaagataaagc

SEQ ID NO: 7114 - DNA, 220 bp, Homo sapiens
  DISO7_10001495
  Located on chromosome 4
  Distance between a terminus base of telomere on chromosomal short arm and 5'-terminus of this base sequence : 81360576
  Distance between 3'-terminus of neighbour sequence of sequence listing upward to telomere on chrosomal short arm and 5'-terminus of this base sequence : 27277
cagaataatcatgttaagggtcagaaatgggttagaattcttgtgtaaaactgggtaaagcttacacgatgcatgtgtgtgtgtgtgtgtgtgtgtgtgtgtatgtgcacagagaaagaggggatgattaaaaggagaagaataaagaaaatgttagatgaaaacatttcatgataaaatacaattctaaaaataacttgagattgcctacatttaactt

SEQ ID NO: 7115 - DNA, 298 bp, Homo sapiens
  chr4.fa.O7frz.84472330
  Located on chromosome 4
  Distance between a terminus base of telomere on chromosomal short arm and 5'-terminus of this base sequence : 81398716
  Distance between 3'-terminus of neighbour sequence of sequence listing upward to telomere on chrosomal short arm and 5'-terminus of this base sequence : 37920
atgtttgaaactaggtttggactaggttttccaattctttgagagagagagagagagagagtgtgtgtgtgtgtgtgtgtgtgtgtgtgtattttaaataggtaaatagatatagatgtacatatagatgtagatagatacagataagatttagatatagataaacctcaagtatttttactggtagcagtatgttaacaaatagtttggagactgccactccaaaacataagttctaaaaaggaatgaatctttttatcattatactcccagaacctagcactgttggttacatgtt

SEQ ID NO: 7116 - DNA, 101 bp, Homo sapiens
  DISO7_10001498
  Located on chromosome 4
  Distance between a terminus base of telomere on chromosomal short arm and 5'-terminus of this base sequence : 81580921
  Distance between 3'-terminus of neighbour sequence of sequence listing upward to telomere on chrosomal short arm and 5'-terminus of this base sequence : 181907
aatgtcagttatgtcatattgggacacacacacacacacacacacacacacacacacacacacacagagagagaagcccccacccatggaattatattaca

SEQ ID NO: 7117 - DNA, 326 bp, Homo sapiens
  chr4.fa.O7frz.84840644
  Located on chromosome 4
  Distance between a terminus base of telomere on chromosomal short arm and 5'-terminus of this base sequence : 81734336
  Distance between 3'-terminus of neighbour sequence of sequence listing upward to telomere on chrosomal short arm and 5'-terminus of this base sequence : 153314
cctattaagcagtggaatcataaggcagggactgtatcttttttctcattctgtcccaaatacctaaaagtgttcccatcccgaagaatatcctctccattgattttaaatgagaaaagacataataataagtgagtgagtgagtgagtgagtgagtgagtgagtgagtgagtgaattagcatggcttcacgggcactttgcttggctcctcgcctcaccctaagctgtgtgacctctaagcaacaattttcctgtaggcctgcaggaaaaattggacagaactactttgaagccagaaaacctccaaagatccttatttacctaa

SEQ ID NO: 7118 - DNA, 233 bp, Homo sapiens
  D4S3011
  Located on chromosome 4
  Distance between a terminus base of telomere on chromosomal short arm and 5'-terminus of this base sequence : 81777889
  Distance between 3'-terminus of neighbour sequence of sequence listing upward to telomere on chrosomal short arm and 5'-terminus of this base sequence : 43227
caaattgccatcccaaaagtttcatcaattcataattctacagtgtatatacatatatatatatatgtctgtgtacatgtatatatgtgtgtgtatatatatgtgtgtgtgtgtgtgtgtatatatacttcttttcttttcttttcttttttcgagggagtctcgctctgtcacccaggctggagtgcagtggtgcgatctcggctcactgcaacctccgcctcctgggttca

SEQ ID NO: 7119 - DNA, 301 bp, Homo sapiens
  AC025633.3_143646
  Located on chromosome 4
  Distance between a terminus base of telomere on chromosomal short arm and 5'-terminus of this base sequence : 81817324
  Distance between 3'-terminus of neighbour sequence of sequence listing upward to telomere on chrosomal short arm and 5'-terminus of this base sequence : 39202
ctgtttccatcctgcaaacctgccctacagatctcagatgtgccagttcccatagccgcatgagccacgttattaaaataaatctctttagataggtaggtagattagatagatgactggtagatgatagatagatgatagatgatagatagatagatagatagatagatagatagatagatagatacatagatagatagatcaatctaaagagaaatagatatctctatctgtgtgtttgtgtatgtggcctattggttctgtttctctggaaaaccttgacaaatacagtgaccaacta

SEQ ID NO: 7120 - DNA, 91 bp, Homo sapiens
  Z67012
  Located on chromosome 4
  Distance between a terminus base of telomere on chromosomal short arm and 5'-terminus of this base sequence : 81972365
  Distance between 3'-terminus of neighbour sequence of sequence listing upward to telomere on chrosomal short arm and 5'-terminus of this base sequence : 154740
ggaagtactgatgatatacaaccagatgtatagtacacacacacacacacacacacacacacacacacacacacctctgtgcattatgtga

SEQ ID NO: 7121 - DNA, 476 bp, Homo sapiens
  chr4.fa.O7frz.85397279
  Located on chromosome 4
  Distance between a terminus base of telomere on chromosomal short arm and 5'-terminus of this base sequence : 82315585
  Distance between 3'-terminus of neighbour sequence of sequence listing upward to telomere on chrosomal short arm and 5'-terminus of this base sequence : 343129
gcactttctactcaatcctttcttctgtttctcctttcataggtctcagagctgcatcatgggctgcaggcttcctccacctcctccagctccctccactttgtcctttatctttcacaggctcttctcttagtaaaccacttgcacttctaattccagttggcatctgtctcttacagaagcagggtatgatgcttttaagtctgtatgcctggcccactgtattagccagggttcagagaaacagaagcaatatgatatatctgtatatgtagatatagcctatagatatatagatatatctatatgtgcagatatgtagatatagcctatcagtctacaggatatacatatagacatacatatagacacacacacacacacacacacacacacacacatacacacactataaggaattggatcatgcaattacaaaagctgaaaactccctagatctgtattcagtaagctgg

SEQ ID NO: 7122 - DNA, 258 bp, Homo sapiens
  D4S2922
  Located on chromosome 4
  Distance between a terminus base of telomere on chromosomal short arm and 5'-terminus of this base sequence : 82331116
  Distance between 3'-terminus of neighbour sequence of sequence listing upward to telomere on chrosomal short arm and 5'-terminus of this base sequence : 15055
catgtttccactccagttcttcctctcctgcttatgcagaggctgttcttaaaaaatactaaacacacacacacacacacacacacacacacacacacatgccacacctatatctttagtagtttgagtaaagaagatgtgtattatcatatcccttttctaagatcaggcacccaaaaggagttaataaatcaccttggaaaagtaccttaaaaatcttcaaagggctgtaccctagcatccctaactgccctttat

SEQ ID NO: 7123 - DNA, 202 bp, Homo sapiens
  D4S1553
  Located on chromosome 4
  Distance between a terminus base of telomere on chromosomal short arm and 5'-terminus of this base sequence : 82508484
  Distance between 3'-terminus of neighbour sequence of sequence listing upward to telomere on chrosomal short arm and 5'-terminus of this base sequence : 177110
aaaagactgttagttaaacatcaggactttcaacatgaaatgaattgctccagaaaaagaaaagttgacagcgcagatttaaaaaacaattggtactaatattgaattgcccttttgggtctatggaaggtgtgtttgtgtatgtgtgtgtgtgtgtgtgtgtgtgtaatcaattacaagggaagcagaagcatttcatagc

SEQ ID NO: 7124 - DNA, 462 bp, Homo sapiens
  chr4.fa.O7frz.85687031
  Located on chromosome 4
  Distance between a terminus base of telomere on chromosomal short arm and 5'-terminus of this base sequence : 82683854
  Distance between 3'-terminus of neighbour sequence of sequence listing upward to telomere on chrosomal short arm and 5'-terminus of this base sequence : 175168
cagtagacagctgcatttctacagctctctttctcagtgacgtctctctccaggcatccatagctctgttcctgtgccttgccattcttgctgtcactagtccctgggtattttacctcctgttggttcttaaactcacccacactgctggaaattgtcccttcattaaattcttcccagttaagtcttcgaagaacaacatctggtcttgacaacctgattccaattacaaacactgggatcacctgatttgtgaactaaaccagcaaggatatggtcacattctcttttggggcagggtgcaagagtgagtgtgtgtgtgtgtgtgtgtgtgtgtgtgtgtgcgcgccgcgcatgcacgcatgcgcgcatgtgtgtgtacactcacgtgtatttgtgttgggattgggcagaagatatcagagtcagtgcccagggacctgtgaacaataactttctcca

SEQ ID NO: 7125 - DNA, 169 bp, Homo sapiens
  D4S400
  Located on chromosome 4
  Distance between a terminus base of telomere on chromosomal short arm and 5'-terminus of this base sequence : 82777770
  Distance between 3'-terminus of neighbour sequence of sequence listing upward to telomere on chrosomal short arm and 5'-terminus of this base sequence : 93454
atccctcacagcagatcaaatagagggtcagaagggaaggccaagccttacacacacacacacacacacacacacacatacacacagcatctctttatattcaggctggtttctgctgttatagcaagatatgaaatgaaatggcgcaggaaaagcacccagtgtagag

SEQ ID NO: 7126 - DNA, 129 bp, Homo sapiens
  DISD22_0003799
  Located on chromosome 4
  Distance between a terminus base of telomere on chromosomal short arm and 5'-terminus of this base sequence : 83063064
  Distance between 3'-terminus of neighbour sequence of sequence listing upward to telomere on chrosomal short arm and 5'-terminus of this base sequence : 285125
gagcctcccaggattagggggtggaacggcacctgctcaaaaaaaacgtgtgtgtgtgtgtgtgtgtgtgtgtgtgtgtgtgtgtgtgtgtgtgtgtgtgtgtatgatggcggaagcggagaagaaggt

SEQ ID NO: 7127 - DNA, 215 bp, Homo sapiens
  D4S2932
  Located on chromosome 4
  Distance between a terminus base of telomere on chromosomal short arm and 5'-terminus of this base sequence : 83431403
  Distance between 3'-terminus of neighbour sequence of sequence listing upward to telomere on chrosomal short arm and 5'-terminus of this base sequence : 368210
ggcttacttggaaaggtctcttccaacccaatattattcaaatactttcaattttcttctaatgtttttagtgtgtgtgtgtgtgtgtgtgtgtgtgtgtgtgtgtgtgtggttttgttttatttcttttaattctctgatacatttagaatttcttttattattttattttattttattatttatttatttatttttgagacagagttttgctc

SEQ ID NO: 7128 - DNA, 114 bp, Homo sapiens
  D4S2402
  Located on chromosome 4
  Distance between a terminus base of telomere on chromosomal short arm and 5'-terminus of this base sequence : 83502878
  Distance between 3'-terminus of neighbour sequence of sequence listing upward to telomere on chrosomal short arm and 5'-terminus of this base sequence : 71260
gcagaactagttgggcagaatttgaaagtcaatgatagatagatagatagatagatagatagatatagatagatagatagatatagatagataggctttcaaattatgcccagc

SEQ ID NO: 7129 - DNA, 466 bp, Homo sapiens
  AC021105.11_97151
  Located on chromosome 4
  Distance between a terminus base of telomere on chromosomal short arm and 5'-terminus of this base sequence : 83808093
  Distance between 3'-terminus of neighbour sequence of sequence listing upward to telomere on chrosomal short arm and 5'-terminus of this base sequence : 305101
ctacgtttgaattgagatccagttctatatgtctgtctttataagtttggaaatgattgatatttctcttagttttatgatctcctttttcttgttgccttttaccatgtgttttgcagatattttctctcaatctatggcttgtctgttcattatgttatgttatgttatgttatgttatgttatgttatgttatgttatgttatttttttgagatggagtctcgctctgttgcccaggctggagtgcagtggcgcaatctcgactcattgcaacctccacctcccaggttcaagtgattctcttgcgtcagcttcctgagctgctgggattacaagtggatgccaccaagcccagttaatttttgtatttttagtagagacgaggtttcaacatgttggccaggctggtcctgacctcaagtgatccgcctccttcggcctctctaagtgctaggattacaggc

SEQ ID NO: 7130 - DNA, 444 bp, Homo sapiens
  AC021105.11_165160
  Located on chromosome 4
  Distance between a terminus base of telomere on chromosomal short arm and 5'-terminus of this base sequence : 83875988
  Distance between 3'-terminus of neighbour sequence of sequence listing upward to telomere on chrosomal short arm and 5'-terminus of this base sequence : 67429
gcactgttctaaccactctgagtaataccacttatttctcacaacaaccctgtagtatagatactgttctccttattttaatgagagaggagccaggacatacatggataaagcgacatgattaaagtcagaggtggacatagtgaagctggaatttaaactgagggtgtctgccctagaccccatgctcttaattgccgtgctatagatactgtcttggagatggcatgtatgaacaagcccacacaattttcttttcctttcttttttcttttcttttcttttcttttctcaatgttttcttagaacattgagtactaaggctaagaaataaactttagtaaatgctttgaattcacatttaactattttatgttcttataaatgtgtctctttctttttcagtcaatgttacacattaaccaagcattaatgaattaggta

SEQ ID NO: 7131 - DNA, 114 bp, Homo sapiens
  DISO7_10001501
  Located on chromosome 4
  Distance between a terminus base of telomere on chromosomal short arm and 5'-terminus of this base sequence : 84090481
  Distance between 3'-terminus of neighbour sequence of sequence listing upward to telomere on chrosomal short arm and 5'-terminus of this base sequence : 214049
cttctgaccacagagctccaaaacaaacaaacaaacaaacaaacaaaaaacaaacaaaaaaacctttcaagtcccttatcattagattttagctggagcaaataacaactattc

SEQ ID NO: 7132 - DNA, 298 bp, Homo sapiens
  AC025517.2_66884
  Located on chromosome 4
  Distance between a terminus base of telomere on chromosomal short arm and 5'-terminus of this base sequence : 84246606
  Distance between 3'-terminus of neighbour sequence of sequence listing upward to telomere on chrosomal short arm and 5'-terminus of this base sequence : 156011
atctgaactacatggtccataaattattcttttgttgttgttgttgtatgaataaacatttacaggagagttttccaaattttctttgttcacagccccagggcccaaagaaatactttacagttttgttaattaaatagtgaggtccaaacaacttaataaatacgtacttcctcacaatttagtagctgttagaataaataatacacatcagttgagtgaaaaaatatttttatttcattcttaaataaccacaacagctcactaatgggatgtgtgcacaacttggtactgtctt

SEQ ID NO: 7133 - DNA, 417 bp, Homo sapiens
  AC025517.2_140962
  Located on chromosome 4
  Distance between a terminus base of telomere on chromosomal short arm and 5'-terminus of this base sequence : 84390757
  Distance between 3'-terminus of neighbour sequence of sequence listing upward to telomere on chrosomal short arm and 5'-terminus of this base sequence : 143853
gaacaagacaaagatcaaccaggtaagagaataagagcagagaaaatggaaacagagagagatagaaagagatatagatagatagatagatagatagagacttctaactatatatatatattctctcctcattcttctgtccactgctactcttgtgggctatatttttctcccaagaataatagaagttgtctaccaactcctcttcagaaacaaaaacattgaatgtgttatctgtaagctgtgcttttctgtgaatttatacacatgaggtgggagattattagggacttctaaagctagcacagaaattaagtattttatgtaagatttggaatgaaagggtaacattagttatgtggaaagcaccataatctagttttactttgttttatctttacaattctgaggacatgc

SEQ ID NO: 7134 - DNA, 218 bp, Homo sapiens
  HUMUT5692
  Located on chromosome 4
  Distance between a terminus base of telomere on chromosomal short arm and 5'-terminus of this base sequence : 84471211
  Distance between 3'-terminus of neighbour sequence of sequence listing upward to telomere on chrosomal short arm and 5'-terminus of this base sequence : 80037
agcctgttgaaatcccagcagtcctgttaacaatgaattgtgcacattctactggggacttccttcctttcctttccttcctttccttcctttccttccctttccttccttccttccttccttccttccttccttccttccttccttccttctctctcttttcttttcttttcttttcttttcttcttcctttctgtcctgaatctcgcactgtcacc

SEQ ID NO: 7135 - DNA, 245 bp, Homo sapiens
  chr4.fa.O7frz.87712410
  Located on chromosome 4
  Distance between a terminus base of telomere on chromosomal short arm and 5'-terminus of this base sequence : 84592523
  Distance between 3'-terminus of neighbour sequence of sequence listing upward to telomere on chrosomal short arm and 5'-terminus of this base sequence : 121094
aggacaaacctatttgacattccttaataacagttaatgagagatatctttgaattttttaaaatatagtgtgtgtgtgtgtgaacacacatgctggtgtgtgtgtgtgtgtgtgtgtgtgtgtgctgtcattacatgttaaaaataatttctagaatatatataatataaatactaattaagtaaatatgttaattttcttttaaaatgacaaatgtagtcagtagaaagccatcttacctcat

SEQ ID NO: 7136 - DNA, 149 bp, Homo sapiens
  D4S1538
  Located on chromosome 4
  Distance between a terminus base of telomere on chromosomal short arm and 5'-terminus of this base sequence : 84690626
  Distance between 3'-terminus of neighbour sequence of sequence listing upward to telomere on chrosomal short arm and 5'-terminus of this base sequence : 97858
tgagaattgcttggaaccgagaggtgaaagttgcagtgggccgagattgcgccactgcattccagcctgggtgacagagactccgtcacacacacacacacacacacacacacagaaacactcttacacaatgtctccgtgctgtgtgg

SEQ ID NO: 7137 - DNA, 332 bp, Homo sapiens
  chr4.fa.O7frz.87799216
  Located on chromosome 4
  Distance between a terminus base of telomere on chromosomal short arm and 5'-terminus of this base sequence : 84713033
  Distance between 3'-terminus of neighbour sequence of sequence listing upward to telomere on chrosomal short arm and 5'-terminus of this base sequence : 22258
ttattgcactgctaattagcacttctattaagcagtccagaagaggagaataatcaatcaaggaaaggagtttccatttaaggtttggtgggtgagaagttaaatctattggcaaaaatcagcttattttcagattctctgtggatttcctttatctatgttatttctgtccccaatagcatagaccaacataagctgattatactgtataacatgaggacacacacacacacacacacacacacacacacacacacacacacacagagctaaaggtttttggagcatgggcatatttaaactaaaacctctggatgacaaatttagttaag

SEQ ID NO: 7138 - DNA, 258 bp, Homo sapiens
  AC027462.3_101516
  Located on chromosome 4
  Distance between a terminus base of telomere on chromosomal short arm and 5'-terminus of this base sequence : 84743698
  Distance between 3'-terminus of neighbour sequence of sequence listing upward to telomere on chrosomal short arm and 5'-terminus of this base sequence : 30333
cctgacaagttacaaagctgacctcaagcttttctcccttccatacctgaaaagtgagtttctgacatggaattctttggagagagaaaaagaaaaaaaaaacaaaaaacctcccaccctgcaaacaaacaaacaaacaaacaaacaaacaaaaccaaacaaaaaaaaaaaacaagtttaatctctaataaggcattctgctataagggtaacacaaatcttcaccctttgtaacattcttagtctccagtgacctga

SEQ ID NO: 7139 - DNA, 156 bp, Homo sapiens
  D4S2361
  Located on chromosome 4
  Distance between a terminus base of telomere on chromosomal short arm and 5'-terminus of this base sequence : 84923784
  Distance between 3'-terminus of neighbour sequence of sequence listing upward to telomere on chrosomal short arm and 5'-terminus of this base sequence : 179828
ccacgtgactttcattagggcactcttgggatgcaaaaattcttttattattattattattattattattattattattattatactttaagttctagggtacatgtgcacaacgtgcaggtttattacatatgtatacatgcgccatgatggtgt

SEQ ID NO: 7140 - DNA, 248 bp, Homo sapiens
  AC016357.6_41159
  Located on chromosome 4
  Distance between a terminus base of telomere on chromosomal short arm and 5'-terminus of this base sequence : 85348225
  Distance between 3'-terminus of neighbour sequence of sequence listing upward to telomere on chrosomal short arm and 5'-terminus of this base sequence : 424285
tcaaagtctgactattccaggtttaaaagttttctaagaggtagtactgctacagctctgtccaaattgtcacccactttggcctatcaagtctctttgaggctctttcttctcctgggcaaaacgacacagcactatactacagaagatagagagctagatagatagatgatagatagatagatagatagatagatagatagatagatagatagacagacagatagatactgttcacttggaaacca

SEQ ID NO: 7141 - DNA, 262 bp, Homo sapiens
  D4S2410
  Located on chromosome 4
  Distance between a terminus base of telomere on chromosomal short arm and 5'-terminus of this base sequence : 85348280
  Distance between 3'-terminus of neighbour sequence of sequence listing upward to telomere on chrosomal short arm and 5'-terminus of this base sequence : -193
ctctgtccaaattgtcacccactttggcctatcaagtctctttgaggctctttcttctcctgggcaaaacgacacagcactatactacagaagatagagagctagatagatagatgatagatagatagatagatagatagatagatagatagatagatagacagacagatagatactgttcacttggaaaccatcatggcccttgcaggtagagcatgggtccctggctgacacagtcaccttaagtgtgctgacagcaagg

SEQ ID NO: 7142 - DNA, 153 bp, Homo sapiens
  HUMUT1856
  Located on chromosome 4
  Distance between a terminus base of telomere on chromosomal short arm and 5'-terminus of this base sequence : 85350221
  Distance between 3'-terminus of neighbour sequence of sequence listing upward to telomere on chrosomal short arm and 5'-terminus of this base sequence : 1679
cacaagacagtagggctagagctaaaggcaacctgagacagggcctttcttgatggtgctactgctgctgctgctgctgctgatgatgatgatgatgatggtgatgacaacaatgatggctacaactttcatagcttactatgtgccaggtac

SEQ ID NO: 7143 - DNA, 375 bp, Homo sapiens
  chr4.fa.O7frz.88633709
  Located on chromosome 4
  Distance between a terminus base of telomere on chromosomal short arm and 5'-terminus of this base sequence : 85524661
  Distance between 3'-terminus of neighbour sequence of sequence listing upward to telomere on chrosomal short arm and 5'-terminus of this base sequence : 174287
cttgcaaagacttagaatttgtagatacataggattaaaaatagtaattacataagaaatgtacattacttgcagaaaaaaaaatcctgtaatcctcctaccaagacattaatatttagaatacttcagtgtttaccctttgaggcttttttcttgtgcagtgtgtgtgtgtgtgtgtgtgtgtgtatgtgtgtgtatgtatggatgtgtgtaaagcaaaaatgagattgtactgttttctaccttactgttttaattttcattccatggtattattaggaacaacatttcatgcaggatcctaaatatatttcagaaacatttttaatgtctgtatattttgctgcatggctatggtctagtttatccaactga

SEQ ID NO: 7144 - DNA, 234 bp, Homo sapiens
  AC022739.3_171775
  Located on chromosome 4
  Distance between a terminus base of telomere on chromosomal short arm and 5'-terminus of this base sequence : 85640154
  Distance between 3'-terminus of neighbour sequence of sequence listing upward to telomere on chrosomal short arm and 5'-terminus of this base sequence : 115118
tcagtggttaagaacatagtcctctggagttaatgaccttggaaaattattcaactttctgaaccttagtttcttatctataaaactgggacaagagccaggtgtgggcaacacagcaagattctgtcttaaaacaacaacaacaacaacaacaacaaaaaacatggtacaagtacactatcttagaggattgttggaggactaaattaggtaactcatgtaaagtgcttagca

SEQ ID NO: 7145 - DNA, 448 bp, Homo sapiens
  AC023391.4_34042
  Located on chromosome 4
  Distance between a terminus base of telomere on chromosomal short arm and 5'-terminus of this base sequence : 85674903
  Distance between 3'-terminus of neighbour sequence of sequence listing upward to telomere on chrosomal short arm and 5'-terminus of this base sequence : 34515
gcctgactgtagtttcagctactcaggagactgaggtgggagaatcgcttgaacccgggaggtggaattttcaatcagctgagatcatgccactgcactctagcctgggtgacagagtaagactctgtctcacaaataaaataaaataaaataaaataaaataaaataaaataaaataaaataaaataaatcatataacaaaagagttctttagatcaccattaaatatcatccagagtctttatgcatctataatatacagagttatcatataggaaaaaattgtaaatagggacaaaggactttttgggaaaattttctgtggtattttcagatttttctgtcccaaatcaaaccttaaatgtggggaaagtgatggaattgacagttggttttacagtgattatccattatcctacggtgattctttggaatacgtaatttcacg

SEQ ID NO: 7146 - DNA, 403 bp, Homo sapiens
  chr4.fa.O7frz.88877617
  Located on chromosome 4
  Distance between a terminus base of telomere on chromosomal short arm and 5'-terminus of this base sequence : 85707791
  Distance between 3'-terminus of neighbour sequence of sequence listing upward to telomere on chrosomal short arm and 5'-terminus of this base sequence : 32440
agaatgtaagtcttctggactaaattacaacaacaataatgaagtggcaaaatagtgtgttcaccgttatttatgaatccttcaactggttcctctattatgaaaaagcacctagcaatctggcttaagctcttgcatattcagcaacttctttagtacctataagccctcatttctattcttctctaataaaatggtttaagaattggccacatgagtctaacatattattcaaatgggtactgaatatcaacttaaaattaagaaagtaattttaaaaatatccctgtaacacacacacacacacacacacacacacacacacacaccccccaaactactaccttataaaacaggtagatttacaagtgcacatacacttacctttacagtgttaacaagc

SEQ ID NO: 7147 - DNA, 119 bp, Homo sapiens
  DISD22_0003829
  Located on chromosome 4
  Distance between a terminus base of telomere on chromosomal short arm and 5'-terminus of this base sequence : 85902700
  Distance between 3'-terminus of neighbour sequence of sequence listing upward to telomere on chrosomal short arm and 5'-terminus of this base sequence : 194506
ctccatgaacttgagatattcttagactaaatttactaaagaaatgttattccatatgttacacacacacacacagacacacacacaccttatagattaactcatacagataatgccaa

SEQ ID NO: 7148 - DNA, 128 bp, Homo sapiens
  DISD22_0003831
  Located on chromosome 4
  Distance between a terminus base of telomere on chromosomal short arm and 5'-terminus of this base sequence : 85996366
  Distance between 3'-terminus of neighbour sequence of sequence listing upward to telomere on chrosomal short arm and 5'-terminus of this base sequence : 93547
tgaaggcatcaaacagagttacattataaagaacttcagactttcatcaaatacagtgtgtgtgtgtgtgtgtgtgtgtgtgtgtgtgtgtgtgtgtgtgtgtttagcataaacctaatatgctccag

SEQ ID NO: 7149 - DNA, 135 bp, Homo sapiens
  chr4.fa.O7frz.89161443
  Located on chromosome 4
  Distance between a terminus base of telomere on chromosomal short arm and 5'-terminus of this base sequence : 86112335
  Distance between 3'-terminus of neighbour sequence of sequence listing upward to telomere on chrosomal short arm and 5'-terminus of this base sequence : 115841
gttgacattgagttagtctacgacatatagtttaaaatagctaagagagtgtatgtgtgtgtgtgtgtgtgtgtgtgtgtgtgtgtgtgttttaagcagccattgagatgactcagaaatctaacttctgttcag

SEQ ID NO: 7150 - DNA, 146 bp, Homo sapiens
  D4S1534
  Located on chromosome 4
  Distance between a terminus base of telomere on chromosomal short arm and 5'-terminus of this base sequence : 86353466
  Distance between 3'-terminus of neighbour sequence of sequence listing upward to telomere on chrosomal short arm and 5'-terminus of this base sequence : 240996
attcactttcagccccatcttcagtgaatatgcaggttactcccaggacagtaccctcaccctggctcactaacattctcttacacacacacacacacacacacacacacacacacttctccttccctcctctaccttgggctggt

SEQ ID NO: 7151 - DNA, 451 bp, Homo sapiens
  chr4.fa.O7frz.89782028
  Located on chromosome 4
  Distance between a terminus base of telomere on chromosomal short arm and 5'-terminus of this base sequence : 86665809
  Distance between 3'-terminus of neighbour sequence of sequence listing upward to telomere on chrosomal short arm and 5'-terminus of this base sequence : 312197
ttaccatcagtatgagaaatgttcccataatattaatatttaatatttactgaaatatgtgtcaggccctgtactgatatatgtcaggcattatatacaatgactcatttaatataactgcacacacacacacacacacacacacacacacacacacacagagagagagactgggcatgtgtgtgtgtgtatatatacatatatgtatatgtgtatgtatgcaaaacggtggtacaaattcacatttttaataagtggtaaagccaggattcacacccatctgcgcccacaaaaccaccacatgctacaaccttcttataccaataagaatatggataggtttattatctacactacactgaggccaaatatctgagacttaagagaaacaaggatgacaagaagaaatggggttataggtttaagagtcagtatactctgcatttcattc

SEQ ID NO: 7152 - DNA, 458 bp, Homo sapiens
  chr4.fa.O7frz.89881054
  Located on chromosome 4
  Distance between a terminus base of telomere on chromosomal short arm and 5'-terminus of this base sequence : 86760015
  Distance between 3'-terminus of neighbour sequence of sequence listing upward to telomere on chrosomal short arm and 5'-terminus of this base sequence : 93755
ttaaattgattctgtcagctctgaaataaatacatctttactatattttaatatggaagtttgcataattccagtatgtatgcaaaatgcaagactttattatatgagtttatgggccagaaatcattttgctcttagaattaatttgattttggcaaatacttcaattttctaagatccttctttaagccctgttacctggaaacctgaaaaaaataaacaacttttgggcttgagagggatgtctgggcaattagaatagctacactgaagtctgcccgtgtgtgtgtgtgtgtgtgtgtgtgtgtgtgtgtgtgtgtgtgtgtgtgtgtgtgtgtgtgtgtttagagagagagagagattattgcttaaacagtgcccctgggttggttgcttggcttggtgccatttgggattctcagattttattgtcccagctctgatttacggagttcaga

SEQ ID NO: 7153 - DNA, 271 bp, Homo sapiens
  DISD22_0003836
  Located on chromosome 4
  Distance between a terminus base of telomere on chromosomal short arm and 5'-terminus of this base sequence : 86860741
  Distance between 3'-terminus of neighbour sequence of sequence listing upward to telomere on chrosomal short arm and 5'-terminus of this base sequence : 100268
gagaggcacatggtttctgcataaaagtcaaattcaaaaatctgaatgtcaaacatttatttagctttgggaaggtttcgttttccttccttccttccttccttcccttcttcctccctcccaacctcccttcctccatccctccctcgcactctcctttcctttcttccttcctccctcctccttccctcctttcctcccgtccttccttgtgtatttttatactgggtttctgttcaattgtttttgaggcaatatttatggaagtgtc

SEQ ID NO: 7154 - DNA, 125 bp, Homo sapiens
  DISD22_0003848
  Located on chromosome 4
  Distance between a terminus base of telomere on chromosomal short arm and 5'-terminus of this base sequence : 86998030
  Distance between 3'-terminus of neighbour sequence of sequence listing upward to telomere on chrosomal short arm and 5'-terminus of this base sequence : 137018
ttcagtgtcagtggattggatgttaaaaacagatcaaatgaatatatatatatatatatatatatatatatatatatatatatatatatataaaatgaatgttgtaattaactagaaagccagtg

SEQ ID NO: 7155 - DNA, 458 bp, Homo sapiens
  chr4.fa.O7frz.90378590
  Located on chromosome 4
  Distance between a terminus base of telomere on chromosomal short arm and 5'-terminus of this base sequence : 87340532
  Distance between 3'-terminus of neighbour sequence of sequence listing upward to telomere on chrosomal short arm and 5'-terminus of this base sequence : 342377
tttcctgtaagagtccaagatcaaagtcagacccacagatacacaatattaagacacctgatcccaagcactatatgattacacagttttaagttacacacacacacacacacacacacacacacacatacatgcaccccaacagagtcaaccatgtgggctgtgcatatttgtcctgaaaaacaaacatctaagctaatatgcaaacaaatgtaacacatattgcttgaatagtataaatgtattaatatcaacaaaaaatgactcaacattaataaggaagcttaaaagataaaatactaaggaggagaaagttataaaccacaaatcctaggctctcgtcttattattcattagttttatagataatccaaggtaaatctttacctcttttatgattctcagtttttccatcatgactatataaactcttttaatggcactgatcttacattata

SEQ ID NO: 7156 - DNA, 215 bp, Homo sapiens
  Z67188
  Located on chromosome 4
  Distance between a terminus base of telomere on chromosomal short arm and 5'-terminus of this base sequence : 87385502
  Distance between 3'-terminus of neighbour sequence of sequence listing upward to telomere on chrosomal short arm and 5'-terminus of this base sequence : 44512
ttcagaaagcacatagggcacccaggcaggttaacacagacaaacaggagtcagttttatttctatgaagacaagtcactaagatgaatttctagaactttaaagtcactgctgtttttgtttttgtttttcttcacacacacacacacacacacacacacacgtgtacaaacacaaggtagtgaaaatcctgtttattactgtgcaggtcactg

SEQ ID NO: 7157 - DNA, 336 bp, Homo sapiens
  G08379
  Located on chromosome 4
  Distance between a terminus base of telomere on chromosomal short arm and 5'-terminus of this base sequence : 87660074
  Distance between 3'-terminus of neighbour sequence of sequence listing upward to telomere on chrosomal short arm and 5'-terminus of this base sequence : 274357
gacaaaatccctctgtgcatggagtttatattccagtatgttataactgtatagacagaaatgtatttctgtcctacaggacttatattaatgagcttccttgactctcatctttccatgtcacattttcctttctatctatctctatctatctatctatctatctatctatctatctatctatctatctatctatctctatctctatctctgtctccatctctggttcctcccttttcacatatgtacttaattgcctgaatttctcaagtctgctaagtttagcccttctaattctttcctcttcagccctattgctggcactatggtgaagtt

SEQ ID NO: 7158 - DNA, 215 bp, Homo sapiens
  D4S1542
  Located on chromosome 4
  Distance between a terminus base of telomere on chromosomal short arm and 5'-terminus of this base sequence : 87731747
  Distance between 3'-terminus of neighbour sequence of sequence listing upward to telomere on chrosomal short arm and 5'-terminus of this base sequence : 71337
attctcccagatagcagggcatattatttaagtgaaattgtatgtatgtgtgtgtgtgtgtgtgtgtgcatgcacatgtgcatatatatctatatatatgcaccttttaagatgcttaccttttatacatgctaccttttaagataaatagttcaggtttcctgttgccttgtgcaacttaaaagggaaacgcactggagtcgatctttgaaaag

SEQ ID NO: 7159 - DNA, 396 bp, Homo sapiens
  AC016973.5_97133
  Located on chromosome 4
  Distance between a terminus base of telomere on chromosomal short arm and 5'-terminus of this base sequence : 87853166
  Distance between 3'-terminus of neighbour sequence of sequence listing upward to telomere on chrosomal short arm and 5'-terminus of this base sequence : 121204
tccagaattagtgctcttacctattaggctatacaagatatattaggaaggggtgggcagagcaaagttcaatatgattccatgtgttaaaaagacatatgtgtgtgtatacatgtgtgtatgtgtcttgtgtagcaatgcacatacacaatgcaaataaaataataataataataataataataataataataataatgacacttactataatggtacttgcccatagttcaaggtctaaatacgtactaaactgacaaaactaaacagaatgcaacagtgagttttctctgaatttcttatagctctggttttataatcccgtagggaatcctcatttacttcacagaatattgtttaaaagacaaattcagctgatgcctaatcaaacgttta

SEQ ID NO: 7160 - DNA, 451 bp, Homo sapiens
  AC021425.3_114306
  Located on chromosome 4
  Distance between a terminus base of telomere on chromosomal short arm and 5'-terminus of this base sequence : 88002530
  Distance between 3'-terminus of neighbour sequence of sequence listing upward to telomere on chrosomal short arm and 5'-terminus of this base sequence : 148968
tacatcaggttgaacctcaaagatggtggacagtagtatatgatctgaaggcaagaacttggctactgaaaggagaattatttccctatttaaatagatttttgcagacttccagtagaactcatggtgtctgtggagtggtcagactttgcatcctccttcccaggggcacatcagaggctctgaaacaagaattgtaacacagtttttatatttatttatttatttatttttgagatggagtctcgctctgtagcccaggttgaagtgcagtggcgcgatctcggctcactgcagccgagatctagcgattctcctgcctcagcctcccaagtagctgggattacaagcacgtgccactacgcccggttaatttttgtatttttagtagagacagggtttcgccatgtgggccaggctggtctcaaacccctgacgacctcaggtgatc

SEQ ID NO: 7161 - DNA, 432 bp, Homo sapiens
  AC021425.3_53954
  Located on chromosome 4
  Distance between a terminus base of telomere on chromosomal short arm and 5'-terminus of this base sequence : 88073251
  Distance between 3'-terminus of neighbour sequence of sequence listing upward to telomere on chrosomal short arm and 5'-terminus of this base sequence : 70270
gttgtgctggcaaatactagatcttgttctggtttttttgttttgttttgttttgttttgttttgttttgttttgttttgttggtaccgattaaccatccccccaccccctactacccttccaatcctctggtaaccatccttctactctctatctccatgagttcaattgtttgaattttttagctcccacaaattagtgtgtatcttccatttttttaatgctctttttaaaaaaaaattttgcactcatattccccatagctatgtagtgttactaaaagagtaaatctatattgtgcataataataagctcaaaacttcttaattcaaaatcataattcattctcaaatatactaacttttgccaatttattaaaacacctaataaaaaataattatatcctttttttcctatttccaatttgcagta

SEQ ID NO: 7162 - DNA, 192 bp, Homo sapiens
  DISO7_10001506
  Located on chromosome 4
  Distance between a terminus base of telomere on chromosomal short arm and 5'-terminus of this base sequence : 88273697
  Distance between 3'-terminus of neighbour sequence of sequence listing upward to telomere on chrosomal short arm and 5'-terminus of this base sequence : 200014
gaacagtcagttggaagaatagagagtaaagctgcacatagaaagtgatttggtattgtgtgtgtgtgtgtgtgtgtgtgtgtgtgtgtgtgtgtgtgtgtgtggtggggtgggggtgggagggttgaatcaggggtgtggggagaaacttaaatcatttataaccttactagtctggactaatcaattccc

SEQ ID NO: 7163 - DNA, 242 bp, Homo sapiens
  chr4.fa.O7frz.91921556
  Located on chromosome 4
  Distance between a terminus base of telomere on chromosomal short arm and 5'-terminus of this base sequence : 88292097
  Distance between 3'-terminus of neighbour sequence of sequence listing upward to telomere on chrosomal short arm and 5'-terminus of this base sequence : 18208
agatttacatcttccactgctctgcccttgctctcgggagctggctgcctctcagtgcctcaaataggccacgatccctcttgctccagggtctttgcacaagtgttcacgctgtcagaattctctctccagcacccgctcctcccagccaccaccaccaaacacacacacacacacacacacacacacacacacacacacacgcacacacacagagttaacctctattcagacttcagatc

SEQ ID NO: 7164 - DNA, 407 bp, Homo sapiens
  chr4.fa.O7frz.92035156
  Located on chromosome 4
  Distance between a terminus base of telomere on chromosomal short arm and 5'-terminus of this base sequence : 88438410
  Distance between 3'-terminus of neighbour sequence of sequence listing upward to telomere on chrosomal short arm and 5'-terminus of this base sequence : 146071
actgtacatacttgtggcgtacatagctatattttgatacatacaatgtatagtgatcagataagggtaaataggatatccatcacctcaagcatttattatgtttttgtgttgggaatgttcaatatcctccttccagctatttgaaaccatatatatatatatatatatatatatatacacacacacacacacacatacttttttatatattatgtatatattttgtataatatgtatatatatacacacattctttttcatcagacaaccaatttcttttttttaaagtcaacttttattttaagttcaggggcacatgtgccagtttgttacacaggtaaacttgtgtcatgggggtttgttgtacagattattttattactcaggtattaagcctaggactc

SEQ ID NO: 7165 - DNA, 456 bp, Homo sapiens
  chr4.fa.O7frz.92131831
  Located on chromosome 4
  Distance between a terminus base of telomere on chromosomal short arm and 5'-terminus of this base sequence : 88491654
  Distance between 3'-terminus of neighbour sequence of sequence listing upward to telomere on chrosomal short arm and 5'-terminus of this base sequence : 52837
gaactacctgatgtcactattgatactgaggatgaatctccttcccaaatgtttttctaaaacaagtgagaaatttcatggctatttttaaactaagttgaaagaaggaaaggtagggatcgtgagggacaccatggtacatgcttgaatttataggtgtgagaatttttgtcaacatcttttgataataaataacagctatccttttatacaaggatattagtatgtaagaagcaggaggttaatacagcttacaatatctagaaattccctaatttcctttccttccttccttccttcctttcttccttccttctttccttctttccttcctttctccttccctccctccctcccttcctctcttactttttctttctttcttttttttgaggcagggtctcactctgtcacccaggctggagtgcagtggctcactacaatctcagttcactg

SEQ ID NO: 7166 - DNA, 163 bp, Homo sapiens
  DISO7_10000285
  Located on chromosome 4
  Distance between a terminus base of telomere on chromosomal short arm and 5'-terminus of this base sequence : 88572447
  Distance between 3'-terminus of neighbour sequence of sequence listing upward to telomere on chrosomal short arm and 5'-terminus of this base sequence : 80337
cgtgctacatgatgtcagtgtgatatttcatatattatggatcctctctgtctctctgtctctgtctctcatccacccacccatacacacacacacacacacacacacacacacacacgcatatacacacacacacacaccaattattccaagatgttcagag

SEQ ID NO: 7167 - DNA, 479 bp, Homo sapiens
  chr4.fa.O7frz.92259935
  Located on chromosome 4
  Distance between a terminus base of telomere on chromosomal short arm and 5'-terminus of this base sequence : 88699062
  Distance between 3'-terminus of neighbour sequence of sequence listing upward to telomere on chrosomal short arm and 5'-terminus of this base sequence : 126452
ctggagtctgaagtgcagtggtgtgatcatggctcactgcagccttgacctccctggggtcaggtgatgcttctgcctcagcctcccaagtagctgggactacaggtgtgtaccaccatgcccagctaatttgtgtgtgtgtgtgtgtgtgtgtgtgtgtgtgtttgtagaggcagggtttcactgtgttgtccaggctggccttaaactcctgggctcaagtgattctcccacctcggcttcccaaaatgctgagatcactggcatgagccactgcacctggccccactatttctttagatgaaaaatttcctgaggactagcttttaatatttgttgatattaaattaaaaagcagggattagctccatcctatagagaaggtaacaggagttcagaggttacagttattagtgtcagaatcagcacctctgacttctgatatccatataccagagtctattcctcatctgatttcc

SEQ ID NO: 7168 - DNA, 159 bp, Homo sapiens
  DID22N_0023222
  Located on chromosome 4
  Distance between a terminus base of telomere on chromosomal short arm and 5'-terminus of this base sequence : 88810545
  Distance between 3'-terminus of neighbour sequence of sequence listing upward to telomere on chrosomal short arm and 5'-terminus of this base sequence : 111004
aataagagcgttctcatttgttcatttctcaatcatttaataagtatttactaagccactatatccatatatatatatatatcatatatactgtataatacacactgtagtgttttttgtggattgtgtactatgaggtagtatgttagatactgccag

SEQ ID NO: 7169 - DNA, 272 bp, Homo sapiens
  DID22N_0023223
  Located on chromosome 4
  Distance between a terminus base of telomere on chromosomal short arm and 5'-terminus of this base sequence : 88951999
  Distance between 3'-terminus of neighbour sequence of sequence listing upward to telomere on chrosomal short arm and 5'-terminus of this base sequence : 141295
cctgctactaatggataaagtcccataatgccccatgtcaactttcggccaagaaatttgagagtctaggcgttatgtgatgactcacatctgtaatcccatcaccttgggaggtcgaggcagggggactgcttgaggccaggagctcaagaccaaccagtgcaacataggaggaccccatctctacaattatttatatatatatatatatatatatgtatattttaattagctgggcatggtagtgttgtaggactttctccttaaggtcc

SEQ ID NO: 7170 - DNA, 249 bp, Homo sapiens
  DISO7_10000026
  Located on chromosome 4
  Distance between a terminus base of telomere on chromosomal short arm and 5'-terminus of this base sequence : 88951999
  Distance between 3'-terminus of neighbour sequence of sequence listing upward to telomere on chrosomal short arm and 5'-terminus of this base sequence : -272
cctgctactaatggataaagtcccataatgccccatgtcaactttcggccaagaaatttgagagtctaggcgttatgtgatgactcacatctgtaatcccatcaccttgggaggtcgaggcagggggactgcttgaggccaggagctcaagaccaaccagtgcaacataggaggaccccatctctacaattatttatatatatatatatatatatatgtatattttaattagctgggcatggtagtgtt

SEQ ID NO: 7171 - DNA, 149 bp, Homo sapiens
  DISO7_10000287
  Located on chromosome 4
  Distance between a terminus base of telomere on chromosomal short arm and 5'-terminus of this base sequence : 89330252
  Distance between 3'-terminus of neighbour sequence of sequence listing upward to telomere on chrosomal short arm and 5'-terminus of this base sequence : 378004
tcatttagcagccacagtgggtcctgtgcaattttatatatatatatatatatatatatatatatatatatatatatatatatataaaaacatatttgccatcttaaaggaatttacaaatcttagttgtacaggtactgaacatgaaa

SEQ ID NO: 7172 - DNA, 189 bp, Homo sapiens
  DISO7_10000288
  Located on chromosome 4
  Distance between a terminus base of telomere on chromosomal short arm and 5'-terminus of this base sequence : 89361060
  Distance between 3'-terminus of neighbour sequence of sequence listing upward to telomere on chrosomal short arm and 5'-terminus of this base sequence : 30659
gcactaggataaacttctgttggtaaggtatggtagcacatgcctgcaatcccagtgctttgggaggctgaggcaggagggttgcttgaggccaggagttcaaaaacagcctggaccacacagcaagacaccgtctttaaacacacacacacacacacacacacacacaccctccttctgttggacttg

SEQ ID NO: 7173 - DNA, 105 bp, Homo sapiens
  D4S2929
  Located on chromosome 4
  Distance between a terminus base of telomere on chromosomal short arm and 5'-terminus of this base sequence : 89361149
  Distance between 3'-terminus of neighbour sequence of sequence listing upward to telomere on chrosomal short arm and 5'-terminus of this base sequence : -100
ggccaggagttcaaaaacagcctggaccacacagcaagacaccgtctttaaacacacacacacacacacacacacacacaccctccttctgttggacttgctgca

SEQ ID NO: 7174 - DNA, 203 bp, Homo sapiens
  D4S1563
  Located on chromosome 4
  Distance between a terminus base of telomere on chromosomal short arm and 5'-terminus of this base sequence : 89656104
  Distance between 3'-terminus of neighbour sequence of sequence listing upward to telomere on chrosomal short arm and 5'-terminus of this base sequence : 294850
actattgctgttgctgaccctgagactactgtggtttctttgtactctcatttctgtacttctcacattagcaatacccttatgtgaccaactgtgtgtgtgtgtgtgtgtgtgtggtaagaaggaggcatttcaaagatacatcaaattctgaaactcctggttattcaggccccagatattttcccagtgtgtcaggcagc

SEQ ID NO: 7175 - DNA, 102 bp, Homo sapiens
  DISO7_10000289
  Located on chromosome 4
  Distance between a terminus base of telomere on chromosomal short arm and 5'-terminus of this base sequence : 89817936
  Distance between 3'-terminus of neighbour sequence of sequence listing upward to telomere on chrosomal short arm and 5'-terminus of this base sequence : 161629
aacaatgctacttccatttataccctacctccctttcccattcgttcattcattcattcattcattcattcattcatacatttggcaagcgttcattgaaca

SEQ ID NO: 7176 - DNA, 189 bp, Homo sapiens
  D4S2460
  Located on chromosome 4
  Distance between a terminus base of telomere on chromosomal short arm and 5'-terminus of this base sequence : 89967214
  Distance between 3'-terminus of neighbour sequence of sequence listing upward to telomere on chrosomal short arm and 5'-terminus of this base sequence : 149176
ccaaaatcatgtgagccaaaccccataataaatcacctctctctttacacacatacatacacacacacacacacacacacacacacacacacacctcctattggttttctctggaaaaccttgaacatatacaggaggaaaacattttcctactcacccagaccaactccatacagttggctgctgctc

SEQ ID NO: 7177 - DNA, 162 bp, Homo sapiens
  chr4.fa.O7frz.93475482
  Located on chromosome 4
  Distance between a terminus base of telomere on chromosomal short arm and 5'-terminus of this base sequence : 90108918
  Distance between 3'-terminus of neighbour sequence of sequence listing upward to telomere on chrosomal short arm and 5'-terminus of this base sequence : 141515
catagaaactgagtttattggaaccaatttgtgtcccacttcaagagtccacacacacatacagacacacaaagatacacacagacacacacacacacacacacgtacgtactacagatatctagtactcattatactgtctgaagtattaatgtcttcagc

SEQ ID NO: 7178 - DNA, 101 bp, Homo sapiens
  DISO7_10001505
  Located on chromosome 4
  Distance between a terminus base of telomere on chromosomal short arm and 5'-terminus of this base sequence : 90125297
  Distance between 3'-terminus of neighbour sequence of sequence listing upward to telomere on chrosomal short arm and 5'-terminus of this base sequence : 16217
aggtctggctgagattgtgaaaaaaacaaaacaaaacaaaacaaaacaatacatatcacactaactactgtgatgattagaagcactctgagattcttggg

SEQ ID NO: 7179 - DNA, 275 bp, Homo sapiens
  AC055833.3_192272
  Located on chromosome 4
  Distance between a terminus base of telomere on chromosomal short arm and 5'-terminus of this base sequence : 90144870
  Distance between 3'-terminus of neighbour sequence of sequence listing upward to telomere on chrosomal short arm and 5'-terminus of this base sequence : 19472
ttatgttgcacttaaatctgacagtctcattcaacaaatagtgaaatcctgccaattcttatttatttatttatttatttattgaaacagggtcttgctctgtcatccaggctggagtgtggtggcacagtcacagctcactgcagtctcaaaatcctgggctcaagcaatcctccatctcagtatcctgagtaggtaggaccacaggcacgcaccaccagtcctggctaattttttattttttgcagaattgggaccttgctatgtcactcagg

SEQ ID NO: 7180 - DNA, 275 bp, Homo sapiens; identical to SEQ ID NO: 7179
  AC011117.5_59087
  Located on chromosome 4
  Distance between a terminus base of telomere on chromosomal short arm and 5'-terminus of this base sequence : 90144870
  Distance between 3'-terminus of neighbour sequence of sequence listing upward to telomere on chrosomal short arm and 5'-terminus of this base sequence : -275

SEQ ID NO: 7181 - DNA, 271 bp, Homo sapiens
  AC011117.5_104936
  Located on chromosome 4
  Distance between a terminus base of telomere on chromosomal short arm and 5'-terminus of this base sequence : 90183985
  Distance between 3'-terminus of neighbour sequence of sequence listing upward to telomere on chrosomal short arm and 5'-terminus of this base sequence : 38840
ccattgtgaagcttagtcatctagctagagcctccagtatcccatttctgccaataatctgatgttctaaccttgtgtccatgtttattcaacatcttgggatctaactgacccatctgccccaattcatgcagttggaaatttcaaagtatatagttagaaagatagactgaaagatagacagatagatagatagatagatagatagatagatagatacatagatacatagatacatagatacatagatacatagagatatggtttggct

SEQ ID NO: 7182 - DNA, 189 bp, Homo sapiens
  D4S2371
  Located on chromosome 4
  Distance between a terminus base of telomere on chromosomal short arm and 5'-terminus of this base sequence : 90184111
  Distance between 3'-terminus of neighbour sequence of sequence listing upward to telomere on chrosomal short arm and 5'-terminus of this base sequence : -145
tcatgcagttggaaatttcaaagtatatagttagaaagatagactgaaagatagacagatagatagatagatagatagatagatagatagatacatagatacatagatacatagatacatagatacatagagatatggtttggctttgtgtccccatccaaatctcatctcaaattgtaatgccctggt

SEQ ID NO: 7183 - DNA, 354 bp, Homo sapiens
  AP001940.1_31765
  Located on chromosome 4
  Distance between a terminus base of telomere on chromosomal short arm and 5'-terminus of this base sequence : 90208487
  Distance between 3'-terminus of neighbour sequence of sequence listing upward to telomere on chrosomal short arm and 5'-terminus of this base sequence : 24187
atgaggtcacgagatcaagaccatcctgcctaacacagtgaaacaccatctctaccaaaaatacaaaaaattagccggacgtggtggtgggtgcctgtagtcccagctactcaggaggctgaggcaggagaatggcgtgaatccgggagaaggagcttgcagtgagctgagatcgcaccactgcacactccagcgtgggcgacagagcgagacactgagggaaaacaaaacaaaacaaaacaaaacaaacaaaattcttattatttatccagatttatcaaaagtttattaaatagaatacaatggcaaaattcaaggcttttaacaattgagtggtaaagttcaagtggaaga

SEQ ID NO: 7184 - DNA, 362 bp, Homo sapiens
  AP001940.1_65525
  Located on chromosome 4
  Distance between a terminus base of telomere on chromosomal short arm and 5'-terminus of this base sequence : 90242489
  Distance between 3'-terminus of neighbour sequence of sequence listing upward to telomere on chrosomal short arm and 5'-terminus of this base sequence : 33648
ccaaaacagaatacatggtgacattaaaaagtataaagaaagtgacaagagagatatgatgaatttattcaccataaaagggcaaaaggaacaggagaaataaaaatataaaggcttccctttgtctagtggtggtacagcttctcaggaatgaagatggtagattaatattgatgacttgtaaggttgatataaaaaacctggcgactaagtaagtctctctgcaattctcttttatggcaaaacaaacaaacaaacaaacaaaaaaacaaccaaaagtgagttaactgaaatcaaataacttatcaaagttgccagacaaatgtatacctctctgagtctggaaatacaaacgactcatc

SEQ ID NO: 7185 - DNA, 180 bp, Homo sapiens
  D4S2461
  Located on chromosome 4
  Distance between a terminus base of telomere on chromosomal short arm and 5'-terminus of this base sequence : 90283995
  Distance between 3'-terminus of neighbour sequence of sequence listing upward to telomere on chrosomal short arm and 5'-terminus of this base sequence : 41144
tacattatgttcacacagtgccaagtaatttactaagtgctttttactattttcagtcatttgacctcctcttctctccccctagacaagcaggccagtgcacgtgggagtgcatacacacacacacacacacacacacacacacccaatatgggaaaggaaatgcaagcctcttatcaa

SEQ ID NO: 7186 - DNA, 414 bp, Homo sapiens
  chr4.fa.O7frz.93836526
  Located on chromosome 4
  Distance between a terminus base of telomere on chromosomal short arm and 5'-terminus of this base sequence : 90464205
  Distance between 3'-terminus of neighbour sequence of sequence listing upward to telomere on chrosomal short arm and 5'-terminus of this base sequence : 180030
gtggcaagcattcaataagatattaggtattattgttgttattatcattagcttttagcttgtgttaattcaagaagagagtttgttttttacgcttttgctaatcaccttttattatatcttacattctatgttgctgcccaaccctgaagggactttaaataattctccatctcccagcctgggtgacagagcgagactctgtctctaaaattaataataataataataataataataataataataataatgctccatttctttcaagggaaagattcacaacaccatcagcctcaattggaattagttaacaaccaggccagctgcatgacaatggacaatttatctcacatgactctttcaataaatatttttgagtgcctggtcattgaactaggtcctataagatcc

SEQ ID NO: 7187 - DNA, 295 bp, Homo sapiens
  HUMUT7257
  Located on chromosome 4
  Distance between a terminus base of telomere on chromosomal short arm and 5'-terminus of this base sequence : 90573016
  Distance between 3'-terminus of neighbour sequence of sequence listing upward to telomere on chrosomal short arm and 5'-terminus of this base sequence : 108397
gttgtgtgatttccctgttatagttcctttagattttccttttttttttttttagtctgttagctactccgtagccttgcaatcctgcaataagtctttatctatctatctatctatctatctatctatctatctatctatctatgtatttatttatctatacttaagctggtttaagatttgagtgttgaagttatcggtaataagaaggtctaggaggcagggatcaacaaacctttaagtaaaagaccagatagtaactattttccactttgtaggcaataaatctgtctcg

SEQ ID NO: 7188 - DNA, 425 bp, Homo sapiens
  AC015529.3_4287
  Located on chromosome 4
  Distance between a terminus base of telomere on chromosomal short arm and 5'-terminus of this base sequence : 90834736
  Distance between 3'-terminus of neighbour sequence of sequence listing upward to telomere on chrosomal short arm and 5'-terminus of this base sequence : 261425
tatgatcctagcgatggagtacctaccaactttctttacaatagcccaacgtctagtatgagaatcattctgtggacactcttccaaattgaaacaatctccttggattactcctggcacagcttatgtattctcatagccaatcccctggtcatgactctgacactagtagataaaaagtatcactctaatctcttgatcttttcatcatgcctttatttttacacatgcagtactcagagtctaaacaaaccttagcttgcattttcctcttaaaagcccaccatggatctcacagttttgttgttgttgttgttgttgttgttgttgttgttgagacgggatctcactctgttgccaggctggagtgcagtggcacaatcttggctcactgcaacctccgactccttggttgttcaagtgat

SEQ ID NO: 7189 - DNA, 380 bp, Homo sapiens
  AP001947.2_75500
  Located on chromosome 4
  Distance between a terminus base of telomere on chromosomal short arm and 5'-terminus of this base sequence : 90834781
  Distance between 3'-terminus of neighbour sequence of sequence listing upward to telomere on chrosomal short arm and 5'-terminus of this base sequence : -380
ccaacgtctagtatgagaatcattctgtggacactcttccaaattgaaacaatctccttggattactcctggcacagcttatgtattctcatagccaatcccctggtcatgactctgacactagtagataaaaagtatcactctaatctcttgatcttttcatcatgcctttatttttacacatgcagtactcagagtctaaacaaaccttagcttgcattttcctcttaaaagcccaccatggatctcacagttttgttgttgttgttgttgttgttgttgttgttgttgagacgggatctcactctgttgccaggctggagtgcagtggcacaatcttggctcactgcaacctccgactccttggttgttcaagtgat

SEQ ID NO: 7190 - DNA, 403 bp, Homo sapiens
  AP001947.2_44832
  Located on chromosome 4
  Distance between a terminus base of telomere on chromosomal short arm and 5'-terminus of this base sequence : 90865603
  Distance between 3'-terminus of neighbour sequence of sequence listing upward to telomere on chrosomal short arm and 5'-terminus of this base sequence : 30442
cactcagcaagttaatttccaccacaccttctaagcaacacaatacatacttctatttatttatttatttgagatggagtttcattcttgttgttcaggctggaatgcaatggcacaatctcagctcacagcaacctccgcctcctgagttcaagctattctcctgcttcagtctcccgagtagctgggattacaggtgcccacaaccacacctggctaattattattattattattttttgtatttttagtagaaacagggtttcatcatgttggccaggccggtcttgaactcctaacctcaggtgatccacctgccttagcctcccaaagtgctgggattataggcatgatccaccgcacccagcccctacttattatctacgtgttcagacgtggtatt

SEQ ID NO: 7191 - DNA, 234 bp, Homo sapiens
  U46895.1_128
  Located on chromosome 4
  Distance between a terminus base of telomere on chromosomal short arm and 5'-terminus of this base sequence : 90888765
  Distance between 3'-terminus of neighbour sequence of sequence listing upward to telomere on chrosomal short arm and 5'-terminus of this base sequence : 22759
cctatggaagacatgaagacttacctcacatatatatcacataaatcattatatcctatatatatgtatgtgtatacacacatgagatatctgatgccttccgtgtgtgtgtgtgtgtgtgtgtatatatatatatatagagagagagagagagagagaaagagagagagagagagagagagatcatagctactaatccatccttttgtctactctattgcaatcaaatatgcc

SEQ ID NO: 7192 - DNA, 237 bp, Homo sapiens
  chr4.fa.O7frz.94353240
  Located on chromosome 4
  Distance between a terminus base of telomere on chromosomal short arm and 5'-terminus of this base sequence : 90981260
  Distance between 3'-terminus of neighbour sequence of sequence listing upward to telomere on chrosomal short arm and 5'-terminus of this base sequence : 92261
gatcttcaattagctatacagcatgtgtgaccacacaccaggcaagctatgtcattttttaaacatatatatatatatatatatatatatatatatatatttaaaatatatatatgctattttcatagtaagtataaaattgaaatagcctcaaataaattgaggaaaaacatttatagaacattaagaacttgcaaactttgataatataatgaatgcatgttaggacattataaa

SEQ ID NO: 7193 - DNA, 245 bp, Homo sapiens
  D4S1544
  Located on chromosome 4
  Distance between a terminus base of telomere on chromosomal short arm and 5'-terminus of this base sequence : 91150710
  Distance between 3'-terminus of neighbour sequence of sequence listing upward to telomere on chrosomal short arm and 5'-terminus of this base sequence : 169213
cagaaactccagcagagactaaaaaacacctcctgtgtatcacaaataaatagcgcatgatcccatttgtacctcaagacaacacactaagactgatattgaataaacaatgaagactttaatactaaggaattcactgtgactattttgatatttatggcaatttcagttgggatgtgtgtgtgtgtgtgtgtgtgtgtgtgtgtaatattagaagatttgctatatccattgtgttagtatgg

SEQ ID NO: 7194 - DNA, 381 bp, Homo sapiens
  chr4.fa.O7frz.94632787
  Located on chromosome 4
  Distance between a terminus base of telomere on chromosomal short arm and 5'-terminus of this base sequence : 91292635
  Distance between 3'-terminus of neighbour sequence of sequence listing upward to telomere on chrosomal short arm and 5'-terminus of this base sequence : 141680
tcctgtagtgttcttagcatttactttcatttactaaaatatctgtatgttttttaaaagtatatgttgatatacatatcaacatatatatcaacacacacacacacacacacacacacacacacgcacactttatgaacatattgattctaccagcatttattctgcttctaccagtaatggtcttctttttaattaaaatggtagtgttttttaaagcataagtcaagcaaaatttagcgcttttcgtcagcaagtaacaattcttttattaaacactattttcaagtcctttttcaaataccatcagaatttccatttattaatttacaaagaaaattataaaaattacatagaactatttgaataagcataaccata

SEQ ID NO: 7195 - DNA, 254 bp, Homo sapiens
  AC021741.4_71526
  Located on chromosome 4
  Distance between a terminus base of telomere on chromosomal short arm and 5'-terminus of this base sequence : 91384967
  Distance between 3'-terminus of neighbour sequence of sequence listing upward to telomere on chrosomal short arm and 5'-terminus of this base sequence : 91951
tatcaggctgccaatttataaggaactaatttcacctcataagactaaatactatgtattttttaaacattcagtgataactattaacataagctctatctatctatctatctatctatctatctatctatctatatactttattggtagaatagaatgagctttttagtttacctaatagggactatctcttggattacagtggctatctctggtttcacttttggcaggtggagctatccacagtcatccac

SEQ ID NO: 7196 - DNA, 312 bp, Homo sapiens
  AC041013.3_53868
  Located on chromosome 4
  Distance between a terminus base of telomere on chromosomal short arm and 5'-terminus of this base sequence : 91481977
  Distance between 3'-terminus of neighbour sequence of sequence listing upward to telomere on chrosomal short arm and 5'-terminus of this base sequence : 96756
aaatgctaaatcatgcacttagacaacatacttgtgaaactgttttactgacataatcataaagtctaatctaaaaaatgtagatacatacatacacaaagatttattgaaggaaaacaggatatgtcatggtagatcagcatccttgacattaatcaaaactgatgatgtcattaaagaatttatagattcttttgatatcttctatctatctatctatctatctatctatctatctactttctgtcagagaacttgattgccctttgattctgaatcattagaaaaattacattcttatttggcacagtg

SEQ ID NO: 7197 - DNA, 214 bp, Homo sapiens
  D4S410
  Located on chromosome 4
  Distance between a terminus base of telomere on chromosomal short arm and 5'-terminus of this base sequence : 91519376
  Distance between 3'-terminus of neighbour sequence of sequence listing upward to telomere on chrosomal short arm and 5'-terminus of this base sequence : 37087
gccccacataaagccctagaagcaatcctggaaatttttccttcttttctcgtgtgtgtgtgtgtgtgtgtgtgtatgtgtgtgtgtgtgggtgtgtgtgtatgtgttttgagatccctccagatttcataaacttcagggctcacataacctggatttatccctttgtaccatcgcctttagatctgggcactcaggattcttgccttaggcc

SEQ ID NO: 7198 - DNA, 402 bp, Homo sapiens
  chr4.fa.O7frz.94979916
  Located on chromosome 4
  Distance between a terminus base of telomere on chromosomal short arm and 5'-terminus of this base sequence : 91591948
  Distance between 3'-terminus of neighbour sequence of sequence listing upward to telomere on chrosomal short arm and 5'-terminus of this base sequence : 72358
gaaggtgcctagaaactctaagactctaggtccttggattgtagggcttcagcctagtatgacgtgtctcctagtgagtggtaggacctgggaaactcctattggtatttgtgtcatgctaagcagaattgacttagaaaagttagttacaataacatcttataagcaaggtttatcatttaaagatatatatatatatatatatatacacacacacacagacatatatacacacacatacacacacatactagcatattctttatcaataagtgattactctgtactattttcaaacttcagaatatcaaagttcaaaagaatcgtttgaaagagtgagggtaagaggttttaatatgtagttttctgagccttgttcttagactctgaatcaagattgag

SEQ ID NO: 7199 - DNA, 273 bp, Homo sapiens
  chr4.fa.O7frz.95079476
  Located on chromosome 4
  Distance between a terminus base of telomere on chromosomal short arm and 5'-terminus of this base sequence : 91691519
  Distance between 3'-terminus of neighbour sequence of sequence listing upward to telomere on chrosomal short arm and 5'-terminus of this base sequence : 99169
ataggctccttaccgtagttatagaattcagtttagacatagactcacagttttttgttcagtttatcaacaaattttcattgtatgtcagtctctgagtctacaaaaaggaaagacaaaatgagaggaataaaggaaaaaaagaagaaagaaagagagagagaaagaaaggaaagaaagaaagaaagaaagaaagaaagaaagaaagaaagaaagaaagaaagaaagagagttgccctcaagaaagaagtatacaagttcctggtattcaaa

SEQ ID NO: 7200 - DNA, 400 bp, Homo sapiens
  chr4.fa.O7frz.95163554
  Located on chromosome 4
  Distance between a terminus base of telomere on chromosomal short arm and 5'-terminus of this base sequence : 91775807
  Distance between 3'-terminus of neighbour sequence of sequence listing upward to telomere on chrosomal short arm and 5'-terminus of this base sequence : 84015
tatgattctgtaggtcgactagactcatctgggcagttcttgtgtgaggttttaaagtgggtacagtcagactgaggttgagaatggggtcatctgaaggctcaggtgaggtagactcccaggataattcctttattcacaagtctggtgttgcactgaaaacactgtacctattgggatttctctctctctctctctctctctctctctctctcactgctctattctacttctgcctccctctttctctcctcagcctctccatggactagcttgagctttctcacaacatgctggttttggataattagacttgttatatgatagttggcttcccctagggtgaatgttccacaggaaaagaaagggaaacatgtcagtctaattaggactagaccag

SEQ ID NO: 7201 - DNA, 255 bp, Homo sapiens
  chr4.fa.O7frz.95263890
  Located on chromosome 4
  Distance between a terminus base of telomere on chromosomal short arm and 5'-terminus of this base sequence : 91832824
  Distance between 3'-terminus of neighbour sequence of sequence listing upward to telomere on chrosomal short arm and 5'-terminus of this base sequence : 56617
gcctagttatgtactgaatctcattctttcttaacacctgaaagattttcctcccccaggcattcctctttccctggtatttttaaatcactggatcattttcatcagtgtttaaacttgattaagcttttctatctaacacatacacacacacacacacacaccatctcaatcttgttaacaactattctgttcacaagtttattgaaagaagcttgccttctgataattatgtagttggtagctcactacttt

SEQ ID NO: 7202 - DNA, 294 bp, Homo sapiens
  chr4.fa.O7frz.95383160
  Located on chromosome 4
  Distance between a terminus base of telomere on chromosomal short arm and 5'-terminus of this base sequence : 91994253
  Distance between 3'-terminus of neighbour sequence of sequence listing upward to telomere on chrosomal short arm and 5'-terminus of this base sequence : 161174
ttctacatttctgagccattacactgaggtcttttaattttttttccctgagactaaataaacgtgatggaaactgagatatatttttattactgagtacgtctgctgttgaagacctgaataaacaaagaacaaaactgaattatggtgctgcagcctaatatcatcacctactaatcaaatatagaaactcttaaaacaaaacatacacatacacacacacgtgcacgcgtgcacacacacacatacacacacgttgaattcccacagctctagctgtctgattcagaaaga

SEQ ID NO: 7203 - DNA, 254 bp, Homo sapiens
  chr4.fa.O7frz.95591326
  Located on chromosome 4
  Distance between a terminus base of telomere on chromosomal short arm and 5'-terminus of this base sequence : 92202477
  Distance between 3'-terminus of neighbour sequence of sequence listing upward to telomere on chrosomal short arm and 5'-terminus of this base sequence : 207930
tctactgtatggcgcatagtataattttgtggttagtttacaaaaacttttctacgatattcaatgggaaaattgggaaatttaaaacatttctctctccctctctttctgtgtgtgtgtgtgtgtgtgtgtgtgtctcactgggatggacacacaaacgtgcaggcaaacgcacatgcacgcacacacacacggccttgtaagactttagttttgttcactaagggtctcagtaagtctagtttgcacctcaa

SEQ ID NO: 7204 - DNA, 238 bp, Homo sapiens
  D4S414
  Located on chromosome 4
  Distance between a terminus base of telomere on chromosomal short arm and 5'-terminus of this base sequence : 92365349
  Distance between 3'-terminus of neighbour sequence of sequence listing upward to telomere on chrosomal short arm and 5'-terminus of this base sequence : 162618
tcaggaacctcagcccatttaagaatcatttctgggaaactagtgcattcatttggaagaaagaatatactctgccatttgagttaccagagttcttacgctggttctttcagttctttctcgtgtgtgtgtgtgtgtgtgtgtgtgtgtgtgtgtgtgtgtttaactttgatataaattgagtacagtcagtaaacttatattctggatgttttcagagggctgatgctttgtgcaa

SEQ ID NO: 7205 - DNA, 117 bp, Homo sapiens
  D4S423
  Located on chromosome 4
  Distance between a terminus base of telomere on chromosomal short arm and 5'-terminus of this base sequence : 92399348
  Distance between 3'-terminus of neighbour sequence of sequence listing upward to telomere on chrosomal short arm and 5'-terminus of this base sequence : 33761
ttgagtagttcctgaagcagcaggcaaaaaacaaacacacacacacacacacacacacacacacacacacacacacacaatcagtcaaggccgaagcactcaagatggaggactttg

SEQ ID NO: 7206 - DNA, 128 bp, Homo sapiens
  DISO7_10001507
  Located on chromosome 4
  Distance between a terminus base of telomere on chromosomal short arm and 5'-terminus of this base sequence : 92619153
  Distance between 3'-terminus of neighbour sequence of sequence listing upward to telomere on chrosomal short arm and 5'-terminus of this base sequence : 219688
gacagtgctcctctcagtctctctttctttttcatatatatatataaatatatatttatatgatatagatgttgcttttcatagttttgataagaagaattaaatgtgacatttgacctgacctataa

SEQ ID NO: 7207 - DNA, 230 bp, Homo sapiens
  DISO7_10001509
  Located on chromosome 4
  Distance between a terminus base of telomere on chromosomal short arm and 5'-terminus of this base sequence : 92820439
  Distance between 3'-terminus of neighbour sequence of sequence listing upward to telomere on chrosomal short arm and 5'-terminus of this base sequence : 201158
cgtgcatcttatcatttgtgtacatttttctgcctctcaagtgtgtgtgcttgtgtgtgtgtgtgtgtgtgtgttagtgtgcgtatgaatgtttaaataactgcatttagattaagattacaaataagaaatgttaaatctctcagatataagaataatcttaaggtatttttcttgaccctgaaaagtaaaaaagcatgaaatagttttgccaagaggaacagatgttt

SEQ ID NO: 7208 - DNA, 121 bp, Homo sapiens
  DISO7_10001511
  Located on chromosome 4
  Distance between a terminus base of telomere on chromosomal short arm and 5'-terminus of this base sequence : 92983696
  Distance between 3'-terminus of neighbour sequence of sequence listing upward to telomere on chrosomal short arm and 5'-terminus of this base sequence : 163027
aggaatataaactggcaatcttcttctttgtaatatggctatatatatatatatatatatatatatatatatatattttaccattttctttctcaaaaacaataaactacgatccttcctg

SEQ ID NO: 7209 - DNA, 233 bp, Homo sapiens
  chr4.fa.O7frz.96692791
  Located on chromosome 4
  Distance between a terminus base of telomere on chromosomal short arm and 5'-terminus of this base sequence : 93034289
  Distance between 3'-terminus of neighbour sequence of sequence listing upward to telomere on chrosomal short arm and 5'-terminus of this base sequence : 50472
ctttgagcttaccgtctacttaaaaggatataaaatttcttaggttcatggatcagtgttaagagatctctagctctcctgaaattatatgccaaaaattatgtgtgtgtgtgtgtgtgtgtgtgtgtgtgtgcatttccctgggctgaaattagtagctattgtttaaacaattcttaatagtgtccatgctcctcaacaaatttaaagactattaaatcaaagcctagctc

SEQ ID NO: 7210 - DNA, 208 bp, Homo sapiens
  D4S3037
  Located on chromosome 4
  Distance between a terminus base of telomere on chromosomal short arm and 5'-terminus of this base sequence : 93189884
  Distance between 3'-terminus of neighbour sequence of sequence listing upward to telomere on chrosomal short arm and 5'-terminus of this base sequence : 155362
ccaactcaaatgcctgtcaaagaatgagtggataaagaaactctgatatgtgtgtgtgtgtgtgtgtgtgtgtgtgtgtgtgtgtgtgtatatgagatggaatactactcagccataaaaaagaacgaattaacagcatttgcaatgacttggatgagattagagactattattctaagtgaagtaattcaggaatggaaaactaaac

SEQ ID NO: 7211 - DNA, 463 bp, Homo sapiens
  chr4.fa.O7frz.95770238
  Located on chromosome 4
  Distance between a terminus base of telomere on chromosomal short arm and 5'-terminus of this base sequence : 93427988
  Distance between 3'-terminus of neighbour sequence of sequence listing upward to telomere on chrosomal short arm and 5'-terminus of this base sequence : 237896
aggttcaatggactcatagttccacatgactggggaggcctcacaatcatggcagaaggcgaaggaggagcaaggcgcctcttacacggcagcaggcagaagagcgtgttcaggggaactgccatttataaaaccgtcagatcttgtgagaccccccctcactatcacgagaacagcatgggagaacatgcccccatgattcagttatctcccaccaggtccctctcataacacatgggaattatgggagctacaattcaagatgagatttgtttgggtggggacacaaccaaaccatatcagtgtgtttgtgtgtgtgtgtgtgtgtgtgtgtgtgtgtgtgtgtatacgaaaaaaatccataacagaaatttttttcatgaacatcattgccaacctttcatatatgattactttttcttttctttgtttcatagagaagtcaaatttaagagttatcagc

SEQ ID NO: 7212 - DNA, 239 bp, Homo sapiens
  DISD22_0003868
  Located on chromosome 4
  Distance between a terminus base of telomere on chromosomal short arm and 5'-terminus of this base sequence : 93710499
  Distance between 3'-terminus of neighbour sequence of sequence listing upward to telomere on chrosomal short arm and 5'-terminus of this base sequence : 282048
tgaagtactgacttatttcaagcacaaaaaatctacacacacacacacacacacacacacacacacacacacatacacacacacagacaccaagcatatatctattaggttaaaagaagaaatttggattgtcattttaaaaattggcaagtaagtatatgtattttgggaatatttaaatacctttctaaaacataattatgtttttttaacagaagtactgtagcttgtcagttagc

SEQ ID NO: 7213 - DNA, 445 bp, Homo sapiens
  chr4.fa.O7frz.97245538
  Located on chromosome 4
  Distance between a terminus base of telomere on chromosomal short arm and 5'-terminus of this base sequence : 93837528
  Distance between 3'-terminus of neighbour sequence of sequence listing upward to telomere on chrosomal short arm and 5'-terminus of this base sequence : 126790
agaatggccaatatttcagtacttttttagacttgttctctctctgagtgggttatataaccaagaataaaatttaaaaaaattagttaacatagacagtttacatatatttacatatacatatacatatatatatatatatatatatatatatatatatatatatattaccaaaattaggtcttggatagtgttttcatgctggattagtctgttttcatgctgctgataaagacatacttgacactgggcaatttgcaaaagaaagaggtttaatggacctacagctccatgtggctggggaggcctcacaattatggcagaaggtgaaaggcacatttcatgtgatggcagacaagtgaagaaagtttgtgctaaaaattccccttttataaaaccatcagatctcatgagacttattcactatcatgaaattagcacagga

SEQ ID NO: 7214 - DNA, 384 bp, Homo sapiens
  chr4.fa.O7frz.97347623
  Located on chromosome 4
  Distance between a terminus base of telomere on chromosomal short arm and 5'-terminus of this base sequence : 93991938
  Distance between 3'-terminus of neighbour sequence of sequence listing upward to telomere on chrosomal short arm and 5'-terminus of this base sequence : 153965
tcgtctatatgaaaccagttagatatattgttgggtatgtacagctattcaaatgtgtttggaataccatcatgcaaaaatatacataaaatgttagtcattagaatcatttaacagatcagcaaactgcaactcacagggtagtgattcccaaatccaggttacataagcttcctgggtcccattttcacagttggttgtactttggctcagaagagattttggtgtaggtgataggcaaatgatactgaaaggttttctttctttctttctttctttctttctttctttctttctttctttctttctgtctgtctgtctgtctgtctttctttctttctctttctttctttttttaatgtgcagttgacaagttaactattt

SEQ ID NO: 7215 - DNA, 179 bp, Homo sapiens
  DISD22_0003880
  Located on chromosome 4
  Distance between a terminus base of telomere on chromosomal short arm and 5'-terminus of this base sequence : 94134558
  Distance between 3'-terminus of neighbour sequence of sequence listing upward to telomere on chrosomal short arm and 5'-terminus of this base sequence : 142236
agccctccatatacttgaccaaattatttggtttaagaatggaaaaggacccaaacaacatgtagtatttgatgtatggataaaaatccctatgtgtatcatacacacacacacacacacacacacacacacacacacacaggaaatgatctttctttaatacaatcatctgtcaggat

SEQ ID NO: 7216 - DNA, 398 bp, Homo sapiens
  chr4.fa.O7frz.97602561
  Located on chromosome 4
  Distance between a terminus base of telomere on chromosomal short arm and 5'-terminus of this base sequence : 94210295
  Distance between 3'-terminus of neighbour sequence of sequence listing upward to telomere on chrosomal short arm and 5'-terminus of this base sequence : 75558
caaatcttccatgatctattgtgtatctttaacagaagaatatcttatgatatttttttcttgaaatatttcactacagattttttttcttggaataattattaacatctagagaaattctatcatacatacatatcattcaggaaaatacagccagcaatatgtcattaattaaaaatggtaaaatcagctatttctaccattaactaatagttattatccaaagatacatgcccaatacagacacacacacacacacacatacatacacacacacacacacacacacacacacacacaaatgttctctgtggccacccaatttaatcttctcattaaatgtcctaaaatcaatggcactggttcactatttatacataaacaatgtcaacattctt

SEQ ID NO: 7217 - DNA, 306 bp, Homo sapiens
  chr4.fa.O7frz.97813265
  Located on chromosome 4
  Distance between a terminus base of telomere on chromosomal short arm and 5'-terminus of this base sequence : 94398148
  Distance between 3'-terminus of neighbour sequence of sequence listing upward to telomere on chrosomal short arm and 5'-terminus of this base sequence : 187455
cctgatttcctaatttattcctacttcagcaacgcataggaataaaatataattttattcactgcttattgctgaataaaggatttaccacataaaaatattttatttttatagaattattacctctggatataaaatatgtatatatacatatacacacaatatgtgtgtgtatatatatatatatatatatacacacacacacacacacacacacacacaatactggtaatactaatatacacaatactggtaatactaatacaacacacaatactggtaatactataatcaattgcagaccat

SEQ ID NO: 7218 - DNA, 382 bp, Homo sapiens
  chr4.fa.O7frz.97898637
  Located on chromosome 4
  Distance between a terminus base of telomere on chromosomal short arm and 5'-terminus of this base sequence : 94483639
  Distance between 3'-terminus of neighbour sequence of sequence listing upward to telomere on chrosomal short arm and 5'-terminus of this base sequence : 85185
gtaaagtgagttcttgcctttccgattttacagctattattctcccaagtgtgaggtgactgtgtgtgtgtgtgtgtgtgtgtgtgtgtgtgtgtgtgtattgggtcatattagaagttattagaagttcccttataataattataaaattaagaaataatataattggctatgtgggttaccatctgattttcattcacatctgactatttgaattgggatgtgttttctttaattattttgtatgaaaaagaaaagatggggcatagtgtcatagtagttgcatacgttttgtaagaaatttcaagttctcccagatgaaagataacctttgtttttcaacttgttttccactttcaactgtacgcttcataagacattc

SEQ ID NO: 7219 - DNA, 398 bp, Homo sapiens
  chr4.fa.O7frz.97977629
  Located on chromosome 4
  Distance between a terminus base of telomere on chromosomal short arm and 5'-terminus of this base sequence : 94566161
  Distance between 3'-terminus of neighbour sequence of sequence listing upward to telomere on chrosomal short arm and 5'-terminus of this base sequence : 82140
ggtgctttctaattgaaggtacaatcatttctcacatatgccttcttctcattatttgtttaatttctcttcacagcacctatcatcaccatctgacattttatatatatatatatatatatttccttttttgtttgttgtctgtcactcccactaaaatgtaggtctagaagaatagaaatgttcgtttgttgtttgttttgttcactgctgtattcttagtgtgtgcctggcattaacactcttttgaatgactgaataaatatctgaatttctgctatttccctataagtaatattattttggatagaaatgccactaatcctgaaacattttcaagttttatatggtttttatctttaatatttgtgtggctttctgctacattccaatattta

SEQ ID NO: 7220 - DNA, 268 bp, Homo sapiens
  chr4.fa.O7frz.98085879
  Located on chromosome 4
  Distance between a terminus base of telomere on chromosomal short arm and 5'-terminus of this base sequence : 94680273
  Distance between 3'-terminus of neighbour sequence of sequence listing upward to telomere on chrosomal short arm and 5'-terminus of this base sequence : 113714
acatgtaaagttgcttatgaagacttcttaggtcatcaccaggaattttacataagttacaatgtgtcaagttttatagcagacaaatcatactacaaatactacaaacaaacatgtttttctagatgccaagaaaaaatatatgtatgtatgtgtatatatatatatatatatatatatgtatgtatgtatatatatatatatatatatatatgtatacaaattctgtgaattatactggatgctgatgcaacagtgaagtactgtc

SEQ ID NO: 7221 - DNA, 177 bp, Homo sapiens
  Z67174
  Located on chromosome 4
  Distance between a terminus base of telomere on chromosomal short arm and 5'-terminus of this base sequence : 94940189
  Distance between 3'-terminus of neighbour sequence of sequence listing upward to telomere on chrosomal short arm and 5'-terminus of this base sequence : 259648
gccagagaataagacttttggcttgaatcaggaagtcctatggagacagacagaagatggaaaaaaaaaatttgttgatttattcaacaattgtattttatattttcagagtcctttttatacacacacacacacacacacacacacacaccacggtatcgcagaacatacagacat

SEQ ID NO: 7222 - DNA, 325 bp, Homo sapiens
  chr4.fa.O7frz.98513634
  Located on chromosome 4
  Distance between a terminus base of telomere on chromosomal short arm and 5'-terminus of this base sequence : 95046637
  Distance between 3'-terminus of neighbour sequence of sequence listing upward to telomere on chrosomal short arm and 5'-terminus of this base sequence : 106271
tgaaatcatggtcctgaagctatatagatagaaagaagtacagatttgaacttgtgggtatatgtgtatgtacgtgtgtgtgtgtgtgtgtgtgtgtgtgtgtgtgtgtgtgtgtgtgcgcgcgcgcgcgcgctctagctctgggcactgagagagtctaagagctacaactccacaaaagcaatgcacatacttagtagtgcccagatactggtttttaaatattactctccactaaaaggagccaggtctctttggaagaatggctgattccaaggctggtgcagagaaaatacaaaatgaacctagaacatcttgtttgcta

SEQ ID NO: 7223 - DNA, 109 bp, Homo sapiens
  DISD22_0003896
  Located on chromosome 4
  Distance between a terminus base of telomere on chromosomal short arm and 5'-terminus of this base sequence : 95240948
  Distance between 3'-terminus of neighbour sequence of sequence listing upward to telomere on chrosomal short arm and 5'-terminus of this base sequence : 193986
gcacaaatccttgaatgactctatacatatatttatatttttatatatatttatatttatatatatatatggagtcatacaaggatttgtgcccttaagtatccttcac

SEQ ID NO: 7224 - DNA, 479 bp, Homo sapiens
  chr4.fa.O7frz.98875928
  Located on chromosome 4
  Distance between a terminus base of telomere on chromosomal short arm and 5'-terminus of this base sequence : 95473630
  Distance between 3'-terminus of neighbour sequence of sequence listing upward to telomere on chrosomal short arm and 5'-terminus of this base sequence : 232573
agatggcctaaagtaactgaagatccacaaaagaagtaaaaacagccttaactgatgacactccaccattgtgatttgttcctgccgcaccctaactgatcaatgtactttgtaatctcccccacccttaagaagggactttgtaattctccccacccttgagaatgtactttgtgagatccacccctgcccaccagagaacaaccccctttgaccgtaattttccattaccttcccaaatcctataaaacggccccacccgtatctcccttcactgactctcttttcggactcagcccacctgcacccaggtggaataaacagccatgttgcacacacacacacacacacacacacacacacacacacacaaagaactcataaaactcaacaataagacaacaaacaagctgatcaaaagatgggcaaaagacctcaatagacacctcaacaaagatacaggtagcaataagcatatg

SEQ ID NO: 7225 - DNA, 101 bp, Homo sapiens
  DISO7_10001516
  Located on chromosome 4
  Distance between a terminus base of telomere on chromosomal short arm and 5'-terminus of this base sequence : 95905844
  Distance between 3'-terminus of neighbour sequence of sequence listing upward to telomere on chrosomal short arm and 5'-terminus of this base sequence : 431735
agaaaggatgaaggatgactaagggcttttataaatgtgtgtgtgtatgtgtgtgtgtgtgtgtgtataaaataaaatacataataagcctgaagttcagg

SEQ ID NO: 7226 - DNA, 252 bp, Homo sapiens
  DISO7_10001515
  Located on chromosome 4
  Distance between a terminus base of telomere on chromosomal short arm and 5'-terminus of this base sequence : 95944466
  Distance between 3'-terminus of neighbour sequence of sequence listing upward to telomere on chrosomal short arm and 5'-terminus of this base sequence : 38521
atattgccaaccagcatgtttcttttccttccttccttccttccttccttccttccttccttccttcctttctttccttctttctttcttctttctctttctttctttttctttctttcctttctttcttccttccttccttcctttttctttctttctttctgactctatgttaatcttctctgcatcgttcaaattttagtgtatgtgctgtccaaggcctccttctcaaacttatgtgggagaaggcaa

SEQ ID NO: 7227 - DNA, 168 bp, Homo sapiens
  DISO7_10001520
  Located on chromosome 4
  Distance between a terminus base of telomere on chromosomal short arm and 5'-terminus of this base sequence : 95989304
  Distance between 3'-terminus of neighbour sequence of sequence listing upward to telomere on chrosomal short arm and 5'-terminus of this base sequence : 44586
gcagaattactatttcttacctgcaaagaagatttaagctctctggacttacattttccgctgtataattctgtgtgtgtgtgtgtgtgtgtgtgtgtgtgtgtgtgtgtgtgtgtgttgaagggggttagggagaagaaaaaggaagtttggaccagattagtggtt

SEQ ID NO: 7228 - DNA, 303 bp, Homo sapiens
  AC004061.1_21123
  Located on chromosome 4
  Distance between a terminus base of telomere on chromosomal short arm and 5'-terminus of this base sequence : 96072078
  Distance between 3'-terminus of neighbour sequence of sequence listing upward to telomere on chrosomal short arm and 5'-terminus of this base sequence : 82606
gtattgcatacttgaaatttgctaaaagaattgatcttaattgttttcatcacaaaaaaaggttaaaaaagaaactaatgtagccattctattctgaatcatctttgtgtgtgtgtgtgtgtgtgtgtgtgtgtgtgtgaatcttctagttcgactcttcttcctctgtggcttgctctttctgtgcccagctccctctgttacagatacaagaaacagaaactaatcttaaggaaagtgaattagttgagaggattcagagtggctcaaaggaagagttaaacaatgaggccttaggattag

SEQ ID NO: 7229 - DNA, 282 bp, Homo sapiens
  AC004061.1_45995
  Located on chromosome 4
  Distance between a terminus base of telomere on chromosomal short arm and 5'-terminus of this base sequence : 96096911
  Distance between 3'-terminus of neighbour sequence of sequence listing upward to telomere on chrosomal short arm and 5'-terminus of this base sequence : 24530
ccatagagtcctcattcaacagttaaatgttagagtgctctgaggacagggcttaaacagtcaaaaactatttcttaaatttctctagaacctcttttttaaaattaaactccatgatttgtttgaattaaattttactatcaaacacacacacacacacacacacacacacacacacacacacacacacactttgctttaaaggaagaataataatttgtatttgtcagataatttctgatttttgttttactctttctgaaatgtcaaagacaaaacttc

SEQ ID NO: 7230 - DNA, 302 bp, Homo sapiens
  AC004061.1_59878
  Located on chromosome 4
  Distance between a terminus base of telomere on chromosomal short arm and 5'-terminus of this base sequence : 96110847
  Distance between 3'-terminus of neighbour sequence of sequence listing upward to telomere on chrosomal short arm and 5'-terminus of this base sequence : 13654
aatgcttagaggtaggatcagaactagccccaggctgaattatcaaaaagggtgaccttttctttcctgtgtgtgtgtgcgtgtgtgtgtatgtgtgtgtgtgtgtgtgtgtgtgtgtgtttccttccctgaattcccttgtgtttttagcctgcacccaattctcagtgcagggttctttctactcatctgcctttgcaggtgtcatcccagagagccttgaaaatagacttcgaaaagtgactgagctcacctcccttcttccactgatgagagaactgtatcagctggattctagtcca

SEQ ID NO: 7231 - DNA, 455 bp, Homo sapiens
  chr4.fa.O7frz.99849497
  Located on chromosome 4
  Distance between a terminus base of telomere on chromosomal short arm and 5'-terminus of this base sequence : 96213114
  Distance between 3'-terminus of neighbour sequence of sequence listing upward to telomere on chrosomal short arm and 5'-terminus of this base sequence : 101965
tattctatgctgagaagtttgaaccctctgttgccagaggaggtcttgattaaaaaaatcagcctagtagcaatatagaagattgatggaggagaaaggaaagtggtgccagggagactagattgtgatcatttcagtatttaaagttagataaaagctaagtctgaatttcagtaggaacagaggaaagaaaaggagacaagctccagagattcagaatatactcaagaatctcgagtagatagtaactaattggaaataggggagagcagaagtgagacactgaaatttttagtgtggttgactaagtaatgatactgccattaaccaacaccagagaaaccaaaataagagctgtgtgtgtgtgtgtgtgtgtgtgtgtgtgtgtgtgtgtgtgtgtgtgttggccattgtcaacaaaaatatatatgccctaaattggaagacttcgttct

SEQ ID NO: 7232 - DNA, 199 bp, Homo sapiens
  AC011818.3_74917
  Located on chromosome 4
  Distance between a terminus base of telomere on chromosomal short arm and 5'-terminus of this base sequence : 96337604
  Distance between 3'-terminus of neighbour sequence of sequence listing upward to telomere on chrosomal short arm and 5'-terminus of this base sequence : 124035
gaagatgttgatttcaaaccattgcacctaagagaatggtgggttcttcattagaacttctttttattattattattattattattatactttaagttttaggggacgtgtgcacaatgtgcagctttgttacatatgtatacaacatgtgccatgttggtgtgctgcacccattaactcgtcatttagcattaggtgt

SEQ ID NO: 7233 - DNA, 444 bp, Homo sapiens
  AC011818.3_8444
  Located on chromosome 4
  Distance between a terminus base of telomere on chromosomal short arm and 5'-terminus of this base sequence : 96348361
  Distance between 3'-terminus of neighbour sequence of sequence listing upward to telomere on chrosomal short arm and 5'-terminus of this base sequence : 10558
tagcactggaagtcctagtcagagcaatcagaccagagaaagaaataaaaggcatccttatgaaaagaagaagttaaagtatcttcactgatggtatgatcgtatacttagaaaaacctaaagactccatcaaaagactactagaactgataaacgagttcagcaaggtttaaggatacagaatgaatatacaaaaaatcagtcaatagcctgcctttccttccttccttccttccttccttccttccttccttcctttccttccttcctttttctttcttttcttttctttctttctttctctctttctctctctctctctttctctctctctctttgtgtctgtctctctctttctctctctctctccctcccttcctcccttcccttccctccccctgctcccctccctcccttccttacttccttttcaagatggagtct

SEQ ID NO: 7234 - DNA, 382 bp, Homo sapiens
  chr4.fa.O7frz.100585296
  Located on chromosome 4
  Distance between a terminus base of telomere on chromosomal short arm and 5'-terminus of this base sequence : 96414390
  Distance between 3'-terminus of neighbour sequence of sequence listing upward to telomere on chrosomal short arm and 5'-terminus of this base sequence : 65585
acttccaagaatgaaagattttactagtaaaaggcagtgtgtgtgtgtgtgtgtgtgtgtgcgcgcgcgcgcgtgtgtgtgagatcagtgtgcttctgaattaggaccctcctggtttataaatgcattttatctgggctacacagcattgatatgctgcttatctagctccaactagtgttatgagtgttaacaccaccaaactcaggacaaaaaattactgaagtctctaattagattgggataattccctattatcttaattcatagtttttttttttaaataacatatgtcttcctacaaaagagtaaaaattcctttatgcatgtttgcatattggtgtggtacaaatagacagtcaacagtgaagacaactaaagt

SEQ ID NO: 7235 - DNA, 222 bp, Homo sapiens
  DISO7_10001517
  Located on chromosome 4
  Distance between a terminus base of telomere on chromosomal short arm and 5'-terminus of this base sequence : 96496854
  Distance between 3'-terminus of neighbour sequence of sequence listing upward to telomere on chrosomal short arm and 5'-terminus of this base sequence : 82082
gctagtttcagcatcacagctttgtttcctttctgattattccctttacatgcattttggcttatttccttaccatattttcagcattttgatgcctaaacatgcacacacacacacacacacacacacacacacacacggcatttgtagtcattttcagtaagttagtataaatatcttgatagccacatttcaaatatggggctcatagaggctaccatc

SEQ ID NO: 7236 - DNA, 309 bp, Homo sapiens
  chr4.fa.O7frz.100170802
  Located on chromosome 4
  Distance between a terminus base of telomere on chromosomal short arm and 5'-terminus of this base sequence : 96787617
  Distance between 3'-terminus of neighbour sequence of sequence listing upward to telomere on chrosomal short arm and 5'-terminus of this base sequence : 290541
ctggagtaactaaacagagttcactttaccaacaaaaaatataaaggagtacttttacattgattttaagagataagatatgaattgggtgagaaatattcaatttcgtgacaagtacttcccaacagatattgttacataaagcaagaaaggtgacaaaattatataattacaattctggcatctgctatgaaaaggtatttgctgtgtgtgtgtgtgtgtgtgtgtgcttttctcattggtcattgcctggtattatttttatcctttgttagtgttcttgcattgtttgctagaaagtatgctttg

SEQ ID NO: 7237 - DNA, 192 bp, Homo sapiens
  DISO7_10001524
  Located on chromosome 4
  Distance between a terminus base of telomere on chromosomal short arm and 5'-terminus of this base sequence : 96814753
  Distance between 3'-terminus of neighbour sequence of sequence listing upward to telomere on chrosomal short arm and 5'-terminus of this base sequence : 26827
ccaagattgcttcatactcctactatacactctcttttacacacacacacacacacacacacacacacactgctaattgttaacacaatagttctcatcagattatgaaatataatcatgtttgacaaacacacgtttatgaataatttactataactatttcaggccctcaaagtaacactcttcttactg

SEQ ID NO: 7238 - DNA, 465 bp, Homo sapiens
  chr4.fa.O7frz.100663871
  Located on chromosome 4
  Distance between a terminus base of telomere on chromosomal short arm and 5'-terminus of this base sequence : 96936924
  Distance between 3'-terminus of neighbour sequence of sequence listing upward to telomere on chrosomal short arm and 5'-terminus of this base sequence : 121979
taacttaatcttggaagtgtcaacccatcccgtctgctgtattctgttcatcagaagtgagtcatttggtccactcttcctcaagatgaagggattatacaagagcctgaatgccaggacctggaacagtggggaccccctcagagggagcccaccacaggtgccaaccaaacatttcctcccaggctgtcacaggcacctgaaagtcaacatgtctaaaattaactctatcaatgctgctcctaaaccaacttctccttctatattctctcacttgaatatgggtcacagaatgtgatctatacagtgtctacgtgtgtgtgtgtgtgtgtgtatgtgtgcacgcacatgtgcgtatttggtgtgtttattaaagttttttttttcttgttttgcttttgtctgaagggccagcttgtgtcagcttatgtgacaagtgcagagatcctggagtcaaagtacagt

SEQ ID NO: 7239 - DNA, 188 bp, Homo sapiens
  chr4.fa.O7frz.100747917
  Located on chromosome 4
  Distance between a terminus base of telomere on chromosomal short arm and 5'-terminus of this base sequence : 96960787
  Distance between 3'-terminus of neighbour sequence of sequence listing upward to telomere on chrosomal short arm and 5'-terminus of this base sequence : 23398
gttgtactatgttccagcactattttgtctcagctgtgagaaaagcagacaaaaacattttatttcatagagcttagtttccagcaaagattgaaagataataataaacctataaaaaaaatatatatatgtgtgtgtgtgtgtgtgtgtgtgtgtgtgtgtgtgtgtcaaatggtcataagaataag

SEQ ID NO: 7240 - DNA, 225 bp, Homo sapiens
  D4S2973
  Located on chromosome 4
  Distance between a terminus base of telomere on chromosomal short arm and 5'-terminus of this base sequence : 97132733
  Distance between 3'-terminus of neighbour sequence of sequence listing upward to telomere on chrosomal short arm and 5'-terminus of this base sequence : 171758
ctggatggaacaattggatttgttttcatcttatatgcaataacatggtgtagaaatcaatgaggagtgaaagcatgggtaattaaaagacgcttcattttcattttatatgaaatgttcttattctattagaaaaatcctgccaatctaacaaacgagcaaaacacacacacacacacacacacacgcacatcatgtgaattagaaaggtgctcatgttagtgc

SEQ ID NO: 7241 - DNA, 430 bp, Homo sapiens
  AC012211.3_137002
  Located on chromosome 4
  Distance between a terminus base of telomere on chromosomal short arm and 5'-terminus of this base sequence : 97152044
  Distance between 3'-terminus of neighbour sequence of sequence listing upward to telomere on chrosomal short arm and 5'-terminus of this base sequence : 19086
tgtttctagatttcctggactaaggctggtccagtttgattgatatgaaagcaaaataaataaataaataaataaataccacctgaaagtctatggaaacctgctgaagacatttttatagaaaaccaaaaagaaaaaaaagaggaaataaacaaaaggaagagcaaaagtgaagtagtcagaaaatagggataaaactaggtaaaaacagagattcagaattattaaacagagtaaggaaaagtggaatgtcacaaactacaaactttttaccacaatctgcacctcaaccctctctccctgcttccaattttcccacaccaagcaaagtttattactgggtttaaagtgttatcctcaggccgaggtttgtatacattttccctccccacttcaagtgtcacaggtgctagacgccatcaggataaat

SEQ ID NO: 7242 - DNA, 278 bp, Homo sapiens
  AP002332.2_79783
  Located on chromosome 4
  Distance between a terminus base of telomere on chromosomal short arm and 5'-terminus of this base sequence : 97182321
  Distance between 3'-terminus of neighbour sequence of sequence listing upward to telomere on chrosomal short arm and 5'-terminus of this base sequence : 29847
gtcccaagcatttcagatactagatacacaacctctctccttccctctctctctctctatatatagatatacatagaaatatctagatatctatctatctatctatctatctatctatccatatatgtttgttgcggcactaatcacaacagcaaaaacttggaaccaacccagatgtccatcaatgacagactggattaagaaaatgtggcacatatacaccatggaatactatgcagccataaaaaaggatgagttcatggtaaatgacaagttaa

SEQ ID NO: 7243 - DNA, 259 bp, Homo sapiens
  D4S1559
  Located on chromosome 4
  Distance between a terminus base of telomere on chromosomal short arm and 5'-terminus of this base sequence : 97389885
  Distance between 3'-terminus of neighbour sequence of sequence listing upward to telomere on chrosomal short arm and 5'-terminus of this base sequence : 207286
gcgttgaaaccatccacagaatataaggaatggagacacactttctgagcaccagaaaattctccatttgcaaaatgtactgtttcacaacttaagaaactctaagtagtcagtctacttagaaaccctgcaatttcagaaaaaaactggagaagaactacaattgtttgtgtgtgtgtgtgtgtgtgtgtgtgcacgtgtgcgtacacgcgcttcattttcctacttgtacatttcatgtctgattcacctttggctg

SEQ ID NO: 7244 - DNA, 224 bp, Homo sapiens
  D4S1578
  Located on chromosome 4
  Distance between a terminus base of telomere on chromosomal short arm and 5'-terminus of this base sequence : 97470481
  Distance between 3'-terminus of neighbour sequence of sequence listing upward to telomere on chrosomal short arm and 5'-terminus of this base sequence : 80337
ctccagtctgtgggaccaatcagagcaaagagcccaaagagtggtgaaatattctgccttattttaagtgaagtggggaggccaaaagaattgcacagatatgtcactatgccccaactctctttctctcttacacacacacacacacacacacacacacacacacacactctcaggtttttactatctttgcaatcatttactaatgtgctatttttgaatgc

SEQ ID NO: 7245 - DNA, 372 bp, Homo sapiens
  D4S2422
  Located on chromosome 4
  Distance between a terminus base of telomere on chromosomal short arm and 5'-terminus of this base sequence : 97639515
  Distance between 3'-terminus of neighbour sequence of sequence listing upward to telomere on chrosomal short arm and 5'-terminus of this base sequence : 168810
cttttggcttgctactgagcattagtagagactaaacagttatccacaggccaccaactggaaaagcgacacgagcaatccatcatatatagatatatggcttggtgggttagattatctctctctctctctctctaatctaatatagatagatagatagatagatagatagatagatagatagatagatagatagagagagagatacagaaatatctcagtttaagcaggccctgaaggcataagttaaatgaagaagttggcaaatgcccttactcttgctacgttactttctctctctctccccacacctatggcttgatgagaagcactctttgaacagttgactgttcatcagtcaaccgatgttga

SEQ ID NO: 7246 - DNA, 199 bp, Homo sapiens
  chr4.fa.O7frz.101652751
  Located on chromosome 4
  Distance between a terminus base of telomere on chromosomal short arm and 5'-terminus of this base sequence : 97913187
  Distance between 3'-terminus of neighbour sequence of sequence listing upward to telomere on chrosomal short arm and 5'-terminus of this base sequence : 273300
tgttgaatcaggaagtcactactatagctccttgcttcagaaccacaacacctgtactaaaacagacacacacacacacacacacacacacgcatgaatatacagaaatggatgctttgtgcccttcttctctctgttcttaaatcaagatttttaattcaagtctcatttaaatgtatctgatttgaggaatgtaaac

SEQ ID NO: 7247 - DNA, 355 bp, Homo sapiens
  chr4.fa.O7frz.101554530
  Located on chromosome 4
  Distance between a terminus base of telomere on chromosomal short arm and 5'-terminus of this base sequence : 98011209
  Distance between 3'-terminus of neighbour sequence of sequence listing upward to telomere on chrosomal short arm and 5'-terminus of this base sequence : 97823
atagatctatccatttggatagaaccatttaaaaaataacaacaactctaattatctgatatacatttgaactgatgaaaatattattctggtgtccagtcacagtatgtaataacaaggtagggagtgtggggcggggatgatgcctcagtggaaaaaaattatattgtcttattttatatacagtcaatatgatataaattatcatatatatcatatatgtcatatatcatattgtcttattagtcatactgtgtgtgtgtgtgtgtgtgtgtgtgtgtgtgtgtgtgtatatatatatgtatatataatctaataatacaccccttcctctattggttcaatgtaaattcta

SEQ ID NO: 7248 - DNA, 268 bp, Homo sapiens
  D4S1560
  Located on chromosome 4
  Distance between a terminus base of telomere on chromosomal short arm and 5'-terminus of this base sequence : 98103859
  Distance between 3'-terminus of neighbour sequence of sequence listing upward to telomere on chrosomal short arm and 5'-terminus of this base sequence : 92295
agataaggagccaactggaaaaaatatgtgtgtgtgtgtgtgtgtgtgtgtgtgtgtgtgtgtgtgtgtgtgtgttgtgctcattgcactgggtgatctagtcctagatgcaggtttgaactaaatcccatttgttggggtgtggggactaagaagagtcaacaactcatgatagttttggagtgccctgaaacttaaaattactccctaggcccttggagaaacttgaaactcttaagtattacagtttcctggtgagacgcttaaa

SEQ ID NO: 7249 - DNA, 409 bp, Homo sapiens
  chr4.fa.O7frz.101864328
  Located on chromosome 4
  Distance between a terminus base of telomere on chromosomal short arm and 5'-terminus of this base sequence : 98175128
  Distance between 3'-terminus of neighbour sequence of sequence listing upward to telomere on chrosomal short arm and 5'-terminus of this base sequence : 71001
acacgtattgaataacttgcagttcccctcatttgtttagctttggtgaatacagaccacattattgtaagacaatttcttcttgatttagttcttaaatggcatatcccttaagtacagcacattctagcacaataaacgtatctctgaggcactacagtacacacattacacactcatgaattcttgctattcatgtgcctatccttgctcttgtttctctttccacacaatctggctagattccaagtaaaaattatcattcacttatcacaataattaatttttgtttactattgatacatccattcctacattcttcacaaaagacaaggagaaatgatgcatgtgtgtgtgtgtgtgtgtgtgcatgtggtaggcagaagtgacagtaactgtagataaaggc

SEQ ID NO: 7250 - DNA, 325 bp, Homo sapiens
  AC004544.1_35703
  Located on chromosome 4
  Distance between a terminus base of telomere on chromosomal short arm and 5'-terminus of this base sequence : 98320392
  Distance between 3'-terminus of neighbour sequence of sequence listing upward to telomere on chrosomal short arm and 5'-terminus of this base sequence : 144855
gacaagctgaacagtataagttctcacagccaaccgtgttgtattcctagaccatttgctcttcgaaagcagagattatagcttaataactacttaaaaaggtacagtttaatgatagccttgcacattctaaacaatagtaaatatttacagaagaaaggaaataaatacagaagagaagaagaaagaaagaaaaagaaagaggatggaaggaaggaaggaaggaaggaaggaaggaaggaaggagcgagccaggcgtggtggctcatgcctgtaatcccaggactttgggggtcgaggagggtggatcacgaggtcaggagtt

SEQ ID NO: 7251 - DNA, 185 bp, Homo sapiens
  AC004544.1_61478
  Located on chromosome 4
  Distance between a terminus base of telomere on chromosomal short arm and 5'-terminus of this base sequence : 98346297
  Distance between 3'-terminus of neighbour sequence of sequence listing upward to telomere on chrosomal short arm and 5'-terminus of this base sequence : 25580
tctggaatcaggacttgtatttagacatgattgtcaagaatctctctctctctctctctctgtgtatctgtgtgtgcgtgtgtgtgtgtgtgtgtgtgtgtgtgtgtgtagtatagggatcagcctcctctctgttattctaacaaaatcttaaggttatgctgtgactgatgctcttaggtcat

SEQ ID NO: 7252 - DNA, 166 bp, Homo sapiens
  DISD22_0003910
  Located on chromosome 4
  Distance between a terminus base of telomere on chromosomal short arm and 5'-terminus of this base sequence : 98486823
  Distance between 3'-terminus of neighbour sequence of sequence listing upward to telomere on chrosomal short arm and 5'-terminus of this base sequence : 140341
cctactttcttgcttcctcctttccatatatatatatatatatatatatatatatatatatatatatatatgttttttcatatattttgcttttgggatttaaaagataaaaaccttaaacatttcagatatatttgaaattatctttggaatccttctcagtctc

SEQ ID NO: 7253 - DNA, 465 bp, Homo sapiens
  chr4.fa.O7frz.102933455
  Located on chromosome 4
  Distance between a terminus base of telomere on chromosomal short arm and 5'-terminus of this base sequence : 98658215
  Distance between 3'-terminus of neighbour sequence of sequence listing upward to telomere on chrosomal short arm and 5'-terminus of this base sequence : 171226
tttgaattggtagactgagtaaagcagattgccctcctcaccacggatgagcatcatgcatcctttcagggcctaaatagaacaaaaaggcagagaaagggagaatcaatctatcttcctttccttccttccttccttcctccctccctctctttctctacctttctttctttctttttcttttcttttctttttctttcactctctttctgtctctctctctttctgaccctcttccttccttccttcccttcctgccttcctccttcctttctttctctttctctttcactctttctttttcttttttatttctctcatatatgcacatacataaatataaatatacatttatacacatgtgtgtagaaaatatatattatatattttatatattatatattattttatatatacatatatttcctattggttctgtttttctggagaattctgacaaataca

SEQ ID NO: 7254 - DNA, 146 bp, Homo sapiens
  DISO7_10001527
  Located on chromosome 4
  Distance between a terminus base of telomere on chromosomal short arm and 5'-terminus of this base sequence : 98759984
  Distance between 3'-terminus of neighbour sequence of sequence listing upward to telomere on chrosomal short arm and 5'-terminus of this base sequence : 101304
agcacaggaaattgtgtatactgttaagaattttttatgcattaaggagaactctctatatatcacaaagtgatgatgggtcattactttcacacacacatacacacacacaaacacacacacattggtcacatgctgatccatag

SEQ ID NO: 7255 - DNA, 482 bp, Homo sapiens
  chr4.fa.O7frz.103473314
  Located on chromosome 4
  Distance between a terminus base of telomere on chromosomal short arm and 5'-terminus of this base sequence : 99007010
  Distance between 3'-terminus of neighbour sequence of sequence listing upward to telomere on chrosomal short arm and 5'-terminus of this base sequence : 246880
agacaagtaagcaacagttgactattccttattaactatattaatatagctgatgaatgaatgtatccagaaaaaggaaagggagatattgattggctacggaagtagattaaaagaggaatcacccaggtaagcccatctaagcactgggtgtgtacatttgtcttgctggcaaggctattcctgttgagagaactatgtaagtcaggtttctccagaaacaaaagcaataggtgtgtgtgtgtgtgtgtgtgtgtgtgtgtgtgtgtgtgtgtgtgtgtgtgtgtgtgtgtctgtctgtgtcaagaaagagaaagatttattgtgaggcattggcctacacagttgtgggggttataacttccaaaatcttcagggtaggcaagcaggctagagactcagggaagactggcaaggaagaattggagtccaaagggcgtctgctgccagaattctctcttctatgaggtacctctgtcttt

SEQ ID NO: 7256 - DNA, 282 bp, Homo sapiens
  chr8.fa.O7frz.36888832
  Located on chromosome 4
  Distance between a terminus base of telomere on chromosomal short arm and 5'-terminus of this base sequence : 99068210
  Distance between 3'-terminus of neighbour sequence of sequence listing upward to telomere on chrosomal short arm and 5'-terminus of this base sequence : 60718
tgataaacaaatctgcaatattaccaagtcaatatttgtgtaccaaagactccaaactcatacgatatctgattttggcctgggagccaggggatctgagcagaggcgaccatacaaccaccagacaagcggatgtgaacacagaggttgagagagtaagagagaaacgtaaagtgaaacttcaaaatacatatttgtgtgtgtgtgtgtgtgtgtgtgtgtgtgtgtagccaacagcaacactcaataaaataaaaaatcagatgaactgatctcagatga

SEQ ID NO: 7257 - DNA, 411 bp, Homo sapiens
  chr4.fa.O7frz.103719401
  Located on chromosome 4
  Distance between a terminus base of telomere on chromosomal short arm and 5'-terminus of this base sequence : 99219094
  Distance between 3'-terminus of neighbour sequence of sequence listing upward to telomere on chrosomal short arm and 5'-terminus of this base sequence : 150602
tctgatgagctgattagcatacagtcctgttttccatctttataacaatacagtaaaactaagtggataaaactgttttgtttcattttagtgtggatttcctcaaaaattttcaaaattatgaacatagtatttctgaggtcttactatataattgtgtgtgtgtgtgtgtgtgtgtataccataagaaattacatattttaagttgtatcatctaatatgattcagcaacagtaataaagatgtgaccttagtttcagttcttatatttggaaaatgaaaatctttcaaattgtaactaacttcgtagctgtaattcctttgtgagtcatttattttgctgatctttgtgctatatttctgtagctgaatagtacagtgtggtagctactagccaaatttagctactga

SEQ ID NO: 7258 - DNA, 312 bp, Homo sapiens
  chr4.fa.O7frz.103266155
  Located on chromosome 4
  Distance between a terminus base of telomere on chromosomal short arm and 5'-terminus of this base sequence : 99380155
  Distance between 3'-terminus of neighbour sequence of sequence listing upward to telomere on chrosomal short arm and 5'-terminus of this base sequence : 160650
actgaatgcaatctgaatgtattcatacttttcactttttgtttcaaattcaatttttaaaatcagaaggcatataggtttggagtttttattattttttctatctttattgaagtataatagacaaattttaaattctatacatttaagatgtacaatgtgatgttttgatgtatgaaaacattgtgaaatgattataataatcaagctaattaacatgtacatcacctcacataactacgtgtgtgtgtgtatgtgtgtgtgtggtgagaacaattaagagctactcttagcaactttcaagtgtaaact

SEQ ID NO: 7259 - DNA, 142 bp, Homo sapiens
  DISO7_10001526
  Located on chromosome 4
  Distance between a terminus base of telomere on chromosomal short arm and 5'-terminus of this base sequence : 99416933
  Distance between 3'-terminus of neighbour sequence of sequence listing upward to telomere on chrosomal short arm and 5'-terminus of this base sequence : 36466
  misc_feature (1)...(142): n = A,T,G or C
cctgagtcttagaaattggatgaggattttaagatctagagttatgactcttttctgtntcctcagtgagccctgagagagagagagagagagagagagagagagagagagagaaattcttggggccttgtcatcagtggaa

SEQ ID NO: 7260 - DNA, 314 bp, Homo sapiens
  chr4.fa.O7frz.102776564
  Located on chromosome 4
  Distance between a terminus base of telomere on chromosomal short arm and 5'-terminus of this base sequence : 99554737
  Distance between 3'-terminus of neighbour sequence of sequence listing upward to telomere on chrosomal short arm and 5'-terminus of this base sequence : 137662
ttaatttgctttacatttccatcccctctttatgcaaaatctgagaataaaactgcatcatgttttcttctctaatttcttgtgttgtagtaacttatttgtgcaatatataggcattaatattattaatttctttatcattctaatttttacacctgcatttttgttaatacttgagtcaggtatacttctttgttggtcctttaatgtttctctctgtgtgtgtgtgtgtgtgtgtgtgtgtgtgtgtgtctgtgtgtctgtgtgtatgtaggccaaagcaactccatcttggatactaattcaccatattg

SEQ ID NO: 7261 - DNA, 407 bp, Homo sapiens
  chr4.fa.O7frz.102605442
  Located on chromosome 4
  Distance between a terminus base of telomere on chromosomal short arm and 5'-terminus of this base sequence : 99658547
  Distance between 3'-terminus of neighbour sequence of sequence listing upward to telomere on chrosomal short arm and 5'-terminus of this base sequence : 103496
agtccattgtatcattcttatgactttgcatcctcatagcttagctcccacatgtcagtgagaacatacagtgtttggttttccattcctgaattgcttcacttagaataatagtctccaatctcatccaggtcacagaaaatgcgttaattcattcttttttatggctgagtagtattccattgtgtgtgtgtgtgtgtgtgtgtgtgtgtgtgtgtgtttgtatacatacatatatatatatatatatacacacacacacacacacacacacaccacagtttctttatccactcattgattgatgggcatttgggttggttccatgattttgcaattgcgaattgtgctgctataaacatgcatgtgcaagtatctttttcatgtaatgacttcctttcttcagg

SEQ ID NO: 7262 - DNA, 159 bp, Homo sapiens
  G08386
  Located on chromosome 4
  Distance between a terminus base of telomere on chromosomal short arm and 5'-terminus of this base sequence : 99781292
  Distance between 3'-terminus of neighbour sequence of sequence listing upward to telomere on chrosomal short arm and 5'-terminus of this base sequence : 122338
attcttgcacttcactcatggtagccaaataaatagctagataggtaggtaggtagatgatagatagataggtagatagatagatagatagatagatagatagatagatagatagatagtacctgtgagtgattcatgccagatacttttggcaattga

SEQ ID NO: 7263 - DNA, 371 bp, Homo sapiens
  chr4.fa.O7frz.102344770
  Located on chromosome 4
  Distance between a terminus base of telomere on chromosomal short arm and 5'-terminus of this base sequence : 99923041
  Distance between 3'-terminus of neighbour sequence of sequence listing upward to telomere on chrosomal short arm and 5'-terminus of this base sequence : 141590
ctgtaacactgcctatgcttatgctccttggcacagggctttaaatacaaacttgttctcttgtgctctttcttcccggttatttgtatggtgtgaggggaacttcttcaagaaatattacttcctcagttccatttgggatgccattacctcccttcccttcccttcccttcccttcccttccctcccctcccctcccctcccctcccttttttctttctttctttccttccttccttccttccttccttccttccttccttccttccttccttccttccttctttctttctttctttctttctttctttctttctttctttctttctttctttctttctttcttctttctttgatggagtctcactctg

SEQ ID NO: 7264 - DNA, 223 bp, Homo sapiens
  D4S2986
  Located on chromosome 4
  Distance between a terminus base of telomere on chromosomal short arm and 5'-terminus of this base sequence : 100049846
  Distance between 3'-terminus of neighbour sequence of sequence listing upward to telomere on chrosomal short arm and 5'-terminus of this base sequence : 126434
tcactctacagcactccagctcgggtgggtgacagaatgagacagacacacagacagaaagaaagaggaaataaaataaaataaaagaaggaaagaaagaaaagaaggagagagaaagagagagcaagaaagagggaaagaaagaaaaaacactaaagacttcacacacacacacacacacacacacacacacacacacggtcagaactaataaacaaagtaa

SEQ ID NO: 7265 - DNA, 259 bp, Homo sapiens
  Z67241
  Located on chromosome 4
  Distance between a terminus base of telomere on chromosomal short arm and 5'-terminus of this base sequence : 100094685
  Distance between 3'-terminus of neighbour sequence of sequence listing upward to telomere on chrosomal short arm and 5'-terminus of this base sequence : 44616
cctgggttatggctgtgagccctgccaaagtgcacatggagggaagcttgtgtgtccctctgtgccagtccaacaactccactcacatgccgtgcatcgaagaatcttcctggtgagtatgtgtgtgtgtgtgtgtgtgtgtgtgtgtatgtgttttcatgatgtctttttttgggttggaagagagacgccttgctctctctcagaaattctgtgaatggtcattttactcagaatttccagcatgtaagatagaagc

SEQ ID NO: 7266 - DNA, 357 bp, Homo sapiens
  AC015993.4_39475
  Located on chromosome 4
  Distance between a terminus base of telomere on chromosomal short arm and 5'-terminus of this base sequence : 100145818
  Distance between 3'-terminus of neighbour sequence of sequence listing upward to telomere on chrosomal short arm and 5'-terminus of this base sequence : 50874
taaggtagactgctcagtggactaattacaaaggcagaaatgcatccaaatacacatgcacatttttgacccagcaattcttttttttctttttattttattcattcattcattcattcattcattcattcattcattcatttttagatacagggtcttgctgtgtcacccaggctggaatgcagtgatgcaatcatggctcactgcagccttgaactcctgggctcaagcaatccacccacctcggcctcccaaagtgctgggattacaggcatgtgccactgtgcccagcctgacccagtaattctaattattgtattttgtcaggtaggtaatatttgcatgtatggaaaatga

SEQ ID NO: 7267 - DNA, 282 bp, Homo sapiens
  chr4.fa.O7frz.104380062
  Located on chromosome 4
  Distance between a terminus base of telomere on chromosomal short arm and 5'-terminus of this base sequence : 100252707
  Distance between 3'-terminus of neighbour sequence of sequence listing upward to telomere on chrosomal short arm and 5'-terminus of this base sequence : 106532
tttatccaacaagaccattctggccaacatggtgaaaccctgtttctactaaaaatacaaaaattagctgggcttggtggtgtgcacctatagtccgagctacttgggaggctgaggcaggagaatcgcttgaacccaggaggcggaggttgcagtaggctgagatagcgtcactgcactccagcctggcaacagagcgagactcgcctcaaaagagaaggaaggaaggaaggaaggaaggaaggaaaagaaattggtgaaattggtactgacatgaaatta

SEQ ID NO: 7268 - DNA, 381 bp, Homo sapiens
  AC019131.4_163113
  Located on chromosome 4
  Distance between a terminus base of telomere on chromosomal short arm and 5'-terminus of this base sequence : 100419767
  Distance between 3'-terminus of neighbour sequence of sequence listing upward to telomere on chrosomal short arm and 5'-terminus of this base sequence : 166778
aggtaggcatgatcactatgacaggtagctggagtagtttggaaaatagtattgtctgatctactgcaatttttggaggtggcagtggaggtaccatatgtatcaattagattgttttgcctgaaaataatagaaatttgagtaaaagaggcttaaaaaatgaagatttattattattattattattttgcagttgcaagatttaatagagtgaaaacagagctcccatacaatgggaggggacccaaagggggttgcccctgaaaggaggttgcccactcccggctcgaatgcctggagtttatatcccaatcattgtccctccccctgtgccctcaggcgatatatgatttgactgtgtctttaccttctgctctagcc

SEQ ID NO: 7269 - DNA, 228 bp, Homo sapiens
  G08396
  Located on chromosome 4
  Distance between a terminus base of telomere on chromosomal short arm and 5'-terminus of this base sequence : 100473242
  Distance between 3'-terminus of neighbour sequence of sequence listing upward to telomere on chrosomal short arm and 5'-terminus of this base sequence : 53094
cccctaagtttccgtcacttggttgaagtttagtagatatctccacatctccagctagaacagcaccagaatttcaggactagggcaatagagtctgatattaaattctatttctatctatctatctatcatctatctatctatctatctatctatctatctatctatctatctatctacagaacaatttgtgggatagtagctttggggtcccagatctaggatggg

SEQ ID NO: 7270 - DNA, 290 bp, Homo sapiens
  AC025902.3_33168
  Located on chromosome 4
  Distance between a terminus base of telomere on chromosomal short arm and 5'-terminus of this base sequence : 100594710
  Distance between 3'-terminus of neighbour sequence of sequence listing upward to telomere on chrosomal short arm and 5'-terminus of this base sequence : 121240
aagtacatgaaagtgcctagtcaccttagtcttaccaatattgagtgttacaatttttaatcttattgataggattaattatatttacatatgcatattactatatgacattctcataaagtgaatttaggcatgcttcatgacttcttatgttgctcaacactatcttctggttttgttcatctctatatttgccatcatcttttcaatcctatgatgatgatgatgatcacgatgatgatgtcaatgataatgatgacaatgataactaacctttgatggctactgtg

SEQ ID NO: 7271 - DNA, 327 bp, Homo sapiens
  AP002027.1_141602
  Located on chromosome 4
  Distance between a terminus base of telomere on chromosomal short arm and 5'-terminus of this base sequence : 100728189
  Distance between 3'-terminus of neighbour sequence of sequence listing upward to telomere on chrosomal short arm and 5'-terminus of this base sequence : 133189
tagctacagatattgctaatggacagaggaaatgtctccaaatgattcttggatagagattttctatactcatctatatctatcatctatctatctatctatctatctatctatctatctatctatcatctatctatgtatctatttattgacataaatatagatatatatgtatacataaaaatataattcttataagctgtaaatattcatagtgttttgagaattgccatagctaaactcagctgatgatgaagatacttcaaaataattatttacacttttcagctattttttttaaacctagattaagcctagattgacaaa

SEQ ID NO: 7272 - DNA, 467 bp, Homo sapiens
  chr4.fa.O7frz.104949852
  Located on chromosome 4
  Distance between a terminus base of telomere on chromosomal short arm and 5'-terminus of this base sequence : 100822842
  Distance between 3'-terminus of neighbour sequence of sequence listing upward to telomere on chrosomal short arm and 5'-terminus of this base sequence : 94326
gcttcattaatctggatgactattttcctctccagatttagaagttttcaaccaaccttccttctttgtttttccactttctccattccgttttctcccttcctccctcccttcctccctcccttcctcccttctttcctttctttctctctttctctctcactttctttctttctctttctctctcttttttctctctccctttctttctctttctctttcccttccttacttccttctctttctttcttttttctttctttcttctctttctctttcttttcctttttctttctcattttctttctttctttttctctcttgctctttctttcttttctttctttctgtctttctgtctgtctttctttctttctttctttctttctttctttctttctttcttcctttctttctttcttctttctttctttcttgatgagatcttgctacattgactagactgg

SEQ ID NO: 7273 - DNA, 317 bp, Homo sapiens
  chr4.fa.O7frz.105055956
  Located on chromosome 4
  Distance between a terminus base of telomere on chromosomal short arm and 5'-terminus of this base sequence : 100922167
  Distance between 3'-terminus of neighbour sequence of sequence listing upward to telomere on chrosomal short arm and 5'-terminus of this base sequence : 98858
cattatcttccataggaattgtaccattttaggctttcatcagcaatttatgaaaaggcctatttccccatagtctcacctacaaaatatgttagcaaacttttgaatttttcaccaatttgatagttgagaaatgtcacttctctgattaagtgtgatgtttagcatctttccttctattgggagccttttgttaatacttctccactcttccccatatcatccattctccccaaccccatgtatgtgtgtgtgtgtgtgtgtgtgtatgtgtgtgtctgtgtgtttgtgtgtgcttgtagcctaatttcagaggt

SEQ ID NO: 7274 - DNA, 280 bp, Homo sapiens
  HUMUT2079
  Located on chromosome 4
  Distance between a terminus base of telomere on chromosomal short arm and 5'-terminus of this base sequence : 101121961
  Distance between 3'-terminus of neighbour sequence of sequence listing upward to telomere on chrosomal short arm and 5'-terminus of this base sequence : 199477
tattggtcacaagtgaatcacagaggccaggccagattcaaaggaggggagttaggtgctgcctcttgacagggagcagcaaggtcacattgcagaagagcatgtgggttgggagatgtatgtgtgtatgtatgtatgtatgtatgtatgtatctatctatctatctatctatctatctatttatctatcatctatctactatctatccatcaagagaatttgccacaagtaagcaaatattctatataatttcaggtagagctaaaaacagaagtggta

SEQ ID NO: 7275 - DNA, 254 bp, Homo sapiens
  chr4.fa.O7frz.105511636
  Located on chromosome 4
  Distance between a terminus base of telomere on chromosomal short arm and 5'-terminus of this base sequence : 101328991
  Distance between 3'-terminus of neighbour sequence of sequence listing upward to telomere on chrosomal short arm and 5'-terminus of this base sequence : 206750
cttgatttcttttaatgaaggataccatttattaaaagaatgaaacaatgatctgggtgctcatgttcatcattaccgaggtgtcattgcattgggaattttcagtagaaagagctagaaaatgttgtatgtatatacgcatgtacatgtgtatgtatacgagcatatgattgtaactatttttatttatgtacatgtgtatgtgtgtgtgtgtgtgtgtgtgtgtgttttcatacctgacttgatgctgatac

SEQ ID NO: 7276 - DNA, 421 bp, Homo sapiens
  chr4.fa.O7frz.105628685
  Located on chromosome 4
  Distance between a terminus base of telomere on chromosomal short arm and 5'-terminus of this base sequence : 101456172
  Distance between 3'-terminus of neighbour sequence of sequence listing upward to telomere on chrosomal short arm and 5'-terminus of this base sequence : 126927
tttcaggttatcaaatgtcaactcagaccctgtattagtaagggttctcagaaaacaaaaccagctgacaagtgctgcgtgtgtgtgtgtgtgtgtgtgtgtgtgtgtgtgtgtgtgtgtgtgtgtgtttgcagtgttaaaagaaaaaccttagataaatttaacaaagtttaattgaactaagaacaattagcaaatcaggcagccctcaaaccagaatagattcagggagactccagcattgccttgtggttgaagatgatttatggatagaaaaaggaaaaaagtaacatacagaaaatggaagtgagatacagaaacagacagattggttacagcctggcatttgacttatttgaatatggtttgaacaattggctgccgttgattgaccaaaacttggtgattggtagataagtag

SEQ ID NO: 7277 - DNA, 446 bp, Homo sapiens
  chr4.fa.O7frz.105724325
  Located on chromosome 4
  Distance between a terminus base of telomere on chromosomal short arm and 5'-terminus of this base sequence : 101549425
  Distance between 3'-terminus of neighbour sequence of sequence listing upward to telomere on chrosomal short arm and 5'-terminus of this base sequence : 92832
tggaacttatttctaggtgctaaatatttattgaatagatatttaatgggactaaaatttattgaattatgaatgtccttattttttaaaacaagatagaggctttggcatttagtttctcttttcttttcttttcttttcttaccttttcttttcttttcttttttcctttcctttcctttcctttcctttcctttcctttcctttcctttcctttcctttcctttcctttctttttgttttcctttcccatcttgtaccttctttggaggtttcttgcaggttctttgggattttgtaacagagaactagaataagaagaaaaaaagagagacatgggatagggatcatcatggcggacgggaggcaggactagattgcaactctgactgggacagacagagcatggttcggaggatggcattgtaaactttagcttcagattg

SEQ ID NO: 7278 - DNA, 249 bp, Homo sapiens
  chr4.fa.O7frz.106133195
  Located on chromosome 4
  Distance between a terminus base of telomere on chromosomal short arm and 5'-terminus of this base sequence : 101809145
  Distance between 3'-terminus of neighbour sequence of sequence listing upward to telomere on chrosomal short arm and 5'-terminus of this base sequence : 259274
ctgttgaaatcagttacctgacccatataagaaaatatgttttcctgtatctgaatctgttctctagctattttcacctatacacaaacgtatctgcatgtttgtctatgtgtatgtgtgtgtgtgtgtgtgtgtgtgtgtgtgtgtgtgtgtgtgtagatgtacagttttttcttggtatcttgaaacaaagtttggaatattttgaaaatgccgtaattagttgttcataatttgatttctaggttg

SEQ ID NO: 7279 - DNA, 290 bp, Homo sapiens
  chr4.fa.O7frz.106046161
  Located on chromosome 4
  Distance between a terminus base of telomere on chromosomal short arm and 5'-terminus of this base sequence : 101896096
  Distance between 3'-terminus of neighbour sequence of sequence listing upward to telomere on chrosomal short arm and 5'-terminus of this base sequence : 86702
tgatactttaacattctcaggaaggcctccccagctgattggctggttgctacaagttagattatattaacagttaaaacccaaatcatctccttactaccctttaatagcccatgctagtagacctcattctgtttatctatgatctatgtcacttcctctctctctctctctctctctctctctctctctctctctcgtgtgtgtgtgtgtgtgtgtgtgtgtgtgtgcgttcaggaggcagagaatgggcaggtggaagttaggggtgtctcgtgtatgtttcctta

SEQ ID NO: 7280 - DNA, 369 bp, Homo sapiens
  chr4.fa.O7frz.107169744
  Located on chromosome 4
  Distance between a terminus base of telomere on chromosomal short arm and 5'-terminus of this base sequence : 102046354
  Distance between 3'-terminus of neighbour sequence of sequence listing upward to telomere on chrosomal short arm and 5'-terminus of this base sequence : 149968
gaatgacactataggtgcagttacgagttacattggggtgattagcctcaatgttaaccacctggtgggcctccaggatcatggatgtaaggtacgggtattcatggtcaaatgctgggtacccagtgaaatcgtcactcccagatagagccaaataaactagattgtgcagaacagctgggaaatctccatattgttggactgagacacctgagacctcgagaagcgtgtgtgtgtgtgtgtgtgtgtgtgtgtgtgtgcacacgcacatgcagggggaataactaaccttccacatccttttacctccaggttcccttggattagtcatggtgggacaaagcaatggttaacattagccaggcagta

SEQ ID NO: 7281 - DNA, 378 bp, Homo sapiens
  chr4.fa.O7frz.108717640
  Located on chromosome 4
  Distance between a terminus base of telomere on chromosomal short arm and 5'-terminus of this base sequence : 102268470
  Distance between 3'-terminus of neighbour sequence of sequence listing upward to telomere on chrosomal short arm and 5'-terminus of this base sequence : 221747
gtcatgcctgttaaatctcagcacactcctgtggagcagggaacaggtctcccctttctcagatacccacactgtggcccctcttgcttcacctttgcctcttctcacttccgcggccaccacacacaccacacacacacacacacacacacacacacacacacaatcctcagggagttgcaagacttgttctgacttaccaaacactgtctctgccctgaggtctcctggggtacagggcttttgaaattccactgagcttctgctataacattccttccctaaggcaactgatgctgcacattctagatacccaaattacttgttaaaactacaaaataccatcctgccacaatgtctgtttccatttactctaaa

SEQ ID NO: 7282 - DNA, 138 bp, Homo sapiens
  DISO7_10001532
  Located on chromosome 4
  Distance between a terminus base of telomere on chromosomal short arm and 5'-terminus of this base sequence : 102379056
  Distance between 3'-terminus of neighbour sequence of sequence listing upward to telomere on chrosomal short arm and 5'-terminus of this base sequence : 110208
cctaaacctatgcacatacatacacatatacaccacacacacacacacacacacacacacacacgtactatctgtatatatatttgttgcaactacacatttaaattttgctcatggagtacatcttctatcccaatg

SEQ ID NO: 7283 - DNA, 256 bp, Homo sapiens
  DISO7_10001533
  Located on chromosome 4
  Distance between a terminus base of telomere on chromosomal short arm and 5'-terminus of this base sequence : 102448715
  Distance between 3'-terminus of neighbour sequence of sequence listing upward to telomere on chrosomal short arm and 5'-terminus of this base sequence : 69521
aaattctctgccacaactgtcttttgcttgcagaaaacaaaacaaaacaaaaaagcgcacacacacacacacacacacacacacacacaaattagcttcagttttattcctctgtaggtaactttctctctgttttttgtttacctagctattttatggtattttttctttatctttgttgtttaaatgattcccaaggtaaatataagcatagacttattttcattgatttttctgggaacataacctactacca

SEQ ID NO: 7284 - DNA, 241 bp, Homo sapiens
  chr4.fa.O7frz.106333447
  Located on chromosome 4
  Distance between a terminus base of telomere on chromosomal short arm and 5'-terminus of this base sequence : 102607386
  Distance between 3'-terminus of neighbour sequence of sequence listing upward to telomere on chrosomal short arm and 5'-terminus of this base sequence : 158415
gtccatcagaaaccattaaataaaaaatatatagactaatctacataggatcatctcatctttaaagtgtgtgtgtgtgtgtgtgtgtgtgtgtgtgtgtgagagagagagagagagagagagcacaacagagacagaaacagaaagggaaagttctgggaaatacttggagttctcctcttccatttcttacttttcttcctctctgtccctgctcttgtccgttctattaagagtccat

SEQ ID NO: 7285 - DNA, 331 bp, Homo sapiens
  chr4.fa.O7frz.106416124
  Located on chromosome 4
  Distance between a terminus base of telomere on chromosomal short arm and 5'-terminus of this base sequence : 102689982
  Distance between 3'-terminus of neighbour sequence of sequence listing upward to telomere on chrosomal short arm and 5'-terminus of this base sequence : 82355
ccatgactaaataaccactcactctttccacatagcaatattgcaatcctacataaccagaaaaaagtctttaaaatacaaattgtatatatacacatatacacaaacatacatatatttgcgtgtatatatacatacatagagacacacacacacacacaaacacacacacacacacacacacacacacacacacacagggagagagtttagtatgtagaattatctactccaaatttttacgaaggtgtctcacgtgactcaaacagaattcctgaacttctccccataacctgctgcttccacaatctgtcttcaactcagaaattag

SEQ ID NO: 7286 - DNA, 312 bp, Homo sapiens
  chr4.fa.O7frz.106546059
  Located on chromosome 4
  Distance between a terminus base of telomere on chromosomal short arm and 5'-terminus of this base sequence : 102819165
  Distance between 3'-terminus of neighbour sequence of sequence listing upward to telomere on chrosomal short arm and 5'-terminus of this base sequence : 128852
gaggtcaggagctcaagaccagcctggccaagatggtgaaaccccatctctactaaaaatacaaaaattagctgggtgtggtggcgggtgctggtaatcccagctattcaggaggctgaggcagagaattgcttgaacctgggaagcagatgttgcagtgagccgtgatcacgccactgcacttcagcctgggcgacagagcaagactccatcaaaataaataaataaataaataaataaataaataaataaataaagggaaatgtatcaggtatagaactgatttctgcatctttgacactttgtggaata

SEQ ID NO: 7287 - DNA, 365 bp, Homo sapiens
  AP001963.1_82726
  Located on chromosome 4
  Distance between a terminus base of telomere on chromosomal short arm and 5'-terminus of this base sequence : 102916109
  Distance between 3'-terminus of neighbour sequence of sequence listing upward to telomere on chrosomal short arm and 5'-terminus of this base sequence : 96632
ggataggaatcttactgctaaacacgtttgttttcaatttcatggttttcttcctcctttcccagttgacaggaaggcaatcattcattcattcagcaagcaagcaagcatccacaatgagcctggatgccacatggaccacgatcaccaaggagatcgataaatcccagtaagttcagttgccctccactccacagaccagtccccacagtgggcaccatttccttacaggtcaaaactttgttcttttttgtaccagataatttattttctggagctaaaagtaatatttctaagtgctagcttaaaaaatgtgtttctggcatgacgtaaaagtaacctggtcaggattataaagtacatca

SEQ ID NO: 7288 - DNA, 365 bp, Homo sapiens; identical to SEQ ID NO: 7287
  AP002017.2_20801
  Located on chromosome 4
  Distance between a terminus base of telomere on chromosomal short arm and 5'-terminus of this base sequence : 102916109
  Distance between 3'-terminus of neighbour sequence of sequence listing upward to telomere on chrosomal short arm and 5'-terminus of this base sequence : -365

SEQ ID NO: 7289 - DNA, 297 bp, Homo sapiens
  AP001816.1_40488
  Located on chromosome 4
  Distance between a terminus base of telomere on chromosomal short arm and 5'-terminus of this base sequence : 102977230
  Distance between 3'-terminus of neighbour sequence of sequence listing upward to telomere on chrosomal short arm and 5'-terminus of this base sequence : 60756
gatcagcatagctatggcatagcttgaatggtacacacacatacacaaaaccactcatatgtatgtatgtatgtatgtatgtgtgtgtgtgtgtgtatacacacacacacacacacatacacagacaatatgtcaatgtttcctccagtggagggcggaggggcttggattccaggtgattggtcatgtttcttagaaagaaataaccttcatatagaaagaaacaatgcttctggctaaaaaccttgcctaaaacatgacatacagctattccttcattccaaacttgagttaaac

SEQ ID NO: 7290 - DNA, 132 bp, Homo sapiens
  DISO7_10001529
  Located on chromosome 4
  Distance between a terminus base of telomere on chromosomal short arm and 5'-terminus of this base sequence : 103061124
  Distance between 3'-terminus of neighbour sequence of sequence listing upward to telomere on chrosomal short arm and 5'-terminus of this base sequence : 83597
tctcagtcttcagagttcatgactatacacacacacacacacacacacacacacacatatatatatatatacataatatttatatgattgttttaacctttataaaatgacctgaccaactactcctactaa

SEQ ID NO: 7291 - DNA, 163 bp, Homo sapiens
  D4S2961
  Located on chromosome 4
  Distance between a terminus base of telomere on chromosomal short arm and 5'-terminus of this base sequence : 103173497
  Distance between 3'-terminus of neighbour sequence of sequence listing upward to telomere on chrosomal short arm and 5'-terminus of this base sequence : 112241
atgacattgtctcaagagcatcttattggtttaactatgggcaaggatgcctataaactacatttagtttaaggaagtaaggggtgtgtgtgtgtgtgtgtgtgtgtgtgtgtgtgtgtgtgtgtgcgcgtgcgcgcgcatgtgcctacacaaatgagaccct

SEQ ID NO: 7292 - DNA, 374 bp, Homo sapiens
  AP002022.1_73504
  Located on chromosome 4
  Distance between a terminus base of telomere on chromosomal short arm and 5'-terminus of this base sequence : 103458385
  Distance between 3'-terminus of neighbour sequence of sequence listing upward to telomere on chrosomal short arm and 5'-terminus of this base sequence : 284725
gaatgcaaaggaactagaattctcgcacactgctggtaggagtacagaatggtattgtttttggaaaacagtttgacagttacttttggaattaaatctacctttattaaatgatgcacaagttctgctcatgggtatttacctaggattaattaaaacatatgccaacaaaagacctgtatgctaatgttacggcagctatattcataatagcccaaactgaaaagtagccaaacatccatcaaatggagaaatgataaaaatcttgtggtgtgttcatacaatctaatactactcaaaaacaaacaaacaaacaaacaaacaaacaaaactcactcttgtaaaaaataacatgtttgaaagcattatggtaa

SEQ ID NO: 7293 - DNA, 315 bp, Homo sapiens
  AP002022.1_77518
  Located on chromosome 4
  Distance between a terminus base of telomere on chromosomal short arm and 5'-terminus of this base sequence : 103462476
  Distance between 3'-terminus of neighbour sequence of sequence listing upward to telomere on chrosomal short arm and 5'-terminus of this base sequence : 3717
tgacatccactacagatgacacacgcataagcatcataaatctagcaaaagtgtggaaggacttaatgcagaaaactataaaatgttattgaaagaaatcaaaacaacctcagtaaatgagaagatataccctgaacatgaacaaaaggctcaatatcataaagttgccaaatctcactaatagattgaatacaatcctaataaaaattccaatgttaagtatgtgtgtgtgtgtgtgtgtgtgtgtgtgtgtaacttgacaaaccaatactaaaaaatgtctacgaaaatgtagaaatgtaaaggctatgccta

SEQ ID NO: 7294 - DNA, 349 bp, Homo sapiens
  AP002022.1_86203
  Located on chromosome 4
  Distance between a terminus base of telomere on chromosomal short arm and 5'-terminus of this base sequence : 103471205
  Distance between 3'-terminus of neighbour sequence of sequence listing upward to telomere on chrosomal short arm and 5'-terminus of this base sequence : 8414
cagtgtcctaggtgagcaatagccccgctctgtcgtttccgtgaaggttcatgaaaaaaactccaagcttaggatttcaatttgcattataaaacaatctataattaaactttgagtttcattttcaaaaactcagcaacatagccacaagagatatgcatgcatatacacacaacagacacacacacacacacacacacacacacacacacaccgttttctagccctagtgaagctgttaactgcagtaagccctcagagggccaattttaggtcaaaggaccatagcagtttgtgggaaagtgagggagaataccatttattttcgttctaaggactccatgatcaa

SEQ ID NO: 7295 - DNA, 250 bp, Homo sapiens
  AF213884.1_54405
  Located on chromosome 4
  Distance between a terminus base of telomere on chromosomal short arm and 5'-terminus of this base sequence : 103775221
  Distance between 3'-terminus of neighbour sequence of sequence listing upward to telomere on chrosomal short arm and 5'-terminus of this base sequence : 303667
aaataggaaccagctcaaatacccattaatcaacaagtggataaagaaaatgtgagatatacatagatagatgatggatagattagatagacagatagatgattgatagatagatagatagatagatagatagatagatagatagaaaatggaatgctactcaaccataaaaagtaacaaaataatggcacttgcagcaacctggatggaattggagaccattattctaagtgaaataactcatgaatgg

SEQ ID NO: 7296 - DNA, 321 bp, Homo sapiens
  AF224669.1_683
  Located on chromosome 4
  Distance between a terminus base of telomere on chromosomal short arm and 5'-terminus of this base sequence : 103911483
  Distance between 3'-terminus of neighbour sequence of sequence listing upward to telomere on chrosomal short arm and 5'-terminus of this base sequence : 136012
ggcttgcctattgctactcaattttattttattttattttattttattttattttattttattttattttattttattgcttctgtaaaattggaaaaaccttaccaaaaaaaaggaattagaaatttcttcagctttctgcctggatttttctccttcaactcagttcatgaagcctgttgattattttccctcagtacagaaggcttaagttgctctttccttttagcaagcggaatcaaagattcttaggcctgaacacttcagccaccaccagccttatcctttgagggatgatattgataaaccaacatttattgc

SEQ ID NO: 7297 - DNA, 270 bp, Homo sapiens
  AF224669.1_5951
  Located on chromosome 4
  Distance between a terminus base of telomere on chromosomal short arm and 5'-terminus of this base sequence : 103916709
  Distance between 3'-terminus of neighbour sequence of sequence listing upward to telomere on chrosomal short arm and 5'-terminus of this base sequence : 4905
tttaccaagtaagactctacggagtcccagccctaagtccccttatccccttgataaggctttgtgtgtgtgtgtgtgtgtgtgtgtgtgtgtgtgtgtgtgtgtgtgtgtgtacatataaaatgaggatactcttagatactgaagaagactggattgtctgtagttacttttagagtcactgaacataatgcttctcatttttaaaaccaaaaccactaataatatcttaattttaaagccaaacactctttgctggtccattctata

SEQ ID NO: 7298 - DNA, 382 bp, Homo sapiens
  AF224669.1_28065
  Located on chromosome 4
  Distance between a terminus base of telomere on chromosomal short arm and 5'-terminus of this base sequence : 103938651
  Distance between 3'-terminus of neighbour sequence of sequence listing upward to telomere on chrosomal short arm and 5'-terminus of this base sequence : 21672
cttcagtatccaaatctaatgcagtctagctccagtccctagttcattaaacccagaaggatctgaagaaaatcgaactgtcatacaaatcatatggttaaaatggtctatactaaaggtaaatagtttacatttcatgggctctcactgtgtcaggtagagtgctgagtgcttcaatgtattagttaacttaatctttactcataaacacacgcacatatgcagatctacatgcacacacacacacacacacacacaaggtatttactaccattaaccccaatttacagatgaggaaactgaaattcagaaagattaaataatctgtccaagatgatacagataatgaatggcagctgtcatattcaatccagttctgttt

SEQ ID NO: 7299 - DNA, 153 bp, Homo sapiens
  D4S3043
  Located on chromosome 4
  Distance between a terminus base of telomere on chromosomal short arm and 5'-terminus of this base sequence : 103938794
  Distance between 3'-terminus of neighbour sequence of sequence listing upward to telomere on chrosomal short arm and 5'-terminus of this base sequence : -239
ctcactgtgtcaggtagagtgctgagtgcttcaatgtattagttaacttaatctttactcataaacacacgcacatatgcagatctacatgcacacacacacacacacacacacaaggtatttactaccattaaccccaatttacagatgagg

SEQ ID NO: 7300 - DNA, 473 bp, Homo sapiens
  AC024629.1_28139
  Located on chromosome 4
  Distance between a terminus base of telomere on chromosomal short arm and 5'-terminus of this base sequence : 103994648
  Distance between 3'-terminus of neighbour sequence of sequence listing upward to telomere on chrosomal short arm and 5'-terminus of this base sequence : 55701
atacaacctgccaatactgactgacaaaaaaatagaggccaggcgcagtggctcatgtaattccaacactttgggaggccaaggcaggaggattgcttgagaacaggagttggaaaccagcctgggcaacatagcaaggccccgtcaggaaggaaaggaaaagaaaggaaaggagggagagagggaggaaaaaggaaaaggcaaggcaaggcagaaaaggaaaggaaaggaaaaaagaaaggaagaaagaaagaaagagagagagagaaagaaaagaaagaaaggaaggaaggaaggaaggaagaaaagaaaagaaaaagaaaggaaggaaggaaggaaggaaggaagaaaagaaaagaaaaagaaaggaaggaaggaagaaagaaagaaagaaaaaaaagaaagaaagaaagagaaagagagagagagaaaggaaggaaggaaggaaggaaatagtgaacctgaacgactaa

SEQ ID NO: 7301 - DNA, 236 bp, Homo sapiens
  AF224669.1_173160
  Located on chromosome 4
  Distance between a terminus base of telomere on chromosomal short arm and 5'-terminus of this base sequence : 104083896
  Distance between 3'-terminus of neighbour sequence of sequence listing upward to telomere on chrosomal short arm and 5'-terminus of this base sequence : 88775
ctggattatactcatgccatagactacttacaacaacaaaaaacagtgataaccttaagaaaggaatatatatatatatatatatatatatatatatatatatatatatatgcacaggagaatttttatattgtttaaatattaactagctttatttcaaaccaagaaccaaatatggtccaacaacttttctaaactttttaaaaagttctttctaccaattcattgtcatctcc

SEQ ID NO: 7302 - DNA, 184 bp, Homo sapiens
  AF224669.1_223813
  Located on chromosome 4
  Distance between a terminus base of telomere on chromosomal short arm and 5'-terminus of this base sequence : 104134538
  Distance between 3'-terminus of neighbour sequence of sequence listing upward to telomere on chrosomal short arm and 5'-terminus of this base sequence : 50406
ccatggattacctgtagtctgtagtctctttccttataggaacgaggttattcctctgattgattttatgtgtgcctgtgtgtgtgtgtgtgtgtgtgtgtgtgtgtgtgtgtgtccaacccaatctcaaaatcttacttaagggtccatttcctgtaataacttctgttgcaaatcaccatat

SEQ ID NO: 7303 - DNA, 141 bp, Homo sapiens
  D4S1572
  Located on chromosome 4
  Distance between a terminus base of telomere on chromosomal short arm and 5'-terminus of this base sequence : 104134592
  Distance between 3'-terminus of neighbour sequence of sequence listing upward to telomere on chrosomal short arm and 5'-terminus of this base sequence : -130
tctgattgattttatgtgtgcctgtgtgtgtgtgtgtgtgtgtgtgtgtgtgtgtgtgtgtccaacccaatctcaaaatcttacttaagggtccatttcctgtaataacttctgttgcaaatcaccatatctttagagtct

SEQ ID NO: 7304 - DNA, 354 bp, Homo sapiens
  chr4.fa.O7frz.108459522
  Located on chromosome 4
  Distance between a terminus base of telomere on chromosomal short arm and 5'-terminus of this base sequence : 104245150
  Distance between 3'-terminus of neighbour sequence of sequence listing upward to telomere on chrosomal short arm and 5'-terminus of this base sequence : 110417
aggcaactattactgtacaggactttaaaaaaacaagattcagctatatggtgcctacaagaaacaaactttagataaaacaagcaggttgaatgtaaaaggataggagattaggagacatacatatatatatacacacacacacacacacacacatacgcaaatggtaattatggggaaagaagaaaacataagtgtaattactatatatatgtaatttttttaacctgtaagtcagttttattatctgtaaaatggggataaaaaaattatctcctgccaacataaataggttttgttacaataaaatgaactagtgagcatgaaagaacattgcaatctgttaagatgttc

SEQ ID NO: 7305 - DNA, 110 bp, Homo sapiens
  DISO7_10001538
  Located on chromosome 4
  Distance between a terminus base of telomere on chromosomal short arm and 5'-terminus of this base sequence : 104402255
  Distance between 3'-terminus of neighbour sequence of sequence listing upward to telomere on chrosomal short arm and 5'-terminus of this base sequence : 156751
cacagtaaggccaacaaatgaaattaagagaaccaacagaagccttagtaaaactgctaaatacacacacacacacacacacacacactcttaatgttcactttcaggca

SEQ ID NO: 7306 - DNA, 235 bp, Homo sapiens
  DISO7_10001540
  Located on chromosome 4
  Distance between a terminus base of telomere on chromosomal short arm and 5'-terminus of this base sequence : 104418844
  Distance between 3'-terminus of neighbour sequence of sequence listing upward to telomere on chrosomal short arm and 5'-terminus of this base sequence : 16479
aacgagtatttaaccactcttccaaaaactgtgtcatttctttcctattacttagtacttgttgaaattcagtctttatgctagggaactcactttctgagaaatctttgagaatttcctgtgtgaaaaataagcgtcaaattgtttaaacattaggaaagttttgatccaaatattttatttatatatatatatatatatatataaaataaaaagagggcaatacctagtggac

SEQ ID NO: 7307 - DNA, 146 bp, Homo sapiens
  chr4.fa.O7frz.109255775
  Located on chromosome 4
  Distance between a terminus base of telomere on chromosomal short arm and 5'-terminus of this base sequence : 104498851
  Distance between 3'-terminus of neighbour sequence of sequence listing upward to telomere on chrosomal short arm and 5'-terminus of this base sequence : 79772
catttagtgatagcttagaccaagagattaaaaatttcaagtacatctccattccttgtagacctttgtgctctacacacacacacacacacacacacacacacacacacacacacacacacagagacatcttaacatttgaggtg

SEQ ID NO: 7308 - DNA, 322 bp, Homo sapiens
  chr4.fa.O7frz.109366837
  Located on chromosome 4
  Distance between a terminus base of telomere on chromosomal short arm and 5'-terminus of this base sequence : 104595510
  Distance between 3'-terminus of neighbour sequence of sequence listing upward to telomere on chrosomal short arm and 5'-terminus of this base sequence : 96513
tctgtttattgcagtgctattcacaatagccaagatatgaaatcaacttaaatgacaatctacagataaagaaatgttttatacatatatatatgtgtgtgtgtgtgtgtgtgtgtgtgtgttgtgtgtgcataacatttcattatccatttatctgtagatgtatatatacacacaaaatcaaatactattcatccataaaacagaatgaaatcctctcatttgtggcaacatggttgaacctggaagacactatgttaagtgaaataagccaggcacagaaagacaaacatcacatgatctcagtcatgttgaatctaaa

SEQ ID NO: 7309 - DNA, 219 bp, Homo sapiens
  chr4.fa.O7frz.109879977
  Located on chromosome 4
  Distance between a terminus base of telomere on chromosomal short arm and 5'-terminus of this base sequence : 104742621
  Distance between 3'-terminus of neighbour sequence of sequence listing upward to telomere on chrosomal short arm and 5'-terminus of this base sequence : 146789
aagatcactgatcacagatcaccataacaggtataataataataaaaaagctggaaatattgtaagaattaccaaaatgttttattattattattattattattattatacttgaagttttagggtacatgtgcacaatgtgcgggttagttacatatgtatacatgtgccatgctggtgtgctgcacccactaactcgtcatctagcattaggtatac

SEQ ID NO: 7310 - DNA, 358 bp, Homo sapiens
  HUMUT6976
  Located on chromosome 4
  Distance between a terminus base of telomere on chromosomal short arm and 5'-terminus of this base sequence : 104859503
  Distance between 3'-terminus of neighbour sequence of sequence listing upward to telomere on chrosomal short arm and 5'-terminus of this base sequence : 116663
catgctcaaggtcaaaagaaatttcaaagtagttaaagaggttgcttgattgcctgcccgccgttcattcgttctttctctttctttctttctttctttctttctttctttctttctttctttctttctttctttctttctttctttctctttctttctttcttttcttttcttttctttctttctttctttctttctttctttctttctttctttctttctttctttctttctttctttctttctttcttcctttccttccttccttccttccttccttccttccttccttccttccttcctttctttctttctttttctttctttctatcttctttttggagtttcactcttgttg

SEQ ID NO: 7311 - DNA, 392 bp, Homo sapiens
  AC004065.1_136231
  Located on chromosome 4
  Distance between a terminus base of telomere on chromosomal short arm and 5'-terminus of this base sequence : 104978806
  Distance between 3'-terminus of neighbour sequence of sequence listing upward to telomere on chrosomal short arm and 5'-terminus of this base sequence : 118945
taaggcttccagtgaagtaaatagtaaagtttcgtggggttcaaaattatacacaattatttttactgtgcagggctcagtgcccctaagtcctgcattgctcaagggtcaacagaatatagatatgtctctctctctgtgtgtgtgtgtgtgtgtgtgtgtgtgtgtgtaaagtttacttcatatagttctcacatattatatttgcagataaatattgtttattatgttaagaaatactgtatattgtagttcgccaagaattctatcaggaatgggaattgagttatcacaaattatttcagaatccacttagatgatcatatacttatttttgaaattatgtgttaatagttttcagtatttagccatccacactccttaggttacct

SEQ ID NO: 7312 - DNA, 260 bp, Homo sapiens
  AC004065.1_115719
  Located on chromosome 4
  Distance between a terminus base of telomere on chromosomal short arm and 5'-terminus of this base sequence : 104999286
  Distance between 3'-terminus of neighbour sequence of sequence listing upward to telomere on chrosomal short arm and 5'-terminus of this base sequence : 20088
agctaactgcagtgatttgaatcttgactgtactgcataatcttggaaaagcttatcatctttgaggcaagtgttacatttatatgttatttttcaaaatggcaaattggggaaggatggtggagagaaaagcaactcttcactgacaaataattttatcttgtgtgtgtgtgtgtgtgtgtgtgtgtgtgtgtgtgtgtgttggaggtataggggtgaggagacaggtactggtagtggtaaagtagacttctaggcaa

SEQ ID NO: 7313 - DNA, 175 bp, Homo sapiens
  Z67206
  Located on chromosome 4
  Distance between a terminus base of telomere on chromosomal short arm and 5'-terminus of this base sequence : 104999413
  Distance between 3'-terminus of neighbour sequence of sequence listing upward to telomere on chrosomal short arm and 5'-terminus of this base sequence : -133
aaaagcaactcttcactgacaaataattttatcttgtgtgtgtgtgtgtgtgtgtgtgtgtgtgtgtgtgtgtgttggaggtataggggtgaggagacaggtactggtagtggtaaagtagacttctaggcaagaaggaaatgtgtagaactagaagatggatttctggcaaatt

SEQ ID NO: 7314 - DNA, 434 bp, Homo sapiens
  AC022979.2_131494
  Located on chromosome 4
  Distance between a terminus base of telomere on chromosomal short arm and 5'-terminus of this base sequence : 105007535
  Distance between 3'-terminus of neighbour sequence of sequence listing upward to telomere on chrosomal short arm and 5'-terminus of this base sequence : 7947
tggtgaattgcatttattgatttttgaatgttacagtatacttacattcctggtataaattctactttttcatgatgtattatcttttaaaaatatgattaaaatatgattgaatgtagcttactaataaaaataaataaataaataaataaataaataaaaaacatgtaaaaagaaataggaaggtatggagaaaaatgagtgtttaactgtgtaagagaatgtggtgcccactgattctggattgttccaacttctcttgtaaatgtttgagatggacatgctaattacccttaactgatcactatacattgtacatatcaaaatatgtaccccatgaatatgtaaagttattatttgttaataaaaaataaaattttgaaaatattttaaataaatacaaagtaaaagtacagtcatctccagtatccaat

SEQ ID NO: 7315 - DNA, 423 bp, Homo sapiens
  AC004065.1_35233
  Located on chromosome 4
  Distance between a terminus base of telomere on chromosomal short arm and 5'-terminus of this base sequence : 105079725
  Distance between 3'-terminus of neighbour sequence of sequence listing upward to telomere on chrosomal short arm and 5'-terminus of this base sequence : 71756
ggaattatcttgaatgcatagactgtttttgcaggaaataaaatatttacaacatcagatttgatgactgagtgtggtggctcacacctgtaatcctaacacttgggtggcctaggtgggaggatcgtatgtgcccaggtgttcaaggctacagtgagctatgatcacaccgctgcacttagcctgggcaacagaataagaccctgtctcacagagagagagtgagagagagagagagagagagagagaaagagagaaacagagagacagatagatagataatccataaagaaacattaaaaatatttacatttatatgtgacttgttttatttaagtaagagttttgttaattttattttttggatagttgtttgaccttaacatttttagtaaacttattaagtctaaatgctttcgtgtc

SEQ ID NO: 7316 - DNA, 264 bp, Homo sapiens
  AC004047.1_55662
  Located on chromosome 4
  Distance between a terminus base of telomere on chromosomal short arm and 5'-terminus of this base sequence : 105142047
  Distance between 3'-terminus of neighbour sequence of sequence listing upward to telomere on chrosomal short arm and 5'-terminus of this base sequence : 61899
tttaggtgtaggtcgaactcagagttcatgaagaagatattcactatcattttatttatacctaaaaccttaatagattccagatctctctctctctcactttctctctctctatatatatatgtgtgtgtgtgtgtgtgtgtgtgtgtgtgtggtgtacgcatgtatatataattttttatatcaatttaaaattttaatgattttaatattctaaaagatatgcttgtaaaaacttttgctcataacagcactgtgaagttc

SEQ ID NO: 7317 - DNA, 165 bp, Homo sapiens
  AC004047.1_84746
  Located on chromosome 4
  Distance between a terminus base of telomere on chromosomal short arm and 5'-terminus of this base sequence : 105171172
  Distance between 3'-terminus of neighbour sequence of sequence listing upward to telomere on chrosomal short arm and 5'-terminus of this base sequence : 28861
tttatcttcctgccaatattacactctgatggtgttaaaattctctaaaatggtttaacatggaaatgcaaatacacacaaacacacacacacacacacacacacacacacacacaaacacatatatgttttccacagtatgtatcacatagtggtcatgaacaa

SEQ ID NO: 7318 - DNA, 257 bp, Homo sapiens
  AC004047.1_89985
  Located on chromosome 4
  Distance between a terminus base of telomere on chromosomal short arm and 5'-terminus of this base sequence : 105176446
  Distance between 3'-terminus of neighbour sequence of sequence listing upward to telomere on chrosomal short arm and 5'-terminus of this base sequence : 5109
catcagttatcaatttaggtggaggtaagtgggtggagatacacatacacacacacacacacacacacacacacacacacacacaatcatacatgtactgcagaattattttattatttttattaagtgtttaattaaagtaatcatgaaaattaaagtactgatattagctctatctatacaccggttccttaaattaaaaaaaatgaaacttaaaactcaactccaaatgactagatggataattggactgagaa

SEQ ID NO: 7319 - DNA, 298 bp, Homo sapiens
  chr4.fa.O7frz.110181365
  Located on chromosome 4
  Distance between a terminus base of telomere on chromosomal short arm and 5'-terminus of this base sequence : 105280864
  Distance between 3'-terminus of neighbour sequence of sequence listing upward to telomere on chrosomal short arm and 5'-terminus of this base sequence : 104161
ctagcaaattgactttaaacaaagacaagttgtattagagtgtgtgtgtgtatatatatatatatatatacacacacatatatatatacacacacatacatggagagagagagaaactatttcatgtttgagagaaagcagggaaatgagaatgttttcttcctattttccaaattggttagttcaaggccaagtatatatggacagtattatgtaaaacattatcaatgagatgaatatattctccactgcacaaagaatgaaattaattatgaaccaatctattaagaaatcgagt

SEQ ID NO: 7320 - DNA, 118 bp, Homo sapiens
  DISD22_0003917
  Located on chromosome 4
  Distance between a terminus base of telomere on chromosomal short arm and 5'-terminus of this base sequence : 105356908
  Distance between 3'-terminus of neighbour sequence of sequence listing upward to telomere on chrosomal short arm and 5'-terminus of this base sequence : 75746
aacattgaatgtgttgaatgtgttttccttctcccccaacacacgcacaggcatacacacacacacacacacacacacacacacacacacacacttctctgcagaagacagaaatctg

SEQ ID NO: 7321 - DNA, 200 bp, Homo sapiens
  D4S2913
  Located on chromosome 4
  Distance between a terminus base of telomere on chromosomal short arm and 5'-terminus of this base sequence : 105527382
  Distance between 3'-terminus of neighbour sequence of sequence listing upward to telomere on chrosomal short arm and 5'-terminus of this base sequence : 170356
tgattttactatttttgtaactggatagtattctagtgtgtgtgtgtgtgtgtgtgtgtgtgtgtgtgtgtatgaatgggatattcagtgtgtgtgtatatatatatgaatgggatattcagtgtgtatatgtatatacacacacacatagatgttaatgtatatacacacatctgtctatctgttgatggacacttaac

SEQ ID NO: 7322 - DNA, 272 bp, Homo sapiens
  AC004052.1_153557
  Located on chromosome 4
  Distance between a terminus base of telomere on chromosomal short arm and 5'-terminus of this base sequence : 105553234
  Distance between 3'-terminus of neighbour sequence of sequence listing upward to telomere on chrosomal short arm and 5'-terminus of this base sequence : 25652
tcatgaaagtgacaggttctacttgagaaaagagccaatagcaaagtgataatgcagactggataacatgatttaaatttttggagatagatagatagataaatagagagacagatagatagatagatagatagatagatagatagatagatagatggatagatgatagatagagagagagacagagatgtaggtatattccctaagtcacttttattttgtaagaaaaaatatacattactgaaaacatataaacctgaattatgcaacac

SEQ ID NO: 7323 - DNA, 207 bp, Homo sapiens
  AC004052.1_150821
  Located on chromosome 4
  Distance between a terminus base of telomere on chromosomal short arm and 5'-terminus of this base sequence : 105555973
  Distance between 3'-terminus of neighbour sequence of sequence listing upward to telomere on chrosomal short arm and 5'-terminus of this base sequence : 2467
actctcaggccttaagactcagactgaaatagatcactgactttcctggttccccagtttgtagatggcaaatcatgggacttgtcagcctccataattgtgtgaaccaattcttataataaatatcatcacacacacacacacacacacacaacacacacacacacacaccctattggttctgtttatctgaagagccatgactag

SEQ ID NO: 7324 - DNA, 132 bp, Homo sapiens
  D4S2907
  Located on chromosome 4
  Distance between a terminus base of telomere on chromosomal short arm and 5'-terminus of this base sequence : 105556055
  Distance between 3'-terminus of neighbour sequence of sequence listing upward to telomere on chrosomal short arm and 5'-terminus of this base sequence : -125
tgtcagcctccataattgtgtgaaccaattcttataataaatatcatcacacacacacacacacacacacaacacacacacacacacaccctattggttctgtttatctgaagagccatgactagcatacca

SEQ ID NO: 7325 - DNA, 396 bp, Homo sapiens
  AC004052.1_131746
  Located on chromosome 4
  Distance between a terminus base of telomere on chromosomal short arm and 5'-terminus of this base sequence : 105574901
  Distance between 3'-terminus of neighbour sequence of sequence listing upward to telomere on chrosomal short arm and 5'-terminus of this base sequence : 18714
ataacaagtatttgctcaggacacatccaatgactaaatcatgaaatttactgaatagagagcattatctgtaactaaattctatatggctttattgtcatccttcctggcaccctctcagagagccacttccactctttctggaagaggatggttattggtgaataatggcaagttggagttgacaaacgttctttagttagagacagacagggctccgggtaagtcttcctgtctgggttagttttatgcttttttccctgtaactttctctctctctctctctctctctctctctctgtgtgtgtgtgtgtgtgtgtgtgtgtgtgtgtgtgagagagagagagagagagagatgcagttcatgtgtagtggtatgaccacttgttctggagt

SEQ ID NO: 7326 - DNA, 204 bp, Homo sapiens
  AC004052.1_131354
  Located on chromosome 4
  Distance between a terminus base of telomere on chromosomal short arm and 5'-terminus of this base sequence : 105575470
  Distance between 3'-terminus of neighbour sequence of sequence listing upward to telomere on chrosomal short arm and 5'-terminus of this base sequence : 173
ggattagcaatgattagtgcacatgctatgaattctggatttttgtccctgtcaccaagtactcatacaattaatctttttgtcacattattttacacacacacacacacacacacacacacatatatatatatataaattttcctacaatttatctttccagttattcccttttaaatccagttatactctgtccaggcactg

SEQ ID NO: 7327 - DNA, 305 bp, Homo sapiens
  AC004052.1_84084
  Located on chromosome 4
  Distance between a terminus base of telomere on chromosomal short arm and 5'-terminus of this base sequence : 105622732
  Distance between 3'-terminus of neighbour sequence of sequence listing upward to telomere on chrosomal short arm and 5'-terminus of this base sequence : 47058
ttctgtgcctaacttatttcacttagcgtaatatcctccagttttatccatgctgtcacaaatgatagaacttcctttttaaggctgtggagtattccattgtgtgtgtgtgtgtgtgtgtgtgtgtgtgtataacatttttaaatctattcatctgtttataggcacttattttgctctcaaatcttggctattctgaataatgctgaaataaacatgggaatgcagatatttctttgacatatcaatttcaattcctttggatgtatatccagaagtgggattgctgaatcatacagtgattc

SEQ ID NO: 7328 - DNA, 373 bp, Homo sapiens
  AC004052.1_71261
  Located on chromosome 4
  Distance between a terminus base of telomere on chromosomal short arm and 5'-terminus of this base sequence : 105635389
  Distance between 3'-terminus of neighbour sequence of sequence listing upward to telomere on chrosomal short arm and 5'-terminus of this base sequence : 12352
tgatgtaataggaaggtaagcaacgtggaaaaacaaaaggatgatgtaaacagagagatgaaaagtctaacagttaaaaggaagagctagaaaacaaaacaaaaaaagataacactataacagaaatgaagaacaccttcagtgagttattcagtaaatttggcatagctaaggaaagattcagtgagtatgatgatttgttaatagacacactgaaattgaatggtaaagaggaaaaggaagaaaagagaacacacacacacaaacacacacacacacacacacacacacacacacccccaggacagaagattaacaaactatgagacaatttcaaaagatataatgtattcattatcgaataccagaagga

SEQ ID NO: 7329 - DNA, 171 bp, Homo sapiens
  AC004052.1_70350
  Located on chromosome 4
  Distance between a terminus base of telomere on chromosomal short arm and 5'-terminus of this base sequence : 105636524
  Distance between 3'-terminus of neighbour sequence of sequence listing upward to telomere on chrosomal short arm and 5'-terminus of this base sequence : 762
gacacaaactaagtgctaaggaatgaatggataaagaaaatgtagtgtgtgtgtgtgtgtgtgtgtgtgtgtgatgtaatataatttttccttaaatagaagaaaatcctgataattgcaacaagatgaatcaacctgatggacattatgttaagtgaaataaaccaggca

SEQ ID NO: 7330 - DNA, 101 bp, Homo sapiens
  DISO7_10001543
  Located on chromosome 4
  Distance between a terminus base of telomere on chromosomal short arm and 5'-terminus of this base sequence : 105835168
  Distance between 3'-terminus of neighbour sequence of sequence listing upward to telomere on chrosomal short arm and 5'-terminus of this base sequence : 198473
ccagtgattattgtttcctggttttttgtttgtttgtttgtttatttgtttgttttgatgagattcttagagaagcagtgtctcaatgcaattatatttct

SEQ ID NO: 7331 - DNA, 137 bp, Homo sapiens
  D4S411
  Located on chromosome 4
  Distance between a terminus base of telomere on chromosomal short arm and 5'-terminus of this base sequence : 106005294
  Distance between 3'-terminus of neighbour sequence of sequence listing upward to telomere on chrosomal short arm and 5'-terminus of this base sequence : 170025
aggctgtcttggcagaaatgaactgcaaatatcacacacacacacacacacacacacacgcatggacagagcaagaaaagggcagggtagtaacagtggaagattttaattatcttgccatagcacaggattacatc

SEQ ID NO: 7332 - DNA, 412 bp, Homo sapiens
  AC004063.1_156708
  Located on chromosome 4
  Distance between a terminus base of telomere on chromosomal short arm and 5'-terminus of this base sequence : 106081715
  Distance between 3'-terminus of neighbour sequence of sequence listing upward to telomere on chrosomal short arm and 5'-terminus of this base sequence : 76284
aaacaagtttctaaggagttccacactttcccacattttcctatcttcttctgagccctccaaactgttccaaactctgcctgttacccagatccaaagttgcctcccccttttggggcatcttttcagcagcaccccactctactggtatcaacttaccatattagtctgttttcatgctgctgataaagacatacccaagactgggcaatttacacacacacacacacacacacacacacacacacacacacacacacacacagaggtttattggagttccacatggctggggagtcctcacaatcatggtggaaggtgaaaggcacatctcacatggtggcagacaagagaacagagcttgtgcaggagaaattcccctttttaaaaaccatccgatcttataagactt

SEQ ID NO: 7333 - DNA, 357 bp, Homo sapiens
  AC004053.1_3259
  Located on chromosome 4
  Distance between a terminus base of telomere on chromosomal short arm and 5'-terminus of this base sequence : 106107214
  Distance between 3'-terminus of neighbour sequence of sequence listing upward to telomere on chrosomal short arm and 5'-terminus of this base sequence : 25087
ttgcctgtactattgaggtcttactcaagaaatcattgcccagaccaatgtcccagagtcctttctcaacgttttcaactttacagcctgattttttatctaactatttatctattgatgtatttatttatctatcatctatctatataatctgtcttataataaacacacacacacacacacacacacacactcaaatacacatagtaaatataatataacctaaaatggacaatataggatatatcaattctacaatgctaaaaagagtgtttggtaagaacatttgtttgctgtcatactgatagcaaaatgtctaatcagattgcttctctatgtttatccttagccaaatgt

SEQ ID NO: 7334 - DNA, 189 bp, Homo sapiens
  D4S1570
  Located on chromosome 4
  Distance between a terminus base of telomere on chromosomal short arm and 5'-terminus of this base sequence : 106210237
  Distance between 3'-terminus of neighbour sequence of sequence listing upward to telomere on chrosomal short arm and 5'-terminus of this base sequence : 102666
cctggcccattatattccttttttatgcttactttttgtggcttctttttcttgatccatttttacaatggtttgcatattttactaaagtttctaacaaattagttttcatgttgtgtgtgtgtgtgtgtgtgtgtgtatatatatatatatatactattttagtttatacgttgtgctttcatcttg

SEQ ID NO: 7335 - DNA, 218 bp, Homo sapiens
  AC004053.1_154426
  Located on chromosome 4
  Distance between a terminus base of telomere on chromosomal short arm and 5'-terminus of this base sequence : 106258464
  Distance between 3'-terminus of neighbour sequence of sequence listing upward to telomere on chrosomal short arm and 5'-terminus of this base sequence : 48038
aacttcagtgaatagcatcacttagtgtatttttaaaaggcatatcagaagtcctgtcttgttgggggtaggggggatgcaggtgtgtgtgtgtgtgtgtgtgttcataaaggtgttatttttaatgatgaaaatgtagggcattgagagacattgtggaaaatggctgtagggatctaactgaaaagataggactttcagtttaagttacagctggt

SEQ ID NO: 7336 - DNA, 302 bp, Homo sapiens
  AC004069.1_107027
  Located on chromosome 4
  Distance between a terminus base of telomere on chromosomal short arm and 5'-terminus of this base sequence : 106475217
  Distance between 3'-terminus of neighbour sequence of sequence listing upward to telomere on chrosomal short arm and 5'-terminus of this base sequence : 216535
agtttatccactcacctactgaaggacatcttacttgcttccaagttttggtaattatgaataatcaggccacaaaaatctgcgtgccccgcatgtgtttcccccatgctgttctcgtgatagtgagggagttctcacaacagctcgtgattttaagtttgacacttccacactctttctctctctctctctctctctcctgccgccatataagaagtgccttgcttcccctttgccttctgccacgactgtaggtctcttgaggccaccccagccatgtggaactatgaatcaattaaacc

SEQ ID NO: 7337 - DNA, 385 bp, Homo sapiens
  AC004069.1_59039
  Located on chromosome 4
  Distance between a terminus base of telomere on chromosomal short arm and 5'-terminus of this base sequence : 106523152
  Distance between 3'-terminus of neighbour sequence of sequence listing upward to telomere on chrosomal short arm and 5'-terminus of this base sequence : 47633
atgcatcaagtttcattctgagtttttgtttcattagaaaatatgtgaatttgaaactctaaactaaatccaccaagccccatccctccagccttaatcaataaaaaggggaattgtttcaataaatttcaaaatttaaaaaaaaaacttttcataaaactttcagtttataaacttctggtctaatgattttttctcattacttacacacacacacacacacacacacacacacacacacacacacacacaaacttctctccctctagctctttctctctcctctctctccccttcatccaaacatctttctcagttgctttgaaggggagacagcaagtaagagctccaaacattttgtctttcatgcctttgaataacttat

SEQ ID NO: 7338 - DNA, 372 bp, Homo sapiens
  chr4.fa.O7frz.111557947
  Located on chromosome 4
  Distance between a terminus base of telomere on chromosomal short arm and 5'-terminus of this base sequence : 106609721
  Distance between 3'-terminus of neighbour sequence of sequence listing upward to telomere on chrosomal short arm and 5'-terminus of this base sequence : 86184
tgcattacaaagaacattagattattggaataaaaggatagacatacataatatgactagtgggatctaaattataaccttttaaaattgtaatttaattagtctgtcatttaggcaaatgataatttctaaaactgcctttttagacttaaaaaaataccaaagttcttataactttagcattatgttttgttcattcttaaagtttaattcactttgttgcctttttggtaaacctatgaagaaatctcatgctgcaccatatagtaaaaaatcgtgtgtgtgtgtgtgtgtgtgtgtgatttgaataatgagctatgtgttatattttgataagcaaagataagtttatagtgaagcagataaacatgc

SEQ ID NO: 7339 - DNA, 436 bp, Homo sapiens
  AC024544.2_166640
  Located on chromosome 4
  Distance between a terminus base of telomere on chromosomal short arm and 5'-terminus of this base sequence : 106763516
  Distance between 3'-terminus of neighbour sequence of sequence listing upward to telomere on chrosomal short arm and 5'-terminus of this base sequence : 153423
aatgttgaaggcatgaacatatatgtatctcttcatttacttagttctctgatgtctgttggcaatattttatacttttcagggtgcaggttctttgcatacttttgccagagttattcctaagtgtttcttttgtatttttgataccattataaataatgtaattttaatattattttctaattgtagccagtacacaaaaatacttccttgagatatatatctctgtatatacagatgtatatatatctatatatatagatgtgtgtgtatatatatatctatatgtgtgtatctatcaatatgtgtagatagatagatagatagatagatagatagatagatagataatctcaagcaactatttttatatactggctcttgttgcccaggctgaagtgcaatggcatgatcctgactcactgtaacttctgcc

SEQ ID NO: 7340 - DNA, 223 bp, Homo sapiens
  D4S3026
  Located on chromosome 4
  Distance between a terminus base of telomere on chromosomal short arm and 5'-terminus of this base sequence : 106810415
  Distance between 3'-terminus of neighbour sequence of sequence listing upward to telomere on chrosomal short arm and 5'-terminus of this base sequence : 46463
gcattctatctcatgtataaatggaattccagaatgggaaagaggaggccaaaaaatatttgaataaataacgtccaaaaaatttccaaatttgatgaaaagtataaaccccacagattgagaaaggacacatgcacatacacacacacacacacacacacacacacacacacacacacccatcagaataaacaaacaaacaaaatccaaagtgaagcacatc

SEQ ID NO: 7341 - DNA, 206 bp, Homo sapiens
  AP002335.2_44320
  Located on chromosome 4
  Distance between a terminus base of telomere on chromosomal short arm and 5'-terminus of this base sequence : 107131089
  Distance between 3'-terminus of neighbour sequence of sequence listing upward to telomere on chrosomal short arm and 5'-terminus of this base sequence : 320451
tcgactgagagtttcaatttctccacacctctttattattattattattattattattattattattattattgttatagctatcctaatgggtgtgcagtggtatctcattgtggtttttatttgtatttccctgatcagcactgttttaaaactcattaaattgaagtaataacttctatacattaaactgcaccagtctgaac

SEQ ID NO: 7342 - DNA, 206 bp, Homo sapiens; identical to SEQ ID NO: 7341
  AC016838.4_152580
  Located on chromosome 4
  Distance between a terminus base of telomere on chromosomal short arm and 5'-terminus of this base sequence : 107131089
  Distance between 3'-terminus of neighbour sequence of sequence listing upward to telomere on chrosomal short arm and 5'-terminus of this base sequence : -206

SEQ ID NO: 7343 - DNA, 379 bp, Homo sapiens
  chr4.fa.O7frz.111812589
  Located on chromosome 4
  Distance between a terminus base of telomere on chromosomal short arm and 5'-terminus of this base sequence : 107266823
  Distance between 3'-terminus of neighbour sequence of sequence listing upward to telomere on chrosomal short arm and 5'-terminus of this base sequence : 135528
aggttgaagaggaaatgataagagacagagatacatgtgtgtgtgtgtgtgtgtgtgtgtgtgtgtgtatgtgtgtgtgtgtgcgtctgggttcagcagaggaggccaagtttgtcagtataggctcacagacaccaggatttaatagtcatacctatcatgttaggtagttagttaatttctttcccactacctcaacttttttcttgttatttttttttctcctgtcctatttttttccctgttggaacttgtaaataaataattggagtaaatatcacacaaggatagttgtgttcatataccagcataccttggcgatattgcaggttcagttccatactaccacaatgaagtgaatattgcaataaagtgaatc

SEQ ID NO: 7344 - DNA, 300 bp, Homo sapiens
  DISD22_0003919
  Located on chromosome 4
  Distance between a terminus base of telomere on chromosomal short arm and 5'-terminus of this base sequence : 107447876
  Distance between 3'-terminus of neighbour sequence of sequence listing upward to telomere on chrosomal short arm and 5'-terminus of this base sequence : 180674
ctgtgttaattctacacccacacgtgtgtgtgtgtgtgtgtgtgtgtgtgtgtgtgtgtgtgtgtgtgtgtgtgtgtatatataggcagagacagagagagagctgggtgtggtggcacatgcctatagttccagctactcaggaggctgaagcagaaggatcacttgagcccaggagtttaaggctgcagtgacctatgattgccactacactccagcgtgggtgaccagagtgaaatcctgtctctctcttaacaaaataaaattagcaaaacatttggtacacctatttgcttcctg

SEQ ID NO: 7345 - DNA, 333 bp, Homo sapiens
  chr4.fa.O7frz.113692380
  Located on chromosome 4
  Distance between a terminus base of telomere on chromosomal short arm and 5'-terminus of this base sequence : 107633991
  Distance between 3'-terminus of neighbour sequence of sequence listing upward to telomere on chrosomal short arm and 5'-terminus of this base sequence : 185815
gttcagaaatgaggacgtaagtttcctgtaaatgtgtgtgtgtgtgtgtgtgtgtgtgtatgtgtatatatgtatgtatatatacatatatacacacactatatatatatacatctgcatacacacagatacacacacacacacacacacacacacacatatgtatgtataaaattagctcaagttatctcaggaaatatgcccagaaattgtgtaacaggaaggtagacaggattattgagaccagacaagatcaagaacagaggaaaggaaaaaacttcgtttacattaaactcttttaaacattttgtaatctgcactagatgcaagtat

SEQ ID NO: 7346 - DNA, 227 bp, Homo sapiens
  G08385
  Located on chromosome 4
  Distance between a terminus base of telomere on chromosomal short arm and 5'-terminus of this base sequence : 107664873
  Distance between 3'-terminus of neighbour sequence of sequence listing upward to telomere on chrosomal short arm and 5'-terminus of this base sequence : 30549
tggaacaccaattgtttctgaatttccagcctaaggatttttggacttgtcagtcccacaatcatgtcagccaatttcttaaacaacatgatagatgatagataggagagagagagagagagatgatagattagatatagatagatagatatagatagatagatagatagatagatagatagatagatagatagattgattgattctgattctctggaaactttgcc

SEQ ID NO: 7347 - DNA, 284 bp, Homo sapiens
  AC003099.1_94149
  Located on chromosome 4
  Distance between a terminus base of telomere on chromosomal short arm and 5'-terminus of this base sequence : 107711569
  Distance between 3'-terminus of neighbour sequence of sequence listing upward to telomere on chrosomal short arm and 5'-terminus of this base sequence : 46469
cagctgaagtattgcacaattatattttggtatgcagcaaaagcaaaagtgttttacacatactctgcattcatcatacaaaataactaaaatacgtgtattcgagagtcaacatgtaataaaataacatttgctgcttcatcatggacattcctaagggaaattagcatatatctttgtctgagtgtgtgtgtgtgtgtgtgtgtgggtgtgtataattttattttgagtgtgttgataaaaaacacaacatacagtttgttgtcactagtttgatttctgct

SEQ ID NO: 7348 - DNA, 183 bp, Homo sapiens
  Z67227
  Located on chromosome 4
  Distance between a terminus base of telomere on chromosomal short arm and 5'-terminus of this base sequence : 107745148
  Distance between 3'-terminus of neighbour sequence of sequence listing upward to telomere on chrosomal short arm and 5'-terminus of this base sequence : 33295
tctgggaatacatgatggcatagtttttctaactcatgcggtgctatgtaaaaccagaaaaagagatgaggataacaattccccaaaatgcacatacgagcacacaccacacacacacacacacacacacacacacacacacacacacatctagagtaaaattaggtgacaaggtgagtaagc

SEQ ID NO: 7349 - DNA, 341 bp, Homo sapiens
  AP001819.1_129345
  Located on chromosome 4
  Distance between a terminus base of telomere on chromosomal short arm and 5'-terminus of this base sequence : 107841917
  Distance between 3'-terminus of neighbour sequence of sequence listing upward to telomere on chrosomal short arm and 5'-terminus of this base sequence : 96586
ggctttgccttctgtattagtcagggttctctagaggagcagaactagtaggatatatatcttactagtttacatatatatcccactagttcatacatatatatatatgtgtgtgtgtgtgtgtgtgtgtatgtgtgtatgtgtatgtgtgtgtgtgtgtgtgtgtgtatatatatatatatatatatatatatatatatatatcctactagtatatatatggagtttattaggagtattaactgacacaatcacaaggtcccacagcaggccatctgcaagctgaggagcaaggaaaccagttcatcccaaagatgaagaacttggagtctgatgtttga

SEQ ID NO: 7350 - DNA, 293 bp, Homo sapiens
  AP001819.1_153565
  Located on chromosome 4
  Distance between a terminus base of telomere on chromosomal short arm and 5'-terminus of this base sequence : 107866239
  Distance between 3'-terminus of neighbour sequence of sequence listing upward to telomere on chrosomal short arm and 5'-terminus of this base sequence : 23981
catcttatagtgccagaaagtaaggaggtactccaataaaagaagagaaaatgaaggaaggaaggaggaaggaaggaaggaaggaaggaaggaaggaaggaaggaaggaaggaaggaaggagaaacagtcataaaacttaattaattttcatattctgctttggataatgaaagaagagagtctcagaaaataacaaatgtctttcttgcaaaatatctcttttagagttcagaattacaataatattatgcatcaggaaaaaaatagccttgctcatagatttctcagttac

SEQ ID NO: 7351 - DNA, 410 bp, Homo sapiens
  AC003100.1_34022
  Located on chromosome 4
  Distance between a terminus base of telomere on chromosomal short arm and 5'-terminus of this base sequence : 108041978
  Distance between 3'-terminus of neighbour sequence of sequence listing upward to telomere on chrosomal short arm and 5'-terminus of this base sequence : 175446
gataaattagccttgtttgcagaaatcatgatcttatactaagaaaaatctgaactatccaacaaaaaactcttagaactaataaatttggtaaagtagcaaaataaaaaatcaacatttaaaaaacagtagcatacacacacacacacacacacacacacacatatacccacacagatatatacatatgccaatagcaagcaatctgaaaaagaaatcaagaaagcaatcatggctgggcatggtagctcacacctgtaatcctagcactttagtaggctgcagcaggcagatggcttgagctcaggagctggagaccagcctgagcaatgtggtgaaaccccatctctacaaaaattacaaaaattagccaggcatggtggcatgtacctgttgtcctagctactcag

SEQ ID NO: 7352 - DNA, 446 bp, Homo sapiens
  AC004055.1_57063
  Located on chromosome 4
  Distance between a terminus base of telomere on chromosomal short arm and 5'-terminus of this base sequence : 108155217
  Distance between 3'-terminus of neighbour sequence of sequence listing upward to telomere on chrosomal short arm and 5'-terminus of this base sequence : 112829
cagatgttagttcactgaggattatcaaataattgaaaaagattatgatgtggactgatcatttgagtctaggaattctagaacagcctgtgcgacatggcaaaacaccatctctacaaaaaaaatacaaatattagctgggcggggtcgtgcatgcctgtagtcctagctactcaggaggctggggcaggaaaatcacttcagcccaggaggtgaaggttgcagtgagccgagatcacgccactgcactccaacctgggcaacagaatgagacacctctctctctctctctctctctctctctctctctctctctctctctctctttcacacacacacacacacacacacacacaatgaaaaaaagtcattttcctatagaatgctctccagttactgataaagaatactcccctttctcaatgtttcctagaaatctcatttga

SEQ ID NO: 7353 - DNA, 238 bp, Homo sapiens
  D4S1564
  Located on chromosome 4
  Distance between a terminus base of telomere on chromosomal short arm and 5'-terminus of this base sequence : 108155419
  Distance between 3'-terminus of neighbour sequence of sequence listing upward to telomere on chrosomal short arm and 5'-terminus of this base sequence : -244
agcccaggaggtgaaggttgcagtgagccgagatcacgccactgcactccaacctgggcaacagaatgagacacctctctctctctctctctctctctctctctctctctctctctctctctctttcacacacacacacacacacacacacacaatgaaaaaaagtcattttcctatagaatgctctccagttactgataaagaatactcccctttctcaatgtttcctagaaatctc

SEQ ID NO: 7354 - DNA, 301 bp, Homo sapiens
  AC060815.2_13169
  Located on chromosome 4
  Distance between a terminus base of telomere on chromosomal short arm and 5'-terminus of this base sequence : 108200892
  Distance between 3'-terminus of neighbour sequence of sequence listing upward to telomere on chrosomal short arm and 5'-terminus of this base sequence : 45235
aaacctgcatgagtgtctgtctgtctgtctgtctctctctgtctctctctctctctctctctctctctctctccctctcttcttgagtctcaagggatttcggcctgtaaggactgaactgtattataagtctctctctgacctggatacatgagtgtttttgttatattcacctgcaccgtaagacagtaataaatgtcagttgctaagaggagatgaaaggaaaagattcccaaaacagattttaaggacatttctggtttcttaaatcagtgtaatagaatggcttatttagcagatg

SEQ ID NO: 7355 - DNA, 211 bp, Homo sapiens
  chr4.fa.O7frz.114367553
  Located on chromosome 4
  Distance between a terminus base of telomere on chromosomal short arm and 5'-terminus of this base sequence : 108316035
  Distance between 3'-terminus of neighbour sequence of sequence listing upward to telomere on chrosomal short arm and 5'-terminus of this base sequence : 114842
aatgtttgtcatctaagccttccaggctgtggtattttttatagcagcctgaactcagacaaatatcactgctatttttagaaaatagagagagagagagagagagtgtgtgtgcacataaagaaatatgccctatgtagtcattgttggggttaaaaaaaaaagaagaaatatgcccaaatgttaacagtggttatttctaggaagtggt

SEQ ID NO: 7356 - DNA, 382 bp, Homo sapiens
  chr4.fa.O7frz.113115948
  Located on chromosome 4
  Distance between a terminus base of telomere on chromosomal short arm and 5'-terminus of this base sequence : 108539037
  Distance between 3'-terminus of neighbour sequence of sequence listing upward to telomere on chrosomal short arm and 5'-terminus of this base sequence : 222791
ttcattcttaagatactcaccaagaatgagcaggaatgctcagtgaccatggcagatggcctctcccaacaattgaccagatgttattgaatttcctatatacttagcattatatcagctatgtgcaatgagaaataagaaccaatttgtcttacactttatatatatatatatatatatatatatatatatatatatatatatatatatattttaaatcttcttctaagtttaggcttattttgctcttctttttctagtttcttgaaattttctgttaggctgtttatttgagatatttattctttcttgatataagcatttattgctataagcttccctctcaggactgcttttgctgtatcttacaagcatcggtatg

SEQ ID NO: 7357 - DNA, 368 bp, Homo sapiens
  chr4.fa.O7frz.113397680
  Located on chromosome 4
  Distance between a terminus base of telomere on chromosomal short arm and 5'-terminus of this base sequence : 108917685
  Distance between 3'-terminus of neighbour sequence of sequence listing upward to telomere on chrosomal short arm and 5'-terminus of this base sequence : 378266
agcacaacttcattgatttaatacagcccagttatgtagtttctcacagttggtaatgaaaatttgttctctattttagagatattggtcaaatggacttagaacccaggggaaaaagtgttgatctaataccaatgtggctctcaacatttcaaagaatcaaagcagcaaactgtgaatgttttcaaagttttgggtttcgattttaataatttcacattttgtggggagatgtgtgtgtgtgtgtgtgtgtgtgtgtgtgtacatatacttatcacagatatcatctaaatgacaggaattatcatcttgattacatttattggcttaatcaaaagtatgagattaatccagacatccaagtatgt

SEQ ID NO: 7358 - DNA, 247 bp, Homo sapiens
  chr4.fa.O7frz.113473865
  Located on chromosome 4
  Distance between a terminus base of telomere on chromosomal short arm and 5'-terminus of this base sequence : 108993854
  Distance between 3'-terminus of neighbour sequence of sequence listing upward to telomere on chrosomal short arm and 5'-terminus of this base sequence : 75801
tagaagtttcatgactaactccaccttgaatggtaaacagtaaagctgaacagtatagggattaaagataatcagcctcagagtgagataaatgagtatatatatatatatctatatagacagatgtataatgagtatatatctatagatacataaaaaagtgaaccaacttatatatatatgtatatatatatatatatgtatctctgtatatatatagcataacttggttaactttcctaaacgt

SEQ ID NO: 7359 - DNA, 406 bp, Homo sapiens
  chr4.fa.O7frz.112472102
  Located on chromosome 4
  Distance between a terminus base of telomere on chromosomal short arm and 5'-terminus of this base sequence : 109130895
  Distance between 3'-terminus of neighbour sequence of sequence listing upward to telomere on chrosomal short arm and 5'-terminus of this base sequence : 136794
actgaaacaatttgatcctttcaaggcttgcttttaaggtttatttaatggggccagagcagcttggttttggagcataattttcctccattactaaagcaatgctcttctgactactctccctaatgccttgtttataacagttgtgggtgtttttttgttttgttttgttttgttttgttgttttcattctggttagtgaaaaaatgaactattcttggcattttatgatcttggcattttttcactctgatcatttgaagtggtttctgccctactttgtattatatatatatatatatatatatatacacacacacacacacacacacacactcagatatgttttctgtgtacacacacacacacacacacacacactcttcagtaattagcaaagatttga

SEQ ID NO: 7360 - DNA, 479 bp, Homo sapiens
  chr4.fa.O7frz.112319888
  Located on chromosome 4
  Distance between a terminus base of telomere on chromosomal short arm and 5'-terminus of this base sequence : 109196894
  Distance between 3'-terminus of neighbour sequence of sequence listing upward to telomere on chrosomal short arm and 5'-terminus of this base sequence : 65593
atgacttctcatttggaaagtctttttacattgctgtaaacatttcatcagaattatcttaaaacaattagattcatagttatgaagtatttaagagagtttaataatgctgattgaaaacaagttgcatatttttatgtttttaattattcaaaagtagctcatcattaatgaataaaacctaaacacagaaaatcaggaagaacaaaaataaaattaattccactactcagaaataaccacttttgcagtttctgtgtggtgtgtgtgtgtgtgtgtgtgtgtgtgtgtgtgtgtgtgtatttagcgcaaaagtggtccataattaatttatagtattacagggtcttttttcccttgataatatataatatccccttaataatatatcctgaacattttcttcattaggaaatattttttgtaaacatagttttaattggtgaatgggatttctttacatgagttcagtgctattt

SEQ ID NO: 7361 - DNA, 410 bp, Homo sapiens
  chr4.fa.O7frz.112244848
  Located on chromosome 4
  Distance between a terminus base of telomere on chromosomal short arm and 5'-terminus of this base sequence : 109271905
  Distance between 3'-terminus of neighbour sequence of sequence listing upward to telomere on chrosomal short arm and 5'-terminus of this base sequence : 74532
agacaaattccaggtgatagtctcaataagagattgttgaaaagacccttaaaagatatattaataacttgtatttgtttcagagattgttgaaaagacccttaaaagatatattaataacttgtatttgtttcaagaaaccataaaaattgactgtctccattataaattagcttaaaaataagaaaaaaattgcataagtgcaagtgattagtagaagaaatttacaaagaaaatgagatcaaagggaactagaagagaaaggaaaggaaaagaccattttgacatgttagaagaaaaaaaattatatatatgtgtgtgtgtgtgtgtgtgtataattgaactttcaacaaaccaaactatgaagttgcattgactcacactcatgctaagatgttatgcaccatagg

SEQ ID NO: 7362 - DNA, 110 bp, Homo sapiens
  DISO7_10001548
  Located on chromosome 4
  Distance between a terminus base of telomere on chromosomal short arm and 5'-terminus of this base sequence : 109429269
  Distance between 3'-terminus of neighbour sequence of sequence listing upward to telomere on chrosomal short arm and 5'-terminus of this base sequence : 156954
ttggaactgtgtccagtccaaaacaataaacttgtaaatctccctctttctttctctctctctctctctctctctctctctctctgacaacaatgtcctcaaatctacac

SEQ ID NO: 7363 - DNA, 130 bp, Homo sapiens
  D4S2917
  Located on chromosome 4
  Distance between a terminus base of telomere on chromosomal short arm and 5'-terminus of this base sequence : 109431662
  Distance between 3'-terminus of neighbour sequence of sequence listing upward to telomere on chrosomal short arm and 5'-terminus of this base sequence : 2283
cctgagcatagattatctgcatgtttctgaggagaggccattcaaggagtttttgcattagaaaccttaacatgattattgtgtgtgtgtgtgtgtgtgtgtgtgtgtgttttgagatggagtctcgctc

SEQ ID NO: 7364 - DNA, 118 bp, Homo sapiens
  DISO7_10001549
  Located on chromosome 4
  Distance between a terminus base of telomere on chromosomal short arm and 5'-terminus of this base sequence : 109477181
  Distance between 3'-terminus of neighbour sequence of sequence listing upward to telomere on chrosomal short arm and 5'-terminus of this base sequence : 45389
catcctgcagttgttaaacagattttaatgaaatttgttaggtagttaaaagatatatatatatatatatatatgctaccaaatcatatacatatatgcactattgggtagtctcagg

SEQ ID NO: 7365 - DNA, 374 bp, Homo sapiens
  chr4.fa.O7frz.115023422
  Located on chromosome 4
  Distance between a terminus base of telomere on chromosomal short arm and 5'-terminus of this base sequence : 109574803
  Distance between 3'-terminus of neighbour sequence of sequence listing upward to telomere on chrosomal short arm and 5'-terminus of this base sequence : 97504
atcatgaggtcaggaaattaagaccatcctggccaacatggtgaaaccccatctctactaaaaataccaaaattagctgggcatggtggcacatgcctgtaatcccagctacttgggaggctgaggcaggagaatcgcttaaaccaagggagttggaggttgcagtgagctgagatcacgccactgcactccagcctggtgacagagcaagactttgtctaaaacacacacacacacacacacacacacacacacacacacacacaattgttaatggatacacactataaagataattaaacactgaattcaaggacacaaaggttggggagaatggcgtttttgtatgagattgaagttagtatcagcttgaa

SEQ ID NO: 7366 - DNA, 182 bp, Homo sapiens
  AC004059.2_32877
  Located on chromosome 4
  Distance between a terminus base of telomere on chromosomal short arm and 5'-terminus of this base sequence : 109662699
  Distance between 3'-terminus of neighbour sequence of sequence listing upward to telomere on chrosomal short arm and 5'-terminus of this base sequence : 87522
tttctattgataggcagagactttaacttgtgcgtgcacgtgcacacacacacacacacacacagagcagtcagagtgaacagcgcacacagattgcttagaaccagctaccctttcagcactgagtctcatggtggattctgccactagctggcacaatgttatcacaaatcacaggccta

SEQ ID NO: 7367 - DNA, 451 bp, Homo sapiens
  chr4.fa.O7frz.115237465
  Located on chromosome 4
  Distance between a terminus base of telomere on chromosomal short arm and 5'-terminus of this base sequence : 109799599
  Distance between 3'-terminus of neighbour sequence of sequence listing upward to telomere on chrosomal short arm and 5'-terminus of this base sequence : 136718
gaatttatcagtagcgttattcagccctactcgctttaaagcacggcacccctcagcccaacaaaaagaccgaaggcgaaacattgtgggttcctgcccgcgaaccaaccgttcagccaccgaaccccctaaactgatccatttggaataagttaccctgcccctctacctcccatcctacacacacacacacacacacacacacacacacacacacacacactgcggaccgggggcccagctacgcacacaccccaaaacaaacgagggatctactcgggaccctcagccgggcggccgggcgccttcgttcccttcctccctctctgagtttcccagggacccgccacgcctctcggaactggggcagcggcccgctcacctcgtgtccgttgctggccgggatgatttcagactcgttcaccaaggaagacttgatgtcagctaaatc

SEQ ID NO: 7368 - DNA, 323 bp, Homo sapiens
  chr4.fa.O7frz.115330058
  Located on chromosome 4
  Distance between a terminus base of telomere on chromosomal short arm and 5'-terminus of this base sequence : 109860593
  Distance between 3'-terminus of neighbour sequence of sequence listing upward to telomere on chrosomal short arm and 5'-terminus of this base sequence : 60543
agatctggtgagaacttactgagcagcaaagggggaatccacctccatgatttaatcacctcccaccaggcccctcctccaattcgacatgaaatttgggcagagacacagatccaaaccacattaggcagtagctccttttttaaaaggctgaatatttcattatatatatatatatatatatactacaatttctttatccattagtccatcgacagacagacctatagagccctatagagcctgcagaaccatgaggcaattaaacctcttgtctttataaattacccagtctcaggtagttctttatagcagtgcaagaa

SEQ ID NO: 7369 - DNA, 316 bp, Homo sapiens
  AC005510.3_133568
  Located on chromosome 4
  Distance between a terminus base of telomere on chromosomal short arm and 5'-terminus of this base sequence : 110043636
  Distance between 3'-terminus of neighbour sequence of sequence listing upward to telomere on chrosomal short arm and 5'-terminus of this base sequence : 182720
cataacaatagcctgagatgacaagagcacagaggaggacctctaagatcagaaataaggcaaggctgttctctatccccagtcctattcaatattatgctgtacgttctagccagtgcaatcaatacaaaaagaaagaaaggaaaggaaaggaaagaaagaaagaaagaaagaaagaaagaaagaaagaaagaaagaaagaaagaaaatagaaaaataagattgtctctatttactcgtgtctgtgtagaaaatctcaaagaatttacaaaacagttcctaaaactagtaagtttagtaaaggttgcagaataca

SEQ ID NO: 7370 - DNA, 343 bp, Homo sapiens
  AC012206.4_155415
  Located on chromosome 4
  Distance between a terminus base of telomere on chromosomal short arm and 5'-terminus of this base sequence : 110225239
  Distance between 3'-terminus of neighbour sequence of sequence listing upward to telomere on chrosomal short arm and 5'-terminus of this base sequence : 181287
ccaacttcatttactgaatagtcaccaatctttccccaccaatctgatatattacctttgtcatataccaaagtttcatacatttattattattattattattattgagataggatctcattctgttgcccaggctggagtatggtggcacaatcatggttcactgcagcctcaaacttctaggctcaagtgatcctccagcctcagcctcctgagtaggtgggactaaaggtgtgtgctacaacacctggctaattaaaaaaaaaaaatttgtagagatgggcgtctcgctatgttgcccaggctgatctttaactacaggtctcagtgatctttctgtatc

SEQ ID NO: 7371 - DNA, 469 bp, Homo sapiens
  AC012206.4_93814
  Located on chromosome 4
  Distance between a terminus base of telomere on chromosomal short arm and 5'-terminus of this base sequence : 110386369
  Distance between 3'-terminus of neighbour sequence of sequence listing upward to telomere on chrosomal short arm and 5'-terminus of this base sequence : 160787
catgtgacatagatggttactgatttctaaataccttttagttagaatagtaccattattttatagactttatatttattattccacctaaaaaccaaatgataatatctctagttataggagcaactgtgagattatattctttgttgcaagtccctgctgaggctatagggatttttgtggcaagattgctatgtgtacaccaaaacccattttcttttttgttggtttgtttttgtttgtttgtttgtttgtttgtttgaaacagggtctcgctctgttgcctaggctggagtgcagtggtgcgatctcggctcactgcaagctccgcctcccgggttcacgccattctcctgcctcagcctcctgagtagctgggactgcaggcacccgccaccacgtcaggctaatttttttttttttttttttgtatttttagtagaggcggggtttcactgcgttagacagg

SEQ ID NO: 7372 - DNA, 238 bp, Homo sapiens
  chr4.fa.O7frz.115920920
  Located on chromosome 4
  Distance between a terminus base of telomere on chromosomal short arm and 5'-terminus of this base sequence : 110490294
  Distance between 3'-terminus of neighbour sequence of sequence listing upward to telomere on chrosomal short arm and 5'-terminus of this base sequence : 103456
ggtctattagcctccgaatgaacctctcatggcagcatcatgtaactaagggatccttgatgtcctactttcctccaacttccttttgccagtgccgggctagagattgtgtgtgtgtgtgtgtgtgtgtgtgtgcgcgcgcgcgcgcgcgcacgcgtgcacgtgcactcatgtgctcctgcttgagtacatgcagggggtgggcataagtgatgataaacttgatggtaagaggaag

SEQ ID NO: 7373 - DNA, 393 bp, Homo sapiens
  chr4.fa.O7frz.116035988
  Located on chromosome 4
  Distance between a terminus base of telomere on chromosomal short arm and 5'-terminus of this base sequence : 110592939
  Distance between 3'-terminus of neighbour sequence of sequence listing upward to telomere on chrosomal short arm and 5'-terminus of this base sequence : 102407
ttcctattgaacatttcattaaagagttcaaacctcaaactttgtcagaaaacattctttaatggctattattactattattattattattattattatttttgagatagagtctcactgtctcccaggctaaagggcaagggcatgatcacaactcactgcaacctcagcctccctgggctcaggcaatcctcccacctcagcctcctgagtagctgggactacaggcatgtgccaccatggccagttaatttttgtagtagagatggagttttgccatgttgcccaggctggtaactcctgacctcaagtgatctgcccacctcggcctcccaaagtgttggcatgagccattgtgtccagccaattctaaatcttattctgctggtatca

SEQ ID NO: 7374 - DNA, 416 bp, Homo sapiens
  chr4.fa.O7frz.116249422
  Located on chromosome 4
  Distance between a terminus base of telomere on chromosomal short arm and 5'-terminus of this base sequence : 110800569
  Distance between 3'-terminus of neighbour sequence of sequence listing upward to telomere on chrosomal short arm and 5'-terminus of this base sequence : 207237
gccaatagaaatttcagatttctttctatattctagaataaagggatgttttcatcatattcaaggtatcttggccagattgggaacaggagaagaatcatataaatgagtaaatgagcccagagaaccctaaaaggtacgaaaatataaagttaatacatctgttcaaacacacatacatacacacacacacacacacacacacacacagacataatctgatatataaaacttccttaagactaagaattatattttttctagtataacatcacttaaactaagaactctctagcaactactatatacttataatgtctgtggttcacatggtaggaccattagaagccattgtggaagagatgacagacgagaattttccaaaactgaatatagcagtcctatgattgaactta

SEQ ID NO: 7375 - DNA, 336 bp, Homo sapiens
  AC004701.1_115279
  Located on chromosome 4
  Distance between a terminus base of telomere on chromosomal short arm and 5'-terminus of this base sequence : 110913373
  Distance between 3'-terminus of neighbour sequence of sequence listing upward to telomere on chrosomal short arm and 5'-terminus of this base sequence : 112388
ttcctattcactgcttgataagagaggaagacacagccctgaaaggaatttagcatagtgaaacaatgaaagaatcctggatccctaaaagaatgcagagaagagacatctcctctacccttataccaccatctcccacattggagattggagtttgacctaatcaagaaatacatttgtttgtttgtttgtttgtttgtttgtttgacctaatcaagaaatacatgtgtttgtttgttggttggttgactggttggttggttttgttttttaatgttaagagacaggatttgaggaaactgttggtgtgaacagtgttggttactccaactagtg

SEQ ID NO: 7376 - DNA, 163 bp, Homo sapiens
  D4S1571
  Located on chromosome 4
  Distance between a terminus base of telomere on chromosomal short arm and 5'-terminus of this base sequence : 110936255
  Distance between 3'-terminus of neighbour sequence of sequence listing upward to telomere on chrosomal short arm and 5'-terminus of this base sequence : 22546
cagaaattattgtcatgcgattatacctttttttaatagtgacacagagtcgtgttttgtgtgtgtgtattctcttgctctctacacacacacacacacacacacacacacataattaacttttccatcttcttctcaaagacttctccaggtttctttacgt

SEQ ID NO: 7377 - DNA, 171 bp, Homo sapiens
  AC004701.1_81392
  Located on chromosome 4
  Distance between a terminus base of telomere on chromosomal short arm and 5'-terminus of this base sequence : 110947404
  Distance between 3'-terminus of neighbour sequence of sequence listing upward to telomere on chrosomal short arm and 5'-terminus of this base sequence : 10986
taaccacatcagactctgcatattcattcacacacacacacacacacacacacacacacacactgatatgtagctattaatgctatgcattaatcaagagaaaaccgatgttcagaacacactccactttatctctctggcaggcttctcaacatctgatttcaactcttt

SEQ ID NO: 7378 - DNA, 415 bp, Homo sapiens
  AC004701.1_63422
  Located on chromosome 4
  Distance between a terminus base of telomere on chromosomal short arm and 5'-terminus of this base sequence : 110965251
  Distance between 3'-terminus of neighbour sequence of sequence listing upward to telomere on chrosomal short arm and 5'-terminus of this base sequence : 17676
tgttaaatgtcacttgtctattgacttagaatataagtgcatgagatcaggaactttgtgtcactctatccggtgttcctactgcctaggaaaatgtcgggcacacagcagatgttcattttatgtaatggatggataggaaggaaggaaggaaaaaaaggaaggaaggaaggaaggaaggaaggacggaaggaaggaaagacggaaggaaggaagggggggcagttaaagaagaaactcagtgggctgccatggtaaaaatgcttatgggttgaattgtgtttcttcaaagagatatgctcaagttctaacccacaatacctgtgtatatgaccttatttggaaatggtctttgtagatataatcaaattaatatgatgtcatcctggattagagtaggtcctaatccagtatg

SEQ ID NO: 7379 - DNA, 337 bp, Homo sapiens
  AC004701.1_25215
  Located on chromosome 4
  Distance between a terminus base of telomere on chromosomal short arm and 5'-terminus of this base sequence : 111003410
  Distance between 3'-terminus of neighbour sequence of sequence listing upward to telomere on chrosomal short arm and 5'-terminus of this base sequence : 37744
agcaatcctatgaggaaggtagagtaaccttattactattattattgtttatttcatttgccaaagacattgaggctgaagggggtttaaatcacttaccccaggtcacaaggctgggaacgctattgagcagtttcctgtggcctgcgttcacataacagcaacaacagggtgctatgtacatgtaggcatatgtttatatatatatatatatatatatatatatatatatatgtatgtgtgtatatacatatacatatatatctgttcatgtgtaatatatttaatacatgccccctcatcttcaccaaccctggattatcaactccttaaacac

SEQ ID NO: 7380 - DNA, 394 bp, Homo sapiens
  AC004701.1_23600
  Located on chromosome 4
  Distance between a terminus base of telomere on chromosomal short arm and 5'-terminus of this base sequence : 111005084
  Distance between 3'-terminus of neighbour sequence of sequence listing upward to telomere on chrosomal short arm and 5'-terminus of this base sequence : 1337
gcatttagaacagagcatacctagctcccacatcatctgctcatcaatgctaatctcacctcctccacatgtacctgaaacctttcctaaagtagccacatggagaaactacatgtggatattaacattttaagcattggtgtgtgtgtgtgtgtgtgtgtgtgtgtgtgtgtgtttgagtacaaatttaacctagagagaagagcaaaagagtttaccatattgttttaaagtagacttctggtgctgtgtgtctgatactttgaaaaattaaacttgatcaatagttaaatggtaagatttttttcattcagaaaatgtatggacagttaagtaaattttcttcagatcaaattcaccttgggtgaacacgtacagttgcaaatagcctagc

SEQ ID NO: 7381 - DNA, 235 bp, Homo sapiens
  AC004051.1_122805
  Located on chromosome 4
  Distance between a terminus base of telomere on chromosomal short arm and 5'-terminus of this base sequence : 111037948
  Distance between 3'-terminus of neighbour sequence of sequence listing upward to telomere on chrosomal short arm and 5'-terminus of this base sequence : 32470
tataaagtccaaactcacaggaactgtcttttaaataactaattttaacagaaatgaaaacattcagtcccccaaatccataggttaggaatatgaaaggaaacagaataataaacaatcatcattactaccaggaatactaaattatatatacacacacacacacacacacacacacacacacacacacacacatatatatacaaaattttttgcttacctaaagaactgtttc

SEQ ID NO: 7382 - DNA, 239 bp, Homo sapiens
  chr4.fa.O7frz.116565524
  Located on chromosome 4
  Distance between a terminus base of telomere on chromosomal short arm and 5'-terminus of this base sequence : 111121018
  Distance between 3'-terminus of neighbour sequence of sequence listing upward to telomere on chrosomal short arm and 5'-terminus of this base sequence : 82835
cttcattgtacgtctgttatcatatacagcaatattattttcttaatgttgactgtgccacctgtgtgtgtgtgtgtgtgtgtgtgtgtgtgtgtgtgtgaatcaatagatatagaggcagatagctgccatccattaaatgcttactctatgccaggcaacatgctaatcacttcactcatttgtttaacaaatatttattgaacacctctgatgtgtcagacactggattagatact

SEQ ID NO: 7383 - DNA, 312 bp, Homo sapiens
  chr4.fa.O7frz.117013461
  Located on chromosome 4
  Distance between a terminus base of telomere on chromosomal short arm and 5'-terminus of this base sequence : 111231206
  Distance between 3'-terminus of neighbour sequence of sequence listing upward to telomere on chrosomal short arm and 5'-terminus of this base sequence : 109949
tccaattcaaagttaagactacagggtttccatttctttgaatttaaacttgtgtttgtcttaccctgaaattcttatgacattagcataattatttatttgccttagcctccatatatatatatatatatatatatatatatatatatatatatatatatatgctgtcaagtaagtattattattaatggtaagattactgaatactactcaagattttgtatcagtttgctaatattttgtttagagtttatgcatctatattcataagtgaggttggtctttttattgtgctgtacttctgcttttgta

SEQ ID NO: 7384 - DNA, 291 bp, Homo sapiens
  AC004067.1_46555
  Located on chromosome 4
  Distance between a terminus base of telomere on chromosomal short arm and 5'-terminus of this base sequence : 111387117
  Distance between 3'-terminus of neighbour sequence of sequence listing upward to telomere on chrosomal short arm and 5'-terminus of this base sequence : 155599
tgacagagcaagactccatctcaataaataggtaggtaggtaggtaggtaggtaggtaggtaggtaggtaggtaggcaggcaggtagataggtaggtaggtaggtaggttggtaggtagagagagagagagagagagagagagagagagagagaagtttaatgttcaataatgaacttgaaaccaactgggatttctggtgtgtacatttacagagggtaataaatgcatcttctaagaagcttattgttatgttggcaattttatttattgaatgtaagtcataagcaag

SEQ ID NO: 7385 - DNA, 252 bp, Homo sapiens
  AC004067.1_46477
  Located on chromosome 4
  Distance between a terminus base of telomere on chromosomal short arm and 5'-terminus of this base sequence : 111387124
  Distance between 3'-terminus of neighbour sequence of sequence listing upward to telomere on chrosomal short arm and 5'-terminus of this base sequence : -284
gcaagactccatctcaataaataggtaggtaggtaggtaggtaggtaggtaggtaggtaggtaggtaggcaggcaggtagataggtaggtaggtaggtaggttggtaggtagagagagagagagagagagagagagagagagagagaagtttaatgttcaataatgaacttgaaaccaactgggatttctggtgtgtacatttacagagggtaataaatgcatcttctaagaagcttattgttatgttggca

SEQ ID NO: 7386 - DNA, 175 bp, Homo sapiens
  DISD22_0003928
  Located on chromosome 4
  Distance between a terminus base of telomere on chromosomal short arm and 5'-terminus of this base sequence : 111648478
  Distance between 3'-terminus of neighbour sequence of sequence listing upward to telomere on chrosomal short arm and 5'-terminus of this base sequence : 261102
aagcaactcttctagaagatcttgataagagattgtttttggaatggtttacaacttcttacacacacagacacacacacacaaaattcctaggggaaaaatccttaactacaaaaaactgagtcgtttattcaagtatttttaaaatattacaagggaattccatactgagctg

SEQ ID NO: 7387 - DNA, 242 bp, Homo sapiens
  AC005509.1_70844
  Located on chromosome 4
  Distance between a terminus base of telomere on chromosomal short arm and 5'-terminus of this base sequence : 111807086
  Distance between 3'-terminus of neighbour sequence of sequence listing upward to telomere on chrosomal short arm and 5'-terminus of this base sequence : 158433
ggctcctgatttcaaagtaatcatttttcttttccttctacaatgggagatgttaattttgagacagaagtgaagattcttgtaggcagtcccaggtattaggaatgcatgcttctctgtctctctctctctctctctctctctctctctctctctctctctctctctctctcatctctctctctctctcatctctctctccctctgtctgtatctctctctgtcctgtattctgagtctgg

SEQ ID NO: 7388 - DNA, 226 bp, Homo sapiens
  AC005509.1_79363
  Located on chromosome 4
  Distance between a terminus base of telomere on chromosomal short arm and 5'-terminus of this base sequence : 111815689
  Distance between 3'-terminus of neighbour sequence of sequence listing upward to telomere on chrosomal short arm and 5'-terminus of this base sequence : 8361
tagacagatcaggatagtgatttctgaattttgccgtgtgtgtgtgtgtgtgtgtgtgtgtgtgtgtgtgtgtgtgtgaaacatttggaaaaacttttctaatgctttaatgttggtaaattcattttagtctagtaatggtagactttaaataaaattgagcataatttgtgttgaaaagctgaggggtgtttaaacttacttaaggtgaaggattacctatagc

SEQ ID NO: 7389 - DNA, 394 bp, Homo sapiens
  AC005509.1_120230
  Located on chromosome 4
  Distance between a terminus base of telomere on chromosomal short arm and 5'-terminus of this base sequence : 111856296
  Distance between 3'-terminus of neighbour sequence of sequence listing upward to telomere on chrosomal short arm and 5'-terminus of this base sequence : 40381
tatctcttgacttgcagtgaagtggggtgctacagactgagcccagcttgtagccctcattaattgcaaatcattgccccctttcagaagccacagtagttcaagcatgatggctacgtcattgaccaatgatcaagggttaataaattaccaatagcagtagcaatatgtgccagatacatggctaaggagatctatctatctatctctctatctatctatagcaataacaatagcaatagcaatatgtgccagatacatggctaaggatatatgtatatttatatctatatacatctatctatctatctatctatctatctatctatctacctacctacctacctacctaataagattgatattattatccttattttaccgatgaggaaac

SEQ ID NO: 7390 - DNA, 334 bp, Homo sapiens
  AC004050.1_111064
  Located on chromosome 4
  Distance between a terminus base of telomere on chromosomal short arm and 5'-terminus of this base sequence : 111891935
  Distance between 3'-terminus of neighbour sequence of sequence listing upward to telomere on chrosomal short arm and 5'-terminus of this base sequence : 35245
gagctaacatagtctgcctcacacagttgctgagatattttttccacagactgccccactcctccctgcaaaattagttgttttttcattgctatatcatcagtactaggacagtgcctggggtatagttagtactcaatagatacctgtgaatgaatgaatgcaaggctattccccccaacatacatgggcatacatacacacacacacacacacacacacacacacacacacaaacacacacacaccctctacctcacagaaccttggaaagagtgaaacactgtctggaaagcattttgagttctgcagaaaagactgccttaaacatcta

SEQ ID NO: 7391 - DNA, 241 bp, Homo sapiens
  AP002080.2_19570
  Located on chromosome 4
  Distance between a terminus base of telomere on chromosomal short arm and 5'-terminus of this base sequence : 112116266
  Distance between 3'-terminus of neighbour sequence of sequence listing upward to telomere on chrosomal short arm and 5'-terminus of this base sequence : 223997
ggaggctgagataggagtatctcttgaacccaggaggtggaggttgcagtgagctgagattgtgccattgcactccagcttgggtgacagagcgagactccatctctaaataaataaataaataaataaataaataaataaataaacaccactgccagtgtggtgtccaagagcagtcccttggaagacagaatggggaagcagatcccagatggtactacctcagaagtggaaagtttaa

SEQ ID NO: 7392 - DNA, 454 bp, Homo sapiens
  AC005187.1_91438
  Located on chromosome 4
  Distance between a terminus base of telomere on chromosomal short arm and 5'-terminus of this base sequence : 112186517
  Distance between 3'-terminus of neighbour sequence of sequence listing upward to telomere on chrosomal short arm and 5'-terminus of this base sequence : 70010
catacttcttggttgactgtttactttttaaaacattttacttagctttctgttaactcgaaacattgtatgtatgcatgtatgtatgtatgtatgcatgcatgcatgcatgtatgtatgtatgtatgtatgtatgtatgtatttacttatgaaggagtgtcgctctgtcacccaggccggagtgcagtggcacgatttcagcttactgcaacctctgccttctgggttcacgcattctcctgcctcagcctcccgagtagctgggattacgggcatccaccaccacacccagctaatttttgtatttttagtagagatggggtttcaccatgttggccaggctggttttgaattcctgacctcaagtgattcacccaccttggcctcccaaagtgctgggattacaggcatgagccaccacccctggcggaaacattgtatttgaaacttcag

SEQ ID NO: 7393 - DNA, 243 bp, Homo sapiens
  HUMUT6097
  Located on chromosome 4
  Distance between a terminus base of telomere on chromosomal short arm and 5'-terminus of this base sequence : 112221599
  Distance between 3'-terminus of neighbour sequence of sequence listing upward to telomere on chrosomal short arm and 5'-terminus of this base sequence : 34628
aagaataaagtccagaaactactgatatgtatttgtgtatttatctatcatctatctctctctctgtgtctatgtatctcatcttctatctccattatctactgatctatctatctatctatctatctatctatcatctgtctattctgtgtacttcaacatatatatactatggtctaagcactcatccaagatgcaaaaggaatatagaaattaaaaacagccatggctgttaaggaactc

SEQ ID NO: 7394 - DNA, 395 bp, Homo sapiens
  AC005187.1_50923
  Located on chromosome 4
  Distance between a terminus base of telomere on chromosomal short arm and 5'-terminus of this base sequence : 112226866
  Distance between 3'-terminus of neighbour sequence of sequence listing upward to telomere on chrosomal short arm and 5'-terminus of this base sequence : 5024
caactatgttggttaaatttgtttctaagtattttattctttctgatgttattgtaatgagattgttttcataatttattttaagtttctttattgctagcatatataagtataattgaatttttaacatcaaccttatatcctgcaactttgctgaacttattagctctaacaataatttctgtaaattatttaggactttctgtatataggatcatctttttgtgaaaggaaataactttatatcttcctttccaatttagatgcattttatttttcttttccttccttccttccttccttccttccccttccttcctttcccttcttcccttcctccctttctctctttctctctttcttttgccatagtagacagctagaactttagcaca

SEQ ID NO: 7395 - DNA, 429 bp, Homo sapiens
  AC005187.1_43707
  Located on chromosome 4
  Distance between a terminus base of telomere on chromosomal short arm and 5'-terminus of this base sequence : 112234186
  Distance between 3'-terminus of neighbour sequence of sequence listing upward to telomere on chrosomal short arm and 5'-terminus of this base sequence : 6925
gagtggtatttgaatcctcattacaggtaatgaaacagattaagagaagttaagagctaaaatctcatagggctgaaactcaaacctaagtgccccggtgctgtttatattccacccacacactattccattccccatgtgtcttgtcttattctaggtgtctgtgtgtgtgtgtgtgtgtgtgtgtgtgtgtgtgtgtgtgtgtacgcatgtgcctgtggagcccagtgccaaatgaatatatggggcaccttgttaaaaattattgagtatttcaagatggcgacagcagagtcttaaaccaaatacagggcccttgtgagcacagggtcctcttgggccacacaggttgtgtgcccatgaagctggccatgagcttgtgaaagaatgccctattcaggaaactactggtaagattggagtgtcaga

SEQ ID NO: 7396 - DNA, 437 bp, Homo sapiens
  AC005187.1_42687
  Located on chromosome 4
  Distance between a terminus base of telomere on chromosomal short arm and 5'-terminus of this base sequence : 112235205
  Distance between 3'-terminus of neighbour sequence of sequence listing upward to telomere on chrosomal short arm and 5'-terminus of this base sequence : 590
tcattatggttgagtggaaaactgtggtttatttttaaatttagtaattcagtagcttcatctgagatagtattgcccccggtgggttagttctccgacatcctgggagtcatttctggagggtggtggaataagaaagcatttttaaaatattaaattaggtatcaactacctttctatctctctctctctctctctctctctctttctctctctcacacacacacacacacgcacgcacacacacacattcttgaatgctttatagaatgggagaaaaaggctcagaactacagattcattcacataatgtgaagcctatttaagtatactcatgaatgtgtcacacatttgaacttcatcttttatgtgtagcaacagcagatgttgaaagtataaccccaacgcagacagacattatggtaaagctttcaatg

SEQ ID NO: 7397 - DNA, 197 bp, Homo sapiens
  D4S2945
  Located on chromosome 4
  Distance between a terminus base of telomere on chromosomal short arm and 5'-terminus of this base sequence : 112235309
  Distance between 3'-terminus of neighbour sequence of sequence listing upward to telomere on chrosomal short arm and 5'-terminus of this base sequence : -333
gggagtcatttctggagggtggtggaataagaaagcatttttaaaatattaaattaggtatcaactacctttctatctctctctctctctctctctctctctttctctctctcacacacacacacacacgcacgcacacacacacattcttgaatgctttatagaatgggagaaaaaggctcagaactacagattca

SEQ ID NO: 7398 - DNA, 116 bp, Homo sapiens
  DISO7_10001552
  Located on chromosome 4
  Distance between a terminus base of telomere on chromosomal short arm and 5'-terminus of this base sequence : 112408124
  Distance between 3'-terminus of neighbour sequence of sequence listing upward to telomere on chrosomal short arm and 5'-terminus of this base sequence : 172618
ttatgctttacagtgaataatgtccccaattcatccaccaccaccaccaccaccaccatcatcatcattattattcaaaaggttgtatatttatttccttagagcagagatcagca

SEQ ID NO: 7399 - DNA, 214 bp, Homo sapiens
  chr4.fa.O7frz.117994644
  Located on chromosome 4
  Distance between a terminus base of telomere on chromosomal short arm and 5'-terminus of this base sequence : 112600774
  Distance between 3'-terminus of neighbour sequence of sequence listing upward to telomere on chrosomal short arm and 5'-terminus of this base sequence : 192534
agcaattcctgtacctcttaagaagattctttttttcttatacaaaatagttttatttaaatgcatgcctgactcattataacctcttagtgtgtgtgtatctgtatatatatatacacacactatatatatatatatatatatatatattttgaacagatggcacactccgcctcaacctggaccctacctctgacttgtttattggaacaga

SEQ ID NO: 7400 - DNA, 168 bp, Homo sapiens
  DISD22_0003931
  Located on chromosome 4
  Distance between a terminus base of telomere on chromosomal short arm and 5'-terminus of this base sequence : 112775217
  Distance between 3'-terminus of neighbour sequence of sequence listing upward to telomere on chrosomal short arm and 5'-terminus of this base sequence : 174229
ctggtggtttcaactgtatactgataactcccaaatacatatttgggctcaaaaagatatgcatgtatatataaatgcagatgcaaatgtatataggtatttgtgtgtgtgaaggtatgtcactacacacacagacacacacacattcatagatattaccagccagcc

SEQ ID NO: 7401 - DNA, 213 bp, Homo sapiens
  D4S2940
  Located on chromosome 4
  Distance between a terminus base of telomere on chromosomal short arm and 5'-terminus of this base sequence : 112920246
  Distance between 3'-terminus of neighbour sequence of sequence listing upward to telomere on chrosomal short arm and 5'-terminus of this base sequence : 144861
tggaaccacttttgcagtaacacatttagaaaagagaaatcaagagcaaaaaaggcttcaatatagtttatttttttttgccagtaactttcttgttgcacaactattatatatgaaattattctttctaaacatgtgtgtgtgtgtgtgtgtgtgtgtgcacgtactcatgtgtttcagttcccaggttcttttcatggctgcacaacttag

SEQ ID NO: 7402 - DNA, 179 bp, Homo sapiens
  HUMUT882
  Located on chromosome 4
  Distance between a terminus base of telomere on chromosomal short arm and 5'-terminus of this base sequence : 113042883
  Distance between 3'-terminus of neighbour sequence of sequence listing upward to telomere on chrosomal short arm and 5'-terminus of this base sequence : 122424
ctgaactgaagtgtgttggagtgtgtgtgtgtgtgtgtctgtgtgtgtgtgtggttatgatttgtaattttctaagtattgctaataggagccaattgtttttctgctttgtattttcctcccttaggtctttgcaactaatgcagtcagtcatctgaattactgacagacctttcttc

SEQ ID NO: 7403 - DNA, 221 bp, Homo sapiens
  AC004062.1_105750
  Located on chromosome 4
  Distance between a terminus base of telomere on chromosomal short arm and 5'-terminus of this base sequence : 113156746
  Distance between 3'-terminus of neighbour sequence of sequence listing upward to telomere on chrosomal short arm and 5'-terminus of this base sequence : 113684
ggtaccagacatgtgaaagaacttattttgtatctccagcccaaacactatctaactgcaactgcaaattcatgacagctgtccagctgagtccagtcaatttggaagtgggataatgtacacacacacacacacacacacacacacacacacacacacacacacaccgcattccctttaggaccagttgagggtggaagctgaaagtaggttaaggagac

SEQ ID NO: 7404 - DNA, 200 bp, Homo sapiens
  G08369
  Located on chromosome 4
  Distance between a terminus base of telomere on chromosomal short arm and 5'-terminus of this base sequence : 113340240
  Distance between 3'-terminus of neighbour sequence of sequence listing upward to telomere on chrosomal short arm and 5'-terminus of this base sequence : 183273
accctacacccttcttccagaagtgtctttctcaaagacaaatctagttatattctctctctttttagaatttcccaatatcttctcttatatcttatctatctatctatctatctatctatctatctatctatctatttatctaactatctttctttctttcttcagtggggccccttaaaaatccccttgtgttaggg

SEQ ID NO: 7405 - DNA, 246 bp, Homo sapiens
  D4S1616
  Located on chromosome 4
  Distance between a terminus base of telomere on chromosomal short arm and 5'-terminus of this base sequence : 113504353
  Distance between 3'-terminus of neighbour sequence of sequence listing upward to telomere on chrosomal short arm and 5'-terminus of this base sequence : 163913
agcctcccaaagccagtagagtttttaagttaaaaaataagtgtgtgtgtgtgtgtgtgtgtgtgtgtgtgtgtatttttttcttcaagtagtaactttaagagtaaaacagaagttatcataatcaggagttgtaagtcatttggctatattagtcagagttttttgggtagaagtgacaaaaacatgactcaagcaagcctgacacaaaacaaaacaagagtgactgaattgtttcacattact

SEQ ID NO: 7406 - DNA, 388 bp, Homo sapiens
  chr4.fa.O7frz.119430734
  Located on chromosome 4
  Distance between a terminus base of telomere on chromosomal short arm and 5'-terminus of this base sequence : 113641718
  Distance between 3'-terminus of neighbour sequence of sequence listing upward to telomere on chrosomal short arm and 5'-terminus of this base sequence : 137119
actggaatttcctcaagattattggtatagtcattgccaaacattgttgaaaataaaaaaggaaaatgatttctctgtctctgtctttctctctctctctctctctccacacacacacacacacacacacacacacacacaaacacacacacacacacgatattaaacttaaaagatgcagagttcgttattaacaaatacttctacagattcaaggtgttcccctgccggtttcaactaatactgtagcaaaaatggaggcccttttcagcaccactatctcaagtaaggggtatacgtcctggagagataggaaaagagagatgaaagcatgagagaaatggtaaaagttagagatggtgtgatttataaagcaagagtcaatgag

SEQ ID NO: 7407 - DNA, 125 bp, Homo sapiens
  D4S407
  Located on chromosome 4
  Distance between a terminus base of telomere on chromosomal short arm and 5'-terminus of this base sequence : 113793330
  Distance between 3'-terminus of neighbour sequence of sequence listing upward to telomere on chrosomal short arm and 5'-terminus of this base sequence : 151224
ataatatcctttgatcctttcgctataaacacacacacacacacacacacacacacacacacacacacacacacacatatatgtgtgtgtgtatatatatagtttgcttaaaaataaccaaattt

SEQ ID NO: 7408 - DNA, 202 bp, Homo sapiens
  D4S2989
  Located on chromosome 4
  Distance between a terminus base of telomere on chromosomal short arm and 5'-terminus of this base sequence : 114075057
  Distance between 3'-terminus of neighbour sequence of sequence listing upward to telomere on chrosomal short arm and 5'-terminus of this base sequence : 281602
gaaagcacttggctcagaattgcattcaacaaatactggtgtgtgtgtgtgtgtgtgtgtgtgtgtgtgtgtgtgtgtgtgtgtgtgtgttagctttctgcttttccaatagtttccctgctgtttttccttcactaatactataatcacaaattagcactgtcataatctctatcaggaacctgccttcaactgggcagca

SEQ ID NO: 7409 - DNA, 382 bp, Homo sapiens
  AC004704.2_13348
  Located on chromosome 4
  Distance between a terminus base of telomere on chromosomal short arm and 5'-terminus of this base sequence : 114087510
  Distance between 3'-terminus of neighbour sequence of sequence listing upward to telomere on chrosomal short arm and 5'-terminus of this base sequence : 12251
acatggtatcgtgcaactatagtcccaacaactccaaaggctgaggcaggaggattgcttgagcctaggagtttgaggccacagtgagctatgatgacaccactgcactccagtccagatgacagagtaagagccgtctctaaaataaaataaaataaaataaaataaaataaaataaaataaaataaaataaaataaaataaaaataaataaagataaagataaagatatctctgattcagtaagtttggatgggacttgagaagttgcgttagcagatttctaggtgagactcgtgctgctgatcctaggaccatacattgagaagtagaaaagggaaatagtttaagcaaatatttaaggcttaattagaagttcaaga

SEQ ID NO: 7410 - DNA, 297 bp, Homo sapiens
  AC004704.2_124304
  Located on chromosome 4
  Distance between a terminus base of telomere on chromosomal short arm and 5'-terminus of this base sequence : 114198439
  Distance between 3'-terminus of neighbour sequence of sequence listing upward to telomere on chrosomal short arm and 5'-terminus of this base sequence : 110547
tgagtgactacaatgtgcaaagcttccctgaaaacccacaattaacatgcaatgtgagcaaaaaataaaacttactcttagatcggtgagtttatttgttactatcctaacctaaccaataaattaatgatgacaattgtctggccagcaacccatcagatactcattctctctctctctctctctctctctctctctctcttcccacccctccttctgtctctcctttttctattaggtctaaaattaataataaatatatggcaggaggtacttacctgaaagatggaatagtca

SEQ ID NO: 7411 - DNA, 154 bp, Homo sapiens
  DISO7_10001554
  Located on chromosome 4
  Distance between a terminus base of telomere on chromosomal short arm and 5'-terminus of this base sequence : 114234613
  Distance between 3'-terminus of neighbour sequence of sequence listing upward to telomere on chrosomal short arm and 5'-terminus of this base sequence : 35877
aagagcagattcttcttaaaggtcaaaatttatttattctgtggaaatatgtatatcacacacacacacacacacccacacacaaaataaaaatggtaagtacattttgaagtgaaatattcctaaaattaaggacagctctcctttataggaa

SEQ ID NO: 7412 - DNA, 172 bp, Homo sapiens
  DISO7_10001555
  Located on chromosome 4
  Distance between a terminus base of telomere on chromosomal short arm and 5'-terminus of this base sequence : 114239630
  Distance between 3'-terminus of neighbour sequence of sequence listing upward to telomere on chrosomal short arm and 5'-terminus of this base sequence : 4863
gcatctaagctccaagggggttatctgacagactagaaaaacttctttcttaagtctttggatactttacatatatatatatatatatatatatatatatatatatatacacacacacacacacacacacacacacacagtatatttgtatctattcctccaagagttcact

SEQ ID NO: 7413 - DNA, 103 bp, Homo sapiens
  DISD22_0003933
  Located on chromosome 4
  Distance between a terminus base of telomere on chromosomal short arm and 5'-terminus of this base sequence : 114452652
  Distance between 3'-terminus of neighbour sequence of sequence listing upward to telomere on chrosomal short arm and 5'-terminus of this base sequence : 212850
tccacctctgctaccctccctgcaacacaacacacacacacacacacacacacgtacacacacactcactaaggtcctgcaaagcccgtgaagagacatacca

SEQ ID NO: 7414 - DNA, 322 bp, Homo sapiens
  AC004049.1_66422
  Located on chromosome 4
  Distance between a terminus base of telomere on chromosomal short arm and 5'-terminus of this base sequence : 114606985
  Distance between 3'-terminus of neighbour sequence of sequence listing upward to telomere on chrosomal short arm and 5'-terminus of this base sequence : 154230
atcacctaaggtcaggagttcaagaccagcccagccaacatggcaaaaccctgtctctactaaaaacacaaaaacttagccaggtgtggcagtgcaggcctgtaatcccagctacttgggaagctgaagcaggagaattgcttgaacctaggaggtgaaggtttcagtgagccgagattgcaccactgcactccaacctgagctacagagtgagactctgtctcaaataaataaataaataaataaataaataaataagttgtgcagggtttcccattgtggtttgaacttgtatttcctgattactaatgaggtcagacac

SEQ ID NO: 7415 - DNA, 341 bp, Homo sapiens
  AC004049.1_133395
  Located on chromosome 4
  Distance between a terminus base of telomere on chromosomal short arm and 5'-terminus of this base sequence : 114673981
  Distance between 3'-terminus of neighbour sequence of sequence listing upward to telomere on chrosomal short arm and 5'-terminus of this base sequence : 66674
agcagtcacggttcatattaatctaaaatctagccaggcatatatcccaagtcttcctgatgtgaggacaagaattatttcttgattagggctcactttttctctttgagaatggttcgcctcagcttttggatttgtcctctgaatcatccttccttgtctataaaatgcatgtatatactcatacatacatagagagaaagagagagagagagagagagagactctgtcacgcaggctggagtgcaatggtgtgatctcagctcactgcaacctacaactcctgggttcaagcaattctcctgtctcagcctcccgagtagctgagactacaggtgcac

SEQ ID NO: 7416 - DNA, 382 bp, Homo sapiens
  AC004049.1_165623
  Located on chromosome 4
  Distance between a terminus base of telomere on chromosomal short arm and 5'-terminus of this base sequence : 114706111
  Distance between 3'-terminus of neighbour sequence of sequence listing upward to telomere on chrosomal short arm and 5'-terminus of this base sequence : 31789
tcatctggcttgacctaaataatactcaaacataattctctcattccatatctctccaaacaactcatctccaggtagtcccatatcctcccagccatatgtgactgcaattccccagatatgatgtgacttcccacagatgtcttccaaagcccttccctgtacctggtatattcactcctacattccctggaaaattctatcctccctcccctaggaaactattacttgtccttcaagtgtcatctccccaggaagaccttctctgactcttctactactcccctctagtaacactaacacacacacacacacacacacacacatacaggctccattacaccatcacagacctttacggtaggacctcaattgcacagta

SEQ ID NO: 7417 - DNA, 213 bp, Homo sapiens
  DISD22_0003934
  Located on chromosome 4
  Distance between a terminus base of telomere on chromosomal short arm and 5'-terminus of this base sequence : 114782109
  Distance between 3'-terminus of neighbour sequence of sequence listing upward to telomere on chrosomal short arm and 5'-terminus of this base sequence : 75616
acatcaacttgacaggatagatgtcatatatatatatatatatatatatatatatttttttttttttttttttttttttttttttttttgagacggagtctcgctctgtcgcccaggctggactgcggactgcagtggcgcaatctcggctcactgcaagctccgcttcccgatgtcatatatttttttaaatcacctgaagacacaacacaa

SEQ ID NO: 7418 - DNA, 374 bp, Homo sapiens
  chr4.fa.O7frz.120522215
  Located on chromosome 4
  Distance between a terminus base of telomere on chromosomal short arm and 5'-terminus of this base sequence : 114968066
  Distance between 3'-terminus of neighbour sequence of sequence listing upward to telomere on chrosomal short arm and 5'-terminus of this base sequence : 185744
gtagtcctgtcactctcctgtagtcttgtaatcttagttacctgggaggctgaggctggaagatcgcttgaagccaagagttcgagactgcagtaagctatgatcacaccaccgccctccagcctgggtgacagaacaagaccctgtctccctctagatagacggatagatagatagatagatagatagatagatagatagatagatagatgctgaagtcctacaacacatccaaggtccaaagacaataaatgaaaacaatttttacaaggaaactctccatctaaagtttagggtataattaggtttaaaagattgtccttaaaaaaaaatcggcattaatcaaaacagatcgaagtatagaagcctaaatc

SEQ ID NO: 7419 - DNA, 207 bp, Homo sapiens
  HUMUT7739
  Located on chromosome 4
  Distance between a terminus base of telomere on chromosomal short arm and 5'-terminus of this base sequence : 115050563
  Distance between 3'-terminus of neighbour sequence of sequence listing upward to telomere on chrosomal short arm and 5'-terminus of this base sequence : 82123
accctgtacttgtcaaggttctccagagaaacagaacaaatataatggacagagagatgaatgggtggatggatggatggatggatggatggacagatgaatggatggatggatgaacaaattagatagatagatagatagatagatagatagatagatagatagatagatagatgaaatttcttatggaaactggttcacatgatt

SEQ ID NO: 7420 - DNA, 299 bp, Homo sapiens
  chr4.fa.O7frz.120710087
  Located on chromosome 4
  Distance between a terminus base of telomere on chromosomal short arm and 5'-terminus of this base sequence : 115188600
  Distance between 3'-terminus of neighbour sequence of sequence listing upward to telomere on chrosomal short arm and 5'-terminus of this base sequence : 137830
tgattagatggcatttgagtagagatctgaagggagtaagagaacaaactttagatattggaggaaagaatcttccatatttagggaacaatgggggacaaagtcctcaggtgagaacgtattttggttgttccaggagcaccaaagcattcactgtggctggagtaggtaagcaaggaggaagtgtaggaaccgaagtcagagaaagtgtgtgtgtgtgtgtgtgtgtgtgtagggtgcagttgggtgctagaacacatagtgccttataagttcttggctttacttctagtgagata

SEQ ID NO: 7421 - DNA, 282 bp, Homo sapiens
  AC004057.1_150971
  Located on chromosome 4
  Distance between a terminus base of telomere on chromosomal short arm and 5'-terminus of this base sequence : 115422625
  Distance between 3'-terminus of neighbour sequence of sequence listing upward to telomere on chrosomal short arm and 5'-terminus of this base sequence : 233726
aattataaggcatggtttccaccttcaagtaaattgaaattttgttctggaagtagcatatatgacttcctctctctctctttctctttccttccacacacacacacacacacacacacacacacacacacactagtttatattatattacaggtagatatttgtgtaaaaatgtatatgtaaaatgaaatatatagactccctatgactgaagagagatacattttatatacatagtaattataaagaaaacaaactttctccttcgtatcttggccagaa

SEQ ID NO: 7422 - DNA, 424 bp, Homo sapiens
  AC004057.1_123614
  Located on chromosome 4
  Distance between a terminus base of telomere on chromosomal short arm and 5'-terminus of this base sequence : 115449929
  Distance between 3'-terminus of neighbour sequence of sequence listing upward to telomere on chrosomal short arm and 5'-terminus of this base sequence : 27022
caacatcaaagaccaaaggtaggtaaatacacgaagatgaagaaaaaccagggcaaaaaggctgaaaaaaagattctaaacagttttttcttccctctgtagaagtttcccagtactttcccacccatccctccctcccctcctggatatcttcccgtgtctctctctctctctctctctctctcttctctctctctctctctctccctcactcactctctatctctgtattgatgattgtaaagaagtaaacaaatcctatgatctctagtcttttcaaggcctcttctcttatggaatacatagaagaaaagaaaaaggaaaccttattttaaaatggcaacttcttcaaattgggaattctcttcttagaaaaaaaggaatttgtgtagaagagaattcgtcagaattaagcagtggttgt

SEQ ID NO: 7423 - DNA, 211 bp, Homo sapiens
  AC004057.1_8788
  Located on chromosome 4
  Distance between a terminus base of telomere on chromosomal short arm and 5'-terminus of this base sequence : 115564751
  Distance between 3'-terminus of neighbour sequence of sequence listing upward to telomere on chrosomal short arm and 5'-terminus of this base sequence : 114398
aggtttgaatttgacactcaatagtctttaggtgatgttcaaaataatgagatttgaatttttatgtttttggggtacacatatcttttatttatttattttagttggcaaataaaaattgtacatatttatggtatacaacatgatgttttgatacacacacacacacacacacacacacacacacacattgtgaaatggctaaatcaag

SEQ ID NO: 7424 - DNA, 406 bp, Homo sapiens
  chr4.fa.O7frz.121133659
  Located on chromosome 4
  Distance between a terminus base of telomere on chromosomal short arm and 5'-terminus of this base sequence : 115628660
  Distance between 3'-terminus of neighbour sequence of sequence listing upward to telomere on chrosomal short arm and 5'-terminus of this base sequence : 63698
gttatgcagaaattgaacagaccattacactggatcatagtgaaggtcaaactgtgtgtgtgtatgtgtgtgtgtgtgtgtgtgtgtgtgtgtgttgtgtctgtgtgtggttaattgaggcactggacctactgtcttttttttttttcagaaggtagaccatggcctatggtgatcatatgttcttttccttgctaccctgaggctttcctccctgttttacacaccctcccacctccgcttcatgctcattctttgttatttcacagataacaaaatgatccattgaattccttttcctcagttccatggtggcacttcttacacttgtatttttttatgctaccttagccacgtatttctaggctcacaactaggactatatcactaccagtgactgtacatt

SEQ ID NO: 7425 - DNA, 277 bp, Homo sapiens
  D4S1611
  Located on chromosome 4
  Distance between a terminus base of telomere on chromosomal short arm and 5'-terminus of this base sequence : 115782973
  Distance between 3'-terminus of neighbour sequence of sequence listing upward to telomere on chrosomal short arm and 5'-terminus of this base sequence : 153907
gggcaaggctcatcacaaaggaatttggctgtttgcataatattatgtgaagaaaggatacaatatagcaaggtgaaaggtggcaaaattggggttaaaaatctatgagatgccctatggctataagtttctaaggagtcattcttgatgtgtgtgtgtgtgtgtgtgtgtgtgtgtgcatgcatgtatgcacatgtgtacgtagtatctatctaatatttgcttaacacctaacaaaatgttatatagtttagaaaacaaagatggaaactactct

SEQ ID NO: 7426 - DNA, 426 bp, Homo sapiens
  AC004056.1_136648
  Located on chromosome 4
  Distance between a terminus base of telomere on chromosomal short arm and 5'-terminus of this base sequence : 115851996
  Distance between 3'-terminus of neighbour sequence of sequence listing upward to telomere on chrosomal short arm and 5'-terminus of this base sequence : 68746
aagattggaaactcagatctacagccagaaagagaatcaaagaaggaataagtgaagacaataaaaactatttttcatattctaaattgatctaataggtaacagtttgtccaaagtaataatagcaacaatttattcaattatgtatgcttgtgtgtgtgtgtgtgtgtgtgtgtgtgtgtgtgtacttatgtataagtgaaataaataacagcagtgatacaagggacaggagagaagactaacattttgttattataagataccgatactacccatgaagtagtataggagatattgtgggttcagttccacaccaccacaataaagcaaatattacaataaaatgagtcacagctttatttcacagtgcatatgaagttatgtttgcactataccatggtctattaaatgtgcaatagcgtt

SEQ ID NO: 7427 - DNA, 431 bp, Homo sapiens
  AC004168.2_12092
  Located on chromosome 4
  Distance between a terminus base of telomere on chromosomal short arm and 5'-terminus of this base sequence : 115876110
  Distance between 3'-terminus of neighbour sequence of sequence listing upward to telomere on chrosomal short arm and 5'-terminus of this base sequence : 23688
ccacgcttatcttacttgtcacagtgccacccttgaggtcattcatgcagcatattttatctttatttactacctttaatacctttcccttcttcagtatatagtctcgtcaccaatactgcccaacaggaaccatattttataagtcttgcatcccacacagagatctggcacatagtagatggtctttcatcaaattgtttttgagcatttactatagaaggttttgggatggaaattttcaccaaagatagctatatatatgttatatatacacataacacacacacacacacacacacacacacacaatgtatataaataaaataagaagatggctacataagcaattcttccatcactttaatggtgtgaaaggtattcttcacgttgccaatatcagagatgcctgctagccttgcttaaactta

SEQ ID NO: 7428 - DNA, 347 bp, Homo sapiens
  AC004168.2_24783
  Located on chromosome 4
  Distance between a terminus base of telomere on chromosomal short arm and 5'-terminus of this base sequence : 115888974
  Distance between 3'-terminus of neighbour sequence of sequence listing upward to telomere on chrosomal short arm and 5'-terminus of this base sequence : 12433
gcatctgcttatctgagcatagaaaagataacagtaaaaatatggtattatctgaccatcatcaatgcaggcagtctgttgttaactaaacattgttatgcagtgactgtgtgtgtgtgtgtgtgtgtgtgttatgttttaattagtaaatatatcatgttatatgaatgtaccattatctatataatcagtcttctgtgtaaggacatttgaattgtcttctgtctcctgttcttcagccctatcactctcactcaccctcaaggagcttctcattgtgtattaaatatgtatacatcaccgagccaggatttcaaggtcttctttggtccagaagtatttaactg

SEQ ID NO: 7429 - DNA, 154 bp, Homo sapiens
  AC004168_64635
  Located on chromosome 4
  Distance between a terminus base of telomere on chromosomal short arm and 5'-terminus of this base sequence : 115928860
  Distance between 3'-terminus of neighbour sequence of sequence listing upward to telomere on chrosomal short arm and 5'-terminus of this base sequence : 39539
gatggatgttgcagtgtgctaagaacgtgccgctgcactccagcctgggtgacagcgggaggctctgtctaaaaataataataataataataataataataataaagtacatgaaagacatatacttaaacagagatttgaattttgttatgga

SEQ ID NO: 7430 - DNA, 329 bp, Homo sapiens
  AC004168.2_97240
  Located on chromosome 4
  Distance between a terminus base of telomere on chromosomal short arm and 5'-terminus of this base sequence : 115961349
  Distance between 3'-terminus of neighbour sequence of sequence listing upward to telomere on chrosomal short arm and 5'-terminus of this base sequence : 32335
tactaactcaggacctttgcacctcctgacaactcttaggaagctcttgccacagatatccacatggctattcctttacctcattcaaaacttgtctcaaatgcaccatactaagggaggtctttgctaagccatcatatttaaaattgcaacgcacaccacttgacagacagacacacagacacacagacacacacacacacacacacacacacacacacacacatacacatatactccttagcccccttcccttgcatcattcttctccacagccctattaccatctcacatacttctagtttacttaggactgaaatgtaagctcc

SEQ ID NO: 7431 - DNA, 438 bp, Homo sapiens
  AC004168.2_121411
  Located on chromosome 4
  Distance between a terminus base of telomere on chromosomal short arm and 5'-terminus of this base sequence : 115985449
  Distance between 3'-terminus of neighbour sequence of sequence listing upward to telomere on chrosomal short arm and 5'-terminus of this base sequence : 23771
cgagttgctatcaacagttctcagataatattaattgttcaaatgtctagcatttgaaggggtcacaaatcattagtctatttggggatggccacaggtcttgttggccatgatttacctgtgccaccagttaaagggttctgattaacaactcagtagtagtaaccaaatttaagttgcatttttaaaagtactcaaaggtatttcccatctctaatcaaataccaatttttggtaaagaaaatcaacaatcacattctcacacacacacacacacacacacactcacacattttaaaaaaacgccttctaatagatttagcaattcagaatcaacacatcccactactgagagcagtaaacatactgagaatatttaaaagtgggaatgcattaaaatcctcttaagaagactggtgatttgaatctgatattggc

SEQ ID NO: 7432 - DNA, 342 bp, Homo sapiens
  AC004168.2_156218
  Located on chromosome 4
  Distance between a terminus base of telomere on chromosomal short arm and 5'-terminus of this base sequence : 116020369
  Distance between 3'-terminus of neighbour sequence of sequence listing upward to telomere on chrosomal short arm and 5'-terminus of this base sequence : 34482
gttctacttccaattcaagacaagtaaccatgaagttgagaaattacagtactttcttgactgcctggaagccaaaaataaaagaaaagtagcaagaattagtttttaacatcccttttacaacatcaaaaaaggttacttagggatacacacacacacacacacacacacacacacacacaaaacatttagattttatagatgaggcctaattttgcatacatggtcaagtagttttataaagtcctgattcatgtactactaatatcaccaatttaggaattaataaaactagtaaaatcaaagaatatcaaaatgacttaactgattaagcctgaagtt

SEQ ID NO: 7433 - DNA, 131 bp, Homo sapiens
  DISO7_10001560
  Located on chromosome 4
  Distance between a terminus base of telomere on chromosomal short arm and 5'-terminus of this base sequence : 116163353
  Distance between 3'-terminus of neighbour sequence of sequence listing upward to telomere on chrosomal short arm and 5'-terminus of this base sequence : 142642
tggatgcagtgaaacataggtaatgatagattgatagatagatagatagatagatagatagatagatagatagatacatagatagatacatagatacatagatagataacagttacctccagaaatgtctc

SEQ ID NO: 7434 - DNA, 395 bp, Homo sapiens
  chr4.fa.O7frz.121741547
  Located on chromosome 4
  Distance between a terminus base of telomere on chromosomal short arm and 5'-terminus of this base sequence : 116352993
  Distance between 3'-terminus of neighbour sequence of sequence listing upward to telomere on chrosomal short arm and 5'-terminus of this base sequence : 189509
actgaaatgagtaatactcagcacagtttatggaagttgcaaagcacatatgtcagcaagattcttttctctcaaggcttgtaatcaattttttatgggccatacttttatttaagtttgaagcttataatttttagctatttatttcggtttcacagttatgattatttaaagagtgtgtgtgtgtgtgtgtgtgtgtgtgtgtgtgtgtatttcagggaattataaacaatatactgcactctctctttgttggatgaatctaaatcaactccatgcagcacctatacagtccagctatctcatgtcatgtagcaagcccagctttaatgttccagtctgttattattagcgccattgctctttatttaatgtattctaatgcttgtcagtgg

SEQ ID NO: 7435 - DNA, 186 bp, Homo sapiens
  DISO7_10001557
  Located on chromosome 4
  Distance between a terminus base of telomere on chromosomal short arm and 5'-terminus of this base sequence : 116452974
  Distance between 3'-terminus of neighbour sequence of sequence listing upward to telomere on chrosomal short arm and 5'-terminus of this base sequence : 99586
cctaaatgccacataatggagtaatattttgaattaattcttcttgctagtttatacagattatatataatatatatttatatatatatataaatatatatgttttttctatatttttccaaatgggtgacattttaacaggtgatatcatttccttttaaacaatataatgacaacaaccactga

SEQ ID NO: 7436 - DNA, 121 bp, Homo sapiens
  DISD22_0003938
  Located on chromosome 4
  Distance between a terminus base of telomere on chromosomal short arm and 5'-terminus of this base sequence : 116576758
  Distance between 3'-terminus of neighbour sequence of sequence listing upward to telomere on chrosomal short arm and 5'-terminus of this base sequence : 123598
tggagctgagtaatattctcaagactctctctctctctctctctctctctcttctctctctctgtccacaccatccatcttttatttctttttttttttttgccactgagacacatatgga

SEQ ID NO: 7437 - DNA, 260 bp, Homo sapiens
  chr4.fa.O7frz.122187090
  Located on chromosome 4
  Distance between a terminus base of telomere on chromosomal short arm and 5'-terminus of this base sequence : 116685282
  Distance between 3'-terminus of neighbour sequence of sequence listing upward to telomere on chrosomal short arm and 5'-terminus of this base sequence : 108403
gaatgtaagcattgtgctagataatataaatttgctctacaaactaaggccatattctttatttgttaaatcctcaaaagtatactggtctttgtgtgtgtgtgtgtgtgtgtgtgtgtgtgtgtgtgtgtgtgtgtgatataacaacaattgcaaaaactgttcctcattaaataatattgcttgaattcttatttcagtcttttgctatgtccacaggaagcaatcgtttcactgtacagaatacagctttcttgagt

SEQ ID NO: 7438 - DNA, 389 bp, Homo sapiens
  chr4.fa.O7frz.122303087
  Located on chromosome 4
  Distance between a terminus base of telomere on chromosomal short arm and 5'-terminus of this base sequence : 116806265
  Distance between 3'-terminus of neighbour sequence of sequence listing upward to telomere on chrosomal short arm and 5'-terminus of this base sequence : 120723
gcaactatcagtaacattctgatatgtactgggagttagaacgtcaatatatacaactgggtgggggagggtagtgaagcaaaattcagtccaaagacttagggaataggaaaatgttaccagagtgaaattgggatctaaacacacacacacacacacacacacacacacacacacacacacacacaattagcaatggtaaaaatataaataaacatacaagagtttttcttctcattatttgatctatgtaaaaaaatattgatagcttaaaaataacaatttactctgtactttataatatatatatagaagtaaaaagtattacagtagtaccatgaagggcagaggaggaaaatgaaaatatactgttatgaggttcttatgct

SEQ ID NO: 7439 - DNA, 420 bp, Homo sapiens
  chr4.fa.O7frz.122525320
  Located on chromosome 4
  Distance between a terminus base of telomere on chromosomal short arm and 5'-terminus of this base sequence : 116970251
  Distance between 3'-terminus of neighbour sequence of sequence listing upward to telomere on chrosomal short arm and 5'-terminus of this base sequence : 163597
agtgatactattcctgaaggaaagtggtttcatttatacattcttcttgatttcctgtgcccctcctttctttccttaaatattctttagtagtgtaaagtatgatagcataggtctctctgctcatgtgctttaatgttacattgctacattatcattttgcacttcctgctatcttactcttaatggtaatgtaaaagagaaaatgtgtcacctaggtcccatgtcccctgtcccctgccttaaagattcagttcatgacctgtcattccaaaactaaaatactaaagtatgactgatatataacagtatatatatatgtgtgtgtgtgtgtgtgtgtatatatgtgtgtgtgggggtatatgtgtgtgtgtgtgtgtgtgtgtgtgtgtattgcactgcaaagtttagaacagtcag

SEQ ID NO: 7440 - DNA, 443 bp, Homo sapiens
  chr4.fa.O7frz.122634865
  Located on chromosome 4
  Distance between a terminus base of telomere on chromosomal short arm and 5'-terminus of this base sequence : 117079815
  Distance between 3'-terminus of neighbour sequence of sequence listing upward to telomere on chrosomal short arm and 5'-terminus of this base sequence : 109144
tgaagactgaattctttacgacctcacaaactgtgcctgtttcctcccagttgtacctgctaagattcatgaacacaataaccaagcaagataagaatgttacaaactataattccactgtatttgttattgaagatgaaaacaaagtttcccataaaacaaagttattacttctttgaaatctagaatcacacttgtggagcatagctagaagttttaattccccataaataccatgaatatttctgggcaaattctggagtatttaattccattaaaaaccaacaatcttacattctaaacagcagtgtgtgtatgtgtcatggtgtgtgtgtgtgtgtgtgtgtgtaatgcttcattttcaaagcagtacttggcaaggaggcaggtataatttatgattgattatatagattcttacctgtttacatgcattaggtcac

SEQ ID NO: 7441 - DNA, 150 bp, Homo sapiens
  Z67028
  Located on chromosome 4
  Distance between a terminus base of telomere on chromosomal short arm and 5'-terminus of this base sequence : 117202343
  Distance between 3'-terminus of neighbour sequence of sequence listing upward to telomere on chrosomal short arm and 5'-terminus of this base sequence : 122085
ttcatcttgtactaagaatacgtgatttctatgttcttatacaattaaatcgtggctacatctctctcattgtaaaacacacacacacacacacacacacacacaaatcaagttaattttaaatactacaagcattataaatttggatct

SEQ ID NO: 7442 - DNA, 227 bp, Homo sapiens
  AC032009.2_127685
  Located on chromosome 4
  Distance between a terminus base of telomere on chromosomal short arm and 5'-terminus of this base sequence : 117284151
  Distance between 3'-terminus of neighbour sequence of sequence listing upward to telomere on chrosomal short arm and 5'-terminus of this base sequence : 81658
gttagctaggatggtctggatcttctgacctcggcctcccaaactaaaatattttgagtatgatactggaatttgcaacagaatgatacagtaagtaaaatagtaattctctatatgtttttattttattttattttattttattttattttattttattttattttattttatagagatggggtttcaccctgttgccgaggctagtctagaactccggaactcaa

SEQ ID NO: 7443 - DNA, 265 bp, Homo sapiens
  AC032009.2_92458
  Located on chromosome 4
  Distance between a terminus base of telomere on chromosomal short arm and 5'-terminus of this base sequence : 117314473
  Distance between 3'-terminus of neighbour sequence of sequence listing upward to telomere on chrosomal short arm and 5'-terminus of this base sequence : 30095
acctctacatgcacattctagaacacctacaggaaatgaataaatttcttaaactataaaacctcccagtaccaaaccaggaagaaatagactactgaacagaccaataacaagtagtgagacttagttggtaataaaaaaaatcacccagcaacaacaacaacaacaacaacaacaaccaaaaaaagcccaggaccagatgtattcacagctgaattctacaagaaccatgcagaagaatatgtaccaatccaaagtattgcat

SEQ ID NO: 7444 - DNA, 206 bp, Homo sapiens
  D4S1550
  Located on chromosome 4
  Distance between a terminus base of telomere on chromosomal short arm and 5'-terminus of this base sequence : 117330861
  Distance between 3'-terminus of neighbour sequence of sequence listing upward to telomere on chrosomal short arm and 5'-terminus of this base sequence : 16123
tgttgtaaagaggtacacgaaaatattggcttccatttaaattcgtttgactctctctgtctctctctctgtcacacacacacacacacacacacacatacagagagagagagagaaagagagtgaaagggacagagtcaaagaaatttgtattaatggaagtcaatatttgcatgtaccattttgcttttctggctttcttgcat

SEQ ID NO: 7445 - DNA, 152 bp, Homo sapiens
  Z23535.1_88
  Located on chromosome 4
  Distance between a terminus base of telomere on chromosomal short arm and 5'-terminus of this base sequence : 117330891
  Distance between 3'-terminus of neighbour sequence of sequence listing upward to telomere on chrosomal short arm and 5'-terminus of this base sequence : -176
ttccatttaaattcgtttgactctctctgtctctctctctgtcacacacacacacacacacacacacatacagagagagagagagaaagagagtgaaagggacagagtcaaagaaatttgtattaatggaagtcaatatttgcatgtaccat

SEQ ID NO: 7446 - DNA, 331 bp, Homo sapiens
  AC032009.2_32658
  Located on chromosome 4
  Distance between a terminus base of telomere on chromosomal short arm and 5'-terminus of this base sequence : 117379893
  Distance between 3'-terminus of neighbour sequence of sequence listing upward to telomere on chrosomal short arm and 5'-terminus of this base sequence : 48850
gagctttaaggttgtgcaaacaaagccaaaagaaaaaagaaagaagaagaagaaggagaagaaggagaaggaggagaagaaggaggaggaggaggaggagaagaagaggaagaagaagaagaagaagaagaaggagaagaagaggaagaggaagaggaagaagaagaaggagaagaagcagcagcagcatacaggagcaccaaatactgtgaggggaagctctgtgctctatagacatctgtgatccagtgactagaggtgtttctgacaagagtaggtgctcaaaaagtattacgttgtgttggctgtgccaatagtactgattcagaat

SEQ ID NO: 7447 - DNA, 144 bp, Homo sapiens
  DISO7_10001567
  Located on chromosome 4
  Distance between a terminus base of telomere on chromosomal short arm and 5'-terminus of this base sequence : 117543771
  Distance between 3'-terminus of neighbour sequence of sequence listing upward to telomere on chrosomal short arm and 5'-terminus of this base sequence : 163547
ttcactgcagacagcttaaacatattttatttcttttggaggtctttgcttgtttgttttgggttgtgtgtgtgtgtgtgtgtgtgtgtgtgtgtgttttgagttattatttattgagtattttcctcaaattgatatgcagga

SEQ ID NO: 7448 - DNA, 179 bp, Homo sapiens
  DISO7_10001563
  Located on chromosome 4
  Distance between a terminus base of telomere on chromosomal short arm and 5'-terminus of this base sequence : 117558682
  Distance between 3'-terminus of neighbour sequence of sequence listing upward to telomere on chrosomal short arm and 5'-terminus of this base sequence : 14767
tgttaactagggaacatgcagacacacatacacacacacacacacacacacacacacacacgacaaattaaaatgcataataatttaaaaataaacatttgagaaaacattttccactccattaatatcttttaacctactcacaaccatttatgaaacacatacttaatgtaagccag

SEQ ID NO: 7449 - DNA, 127 bp, Homo sapiens
  DISO7_10001561
  Located on chromosome 4
  Distance between a terminus base of telomere on chromosomal short arm and 5'-terminus of this base sequence : 117591696
  Distance between 3'-terminus of neighbour sequence of sequence listing upward to telomere on chrosomal short arm and 5'-terminus of this base sequence : 32835
ttgcatgcacatgatatctcctaaaataatacacacacacacacacacacacacacacacacacatcatattttctaaaagagtgcctgctttctttatattttttccgtaacatatgcaagaaatg

SEQ ID NO: 7450 - DNA, 241 bp, Homo sapiens
  DISO7_10001568
  Located on chromosome 4
  Distance between a terminus base of telomere on chromosomal short arm and 5'-terminus of this base sequence : 117699930
  Distance between 3'-terminus of neighbour sequence of sequence listing upward to telomere on chrosomal short arm and 5'-terminus of this base sequence : 108107
cctaagacaacccttgtggaatattttcctttttatacaatgaaagtagattagtaataaatgttcttatgtttctgttaaataaaaaatatattaattatgtgcttgcttctaaaaagctagtttccttggtctaaacttgtatatttacagaatttcatctcaaaaaagtctgtgcatttgtgtgtgtgtgtgtgtgtgtgtgtgtgtgtgtgttttcttattcctatgggtgctattg

SEQ ID NO: 7451 - DNA, 262 bp, Homo sapiens
  D4S1613
  Located on chromosome 4
  Distance between a terminus base of telomere on chromosomal short arm and 5'-terminus of this base sequence : 117700073
  Distance between 3'-terminus of neighbour sequence of sequence listing upward to telomere on chrosomal short arm and 5'-terminus of this base sequence : -98
atatttacagaatttcatctcaaaaaagtctgtgcatttgtgtgtgtgtgtgtgtgtgtgtgtgtgtgtgtgttttcttattcctatgggtgctattgagaaagacctgttccttttaatgatttttaaaaaatttgattaggtaatcatttttctctagttgtacttttattctctctttacattagtgtttttctctttttctttgagcctaaaattgaaattcatattttatattgcacatctcttggcaattgtggaa

SEQ ID NO: 7452 - DNA, 473 bp, Homo sapiens
  AC011019.2_32797
  Located on chromosome 4
  Distance between a terminus base of telomere on chromosomal short arm and 5'-terminus of this base sequence : 117772690
  Distance between 3'-terminus of neighbour sequence of sequence listing upward to telomere on chrosomal short arm and 5'-terminus of this base sequence : 72355
caaagattgaataaatgttttgagttgcataaagataatataatataatataatataatataatataatataatataatataatatagtaaaaatataggccgggtgcagtggctcacacctgtaatcccagaacttagggaggccaaggcaggcggatcacctgaggtcaggaattcgagaccagcctgtccaacatggtgaaaccctgtctctactaaaaatacaaaaatgagacaggtgtagtggtgggtgcctataatcccagctacttgggaagctgagacaggggaatcacttgaacccaagaggcagagtttgcagtgagctaagatcaccccattatactccagcctaggcaacaatagtgaaacactgtctcaaaaaaatatatataaatataaataaggccttcttcatttccttctttgggttattaaggtactatttatgtaaacaatgaatattggcttg

SEQ ID NO: 7453 - DNA, 340 bp, Homo sapiens
  chr4.fa.O7frz.123318983
  Located on chromosome 4
  Distance between a terminus base of telomere on chromosomal short arm and 5'-terminus of this base sequence : 117775056
  Distance between 3'-terminus of neighbour sequence of sequence listing upward to telomere on chrosomal short arm and 5'-terminus of this base sequence : 1893
ggctcatttaggaattagctacctgcagaacatcttcatgtcagaaagattcctcgaactccccctgaactttcacagaagcataatgggactcacagcaatactaatccttagtggcaatcctaaatacatggacccactttctcccatatcactatatgtgacattctgcagactgtgcacactcacgtgtgcacgcacacacacacgcacacacacacacacacacactttgggtgaaagatgcactattagttaaagcaaaaaaaatcataaaatgtgcaattgtattgggtttgtaaaagaagaataccttattaattaccatgattgacattga

SEQ ID NO: 7454 - DNA, 370 bp, Homo sapiens
  chr4.fa.O7frz.123543608
  Located on chromosome 4
  Distance between a terminus base of telomere on chromosomal short arm and 5'-terminus of this base sequence : 117961975
  Distance between 3'-terminus of neighbour sequence of sequence listing upward to telomere on chrosomal short arm and 5'-terminus of this base sequence : 186579
aaataacttccttagagtcctcagagaaaataatttctatatcctttaaaatctctttcaatggaaggtgaaataatgataactttatgcaaaaaagttaagaaaatctgtaacaagtagaaatacattaacagaatactgaaagcaggcttttaggaggaagtagttgatgatagcaggaagattgaaggaaatgcaggaaagaatgaaaatcaagtaaaatatatatatatatatatatatatatatatgagaaaaaatatacggccgggtgcagcgactcacgcctgtaattccagcactttgggaggccaaggcgggtggatcacgaggtcaggagatcgagaccatcctgactaatacggtgaaa

SEQ ID NO: 7455 - DNA, 201 bp, Homo sapiens
  DISO7_10001570
  Located on chromosome 4
  Distance between a terminus base of telomere on chromosomal short arm and 5'-terminus of this base sequence : 118141811
  Distance between 3'-terminus of neighbour sequence of sequence listing upward to telomere on chrosomal short arm and 5'-terminus of this base sequence : 179466
ggtatgcatctgttagagaaataagttataaaaggaaggagggaaggaaggaaggaaggaaggaaggaaagaaggaaggcaggaaggaaggaaggaaggaaatcaggaaggaaggaaggaaggagaattaaattattgggacaataagcagaaatttttcactacatacaatcaaaaaatgaaggaagaaagcctacaagg

SEQ ID NO: 7456 - DNA, 155 bp, Homo sapiens
  DISO7_10001573
  Located on chromosome 4
  Distance between a terminus base of telomere on chromosomal short arm and 5'-terminus of this base sequence : 118180754
  Distance between 3'-terminus of neighbour sequence of sequence listing upward to telomere on chrosomal short arm and 5'-terminus of this base sequence : 38742
acataggaagaacatggagaatcttttagtagcagaaagtaaggaggtacataaacacatacacacacacacacacacacacacactgataggggtatctcaaaaggaaataagagccaactgaaagatctgcctacgttaccagcagcgaatcc

SEQ ID NO: 7457 - DNA, 95 bp, Homo sapiens
  D4S1573
  Located on chromosome 4
  Distance between a terminus base of telomere on chromosomal short arm and 5'-terminus of this base sequence : 118180765
  Distance between 3'-terminus of neighbour sequence of sequence listing upward to telomere on chrosomal short arm and 5'-terminus of this base sequence : -144
acatggagaatcttttagtagcagaaagtaaggaggtacataaacacatacacacacacacacacacacacacactgataggggtatctcaaaag

SEQ ID NO: 7458 - DNA, 316 bp, Homo sapiens
  chr4.fa.O7frz.123989514
  Located on chromosome 4
  Distance between a terminus base of telomere on chromosomal short arm and 5'-terminus of this base sequence : 118337669
  Distance between 3'-terminus of neighbour sequence of sequence listing upward to telomere on chrosomal short arm and 5'-terminus of this base sequence : 156809
cagcattctttacctctacagtatatctttttttctcattaaaatttcaaaaccattgaactatctttctagaaatatctatctatcatctatctatctatcatctatctatctatctatctatctatctacctatctttctatatagatatatagaaaaagagatgagggacatattttagaaatggaaataggagatgagggacatactttagaaataaaaatagtttagaatgaaaatagttaagtagactgttaaattattattgaaatagaaagcatagcgataaaatttaactgaatggagttcactatc

SEQ ID NO: 7459 - DNA, 180 bp, Homo sapiens
  HUMUT1337
  Located on chromosome 4
  Distance between a terminus base of telomere on chromosomal short arm and 5'-terminus of this base sequence : 118448869
  Distance between 3'-terminus of neighbour sequence of sequence listing upward to telomere on chrosomal short arm and 5'-terminus of this base sequence : 110884
aatgccataaaatcaagtaaagcctttctattgacctaccttaaactagaaaatggtacattatctatctatctatctatctatctatctatctatctatctatctatcaatcatcattctatctatctatcatctatctatctatctctgtcatctctctaacattttttgagattcgg

SEQ ID NO: 7460 - DNA, 438 bp, Homo sapiens
  chr4.fa.O7frz.124102457
  Located on chromosome 4
  Distance between a terminus base of telomere on chromosomal short arm and 5'-terminus of this base sequence : 118602623
  Distance between 3'-terminus of neighbour sequence of sequence listing upward to telomere on chrosomal short arm and 5'-terminus of this base sequence : 153574
gaataggagctactctggaactcttgtaggaaagttatgtattattttcagttttacagtcatgtcttatttatttatttatttatttatttatttatttatttattttttattttttgacgaagtctcgctctgtcatccaggctggagtgcaatggcaccatctcggcttattgcaacctccacctctccggttcaagcaattctcctgcctcagccttctgagtagctgggattacaggcgcatgccaccatgcctggctaatttttgtatttttagtaaagagggggttttgccacgtttgccaggctggtctctgactcctgacctcaggtatctgcccgccttggcctcccaaagtgctaggattgcaggcgtgagccactgcacctggctgcagtcatgacttttaagtgtgatcagctaacaaagttgaa

SEQ ID NO: 7461 - DNA, 183 bp, Homo sapiens
  chr4.fa.O7frz.124407258
  Located on chromosome 4
  Distance between a terminus base of telomere on chromosomal short arm and 5'-terminus of this base sequence : 118681230
  Distance between 3'-terminus of neighbour sequence of sequence listing upward to telomere on chrosomal short arm and 5'-terminus of this base sequence : 78169
gaacctacagtttcagttgtaaactttagctaaggtaacacacacacacacacacacacacacaaaccatatagctttggatattaaagagctgctcttcccagtgtgtacagaatttttaattgattgaagctcacaatgacgaactaaaacaaatctctacaaagtcagcttatctgtcat

SEQ ID NO: 7462 - DNA, 243 bp, Homo sapiens
  D4S2392
  Located on chromosome 4
  Distance between a terminus base of telomere on chromosomal short arm and 5'-terminus of this base sequence : 118749497
  Distance between 3'-terminus of neighbour sequence of sequence listing upward to telomere on chrosomal short arm and 5'-terminus of this base sequence : 68084
cagccttccaaatagcttgagactacaggcatgcaccattgtgtctggctgtttttatttttattgttttattattattattattattattattattatttttcttggagcgatgcagtttcgccgtgttgcccaggttgctctcaaactcctgagctcaagcgatccaccctcctgtgcctcctgaagtgttgggaatacaagcatgaacgactgtgcccagccaaaatgagctgcttacta

SEQ ID NO: 7463 - DNA, 360 bp, Homo sapiens
  AC012532.3_100726
  Located on chromosome 4
  Distance between a terminus base of telomere on chromosomal short arm and 5'-terminus of this base sequence : 118936264
  Distance between 3'-terminus of neighbour sequence of sequence listing upward to telomere on chrosomal short arm and 5'-terminus of this base sequence : 186524
aagaactaggagcacttgcttctctagatcagcagccttcctgccttccttccttccatccttccttccttccttccttccttccttccttccttccttccttccttccttctttccttccttccttgcttcttttttttttttttagatgtaatcttgctctatcacccagaatggagggcagtggtgtgacctcagctcactgcaacctctgcctcctgggttcaagcgattctcttacctcagcctccctagtagctggtactacaggcacacaccactatacctaactaatttttatatttttaatagagatggggttctgccatgatggccaggttagtctccaactcctgacct

SEQ ID NO: 7464 - DNA, 322 bp, Homo sapiens
  chr4.fa.O7frz.124787209
  Located on chromosome 4
  Distance between a terminus base of telomere on chromosomal short arm and 5'-terminus of this base sequence : 119033891
  Distance between 3'-terminus of neighbour sequence of sequence listing upward to telomere on chrosomal short arm and 5'-terminus of this base sequence : 97267
ggtagaaaccactcctagacagaaagccattccatggcaggatgcacacacacacacacacacacacacacacacactcagactgagaccatttagacacaccacttaacctaacatgcacatctttgggctgcagtaggaaactggagtacccagagtctaccaatacttaatgaaaaatatgtatattgattaaaacactgggaaaaagaattagtaaacaactttctcttatcaagggcttagtaaacatttaataattttaattatagaaaagttatcagttatctgttggcatgtaacaaactaaccacaaactttg

SEQ ID NO: 7465 - DNA, 400 bp, Homo sapiens
  AC013556.3_137167
  Located on chromosome 4
  Distance between a terminus base of telomere on chromosomal short arm and 5'-terminus of this base sequence : 119125635
  Distance between 3'-terminus of neighbour sequence of sequence listing upward to telomere on chrosomal short arm and 5'-terminus of this base sequence : 91422
taaatggcttactaggcataatagtgagaagatttactctactttcacatctttgtttttagaccatgtattctggttatggacaaataaaactatacatttatcttctgtaatacaaacatggtgtggtcttccaattgaagctatcttcaatgagccaatccatcattctcttattccagccactggggaatgagtattctgtacaaccagttaattcttggatgttgacctaaatagatagacatgtaattagatagatagatagatagatagatagataagacagataaaacaaaatatgattttgtaggaactataggattcttaagagacgttgaactcagaggaaccataaatagagatattgacaaaagagtcctaaaggattgcttacaag

SEQ ID NO: 7466 - DNA, 226 bp, Homo sapiens
  chr4.fa.O7frz.124658572
  Located on chromosome 4
  Distance between a terminus base of telomere on chromosomal short arm and 5'-terminus of this base sequence : 119161952
  Distance between 3'-terminus of neighbour sequence of sequence listing upward to telomere on chrosomal short arm and 5'-terminus of this base sequence : 35917
tctttgacgcagactaaattataccactggctttcctggatctccagtttgcagacagcagattgtgggacttttcagcctccataatcatgtaagccaatccaattcctcctaaaatctgtgtgtgtgtgtgtgtgtgtgtgtgtgtgtgtgtgtgtgtgtatgaccaatacacattttattggtttatacactctatatacacttcataattgaacttgattgg

SEQ ID NO: 7467 - DNA, 339 bp, Homo sapiens
  chr4.fa.O7frz.125037680
  Located on chromosome 4
  Distance between a terminus base of telomere on chromosomal short arm and 5'-terminus of this base sequence : 119259555
  Distance between 3'-terminus of neighbour sequence of sequence listing upward to telomere on chrosomal short arm and 5'-terminus of this base sequence : 97377
ctccttgattaaatgtattcgtagctatttattttattttattttattttattttattttattttattttattttattgttagctattgtaaatgagattgccttcttgatttctctctcagctagatcattattggtgtactaaaaggctactgatttttgtatgttgattttgcatcctgaagctttactgaattgatttatcaactctaagaattttttggtggagtctaggtttttctagatataggatcatatcattagcaaacaggtatactttgacttgttcttttccagtttggatgccttttatttctatctttgctagactacacaagc

SEQ ID NO: 7468 - DNA, 452 bp, Homo sapiens
  chr4.fa.O7frz.125116153
  Located on chromosome 4
  Distance between a terminus base of telomere on chromosomal short arm and 5'-terminus of this base sequence : 119325203
  Distance between 3'-terminus of neighbour sequence of sequence listing upward to telomere on chrosomal short arm and 5'-terminus of this base sequence : 65309
cattggttcttatagccttgtatgttttctgctttggctcacattcaccaaatattcttctactttctttccagtttctaaaaattgttcattccttttttatttgaaaagccaactgtagaatttaaaaggattacattatacttgtgatatatgtacatggtgtgtgtgtgtgtgtgtgtgtgtgtatttgtgatgggcagggttgtctttctacatcaggtcagttcatcatattaaccagaattttattatacttaacaatttgaaaaaaacagaagatatttattttttagaagcaacttaactggatttccagaatcttctttatttatataaatacaatctgcttctaactcaagcattttactagtttcaaatttacgcattatttgggacaagtcccaagattgctgggctattcatctgtgccatttactttctattaattg

SEQ ID NO: 7469 - DNA, 431 bp, Homo sapiens
  chr4.fa.O7frz.125236228
  Located on chromosome 4
  Distance between a terminus base of telomere on chromosomal short arm and 5'-terminus of this base sequence : 119617145
  Distance between 3'-terminus of neighbour sequence of sequence listing upward to telomere on chrosomal short arm and 5'-terminus of this base sequence : 291490
gcaaatttatgaaatcaacctaggtgtctgtcagcaaacgattagataaagatgtggggtgtgttcgtgtgtgtgtgtgtgtgtgtgtgtgtgtgtgtgtgtgtgtgtacatcatggaacattactcaattataaaaaaagaattaaatcgtgtcttctgcagcaacatggatgggctggaggccattatcctaaatgaaataactcagaaacagaaagttaaatgctgcatattctcacttataagtgggagctaaacaatgagtacacgtggacacacagagtggaataatagacatgaaggctctgaaagatgggagcatggaagggggtgagggttgaaaaattacctattgagcacaatgttcactatttgggtgatggttacactaaaagccagatttcaccactatgcaatgtatccgtgtaac

SEQ ID NO: 7470 - DNA, 359 bp, Homo sapiens
  chr4.fa.O7frz.125563490
  Located on chromosome 4
  Distance between a terminus base of telomere on chromosomal short arm and 5'-terminus of this base sequence : 119754192
  Distance between 3'-terminus of neighbour sequence of sequence listing upward to telomere on chrosomal short arm and 5'-terminus of this base sequence : 136616
catctgtaacaggacacgtaaccatgcagaaagaaagactacattttccaacaaggtatggctcagctctagccaatgggttatagaggaaggattgtgctattgtttctgggaactgtcttgtgacagacagacactggagaagcccccatggtacccaccccttgctgttcagtacttgtaaaataccctcccctggagtgttgacaggacctgtgacttatttataactaatagaatatgacaaatgtgatggaatttcactcgttatgttatgttatgttatgttatgttatgttatgttatgttatgttatgttatgttatgttacataagacttcatcttgctaccagactaa

SEQ ID NO: 7471 - DNA, 224 bp, Homo sapiens
  DISO7_10016178
  Located on chromosome 4
  Distance between a terminus base of telomere on chromosomal short arm and 5'-terminus of this base sequence : 120027895
  Distance between 3'-terminus of neighbour sequence of sequence listing upward to telomere on chrosomal short arm and 5'-terminus of this base sequence : 273344
agcaagccataaatggaagactttcccttcctttcttcccttctctcccctcccctccctgagttgtgtctgtgtgtgtccgtgtgtgtgggtgaaggtgggggcattttaatatatatataagtgtgtgtgtgtgtgtgtgtgtgtgtgtgtgtatatacttttttaagaagcttattctgttttttaaagttggtttcaaagtatcatcttaacatgcagtt

SEQ ID NO: 7472 - DNA, 229 bp, Homo sapiens
  AC024535.2_115025
  Located on chromosome 4
  Distance between a terminus base of telomere on chromosomal short arm and 5'-terminus of this base sequence : 120049427
  Distance between 3'-terminus of neighbour sequence of sequence listing upward to telomere on chrosomal short arm and 5'-terminus of this base sequence : 21308
aacttgcctacaagtaatgcactgaatgaatttgatttaaggcacctttgtaatcttaccctagaatctctttctctctctctctctctctctctctctctctctctctctctatatatatatatatatatatatatatatgtctgtctgtctatctatctatctatctatctatctatctatctatctatctatagatatttgtcagttcctgctaaagccaagtact

SEQ ID NO: 7473 - DNA, 439 bp, Homo sapiens
  AC024535.2_145310
  Located on chromosome 4
  Distance between a terminus base of telomere on chromosomal short arm and 5'-terminus of this base sequence : 120181500
  Distance between 3'-terminus of neighbour sequence of sequence listing upward to telomere on chrosomal short arm and 5'-terminus of this base sequence : 131844
attatgtattaggttctttgccagatgtttttacatatataaactcatttcagaaaacttatttaaagtaaatggggccgggtatggtggttcatgcctggaatcctagcactttgggaggctgaggtaggaggactgcttgaggccgggagttggagaccagcctgagcaacatagtgagaccctgtctcaataataataataataatagtaataatgaagtaaatgggataaggaaagaaggataattatctttaaaggttgattcccaccctccctccccagttacttaaggaactaagtgagtacatctccagttgcccatgaaagcataagtttgttttcctcagctgaggcaagtggtagagtatacaggataacgaagtaacatgtaaaaggcaggacgcacataaaggtgtacatggctattgtttcacct

SEQ ID NO: 7474 - DNA, 276 bp, Homo sapiens
  chr4.fa.O7frz.126600833
  Located on chromosome 4
  Distance between a terminus base of telomere on chromosomal short arm and 5'-terminus of this base sequence : 120222411
  Distance between 3'-terminus of neighbour sequence of sequence listing upward to telomere on chrosomal short arm and 5'-terminus of this base sequence : 40472
tctaatccactattcaatccatacatgtattgtgtgtgtgtgcatgtgtgtgtgtatgtatgtgtgtgtgtgtgtgtgtgtatgtatctatctatctatctatctatctatctatctatatatatatatatatatatatatatatgcaatgagctgctcattttgggagggctctgttaatgaaaactctttaagacctggggaaaagatgggttccaatagaagggattttcatttgtttctgtcacgtgtctttacattatcagcctaagatca

SEQ ID NO: 7475 - DNA, 380 bp, Homo sapiens
  AC044813.3_71844
  Located on chromosome 4
  Distance between a terminus base of telomere on chromosomal short arm and 5'-terminus of this base sequence : 120374217
  Distance between 3'-terminus of neighbour sequence of sequence listing upward to telomere on chrosomal short arm and 5'-terminus of this base sequence : 151530
agaacaagcataatggttatcaacacatactctgtagcccaatggcctaggttcaatcctcactctgtgactttaggtgaatcactgtgccattttacagtctcctcttctgcaaagtagagataatagtatcagtttcatagggtcaccatgaagattaaatgaaaaagtgtgtctacagaactcagaacagtgcctgacatgtgtaagaccctaataaatgccattattattattattattattattattattatgtaggggacctggagccttgagggaaataaacttattggaaaattcaaacggacagacaatggaaacgaactgaatactgtccgagaaattataggtgatgaactagtccaggtgagttgtca

SEQ ID NO: 7476 - DNA, 270 bp, Homo sapiens
  AC044813.3_154411
  Located on chromosome 4
  Distance between a terminus base of telomere on chromosomal short arm and 5'-terminus of this base sequence : 120525251
  Distance between 3'-terminus of neighbour sequence of sequence listing upward to telomere on chrosomal short arm and 5'-terminus of this base sequence : 150654
tgctactgccttatcaactaagtttagggaatattctcaatatttgttgtcatgtcaacaatattcacagcatcctcagcaggggtagataccatctcaagaaaccactttcttggcttattcataagaagcaactcctgatctgctcaggtggttttttgttgttgttgttgttgttgttgttgttttgttgttgttttttttagattgcagcaattcagtcacatctccacactccacttctagctttagttgtcttgctatttccac

SEQ ID NO: 7477 - DNA, 161 bp, Homo sapiens
  DISD22_0003954
  Located on chromosome 4
  Distance between a terminus base of telomere on chromosomal short arm and 5'-terminus of this base sequence : 120708212
  Distance between 3'-terminus of neighbour sequence of sequence listing upward to telomere on chrosomal short arm and 5'-terminus of this base sequence : 182691
cagctggacatagcaaactgtttaaatgacagccctggctcaaacagcttttccaggatgtgagtgtgtgtgtgtgtgtgtgtgtgtgtgtgtgagagagagagagagagagagagagagacagagagagagagagagattgagattctcactggcatttg

SEQ ID NO: 7478 - DNA, 201 bp, Homo sapiens
  chr4.fa.O7frz.125915495
  Located on chromosome 4
  Distance between a terminus base of telomere on chromosomal short arm and 5'-terminus of this base sequence : 120788892
  Distance between 3'-terminus of neighbour sequence of sequence listing upward to telomere on chrosomal short arm and 5'-terminus of this base sequence : 80519
cctttacattagctttcacctttgcttggggtgttctttaacagctattttctagttggcttgttccttcctttctctctctctttctttctttctttctttctttctttctttctttctttctttctttctctttctctctttctttgacagtgtttcactctgtcatccaggctggagtgcagtagcataatcatagct

SEQ ID NO: 7479 - DNA, 89 bp, Homo sapiens
  D4S3024
  Located on chromosome 4
  Distance between a terminus base of telomere on chromosomal short arm and 5'-terminus of this base sequence : 121006284
  Distance between 3'-terminus of neighbour sequence of sequence listing upward to telomere on chrosomal short arm and 5'-terminus of this base sequence : 217191
aacacttagaacttgcagcccttattgttacagtgctgtgtgtgtgtgtgtgtgtgtgtgtgtgtgtgtgtttcctacctggcttccag

SEQ ID NO: 7480 - DNA, 442 bp, Homo sapiens
  chr4.fa.O7frz.127205652
  Located on chromosome 4
  Distance between a terminus base of telomere on chromosomal short arm and 5'-terminus of this base sequence : 121235028
  Distance between 3'-terminus of neighbour sequence of sequence listing upward to telomere on chrosomal short arm and 5'-terminus of this base sequence : 228655
gaatgcttagtatgtcgaaataagcaaattaacccccacaaatataagctagagaagtaaacagaatttatatgagaactagtttcatgtagttcaaaatgtacattgctggcgttcaaaaaatcctagagtactattttcttccagactcggtcacgaattttagatcagttgagtccccaaagacaatttgtcctttggaagctaattggatttttgtacacttgccaagagaacgattttgatgcacatcagaattttgggtcaaacagatctcctttccttactgagaaaccagaagttaaacatacacacacacacacacacacacacacacacacacacacggttacatacaaaatagaatgcagaaaggaggcaactgacataagcagtctcaaatttcaaatctacacctctgtatccaacagaatcaaatttg

SEQ ID NO: 7481 - DNA, 234 bp, Homo sapiens
  chr4.fa.O7frz.127333364
  Located on chromosome 4
  Distance between a terminus base of telomere on chromosomal short arm and 5'-terminus of this base sequence : 121343334
  Distance between 3'-terminus of neighbour sequence of sequence listing upward to telomere on chrosomal short arm and 5'-terminus of this base sequence : 107864
caggtcatactagctacagacaacatttgtttagtgtcagaaaatttacaaagagatttctagcctatgcttttggtacttttggaaatttaaactagactataccagtctccatattctttactcttgccgttaataaacacacacactcacacacacacacacacacacacacacacacacagtaattacagtaattctgtaatacagtactatgaaattaaaggacttgca

SEQ ID NO: 7482 - DNA, 278 bp, Homo sapiens
  DISO7_00001227
  Located on chromosome 4
  Distance between a terminus base of telomere on chromosomal short arm and 5'-terminus of this base sequence : 121580919
  Distance between 3'-terminus of neighbour sequence of sequence listing upward to telomere on chrosomal short arm and 5'-terminus of this base sequence : 237351
cttcagaagtcatggaagtagggggtgggagggaatattggagctgctcaagaggctgcagacagacagacagacagagagagagagagagagagagagagagagagagagagagagaaacagaaaggcaagtctactttcccactattttatggagcctataaggcaaggggaagcagtgaggttgagctgccctgatgagacactgccccaggttgctgccttctccagagaagagatcctaggagtgaggagctgtgaggtgggtaggtcactag

SEQ ID NO: 7483 - DNA, 188 bp, Homo sapiens
  D4S2347
  Located on chromosome 4
  Distance between a terminus base of telomere on chromosomal short arm and 5'-terminus of this base sequence : 121595672
  Distance between 3'-terminus of neighbour sequence of sequence listing upward to telomere on chrosomal short arm and 5'-terminus of this base sequence : 14475
agaggatcagcatgatggcttatggaatggtaaaataaggtaagtttttgaagactaactacagcacaatgccaaattgttgaaaggaagcaatcatgaccgtaaccttctgactctactttgaagaaaaatgtgtgtgtgtgtgtgtgaattgtagcatacaaggtaccaggagcctagtttatttg

SEQ ID NO: 7484 - DNA, 249 bp, Homo sapiens
  chr4.fa.O7frz.127596570
  Located on chromosome 4
  Distance between a terminus base of telomere on chromosomal short arm and 5'-terminus of this base sequence : 121759397
  Distance between 3'-terminus of neighbour sequence of sequence listing upward to telomere on chrosomal short arm and 5'-terminus of this base sequence : 163537
atacctgacttaagagattccaacgtgatgcttccaagccttacattaaaataaaagatttttagattgtactctctatttgcaatacaattttgagcagattagctctctctctttctctctctctcttgctctgtgtgtgtgtgtgtgcgtgtgtgtgagagagagagacagagagagagaaagagacaaagagagagagacagagaaggtgacagagagtctccatacctaggacattccataagg

SEQ ID NO: 7485 - DNA, 338 bp, Homo sapiens
  chr4.fa.O7frz.127851419
  Located on chromosome 4
  Distance between a terminus base of telomere on chromosomal short arm and 5'-terminus of this base sequence : 121947388
  Distance between 3'-terminus of neighbour sequence of sequence listing upward to telomere on chrosomal short arm and 5'-terminus of this base sequence : 187742
tgcttgttaggttaataccataatatcaatgcatttataatgtttgctgggctactgtgttccaagatactgtactgcagcattgtccctgcctacaagggatgtttagtcaggaaaacttgatggcattccaatatgggaagatggatcctaaatatatgctcttggagacagtgatttgtaaaattttaaagtttaattttattttaactagaaaatttgaaatgcttactttttattgttaattccctaagagcatatacttccctttacatatatatatatgtgtgtgtgtgtgtgtgtgtgtgtataaatacttcacaggacataacaaagaa

SEQ ID NO: 7486 - DNA, 156 bp, Homo sapiens
  D4S427
  Located on chromosome 4
  Distance between a terminus base of telomere on chromosomal short arm and 5'-terminus of this base sequence : 122306993
  Distance between 3'-terminus of neighbour sequence of sequence listing upward to telomere on chrosomal short arm and 5'-terminus of this base sequence : 359267
ggacctccttgcttcgtacctctttctgccatgcaccacaacaaatacacacacacacacacacacacacacacacacacacacacgcatgcacttttaacattaacacattgcttaataattaattctcctctggatcacaagcaacctaagggg

SEQ ID NO: 7487 - DNA, 265 bp, Homo sapiens
  chr4.fa.O7frz.128341184
  Located on chromosome 4
  Distance between a terminus base of telomere on chromosomal short arm and 5'-terminus of this base sequence : 122398102
  Distance between 3'-terminus of neighbour sequence of sequence listing upward to telomere on chrosomal short arm and 5'-terminus of this base sequence : 90953
gagttggtaccatttctactgagagttttccaaataattgaggaggaaagattccactctaactcattttgagatcagcatcattctgataccaaaacctgacagagacacaacaacaacaacaacaacaacaaaagaaagtctcaggccaatatccttgattaacacagatgcaaaagtcctccacaatatattagcaaactgaacccagcagcactcaaaaagcttagctagcgggatcaagtaggctttatacctgagatgc

SEQ ID NO: 7488 - DNA, 159 bp, Homo sapiens
  G10003
  Located on chromosome 4
  Distance between a terminus base of telomere on chromosomal short arm and 5'-terminus of this base sequence : 122443333
  Distance between 3'-terminus of neighbour sequence of sequence listing upward to telomere on chrosomal short arm and 5'-terminus of this base sequence : 44966
tgtagcttcacaggattctggttcatcacaagttcaaactacagtttctgctgcggctgctgctgctgctgctactgctcctgcatttggtgtggaagttataactgttattcatcatctccctctccatcaccaccactcactctcatttcctctgcc

SEQ ID NO: 7489 - DNA, 401 bp, Homo sapiens
  chr4.fa.O7frz.128496087
  Located on chromosome 4
  Distance between a terminus base of telomere on chromosomal short arm and 5'-terminus of this base sequence : 122551916
  Distance between 3'-terminus of neighbour sequence of sequence listing upward to telomere on chrosomal short arm and 5'-terminus of this base sequence : 108424
agtatacctatttccaggcataagcagtatttactttagtctcctagacttagagacttagtttcttttacacacacacacacacacacacacacacacacgcgcacacaaaacagacattcaatcaaaaattatgttacacttgaaaagcaaactcctgcaaccttcccactcattatcaagagatagaatagtcaaaacaatgagattcacagatggccctgatggtggaaataccaaagaaagaatttaaaataattacaattaatatgtcaaagaatctagtgaaaaaggtgggccacacagatgaaaaaatgggcaatttcaacagaaatacagaaactatttattttcttatctatctatttatttatttttaaatgcaaatttgaaactgaaat

SEQ ID NO: 7490 - DNA, 283 bp, Homo sapiens
  chr4.fa.O7frz.128931057
  Located on chromosome 4
  Distance between a terminus base of telomere on chromosomal short arm and 5'-terminus of this base sequence : 122937569
  Distance between 3'-terminus of neighbour sequence of sequence listing upward to telomere on chrosomal short arm and 5'-terminus of this base sequence : 385252
catcttattcagattgaaccacttatttaatttaatgaggtatatacacctcttcaattctacgtttaggatcactgaggtcaacaatatgtagtcaaatagctaaagaactaaggccctgtggaagaagaatgggagcaatgttaaacgtttacaactgcagaaatttttaccccaggaaacacacacacacacacacacacacacacacacacacacatatgcactttaaatcaacatacaatatccctgcagcaaacactgagttgcctaaatcatagaa

SEQ ID NO: 7491 - DNA, 178 bp, Homo sapiens
  D4S1612
  Located on chromosome 4
  Distance between a terminus base of telomere on chromosomal short arm and 5'-terminus of this base sequence : 123220805
  Distance between 3'-terminus of neighbour sequence of sequence listing upward to telomere on chrosomal short arm and 5'-terminus of this base sequence : 282953
aaggctttattctcttattgttcaaaattatatatatatacatttttttgtgtgtatacacacacacacacacacacacacacacacacacacacacttataggacctcctttgttcattatttgttagatcttctatatccttacctagtattgtccatttgacctgtctttggacc

SEQ ID NO: 7492 - DNA, 304 bp, Homo sapiens
  chr4.fa.O7frz.129302950
  Located on chromosome 4
  Distance between a terminus base of telomere on chromosomal short arm and 5'-terminus of this base sequence : 123332932
  Distance between 3'-terminus of neighbour sequence of sequence listing upward to telomere on chrosomal short arm and 5'-terminus of this base sequence : 111949
caagatatgaaatcaacctaagagtccatggatgggtggatggatatagaaaatgtgacacacacacacacacacacacacaaacactattcagccacacacacacgaatactattcagagacacacacacacacagacacacacgaatactattcagcaacacatacatacatacactagaatactattcagacacacacacacacaagaatactactcagccacacacacacactagactagtattcaaccacacatgcacacacacacatacatacacaatacaagactattcagccacag

SEQ ID NO: 7493 - DNA, 426 bp, Homo sapiens
  chr4.fa.O7frz.129394589
  Located on chromosome 4
  Distance between a terminus base of telomere on chromosomal short arm and 5'-terminus of this base sequence : 123461989
  Distance between 3'-terminus of neighbour sequence of sequence listing upward to telomere on chrosomal short arm and 5'-terminus of this base sequence : 128753
tttcagatgcatacatgtatacacatatacatttacacacttgcctatagacaatctctctcacacacacacgcacacacacacatacacacacacacatttctattttcactcaacatgatgctttaagctccctccaggttgctatgtctaactgctgtaaagcactctgtagatgcgtctctcacattttacctacccactttcccagccattattacccagtttccacttattccccaacgtcacaaatagtgccatgaaaaacatcctcatatgtgtcccctatgaaatacgcttagatgtttctttgaggtttatacccaggagcaaaattgctgggttacatggtttgtttatatttaatatgaccaactatggccatatcgctttccagaacacctgtactatgctgtcaccatcaat

SEQ ID NO: 7494 - DNA, 300 bp, Homo sapiens
  chr4.fa.O7frz.129532588
  Located on chromosome 4
  Distance between a terminus base of telomere on chromosomal short arm and 5'-terminus of this base sequence : 123493707
  Distance between 3'-terminus of neighbour sequence of sequence listing upward to telomere on chrosomal short arm and 5'-terminus of this base sequence : 31292
aaggtgatggaagtaaacctatgtcaacagcaccaccctctgggcacaaaatagactgcccagacttgggatgtacacacacatacacacacacacacacacacacatgcacgcacacacgcacacacacacacacacacacacacacacacacgaaaggaaaaacatatccacagaagtttttgataactaaaattaggtgtaagttctaaatcaagtaataaactgttttgcctcattcatatcagctaaattaactgaaggcatattatttggatgttgtacttccgcctaagacgt

SEQ ID NO: 7495 - DNA, 104 bp, Homo sapiens
  DISO7_10016186
  Located on chromosome 4
  Distance between a terminus base of telomere on chromosomal short arm and 5'-terminus of this base sequence : 123589150
  Distance between 3'-terminus of neighbour sequence of sequence listing upward to telomere on chrosomal short arm and 5'-terminus of this base sequence : 95143
ctatgcagttcttgtccacctaaaagtcattattataccaacacacacacacacacacacacacacacaccccacacatgtcccccaactcagacttgcaccct

SEQ ID NO: 7496 - DNA, 148 bp, Homo sapiens
  chr4.fa.O7frz.129836843
  Located on chromosome 4
  Distance between a terminus base of telomere on chromosomal short arm and 5'-terminus of this base sequence : 123889380
  Distance between 3'-terminus of neighbour sequence of sequence listing upward to telomere on chrosomal short arm and 5'-terminus of this base sequence : 300126
tatgaagctagcatgaccttaacaccaaacttgacagaggtaacacacacatacacacacacacacacacacacacacacaaacacaattttggctcattctcatctaaaaatagaaataacagctaagccgtacatagtgcttacta

SEQ ID NO: 7497 - DNA, 234 bp, Homo sapiens
  DISO7_10016191
  Located on chromosome 4
  Distance between a terminus base of telomere on chromosomal short arm and 5'-terminus of this base sequence : 124013835
  Distance between 3'-terminus of neighbour sequence of sequence listing upward to telomere on chrosomal short arm and 5'-terminus of this base sequence : 124307
gatgagtagaagcaaatggagagaccaagcacataattttaaaaaaatggtttcagtcaactgaaaaaaattccccaaacaaaatccaaaaagagaaaaagcataaaagccttttatatatatttactctctctctctctctctctcacacacacacacacaatttgtatatatttatataaatatccttttaggtttcttattatcatattttagctggttcagacagctctt

SEQ ID NO: 7498 - DNA, 329 bp, Homo sapiens
  AC022489.4_169754
  Located on chromosome 4
  Distance between a terminus base of telomere on chromosomal short arm and 5'-terminus of this base sequence : 124169672
  Distance between 3'-terminus of neighbour sequence of sequence listing upward to telomere on chrosomal short arm and 5'-terminus of this base sequence : 155603
cactaactcaggatttcaccaggaggccactgcatttaaataggtcaaacaaaacaaaacaaaacaaaacaaaacaaaacacccccctatgacctaattttgatgcccagcttcacagagtcacagagttacttgagcagtaataagcctttataaagtttaatgtgcaaggtaatttatgtgcaatttgttattaaaactactggatgctgctattccatatacagttaagtcctacattgaaaatttcaaatccaggtgttcttcattttatatagtatacatgttactgagttaacaagtaaattagactgttagaacagccaatt

SEQ ID NO: 7499 - DNA, 368 bp, Homo sapiens
  chr4.fa.O7frz.130312758
  Located on chromosome 4
  Distance between a terminus base of telomere on chromosomal short arm and 5'-terminus of this base sequence : 124347911
  Distance between 3'-terminus of neighbour sequence of sequence listing upward to telomere on chrosomal short arm and 5'-terminus of this base sequence : 177910
agatgttatgaattcactcttcagggaagtttccaagcttatgtagaacaataaattagttaaggttctccagagaaacagaatcaacaggatgtagatagatgatagatagatagatagatagatagatagatagatagatagatcaattgatcttcatctgtctatgtgtctattgaaaaagagagagagattttaaggaattgacccacacatgattgcagggctggcaagttcaaaatctgcaaggaggccatcaggctggagacccagagaacagtcagtgctgcagttcaagtcagaaggccgactgcccacagaattcagaaaccaggcttcttaaagcctttaactgattaaatgaggca

SEQ ID NO: 7500 - DNA, 470 bp, Homo sapiens
  chr4.fa.O7frz.130586887
  Located on chromosome 4
  Distance between a terminus base of telomere on chromosomal short arm and 5'-terminus of this base sequence : 124539630
  Distance between 3'-terminus of neighbour sequence of sequence listing upward to telomere on chrosomal short arm and 5'-terminus of this base sequence : 191351
ctagatcctagaatagtttcctgacacataagagacaccaatatcaattactgaatgaatgaataggataatagattgagaaattatataaggtcttagtcttttttgcagtatttcccttgggaaataaaataaaactaaaaatttatttattctgtaggtaaagaactgggctcgctatggtaagacattatataagcataaataatatactttaaaaagatgcctcagccacattcatacttgccctcttctagatattctcatctttgataaaatacaaggattcctaaaaacataatttcctgaatctcaaaacaaagcaggtagggtgcaaagccaacatatttgagtgctatatactaaaagtttatatatgggtgtgtacatatgtatatacacacacacacacacacacacaaaagatctataacaactgtttcccatcgtacaggtgagaaggtaagctc

SEQ ID NO: 7501 - DNA, 213 bp, Homo sapiens
  chr4.fa.O7frz.130705010
  Located on chromosome 4
  Distance between a terminus base of telomere on chromosomal short arm and 5'-terminus of this base sequence : 124631671
  Distance between 3'-terminus of neighbour sequence of sequence listing upward to telomere on chrosomal short arm and 5'-terminus of this base sequence : 91571
ataggctacatgcaaatactgtgccattttatataagaggcttgagctgtccttagattttggtatcttaggggtcctggaaccgataccccatagatactaagggatgactgtatcctatcagacttttccaaagtacacacacacacacacacacacacacgcacgcacacacatgtaatcagatgcattgttggcagtattgatgaagac

SEQ ID NO: 7502 - DNA, 221 bp, Homo sapiens
  chr4.fa.O7frz.130784809
  Located on chromosome 4
  Distance between a terminus base of telomere on chromosomal short arm and 5'-terminus of this base sequence : 124733974
  Distance between 3'-terminus of neighbour sequence of sequence listing upward to telomere on chrosomal short arm and 5'-terminus of this base sequence : 102090
ctggaataaatgtttcctaaagtaaaattaaatagaatataaattagtattaatagttttgctccaaaatctcaggcagtaaagaggattatctatgatgtcatttcaaacaaatatatacacacacacacacacacacatcagaactgttcataagtatgtttttttcctctacaaatgtatagcggtcctttaatatgttctacaagtggttcatgttg

SEQ ID NO: 7503 - DNA, 250 bp, Homo sapiens
  D4S2985
  Located on chromosome 4
  Distance between a terminus base of telomere on chromosomal short arm and 5'-terminus of this base sequence : 124959935
  Distance between 3'-terminus of neighbour sequence of sequence listing upward to telomere on chrosomal short arm and 5'-terminus of this base sequence : 225740
ggccttggaactactgatggcaacatgtacatcacattttagtataatgcttaaacttacaccacatcttgtgaatttatatgcatctgccaatgtgtgtgtgtgtgtgtgtgtgtgtgtgtgtgtgtctgtgcacgcatgcatgtagatacacatatatttatttcaaagagaagagagttggtgggaagtaggacagacttgtgaagtaattaagaatttctactggctctcacattcttcagtgtaa

SEQ ID NO: 7504 - DNA, 290 bp, Homo sapiens
  HUMUT1467
  Located on chromosome 4
  Distance between a terminus base of telomere on chromosomal short arm and 5'-terminus of this base sequence : 125033887
  Distance between 3'-terminus of neighbour sequence of sequence listing upward to telomere on chrosomal short arm and 5'-terminus of this base sequence : 73702
gccatgttcatgcccctgccctccagcctgggcaacaggctgtctcaagaaagaaaaagaaaaagaaagaaaaagaaaaagaagaagagaagtaaagaaagaaagaaagaaagaaagaaagaaagaaagaaagaaagaaagaaagaaaaagagaaaggagggagggaagaaaggaaggaaggaaggaaggaaggaaggaaggaaggaaggaaggaaggctggctggctttctgtttaagtttaaagaaaaaggctgggcatggttgctcatgcctgtaatgatgaggtca

SEQ ID NO: 7505 - DNA, 418 bp, Homo sapiens
  AC018990.4_157510
  Located on chromosome 4
  Distance between a terminus base of telomere on chromosomal short arm and 5'-terminus of this base sequence : 125129134
  Distance between 3'-terminus of neighbour sequence of sequence listing upward to telomere on chrosomal short arm and 5'-terminus of this base sequence : 94957
ccttgtgccttacaaagtattaaggactcattcaacacttaatgactgcttgtgaaatggtcaacacaaaacaatgtgggaactgatattaaaatggagatttgtgctaactaaatccaacattgttttggtgttgatgcactttacctattaagatgctactaagccaaaggaagatttaattaataataataataataataataataatgataaggctctttgtgaaggaaaatctggcttaatagacatgcttggatccaaccaactgcaggaaatcaaatagccagtctttggtgaaacaagacttttggctgatttgctcccttatattgtgttgctctaggaaggaagataataattatgagtattttggagaacagtacttatttgcgtcaggcagtgttctaagtacttc

SEQ ID NO: 7506 - DNA, 418 bp, Homo sapiens; identical to SEQ ID NO: 7505
  AC025511.2_39442
  Located on chromosome 4
  Distance between a terminus base of telomere on chromosomal short arm and 5'-terminus of this base sequence : 125129134
  Distance between 3'-terminus of neighbour sequence of sequence listing upward to telomere on chrosomal short arm and 5'-terminus of this base sequence : -418

SEQ ID NO: 7507 - DNA, 440 bp, Homo sapiens
  chr4.fa.O7frz.131338598
  Located on chromosome 4
  Distance between a terminus base of telomere on chromosomal short arm and 5'-terminus of this base sequence : 125226259
  Distance between 3'-terminus of neighbour sequence of sequence listing upward to telomere on chrosomal short arm and 5'-terminus of this base sequence : 96707
ccattgaagtaatgactttgtatcactcctattttatagatagggaagctgagttacagagaggtttcacaacttgctttaatttgctcaaggttatatggctattaaatagttgaattgggattcaaacccaggcaatttggctccaaagcctaatcaattaaaaatttattattagtaataaaaatttcaaacatacataaagataggagaatagtgcaatggacctccccatttacccatctcccacactgacagcaatcattaactcatggccaatcttattttatctatatttctacctacttccctggttgcccagcccctttcctggattattacacacacacacacacacacacccctttttttggtcattatttcaatagtttttgggctacaggtagtttttggttacatgagtaagttctttagtggca

SEQ ID NO: 7508 - DNA, 448 bp, Homo sapiens
  chr4.fa.O7frz.131504537
  Located on chromosome 4
  Distance between a terminus base of telomere on chromosomal short arm and 5'-terminus of this base sequence : 125403764
  Distance between 3'-terminus of neighbour sequence of sequence listing upward to telomere on chrosomal short arm and 5'-terminus of this base sequence : 177065
tgatggttcactgaatacttctgttgctgttgtattcaaaactatatacatggatgattgctttttttttttacttttacagtctaatgtagatatgaatatgctgaatacatgtactttgattagaaatggaagtaaatatcactaaagcctaacataattcttcttcataaaaggggcaaagaggctatgaaggaataagacatttattgctaaaagcatttgtctgcacacacacacacacacacacacacacccacacacacacacacacacacacacctgttttttctggagaacaaatggtagagtttctgcccataaaggatgggcagcatgtgtgttcatattttaaagctgtccagcaaattctacctaccacaagttaactgtctattagaacacaaggattccatgttcctgtccatcagcttctgtcaatctagtg

SEQ ID NO: 7509 - DNA, 414 bp, Homo sapiens
  chr4.fa.O7frz.131603475
  Located on chromosome 4
  Distance between a terminus base of telomere on chromosomal short arm and 5'-terminus of this base sequence : 125503911
  Distance between 3'-terminus of neighbour sequence of sequence listing upward to telomere on chrosomal short arm and 5'-terminus of this base sequence : 99699
caggaaacttaagatgactatgattaacatgttaaaggtcctaatggaaagaataggcaacatacaaaaacagatgggtaatgtaatctgagagataaaaacaacaaaaataaaaaatgaaaaaaaaataaaagaagtgctagaaatcaaagacagaaatgaagactctatttatcagtacagcgggcatgccagaggaaaaaactagtgagattgaaaataggccaacaagaactttccaaactgaaagggaaagaaaaagaaagaaagaaaagaaagaaagaaagaaagaagaaagagaaagaaagaaagaaaggagggagggaggaaggaggagaaaaaatcagaatacccaaggactgtggggcaactgtaataagtataaattatgcataattggaataccagaaggag

SEQ ID NO: 7510 - DNA, 385 bp, Homo sapiens
  AC068441.2_49895
  Located on chromosome 4
  Distance between a terminus base of telomere on chromosomal short arm and 5'-terminus of this base sequence : 125621401
  Distance between 3'-terminus of neighbour sequence of sequence listing upward to telomere on chrosomal short arm and 5'-terminus of this base sequence : 117076
gtgaatgcatactgaatccatccatccatctgtttttcagtctatccatccatccatccatccatccatccatccatccatccatccatccatccatctgtcctgtattctggatactctctatgtagaggtggtttgaggatttgtggagaacacaataccttttctgtagtgttgaagaaaaggcatagaggttggtcttaaacttggaaatgaaggttgaggcataattctacattggtttcttgaaggaagtggtcattcaaactcaggaaaggaaaaacagaataaaacacatcctttgttggaagaaagtcatttaaaaacaaaaataattgcaattttacatttataaacagatgtgaaatgcattacaaaggtactc

SEQ ID NO: 7511 - DNA, 433 bp, Homo sapiens
  chr4.fa.O7frz.131854425
  Located on chromosome 4
  Distance between a terminus base of telomere on chromosomal short arm and 5'-terminus of this base sequence : 125736967
  Distance between 3'-terminus of neighbour sequence of sequence listing upward to telomere on chrosomal short arm and 5'-terminus of this base sequence : 115181
gcttgaggaattaaatgacttatctatattcaggcttgtggtagaatgatatgggaatatcaaagcttcctggagaagttattccatggccagaagaaaggtctccggtagagacattacttggattcataaaacatgtaaccattccagaaaataatctgaacacatacacacacacacacacacacaccccaaatgacttcccaatatctatagaatggtgcctcaaatcacgatttgaaaaagtatgaaggagcgacccatacaagctgcacaaatctgggttaaatattatttatgcttattaattatgtggtaagccacaaacattttattccacaaggtacatacacacatggtcaactaagtctttggttgtttttataaagtcttgatttaatagttcttctttcataagattaagtgaactgaa

SEQ ID NO: 7512 - DNA, 335 bp, Homo sapiens
  chr4.fa.O7frz.132131321
  Located on chromosome 4
  Distance between a terminus base of telomere on chromosomal short arm and 5'-terminus of this base sequence : 125907227
  Distance between 3'-terminus of neighbour sequence of sequence listing upward to telomere on chrosomal short arm and 5'-terminus of this base sequence : 169827
atgaatgctcagttactaaatgattcatttgttaaatcactcctaatattattcccctgctgataaacccactcctacattaataatcttttaagcagatcttcattgtactatcattgttgatttccatgcctctttctgctgcaaactccctgagtggattggtgtgtgtgtgtgtgtgtgtatgcattctcagctcttgctatgataatctgacagtctctaggcgtacaataaatacatttttatacatgggtgaatttagatatttcataattacatatttgttttgttctgatgaacttatttttcttagcgtattgatcttaagcttc

SEQ ID NO: 7513 - DNA, 215 bp, Homo sapiens
  Z66700
  Located on chromosome 4
  Distance between a terminus base of telomere on chromosomal short arm and 5'-terminus of this base sequence : 126142067
  Distance between 3'-terminus of neighbour sequence of sequence listing upward to telomere on chrosomal short arm and 5'-terminus of this base sequence : 234505
tggcctcagttaaggacctatccagtaatggcctatgtgttttgccaattttcagattaaaaattgttttaaatattagaaatatagacagatgtgcatgtagggtgtgtgtgtgtgtgtgtgtgtgtgtgtgtgtgtgtgcgcatatgttttgtatcactggttcttagtccctcctaatattgccacatatttcattcctgcaacttccagat

SEQ ID NO: 7514 - DNA, 268 bp, Homo sapiens
  D4S2975
  Located on chromosome 4
  Distance between a terminus base of telomere on chromosomal short arm and 5'-terminus of this base sequence : 126217453
  Distance between 3'-terminus of neighbour sequence of sequence listing upward to telomere on chrosomal short arm and 5'-terminus of this base sequence : 75171
ctgggctcaagtgattttcctgccttggcatctcctgccttgccaggattataggcatgagctaccacacctggccactgtcttaagccagtatatccaacacacacacacacacacacacacacacacacacacacacacactcatacaatgaacaggttaaattcgatgctcaaaaatactattctgaatcaatgatgacattttactttgtgaggagaggaaacaggaaatgctacaatctaaagtgacaccattgtcccagctg

SEQ ID NO: 7515 - DNA, 448 bp, Homo sapiens
  chr4.fa.O7frz.132625225
  Located on chromosome 4
  Distance between a terminus base of telomere on chromosomal short arm and 5'-terminus of this base sequence : 126353480
  Distance between 3'-terminus of neighbour sequence of sequence listing upward to telomere on chrosomal short arm and 5'-terminus of this base sequence : 135759
gatgctcctacatgacagttattttattctttttctcttttcctctctctctttctctttctttctttcttctttctccctctgtgtcctccctccctccctccctcgctctctttctttctttctttctttctttctttttctttctttctttctttctttctttctttccttctttctttctttctttctttctctgtgcatgtgcttactccaagtgcttctacagcatttctggaaaactttccctttgttataatactttttttcttggatgtcgggagcagacagttgaagtaattatactgcacttctcagttcatgccccattaccatcattggtccaaacaaaacccttctctgattttaggtatttatttattaccttttagctcctcacacactcccatctccacttccattataagcaatcactcattctgtttag

SEQ ID NO: 7516 - DNA, 141 bp, Homo sapiens
  DISD22_0003970
  Located on chromosome 4
  Distance between a terminus base of telomere on chromosomal short arm and 5'-terminus of this base sequence : 126644184
  Distance between 3'-terminus of neighbour sequence of sequence listing upward to telomere on chrosomal short arm and 5'-terminus of this base sequence : 290256
gtacaatgcttgcactaggccttatatagagagaaatgtatatatacatatgtgtgggtgtgtttgtgtgtgtgtgtgtgtgtgtgtgtgtgtgtgtgtgtgtgtatagagagagagaggagagatctcatcccagtgcct

SEQ ID NO: 7517 - DNA, 364 bp, Homo sapiens
  chr4.fa.O7frz.133033858
  Located on chromosome 4
  Distance between a terminus base of telomere on chromosomal short arm and 5'-terminus of this base sequence : 126783043
  Distance between 3'-terminus of neighbour sequence of sequence listing upward to telomere on chrosomal short arm and 5'-terminus of this base sequence : 138718
gcataatgctataggataagacagactgtcaaaatgaattgagatattgagctttcttaccccagtcttatccaaaaaaagagtaatgactttaaaatacgatgttatgggatacatatagtaaaatggttactgcggtgaaggtgattaacatatttatcatcttacgtagttatttatgtgtgtgtgtgtgtgtgtgtgtgtgcgtgtgtgacaagagcagctaaaacctacttatttaacaaaatccctaatacaattttattaatgatagtcctcatattgtacattagatctctggacttgttcattcttcatatctgctattttgtcttaaaaatggaacattcttataggcgtgatt

SEQ ID NO: 7518 - DNA, 391 bp, Homo sapiens
  chr4.fa.O7frz.132948257
  Located on chromosome 4
  Distance between a terminus base of telomere on chromosomal short arm and 5'-terminus of this base sequence : 126805729
  Distance between 3'-terminus of neighbour sequence of sequence listing upward to telomere on chrosomal short arm and 5'-terminus of this base sequence : 22322
tttatgtagctgtgctaatcctggttcattattttttatgttgctgtactgtattccatggtatgaatgtgttctttatttattgcctctagtattgatcaatatttagattttctagtatttgaatattacaaataatgttgctatgaacatatgtgtgtgtgtgtgtgtgtgtgtgtgtgtgtgtgtgtgtgtgtgtgtaggtacatacataacatacataaatgcattcctcttgggaaaatatcttagagtagaagtactagtatgtatgtgtaatatcttagagcagaagatattactctaagatgtaatatcttagagtagaaaatagagtagaggtattggtatgtatatgtacacttttatagaatatgtcaaatagtgagcc

SEQ ID NO: 7519 - DNA, 161 bp, Homo sapiens
  DISO7_10001582
  Located on chromosome 4
  Distance between a terminus base of telomere on chromosomal short arm and 5'-terminus of this base sequence : 126989984
  Distance between 3'-terminus of neighbour sequence of sequence listing upward to telomere on chrosomal short arm and 5'-terminus of this base sequence : 183864
aatcactgtcttgcatataccccaaattattccatctcaatattctatttacttcatgcttaaataaatctatgctgtatgtgataaaggaaaagtaaactcacacacaaacagacatacacacacacacacacacacacccatgttgactactcccactt

SEQ ID NO: 7520 - DNA, 119 bp, Homo sapiens
  DISO7_10001584
  Located on chromosome 4
  Distance between a terminus base of telomere on chromosomal short arm and 5'-terminus of this base sequence : 127093678
  Distance between 3'-terminus of neighbour sequence of sequence listing upward to telomere on chrosomal short arm and 5'-terminus of this base sequence : 103533
gatggaggttcttgaaacttgcttattttttgcttacttttgtggatgttcctattccttctctctctctctctctctttctctcttctctccaccccatgtgtgccctcactctagct

SEQ ID NO: 7521 - DNA, 229 bp, Homo sapiens
  DISO7_10001585
  Located on chromosome 4
  Distance between a terminus base of telomere on chromosomal short arm and 5'-terminus of this base sequence : 127098069
  Distance between 3'-terminus of neighbour sequence of sequence listing upward to telomere on chrosomal short arm and 5'-terminus of this base sequence : 4272
caggaagtctgtgatatttctctagttaggatatatatatatatgtatgtatatattatatatatgtatatatatatatatataaaaatcatattggataaaaaatgttaaccctttctatcaaatttcagactttcctgattctgaaactcaaaactgaatgcaaattaagatttttaaaaagtatgattaaaaaaaataccgcatacacacatgacatctggcaatg

SEQ ID NO: 7522 - DNA, 265 bp, Homo sapiens
  DISO7_10001586
  Located on chromosome 4
  Distance between a terminus base of telomere on chromosomal short arm and 5'-terminus of this base sequence : 127126371
  Distance between 3'-terminus of neighbour sequence of sequence listing upward to telomere on chrosomal short arm and 5'-terminus of this base sequence : 28073
ttgaattatgatgcattcagttaccttttatttgttattttttcttgttttaaggactatgcatatatatgcaaaaaatttacgtgtataaagtgaagatatttagtaatttctgaagaacattcattacatatatgtatgtgtatgtgtgtgtgtatatatatatatatatatatatatatatatatatatataaaatatgtatgtgtgtgtgtatttcaaagctcttcccacatgaaaactcagtgtacattcagtatgtgcc

SEQ ID NO: 7523 - DNA, 195 bp, Homo sapiens
  DISO7_10001588
  Located on chromosome 4
  Distance between a terminus base of telomere on chromosomal short arm and 5'-terminus of this base sequence : 127222466
  Distance between 3'-terminus of neighbour sequence of sequence listing upward to telomere on chrosomal short arm and 5'-terminus of this base sequence : 95830
tcctgcatctctgatcacacacagtttgttttctgtttctcttttctctctctggaaagtaatttgaatacttctcactgcattattttctcagtacttgtgtgtgtgtgtgtgtgtgtgtgtgtgtgagagagagagagagagagagagagagagagagaatttattccattgctgcaagcatcaattctgtga

SEQ ID NO: 7524 - DNA, 473 bp, Homo sapiens
  chr4.fa.O7frz.133546658
  Located on chromosome 4
  Distance between a terminus base of telomere on chromosomal short arm and 5'-terminus of this base sequence : 127434467
  Distance between 3'-terminus of neighbour sequence of sequence listing upward to telomere on chrosomal short arm and 5'-terminus of this base sequence : 211806
agctcttgcgtttctaaattagagagaggccagttgagaaagaggcaacttctccctacacatttcatacggacttgtgctgtttcttttagtatagcataaggtaacaataatcagttgaaatttattgaaattatttttattcatttttatcagccgtaccattagtctgattttcttcaagattatgaaaactgattgactgttggtcctaattttcaacgtctgtgtgtgtgtgtgtgtgtttgtgtgtatatctctgtgtgtttttctttttttatcctgtcttggtaattgttttggtaggaatttagaaaagggagccagtggatgctggccagatgccatattaaacttaaatttgcaggcactaggttttaaagtctagagtaaccattgccaaattcctttcacaaatattctccctgcaatacaactcaaccagtgatatgttaatgtggctgatattacca

SEQ ID NO: 7525 - DNA, 309 bp, Homo sapiens
  chr4.fa.O7frz.134005063
  Located on chromosome 4
  Distance between a terminus base of telomere on chromosomal short arm and 5'-terminus of this base sequence : 127582260
  Distance between 3'-terminus of neighbour sequence of sequence listing upward to telomere on chrosomal short arm and 5'-terminus of this base sequence : 147320
ttgttacactagaatccaccttatatacttataaatatgcaagtaaacatgaccaaagatgcaaacatgcacacacacacacacacacacacacacacaccccaattcaactttgacatttttgaatgcaaatatccaaatatagcttaagtttgtttcctttcaatgtatcagctaaaggagtactacatactttgtagggtttcaataaatatttcttgaatgaaaaagtaaatatttagaatgttgtgttagaattagtcaatacctaaataatcctaaaaaatgtattcactagctgagatctgt

SEQ ID NO: 7526 - DNA, 467 bp, Homo sapiens
  chr4.fa.O7frz.134105809
  Located on chromosome 4
  Distance between a terminus base of telomere on chromosomal short arm and 5'-terminus of this base sequence : 127710526
  Distance between 3'-terminus of neighbour sequence of sequence listing upward to telomere on chrosomal short arm and 5'-terminus of this base sequence : 127957
cttacatggtgacaggtaagagagcatgtgcacggaactcccatttgtaaaactatcagctctcttgagacttattccctaccacaagaacagtataaggaaaactaccctcattattcaattatctccacccggccctgctcttgacacaggagaattatcacaagtcaaggtgaaatttgggtggggacatagccaaaccatatgagggggaatacaggaatctcaaaatcctgtatggaatcccaccacatcttttaatcatctcttctacactgtctttccaatgaactaagtccctgtaattgccatccttttcaagtgaacagagaattaactcacaaccaaagtcagcgagtcacaggtttctctctctctctctctgtgtgtgtgtgtgtgtgtgtgtgtgtgtgtgtaatgacttagcaattatatttttgttctccttctgttggtgtgatcagtag

SEQ ID NO: 7527 - DNA, 282 bp, Homo sapiens
  chr4.fa.O7frz.134190652
  Located on chromosome 4
  Distance between a terminus base of telomere on chromosomal short arm and 5'-terminus of this base sequence : 127795525
  Distance between 3'-terminus of neighbour sequence of sequence listing upward to telomere on chrosomal short arm and 5'-terminus of this base sequence : 84532
tcttgactcatagtgtcaggacaatttcactgtcaaacgaagcatctatagttatctaaaggagctgagcagcttagagtttgtgcttttctctaatctaccccctacagacacacacgtacacacacgcacacacacacacacacacacacacacaccccaattaccatattgtgtataaaggccatggcagttgatctctgtctccgatcttcatcagaatcctattgtgcttccctggttttacagaagcctgctctctcctagtaactgtgcactgac

SEQ ID NO: 7528 - DNA, 182 bp, Homo sapiens
  chr4.fa.O7frz.133774140
  Located on chromosome 4
  Distance between a terminus base of telomere on chromosomal short arm and 5'-terminus of this base sequence : 127964185
  Distance between 3'-terminus of neighbour sequence of sequence listing upward to telomere on chrosomal short arm and 5'-terminus of this base sequence : 168378
attatccagccactgaattaaccacctttgcaagctctgccatatttagcctttatacacacacacacacacacacacacacacacacacaatttatttttgataacacctttttcttgtttattttgtttggataagaaatttttgttaaatcagttgttagcctcttaactgatacagaa

SEQ ID NO: 7529 - DNA, 151 bp, Homo sapiens
  chr4.fa.O7frz.134381259
  Located on chromosome 4
  Distance between a terminus base of telomere on chromosomal short arm and 5'-terminus of this base sequence : 128245706
  Distance between 3'-terminus of neighbour sequence of sequence listing upward to telomere on chrosomal short arm and 5'-terminus of this base sequence : 281339
gaatacaaattcttactattcgctctctctctctctctctctctctctctctctgtgtgtgtgtgtgtgtgtgtgtgtgtgtgtgtgtgtatttaaatataactttcttatttggaggaagggataagtaggtgttaataggagttccaat

SEQ ID NO: 7530 - DNA, 477 bp, Homo sapiens
  chr4.fa.O7frz.134548038
  Located on chromosome 4
  Distance between a terminus base of telomere on chromosomal short arm and 5'-terminus of this base sequence : 128471803
  Distance between 3'-terminus of neighbour sequence of sequence listing upward to telomere on chrosomal short arm and 5'-terminus of this base sequence : 225946
tcctagtctgagattcctcatttacgaacagaggataataagacaacagaggatttatatgagataaaattgaaaccatttttaaactcacacagtaaagcataaaacagtatttaaaatgtgcccttaaaaaacaagtttatctaagatgtatcatatatattttagataactttactatttatgccagacacacacacacacacacacacacacacacacacacacaaatcatcttttattacctttcaaggagaaatttttaaacaaaaacaagaaacactgtatacttttaaaaaaatatttgcgacacttatattgggatttggggaggaaattgggagttttatgcttattgttacgtagccattttcctggttcttttgaattgttcttaaggtgtaatgttttcttcataatggtcaagcattttcttcttcttgcttaaaaatgatagttcactttgaaagcaaagat

SEQ ID NO: 7531 - DNA, 464 bp, Homo sapiens
  chr4.fa.O7frz.134648665
  Located on chromosome 4
  Distance between a terminus base of telomere on chromosomal short arm and 5'-terminus of this base sequence : 128565634
  Distance between 3'-terminus of neighbour sequence of sequence listing upward to telomere on chrosomal short arm and 5'-terminus of this base sequence : 93354
catttaattgaatatgcattgataaatatgtattaatttatcttataatattcatatagatatggcaataatggaaactcagattatattgatactactttaaaaaatcagttttgaaattgtctaatatattgttttccaaacccatgaacagattttgacaggcattttcctaaaatggaactgttgaaggaggcttaatctggaataaagaccaagcaataaatgtccttattgtgcatatttgtggtagaaaagattggtaccacaatacaaagtttaaatctcatcttaattctttattaaaataaaaatagtgcaggtggttaataatatacaagaagtgaagcaccacacacacacacacacacacacacacacacagatacactaaagagtaatttcaaagaaacataatcctaagcacactggatgcctcgctgactacaaatattctcatccac

SEQ ID NO: 7532 - DNA, 474 bp, Homo sapiens
  chr4.fa.O7frz.135031130
  Located on chromosome 4
  Distance between a terminus base of telomere on chromosomal short arm and 5'-terminus of this base sequence : 128902303
  Distance between 3'-terminus of neighbour sequence of sequence listing upward to telomere on chrosomal short arm and 5'-terminus of this base sequence : 336205
gaggaagtattgagttatcctttcattctctctgttgcaaacataacaaaaattgttttcatttgaagcatatgcaggtcaaaaaatgtaagaaacagtgtgtgtgtgtgtatatatatatatatatatatataggtatgtcaggtagttaataaaatattatgttatattcatgaatttgtgatgattatgatttgtcagtttttttaagttagtaatttttgtagtttcttttttattctaaataattactttatacctaacttttaaatatatgacttagaggaaaggggtttgagggggaaggacagatatctaaattgtataagctttagcctccgcagaatctagaatcactcccattttgaaattgaacgtcagttttgtttgctcttttttgttgttgtttcaagatggcagattagaggcttttagcatgcttcaaccacttggaaatagcaagacagtgcataa

SEQ ID NO: 7533 - DNA, 382 bp, Homo sapiens
  chr4.fa.O7frz.135104725
  Located on chromosome 4
  Distance between a terminus base of telomere on chromosomal short arm and 5'-terminus of this base sequence : 129008911
  Distance between 3'-terminus of neighbour sequence of sequence listing upward to telomere on chrosomal short arm and 5'-terminus of this base sequence : 106134
catactggaaagtatgtttggtgtctccagccaagcactgattcatctgttccaggacaccagaatgtcaatacagtctcctcttcactgcattttctttttcattttcttcctaaggtgttattagtaagttgcctgatacatagatgataaacctcgtgtgtgtgtgtgtgtgtgtgtgtgtgtgtgtgtgtgtgtgtgtgtgtgtgtactcttttctaatgaccagctctttggcagtgtcttctcttttctaatgaccagctctttggcagtgccttctcaagagagaactgggagcgggggaacagaggtactgatgtcacagcccaggtacactggcagggacagacagaaaatcttacatagcacctacacagat

SEQ ID NO: 7534 - DNA, 123 bp, Homo sapiens
  D4S1615
  Located on chromosome 4
  Distance between a terminus base of telomere on chromosomal short arm and 5'-terminus of this base sequence : 129155440
  Distance between 3'-terminus of neighbour sequence of sequence listing upward to telomere on chrosomal short arm and 5'-terminus of this base sequence : 146147
ccttgggtcagccacatatctaaaccttccctttctaggagggagtgctcatcacacacacacacacacacacacacacacacacacacactcacgttgtcacccaagtttctgttctgagtg

SEQ ID NO: 7535 - DNA, 225 bp, Homo sapiens
  Z67424
  Located on chromosome 4
  Distance between a terminus base of telomere on chromosomal short arm and 5'-terminus of this base sequence : 129201809
  Distance between 3'-terminus of neighbour sequence of sequence listing upward to telomere on chrosomal short arm and 5'-terminus of this base sequence : 46246
agggcattactgggttctcacgtactcctaaaaaatagagtcaatctgctcttactcaaaagtctgtaagatccttttgtacattaaacacacacacacacacacacacacacacacaatttcaccatcccacacaccaatttgtctaatcttcttctatgtaatgaataaaacagacattttggagagtagactctaattgtgcaattggaactgcctagccca

SEQ ID NO: 7536 - DNA, 339 bp, Homo sapiens
  chr4.fa.O7frz.135427484
  Located on chromosome 4
  Distance between a terminus base of telomere on chromosomal short arm and 5'-terminus of this base sequence : 129297376
  Distance between 3'-terminus of neighbour sequence of sequence listing upward to telomere on chrosomal short arm and 5'-terminus of this base sequence : 95342
actaccatttaaaccagcaatcccactactgagtatctacccagagaaaaagaagtcattattcgaaaaagatacttgcacaggcatgttcatagcagcacaattcacaattgcaaattgtggaaccaacccaaatgcccccatcaatcaatgagtggataaagaaactgtgatatatatatatatatatatatatatatatatatatatatatatatatatatatatgtatctccacacacatatatatgatggaatactatatatatatatatatatatagtattattctaagtgaaataactcaggaatggaaaaccaaacatcgtatgttcttac

SEQ ID NO: 7537 - DNA, 389 bp, Homo sapiens
  chr4.fa.O7frz.135603960
  Located on chromosome 4
  Distance between a terminus base of telomere on chromosomal short arm and 5'-terminus of this base sequence : 129384473
  Distance between 3'-terminus of neighbour sequence of sequence listing upward to telomere on chrosomal short arm and 5'-terminus of this base sequence : 86758
ttatttgcactcaaattacacttaaaaataaagtttataggccgggcgcggtggctcacgcctgtaattccagcactttgggaggccgaggtgggcggatcacgaggtcaggagatcccagaccatcctggctaacatggtgaaaccccgtgcagttccagctactcgggaggctgaggcgggacaatggcgtgaacccgcgaggcggagcttgcagtgagccaagatcgcgccactgcactccagcctgggcgacggtgcgagactccgtctcaaaataaataaataaataaataaataaataaataaataaataaaaaataaagtttataacagttaaggccgccttcaaagaaaaatacagggtagacattacagtgctttgaaac

SEQ ID NO: 7538 - DNA, 119 bp, Homo sapiens
  DISO7_10001591
  Located on chromosome 4
  Distance between a terminus base of telomere on chromosomal short arm and 5'-terminus of this base sequence : 129619025
  Distance between 3'-terminus of neighbour sequence of sequence listing upward to telomere on chrosomal short arm and 5'-terminus of this base sequence : 234163
ggtgtaataaactcaattgcctacttttatttgaacaactagacacgtactaatagaattcacacacacacacacacacacacacacacacacagtacagagctaccacattcttaatc

SEQ ID NO: 7539 - DNA, 464 bp, Homo sapiens
  chr4.fa.O7frz.136036507
  Located on chromosome 4
  Distance between a terminus base of telomere on chromosomal short arm and 5'-terminus of this base sequence : 129832693
  Distance between 3'-terminus of neighbour sequence of sequence listing upward to telomere on chrosomal short arm and 5'-terminus of this base sequence : 213549
cttccaacactatgttgaacaggagaggtgagagagggtatccttgtcttgtgccggttttcaaagggaatgcttccagtttttgcccattcagtatgatactggctgtgggtttgtcataaatagcgcttattattttgagatacgttccatcaatatcagtttattgagtgttgttagcatgaaggagtgttgaattttatcaaaggccttttctgcatatattgagataatcatgtggtttttgtcattggttctgtttatgagatggattacatttattgatttgtgtatgttgaaccagccttgcatctcagggatgaagcagatttgatcgtggtggataagctttttgatgtgctgctgaattcagttttccagtattttattttttatttttatttattattattattattattattattattattattattattatttgagacagagtcttgctc

SEQ ID NO: 7540 - DNA, 316 bp, Homo sapiens
  chr4.fa.O7frz.136024267
  Located on chromosome 4
  Distance between a terminus base of telomere on chromosomal short arm and 5'-terminus of this base sequence : 129849881
  Distance between 3'-terminus of neighbour sequence of sequence listing upward to telomere on chrosomal short arm and 5'-terminus of this base sequence : 16724
cattcacaaggaattgtatcttacataacttctcagttttttacaaaacatctccataggcaatttaaattatacaatttcttccaaaaattaattataaaggtttaatcagcttcattataagaatgaaaatatcatattttagaccagatatcttaaatattattctgtatatggtatatatatatatatatatatatgtgtgtgtgtgtatatatttattatcatttgaccatagtattatatacaagtaaaatgaaaaaaaaaaattatttcatccaaaagcatacataatccaccttagtatttgaagttt

SEQ ID NO: 7541 - DNA, 401 bp, Homo sapiens
  chr4.fa.O7frz.136400665
  Located on chromosome 4
  Distance between a terminus base of telomere on chromosomal short arm and 5'-terminus of this base sequence : 130135934
  Distance between 3'-terminus of neighbour sequence of sequence listing upward to telomere on chrosomal short arm and 5'-terminus of this base sequence : 285737
ctaaaaccagtgcatctgaacatgggcaaatttgattttctgtgctttgttttaactggatgaagctttccagctgagttggcaatggtcttctggcaatcatcagtcagccctgcccctgagcatcttcctcttttcctgtttggtttgctccttggtcttggtgaatggtgtgtgtgtgtgtgtgtgtgtgtgtgtgtgagagagagagagagagagagagacagagagagacagagagctcgctgcagtctggcaatggtaccaatgtgctgatgattaatttttgagaataacttcatattcacaaacatggaaaatgtcctctggcatgagtggatctcaatccatataattttaacatctaaaacagagtacagtcctcgttttagatcttgttc

SEQ ID NO: 7542 - DNA, 170 bp, Homo sapiens
  D4S2938
  Located on chromosome 4
  Distance between a terminus base of telomere on chromosomal short arm and 5'-terminus of this base sequence : 130221252
  Distance between 3'-terminus of neighbour sequence of sequence listing upward to telomere on chrosomal short arm and 5'-terminus of this base sequence : 84917
tggtgtagtattccatcgtgtgtgtatgtatatgtgtgtgtgtgtgtgtgtgtgtgtgtatatatatatatatatatatatatatatatcacagtttcttatatatatatcacagtttctttatccccttgttgattgacaaggatttgggttggttccacgaatttgca

SEQ ID NO: 7543 - DNA, 180 bp, Homo sapiens
  D4S2401
  Located on chromosome 4
  Distance between a terminus base of telomere on chromosomal short arm and 5'-terminus of this base sequence : 130417070
  Distance between 3'-terminus of neighbour sequence of sequence listing upward to telomere on chrosomal short arm and 5'-terminus of this base sequence : 195648
ttctcagcctccataatcacatgagccagtttccgtaataaccctgctcttgtctgtctgtctatctatctatctatctatctatctatctatctatccatccatccattctattggttctgtttctctggagaactttgactaatatactctctaaagcccagtatcttcctctgttaa

SEQ ID NO: 7544 - DNA, 450 bp, Homo sapiens
  chr4.fa.O7frz.136736971
  Located on chromosome 4
  Distance between a terminus base of telomere on chromosomal short arm and 5'-terminus of this base sequence : 130559896
  Distance between 3'-terminus of neighbour sequence of sequence listing upward to telomere on chrosomal short arm and 5'-terminus of this base sequence : 142646
cactgctacatctgaattagtttcctatggcttccgtaacaaatatcacaaacttggttcttaaaacaacaaaaatttattctctcactggtctagaagccagaggtttgatgtgtcactgggctgacatcaaagtgttagcagggctcttctccctctgaaggctctagtggagaatctgtttcttgcctcttccagattctgatagctgccagcattctttggcttgtggccacatcactccaatctctgactccaccttcacattacctttgtgtgtgtgtgtgtgtgtgtgtgtgtgtgtgtgtgtgtgtgtgtcttctctctgtctatatcaaatctccctctacccctttcttaaaaggtcactttgtgactgcatttagggcccacctggacaattcaggatattctccctatctcaggatcctaaacttaatcatatctgca

SEQ ID NO: 7545 - DNA, 321 bp, Homo sapiens
  AC009608.4_94290
  Located on chromosome 4
  Distance between a terminus base of telomere on chromosomal short arm and 5'-terminus of this base sequence : 130702742
  Distance between 3'-terminus of neighbour sequence of sequence listing upward to telomere on chrosomal short arm and 5'-terminus of this base sequence : 142396
aacaagagcagaactccatctcaaaataaataaataaataaataaataaattccacagtctacccagagacagtgtcagatcccataaggtgaggttttagtccccaaaactgcccctaaccccaaacaccagtcgttaagtcagggcctctggaacttctgacccattggcttcaaattgggattcccaaaaccccctcctcgggtttgattaatttgcgggggcagctcacaaaactcagggaaattaattattctattatgtttactggtttattataaaggatattaccaaggatacagataaggagatgcataagg

SEQ ID NO: 7546 - DNA, 97 bp, Homo sapiens
  DISO7_10001592
  Located on chromosome 4
  Distance between a terminus base of telomere on chromosomal short arm and 5'-terminus of this base sequence : 130829410
  Distance between 3'-terminus of neighbour sequence of sequence listing upward to telomere on chrosomal short arm and 5'-terminus of this base sequence : 126347
gttacagaagatactcctggcagtgaggtgctaagtcatcactgaggctgtgtgtgtgtgtgtgtgtgcgcgtgcccgtgtccatccatgtctctgt

SEQ ID NO: 7547 - DNA, 211 bp, Homo sapiens
  DISO7_10001594
  Located on chromosome 4
  Distance between a terminus base of telomere on chromosomal short arm and 5'-terminus of this base sequence : 131001027
  Distance between 3'-terminus of neighbour sequence of sequence listing upward to telomere on chrosomal short arm and 5'-terminus of this base sequence : 171520
caagatgccaaatatcactacatactagattcatatactaactactttatatgctaaatactaactttataatcttgttgaagttttatgtttctgtgttctaaagctatatatatatatatatatatgcctaaataaatatcttaagatagttttaaatttcaaaaaaactttttagtgactgttaaagaccagtttaagagattctgca

SEQ ID NO: 7548 - DNA, 415 bp, Homo sapiens
  AC060779.3_95898
  Located on chromosome 4
  Distance between a terminus base of telomere on chromosomal short arm and 5'-terminus of this base sequence : 131186169
  Distance between 3'-terminus of neighbour sequence of sequence listing upward to telomere on chrosomal short arm and 5'-terminus of this base sequence : 184931
tgctgattaatcagtagaagcactttgtgtattaagaatataacccatttggtcagtcatgagttttgtacatactttcttcccataatatagtttgtttcttgacttttttttgtggttttgtgccaaagagaattctttttattattagaaaaacaattataggttctatttttaatggtttctttgtttccttcattgcttaaattgtgccccaccttgaggttttatagataatcaatctcctatttaaaacaatatatatatacacacacacacacacacatatatatagatagatagatagatagatagatatgtttttggattttttagtctatttcatttagacgttgggtcagaggtccccaacccctgggtcatggactggtactggtcagtggcctgttaggaa

SEQ ID NO: 7549 - DNA, 212 bp, Homo sapiens
  G08378
  Located on chromosome 4
  Distance between a terminus base of telomere on chromosomal short arm and 5'-terminus of this base sequence : 131186361
  Distance between 3'-terminus of neighbour sequence of sequence listing upward to telomere on chrosomal short arm and 5'-terminus of this base sequence : -223
ccttcattgcttaaattgtgccccaccttgaggttttatagataatcaatctcctatttaaaacaatatatatatacacacacacacacacacatatatatagatagatagatagatagatagatatgtttttggattttttagtctatttcatttagacgttgggtcagaggtccccaacccctgggtcatggactggtactggtcagtgg

SEQ ID NO: 7550 - DNA, 455 bp, Homo sapiens
  chr4.fa.O7frz.137719770
  Located on chromosome 4
  Distance between a terminus base of telomere on chromosomal short arm and 5'-terminus of this base sequence : 131397340
  Distance between 3'-terminus of neighbour sequence of sequence listing upward to telomere on chrosomal short arm and 5'-terminus of this base sequence : 210767
ggagcactaagtggaatacttctgttaaacttattttttttcaaatgtgacactttaaaaagccttggtttgtataggataagacagagatattcatggatccgagtaccaatacacacacacacacacacacacacacacacacaataaattataaattactttatcccaaagtaataattctaaaaatatttgcaccagcagaatagaaggaaaatcaataagcaaattaattaatgaattagttgaatttatgacaatttagaattcattttgcagacataagctggcataaatacatcagttacagaaaaatttataactaccaacctcatcgcaaataataccacacatacaaatacatgtacacatatatatggtgctttttacatttctggaattatcagttttttaacatagttggattcaaaatgtattgttatggttcgaatacg

SEQ ID NO: 7551 - DNA, 454 bp, Homo sapiens
  chr4.fa.O7frz.137826921
  Located on chromosome 4
  Distance between a terminus base of telomere on chromosomal short arm and 5'-terminus of this base sequence : 131464463
  Distance between 3'-terminus of neighbour sequence of sequence listing upward to telomere on chrosomal short arm and 5'-terminus of this base sequence : 66668
gcactttacatgtattacctcatttagttctgacaatagtcatgtgagatcccattttacaggtggggcaattgagatccagaatatttatataaatgtttagggcttccacatatggacaatggtggagtcaagttttgaatcaggcaatctggggccagggctctttaactattctctagggcgtgcgcgcgcgcgcgcgcgcgcacacacacacacacacacacacacacacacacacacacacacacacacacaaagtcattatttctggagtttagtaagctgggagaggtaagcaaagaggctgcaggaggcagctgccatttgatcactggccctttaagctctgttcaggggtttgaatttttatctaagcaacggccgtgtcttgatgtgttctgagcagcaagtgatgggacgggatttgcttctaatctacagctggtattga

SEQ ID NO: 7552 - DNA, 170 bp, Homo sapiens
  HUMUT7651
  Located on chromosome 4
  Distance between a terminus base of telomere on chromosomal short arm and 5'-terminus of this base sequence : 131787777
  Distance between 3'-terminus of neighbour sequence of sequence listing upward to telomere on chrosomal short arm and 5'-terminus of this base sequence : 322860
tattagtcagggtttttcagagaaacaaagttatctatctatctatctatctatctatctatctatctatctatctatgtctatcatctgtctatctatctgtctatctatctattacgaggtttatttcaaggaattgtgattttggggagctggtgatatgacatttg

SEQ ID NO: 7553 - DNA, 298 bp, Homo sapiens
  D4S2365
  Located on chromosome 4
  Distance between a terminus base of telomere on chromosomal short arm and 5'-terminus of this base sequence : 131825509
  Distance between 3'-terminus of neighbour sequence of sequence listing upward to telomere on chrosomal short arm and 5'-terminus of this base sequence : 37562
atgccaaggatggtgagttactcatctttctattccaggctataactcacatgaaaaagatgaacattaaatacttactaaattttatcagtgattctacttaggctctatggatttataatttattttccagcaaaaagggaaattatctatctatctatctatctatctatctatctatctatctatcatctatctagctagctaggtagctgcttacctatctgtctgtctagctgcttacctatctgtctatcagttatttttcttccaatggtgatgcagctgaagaattact

SEQ ID NO: 7554 - DNA, 453 bp, Homo sapiens
  chr4.fa.O7frz.138393957
  Located on chromosome 4
  Distance between a terminus base of telomere on chromosomal short arm and 5'-terminus of this base sequence : 131936698
  Distance between 3'-terminus of neighbour sequence of sequence listing upward to telomere on chrosomal short arm and 5'-terminus of this base sequence : 110891
tgtacggagtttcttagtcaactgaataaggcactggagacaaaacatctgcattgagtgaccttgaacaagtctctgcttacctcattacataactcttattcaaataaaactatacacacacatacacacacacagtctttattctgtacatgggacataggaagaatgtaataaatgttagctatggttttccttatgaaggagcttacacaaaaactagtttatctctgtggatgtttccattattgagacaaatattaaatactgttatagttaacacaagataaactatctttgaaatggaatatgaacctaaaagttttatgccaggaaattaaacacttttcaaaaaaagggcataaacattaggaggcatataaaagttactctcctgctatctcatagattgttcatatttttcaataagatgttagagttgtcaaagtcaag

SEQ ID NO: 7555 - DNA, 152 bp, Homo sapiens
  chr4.fa.O7frz.138510988
  Located on chromosome 4
  Distance between a terminus base of telomere on chromosomal short arm and 5'-terminus of this base sequence : 132128908
  Distance between 3'-terminus of neighbour sequence of sequence listing upward to telomere on chrosomal short arm and 5'-terminus of this base sequence : 191757
agacctttaccacttccactaggcaaaacccaccatcatttttaacagagtattgtaacagactcttcactagtctcgctgttttcaacacacacacacacacacacacacacacacacacacacaccatacagcaactaaagtgaacatct

SEQ ID NO: 7556 - DNA, 406 bp, Homo sapiens
  chr4.fa.O7frz.138587862
  Located on chromosome 4
  Distance between a terminus base of telomere on chromosomal short arm and 5'-terminus of this base sequence : 132161788
  Distance between 3'-terminus of neighbour sequence of sequence listing upward to telomere on chrosomal short arm and 5'-terminus of this base sequence : 32728
aattcatgtgaattcaagtcagataaagaagagcatgtctgtctgtgtcttagacacatgtatacatacacacacacacacacacacaaacacacatcaaaactcatggataaaaacatgttgattttatcaaccccctcctaaatttttatgacaatttgaaaaaaatgacaacaaacataagagttgtttttatcagaagactgcttattaatttccctttctctatgggagagaacgataattgaagctacaggcaataggtcagattaaaataaaaagtaatttttaatttttaacattgtgaaagagatttataaaggaagtaaggtactctataatatcctagtctttggactttctgtatatttagtttgtaatacttagctattacatgcttggatag

SEQ ID NO: 7557 - DNA, 320 bp, Homo sapiens
  chr4.fa.O7frz.138934546
  Located on chromosome 4
  Distance between a terminus base of telomere on chromosomal short arm and 5'-terminus of this base sequence : 132344922
  Distance between 3'-terminus of neighbour sequence of sequence listing upward to telomere on chrosomal short arm and 5'-terminus of this base sequence : 182728
atggtaaatggtatgtagacagaatatgtccaaaagttttgtcaaaaagaaaaaaaattattctgacccttgttaaaatgttgaggaagactttattcaagactattgtgatagatgtcaactatactataataggggagagagaccgagatcaactccaaatataacaaggacgagtggtgatttacaaccaaggagcagtgtgtgtgtgtgtgtgtgtgtgtgtgtgtgtgtgtgtgagagagagagagagagagagagagagagagaaagagagagagaggtgaggttggaggggttggtgaatggaaaactattaa

SEQ ID NO: 7558 - DNA, 418 bp, Homo sapiens
  chr4.fa.O7frz.138808040
  Located on chromosome 4
  Distance between a terminus base of telomere on chromosomal short arm and 5'-terminus of this base sequence : 132402334
  Distance between 3'-terminus of neighbour sequence of sequence listing upward to telomere on chrosomal short arm and 5'-terminus of this base sequence : 57092
ttgattggtttaagtttggagtatatatggggtgtgtgtgtgtgtgggtgtgtgtgtgtgtttatatatatatatatatatatatatgcacatatatattcttcaattcatcttaaactcattcattggaatcatatgagaagcttatttgaaatgcatattcacttgtctttttttcccctacatttctgatttagttgatttggatgtgagatctaagattctaaattttttattggcactccaagttaaatttgatgcaatgttgtcatgtacattttaagaaacactgcaactgattttttaagtgaatgaaacattatatcttctttggcccaccattcttgaggttatattcattaatttaatcacttcaagcagcactaacaataaactacttctggaagattatgtcatc

SEQ ID NO: 7559 - DNA, 401 bp, Homo sapiens
  chr4.fa.O7frz.139801124
  Located on chromosome 4
  Distance between a terminus base of telomere on chromosomal short arm and 5'-terminus of this base sequence : 132560269
  Distance between 3'-terminus of neighbour sequence of sequence listing upward to telomere on chrosomal short arm and 5'-terminus of this base sequence : 157517
ctgacagtaggatgaagattaagttctagacctgctcacatcacggttttagtcctactaaatgtgggtcgatgtaggggaaaaaaagaaaaaaaaatctttcaagattcctcatcttaactggtctcctaaccccagcttgacaaaaccaggaaaataaaatctaagtgtgcagtatcagaaagttatgtcatgtaagagtggcttttgttttcagatttttcatgtcattctaggtctaggatctcttttcagttttgcctggttgcccttctttttccctccccacattttttcactgcttacttctttcaagacaattgtgtgtgtgtgtgtgtgtatgtgtgtgtgtgtgtgtatttagcattttattccctgacgataggcttagaataacctag

SEQ ID NO: 7560 - DNA, 102 bp, Homo sapiens
  DISO7_10016206
  Located on chromosome 4
  Distance between a terminus base of telomere on chromosomal short arm and 5'-terminus of this base sequence : 132610102
  Distance between 3'-terminus of neighbour sequence of sequence listing upward to telomere on chrosomal short arm and 5'-terminus of this base sequence : 49432
ttgcagagaagacaaatagagacatttagcattcacacaaacatacacagagagagagagagagagagagatcggaaacttgactggtaagaatttcttacc

SEQ ID NO: 7561 - DNA, 448 bp, Homo sapiens
  chr4.fa.O7frz.139341116
  Located on chromosome 4
  Distance between a terminus base of telomere on chromosomal short arm and 5'-terminus of this base sequence : 132762758
  Distance between 3'-terminus of neighbour sequence of sequence listing upward to telomere on chrosomal short arm and 5'-terminus of this base sequence : 152554
agatgttcactgagcacaataaaagactgtaaatttaataagaaatgtaaacctgaggggaaaaattcagaagtcattgatgaagcaggaagaaaacggcagaaaaggggataaaaggaaagattagaaaattgacgaaaagtgaacaaaaaataaatagttatatatataatgttcacactaaatgtaaattaattaattgtaagtcctgattagagtaagaaagattctaaagatcctctgatatactgcttataagcagcacaacagaacacacacataaacatacacatgtggactggtgaaaaataaaaggatcagaaaaatagaccaggcaaattataactaaaagaaacacacacacacacacacacacacacacacacacaatttaacaaaatccattataataggtaaagatgagacactgaataacaaatgaggatgc

SEQ ID NO: 7562 - DNA, 388 bp, Homo sapiens
  chr4.fa.O7frz.139434309
  Located on chromosome 4
  Distance between a terminus base of telomere on chromosomal short arm and 5'-terminus of this base sequence : 132856712
  Distance between 3'-terminus of neighbour sequence of sequence listing upward to telomere on chrosomal short arm and 5'-terminus of this base sequence : 93506
ttgtaggcaccacttgtattagttttttgtatatatatacacatatatataaaactatatataaatatatatataactataaaaatatataatatatattatctagaaaaactatatatatagttatatatatatttggtaacaaggtttttaattggaaaaatatatattatatatggtaacaagatttttaattggaaaagttagcgttgttttagtgaacaaacgaaaagttgcagtgatgtttagaatattgatagctatttatttatttactttggcgttttggagtgactctcattgggaatgtgaagatgcattggcattagtggaaagttttttgattgtttatattggcttgtaaacctgacagctattctagttgcat

SEQ ID NO: 7563 - DNA, 253 bp, Homo sapiens
  chr4.fa.O7frz.139674206
  Located on chromosome 4
  Distance between a terminus base of telomere on chromosomal short arm and 5'-terminus of this base sequence : 133096518
  Distance between 3'-terminus of neighbour sequence of sequence listing upward to telomere on chrosomal short arm and 5'-terminus of this base sequence : 239418
tgtattcatacatcgtgtactgattactacagtcaagttaattaacatatccgtcatcacccatggttacaatttgtgtgtgtgtgtgtgtgtgtgtgtgtgtgtgtgtgtgtgtggccgggggtgggtgaagacaaaaaaatatacttcattatcaaatttcaagtaaataatacactgttataaccagagttgccatgttatatgttagagccccagaacttatcaatcttacaactcagtttgtaacctt

SEQ ID NO: 7564 - DNA, 412 bp, Homo sapiens
  chr4.fa.O7frz.139139045
  Located on chromosome 4
  Distance between a terminus base of telomere on chromosomal short arm and 5'-terminus of this base sequence : 133273664
  Distance between 3'-terminus of neighbour sequence of sequence listing upward to telomere on chrosomal short arm and 5'-terminus of this base sequence : 176893
taggcagttgtcagctaaatagttttaagtttgcatattaaaagaaataactcaggtgaaagtaagatagcaaaatttacatcacaaattatagagagaaaaactttggtatgctagagggaaattaaaatggatttaattgccaattaaacatgaaattataaagtctttctaaatataaacacatacacacacacacacacacacacacacacacacacacacacacacacagagatcctacagcttttacttcagaactttagccacgagataaataaaaatttactgacagaaaacttgttggatccaaaatgtggtttttaacttaatagaaaaataacgccaaatttaaagcaggcagaaaagaaaatagagaaaaaaagagaacttacgaactgtagagtttgca

SEQ ID NO: 7565 - DNA, 284 bp, Homo sapiens
  chr4.fa.O7frz.140180323
  Located on chromosome 4
  Distance between a terminus base of telomere on chromosomal short arm and 5'-terminus of this base sequence : 133457362
  Distance between 3'-terminus of neighbour sequence of sequence listing upward to telomere on chrosomal short arm and 5'-terminus of this base sequence : 183286
ccaacagttgtagagaattatcagagaattatcatcagttgtctcctcaaacaatgcctctcattttctaataatttctaataattttattatatatatgtgtgtgtgtgtgtgtgtgtgtgtgtgtgcgcgcgcctcatctttttttacctgtgtctcctatgtcatgttttaaatatttcatctaggtttttttttccataaacattatgcgtgaatttttcagttctaatttctagtttgcttattttttattaaaatatgcttaattccttaatcagatc

SEQ ID NO: 7566 - DNA, 415 bp, Homo sapiens
  chr4.fa.O7frz.140310045
  Located on chromosome 4
  Distance between a terminus base of telomere on chromosomal short arm and 5'-terminus of this base sequence : 133610993
  Distance between 3'-terminus of neighbour sequence of sequence listing upward to telomere on chrosomal short arm and 5'-terminus of this base sequence : 153347
ttgacgtattgattctttgaagagaaagttagaactcatatctaacatacctaaaacaaagtatgttttatctttccaagaaaattcagtagtgatcttttgtatatattttctgcatttgctgtgaagcaaaaaatatatatgtaatgtgtgtgtgtgtgtgtgtgtaaaacgaaacctactgaaccaatggaagaaatgtcagacctaataagagaggatggaaattaagtctgtataaggcatgtaaatagtctttgagcaaaaattaccccatgaggcacaacatatctgtgtcactcatgtattctaaattatttgcttatatacactgagtaaatgatcattaaaagatatgtttggtatacatagagtattcattgattgacttggcttctagttctgcctctgctat

SEQ ID NO: 7567 - DNA, 129 bp, Homo sapiens
  DISD22_0003984
  Located on chromosome 4
  Distance between a terminus base of telomere on chromosomal short arm and 5'-terminus of this base sequence : 133771563
  Distance between 3'-terminus of neighbour sequence of sequence listing upward to telomere on chrosomal short arm and 5'-terminus of this base sequence : 160155
cagtgaattctatttcctgtacatctaataaatcaatcctatctatctatctatctatctaaataattcaacaatatgaagtagattaaaaaacacaactttatcttgatgtctaactactgtggaaat

SEQ ID NO: 7568 - DNA, 280 bp, Homo sapiens
  chr4.fa.O7frz.140614257
  Located on chromosome 4
  Distance between a terminus base of telomere on chromosomal short arm and 5'-terminus of this base sequence : 133906069
  Distance between 3'-terminus of neighbour sequence of sequence listing upward to telomere on chrosomal short arm and 5'-terminus of this base sequence : 134377
tcaatggtttatcctactgtctacttcctagaggaaaattataaatttacaataactgatccaaatacatttccagagttattttagctttcacagtgttggccagcacaatgtgttttttgtttgtttgtttgtttgtttgcttgcttccttggtttttaattgagaacattcccatagttgactatttcaatatttaattctccaatcttgtatttttggtttatcttgataaacatcaaataaggtggaggcagtttacgctgaatagacttaagaa

SEQ ID NO: 7569 - DNA, 223 bp, Homo sapiens
  Z67576
  Located on chromosome 4
  Distance between a terminus base of telomere on chromosomal short arm and 5'-terminus of this base sequence : 134010509
  Distance between 3'-terminus of neighbour sequence of sequence listing upward to telomere on chrosomal short arm and 5'-terminus of this base sequence : 104160
gtgtcccaaggcacacgaacacacagacggacagagagagaaagagagggcgaaggaaagagcgagaagggagagagagagagagacgtaagagagagacagaagtgggcacacagacacgcacgcgcggacgcgcacacacacacacacacacacacacccataacgcacacagacatacagcaggtaacacccacccccaggcagctcctgaagttgccgg

SEQ ID NO: 7570 - DNA, 304 bp, Homo sapiens
  chr4.fa.O7frz.140823787
  Located on chromosome 4
  Distance between a terminus base of telomere on chromosomal short arm and 5'-terminus of this base sequence : 134107666
  Distance between 3'-terminus of neighbour sequence of sequence listing upward to telomere on chrosomal short arm and 5'-terminus of this base sequence : 96934
ttaagtggagcgtatgttaagttttggggaaataacatcaaacaaaacacacataatctctacttacatggatatcaaatttgagaagagatgaagataaataaaatcactattatatttgaagcagattatatatgtgtgtgtatacactcacacacacacacacacacacacacacacgtacacatataaatgtatgcatacacacatcataccagacttctggatcagatataacttttatgatcaaaattgtcaagggtctgaatatatatctacatatagacatttggtgtttataggc

SEQ ID NO: 7571 - DNA, 201 bp, Homo sapiens
  D4S429
  Located on chromosome 4
  Distance between a terminus base of telomere on chromosomal short arm and 5'-terminus of this base sequence : 134225889
  Distance between 3'-terminus of neighbour sequence of sequence listing upward to telomere on chrosomal short arm and 5'-terminus of this base sequence : 117919
ggtgatccacctgcctcagcctcccaaagtgttgggattacaggcatgagccaccatgcccgtctatgtgatcttttcaacccactcctgtgttcaattttctactaaccgctacacatacacacacacacacacacacacacacacacacacatagacacacacacttaatattaatttttcagtgaaggtcagtggctt

SEQ ID NO: 7572 - DNA, 237 bp, Homo sapiens
  chr4.fa.O7frz.141036916
  Located on chromosome 4
  Distance between a terminus base of telomere on chromosomal short arm and 5'-terminus of this base sequence : 134391949
  Distance between 3'-terminus of neighbour sequence of sequence listing upward to telomere on chrosomal short arm and 5'-terminus of this base sequence : 165859
acctccaaacttaatattctgttcctccagaaccactcctgataccaaaatctgtattagtcagggttctctagagggacagaactaataacatttatatatatatatatatatatgagagcttattaagtattactttacatgatcacaaagtcccacaggaggctgtctgcaagccctaggagcaaggagagtcagtccaagtctcaaaactgaagaacttggagtctgatgttt

SEQ ID NO: 7573 - DNA, 371 bp, Homo sapiens
  chr4.fa.O7frz.141444072
  Located on chromosome 4
  Distance between a terminus base of telomere on chromosomal short arm and 5'-terminus of this base sequence : 134607133
  Distance between 3'-terminus of neighbour sequence of sequence listing upward to telomere on chrosomal short arm and 5'-terminus of this base sequence : 214947
gtgctagttggaataaatcataagcatgctgctcatcttatactaaaacaagcattcaaggaaaacaaaacaaaacaagaataaactcttttccttgtacacactttatttttccaatgagtcatatacatgaatagagcaacactttcattttcttattctctgttttataatacacacacacacacacacacacacacacacaaatactataattgccaaaagtaactgttattttgggcacataacatgctttaaactgttatgctttgggcaaaaatattgagagaactttttagagtaaataatgaacagcatgtcttttaactataaaacaaaataacctggttaaagtctgacacctgactaag

SEQ ID NO: 7574 - DNA, 419 bp, Homo sapiens
  AC011960.3_96173
  Located on chromosome 4
  Distance between a terminus base of telomere on chromosomal short arm and 5'-terminus of this base sequence : 134648927
  Distance between 3'-terminus of neighbour sequence of sequence listing upward to telomere on chrosomal short arm and 5'-terminus of this base sequence : 41423
ctctagcttacagaaggcatgtcatgggatttcttcactccataatcatgtgattcaattcccctcataaatttccttttgtgtatctatctatctatctatctatctatctatctatctatctatctatctacccatccattatctatctgtctatctatctatcatctgtctgtcttattggatctctttctctggagaaccctaatactcttggaaataatattctccaggaagggaaaatcaccaatttgtacaatccttttcttactactttggtaactttgggtgaagcattcggcttctaattcttttctcacttttgaaatcagatcaccttcagagggtatccattcttctttacttctctatgctattagttttaccacacttggccacctaaaggaaacctatgcttt

SEQ ID NO: 7575 - DNA, 174 bp, Homo sapiens
  DID22N_0023630
  Located on chromosome 4
  Distance between a terminus base of telomere on chromosomal short arm and 5'-terminus of this base sequence : 134765925
  Distance between 3'-terminus of neighbour sequence of sequence listing upward to telomere on chrosomal short arm and 5'-terminus of this base sequence : 116579
tggaagtcattccacatttgaaaataccatatttctgtgtgtgtgtgtgtgtgtgtgtgtgtgtgtgtgtacatgtattgtagcctagaaaaccagacttaaatcaaaatagggttatagtaaaaaatgcttatgaaaagtggaaagtagtttaattgacaagaacacagactt

SEQ ID NO: 7576 - DNA, 446 bp, Homo sapiens
  chr4.fa.O7frz.141566568
  Located on chromosome 4
  Distance between a terminus base of telomere on chromosomal short arm and 5'-terminus of this base sequence : 135089643
  Distance between 3'-terminus of neighbour sequence of sequence listing upward to telomere on chrosomal short arm and 5'-terminus of this base sequence : 323544
attggcttacatgaatcactatctcctttttctagctcatggacacccttcctgaatacatggaagaaataaggcaatgacacttggaataaaatgtgacttaaaacaataagaaatggacaataaaatagatgtatataggcaaatagctatgtcttcaatagggaagatcttaatatattattaaatcaacagtgttaattatattgattttactgttcaagtcttcaatacatttgtaaattttttggagggtttgctttatcagtttttggaggaaagagagagagattatgtgtgtgtgtgtgtgtgtgtgtgtgtgtgtgtgtgtgtgtgtagttttctataattatagatttacttatttcttctgggtattttgtccacttgattttgaacaaactgaattttgttagaaatataaaagttatggtagcaattatgcc

SEQ ID NO: 7577 - DNA, 378 bp, Homo sapiens
  chr4.fa.O7frz.142051184
  Located on chromosome 4
  Distance between a terminus base of telomere on chromosomal short arm and 5'-terminus of this base sequence : 135227838
  Distance between 3'-terminus of neighbour sequence of sequence listing upward to telomere on chrosomal short arm and 5'-terminus of this base sequence : 137749
ggtagatatttcctggtgaaacagttgtaaatgtactattgccttgtgagaaggtagttctcatgtgtaaatatataaatatatatatataaatatatatatttatatatatatttatatatttacacatatatacacaagattatatataatatataaatatatgtaaacaaatataaatatatatattttatataaatatatgtaaataaatataaataaataacttatttatttatatttatagataataaaaccggtttatttatttatttttgagacacagtcttgctctggtgtgcagtgctgtgatcctggctcactgcaacctcagcttcccgggttcaggcgattcttctgtctcagactaccaagtag

SEQ ID NO: 7578 - DNA, 444 bp, Homo sapiens
  chr4.fa.O7frz.141927874
  Located on chromosome 4
  Distance between a terminus base of telomere on chromosomal short arm and 5'-terminus of this base sequence : 135266043
  Distance between 3'-terminus of neighbour sequence of sequence listing upward to telomere on chrosomal short arm and 5'-terminus of this base sequence : 37827
acaaattgcacttaagcaatacatgaacaaaaaatgatttatggatttttacaatggtctgagcaaatgaaagcaacatgaattatacatcctaatgctcacaatatcattttctaataatactgtttcagttcagatactatactctgctcctttctgtaagagaaattgatcaataagaggtccaggaatgtttttaaattgggcactggtttgtgatactgattccaaagtgtgtgtgtgtgtgtgtgtgtgtgtgtatacatatgcatatatatatgtgtgtgtgtgcatatattttcttttggttttggggaggtgggttgatgacagacattgaacatgcattcttgtcagattcttcacgtattgtgtcttttggtagtaaatagtcctttgaaaacttttgtttgttccatactatctttcagaatgcagataaat

SEQ ID NO: 7579 - DNA, 154 bp, Homo sapiens
  D4S2420
  Located on chromosome 4
  Distance between a terminus base of telomere on chromosomal short arm and 5'-terminus of this base sequence : 135508577
  Distance between 3'-terminus of neighbour sequence of sequence listing upward to telomere on chrosomal short arm and 5'-terminus of this base sequence : 242090
aatgcttatctaccaatgagtggataaagaaaatgttatatatatatataaacatagatagatagatagatagatagatagatagataccatgaatactacccagccataaaaaggagcaaaataatgtcttttgcagcaacttagatggagct

SEQ ID NO: 7580 - DNA, 417 bp, Homo sapiens
  chr4.fa.O7frz.142280992
  Located on chromosome 4
  Distance between a terminus base of telomere on chromosomal short arm and 5'-terminus of this base sequence : 135583772
  Distance between 3'-terminus of neighbour sequence of sequence listing upward to telomere on chrosomal short arm and 5'-terminus of this base sequence : 75041
tcagtcaagtaggctatttacaacaaacatgagtggcttactttataactgccatatttttcccttgaaaacacacacaccacacacacacacacacacacacacacacacacacacacactttggcatcattaattttctttatattttcttaatttctatttaattgatttttaaaataatttattatatccttctacttacttttcatttaattttcactttttaaaacaattttctaagcctggatctcataatgatttgagattctattcttttctaataatataagtctttaaatttataagcttccaagagctgctttaggctcatcctacaaatttcaatatgctttatttttatcatttggcttgaaatgttttctacctcctcttgtgatttcttatttgatccatg

SEQ ID NO: 7581 - DNA, 253 bp, Homo sapiens
  chr4.fa.O7frz.142488759
  Located on chromosome 4
  Distance between a terminus base of telomere on chromosomal short arm and 5'-terminus of this base sequence : 135611395
  Distance between 3'-terminus of neighbour sequence of sequence listing upward to telomere on chrosomal short arm and 5'-terminus of this base sequence : 27206
tacaccagtagactggaaacagattaaaaaaaaaaaaggcagtgagcttaatgataggtgaacagaaatttcccaaactaaaatctaagtttatgtgtgtgtgtgtgtgtataattatatatatgcacattatatatatatacatatatatatatatatatagagagagagagagaaatttcaaaccaaacatccaagaactatgagacaatttcaaaaggcatatcacatgtgcaattggaataccatagta

SEQ ID NO: 7582 - DNA, 233 bp, Homo sapiens
  chr4.fa.O7frz.142394363
  Located on chromosome 4
  Distance between a terminus base of telomere on chromosomal short arm and 5'-terminus of this base sequence : 135628241
  Distance between 3'-terminus of neighbour sequence of sequence listing upward to telomere on chrosomal short arm and 5'-terminus of this base sequence : 16593
tgttaaatgtgagcttattcctaggaaatgcatattcgtgtgtgtgtgtgtgtgtgtgtgtgtgtgtgtgtgtgtgtgatgagaaatatataaatgatattctgctacagatgttaaaataaagaaattgactccattttttgatgtttgttgacagcttttaagctgtcagtggaaagcaggagtgctctctcctctggtgttgatgggaggttcaaatcatttaagctact

SEQ ID NO: 7583 - DNA, 446 bp, Homo sapiens
  chr4.fa.O7frz.142876029
  Located on chromosome 4
  Distance between a terminus base of telomere on chromosomal short arm and 5'-terminus of this base sequence : 136330815
  Distance between 3'-terminus of neighbour sequence of sequence listing upward to telomere on chrosomal short arm and 5'-terminus of this base sequence : 702341
atctatcctcatccatgtacatacatctccaaattatacttaaaggttcgtcggaaagttgagtaaagtcttatcatacaagacaaggatgaaagaaaaaaaaagaaaaattaattagagaaaagcagaaacaatttaggaaacaaactatatatatatatatatatagtgtgcgtgtatatatagtgtgtatatatgtatatatacacacatgtacacatacacacacattatttgcaaatacatttaattattttatattctcagaaagaaaatacttacataagtttatgttcacctatatacaaattattatcctcagggagataatagaacatatggcactgatgaaatatgaacaagatatcataaaattaataataatcagaaatagaactatagaaataatattatagaaaaattttaacaaagttcaatagaacggt

SEQ ID NO: 7584 - DNA, 120 bp, Homo sapiens
  DISO7_10001598
  Located on chromosome 4
  Distance between a terminus base of telomere on chromosomal short arm and 5'-terminus of this base sequence : 136419277
  Distance between 3'-terminus of neighbour sequence of sequence listing upward to telomere on chrosomal short arm and 5'-terminus of this base sequence : 88016
ttggtagtcaatgttcagaaattacagtgtgtgtgtgtgtgtgtgtgtgtgttgttgttgttgttgttgttttttcctagaagaagatgttaaaataagtgtttgaatgcaattaattgg

SEQ ID NO: 7585 - DNA, 143 bp, Homo sapiens
  DISO7_10001603
  Located on chromosome 4
  Distance between a terminus base of telomere on chromosomal short arm and 5'-terminus of this base sequence : 136737491
  Distance between 3'-terminus of neighbour sequence of sequence listing upward to telomere on chrosomal short arm and 5'-terminus of this base sequence : 318094
gttaatccatgtgccgtgatttgccgaggatttttttaaaatagtgcatgaaaatattatatcgatagatagatagatagatagatagatagatagatagatagataaactgtgtttcagtgccctgttaaatgttgcctcaa

SEQ ID NO: 7586 - DNA, 126 bp, Homo sapiens
  D4S2346
  Located on chromosome 4
  Distance between a terminus base of telomere on chromosomal short arm and 5'-terminus of this base sequence : 136833138
  Distance between 3'-terminus of neighbour sequence of sequence listing upward to telomere on chrosomal short arm and 5'-terminus of this base sequence : 95504
tagggtcctccaaagaacagactaattatgtgtgtgtgtgtgtgtgtgtgtgtgtgtgtatagagagagagagagcgagagagagagatctattacatggaattgactctaatgaccatggaagct

SEQ ID NO: 7587 - DNA, 307 bp, Homo sapiens
  chr4.fa.O7frz.143638010
  Located on chromosome 4
  Distance between a terminus base of telomere on chromosomal short arm and 5'-terminus of this base sequence : 136944441
  Distance between 3'-terminus of neighbour sequence of sequence listing upward to telomere on chrosomal short arm and 5'-terminus of this base sequence : 111177
gaggaatactttattgtccgaggtatgcctgtatctgtatctatatccactatcctatctatctatctatctatctatctatctatctatctatgtactgtgtgtgtataaacacacacacacacacacacacacacacacatgtatatggcttgaaattctctatctagtagtcatgttgtttatttgactttatttgctgtccttcacacccagtccagaaacaaatcgtataatggtgtcttatcattctttctcctcagcaacattagagaacttaccactttagtgaccttgctagtgatag

SEQ ID NO: 7588 - DNA, 348 bp, Homo sapiens
  chr4.fa.O7frz.143944303
  Located on chromosome 4
  Distance between a terminus base of telomere on chromosomal short arm and 5'-terminus of this base sequence : 137260033
  Distance between 3'-terminus of neighbour sequence of sequence listing upward to telomere on chrosomal short arm and 5'-terminus of this base sequence : 315285
ttcgttcctgagcctagtaaaaaccatagccaacaagaaaaaataattagagatgctaaaatcctccaaggcattacaaaatgaaatctcagttaatttgaaattattattaattttcaattatctacaaaatccttgcttcctttgcagtgtgtgtgtctgtgtgtgtgtgtgtgtgtgtgtgtgtgtgtgaataaaccatatctaattgaagccttgattgactagttagtagatgtttcatatgacatatgcatatccatattgcatatactgactacacattactatgaaattttaagtatattttaattatgttaataaagaaacattattctttcatttacg

SEQ ID NO: 7589 - DNA, 198 bp, Homo sapiens
  chr4.fa.O7frz.144258562
  Located on chromosome 4
  Distance between a terminus base of telomere on chromosomal short arm and 5'-terminus of this base sequence : 137497397
  Distance between 3'-terminus of neighbour sequence of sequence listing upward to telomere on chrosomal short arm and 5'-terminus of this base sequence : 237016
tggactcagactgaattatatcaccagcatccctggttctccagcttacagatggcagatggtgggactttttactctcaatcattgtggaagccaattcccataacaaatctcctgttacatctatctatctatctatctatctatctatctatctatctatctatcatctatccatcgacctatctaatcacctct

SEQ ID NO: 7590 - DNA, 302 bp, Homo sapiens
  chr4.fa.O7frz.144345686
  Located on chromosome 4
  Distance between a terminus base of telomere on chromosomal short arm and 5'-terminus of this base sequence : 137568921
  Distance between 3'-terminus of neighbour sequence of sequence listing upward to telomere on chrosomal short arm and 5'-terminus of this base sequence : 71326
attagtctccaatttcatccaggtgttgcaaatgccattatttcattcatttttatggctgggtaatgtaccatcatatatatatatatatatatatatatatatatatatatatatatacacacacacacacacacacacacacacacatacacacacaatatgttgaacgtttttatttttatatataaatatgatatatatatatcacatttgctttattcattgattgatgggcatttgggctggtttcatatttttgcaattacaaattgtgctgctataaacatgcacgtgaaagt

SEQ ID NO: 7591 - DNA, 426 bp, Homo sapiens
  chr4.fa.O7frz.144375414
  Located on chromosome 4
  Distance between a terminus base of telomere on chromosomal short arm and 5'-terminus of this base sequence : 137609375
  Distance between 3'-terminus of neighbour sequence of sequence listing upward to telomere on chrosomal short arm and 5'-terminus of this base sequence : 40152
actggtgagaagtctaatccacacaagcctggtcctatacatgaatgtgaaacctcaccccttaacccagtaaataaccaagacagttaaagctaaattgggtctaaagcctgaccccattaatacagtgtattcttattgctcctgctcattctcttgttatttttaagtctgcttagaagtcttcccagatcttcttggaaaacctcactctgctataaatttattgtgtgtgtgtgtgtgtgtgtgtgtgtgtgtgtgtgtgatcatctgtcttgacatatgaactacttttgaatgagaaaaccattctgcctctgcggtgtgaccacaacaataattactgataatttatattgatatcaagatagaattaattatttcacattaaaatgtgtgtttgttcctatgctattgagttatcaa

SEQ ID NO: 7592 - DNA, 434 bp, Homo sapiens
  chr4.fa.O7frz.144455334
  Located on chromosome 4
  Distance between a terminus base of telomere on chromosomal short arm and 5'-terminus of this base sequence : 137693392
  Distance between 3'-terminus of neighbour sequence of sequence listing upward to telomere on chrosomal short arm and 5'-terminus of this base sequence : 83591
atagctggccagtaataagaacaagtaacaatctggacttgggacaggcacctcaagtgagaattgtgtgtgtttgtgtgtgtgtgtgtgtgtgtgtgactgagcttttaacctataggattaggttgatagtgtcagaattgcatccagttgtaggacatccagctggtgtaggataattggttagtgttggttaccaaatcttttggtagagagaagtatattataccagagtacagagataagtagtttttttttaatatatttaagaagttaaacttatagagacaaaaagtagaatggtggttgccagggtctgggagaagaggtgaatggagaattgctgtttaatagaagcagagttttagttttacaagataaaaggagttatggaaataatgcttgtgatggtcgtgtaacattatggatgtatt

SEQ ID NO: 7593 - DNA, 198 bp, Homo sapiens
  DISD22_0004017
  Located on chromosome 4
  Distance between a terminus base of telomere on chromosomal short arm and 5'-terminus of this base sequence : 137791948
  Distance between 3'-terminus of neighbour sequence of sequence listing upward to telomere on chrosomal short arm and 5'-terminus of this base sequence : 98122
ggagaggctagaaatgaatagaagtaactacaacaaagtatgtgtgtgtgtgtgtgtgtgtgtgtgtgtgtgtgttaaattgaaggtgagataatttgtacatctagatagaagtatgagatctgatggttaagtgtagattagaaaaaaaggaagagacaaaaagcagaatgaagtgagagaggctcacaaggttga

SEQ ID NO: 7594 - DNA, 81 bp, Homo sapiens
  D4S422
  Located on chromosome 4
  Distance between a terminus base of telomere on chromosomal short arm and 5'-terminus of this base sequence : 138262225
  Distance between 3'-terminus of neighbour sequence of sequence listing upward to telomere on chrosomal short arm and 5'-terminus of this base sequence : 470079
cgcaagactccgtctcaaacacacacacacacacacacacacacacacacacacacaaacaatctcccaaattttacttca

SEQ ID NO: 7595 - DNA, 240 bp, Homo sapiens
  D4S2429
  Located on chromosome 4
  Distance between a terminus base of telomere on chromosomal short arm and 5'-terminus of this base sequence : 138348965
  Distance between 3'-terminus of neighbour sequence of sequence listing upward to telomere on chrosomal short arm and 5'-terminus of this base sequence : 86659
ttgaggactcaaaagtcatgcattgatttttgactgtgtggggggttccgcatccctacccctgtgttgctcaagggtcagttgtatataaatcctacttctgttgtttctccagggaatcacgactaataaagatggatggatgggtgaatagacagatgaatagatagatagatagatagatagatagatagatagatagatatgtagacagatgatagataagttggtagagcaaag

SEQ ID NO: 7596 - DNA, 388 bp, Homo sapiens
  chr4.fa.O7frz.145122787
  Located on chromosome 4
  Distance between a terminus base of telomere on chromosomal short arm and 5'-terminus of this base sequence : 138541842
  Distance between 3'-terminus of neighbour sequence of sequence listing upward to telomere on chrosomal short arm and 5'-terminus of this base sequence : 192637
tacaaggatcaaccatagacaggagttttgagaccaacctgggcaaaacagcaaaactctgtctttacacacacacacgcacacacacacacacaattagtcaggcatggtggctcacacctgtagtcccagctactaaggacgctgaggtgggaggatcacttgaaccgaggagtttgaggttgcagtgaaccatgattatcccaccatactccagcctaggcaatagagtgagactttgtctctctaaatgataatacaaacaataataataataaagctggcaaggtacagataggcaaactttccatattccatgttctcactcatttgtggcatctcaaacagttgaactcatggagagagacagtagaatgacggttatcag

SEQ ID NO: 7597 - DNA, 463 bp, Homo sapiens
  chr4.fa.O7frz.145250523
  Located on chromosome 4
  Distance between a terminus base of telomere on chromosomal short arm and 5'-terminus of this base sequence : 138589922
  Distance between 3'-terminus of neighbour sequence of sequence listing upward to telomere on chrosomal short arm and 5'-terminus of this base sequence : 47692
acaaccaatgttacatagtgactccaaagtgtgccagaaaactaaattttggttcactgccaagaagagtttgaatttttcattattttaattttccaaatatttccccatgtttggtatttgtgtgtctcagttgtcttctcaggctgccataacaaaattccagagactcggtagttgaaacaagagaaatttatgttctcacagttctggcaggttggaagtccaaggtcaaggtgctggccaattcagttcctgatgagggctctgtttgtggcttgtagatggtggcctatccatctcactctgtcctcaaataggagagagagagagacagagagagggggagagagagagagagagagagagagaaagaaacagctgtttgctatctctttttataagggcattaatcccatcatgaaagcctactctcattatctcatgtgaacctaattatgtc

SEQ ID NO: 7598 - DNA, 396 bp, Homo sapiens
  chr4.fa.O7frz.145378143
  Located on chromosome 4
  Distance between a terminus base of telomere on chromosomal short arm and 5'-terminus of this base sequence : 138705405
  Distance between 3'-terminus of neighbour sequence of sequence listing upward to telomere on chrosomal short arm and 5'-terminus of this base sequence : 115020
ttctggatgttagacatctgacctcgaggtacggacaggcgtggttacttctgaagtccagatctctcccatggcttctggaggtttgcgggcaatctttgggactcctgggcctggagaaacatcaccctcatctccgctttcatgtttatatggcattcaccgtgtgtgtgtgtgtgtgtgtgtgtgtgtgtgtgtgtgtgtgtgttttccaaatttcccctattttaaaaaaaataagatcaatcatattaggatccaccataatgacatagagagcagcaggagactgtcaaatgcctatgcagagaggagcgggcccctggtgaaaccctacctctgagccaaagatagtttaaagcctgagagccaaggtacaaattaaatccttggacc

SEQ ID NO: 7599 - DNA, 435 bp, Homo sapiens
  chr4.fa.O7frz.145579709
  Located on chromosome 4
  Distance between a terminus base of telomere on chromosomal short arm and 5'-terminus of this base sequence : 138872663
  Distance between 3'-terminus of neighbour sequence of sequence listing upward to telomere on chrosomal short arm and 5'-terminus of this base sequence : 166862
gtggctaaacatcaagttataactcatgatatatttatgtttcctaggttcacctataattaatattttttaactatattattaattggaaaaaataaacaataagatatatcttgagcttactttttaaactgtgcttgattccagtgctcccccttctacccaatatgtggagaagaagaagaggaagaaaaggaagaagaaggatgaagaagaaggaggaagaagaaggaggaagaacaagaaaagaagaagaggaagaggaagagaaagaagaagaagaagaagaagaagaagaagaagaagaagaagaagaagaagaagaagaagaagagccaaatagcttcatcccatactgctcaccttttctagatttttggttttgcttcattaccaacatccaaaaaaagtgaattgaataaggtagcttctgtt

SEQ ID NO: 7600 - DNA, 196 bp, Homo sapiens
  chr4.fa.O7frz.145690515
  Located on chromosome 4
  Distance between a terminus base of telomere on chromosomal short arm and 5'-terminus of this base sequence : 138990094
  Distance between 3'-terminus of neighbour sequence of sequence listing upward to telomere on chrosomal short arm and 5'-terminus of this base sequence : 116996
tgaggttatactggatcaaagtaggccctactctgatgactaaagtaataagtgaaatgaaatttataaacacacacacacacacacacacacggagaatgctatttgacaacactgggcagaaattggagtgaggcagctgtcaagaaagtacaaggattgcagcagacaccagaagctaggagaacaaattctg

SEQ ID NO: 7601 - DNA, 236 bp, Homo sapiens
  Z67103
  Located on chromosome 4
  Distance between a terminus base of telomere on chromosomal short arm and 5'-terminus of this base sequence : 139088538
  Distance between 3'-terminus of neighbour sequence of sequence listing upward to telomere on chrosomal short arm and 5'-terminus of this base sequence : 98248
aatggcttatctagtgcttttctgaggttaacaactggttttaatcacccttttctgatttatatgacattacaaataattttggaaattgtagataatttgtcatagtactaaaagtttgtatgcaaggggtgtgtgtgtgtgtgtgtgtgtgtgtgtgtcacagagagagagagagagggaaagagaaagagaaattgatgaataaatctaattaatcaatttggtcctgtaca

SEQ ID NO: 7602 - DNA, 457 bp, Homo sapiens
  chr4.fa.O7frz.145803877
  Located on chromosome 4
  Distance between a terminus base of telomere on chromosomal short arm and 5'-terminus of this base sequence : 139233607
  Distance between 3'-terminus of neighbour sequence of sequence listing upward to telomere on chrosomal short arm and 5'-terminus of this base sequence : 144833
aactcgttaaccagaacctaatctgctacaggtgtggtggctcacacctgtaatcctagcactttgggaggccaagatgggtgggttatttgaggtcaggagttggagaccagcctgtccaacatagtgaaatccaatctctactgaaaatacaaaatagtatttacaaatacaaaatagtggtgcatgcctgtagttccagctactcgggaggctgaggcaggagaatacttaaacccaggaagtggacgttgcagtgagccaagattgcacaatttgtactccagcctggacaacagagcgagactctatcacacacacacacacacacaaaaagtcaacagcaagcaaaaacagatgagcaatgtgagcagagcaatgaaaatcctgagagagaatcgaaagaaataatagaggtaaaaaaacaaaaataaaattgtaacagaaatgaagactg

SEQ ID NO: 7603 - DNA, 294 bp, Homo sapiens
  chr4.fa.O7frz.146059051
  Located on chromosome 4
  Distance between a terminus base of telomere on chromosomal short arm and 5'-terminus of this base sequence : 139319964
  Distance between 3'-terminus of neighbour sequence of sequence listing upward to telomere on chrosomal short arm and 5'-terminus of this base sequence : 85900
atcaaacattcctttgactagagggtgaatgttgtcaaaagtaatgaaagctggccagattttatgtatgaggcagttttcatccacacaaaccaaaaagaagaggcaaatatatatatatatataatatatatatatcacatagatgatatatatgtgatatatatatgatattcaattcaatatattctatatatatgatattcaaaattactttatttggatttgaaattaaggtcactttagtgttccatgctgcaagtgctaaataactgcatagcaacagaatagtct

SEQ ID NO: 7604 - DNA, 119 bp, Homo sapiens
  DISD22_0004047
  Located on chromosome 4
  Distance between a terminus base of telomere on chromosomal short arm and 5'-terminus of this base sequence : 139629874
  Distance between 3'-terminus of neighbour sequence of sequence listing upward to telomere on chrosomal short arm and 5'-terminus of this base sequence : 309616
ggtttctgaggcttacaaccaaaatatatatatatatatatatatatatataattttatatatttttatatgtggatatatatttttatatatggcacatttaatgattaagttatgca

SEQ ID NO: 7605 - DNA, 275 bp, Homo sapiens
  chr4.fa.O7frz.146669732
  Located on chromosome 4
  Distance between a terminus base of telomere on chromosomal short arm and 5'-terminus of this base sequence : 139709644
  Distance between 3'-terminus of neighbour sequence of sequence listing upward to telomere on chrosomal short arm and 5'-terminus of this base sequence : 79651
gaaccattatgttacagcaagtctttatcactttctcctgaaaaattgaatgcttcgtgtgaatgtaattttactcaatcctgaataaactcgtctgcctagtattgatggtctgcaatctcttaagttatatatatatatatatatatatatatatatatatatacatacatacatacatacacacacacaggttaaggtaaaacctttgatgtatatgtataaagaccagagcaagaataaaccactgtggaacctatggtttaacatgaggt

SEQ ID NO: 7606 - DNA, 477 bp, Homo sapiens
  chr4.fa.O7frz.147022603
  Located on chromosome 4
  Distance between a terminus base of telomere on chromosomal short arm and 5'-terminus of this base sequence : 140178078
  Distance between 3'-terminus of neighbour sequence of sequence listing upward to telomere on chrosomal short arm and 5'-terminus of this base sequence : 468159
aatacaaatagccttggttgtctttcatatgacaattattttgtaacataaattctaaaatcaatattttctcaattttattttataattaaaatcaatgatatggatcagttgcacaataatatgaatagacttaacactactggactgtacacttaaaaatagttaagatcatcaattttatgttatgtatttttagcacaattaaattttaaaaaaatttttaataagcaacaataatttagaaaagtttctttcagcttcactattcattattggtaatgtacctttttaggattgttgcgaaattgggccaaactgctatataagtgaagctcttttgagtttggctgtgcaataaaacacataataataataataataataataataataataataatcttaaacactccagattgttgactctttttaactagtttgatgttgatggtctcactgtagctgtgcataagt

SEQ ID NO: 7607 - DNA, 424 bp, Homo sapiens
  chr4.fa.O7frz.147101983
  Located on chromosome 4
  Distance between a terminus base of telomere on chromosomal short arm and 5'-terminus of this base sequence : 140250302
  Distance between 3'-terminus of neighbour sequence of sequence listing upward to telomere on chrosomal short arm and 5'-terminus of this base sequence : 71747
ttcatgaccaaactttattcaggcttctctgagcccacttctcaattaggcctcaactttggcctataagaactgcaaatttcagcacagtttcatccacctgacccccagacacacacacacagacacacacacacacacacacacacacacacacacaaagagacttgaacaaaccctagcatagtttttattcgctcaaggccatttccctagtatgacaattgacaattccagccctcttaaaatgccttcctgagacagttcaatgctgccaaaaggccatttccctaggatgacaatcccagctccccttaaaatgccttcctgagacagttcactgctgccaaatgaatttactgtttgttcaggccaaaacctgactataagccctgagtccctttccttacagcatgtactttag

SEQ ID NO: 7608 - DNA, 358 bp, Homo sapiens
  chr4.fa.O7frz.147275845
  Located on chromosome 4
  Distance between a terminus base of telomere on chromosomal short arm and 5'-terminus of this base sequence : 140338265
  Distance between 3'-terminus of neighbour sequence of sequence listing upward to telomere on chrosomal short arm and 5'-terminus of this base sequence : 87539
gaggaactttaagtcctttctaactaaatttctattcagatatactcgtagtgggcaaggggcatcaggagatggtagcctggtgactacttactataaaaggatataggtaatgctctaaggttagattatatttttaaaaacctctgatacatattattctatcaatgagaatttccatttatatggaagaaaattcattgatagtagaaagaaagtttgcaacaataattaaccgtatacactcaatgaaccttactcagtttccattagcattttcatgcgcgcgcgcgcgcgcgcgcgcgcatgtgtgtgtgtgtgtgtgtgtaggtaggtaggtagttctatgcagtttgat

SEQ ID NO: 7609 - DNA, 369 bp, Homo sapiens
  chr4.fa.O7frz.147425382
  Located on chromosome 4
  Distance between a terminus base of telomere on chromosomal short arm and 5'-terminus of this base sequence : 140562129
  Distance between 3'-terminus of neighbour sequence of sequence listing upward to telomere on chrosomal short arm and 5'-terminus of this base sequence : 223506
ataatctagtcaatgccacctcaaattttctgtgtaaagaggtggaatgactaaatgggaggagatgataaatgactaaaggggagatagataggtagatagatagatagatagatagatagatagatagatagatagatagacagacagacagacagacagatagataacagaaagatagaaaaatgtattaataagaatttctaatacatatataacattttattattacaaactaaactttaaaagtcacggggtctccagacagacggtggaatggtggttgctaggggttggggaagaggcagaatgggagagttttcttgtttagcagatagagttttcgttgtacaaggaaactgagttatg

SEQ ID NO: 7610 - DNA, 320 bp, Homo sapiens
  DISO7_00016949
  Located on chromosome 4
  Distance between a terminus base of telomere on chromosomal short arm and 5'-terminus of this base sequence : 140638740
  Distance between 3'-terminus of neighbour sequence of sequence listing upward to telomere on chrosomal short arm and 5'-terminus of this base sequence : 76242
caactgcttctaaagctgacacgaaggcaccagagccagggatggggctttccgtcctcagctcctttctttgcttcccttacccctctcgcatccctgatttccttctcaccagtgaactgattctctcatgcatggtccctgctcacatggaagatttttctgttcctaccggctgtgtatgcatatgtgtgtctctgggttgtgtctgtgtgtttatgtgtctgtctcctctctctctctctccacacacacacacacacacacacacacacacacacacacacacacacaagaacacacaatgaagctcattgcct

SEQ ID NO: 7611 - DNA, 267 bp, Homo sapiens
  chr4.fa.O7frz.147606547
  Located on chromosome 4
  Distance between a terminus base of telomere on chromosomal short arm and 5'-terminus of this base sequence : 140847584
  Distance between 3'-terminus of neighbour sequence of sequence listing upward to telomere on chrosomal short arm and 5'-terminus of this base sequence : 208524
agacgatcctggctaagacggtgaaaccccatctctactaaaaatacaaaaaaattagccgggcgtggtggcaggcgcctgtagtcccagctacttgggaggctgaggcaggagaatggcgtgaacccggaaggcggagcttgcagtgagccgagatcgcgccactgcactccagcctgggcgagagggcgagactctgtctcaacaaacaaacaaacaaacaaacaaacaaacaaaaccaaaatacagatctagtaaattggcaac

SEQ ID NO: 7612 - DNA, 171 bp, Homo sapiens
  D4S2972
  Located on chromosome 4
  Distance between a terminus base of telomere on chromosomal short arm and 5'-terminus of this base sequence : 141003249
  Distance between 3'-terminus of neighbour sequence of sequence listing upward to telomere on chrosomal short arm and 5'-terminus of this base sequence : 155398
tttttaatatccaacctcacttgtgtgtgtgtgtgtgtgtgtgtgtgtgtgtgtgtgagacaaggacttactctgtcactcaggctggagtgcagtggtgtaatcatgactcactgaagccttgacctcccaggcttaagcaatcctcccacctcagcctcctgagtagct

SEQ ID NO: 7613 - DNA, 280 bp, Homo sapiens
  DISO7_10004981
  Located on chromosome 4
  Distance between a terminus base of telomere on chromosomal short arm and 5'-terminus of this base sequence : 141113433
  Distance between 3'-terminus of neighbour sequence of sequence listing upward to telomere on chrosomal short arm and 5'-terminus of this base sequence : 110013
tgatattgctatgagaaatatagccatgtgcctatagttccaactatataggaggctgaggtgggaggatcacttgaatctaggagttcaaggctgcagtacactgtgagctatgatcatgcctgtgaatagccattgtactccagcctgggagacatagcaagactctgtctcttaaaaaaaaaaaaaagaaaagtagcacacacacacacacacacacacacacacacacacacacacacacgaaatatagaaaaatccagttggattctacaaggat

SEQ ID NO: 7614 - DNA, 319 bp, Homo sapiens
  AC019049.4_15222
  Located on chromosome 4
  Distance between a terminus base of telomere on chromosomal short arm and 5'-terminus of this base sequence : 141378951
  Distance between 3'-terminus of neighbour sequence of sequence listing upward to telomere on chrosomal short arm and 5'-terminus of this base sequence : 265238
ggattacctgaagtcaggagttcgagaccaccctggccaacgtggtgaacccttgtctctactaaaaatacaaaaattagctgggcgtgatggcaggcacctgtaatcccagctactcaggacactgaggcaggagaatcgcttgaacccgggaggaggaggttgcagtgaaccgagatggtgccactacactccaacctgggcaacagagcgagactccgtctcaaaacaaaacaaaacaaaacaaaacaaacaaacaaaaaaacacatctgtttctcatgttctttaagatgtggctagattcctacctttccatcc

SEQ ID NO: 7615 - DNA, 442 bp, Homo sapiens
  chr4.fa.O7frz.148274882
  Located on chromosome 4
  Distance between a terminus base of telomere on chromosomal short arm and 5'-terminus of this base sequence : 141406463
  Distance between 3'-terminus of neighbour sequence of sequence listing upward to telomere on chrosomal short arm and 5'-terminus of this base sequence : 27193
gtcatgtgatgctatactggagtcaggctggaatttggtgtcttatttctacaaaaagtcttaagtgttagattttttaaagggaaggtggggttcaagaaagacacagagagagagagagagagaggagggggagggggtagagggggagagggagagagagagaggctttacaacaacacaggtttattacaaaaacctgtggaggtgggggaccagcttaatgccagagcccgccattgcttacaggctggggtatgtacaggtatgggcaggagggttttgggcagtatggcttgctgccctggaggatattgataagatgttcttatgttcaggtggtttggccagggatattccttgggctctgtcaggatttgatagggatatttcttcagttgggtctttgcttggcagggtatgataaagatgttcctgtgtc

SEQ ID NO: 7616 - DNA, 462 bp, Homo sapiens
  AC044906.2_98329
  Located on chromosome 4
  Distance between a terminus base of telomere on chromosomal short arm and 5'-terminus of this base sequence : 141509788
  Distance between 3'-terminus of neighbour sequence of sequence listing upward to telomere on chrosomal short arm and 5'-terminus of this base sequence : 102883
gataccatgatctatttccagaactttttcatcttaaacagaaactctgtacccattaagcagcctgcctttctttgcttttttcttttctttttaatctatctatctatctatctatctatctatctatctatctatctattttttgttaggagcattttaactgctgttatgggtattgatacaaatttggaaaggaatgtgattaatatgcatgatggagaaaatcctgacagaaaaaaattaaagatgagtttcagaggctggtaggagaactattataagcaggcctttataaccttgagtctaaaactaccatgaaaataaaatataattttacaaaataagtgaagggaaaaatatctgtattagggcaactgcagatcttttatgctccttccctacatacatccctgaggctgaggtgagaattaataagtttacaaggctactcaagtcaaa

SEQ ID NO: 7617 - DNA, 341 bp, Homo sapiens
  HUMUT1264
  Located on chromosome 4
  Distance between a terminus base of telomere on chromosomal short arm and 5'-terminus of this base sequence : 141509835
  Distance between 3'-terminus of neighbour sequence of sequence listing upward to telomere on chrosomal short arm and 5'-terminus of this base sequence : -415
tgtacccattaagcagcctgcctttctttgcttttttcttttctttttaatctatctatctatctatctatctatctatctatctatctatctattttttgttaggagcattttaactgctgttatgggtattgatacaaatttggaaaggaatgtgattaatatgcatgatggagaaaatcctgacagaaaaaaattaaagatgagtttcagaggctggtaggagaactattataagcaggcctttataaccttgagtctaaaactaccatgaaaataaaatataattttacaaaataagtgaagggaaaaatatctgtattagggcaactgcagatctt

SEQ ID NO: 7618 - DNA, 146 bp, Homo sapiens
  D4S1579
  Located on chromosome 4
  Distance between a terminus base of telomere on chromosomal short arm and 5'-terminus of this base sequence : 141539869
  Distance between 3'-terminus of neighbour sequence of sequence listing upward to telomere on chrosomal short arm and 5'-terminus of this base sequence : 29693
cccccaccttcctgactcccacctggtttgctgtgtgaagaaagcacaggggtggtcagttgttgggctgattaaagaaatacacatttatacctgcacgtacacacacacacacacacacacacacacacacacggatgctccag

SEQ ID NO: 7619 - DNA, 199 bp, Homo sapiens
  G09937
  Located on chromosome 4
  Distance between a terminus base of telomere on chromosomal short arm and 5'-terminus of this base sequence : 141619970
  Distance between 3'-terminus of neighbour sequence of sequence listing upward to telomere on chrosomal short arm and 5'-terminus of this base sequence : 79955
gaggtcctaagggagaccaatttgaagtctgatttgagtgctgttgctgctgctgctgctgctgctgctgctgctgctgctgctgctgctgctgctgctgctgttgctgttgctgtttctgctgcatgagtttggccctttgttgctgctgtgcagccatctgtttgagctgttctgctggagacatgtcagagctggg

SEQ ID NO: 7620 - DNA, 210 bp, Homo sapiens
  D4S397
  Located on chromosome 4
  Distance between a terminus base of telomere on chromosomal short arm and 5'-terminus of this base sequence : 141676871
  Distance between 3'-terminus of neighbour sequence of sequence listing upward to telomere on chrosomal short arm and 5'-terminus of this base sequence : 56702
agggaggtcatcagttcattgagggtcaagaaatactacacttctaaaactaccttatatcaacccttgatgtttcaaaaggaaaacaaaaatagcacccaaatttctccaggcagagtaagccacacacacacacacacacacacacacacacacacactctctctctctctctctctctctctctttagaaaagcaaagtttgcaaca

SEQ ID NO: 7621 - DNA, 342 bp, Homo sapiens
  chr4.fa.O7frz.148781336
  Located on chromosome 4
  Distance between a terminus base of telomere on chromosomal short arm and 5'-terminus of this base sequence : 141792283
  Distance between 3'-terminus of neighbour sequence of sequence listing upward to telomere on chrosomal short arm and 5'-terminus of this base sequence : 115202
ctaggatgtatggaaaccagagctggcccaaatgtgcttttaacacacatgaattaaactatgccttctggtttgttaaataaaaaagaaaaagaaaaaagtgtgtatatatatatatatatatttttttttaagccttaaaactatttttactgtgtgtgtgcgtgtgtgtgtgtgtgtgtgtgtgtgtgttttctctctttttttttcttttattttaagttctgggatacatgtgcagaacgtgcaggtttgttacacatgtgccatggtggtttgctgcacctatcaacccatcatctaggttttaagcaccgcattcattaggtacttgtcctaatg

SEQ ID NO: 7622 - DNA, 361 bp, Homo sapiens
  chr4.fa.O7frz.148675469
  Located on chromosome 4
  Distance between a terminus base of telomere on chromosomal short arm and 5'-terminus of this base sequence : 141862465
  Distance between 3'-terminus of neighbour sequence of sequence listing upward to telomere on chrosomal short arm and 5'-terminus of this base sequence : 69840
caggatagtaatcaatgaagtcactaaatgattcagccctagtgggccattcagaacaaattttaggggtgtgtgtgtgtgtgtgtgtgtgtgagtgagagaaagaaacagagagagaataagaaagaagagacatagaaaaacatctaagactctcagaaaggatttaatttactctactgctcagggatatgacttgagcccagttatcaaaatggccaagagtttgcaaatctgtcacacagattctagagaagtgcttgggatagccaacaaggttagggagggagacagcatacgtattatttacaataaaacttgctaacaatgtctatatgtagttaaattgtcatgtcctagg

SEQ ID NO: 7623 - DNA, 280 bp, Homo sapiens
  AC048378.2_15180
  Located on chromosome 4
  Distance between a terminus base of telomere on chromosomal short arm and 5'-terminus of this base sequence : 141985129
  Distance between 3'-terminus of neighbour sequence of sequence listing upward to telomere on chrosomal short arm and 5'-terminus of this base sequence : 122303
actaaagaccggctaaagacaggtgtgtccttacttcttcttcttcttcttcttcttttttttttttttttgtgagagtctcgctctgctgcccaggctggagtgcagtagtgtgatcttggctcactgcaacctccacctcctgggttcaagcgattctcctgcctcaccctcccaactaactgagactacaggccaagccaccatgcccggctaatttttgtatttttattacagacagggtttcactatattggccaagttggtctggaactcctga

SEQ ID NO: 7624 - DNA, 134 bp, Homo sapiens
  D4S2939
  Located on chromosome 4
  Distance between a terminus base of telomere on chromosomal short arm and 5'-terminus of this base sequence : 142050410
  Distance between 3'-terminus of neighbour sequence of sequence listing upward to telomere on chrosomal short arm and 5'-terminus of this base sequence : 65001
  misc_feature (1)...(134): n = A,T,G or C
ctcttgaagccctgaagtttcagaaaaatctgatttctctggttgttctaaccatactaggatggccactttgatatccaagcattggtgtgtgtgngngtgtgtgtgtgtgtttaataaggccaggtggaaaa

SEQ ID NO: 7625 - DNA, 189 bp, Homo sapiens
  D4S2965
  Located on chromosome 4
  Distance between a terminus base of telomere on chromosomal short arm and 5'-terminus of this base sequence : 142050904
  Distance between 3'-terminus of neighbour sequence of sequence listing upward to telomere on chrosomal short arm and 5'-terminus of this base sequence : 360
tttacagttttcaaaatgggttcgttatctatctttccattcaatcctcacaggaactgtgtgaggtaggtaagatttagtgttcaactttgcatacatacacatacacacacacacacacacacacacacacacacacacacacacaccctgatgctcagataaatggaggagctagggtcaagaacc

SEQ ID NO: 7626 - DNA, 463 bp, Homo sapiens
  chr4.fa.O7frz.148970089
  Located on chromosome 4
  Distance between a terminus base of telomere on chromosomal short arm and 5'-terminus of this base sequence : 142136904
  Distance between 3'-terminus of neighbour sequence of sequence listing upward to telomere on chrosomal short arm and 5'-terminus of this base sequence : 85811
aatgctcaacatcactaatcatcaaggaaatgcaaattaaaaccacaatgagatactacgttacccctgtaagaatggccattattaaaaagtcaaaaaacaattggcatggatgtggtaaaaagggaacatttatacactgctggtgcaatgtaaattaatacagcctctatggaaaacagcatggaggtttattaaaaaactgaaagtagatctactatttgatccagaaatcccactactgctttttctgtgcatatggtggtgtcctttttggagttgataagcatatatatatatatatatatatatacacacacacacatatatatacacacatatatgtgtatatgtatatatatttgtgtatatatgtatatatgtgtatatatatacacaggggatttgctgggatggcgaacaccatgcaaaggaagacatgcaggtatgatctttatcttac

SEQ ID NO: 7627 - DNA, 436 bp, Homo sapiens
  chr4.fa.O7frz.149085013
  Located on chromosome 4
  Distance between a terminus base of telomere on chromosomal short arm and 5'-terminus of this base sequence : 142208924
  Distance between 3'-terminus of neighbour sequence of sequence listing upward to telomere on chrosomal short arm and 5'-terminus of this base sequence : 71557
catctgatatgtatccaggataatatgtagaactctttcaaaactcaatgagaaaacaaaatcacccagttaaagaaactggcaaaacaggagtttgagaacagcatgagcaatatagcaagaccctcatctctaaacacacacacacacacacacacacacacacacacacacacacacacacacacacacacgcagtggggcatagtggcatgcgcctggagtcccagctgctcaggaagctgaggtgggaagatcccttgagctcaggaggtggaggctgcagtgagccatgattgtgccattgcattccccgtttgaacagacatttcaccaaagaagatatctggatggcaaatagtaaaaatgttcaacatcattagtttctgggaaatacaacataaagctatgagatatcatgacattagaatggcta

SEQ ID NO: 7628 - DNA, 210 bp, Homo sapiens
  D4S420
  Located on chromosome 4
  Distance between a terminus base of telomere on chromosomal short arm and 5'-terminus of this base sequence : 142296399
  Distance between 3'-terminus of neighbour sequence of sequence listing upward to telomere on chrosomal short arm and 5'-terminus of this base sequence : 87039
tttctcagcaacattcctcttccatccacctccctctaccgtgtgtgtgtgtgtgtgtgtgtgtgtgtgtgtgtgtgtgtgtgtgtgttcgctcacgcgcagatggagggaggctggctacaatgcacattttgaatatccccctccccaggaactctccagaacccctagggcagtaggataggacagaacccccgaagaatcaaagaa

SEQ ID NO: 7629 - DNA, 218 bp, Homo sapiens
  chr4.fa.O7frz.149309620
  Located on chromosome 4
  Distance between a terminus base of telomere on chromosomal short arm and 5'-terminus of this base sequence : 142403548
  Distance between 3'-terminus of neighbour sequence of sequence listing upward to telomere on chrosomal short arm and 5'-terminus of this base sequence : 106939
ttaaaggttctattctgaacagacatgtaaagaatgtaaacagcttaattgcaacattatctgaactaccagactgtgtgtgtgtgtgtgtgtgtgtgtgtgtgtgtgtgtgtgtgccgaagcctaccacattggggaaatttagctctaaactgaagacatatacgggtgatttataataggattttcatcaactagaaactaggataaacgcatta

SEQ ID NO: 7630 - DNA, 415 bp, Homo sapiens
  AC024016.3_108236
  Located on chromosome 4
  Distance between a terminus base of telomere on chromosomal short arm and 5'-terminus of this base sequence : 142501712
  Distance between 3'-terminus of neighbour sequence of sequence listing upward to telomere on chrosomal short arm and 5'-terminus of this base sequence : 97946
gaatgtcataggtttaccttgaaattttattgtgcaagattaactaaatgaacacaattgctttaacagaatctgaagtaaatcaatatcttcacctccctctgaaataaatcaacagctgctgaatattttaacattgaccgctcctctcccaatttacataattttgttattttttataagtaaatttaatgagggtctgttggtagtaaactttcttagtatctgtctatctatctatctatctatctatctatctatctatctatctatctatctatctatctatctatctatctatctatctggaaaatgtctttatttaggcaacagactagggaccaggaaggatgattaaatataggctctgcctctctggtctatagcctgcctggtgacattactttccatttag

SEQ ID NO: 7631 - DNA, 222 bp, Homo sapiens
  G08330
  Located on chromosome 4
  Distance between a terminus base of telomere on chromosomal short arm and 5'-terminus of this base sequence : 142501843
  Distance between 3'-terminus of neighbour sequence of sequence listing upward to telomere on chrosomal short arm and 5'-terminus of this base sequence : -284
taacattgaccgctcctctcccaatttacataattttgttattttttataagtaaatttaatgagggtctgttggtagtaaactttcttagtatctgtctatctatctatctatctatctatctatctatctatctatctatctatctatctatctatctatctatctatctatctggaaaatgtctttatttaggcaacagactagggaccaggaaggatg

SEQ ID NO: 7632 - DNA, 243 bp, Homo sapiens
  chr4.fa.O7frz.149478657
  Located on chromosome 4
  Distance between a terminus base of telomere on chromosomal short arm and 5'-terminus of this base sequence : 142527140
  Distance between 3'-terminus of neighbour sequence of sequence listing upward to telomere on chrosomal short arm and 5'-terminus of this base sequence : 25075
ctatccagtatttccatgactaatcatattttgaaggggcgagtctagaaaataacacacattggggtcttaaaataatgagcttccttgcatagctaaaattagcattctgtggggactcaccttgtgggttgtgtgtgtgtgtgtgtgtgtgtgtgtgtgtgtgtgtgtgtttgcaggtgtccctgcttatatacagtggttgcatcatcctattctacttccagtacttccagactagac

SEQ ID NO: 7633 - DNA, 122 bp, Homo sapiens
  DID22N_0023778
  Located on chromosome 4
  Distance between a terminus base of telomere on chromosomal short arm and 5'-terminus of this base sequence : 142900481
  Distance between 3'-terminus of neighbour sequence of sequence listing upward to telomere on chrosomal short arm and 5'-terminus of this base sequence : 373098
agtaaagagctcatgcatgcgggtgtgcagcgcacacacacacgcacacacacacacacaattcatgtgagcctgggagggtcttgacttcaaaactgaaaactgtggcacatcttactgga

SEQ ID NO: 7634 - DNA, 425 bp, Homo sapiens
  chr4.fa.O7frz.149778362
  Located on chromosome 4
  Distance between a terminus base of telomere on chromosomal short arm and 5'-terminus of this base sequence : 143006824
  Distance between 3'-terminus of neighbour sequence of sequence listing upward to telomere on chrosomal short arm and 5'-terminus of this base sequence : 106221
gtacattaccatacctggctaagtttttaatatttttttgtagaggatggggtctcattttgttgcccatgctggtctagaactcctggcctcaagcaatcctctagcctcagcctcccaaagtgctgggattacaggcatgagccaacatgcccagccaagttttgttttttatagttgtataagagttgttagaataaacctagtttatggttaaatatatttaatagtattatgaaagtaatttaccctgtaatcccagggactcaagaggtcaggagtttgagaccagcctgggcaatgtagtgaaaccccatctctacagacacacacacacacacacacacacacacacacacacacacacacacacacacagacacacacacaaatttaagtcaatactgagaactgtaggaatgttt

SEQ ID NO: 7635 - DNA, 180 bp, Homo sapiens
  D4S424
  Located on chromosome 4
  Distance between a terminus base of telomere on chromosomal short arm and 5'-terminus of this base sequence : 143134889
  Distance between 3'-terminus of neighbour sequence of sequence listing upward to telomere on chrosomal short arm and 5'-terminus of this base sequence : 127640
tgtgggcaacgtcactcttctaaaaggatgtttggatatgtgtgtgtgtgtgtgtgtgtgtgtgtgtgtgtgtgtgcaggagcctgatgtgtactatgtagggtcggggatgcttatcatcccacagtaaagagaacagcctcatacaacaaagaacgctgtatcatataccaagagcgc

SEQ ID NO: 7636 - DNA, 342 bp, Homo sapiens
  HUMUT6304
  Located on chromosome 4
  Distance between a terminus base of telomere on chromosomal short arm and 5'-terminus of this base sequence : 143201145
  Distance between 3'-terminus of neighbour sequence of sequence listing upward to telomere on chrosomal short arm and 5'-terminus of this base sequence : 66076
aacaacctaggcaatatagcaaaacttcatctattttaaaaattaagaaagaattagctgggcatggttgcatgtgcttgtcctaggcacttggggggcttaggtgggagggttgcttgaggccaggatatcaaggttggagtgagccctgatgggggccaggcagagcaagaccctgtaaaagaaacagaaagaaagaaagaaggaaggaaggaaggaaggaaggaaggaaaggaaggaaggtaggaaggaaaaataaatgggggaagaaaaggagggaaagaaaggaagaaaagaaggaaactggtggcacagtcattcagctattcagggcatatcatc

SEQ ID NO: 7637 - DNA, 284 bp, Homo sapiens
  AC012207.5_120850
  Located on chromosome 4
  Distance between a terminus base of telomere on chromosomal short arm and 5'-terminus of this base sequence : 143284519
  Distance between 3'-terminus of neighbour sequence of sequence listing upward to telomere on chrosomal short arm and 5'-terminus of this base sequence : 83032
aatgaaccaattcagataactcatctttaagagtctgattttctggaaccactactcccggcaccaaattttgtgttggtcagggttacatcaaagaaatagtttcatctatctatctatctatctatctatctgtctatctatctatctatctatctatctgtctgtctgtctgtctgtctatcatctatcatctatctatctatctaatacagatgtagatatatcttcccatatatatttgcctttacacaattgtagagctaggagctagttaagcactc

SEQ ID NO: 7638 - DNA, 454 bp, Homo sapiens
  chr4.fa.O7frz.150126727
  Located on chromosome 4
  Distance between a terminus base of telomere on chromosomal short arm and 5'-terminus of this base sequence : 143377276
  Distance between 3'-terminus of neighbour sequence of sequence listing upward to telomere on chrosomal short arm and 5'-terminus of this base sequence : 92473
gagaaatgcagaactatgttagagaccagtacacacacacacacacacacacacacacacacacacacacacactttatttaaagaaaacaaataaattaatacatgttgaccttagtcttctggcttgttaatgatcaaagtaaaaaaattaaagaattaaattactttttggcttgggctttctcttttcatttcctgtaacgatcatttctgtcactaaatccaaccaatacttctcaatagagtcacagtagacagagggagtgggacaagttggaaatgtttggaaccaatccaattaaaagttatagaaaaaaattatggcttcacattaaattggcagattcgcttcttacctcatttaacctcccgcaaactttgagaactatacccagctgctgttgcacccattaattttcagtatttgtctagtaatgaaggtagacttgcag

SEQ ID NO: 7639 - DNA, 309 bp, Homo sapiens
  chr4.fa.O7frz.150673459
  Located on chromosome 4
  Distance between a terminus base of telomere on chromosomal short arm and 5'-terminus of this base sequence : 143653153
  Distance between 3'-terminus of neighbour sequence of sequence listing upward to telomere on chrosomal short arm and 5'-terminus of this base sequence : 275423
aagtagaactcagctgtcatttagccttaagaacttttgacattccagaaagaggaactttgttttcagatctgtgcaggataaggaaggtgaaacaaatgacaaagctgaaggtttgaacaagataaggggtgtaatgtacatgatagtggagactttcttcaccataaattgttatacacacacacacaaacacacacacacacacacacgcacacagcaacagtagccaatggtcacattctgtggcgtatgggaaacgtaagccgtgaacttggtttgagattgtcttgagctagtagcaccttt

SEQ ID NO: 7640 - DNA, 208 bp, Homo sapiens
  D4S3053
  Located on chromosome 4
  Distance between a terminus base of telomere on chromosomal short arm and 5'-terminus of this base sequence : 143940727
  Distance between 3'-terminus of neighbour sequence of sequence listing upward to telomere on chrosomal short arm and 5'-terminus of this base sequence : 287265
cctgccatgtttcaaaaagaatttaaggcagtttacattgatacatcaaattcagtaagatatcaggaataaaaagtgagaaagaaacagtaagtgcaagagtaatgtcataaaatggagttaagaatgaggccaacacacacacacacacacacacacatacatagtgaaagcctattaaagaatgctatacatttgaagtagatga

SEQ ID NO: 7641 - DNA, 247 bp, Homo sapiens
  AC044875.2_130407
  Located on chromosome 4
  Distance between a terminus base of telomere on chromosomal short arm and 5'-terminus of this base sequence : 143972746
  Distance between 3'-terminus of neighbour sequence of sequence listing upward to telomere on chrosomal short arm and 5'-terminus of this base sequence : 31811
caaactatgacttgcaggctaaccccaggtcatacatttttttatttttgtaaatacatttttattaaaagtcagccatgtccattttttgtttattttatgttatttttattttattttattttattttattttattttattttattttttgagacggagtttcgctcttgttgcccaggctggagtgcaatggcgtgatcttggctcactgcaacctcccacttactggttcaagcaattatcct

SEQ ID NO: 7642 - DNA, 112 bp, Homo sapiens
  DISO7_10001638
  Located on chromosome 4
  Distance between a terminus base of telomere on chromosomal short arm and 5'-terminus of this base sequence : 144016509
  Distance between 3'-terminus of neighbour sequence of sequence listing upward to telomere on chrosomal short arm and 5'-terminus of this base sequence : 43516
gcagtcttctgatgaaatacaagatacacacacacacacacacacacacacacacacacacacacacactgtataatttcaaatattttggaatgttattgtcttcagtgag

SEQ ID NO: 7643 - DNA, 235 bp, Homo sapiens
  DISO7_10001642
  Located on chromosome 4
  Distance between a terminus base of telomere on chromosomal short arm and 5'-terminus of this base sequence : 144241551
  Distance between 3'-terminus of neighbour sequence of sequence listing upward to telomere on chrosomal short arm and 5'-terminus of this base sequence : 224930
atcccagaacctcagcaggggtgggggctataaatagtgtgtatgtatacatgtaatatgtgtgtgtgtgtgtgtgtgtgtgtgtgtgtgtgtgtgtgtgccagtcattagagaaaatctaatttgacttcgttatgttctttttacctgttagatgaagtaggttaaagatgatacagtaaacttttttaggacacaattccctagacttccccctaattacctacctcagctt

SEQ ID NO: 7644 - DNA, 196 bp, Homo sapiens
  G08328
  Located on chromosome 4
  Distance between a terminus base of telomere on chromosomal short arm and 5'-terminus of this base sequence : 144403314
  Distance between 3'-terminus of neighbour sequence of sequence listing upward to telomere on chrosomal short arm and 5'-terminus of this base sequence : 161528
gtctctgcatttgctggtttctatgtattagagtttcccagagaaacagaagcaataggatatctatctatctatctatctatctatctatctatctatctatctatctatctatctacctacctatctatctatctatccattcatccaatctatctaatttattataaggaattggctcatgtgatttggagtc

SEQ ID NO: 7645 - DNA, 302 bp, Homo sapiens
  D4S1561
  Located on chromosome 4
  Distance between a terminus base of telomere on chromosomal short arm and 5'-terminus of this base sequence : 144666557
  Distance between 3'-terminus of neighbour sequence of sequence listing upward to telomere on chrosomal short arm and 5'-terminus of this base sequence : 263047
attttcatgcattcgttagaattttaaacatattatatctttaatttaaagtaattattatcgcctaggagtttaaagaaatttacgtatatcattctatacattgcaacacacacacacacacacacacacacacacacacacacacacatccaccactattctctgaattgcattttaggtattttattacatattttcttaccttctatgtcacaccattgccaaagtcaaattctgagagtttagacctcttatactcaaatggtgatccataaactgcagcatcaccatcacctaga

SEQ ID NO: 7646 - DNA, 215 bp, Homo sapiens
  D4S2927
  Located on chromosome 4
  Distance between a terminus base of telomere on chromosomal short arm and 5'-terminus of this base sequence : 144749134
  Distance between 3'-terminus of neighbour sequence of sequence listing upward to telomere on chrosomal short arm and 5'-terminus of this base sequence : 82275
gctattccagggcttgttttttctacaaaaaaggaaggcaatttaaacgtgtgtgtgtgtgtgtgtgtatttccagttctatctatatctatatttcaacagaattacaatttctgtaggaatcaaaatttgaataaagtaaataatatacttcaaaatctttattataaacatttcattgacaatatagaaaggaaattgatacagcattagca

SEQ ID NO: 7647 - DNA, 466 bp, Homo sapiens
  chr4.fa.O7frz.151840703
  Located on chromosome 4
  Distance between a terminus base of telomere on chromosomal short arm and 5'-terminus of this base sequence : 144834464
  Distance between 3'-terminus of neighbour sequence of sequence listing upward to telomere on chrosomal short arm and 5'-terminus of this base sequence : 85115
tctggaatgcaaatataatgattcatacataataattatacatgtttatagagtacatgtgaagtttatttatttattatttatttatttatttatttatttatttatttatttatttatttatgtagagatggaatttcacacttgttgcccaggctggagtgctatgatgtgatctcagctcactgcaacctccacttcccgagttcaagtgattctcctgactcagcctcctgagtagctgggattacaggtgcctgccaccatgcctggctaatttttgtatttttctcatagagatggcattttaccatgttgatcaggctggtctcaaacttctgacctcaggtgatctgcccgcgttggcctcccaaagtgctgggatcactggcgtgagccaccatgcccggccacatgtgatattttaatatatgtatataatgtgtcatgatcaaattaaggtaat

SEQ ID NO: 7648 - DNA, 147 bp, Homo sapiens
  D4S2981
  Located on chromosome 4
  Distance between a terminus base of telomere on chromosomal short arm and 5'-terminus of this base sequence : 145243573
  Distance between 3'-terminus of neighbour sequence of sequence listing upward to telomere on chrosomal short arm and 5'-terminus of this base sequence : 408643
ggttatttaattttagtaacgcatctgaggattgaatttcctttaaaaacacacacacacacacacacacacacacacacacatctgtgttacttgactctcagtgttgagctaggctgtaaagccaggtctccagcacttctgttc

SEQ ID NO: 7649 - DNA, 454 bp, Homo sapiens
  chr4.fa.O7frz.152552928
  Located on chromosome 4
  Distance between a terminus base of telomere on chromosomal short arm and 5'-terminus of this base sequence : 145463060
  Distance between 3'-terminus of neighbour sequence of sequence listing upward to telomere on chrosomal short arm and 5'-terminus of this base sequence : 219340
cttgattcgatcagtatttaacacatacattatggaattatcaaattgtaccctataaatatgtacaagtacagcatatcaattacaaattatttaaaatatattttattaaaatgaaaatagttttggggactttggattgtatatactgttttatgaattatgctgctgcataatttaacataggatactgttatacgatgatcaggagcatccaaacacggacagaaattgacaagagaacaatccaggctcttggtctctgtaactttctgttaatcttattcccctcctgctctgcatatgtgtgtgtgtgtgtgtgtgtgtgcgcgtgtgcatttgcacacgtgtttcttttcccagggccgctttctgtttcttttatcttgcccttctccgtgtatctgcatcatcttcctatttctacttttttgtctttatgcatacgtgagct

SEQ ID NO: 7650 - DNA, 403 bp, Homo sapiens
  chr4.fa.O7frz.152654632
  Located on chromosome 4
  Distance between a terminus base of telomere on chromosomal short arm and 5'-terminus of this base sequence : 145569223
  Distance between 3'-terminus of neighbour sequence of sequence listing upward to telomere on chrosomal short arm and 5'-terminus of this base sequence : 105709
tttctcatgtatggtttagcaccatctccttggggctgttcttgtgatggttagtgagttctcatgagatctggttgtttaaaagtaagtagcaccttccctctctctctctcgttcctgctgaggcctgcttcccctttgccttgattgtaaatttgccatgattgtaaatttcctgaggtctccccaggaacagaagctgccatgtctcctgtatagcctgcagaactgtgagcccattaaacctctttttttttaaataaattacccagtgtctatttctttatatatatatatatatatatataatatatatatatatatataatatatatatatattttattatactttaagttctatatgtgccatgttggtgtgctgcactcattaacttgtcatt

SEQ ID NO: 7651 - DNA, 364 bp, Homo sapiens
  AC044903.2_78916
  Located on chromosome 4
  Distance between a terminus base of telomere on chromosomal short arm and 5'-terminus of this base sequence : 145866653
  Distance between 3'-terminus of neighbour sequence of sequence listing upward to telomere on chrosomal short arm and 5'-terminus of this base sequence : 297027
gtatccaccgaaactaagcttcataaatggaggaaagatacagtctttttcagacaaacaaatgctgagagaatttggcactacgaagccagcactacaggaactgctaaaaggagctataaatgttgaaagaaattctggaacaacattaaaacagagcctctttaaagagtaaatattacaggacctatacaacaacaacaacaaacaaacaacaacaactaaaaaacaaggtatacaggcaagaaatagcacaatgaatggaatggtacctcatatctcgatactaacattgaatataaatggcctaaatgctccacttaaaagatacagaattaaagaatggataagaattcataaagca

SEQ ID NO: 7652 - DNA, 256 bp, Homo sapiens
  D4S1604
  Located on chromosome 4
  Distance between a terminus base of telomere on chromosomal short arm and 5'-terminus of this base sequence : 146066796
  Distance between 3'-terminus of neighbour sequence of sequence listing upward to telomere on chrosomal short arm and 5'-terminus of this base sequence : 199779
ttgctcacaggagtgcttctttattttttggtctctagtatcatctccccaaagttgcatatgttttaattccccttccccctctcattgtttgcaggtgaaaattctctcaaaacttcaatttttcttgcaacttttccctgctagattaggggtgtgtgtgtgtgtgtgtgtgtgtgtgtgtgtgtctgacggaattgaactaaaaaaggaagacttctgtgaacctaaagaagtagtacttggctgggcacga

SEQ ID NO: 7653 - DNA, 327 bp, Homo sapiens
  chr4.fa.O7frz.153370004
  Located on chromosome 4
  Distance between a terminus base of telomere on chromosomal short arm and 5'-terminus of this base sequence : 146200485
  Distance between 3'-terminus of neighbour sequence of sequence listing upward to telomere on chrosomal short arm and 5'-terminus of this base sequence : 133433
tactccaggaaacgaggtcatttcaatgtgaagacgaaaagctgtgtgtgtgtgggtgtgtgtgcacgtgtgcctgtgcatgtgtgtgtgtgtgtgtgtgtgtgtgtgtgtgtactgggggaatgggaaagggaggcaccatggttaatcgggcacttactatgtgctagaacctgccaatgtgaacatgctcttcagcagtgagccccatttatttgctgtctctgttccctgcctgcaattcctcttcagtaaaacctcaggctcaaatcatcagaagaaaccagtcagaattaagaaaaagttctaagccagattagcatatta

SEQ ID NO: 7654 - DNA, 453 bp, Homo sapiens
  AC012202.3_103848
  Located on chromosome 4
  Distance between a terminus base of telomere on chromosomal short arm and 5'-terminus of this base sequence : 146298578
  Distance between 3'-terminus of neighbour sequence of sequence listing upward to telomere on chrosomal short arm and 5'-terminus of this base sequence : 97766
gaggttaggagttcaagaccagcctgaccaacatggtgaaaccccgtctctactaaaaatacaaaaattagccaggtgtagtggcacatgcctttaatctcagctactcaggaggctgaggcaggagaattgcttgaacccgggaggcagaggttgcagtgagccaagatcatgccactgaactacagcctaggagacacagcgagactccaactcaaaaaacaacaacaacaacaaaaacaaacaaacaaacacctaatccatccagataggtagaataccacacaaaaaaattgataaattaattatgtcccagaagggaagaaggaggaaaagcccatttttaaaaagaaatgaggtaaggcttgattacagacttacagaatgtaacactaactttcagaaatatgatctcattttcccctgaggagatactaaatcagcatccatacc

SEQ ID NO: 7655 - DNA, 152 bp, Homo sapiens
  D4S2998
  Located on chromosome 4
  Distance between a terminus base of telomere on chromosomal short arm and 5'-terminus of this base sequence : 146315154
  Distance between 3'-terminus of neighbour sequence of sequence listing upward to telomere on chrosomal short arm and 5'-terminus of this base sequence : 16123
ttctacacccaggggaacctctccccagggactgcgcgcgcgtgcgtgcaggtgtgtgtgtgtgtgtgtgtgtgtgtgtgtttgtgtgtgttaaaacgaacactaattccgcgcccagcttctctctccgtccacctgcggcccaagaactt

SEQ ID NO: 7656 - DNA, 418 bp, Homo sapiens
  AC051645.2_106742
  Located on chromosome 4
  Distance between a terminus base of telomere on chromosomal short arm and 5'-terminus of this base sequence : 146328284
  Distance between 3'-terminus of neighbour sequence of sequence listing upward to telomere on chrosomal short arm and 5'-terminus of this base sequence : 12978
atcaatgcaatagcaagataaatgctgagtttgtcttatttgtacttcatgggagccttttaatactcaacacaatattatttcacttttaccacaatttttaaatttagtttaaaacacaaatgggaatcccaacccccgatatttttcattctttttatttagtatttatttatttatttatttatttatttattttttcagaaggtgtctcgctctgtggctcaggctagagtgcagtggtgtgttcttggttcgctccaacctccacctcccggttcaagtgattctcctgcctcagcctcccgaatagctaggattataggcgcatgccaccatgccctgctaatttttatatttttagtagagacggggtttcgccatgttgaccaggttggtctcaaactcctgacctcag

SEQ ID NO: 7657 - DNA, 454 bp, Homo sapiens
  chr4.fa.O7frz.153736634
  Located on chromosome 4
  Distance between a terminus base of telomere on chromosomal short arm and 5'-terminus of this base sequence : 146605147
  Distance between 3'-terminus of neighbour sequence of sequence listing upward to telomere on chrosomal short arm and 5'-terminus of this base sequence : 276445
ctcatactgaacattagatcttcagagttactcatcctgcgtaagtgcaagtttgtaccctctgacctacatatccccatttcttccccctccctgtccctggtaaccaactctactctctatgtatttgacttttcttttagattccacatataaatgagattatgttgtacatttctttctgcatcttgcttatttcacttaatataatgttctctaggttcatccatattccattgtgtgtgtgtgtgtgtgtgtgtgtgcagagagagagagagagaccatgtgcacaatttctttattcattcattggtcagtggacacttaggttgtttccatatcttggctactttaccccactgatttaatgctacctctgtcctattccaggcttctatatatccaatggtcatttactgagtcatcaagtctcttccattgcttatgtctatac

SEQ ID NO: 7658 - DNA, 301 bp, Homo sapiens
  AC019301.5_90514
  Located on chromosome 4
  Distance between a terminus base of telomere on chromosomal short arm and 5'-terminus of this base sequence : 146842149
  Distance between 3'-terminus of neighbour sequence of sequence listing upward to telomere on chrosomal short arm and 5'-terminus of this base sequence : 236548
aaggccgaaatagttagattctcgacttgtgtgatcaaaatcctcaactctttcacgatcaggttttctgtcaaataaaacattcttgtcagaaaatacataaataaataaataaataaataaataaaacattcttgtcaaaaaaaaaaaacacaaaactgtactgagtacctaaaataaaatgatctattttgcaacacaaacattttactaatttagctacactgacattttagaacatttggcagtctggttaatgaatgtttaagcaaatggaagctcctgtagcattagcctacct

SEQ ID NO: 7659 - DNA, 388 bp, Homo sapiens
  chr4.fa.O7frz.154196363
  Located on chromosome 4
  Distance between a terminus base of telomere on chromosomal short arm and 5'-terminus of this base sequence : 147070515
  Distance between 3'-terminus of neighbour sequence of sequence listing upward to telomere on chrosomal short arm and 5'-terminus of this base sequence : 228065
agtaagtctttctggactccacttatggtgggattctaccatagctccctactttctattaaaatatgactgatgtttccttaacattatggaactcagacaagtgtatcatgacattgactcttcagtgcaagtatctttttcctattcctcaaatatattctatcaaataaggttaagatcatggttttcaggcagctttgcagtggaagggcaaactacattccagattttggcactgggatatatatgaatgtgtgtgtgtgtgtgtgtgtatgcaatacatatatttacatatttaaatatgctgctatttttactaattaaatgcaaaatcataggtgaatttagctttgcatttaatgtacagagcataagatgctaatgt

SEQ ID NO: 7660 - DNA, 160 bp, Homo sapiens
  Z67626
  Located on chromosome 4
  Distance between a terminus base of telomere on chromosomal short arm and 5'-terminus of this base sequence : 147233279
  Distance between 3'-terminus of neighbour sequence of sequence listing upward to telomere on chrosomal short arm and 5'-terminus of this base sequence : 162376
cccttaattgtagggctgctgtactgtggatattttgctctacaatctgagattgttagggtatagttactccaactattcatgtattatcctctccctgtctttttgtgtgtgtgtgtgtgtgtgtgtgtgtggtttctttgtggtgtgcttatgcaaa

SEQ ID NO: 7661 - DNA, 317 bp, Homo sapiens
  chr4.fa.O7frz.154569247
  Located on chromosome 4
  Distance between a terminus base of telomere on chromosomal short arm and 5'-terminus of this base sequence : 147412433
  Distance between 3'-terminus of neighbour sequence of sequence listing upward to telomere on chrosomal short arm and 5'-terminus of this base sequence : 178994
tagaaatgtcattgcttcctagagatctgctacacatactacatctttatttcaaatcaagaatctgagaaatcacaccacctcttttgcaaaaccagtggtgttactggtgccagaaactttcttcccactagctccagtcacttggggctcttaaaataatagaggacacaaaaaccatttttctcaatgaatctcagaacattttattgcctgtcatatattattactgttgttatatatatatatatatatatatatattactgcttgtgacccaaaaaatatgttgaattctaacctccagtacctcagagt

SEQ ID NO: 7662 - DNA, 111 bp, Homo sapiens
  D4S1586
  Located on chromosome 4
  Distance between a terminus base of telomere on chromosomal short arm and 5'-terminus of this base sequence : 147583323
  Distance between 3'-terminus of neighbour sequence of sequence listing upward to telomere on chrosomal short arm and 5'-terminus of this base sequence : 170573
accagagtgctgatgtgtgtgcatgtgtgagtgtgtgtgtgtgtgtgtgtgtgtgtgtgtgtgtgtgtgcacatgtggcttctaaacaggattcctggcaatggtacatgc

SEQ ID NO: 7663 - DNA, 340 bp, Homo sapiens
  chr4.fa.O7frz.155360950
  Located on chromosome 4
  Distance between a terminus base of telomere on chromosomal short arm and 5'-terminus of this base sequence : 147674002
  Distance between 3'-terminus of neighbour sequence of sequence listing upward to telomere on chrosomal short arm and 5'-terminus of this base sequence : 90568
gtaaagtacaatttgctgacaaactataaagcaatataaatagatcatatattagactagtattaaaggttttaaaaatagtctattttaaaaatatagtttgtgaaatttatgagttttaaatggcaaaatttaaaagaattaaataaaatgagagtggtttccattttttgaatcacattttctgcttttattcccatatgcccgtaaaagggattatatatatagtaggtgtgaagcacttatgtaaggtatatgtatataaggtatatgtatgtgtgtgaggtatgtgtgtgtgtgtatgtgtgtgttatgtgtgtgaattaagctgtcaagtcag

SEQ ID NO: 7664 - DNA, 266 bp, Homo sapiens
  Z66934
  Located on chromosome 4
  Distance between a terminus base of telomere on chromosomal short arm and 5'-terminus of this base sequence : 147868336
  Distance between 3'-terminus of neighbour sequence of sequence listing upward to telomere on chrosomal short arm and 5'-terminus of this base sequence : 193994
aggattttgtttggcttccactatccctccttgattctattccttttaggttgactttttttaaatgccacacaaacacacacacacacacacacacacacacacacacacacacacacacacaccaaaaaaattgtaagtaaggagaaactaaacgtgagttaaacatgatcacatttactttggccactgtgtatatagttcttcatcttgacttcatgacttaaatactagaaaactatgaagcactcttaccatcaggaagg

SEQ ID NO: 7665 - DNA, 157 bp, Homo sapiens
  DISO7_10001652
  Located on chromosome 4
  Distance between a terminus base of telomere on chromosomal short arm and 5'-terminus of this base sequence : 148062266
  Distance between 3'-terminus of neighbour sequence of sequence listing upward to telomere on chrosomal short arm and 5'-terminus of this base sequence : 193664
tgtgcgtgcctaagacagaaaagagagggacagacacacacacacacacacacacacacacacacacacacacacacacacacagaaaaagagagagagagagagagagagacagatagacagaggtactatatatccagacagtgtccaagatcca

SEQ ID NO: 7666 - DNA, 157 bp, Homo sapiens
  DISO7_10001653
  Located on chromosome 4
  Distance between a terminus base of telomere on chromosomal short arm and 5'-terminus of this base sequence : 148075830
  Distance between 3'-terminus of neighbour sequence of sequence listing upward to telomere on chrosomal short arm and 5'-terminus of this base sequence : 13407
aatgcaaaggctctagcacaaaacaaaaaacaaaatatatatatacacatatacatatatatgtgtgtgtgtgtatatatatatatggagagagagagagagagagagagagagtgattagacttttagacttttaacctggacatttctatggtga

SEQ ID NO: 7667 - DNA, 476 bp, Homo sapiens
  chr4.fa.O7frz.155469144
  Located on chromosome 4
  Distance between a terminus base of telomere on chromosomal short arm and 5'-terminus of this base sequence : 148091023
  Distance between 3'-terminus of neighbour sequence of sequence listing upward to telomere on chrosomal short arm and 5'-terminus of this base sequence : 15036
atgtctaacaatgatagactggattaagaaaatgtggcacatatacaccatggaataccatgcagccataaaaaatgatgagttcatgtcctttgtagggacatggatgaaattggaaaccatcattctcagtaaactatcgcaagaacaaaaaaccaaacaccgcatattctcactcataggtaggaattgaacaatgagatcacatggacacaggaaggggaatatcacactctggggactgtggtggggtggggggaggggggagggatagcactgggagacatacctaatgctagatgacgcgttagtgggtgcagcgcaccagcatggcacatgtatacatatgtaactaacctgcacaatgtgcacatgtaccctaaaacttaaagtataataaaaaaaaaaaaatatatatatatatatacatatatatagtcttttaaaaagaaaaagctacaattcgacaactatta

SEQ ID NO: 7668 - DNA, 329 bp, Homo sapiens
  chr4.fa.O7frz.157713679
  Located on chromosome 4
  Distance between a terminus base of telomere on chromosomal short arm and 5'-terminus of this base sequence : 148167869
  Distance between 3'-terminus of neighbour sequence of sequence listing upward to telomere on chrosomal short arm and 5'-terminus of this base sequence : 76370
aaatgacctacttacatgcctctctccgctggtcatctaagataggaatctaatgaaactcaccctaagcacccacttgtttgttactcctactcacaccctgactctgaagtggccagaagtagaaagggtgagaaggtttatctatctatctatctatctatctatctatctatctatttatctatctatagtgaaacaaatcaggcccttgaatccactggtactcttttaaaatttttatcacgtgtatatattcattaattaaaaagtatgaattgctgacacaagtacgattccctgaaatgtccaaagtcttcatctcctac

SEQ ID NO: 7669 - DNA, 455 bp, Homo sapiens
  chr4.fa.O7frz.155862765
  Located on chromosome 4
  Distance between a terminus base of telomere on chromosomal short arm and 5'-terminus of this base sequence : 148367012
  Distance between 3'-terminus of neighbour sequence of sequence listing upward to telomere on chrosomal short arm and 5'-terminus of this base sequence : 198814
aagaatgagcactctttcctagatgaaaagtttatcagcattggtgggtattgattaaagatcaccataatattcatgagaaattggaagcctaccctgcattatatatatatatatatgtatatatatatatatatatatgtatatatgtatatttatatatatatatgtatatttatatatatatgtgtgtgtgtgtgtgtgtgtgtgtgtctttatgaaactggagatctgctccattataaaagaactggccttaaaaactgaattgggcctaatactaatgctactagaggtacataacagataaatcccctccgtttgtgagttattacattttattttggagaaaaaaaaacattgacatatttacaaactcagtgtgcagcctcaggacctgaaatgtaggtctgacgaggaattctgatctagtcatatgtctgatagcaatcttc

SEQ ID NO: 7670 - DNA, 222 bp, Homo sapiens
  chr4.fa.O7frz.156001302
  Located on chromosome 4
  Distance between a terminus base of telomere on chromosomal short arm and 5'-terminus of this base sequence : 148484792
  Distance between 3'-terminus of neighbour sequence of sequence listing upward to telomere on chrosomal short arm and 5'-terminus of this base sequence : 117325
tttgaacagttaactaaaggtcactaaattagtgataaggaaactatattctttgtactagaattgggttattaaagaatatatatatatatgtatatctacagtatatatgtgtacacacacacacacacacacacacactcacacacctacaactgaaatagtaaacttggttggtttgggataccagaagaatattcctgtgaattacctaagaggctt

SEQ ID NO: 7671 - DNA, 460 bp, Homo sapiens
  chr4.fa.O7frz.156120918
  Located on chromosome 4
  Distance between a terminus base of telomere on chromosomal short arm and 5'-terminus of this base sequence : 148531297
  Distance between 3'-terminus of neighbour sequence of sequence listing upward to telomere on chrosomal short arm and 5'-terminus of this base sequence : 46283
catggactagttaccaatgtttatttagaaggatcacaacactcacaggctgcttgccttatccatgactggctctgtctttcttgggtaaacacccatactctccttcttttccttattttttgagacagtttcgctcttgatgccctggctggagtgcagtcttggctcactgcaaccgccacctcccaggttcaagtgattctcctgcctcagcctcccgagtagctgggattacaggagccctcctccatggccaactaattttgtgtgtgtgtgtgtgtgtgtggtatttttagtagagagggggcttcaccatgttggccaggctggtctcaaactcctgacctcaggtgatctgctcacctcggcctctcaaagtgctgggattacaggcgtgagccaccgtgcctggcctctccttctaaatatgtctgtgttcctaaaccatttatccagt

SEQ ID NO: 7672 - DNA, 189 bp, Homo sapiens
  DISD22_0004098
  Located on chromosome 4
  Distance between a terminus base of telomere on chromosomal short arm and 5'-terminus of this base sequence : 148628888
  Distance between 3'-terminus of neighbour sequence of sequence listing upward to telomere on chrosomal short arm and 5'-terminus of this base sequence : 97131
gcacagagcttgaagatgctaatacacacatacatatatacacacaaacatgcacacatacaatatatatatatatatttatgaagatacacactacatatatttgtatgtgtgtgtgcatatatatatatatatatatatatatatatatatacacacatatatatcttgataagttgccttcctaga

SEQ ID NO: 7673 - DNA, 148 bp, Homo sapiens
  DISD22_0004102
  Located on chromosome 4
  Distance between a terminus base of telomere on chromosomal short arm and 5'-terminus of this base sequence : 148983713
  Distance between 3'-terminus of neighbour sequence of sequence listing upward to telomere on chrosomal short arm and 5'-terminus of this base sequence : 354636
gcatagatggaaattgtatcatgtttctttagaatatttttcaagtaaaatgtagaacaagcatgcatatatatatatatatatatatatatatatatatatatatatatatatctgtttttgactgtgtgagttggtacgatggcgt

SEQ ID NO: 7674 - DNA, 427 bp, Homo sapiens
  chr4.fa.O7frz.156692792
  Located on chromosome 4
  Distance between a terminus base of telomere on chromosomal short arm and 5'-terminus of this base sequence : 149061608
  Distance between 3'-terminus of neighbour sequence of sequence listing upward to telomere on chrosomal short arm and 5'-terminus of this base sequence : 77747
ctgtaggtgaggataacatgacctatctcacaggctgttgtaaaaattaaatgagttaatgtatgtaaagtgtttaaggtagcctgtgaaggtgatggtcatgatgatgatgatgatgatgatgatgatgatgatagtgtaagtcttcctttatcatcttacatccctcttcttatttcagcatttactgactaaattacttaataatttactcattaaataagacaggatgacaccttttcttgagttagtaattacctcaaactatttaagtagtatctccttatttagatgttgagcttcttggtgaagctaggggaatctgacacttctctggaaagatggaaagggactaaaaacatctagttagtgagaaatgtggttaaaaagtaaaaccaagtacctttgacattatcctaagatgaaa

SEQ ID NO: 7675 - DNA, 121 bp, Homo sapiens
  Z67620
  Located on chromosome 4
  Distance between a terminus base of telomere on chromosomal short arm and 5'-terminus of this base sequence : 149158594
  Distance between 3'-terminus of neighbour sequence of sequence listing upward to telomere on chrosomal short arm and 5'-terminus of this base sequence : 96559
tggatgtctcacaagcatctcaaacttaacctgcctacacacacacacacacacacacacacacacacacacacacacacacaccttgtgcctttaccacccacttaattgttcagagcag

SEQ ID NO: 7676 - DNA, 431 bp, Homo sapiens
  chr4.fa.O7frz.157306786
  Located on chromosome 4
  Distance between a terminus base of telomere on chromosomal short arm and 5'-terminus of this base sequence : 149358150
  Distance between 3'-terminus of neighbour sequence of sequence listing upward to telomere on chrosomal short arm and 5'-terminus of this base sequence : 199435
ttcttcatgaagcactatcaacagaggcaccaaacagataagatctacagaaagaaacagtccaaagcaagataaaaattaaaattgagatatttttcagcccaggtatttattctcatcctctataaaacctaggtcacggaattatatcatattatcttatacattagttttccttaactggaaaagtatacacacacacacacacacacacacacacacacacacacagaggcagctcctttattaaacaaattagaatagtaaagataggttacggaatactaagtttgacattaaaatgaaaccttttaaaaactgtgaacctagagatatcttttttaaaaaagaaaatcaactgtaccctaccatccaaaggaaattcttctttactgtccatagagtagtaagtattgcatgattactgctag

SEQ ID NO: 7677 - DNA, 147 bp, Homo sapiens
  DISD22_0004113
  Located on chromosome 4
  Distance between a terminus base of telomere on chromosomal short arm and 5'-terminus of this base sequence : 149519629
  Distance between 3'-terminus of neighbour sequence of sequence listing upward to telomere on chrosomal short arm and 5'-terminus of this base sequence : 161048
gaagttcctatagcccttgcttacatacactcacacacacacacacacacacacacacacacacacacacaacctgatgataaaagaaactcagcaatctaagaaagtaaaatgcaaggcagaaggaaccaaggcaagccaatgaat

SEQ ID NO: 7678 - DNA, 275 bp, Homo sapiens
  D4S3031
  Located on chromosome 4
  Distance between a terminus base of telomere on chromosomal short arm and 5'-terminus of this base sequence : 149771081
  Distance between 3'-terminus of neighbour sequence of sequence listing upward to telomere on chrosomal short arm and 5'-terminus of this base sequence : 251305
tggtaagccccaaagcaaacactggcaggtctgcttcccttacttatcctaacacaggaatgtaattgccagggggatgcttttgtattgagaaggccttgatattgttctctttataaacacatacacacacacacagagaaaaacaccagacactttacattctaaaggcaggcatcttgatatcgttctctttacacacacacacacacacacacacgcacacacacacacacacacacacacacacacacacaccaggcgctttgcattct

SEQ ID NO: 7679 - DNA, 252 bp, Homo sapiens
  D4S3014
  Located on chromosome 4
  Distance between a terminus base of telomere on chromosomal short arm and 5'-terminus of this base sequence : 149928781
  Distance between 3'-terminus of neighbour sequence of sequence listing upward to telomere on chrosomal short arm and 5'-terminus of this base sequence : 157425
attgattgggccgctgcactccagcctgggtgacagggcgagactccctctcaaacaaacaaataaatgaaacacacacacacacacacacacacacacacacacacacacacacacaaactgggacttttttcaacaatatgttgttttatatacccagcattttctctttattataataaaaaactgacatcaaggaatgagatgaatggccaagaaatgagcaaattacaacatcactgaggtatagca

SEQ ID NO: 7680 - DNA, 465 bp, Homo sapiens
  chr4.fa.O7frz.157419876
  Located on chromosome 4
  Distance between a terminus base of telomere on chromosomal short arm and 5'-terminus of this base sequence : 150069954
  Distance between 3'-terminus of neighbour sequence of sequence listing upward to telomere on chrosomal short arm and 5'-terminus of this base sequence : 140921
gcagtgattagttgataaatgttcaggggctgggtgcagtggctcatgcttgtaatcctagcactttgggagaccgaggcaggcagatcacctgaggtcaggtgttcaagaccagcctggccaacatggtgaaacaccatctctacaaaaatagaaaaactagttgggcatgatggcaggtgcctgtaatcccagctactcaggagggtgaggtggaagaatcacttgaaccaggaggtggagtaatagtgagccaaaatctgccattgcactctagcctgggtgacagagtgagactccatcccaaaaccaaaccaaaccaaaccaaaccaaaccaaagttcatgtctcacatcttttggtctcaatttgtctgaaaatgtctttattttatcttcattcctggatgatagtttaaaaagctatggatttctagcttgacaggtgatttacgacagtactttgc

SEQ ID NO: 7681 - DNA, 437 bp, Homo sapiens
  chr4.fa.O7frz.158064202
  Located on chromosome 4
  Distance between a terminus base of telomere on chromosomal short arm and 5'-terminus of this base sequence : 150225279
  Distance between 3'-terminus of neighbour sequence of sequence listing upward to telomere on chrosomal short arm and 5'-terminus of this base sequence : 154860
ggcactgtctattggtaatttaattggaagagagatgcagaaacaagagaaatgtggagaaggagtaaaaaaaaatgctccttcctttattaggaacaaaaattagcttcatctaagagtcttataatggcaacttgaaatgtattttcaaaaactcaactgtcagcacattctaggcttacattcttttacttatttatattttctaaaagcacataatttttatcttttaatctgtgactgaaatctccctctctgacccagaccacaacactgtgaatatgcacatacgtgcatacacaggtgcacatgtgcgcacacacacacacacacacaccccttagttatgcttcatcccaaaaggatgactgagtgtcccatcacaccccaggtgacaaactgttgagagtttagagcagaaatacatatcacttgag

SEQ ID NO: 7682 - DNA, 466 bp, Homo sapiens
  chr4.fa.O7frz.158144278
  Located on chromosome 4
  Distance between a terminus base of telomere on chromosomal short arm and 5'-terminus of this base sequence : 150298324
  Distance between 3'-terminus of neighbour sequence of sequence listing upward to telomere on chrosomal short arm and 5'-terminus of this base sequence : 72608
catggagtttacatccaagtagagaaagcatacaaaagctacatcttgtcatatggcaaaagtgctatggggaaaattaaagcagagtaagcggggtgagggggagagtaggagatggtgtactattttttttgagtagtcaagggagaattctgaataggtaacatttgagggaaaacttgaacaaaatgagggaggaagctatgtagatatcagaagagagtacgtgtcaagaaaaagagaacacatgtaaaaaaacctgaaaaattaataatttcttttcgtctacattatagggttgctgtgaggatcaaatgaaataatatatgtgatctgtatgtacgtacgtgtgtgtgtgtgtgtgtgtgtgtgtgtgtgtgtatttagagacagggtgtcactctgttgctcaggctggagtgcagtattataatcttaacacactgcagctccaaacttctggact

SEQ ID NO: 7683 - DNA, 225 bp, Homo sapiens
  chr4.fa.O7frz.158305468
  Located on chromosome 4
  Distance between a terminus base of telomere on chromosomal short arm and 5'-terminus of this base sequence : 150519369
  Distance between 3'-terminus of neighbour sequence of sequence listing upward to telomere on chrosomal short arm and 5'-terminus of this base sequence : 220579
tattagcttttcatgtaaaccaagaggtagacagaggatatttgttttagtttcaaggagctgaagggggagggagggaaggaaggggagagagagagagagagagagagagagagagagagaaatttttagttctgtgtatcttgcatggagatggtagtagctctcaggacactgcataatttcattatggaaaattaacactcattcaagtctcctaagacc

SEQ ID NO: 7684 - DNA, 474 bp, Homo sapiens
  chr4.fa.O7frz.158636853
  Located on chromosome 4
  Distance between a terminus base of telomere on chromosomal short arm and 5'-terminus of this base sequence : 150625311
  Distance between 3'-terminus of neighbour sequence of sequence listing upward to telomere on chrosomal short arm and 5'-terminus of this base sequence : 105717
atattaagttacaatgttggcaaggtattttatttaagcactgactagactttcctttaaactagttaagggtatgtttcatcacttcctattcctacaaccaccaaaaatagagttcccttccagagattttgtgtcttaatgctttatccaaaccaaactttctttctttctttttctctttctttctttcttttctttctttctttcttttctttcttttctttctttctttctttctttctttctttctttcttttttctttctttctttttctttcttccttccttcctttcccttcctcctcttctcccctcctccctttctctctctctctctctttctttccctttctttctttctttctttctttctttctttctttctttctttctttctttctttctttctttctttctttcttctttccttctctttctttctttcccctctttcaacagacatttgagtgt

SEQ ID NO: 7685 - DNA, 344 bp, Homo sapiens
  chr4.fa.O7frz.158479238
  Located on chromosome 4
  Distance between a terminus base of telomere on chromosomal short arm and 5'-terminus of this base sequence : 150753104
  Distance between 3'-terminus of neighbour sequence of sequence listing upward to telomere on chrosomal short arm and 5'-terminus of this base sequence : 127319
tttacagacttctaatagccacagcagtgggactactgaggaatatttcatttagattccatataatgagaatgtagatacatgtaaaagtaccaaaaagactgagcttgtgtgtgtgtgtgtgtgtgtgtgtgtgtgtgtgtgtgtacatgcgcatgtatgtgttttaactatgggtgtattgccatggcaacatctggagatggaatagagcaattaacaaactttgacaaactttttaaccaaacctttgtcattttgagatgtactaggatgtgtgcctacttgtatttctcttcctcctcctttcaccacaattttagttcttgatgttcataccaaag

SEQ ID NO: 7686 - DNA, 294 bp, Homo sapiens
  chr4.fa.O7frz.158404027
  Located on chromosome 4
  Distance between a terminus base of telomere on chromosomal short arm and 5'-terminus of this base sequence : 150828308
  Distance between 3'-terminus of neighbour sequence of sequence listing upward to telomere on chrosomal short arm and 5'-terminus of this base sequence : 74860
tgacatttagtagataaggcagatgttttcaaatgttgattcattgttatatatatatgtatatatgtatgtgtatatatatgtatatatgtatgtgtatatatatatgtatatttgtatctgtgtgtgtatatatatatatatatatatatattttagattttggaaagtgtgtgtgattaaataattcttccttttttccctcttacacattttgttcaaatggttcctcttatatttggcaagtagaaattattatatggtcctgtcttaaggcttcactgtctaaatagg

SEQ ID NO: 7687 - DNA, 274 bp, Homo sapiens
  DISD22_0004141
  Located on chromosome 4
  Distance between a terminus base of telomere on chromosomal short arm and 5'-terminus of this base sequence : 151128282
  Distance between 3'-terminus of neighbour sequence of sequence listing upward to telomere on chrosomal short arm and 5'-terminus of this base sequence : 299680
gataatggccagacaactccttaagtatatatatatacttccctttcccaataagaccacctattttccatttttcttaacacatgactaagctaactatatatatatatatatatatatatatatatatatatatatatatatatatatacacacacacacacacacatatgtgtgtatatatatatttgtgtgtgtgtatacatatgtacatatatattcattcaatccctggtaagacaaaaagattcttatttctcaggaataacatgga

SEQ ID NO: 7688 - DNA, 267 bp, Homo sapiens
  D4S3008
  Located on chromosome 4
  Distance between a terminus base of telomere on chromosomal short arm and 5'-terminus of this base sequence : 151233865
  Distance between 3'-terminus of neighbour sequence of sequence listing upward to telomere on chrosomal short arm and 5'-terminus of this base sequence : 105309
gcttgatcttgccttggatgttatgtttcaaaaaaggagtttaggtgcttttacctgatacttggcttttgctataaaatgtaattgtcttcaagacatgcgtataaaaactagaggacaagattatgccaagttccttgcctctgccacactttctttgtgtgtgtgtgtgtgtgtgtgtgtgtgtgttgtgtgtgtgtgatgttctttattagcaaaatttaacagagaagtagccattaaggtagtctcaaatccattcagtta

SEQ ID NO: 7689 - DNA, 143 bp, Homo sapiens
  D4S2962
  Located on chromosome 4
  Distance between a terminus base of telomere on chromosomal short arm and 5'-terminus of this base sequence : 151301924
  Distance between 3'-terminus of neighbour sequence of sequence listing upward to telomere on chrosomal short arm and 5'-terminus of this base sequence : 67792
tagcaggctatctctcaatacacacacacacacacacacacacacacagagagagagagagagagagagagagagagagagagagagaaaggaatttattgcaaggaataggtttatgcagttgtgtgcttgactagccaagt

SEQ ID NO: 7690 - DNA, 292 bp, Homo sapiens
  chr4.fa.O7frz.159243680
  Located on chromosome 4
  Distance between a terminus base of telomere on chromosomal short arm and 5'-terminus of this base sequence : 151482498
  Distance between 3'-terminus of neighbour sequence of sequence listing upward to telomere on chrosomal short arm and 5'-terminus of this base sequence : 180431
cacatactgatgtatgctaatgactcctccttagaagccaggcacagaaggtgacatgcaacaaattccagtttattccacaaagtcagtcgaaagttataagctaatagtttgatgaagaccaaagtcattaatcagactaaatcttcacaaacccttcctggagtcaacaatcttcacagataatgacacatagaaataaaggttctgaatcccaggtgtgtgtgtgtgtgtgtgtgtgtgtgtgtgtgtacacatgtgcacaagagtaggctgtatattgatagatgga

SEQ ID NO: 7691 - DNA, 127 bp, Homo sapiens
  D4S2908
  Located on chromosome 4
  Distance between a terminus base of telomere on chromosomal short arm and 5'-terminus of this base sequence : 151561274
  Distance between 3'-terminus of neighbour sequence of sequence listing upward to telomere on chrosomal short arm and 5'-terminus of this base sequence : 78484
cactcactgatgactccctcacttcacacacacacacacacacacacacacacacccatagcacattggcatttgaccacctaaatactacctgtattttttattaacttattctgccccacagtca

SEQ ID NO: 7692 - DNA, 401 bp, Homo sapiens
  chr4.fa.O7frz.159541109
  Located on chromosome 4
  Distance between a terminus base of telomere on chromosomal short arm and 5'-terminus of this base sequence : 151699767
  Distance between 3'-terminus of neighbour sequence of sequence listing upward to telomere on chrosomal short arm and 5'-terminus of this base sequence : 138366
ctcctttaaacctgttcagattttgttttgggcccttatttttgcctccatagctgcctgcatgttgagctttctgtctcacactggtcaggaacaaaaggcccctcagagagtctgtactattaaagaattgaaatgtattcaactcaatatattttatttctaacattcaaaatcagaacttcaaaatgaaattggaagattctataagaacattctttcttaaataaaatgaaatatatatgtgtatatatatacacatacacacacacacacacacacacacacacacacacgattaaaaagaaagaagaggtgatctgcctgaataatgcttaccaaggagactttcttcaaggtatagccaaatatgtaaagttcttagaacagtgtctagcatg

SEQ ID NO: 7693 - DNA, 415 bp, Homo sapiens
  chr4.fa.O7frz.159690291
  Located on chromosome 4
  Distance between a terminus base of telomere on chromosomal short arm and 5'-terminus of this base sequence : 152004727
  Distance between 3'-terminus of neighbour sequence of sequence listing upward to telomere on chrosomal short arm and 5'-terminus of this base sequence : 304559
agtaggcacttgattaatgttagaatgaatgaatgtgcagtagtacattccttggtgagagttactttactttatatcagatcctgggcattttatcagatgttctacattaaaaagtatcaactgaatttgggccactactaggaacagttaaatacgtagtcccaggctgggcacagtgtctcacatgtgtaataccagcactttgagaggccagagtgagaggatcacctgagcccaggaggttgaggctgcagtgagctgtgatcgtgccactgcactccagcctgggcaacagagtgactctatctcaaaatgtgtgtgtgtgtgtgtgtgtgtgtgtgtgtgtgtagtctcatatacttgtgaaatttaagcatgggcaaataatgattgcattagactaaagaggtct

SEQ ID NO: 7694 - DNA, 138 bp, Homo sapiens
  D4S1606
  Located on chromosome 4
  Distance between a terminus base of telomere on chromosomal short arm and 5'-terminus of this base sequence : 152017715
  Distance between 3'-terminus of neighbour sequence of sequence listing upward to telomere on chrosomal short arm and 5'-terminus of this base sequence : 12573
ctttttgtattatttgactcttgaaatagttaacatgtattgctttgataaatacatttttaaagcactttgtataactatttaattatacacacacacacacacacacacacacacaagtagtgaacccagagttct

SEQ ID NO: 7695 - DNA, 356 bp, Homo sapiens
  chr4.fa.O7frz.159920719
  Located on chromosome 4
  Distance between a terminus base of telomere on chromosomal short arm and 5'-terminus of this base sequence : 152103351
  Distance between 3'-terminus of neighbour sequence of sequence listing upward to telomere on chrosomal short arm and 5'-terminus of this base sequence : 85498
aggtggcctaacacctactgcgccaactcagggcacaagtgaggaaaccatggtgccttggacaggacaccaggtgccatcccatagcagggagcacgtgcgcgcgtgcacacacgcacacacacacacacacacagagtcagatgggtaccaggtagacacaccagttcaccttatgtgcacatctttgggatgtgggaagaaaccagagtacctggaaaaagcccacacagacatgggaagaacatgcaaacaccacacagaaagtggccccggccatgaattgatgttttttttctcaccagcgatataacaaaacattgaatgaaatgacgttatttgaggacatgctgtac

SEQ ID NO: 7696 - DNA, 115 bp, Homo sapiens
  DISO7_10001656
  Located on chromosome 4
  Distance between a terminus base of telomere on chromosomal short arm and 5'-terminus of this base sequence : 152162997
  Distance between 3'-terminus of neighbour sequence of sequence listing upward to telomere on chrosomal short arm and 5'-terminus of this base sequence : 59290
ctgatacctaatggaagccctcattactacacacacacacacacacacacacacacacacacaccacacactaaattacttcctaactttactttctgcctagtctctagccacc

SEQ ID NO: 7697 - DNA, 215 bp, Homo sapiens
  D4S1549
  Located on chromosome 4
  Distance between a terminus base of telomere on chromosomal short arm and 5'-terminus of this base sequence : 152424245
  Distance between 3'-terminus of neighbour sequence of sequence listing upward to telomere on chrosomal short arm and 5'-terminus of this base sequence : 261133
aaagttccaatctccccaaattattttatttatttagagacaaagccttactacatccccagtgctaaaacagtgaccagtacatatgaattagtgatccacaaatgttcaatcaacatacatttctaaaaggaagtctgcaatggaacacacacacacacacacacacacacacacacacacacacacacacacacagtgattgcagcataaga

SEQ ID NO: 7698 - DNA, 461 bp, Homo sapiens
  chr4.fa.O7frz.164052243
  Located on chromosome 4
  Distance between a terminus base of telomere on chromosomal short arm and 5'-terminus of this base sequence : 152510124
  Distance between 3'-terminus of neighbour sequence of sequence listing upward to telomere on chrosomal short arm and 5'-terminus of this base sequence : 85664
caatcatagttcactgttacgttacttcaaactcctgggctcaagtgatcctcccacctcagcctcctgagtagctagaaatacaggtgcatgccaccatcccagctaatggtgtgtgtgtgtgtgtgtgtgtgtgtgtgtgtgtgtgtgtagattgagactcactatgttgcccaggctggtctcaaattcctggcctcaagccatctttcagacttggcctcccaaagtgctgggattagaggtgtgagccaccattcccagcccttatattgtgtgtacgtaaggtttagaaatgtgtatctaaacaaatataaacatagaaaaggtatagtaaaaatccaatataaaagatttaaaatggtacctacataaggtatttaccatgaatggagcttataaaactagaagttgccctgggtcaatcagtgagtaagtggtgagtaaatgtgcaggtctag

SEQ ID NO: 7699 - DNA, 399 bp, Homo sapiens
  chr4.fa.O7frz.163942915
  Located on chromosome 4
  Distance between a terminus base of telomere on chromosomal short arm and 5'-terminus of this base sequence : 152619482
  Distance between 3'-terminus of neighbour sequence of sequence listing upward to telomere on chrosomal short arm and 5'-terminus of this base sequence : 108897
tgcagtaagccttgatcacactactgcacttcagcctgggcagcaaagcaagaccctgtctcaaaaaaataataataatatatacttgtgtgtgtgtgtgtgtgtgtgtgtgtgtgtgtgtacacacacacacacacacacacacacacacacacaaaagtatactgtaaatgtaactcatatgcattggaaaaccaaaaaatgtgtgactcatattcactactttattgcagtgctctcaaacaaaatctgcaatatctccaaggtatgcctgtactaatcaggcctaactccgcttagcttcaaagatcagacaacactgggtgtgctcagggtggtataactgtgtctagagtattagttatctttatatgagtcttgtttccatcagactgtaag

SEQ ID NO: 7700 - DNA, 263 bp, Homo sapiens
  D4S1548
  Located on chromosome 4
  Distance between a terminus base of telomere on chromosomal short arm and 5'-terminus of this base sequence : 152929259
  Distance between 3'-terminus of neighbour sequence of sequence listing upward to telomere on chrosomal short arm and 5'-terminus of this base sequence : 309378
ttacccaactgctacaccatatacatgcttcattttcattcccatcacactagggggaaatgctaaagttacatttctgaaaaccacaacaaaacaacactgtgtgtgtgtgtgtgtgtgtgtgtgtgtgtgtgtgtgtgtgtgtgtgtattctctgtaggatgacaaaaaaatgttaatagtcctttcacatcttcctttgcaaaagaatttcccgcccacaaaacctgtatatatttaaatgtttcaccttgtttatggca

SEQ ID NO: 7701 - DNA, 374 bp, Homo sapiens
  AC026556.3_55034
  Located on chromosome 4
  Distance between a terminus base of telomere on chromosomal short arm and 5'-terminus of this base sequence : 152979857
  Distance between 3'-terminus of neighbour sequence of sequence listing upward to telomere on chrosomal short arm and 5'-terminus of this base sequence : 50335
tgtaagaaagctcaatcctcaccttccacactaggaactcaggattctaaaactgaaaaagaaaaatcaagaaacagctatatataggatttcttgaaaacacttgaaaattactaagagctaaaagagttgaaagtcattgcctctaaatagtttgaactgagggtggtggggcagagaacttgttatttatttatttatttatttatttattttgtacatcttatcaaattacctggcattttaactgtgtatatgtgtaactgtggttatattttgctttaaaattttattcagaaatgaaggtctagtgctcagaacagaaattagtatggacaataaacagcaatgtctattaagcatacaggtgatgg

SEQ ID NO: 7702 - DNA, 264 bp, Homo sapiens
  chr4.fa.O7frz.163337786
  Located on chromosome 4
  Distance between a terminus base of telomere on chromosomal short arm and 5'-terminus of this base sequence : 153225429
  Distance between 3'-terminus of neighbour sequence of sequence listing upward to telomere on chrosomal short arm and 5'-terminus of this base sequence : 245198
aaattagccaggtagtctcaactgctagtgaggctgaggtgggaggattgcttgagcctagaagatcaaggctgcagtgagctgtgatcgtaccactgtgctctagcctgagtgatagaacaagaccccatctcaaaaaacaaacaaacaaacaaacaaacaaacaaacaaactaaaggaaatcaggagaacaattcatgaccaaataggtaatatcagtttaaaaaaatagaaattataaagtgaaaccatgtagaaattcag

SEQ ID NO: 7703 - DNA, 107 bp, Homo sapiens
  DISD22_0004151
  Located on chromosome 4
  Distance between a terminus base of telomere on chromosomal short arm and 5'-terminus of this base sequence : 153296493
  Distance between 3'-terminus of neighbour sequence of sequence listing upward to telomere on chrosomal short arm and 5'-terminus of this base sequence : 70800
caaggctaatgatgcatccaaacacacacacacacacacacacatacacacacacacatgtctgcgtttcttaaagtttgtagatcaacaaatgtctagctatgatc

SEQ ID NO: 7704 - DNA, 194 bp, Homo sapiens
  AC010771.3_7607
  Located on chromosome 4
  Distance between a terminus base of telomere on chromosomal short arm and 5'-terminus of this base sequence : 153584494
  Distance between 3'-terminus of neighbour sequence of sequence listing upward to telomere on chrosomal short arm and 5'-terminus of this base sequence : 287894
gatgattcaagtgcattacatttattgtctactgtatttctattattattattattacattgtaatatgtaaagaaataattatacaactcaccataaggtagaatcagtggaagccctgagcttgtttttctatagctagacaatcccatctgggggtgatgggagatggtgacagatcattaggcattagat

SEQ ID NO: 7705 - DNA, 113 bp, Homo sapiens
  D4S2428
  Located on chromosome 4
  Distance between a terminus base of telomere on chromosomal short arm and 5'-terminus of this base sequence : 153590060
  Distance between 3'-terminus of neighbour sequence of sequence listing upward to telomere on chrosomal short arm and 5'-terminus of this base sequence : 5372
aagtttggaattcaatattgtggtgttattacatgtattatatattacatatatatcttctatctatctatctatctatctatctatctatctgtttttgtccatggtttctg

SEQ ID NO: 7706 - DNA, 323 bp, Homo sapiens
  chr4.fa.O7frz.162951556
  Located on chromosome 4
  Distance between a terminus base of telomere on chromosomal short arm and 5'-terminus of this base sequence : 153712403
  Distance between 3'-terminus of neighbour sequence of sequence listing upward to telomere on chrosomal short arm and 5'-terminus of this base sequence : 122230
agccttggttcttatgtacatcatgataataataccaatatcacagggtttttgttgtttggatgaaaaatgtgtgtgtgtgtgtttgagtatgtgtgtgtgtgtgtgtgtgtgtgtgtgtgtgtgtgtgtgtgtatgtagcctggctattttatgcatttgataaatgatagttattattattataaaccagaagagtccaagttgaaaccagggtgcttggcaacctgccacagcagttcttagcccccagataggaaaatgacttacaggtgatgaaattggtcaagaaatctaatgtaacatcaaggtgatctatgatc

SEQ ID NO: 7707 - DNA, 295 bp, Homo sapiens
  chr4.fa.O7frz.162664341
  Located on chromosome 4
  Distance between a terminus base of telomere on chromosomal short arm and 5'-terminus of this base sequence : 153967486
  Distance between 3'-terminus of neighbour sequence of sequence listing upward to telomere on chrosomal short arm and 5'-terminus of this base sequence : 254760
caagttactggcctctacaactggcataatccaattcctcaaaataaatccagatagagagagagagagagagagagagagagagagagttctgtttctccagagaacccttgactaaaatatggtcttttgtctgacacttgcttcaaaataagagaaatcgggggagtgaattggcaaatagatggggcacaactgaccatgggttaatggctgttggagctggatgaaggatattttttaaaataggagtaatagtatctaattttatgtatgttcaaagttctccataatg

SEQ ID NO: 7708 - DNA, 189 bp, Homo sapiens
  chr4.fa.O7frz.162826140
  Located on chromosome 4
  Distance between a terminus base of telomere on chromosomal short arm and 5'-terminus of this base sequence : 153998357
  Distance between 3'-terminus of neighbour sequence of sequence listing upward to telomere on chrosomal short arm and 5'-terminus of this base sequence : 30576
tagatgaggaaatcagttcattactgaaaggaaaataacagcatttacacccatttccaacaccaaacacacacacacacacacacacacacacacacacacactggcatggttcatttcggtcactgaatataactccttcttttagagaaaaacaaatgtttagggtttcatgagtcatacaaacgt

SEQ ID NO: 7709 - DNA, 466 bp, Homo sapiens
  AC023424.4_170514
  Located on chromosome 4
  Distance between a terminus base of telomere on chromosomal short arm and 5'-terminus of this base sequence : 154091718
  Distance between 3'-terminus of neighbour sequence of sequence listing upward to telomere on chrosomal short arm and 5'-terminus of this base sequence : 93172
taattgatagtgagattaagccaagggtttgcatccatattttctttgctgggctctttgcccttgagcaactgctctcagcacctgtcagctgtctgtaactgaaaccattgtgttttaaagaaggtatgcttacaggtagcttctttctcaccttagcatcctgatgattacgactgctttccaaataccagagatgttttcacttttatttcctcacttgataagatacttcttttggtctagctatttaaacaaacaaacaaacagacagacaacaacaacaacaaacacttagtgtatgtaaaaacttcttttcttgcaaggatcggagggtcagtcattttattttcagaaataatttctaacttcagatctcccacattgttttgggatgacacagagagttatcaaagaaaaggaaggaatagctggttttcctctgagttcttaagagcatcctaaa

SEQ ID NO: 7710 - DNA, 146 bp, Homo sapiens
  DISO7_10016274
  Located on chromosome 4
  Distance between a terminus base of telomere on chromosomal short arm and 5'-terminus of this base sequence : 154142743
  Distance between 3'-terminus of neighbour sequence of sequence listing upward to telomere on chrosomal short arm and 5'-terminus of this base sequence : 50559
tctcaaggcaaattgttggtttgtttttggaagaatgtatgtgtgtgtgtatatatatgtgtgtgtgtgtgtgtgtgtgtgtgtgtgtgtgtgtatataatttttaaatttttaacaaaaattcctgatctagtcaatgcttatga

SEQ ID NO: 7711 - DNA, 173 bp, Homo sapiens
  chr4.fa.O7frz.162477386
  Located on chromosome 4
  Distance between a terminus base of telomere on chromosomal short arm and 5'-terminus of this base sequence : 154252459
  Distance between 3'-terminus of neighbour sequence of sequence listing upward to telomere on chrosomal short arm and 5'-terminus of this base sequence : 109570
agtattcaacagactgtagcctactgttttctttaaaggacccatttcagttcaaataccctattgagaagttttccactgctaagtggattttgtgtgtgtgtgtgtgtgtgtgtgtgtgtgtgtgtggtaagagctgttctttaaatgagtgaaatgacctttgtttaatg

SEQ ID NO: 7712 - DNA, 238 bp, Homo sapiens
  D4S1588
  Located on chromosome 4
  Distance between a terminus base of telomere on chromosomal short arm and 5'-terminus of this base sequence : 154575306
  Distance between 3'-terminus of neighbour sequence of sequence listing upward to telomere on chrosomal short arm and 5'-terminus of this base sequence : 322674
ccggacatctgaggtcttatttacaactgcaaaatgttaaataagaattctgattcccatccaatatgacattcattaaaattgaactttaataataaatgatgtaaaaatatttgaaacacgatgctaaatgaaaaaacaggatagaaaatttgtttcactatattacacacacacacacacacacacacacacacacacacacacacacacacacttctctctagccatttctgaa

SEQ ID NO: 7713 - DNA, 425 bp, Homo sapiens
  chr4.fa.O7frz.162138122
  Located on chromosome 4
  Distance between a terminus base of telomere on chromosomal short arm and 5'-terminus of this base sequence : 154671735
  Distance between 3'-terminus of neighbour sequence of sequence listing upward to telomere on chrosomal short arm and 5'-terminus of this base sequence : 96191
ttgtctctttacttccatctacatttctattaaccccattcatattggatattgtgtgagaaccactttaaaaggcaaagaagagcatagaccggggttgggagaggagaggagaggagaggagaggagaggagaggagaggagaaaaaacaacaacaacaaaaaacatcacactttttttggtaataccattagaaatacagtattataaatgagcaacctcttcaaattgagagaagcagagttgaatataaatcacccaaatatttttgggtgcatatgcataagccgttggctgtgcatgttcctctatgttctaagatccagttccaccctgctctgtgccctgggaggaaggcatccataagctgcatcagttgggctccttactccctagctctgacttagatcatgaccataggaca

SEQ ID NO: 7714 - DNA, 191 bp, Homo sapiens
  D4S2934
  Located on chromosome 4
  Distance between a terminus base of telomere on chromosomal short arm and 5'-terminus of this base sequence : 154745976
  Distance between 3'-terminus of neighbour sequence of sequence listing upward to telomere on chrosomal short arm and 5'-terminus of this base sequence : 73816
caaaacagatcaggatgtggactgctcagacaggaaaagacaaggtccagataaaagtggtagaggggaccagcgtcaggaaatctcagaaagcaagttacacacacacacacacacacacacacacacacacacacacacacacacactcacacattgaaaaaccagagggtgctctgtaaagacagaaa

SEQ ID NO: 7715 - DNA, 198 bp, Homo sapiens
  DISD22_0004155
  Located on chromosome 4
  Distance between a terminus base of telomere on chromosomal short arm and 5'-terminus of this base sequence : 154801379
  Distance between 3'-terminus of neighbour sequence of sequence listing upward to telomere on chrosomal short arm and 5'-terminus of this base sequence : 55212
aaccttggagagcttggacacaccctgcctgaagacaaaagttaaaggggatggcttctgaatgccttccccccaaaacacacacacccacccacacacccacccccccccccacacacacacacacacacacacacatcatcatcatcatcatcatgatcatcatcatcatcatcaggaaagataatgcatctagcc

SEQ ID NO: 7716 - DNA, 463 bp, Homo sapiens
  chr4.fa.O7frz.161854285
  Located on chromosome 4
  Distance between a terminus base of telomere on chromosomal short arm and 5'-terminus of this base sequence : 154963589
  Distance between 3'-terminus of neighbour sequence of sequence listing upward to telomere on chrosomal short arm and 5'-terminus of this base sequence : 162012
catttgcattggctaatattactcataaaactgtagtggagcccgggcgcggtggctcaagcctgtaatcccagcactttgggaggccaaggcgggcagatctcctgaggtcaggagttcaagaccagcctggccaacatggtgaaaccctgtctctactaaaaatacaaatattagccgggcgtggtggtgtgaacctgtaatcccagctattagggagactgaggtaggagaattgcttgaactagggaggtggaggtggcagtgagccaagatcatatcactgcactccagcctgggcaacagagtgagactccatctaaaatacacaaacacacacacacacacacacacatatatatatatatatatttattagaagttttctttcctttcataggtcccaaaacaatttatgtagcattgggactatttggtctctaaagatactcaactataggcc

SEQ ID NO: 7717 - DNA, 118 bp, Homo sapiens
  DISD22_0004163
  Located on chromosome 4
  Distance between a terminus base of telomere on chromosomal short arm and 5'-terminus of this base sequence : 155167803
  Distance between 3'-terminus of neighbour sequence of sequence listing upward to telomere on chrosomal short arm and 5'-terminus of this base sequence : 203751
cgttccattcatctgtttctctctctctctctctttgtgtgtgtgtgtgtgtgtgtgtgtgtgtgtgtgtgtgtgtgtgttatgcctagaaaacatttctcaagaattagaattacga

SEQ ID NO: 7718 - DNA, 208 bp, Homo sapiens
  D4S3049
  Located on chromosome 4
  Distance between a terminus base of telomere on chromosomal short arm and 5'-terminus of this base sequence : 155318456
  Distance between 3'-terminus of neighbour sequence of sequence listing upward to telomere on chrosomal short arm and 5'-terminus of this base sequence : 150535
attcagttctctgcgaatgccattatttcattccttttcatggctgaatagtattccatgacacacacacacacacacacacacacacacacacacatccctatatatctatatctatatctatatctatatctaccacattttctttttttttttttgagatggagtttcactctgtcacccaggctggagtacagtggcacgaact

SEQ ID NO: 7719 - DNA, 214 bp, Homo sapiens
  D4S2999
  Located on chromosome 4
  Distance between a terminus base of telomere on chromosomal short arm and 5'-terminus of this base sequence : 155351373
  Distance between 3'-terminus of neighbour sequence of sequence listing upward to telomere on chrosomal short arm and 5'-terminus of this base sequence : 32709
gtttgttgcctgaatttccctgtctctagaatatctttctgtgtcttctctataaataaacacatcttccaagtagaagttagaaatctcaagtgttattatcttataaggtgtgagggttatgcatttggctgaatattatctctccatgtacacacacacacacacacacacacacacacacacacacacaagacttgaggaaatggacatg

SEQ ID NO: 7720 - DNA, 231 bp, Homo sapiens
  D4S3021
  Located on chromosome 4
  Distance between a terminus base of telomere on chromosomal short arm and 5'-terminus of this base sequence : 155499634
  Distance between 3'-terminus of neighbour sequence of sequence listing upward to telomere on chrosomal short arm and 5'-terminus of this base sequence : 148047
actggcctgatgtggtgattttcacagacattttattgtattttctgaggtacattctcaggaccagcagggcaggagtgggcatccagtagcagcagacctctgtctccctttctctctctcctcacagacacacacacacggcacacacacacacacacacacacacacacgtctcctataagcagttcaccacagcactattttcagcctttcaggctatcaggcacc

SEQ ID NO: 7721 - DNA, 391 bp, Homo sapiens
  chr4.fa.O7frz.160938105
  Located on chromosome 4
  Distance between a terminus base of telomere on chromosomal short arm and 5'-terminus of this base sequence : 155675096
  Distance between 3'-terminus of neighbour sequence of sequence listing upward to telomere on chrosomal short arm and 5'-terminus of this base sequence : 175231
tgcaaagtagcagtcttgatacaggatgagaatgataattcaccatgctttgaacaaagcatttaccaggcatcagtgtctgaaagccaactctacaatgctcatgtcatacaggtaacagaaatatatttgtgtgtgtgtgtgtgtgtgtgtgtgtgggtgtgtctgtgtgagagagagagagagaattattacaagtcaatgtacataaaaatttctaatccctgtagtacaacactctttccaggccatgtacattttatagatgggatgaaaccttaggttaaagaaaatctgaaattcttgcactgtctcttcctctttatttattcagtgctcaattactgacatctgctttctctaggagtactgttgagcactagaagtatgc

SEQ ID NO: 7722 - DNA, 198 bp, Homo sapiens
  DISO7_10001661
  Located on chromosome 4
  Distance between a terminus base of telomere on chromosomal short arm and 5'-terminus of this base sequence : 155866095
  Distance between 3'-terminus of neighbour sequence of sequence listing upward to telomere on chrosomal short arm and 5'-terminus of this base sequence : 190608
tggaatctatatgaagtctctatgctgatgtatatagagccctgacttttaaaaatttgttgtattgtatcaactttagtttggggagagagacagaaggagggagagagagacagagagagagagagagagagagagagagagagagaaaagagagaatagcttacaggatttttagtttacctaatgacctctgcc

SEQ ID NO: 7723 - DNA, 112 bp, Homo sapiens
  DISO7_10001662
  Located on chromosome 4
  Distance between a terminus base of telomere on chromosomal short arm and 5'-terminus of this base sequence : 155867520
  Distance between 3'-terminus of neighbour sequence of sequence listing upward to telomere on chrosomal short arm and 5'-terminus of this base sequence : 1227
ggaaaccatgagcgagagaaagagagggagatagacatagagagagagagagagagagagagagagagagagagagagagagagagaatgtgtagatactgctggagacaga

SEQ ID NO: 7724 - DNA, 115 bp, Homo sapiens
  DISO7_10001663
  Located on chromosome 4
  Distance between a terminus base of telomere on chromosomal short arm and 5'-terminus of this base sequence : 155872088
  Distance between 3'-terminus of neighbour sequence of sequence listing upward to telomere on chrosomal short arm and 5'-terminus of this base sequence : 4456
atcgatatcctggcaaggggtgtgtgtgtgtgtgtgtgtgcgcgcgcatgtgtgtataaatgctatttgaacaatgggaatatataaaatgattggaccattgtacataagtagt

SEQ ID NO: 7725 - DNA, 397 bp, Homo sapiens
  chr4.fa.O7frz.160680734
  Located on chromosome 4
  Distance between a terminus base of telomere on chromosomal short arm and 5'-terminus of this base sequence : 155922284
  Distance between 3'-terminus of neighbour sequence of sequence listing upward to telomere on chrosomal short arm and 5'-terminus of this base sequence : 50081
atagcacattgtggaacttcttggcttctataactgtgtgagccaattcccgtgataaattctctcacatccatctatgtatgtatgtatgtacgtacgtatctatctatctatctatctatctatctatctatctatctatctatctatctatctgtctgtctgtctcccatcggttctgtttctctggagaactctgactccttttttttctcacttcttctctccatctggtctccccagcccatcaaatctacctctaaatatatgtcaagtctgccctgttcagtcagcccccatggctgttattttaagccttgactatttctacctgtgttaaactaacaatctcctaacttatctaatttaccttcttagaaaccattctgtactgcta

SEQ ID NO: 7726 - DNA, 217 bp, Homo sapiens
  DISO7_10001660
  Located on chromosome 4
  Distance between a terminus base of telomere on chromosomal short arm and 5'-terminus of this base sequence : 156008651
  Distance between 3'-terminus of neighbour sequence of sequence listing upward to telomere on chrosomal short arm and 5'-terminus of this base sequence : 85970
gctgttgaatatcacataattggtaagtttgtttgtttgtttgtttgtttgtttgtttttttaagacagagtctcactctgtcacccaggctggagtgcagtggcgcgatggctcactgcaacttcacctcccaggttcaagcaattcttgtgcctcagcctcccaaattggtaagtatttttaaattaaaatttattccaggatgctgactgagtt

SEQ ID NO: 7727 - DNA, 376 bp, Homo sapiens
  AC027377.2_68972
  Located on chromosome 4
  Distance between a terminus base of telomere on chromosomal short arm and 5'-terminus of this base sequence : 156136943
  Distance between 3'-terminus of neighbour sequence of sequence listing upward to telomere on chrosomal short arm and 5'-terminus of this base sequence : 128075
tgtgatcagtccactgcacttcagccttccagtctgagtgacagagaccctgtctctaaaacaaacaaacaaacaaacaaacaaacaaacaaagaatggtagggacaagtcagaagaacacacaggtcagtctgaaggaattttcacaggacaaactggaacaacctgatcatcaaaagaaataaaaatattaatggatctaatccattgaataaaataatacaatgaaatccacagcaatattaataggcaggagagaatagaaacctttttcttatgatggaaatataactccttactgtagaaagaatgactagaataattaccatttggcaatcatcatcacaataactaatccagacaagaattatcaatg

SEQ ID NO: 7728 - DNA, 429 bp, Homo sapiens
  AC009567.8_127610
  Located on chromosome 4
  Distance between a terminus base of telomere on chromosomal short arm and 5'-terminus of this base sequence : 156170386
  Distance between 3'-terminus of neighbour sequence of sequence listing upward to telomere on chrosomal short arm and 5'-terminus of this base sequence : 33067
cacaattaatgcctggttctagttttgttaatgtatctgttatgggctgactatctgtgtatccgctaaattcatatactgaaatcctaacccctagtgtgatggtatttggaggtgggatctttgggaggtgattagagttggatgacatcatagggtggtgtcccatgatggtattagtgttcttagaagaagagagaccagagatctctctctctctctctctctctctccctgccatgtgaggacacagtgagaaggtggccatctgcaagccaggaaaatgacctccaccaggaatggaatctgccaacaccttggtcgtggacttctcagactccagaacaatgagaaataaatgtctgtcaagtcacccagtctatggtattttcttatagcagcttgagctaagacagtagccatgcaagt

SEQ ID NO: 7729 - DNA, 297 bp, Homo sapiens
  AC009567.8_76293
  Located on chromosome 4
  Distance between a terminus base of telomere on chromosomal short arm and 5'-terminus of this base sequence : 156221858
  Distance between 3'-terminus of neighbour sequence of sequence listing upward to telomere on chrosomal short arm and 5'-terminus of this base sequence : 51043
ctcacagttccttgtggtagataggatatgtgtgtgtgtgtgtgtctgtgtgtgtgtgtgtgtgtgtgtgtgtgtgtgacagagtttcgctgtgtcacccaggctggagtgcagtggtgcgatcttggctcattgcaacatccgcctcccgggttcaagtgattctcctgcctcagcctcccgagtagctgggattacaggcatgtactacaatgcctggctaattttcatatttttagtagagacggggtttccctgtgttggccaggctggtcactaattcctgacctcaagtga

SEQ ID NO: 7730 - DNA, 119 bp, Homo sapiens
  D4S2976
  Located on chromosome 4
  Distance between a terminus base of telomere on chromosomal short arm and 5'-terminus of this base sequence : 156285358
  Distance between 3'-terminus of neighbour sequence of sequence listing upward to telomere on chrosomal short arm and 5'-terminus of this base sequence : 63203
caaaggtttttaacatcccaagcctggggtaccattacaaattctgatgagtaaagaaatgtgtgtgtgtgtgtgtgtgtgtgtgtgtgtgtgtgtttccccttcttttgggggtggaa

SEQ ID NO: 7731 - DNA, 208 bp, Homo sapiens
  chr4.fa.O7frz.165104406
  Located on chromosome 4
  Distance between a terminus base of telomere on chromosomal short arm and 5'-terminus of this base sequence : 156510424
  Distance between 3'-terminus of neighbour sequence of sequence listing upward to telomere on chrosomal short arm and 5'-terminus of this base sequence : 224947
gaatcaacctaagtgtacatcaacatatgattgtataaagaaaatgtgtatacacacacacacacacacacacacacacacacacacaggaatactattcagccacacagaaaagaaataatatcttttacaacatggatggaactggaggctattaccttaagtgaaataaatcagaaacagaaagtcaaatggtacatgttctcac

SEQ ID NO: 7732 - DNA, 472 bp, Homo sapiens
  chr4.fa.O7frz.165013333
  Located on chromosome 4
  Distance between a terminus base of telomere on chromosomal short arm and 5'-terminus of this base sequence : 156628859
  Distance between 3'-terminus of neighbour sequence of sequence listing upward to telomere on chrosomal short arm and 5'-terminus of this base sequence : 118227
tctaattgttaaagcagtttgaacaatcctaaattgggaataaattgaaggattgtaatctgggttgtattataatccgatttatatttgggagctatatctttgacaggaaggataaggatggaaggaatcatttaggaggctactgtagataatccatatttgagatggtgaggactcagaccaaggaagatgattagagagttatatctagcctgcctttctttctttctttccttccttccttccttccttccttccttccttccttccttccttccttcccttctttctttcctaatttttttcctggacttctttttaattccgaggtaaggttgcgtatatatgccaagtaaaaaggcaatggcaattgggataagtgggaaattcacaaacccaagacctttagtaggtaaatctgtaagatctggtgattgattgggtgtggtggatgaataaggagaaatct

SEQ ID NO: 7733 - DNA, 469 bp, Homo sapiens
  chr4.fa.O7frz.164938286
  Located on chromosome 4
  Distance between a terminus base of telomere on chromosomal short arm and 5'-terminus of this base sequence : 156675327
  Distance between 3'-terminus of neighbour sequence of sequence listing upward to telomere on chrosomal short arm and 5'-terminus of this base sequence : 45996
aattaccttaggaatcctttaagcctcatctctgaggaaaccatttgcattcatagcatgcatatctttattattattattattattattattattattattattattattttgagactgagtctcgatctgtcgcccaggctggagtgcagtggcatgatctcagctcactgcaacctttgcctcccaggttcaagcgattctcctgcctcagcctcccaagtagctgggattacaggcttgcaccactgtgctcagctaatttttgtattttcagtagaggcagggtttcaccatgttgaccagtctggtctcaaactcctgacctcaggtgatctgcctgcctcggcctcccaaaggactgggattacaggtgtgagccaccatgcctggctatatgcatgcatatcgatagtcaattgactgttgttttgtctggttttatgtggtccacttacaccaagacatc

SEQ ID NO: 7734 - DNA, 420 bp, Homo sapiens
  chr4.fa.O7frz.165412511
  Located on chromosome 4
  Distance between a terminus base of telomere on chromosomal short arm and 5'-terminus of this base sequence : 156750619
  Distance between 3'-terminus of neighbour sequence of sequence listing upward to telomere on chrosomal short arm and 5'-terminus of this base sequence : 74823
gtctgttgcactgcttatttactgggatagttgttccaaagcaaaaacaccttcaacctcattttggtgacacttttgccaatcttgacatccgggtcacctttgtggtctgacttgatcattttcttactaaactctgggggttttagaagcaggcacctagtccttatagcgtttgtagcctcagaacctagctcagtgcctgctgcatagtaatcccttaataatgcttttaaatgaaagaaaaagcttgccacacagaaaaacagaatgtatatacgtgtgtgtttgtgtgtgtgtgtgtgtgtgtgtgtcatattatgtaacagtttgtatcctgggaaatcatttgcctgatcaaaatattgattgctccgggaagtactgggtgaactgagtatattccttatggcagacaag

SEQ ID NO: 7735 - DNA, 208 bp, Homo sapiens
  G09992
  Located on chromosome 4
  Distance between a terminus base of telomere on chromosomal short arm and 5'-terminus of this base sequence : 156822472
  Distance between 3'-terminus of neighbour sequence of sequence listing upward to telomere on chrosomal short arm and 5'-terminus of this base sequence : 71433
ttcaatactcctgtatcacaaaggtattctcaatctgtctcatctatctgtctatttatcatctatctatctatctatctatctatctatctatctatctatctatctatcatctgtctgtctaatctatccatccattattaaaggttgtatcttcacattgtagtctgtagtgaatgctgtggagcatagctcagattgtttctca

SEQ ID NO: 7736 - DNA, 259 bp, Homo sapiens
  AC027561.2_113554
  Located on chromosome 4
  Distance between a terminus base of telomere on chromosomal short arm and 5'-terminus of this base sequence : 156985601
  Distance between 3'-terminus of neighbour sequence of sequence listing upward to telomere on chrosomal short arm and 5'-terminus of this base sequence : 162921
ggagatttgtcagacatcaaatactaatataacatgttacaatattggaggcccatgatgagtcaggctgctatctatctatctatctatctatctatctatctatctatctatctatctatgatttcttatttattttggcctgtccactaggagttttggatttttaaaaattaatttggtttatttaaaattcagaagatttttaacaatatggattttgcttctcttaaaaatcgtatctgacaatactgaatca

SEQ ID NO: 7737 - DNA, 203 bp, Homo sapiens
  D4S3016
  Located on chromosome 4
  Distance between a terminus base of telomere on chromosomal short arm and 5'-terminus of this base sequence : 157130076
  Distance between 3'-terminus of neighbour sequence of sequence listing upward to telomere on chrosomal short arm and 5'-terminus of this base sequence : 144216
gcctgggcaatagagtgagactccatctcaaaagaaaaaaaaagaaaagaaaattcagtgtgtgtgtgtgtgtgtgtgtgtgtgtgtatataccccactcatatcaggctttgaagaaaattaaagaaaggaatattttttgtccttttatgaaacagtaaattttgattgaattataaatggatctactgacaactcatttt

SEQ ID NO: 7738 - DNA, 451 bp, Homo sapiens
  AC023069.2_59492
  Located on chromosome 4
  Distance between a terminus base of telomere on chromosomal short arm and 5'-terminus of this base sequence : 157167713
  Distance between 3'-terminus of neighbour sequence of sequence listing upward to telomere on chrosomal short arm and 5'-terminus of this base sequence : 37434
ttcctcaatctaaatatgctgaagtcatagttgatatttatgagcagaagagctttattctatctatctatctatctatctatctatctatctatctatctatctatcaatcaatcaatctatctatcaatctatcacttgctaaatgtgtaaattaatattctcctaaaagagacaaagccagatatataacagacatctaagttttgcttgttaaagtaaaactttgatgaagaaaggtctttaaaaataatcaaacccctgcattttataggtgaaaacatgatcggagggaagtaaagagacttaaggaagccagactaccagttactagtagagcttgttagaatacaaagttcctgattcacagtctagtgcttttgtttgaaaattttgtagaactcatatgacatcttaaaagtaaatgagtctggaaagtttctagcagata

SEQ ID NO: 7739 - DNA, 341 bp, Homo sapiens
  AC055864.3_42100
  Located on chromosome 4
  Distance between a terminus base of telomere on chromosomal short arm and 5'-terminus of this base sequence : 157262437
  Distance between 3'-terminus of neighbour sequence of sequence listing upward to telomere on chrosomal short arm and 5'-terminus of this base sequence : 94273
tcacaactccactaggcaatactccagtggggactctgtgggagctggaacccctcatttcccttctgcactgccctagcagaggttctccatgaggactctgcccctgcagcacacctctgcctggatatccaggcatttccatacatcctctgaaatctaggcggaagttcccaaaactcaattctttttatttatttatttatttatttatttatttatttattattattatactttaagttttagggtacatgtgcacaatgtgcaggttagttacatatgtatacatgtgccatgctggtgcgctgcaccaactaactcgtcatctagcattaggt

SEQ ID NO: 7740 - DNA, 130 bp, Homo sapiens
  DISD22_0004176
  Located on chromosome 4
  Distance between a terminus base of telomere on chromosomal short arm and 5'-terminus of this base sequence : 157363625
  Distance between 3'-terminus of neighbour sequence of sequence listing upward to telomere on chrosomal short arm and 5'-terminus of this base sequence : 100847
gtttctgccttcaggattgcaccattgtgtgtgtgtgtgtgtgtgtgtgtgcacttgtgtgtgtgcatgtgtgcccttgtgtgtgtatgcctgtgtgcatccataatagaataaagaacctaatggtgca

SEQ ID NO: 7741 - DNA, 344 bp, Homo sapiens
  chr4.fa.O7frz.166052747
  Located on chromosome 4
  Distance between a terminus base of telomere on chromosomal short arm and 5'-terminus of this base sequence : 157704022
  Distance between 3'-terminus of neighbour sequence of sequence listing upward to telomere on chrosomal short arm and 5'-terminus of this base sequence : 340267
gctagtcaaatgatttcattctactatataaggtaatgtgaccccaaacatataatgtgactttataattatacacatttgcatatatataatttatgtgcatatatatatatatatatacacacacatatatatatatgctgcttttaaggaagtgcacatacatacacacacatattcctacacacacacacacacacacacacacacatacatacatacatatatgtatttaagaagacagtgactctacttggttccaaatgaagttattttggaaatgctattgttgcagacacatagccctgatgtacatgtgctactcttgctctacggttaagaat

SEQ ID NO: 7742 - DNA, 146 bp, Homo sapiens
  DISO7_10001665
  Located on chromosome 4
  Distance between a terminus base of telomere on chromosomal short arm and 5'-terminus of this base sequence : 157758881
  Distance between 3'-terminus of neighbour sequence of sequence listing upward to telomere on chrosomal short arm and 5'-terminus of this base sequence : 54515
gagattaaggacactgacagttgtataattaaaaacattaaaaatgtccctgaaatgatgatgatgatgatgatgatgatgatgatgatgatgacagtaatagatatagtcatacacgagaaaatagctagacaacctgagaccaa

SEQ ID NO: 7743 - DNA, 101 bp, Homo sapiens
  DISO7_10001666
  Located on chromosome 4
  Distance between a terminus base of telomere on chromosomal short arm and 5'-terminus of this base sequence : 157925194
  Distance between 3'-terminus of neighbour sequence of sequence listing upward to telomere on chrosomal short arm and 5'-terminus of this base sequence : 166167
ctccttgagcactgaggcttatactccaacacacacacacacacacacacacacacacacactacacacacatacgcacacattcttagtcaagagcagca

SEQ ID NO: 7744 - DNA, 142 bp, Homo sapiens
  DISO7_10001667
  Located on chromosome 4
  Distance between a terminus base of telomere on chromosomal short arm and 5'-terminus of this base sequence : 157954200
  Distance between 3'-terminus of neighbour sequence of sequence listing upward to telomere on chrosomal short arm and 5'-terminus of this base sequence : 28905
tccacactgtgttattaggaaagaagagcgtgtgtgtgtgtgtgtgtgtgtgtgtgtgtgtgtgtttcattttacgaaaacctaccattaaaaaatagactacatcaaatagttttatttttcaaccttcctcatgaacaca

SEQ ID NO: 7745 - DNA, 158 bp, Homo sapiens
  D4S1556
  Located on chromosome 4
  Distance between a terminus base of telomere on chromosomal short arm and 5'-terminus of this base sequence : 158012821
  Distance between 3'-terminus of neighbour sequence of sequence listing upward to telomere on chrosomal short arm and 5'-terminus of this base sequence : 58479
gccatcaactaacacagaaaaaaactatccatttaatttacaaatacacacacacacacacacacacacacacctctttatattcactttctctctgaaaaagaaatggtattctaatatatagttcatcttcctgtactctgtgtctctcactgttt

SEQ ID NO: 7746 - DNA, 302 bp, Homo sapiens
  AC009582.4_7254
  Located on chromosome 4
  Distance between a terminus base of telomere on chromosomal short arm and 5'-terminus of this base sequence : 158305321
  Distance between 3'-terminus of neighbour sequence of sequence listing upward to telomere on chrosomal short arm and 5'-terminus of this base sequence : 292342
atagactttctgacagagcaacaccctgtctccaaataataataataataataataataataataataataataataagaagaagaagaagaagaagaagaagaagaagaagaagaagaagaagaaaagaaagaagggctataaatatattctctcacctacccaatggcaagagtgttccaggtataagaaacttgtagtttactctctgtcggaagggaccctataggctgctccttctttgatacactgttttcctctcaactaaattatgttctttgtatagctgaacagtgttgcct

SEQ ID NO: 7747 - DNA, 207 bp, Homo sapiens
  D4S1589
  Located on chromosome 4
  Distance between a terminus base of telomere on chromosomal short arm and 5'-terminus of this base sequence : 158344879
  Distance between 3'-terminus of neighbour sequence of sequence listing upward to telomere on chrosomal short arm and 5'-terminus of this base sequence : 39256
ccactttatctatgaaatgaaggttaagaaccctttctccaaaaataactttttcatcatgaagcaaaacaatggataaatttttcactttaggattagaagatacatgtgcacacacacacacacacacacacacacgcagatacaaacacatacacaaagtggtccagcatgaacacaggggtatcatttcacatacttccaacg

SEQ ID NO: 7748 - DNA, 299 bp, Homo sapiens
  chr4.fa.O7frz.166613109
  Located on chromosome 4
  Distance between a terminus base of telomere on chromosomal short arm and 5'-terminus of this base sequence : 158512624
  Distance between 3'-terminus of neighbour sequence of sequence listing upward to telomere on chrosomal short arm and 5'-terminus of this base sequence : 167538
ggactaccatcactaatctgtagaggtttgttgtgtaagagacacaagccacactttgtaacaaccagcatctgctgatggtcttcctttatttagggatgtggtcccatgctacaactgcattgtgttcaggcatggtttcctgtgtcttcagttgttccaaccaagaatactctatctctttgtctctttgttttgctctttttctgtctctctctctctctctcacatacacacacacacacacacacacacacacttgattatgacaggaaaacactatcggatgttaatttatt

SEQ ID NO: 7749 - DNA, 358 bp, Homo sapiens
  chr4.fa.O7frz.166739923
  Located on chromosome 4
  Distance between a terminus base of telomere on chromosomal short arm and 5'-terminus of this base sequence : 158583545
  Distance between 3'-terminus of neighbour sequence of sequence listing upward to telomere on chrosomal short arm and 5'-terminus of this base sequence : 70622
ggacaagtctttgattaccttagttaaggttattcctaaatattttattatttttgatggtattacaaacggaattattttcctaacttccttttcagatattcattattggtatatagaaaagcaattgatgtttttatgttgtgtcctggaactttactgaaatttgtttatcagttttaactgtgtgtgtgtgtttgtgtgtgtgtgtgtgtgtgtgtagtctttagagtttcctttatatagattatgccattggcatacagagacaattcacttctttatttctgacttggatgtcttccttttctttttcttatctaattactctgggtgctaggtaccatgttgaacagaa

SEQ ID NO: 7750 - DNA, 173 bp, Homo sapiens
  D4S2322
  Located on chromosome 4
  Distance between a terminus base of telomere on chromosomal short arm and 5'-terminus of this base sequence : 158819138
  Distance between 3'-terminus of neighbour sequence of sequence listing upward to telomere on chrosomal short arm and 5'-terminus of this base sequence : 235235
tgttcaagagaccaggctactcatcaactgttattttatacacacacacacacacacacacacacacacacacacacactctctctctctctttctcactctctctctttctctctctctctctttgtggccatacgtttattgactgaactaagaactgtctgcaagttggc

SEQ ID NO: 7751 - DNA, 397 bp, Homo sapiens
  HUMUT1581
  Located on chromosome 4
  Distance between a terminus base of telomere on chromosomal short arm and 5'-terminus of this base sequence : 159046980
  Distance between 3'-terminus of neighbour sequence of sequence listing upward to telomere on chrosomal short arm and 5'-terminus of this base sequence : 227669
accacggagcattctactgaaagcactctcagttgtttgtttgttttctttctttctttttttctttctttctctctttctttctttctttctttctttctttctttcttttctttctctttctttccttccttccttccttccttctttttttgtacgtttccaagtcgtggatgagttgtcccaaaaacaaggagtaatgatgaagtcaaccccatctaacagatttagttgctaagccatactcatatctttttagaattaaaattagttttcttttagaaagttccctgttttctctattttacatactgtgtgctgacagcagccaaaagaaaaggcgatagctcacattctagtgaaaccttgggttttgtggctcagagtccagttgcta

SEQ ID NO: 7752 - DNA, 458 bp, Homo sapiens
  chr4.fa.O7frz.167380270
  Located on chromosome 4
  Distance between a terminus base of telomere on chromosomal short arm and 5'-terminus of this base sequence : 159153773
  Distance between 3'-terminus of neighbour sequence of sequence listing upward to telomere on chrosomal short arm and 5'-terminus of this base sequence : 106396
atcactacctcaggagatcaagaccatcctgaccaacatggtgaaactccgcctctactaaaaatacaaaaaattagctgggtgtggtggcacatgcctatagttccagttactcgggaggcaggacaatcgcttgaaccctggcgggctgaggttgcagtgagccgagatcgcggcactgcactccagcctgggtgatagagctagactcagtctcaaaaaaaagaaaaattatatatatatatatatatattcaaacttatagatgagttgaagggaaagtatatatgtcactcaaattccccaactgttaatattttgggaactagtggtatcattttctttatctgtccattggagagtaaattgtcctttcctccttaatatttcagtgtgtattttctattacttaaccacaataaaatgattgaaatctggaaattagcatgatacagtat

SEQ ID NO: 7753 - DNA, 341 bp, Homo sapiens
  chr4.fa.O7frz.167149047
  Located on chromosome 4
  Distance between a terminus base of telomere on chromosomal short arm and 5'-terminus of this base sequence : 159287971
  Distance between 3'-terminus of neighbour sequence of sequence listing upward to telomere on chrosomal short arm and 5'-terminus of this base sequence : 133740
ttctattgaaggcagatgaagcaccaaatctctgactagccaattgaaaaagaatgcacaactatagaggatggggtgtgaccctgctatctctctctctctctctctctctctctctctctctctgtctctctctgatgaaaggaatgttggctttgtttcccttcatggaggtctagccattgtgtgagaccagaataagaccctggggcaactgatgggatctggctgaggccacacggtggtgttgccagaaggtccctgaactggttccatccccaccgcccgttagggcatcaaccaagaccctcagtcttttctatgacatgtttccttacgtc

SEQ ID NO: 7754 - DNA, 101 bp, Homo sapiens
  DISO7_10001671
  Located on chromosome 4
  Distance between a terminus base of telomere on chromosomal short arm and 5'-terminus of this base sequence : 159380735
  Distance between 3'-terminus of neighbour sequence of sequence listing upward to telomere on chrosomal short arm and 5'-terminus of this base sequence : 92423
tagaagcattgattatcaatttctctccctctctctcatacacacacacacacacacacacacacacacacacacaccactgatccaacatgcctatctat

SEQ ID NO: 7755 - DNA, 126 bp, Homo sapiens
  DISO7_10001669
  Located on chromosome 4
  Distance between a terminus base of telomere on chromosomal short arm and 5'-terminus of this base sequence : 159409795
  Distance between 3'-terminus of neighbour sequence of sequence listing upward to telomere on chrosomal short arm and 5'-terminus of this base sequence : 28959
catacacaacagatataccaccacctctgcctccccaacagtttgccacagtttagtgtgtgtgtgtgtgtgtgtgtatgtgtgtcagagagagacagagagacagttctatgattaagtatgccc

SEQ ID NO: 7756 - DNA, 202 bp, Homo sapiens
  chr4.fa.O7frz.167820911
  Located on chromosome 4
  Distance between a terminus base of telomere on chromosomal short arm and 5'-terminus of this base sequence : 159541282
  Distance between 3'-terminus of neighbour sequence of sequence listing upward to telomere on chrosomal short arm and 5'-terminus of this base sequence : 131361
tgtagcatggtgactgtagttaataatactgtattacatacttgaaatttgataagagagtagatattaaatgttctcaccacacacacacacacacacacacacacggtaacaatgtgaggtgacgcatatgttattaggttggtgcaaaagtagttgtggttttgccattacttttgattaatgacattaagtacgttgc

SEQ ID NO: 7757 - DNA, 358 bp, Homo sapiens
  chr4.fa.O7frz.167926805
  Located on chromosome 4
  Distance between a terminus base of telomere on chromosomal short arm and 5'-terminus of this base sequence : 159703113
  Distance between 3'-terminus of neighbour sequence of sequence listing upward to telomere on chrosomal short arm and 5'-terminus of this base sequence : 161629
tcttagctttagtcacaccaatagtcttctctaaagagctgatctaaaccagagagaagatcacctgaggatacatcattgagaaaaatttagacacacacacacacacacacacacacacacacacacacaaaacagccaatccatataaagagttagattgttttctttttctcttttcataatgaacagactgatttattttcacagttgcctatacaccaagctactaggatgaccaggataagaggctcaactcaggctgagttaccccaaaccgtgagattccatttacactttgggattttcgtggctcaagtagtgctcagctggcgatgattaaagaattcacttgcta

SEQ ID NO: 7758 - DNA, 454 bp, Homo sapiens
  chr4.fa.O7frz.168028247
  Located on chromosome 4
  Distance between a terminus base of telomere on chromosomal short arm and 5'-terminus of this base sequence : 159931548
  Distance between 3'-terminus of neighbour sequence of sequence listing upward to telomere on chrosomal short arm and 5'-terminus of this base sequence : 228077
gaaattgtccttttggttaaagatggaagaaaaaatcacagattccaagttataaatacacaggagaagtggaattaaaatctcataaataatattactggcaattaaaattctttgtgacttatacccagaattctcagagagcttcatgcacacacacacacacacacacacacacacacacacagtgtccagggtaatttcatatttactcaaaaactgtatgagtatatgcccaaattctaggtagagggggagtcatatattctaaaaatagtggaaattttaaaacttggaaactatttcagctccaagtttaaaatataaaaatatttcctaaacttattttttaaaaacactttattttgaaaaatttcaaacatacacaaaaattacaaaagtagtataatcatacccatacacctttcacctggattcactcatagttaacact

SEQ ID NO: 7759 - DNA, 147 bp, Homo sapiens
  DISO7_10001674
  Located on chromosome 4
  Distance between a terminus base of telomere on chromosomal short arm and 5'-terminus of this base sequence : 159953820
  Distance between 3'-terminus of neighbour sequence of sequence listing upward to telomere on chrosomal short arm and 5'-terminus of this base sequence : 21818
aataattcaaaggagaattcaatgcacacacacacacacacacacacacacacacacacacacaccccaacaggaatactgaaataaatctgattaacacatgcaaaagagaccaataatctatggggcaataatcaatgtatctca

SEQ ID NO: 7760 - DNA, 226 bp, Homo sapiens
  DISO7_10016283
  Located on chromosome 4
  Distance between a terminus base of telomere on chromosomal short arm and 5'-terminus of this base sequence : 160053539
  Distance between 3'-terminus of neighbour sequence of sequence listing upward to telomere on chrosomal short arm and 5'-terminus of this base sequence : 99572
gggagatgagactccatcccctgagattcagaggccacggagggcggctggggagagggaaagctagagaattcacacattcacacacatacacacacacacacacactctctctctctctctctctgtctctccctctctctctctctctctctctctctctctctctctcggctgggcaacatagtgggaaaggtcagtcatggggagggaagagttaaggagc

SEQ ID NO: 7761 - DNA, 170 bp, Homo sapiens
  Z67726
  Located on chromosome 4
  Distance between a terminus base of telomere on chromosomal short arm and 5'-terminus of this base sequence : 160155377
  Distance between 3'-terminus of neighbour sequence of sequence listing upward to telomere on chrosomal short arm and 5'-terminus of this base sequence : 101612
attcaggtagccatcatagcactgcctttcaaacttttctgactgcagtccacagtaagaaatacatttcacatagggacccagttaacaacactgcgtgtgtgtgtgtgtgtgtgtgtgtgtgtgcagtgatatgtatcattaaaacaaagatgcaaaagcaatttagt

SEQ ID NO: 7762 - DNA, 112 bp, Homo sapiens
  DISO7_10001676
  Located on chromosome 4
  Distance between a terminus base of telomere on chromosomal short arm and 5'-terminus of this base sequence : 160323912
  Distance between 3'-terminus of neighbour sequence of sequence listing upward to telomere on chrosomal short arm and 5'-terminus of this base sequence : 168365
gagacaccaagatgactatacctgtaaataacctagaaattgtatttacaccacttagagagagagagagagagagagagagagagaagtcttccatgctcttattagagtg

SEQ ID NO: 7763 - DNA, 162 bp, Homo sapiens
  D4S2918
  Located on chromosome 4
  Distance between a terminus base of telomere on chromosomal short arm and 5'-terminus of this base sequence : 160562729
  Distance between 3'-terminus of neighbour sequence of sequence listing upward to telomere on chrosomal short arm and 5'-terminus of this base sequence : 238705
tcagccccttaatcacatgaaccaattcctatgtgtgtgtgtgtgtgtgtgtgtgtgtgtgtgtacatatcctgttgattctgtgtctctgcagaaccctgatgcacttacaatgaaatattccacccatggactaaaaggctgtcatgaccaggcttctgc

SEQ ID NO: 7764 - DNA, 440 bp, Homo sapiens
  chr4.fa.O7frz.168982025
  Located on chromosome 4
  Distance between a terminus base of telomere on chromosomal short arm and 5'-terminus of this base sequence : 160685709
  Distance between 3'-terminus of neighbour sequence of sequence listing upward to telomere on chrosomal short arm and 5'-terminus of this base sequence : 122818
tttacacttatgcagctggtagatggggcaggggaggtagggagtggggagaagtgggggagggggagtggctgaatcagatgccataattatttcaggactggaaacagaattgaaatgacccagatggttaccctaatgaagctgatccaaaatgtgtgccaagaggcatcagagcatgcctttctctctctgtgtgtgtgtgtgtgtgtgtttaggtgtacaagtgcaagtaggcatgcatgattgatttttggctgaagtgggcttggggttatagcaatgcaagtgtggcaggccaagatggatgtgcataggaaagcaatcacaatgcagagcctcttcctgctatggcctcgggctaggcctgactcctctcaattgcaccagcatggaaaatccgctttcctttggcttttaacatagaccatatttcctgg

SEQ ID NO: 7765 - DNA, 131 bp, Homo sapiens
  D4S2980
  Located on chromosome 4
  Distance between a terminus base of telomere on chromosomal short arm and 5'-terminus of this base sequence : 160839605
  Distance between 3'-terminus of neighbour sequence of sequence listing upward to telomere on chrosomal short arm and 5'-terminus of this base sequence : 153456
ttaagtacatggtccgtcccatggagcaacctgctgagatactccactgtggtgtttaaggttagggattttaaagatttgtgtgtgtgtgtgtgtgtgtgtgttagatgatgcagcctgataccttgagg

SEQ ID NO: 7766 - DNA, 464 bp, Homo sapiens
  chr4.fa.O7frz.169289433
  Located on chromosome 4
  Distance between a terminus base of telomere on chromosomal short arm and 5'-terminus of this base sequence : 160932340
  Distance between 3'-terminus of neighbour sequence of sequence listing upward to telomere on chrosomal short arm and 5'-terminus of this base sequence : 92604
ttatcctactggttcctaaccttttatgataacagtgcctgtggttgattttataaaccacacatgacacttggaattcggttcttgttatccttcgtgtcagagcagttttaaataatcttttagtagaagacttttgcttttgaaaatcaaacactatttccctcaattttatagtttagaaagttttctgtagtctcccaaaatatttttagcgttctgttaattttctcagcacatccaatgataagttgtaacccttaaggttatactcaacttgtactaatacaaaaggtcacatctgaaaaaacccatttccctccctccctccctcccccccttccttccctccttccttccttccttccttccttccttccttccttccttccttccttccttccttccttccttccttcattccttcctatcctgtgactcccaggaccatgattatcagtgtc

SEQ ID NO: 7767 - DNA, 244 bp, Homo sapiens
  G08371
  Located on chromosome 4
  Distance between a terminus base of telomere on chromosomal short arm and 5'-terminus of this base sequence : 160938925
  Distance between 3'-terminus of neighbour sequence of sequence listing upward to telomere on chrosomal short arm and 5'-terminus of this base sequence : 6121
tttctccctgtactggatgcttcctgccctcagacattggactccaagttcttcagttttgggacttgggctggctctccttgctcctcagcttgcagacggcctattgtaggaccttgtgattatgtgagttaatacttaataaactcccctttttctatctatctatctatctatctatctatctatctatctatctatctatctatctatctcctattagttctatccctctggagaaccc

SEQ ID NO: 7768 - DNA, 301 bp, Homo sapiens
  D4S2412
  Located on chromosome 4
  Distance between a terminus base of telomere on chromosomal short arm and 5'-terminus of this base sequence : 160939021
  Distance between 3'-terminus of neighbour sequence of sequence listing upward to telomere on chrosomal short arm and 5'-terminus of this base sequence : -148
agacggcctattgtaggaccttgtgattatgtgagttaatacttaataaactcccctttttctatctatctatctatctatctatctatctatctatctatctatctatctatctatctcctattagttctatccctctggagaaccctattctcctattgtaggaccttgtgattatgtgagttaatacttaataaactcgtatgtgtgtgtatgtatatatatatatatctcctattagttctgtccctctggagaaccctgactagtacacatgtataattcagcaatcccacttctg

SEQ ID NO: 7769 - DNA, 381 bp, Homo sapiens
  AC013406.4_6237
  Located on chromosome 4
  Distance between a terminus base of telomere on chromosomal short arm and 5'-terminus of this base sequence : 160954443
  Distance between 3'-terminus of neighbour sequence of sequence listing upward to telomere on chrosomal short arm and 5'-terminus of this base sequence : 15121
cattttaggttcttgctcctagggatctcaaggtagcattttcagttgtttacaaaatattctaaactattaaattccaaagatagctcaaagtcatcatattcaaacttgctcagcctctctctctctccctctctctctctctctctctcacacacacacatacacatacactctctctctctctgtcacgcacactctctctctctgatctgctccttcctggcatttgctacttcacttaaaagcatcacccctgatccctccatttcccaaacttgaaacctgagaaccagcctcagtgtctctctctttcttacaaactgtgtgcaattgatctagtcccactgactctacttccttaatagctccttaatatcc

SEQ ID NO: 7770 - DNA, 392 bp, Homo sapiens
  chr4.fa.O7frz.169505973
  Located on chromosome 4
  Distance between a terminus base of telomere on chromosomal short arm and 5'-terminus of this base sequence : 161178507
  Distance between 3'-terminus of neighbour sequence of sequence listing upward to telomere on chrosomal short arm and 5'-terminus of this base sequence : 223683
gctcaacttgtagtcacctctaagctgtcaccattagctccacataaagttccactcctctagatttatttttctatgatgctgaaggtgacaagctgaaaattctgtctgctcacctcccagcttgggaccctttgtgaatcaatatcagagggacaccttctcaagatcctctggccttccttacaacagatgggataggcagagggttattgagtgtggagcctgatgtgtgtgtgtgtgtgtgtgtgtgtgtgtgtgtgtgtgtgtgtgttgtttccctgcttgcctaagcatttccaccaaaagcttggcaacctcagctctggcatcagctcccaaaacgagggaagttgagcagaaaaaggcagactaaggtggaagtcacaact

SEQ ID NO: 7771 - DNA, 246 bp, Homo sapiens
  chr4.fa.O7frz.169577217
  Located on chromosome 4
  Distance between a terminus base of telomere on chromosomal short arm and 5'-terminus of this base sequence : 161249828
  Distance between 3'-terminus of neighbour sequence of sequence listing upward to telomere on chrosomal short arm and 5'-terminus of this base sequence : 70929
gaaatgttctacctattgatcaaaaactccccactttctccaccctcttgtccttggcaatcaccattacattatttgtctctgggttcatccatgctgtcacaaatgacagaatttccttccattttaaggatgaataatattccattgtgtgtgtgtgtgtgtgtgtgtgtgtgtgtgtgtatgtatacatcacatattctttatccattctttcatcaatggttgcttaggttgattccatat

SEQ ID NO: 7772 - DNA, 456 bp, Homo sapiens
  chr4.fa.O7frz.169587580
  Located on chromosome 4
  Distance between a terminus base of telomere on chromosomal short arm and 5'-terminus of this base sequence : 161260058
  Distance between 3'-terminus of neighbour sequence of sequence listing upward to telomere on chrosomal short arm and 5'-terminus of this base sequence : 9984
taactcaaagtcacatcctcagaaaaaaataacactctcctgtcatattatttaatatgttgtgattttattttatacatgtatcttttgtaattatatatttacttttatgattatttggttatatattatatatagtatatataccttttagtatactatgtatacgatatgctattataggaaaaagtatatgtatagtatatatataaagtatatgttataaaatggttacagaaaaaacttaatccaataatcataaatatatatgtgtatatatatgtgtgtgtgtgtgtgtgtgtgtgtgtgtgtataaattccaggcagactggcctacatttgcttctgaaatttgaatttaacttgaagatcaaactcagcagagtgcttataatcaatatgacaacataggcaacatatctttattgagtgaaagaataagtggctatttccttc

SEQ ID NO: 7773 - DNA, 189 bp, Homo sapiens
  D4S2982
  Located on chromosome 4
  Distance between a terminus base of telomere on chromosomal short arm and 5'-terminus of this base sequence : 161338220
  Distance between 3'-terminus of neighbour sequence of sequence listing upward to telomere on chrosomal short arm and 5'-terminus of this base sequence : 77706
gaaatgaaacatgatgacaccttggacttctagcctccacaactgtgagaaaatacatttccttgtttaaaccacttggtttatagtattttgttacggtagcctgagctaaggctctgtgtgtgtgtgtgtgtgtgtgtgtgtgtgtgtgtgtgtgtgtgtttgtgtatgtgtgttggggttgactgg

SEQ ID NO: 7774 - DNA, 186 bp, Homo sapiens
  Z67100
  Located on chromosome 4
  Distance between a terminus base of telomere on chromosomal short arm and 5'-terminus of this base sequence : 161398734
  Distance between 3'-terminus of neighbour sequence of sequence listing upward to telomere on chrosomal short arm and 5'-terminus of this base sequence : 60325
ccccacatcctatttctgactttagtatcattcattacctttttgagtttgtgtgtatgtgtatgtgtgtgtgtgtgtgtgtgtgtgtgtgtgtgtgtttaagcaagttttttgaacatggcttctctgatgtctttactttttaaatcacctagacttgtgtaaagagcggtctcattgctacac

SEQ ID NO: 7775 - DNA, 230 bp, Homo sapiens
  chr4.fa.O7frz.170699786
  Located on chromosome 4
  Distance between a terminus base of telomere on chromosomal short arm and 5'-terminus of this base sequence : 161546194
  Distance between 3'-terminus of neighbour sequence of sequence listing upward to telomere on chrosomal short arm and 5'-terminus of this base sequence : 147274
cagaaggtattcttgtcaattaagtgacatgagtatatgactctgtgtgtgtgtgtgtgtgtgtgtgtataagtttctgagcaactaaagagaaatctcctctgacactttctaatcccatacatttaaaattaaaactattttcaattaaacaaattggcaacaatcatgaagctttagaacctacttgcggtcacaaaagagagaagtgcagctgtaggttacttaaa

SEQ ID NO: 7776 - DNA, 234 bp, Homo sapiens
  D4S3033
  Located on chromosome 4
  Distance between a terminus base of telomere on chromosomal short arm and 5'-terminus of this base sequence : 161578106
  Distance between 3'-terminus of neighbour sequence of sequence listing upward to telomere on chrosomal short arm and 5'-terminus of this base sequence : 31682
tggtgtcaacgcagtaaataaagaatagttggagaagcaatatatacatacattaagtgtgtgtgtgtgtgtgtgtgtgtgtgtgtgtgtgtgtgattatggtattttttgtaattataccgcagttcttgtttaacaagaaaaatgtatgtgatcgtttactacacatattcgccaccttaacatagaactttccttttttttaatggaatgtccattgcattcttaaaggca

SEQ ID NO: 7777 - DNA, 452 bp, Homo sapiens
  chr4.fa.O7frz.170246175
  Located on chromosome 4
  Distance between a terminus base of telomere on chromosomal short arm and 5'-terminus of this base sequence : 161686721
  Distance between 3'-terminus of neighbour sequence of sequence listing upward to telomere on chrosomal short arm and 5'-terminus of this base sequence : 108381
taaagttgcataggaaagttgtgacaatataaagaaaggctttgaagttattccaaaaaatttgcctgtgtgtgtgtgtgtgtgtgtgtgtgtgtgtgtgtgttttgttaacttctaatttctagttttctgaggcatagaattgggctattcatcatctaattcctgacattattttaccattgatcaatgcattgctcacttgcttgaatataagtatgtttatatttgtttgtttttaaaaatataattatcaatataacactcacccaatatgacaaataaaatattgacaataattcatttactccaatatgatacaacccaactctattttcctaccttcaagcacccaggataaccatgatcttaaatctgttgttgtcattgtttctcttaaaaattttagtttggttacatttctaagtattactatgaggtgtcttggtttc

SEQ ID NO: 7778 - DNA, 302 bp, Homo sapiens
  chr4.fa.O7frz.169948581
  Located on chromosome 4
  Distance between a terminus base of telomere on chromosomal short arm and 5'-terminus of this base sequence : 161756982
  Distance between 3'-terminus of neighbour sequence of sequence listing upward to telomere on chrosomal short arm and 5'-terminus of this base sequence : 69809
ctcagctgaagtttcttagttaaaaatccaaagttttcacatttgtgtctttgattttctagtcttttctgaaattgttaccagctttgggccataagctttaacactgtactaagattttcaacaaaaagattttaaaaagtactttcatatatatcataaatatcaaatatatatgttttatatatatcatataaatatatattatatatgtatatgtgtgtaataatcagaagaaattgaacaagaatagatttttaccttggttgacattattacaagtactaagacatgctctgtgc

SEQ ID NO: 7779 - DNA, 193 bp, Homo sapiens
  Z66627
  Located on chromosome 4
  Distance between a terminus base of telomere on chromosomal short arm and 5'-terminus of this base sequence : 161985911
  Distance between 3'-terminus of neighbour sequence of sequence listing upward to telomere on chrosomal short arm and 5'-terminus of this base sequence : 228627
taattcaggaatcattaaacaaaggggcctgattccccaaattgtaaaaatgcctaaagaaattgatatttcaaactatacatatatgcgaattcagtactaatatgatatgctcacacacacacacacacacacacacacacgcacacacacacacagacacacagagacacacatacctattgccccaagt

SEQ ID NO: 7780 - DNA, 176 bp, Homo sapiens
  chr4.fa.O7frz.172824617
  Located on chromosome 4
  Distance between a terminus base of telomere on chromosomal short arm and 5'-terminus of this base sequence : 162284398
  Distance between 3'-terminus of neighbour sequence of sequence listing upward to telomere on chrosomal short arm and 5'-terminus of this base sequence : 298294
aagcaaatgtctcctaggatactaagtcttctcttattatttttaaactccctggaagcaatacacacacacacacacacacacacacacacacacacacgcatgaatacatcatccattattcgttgctatctgtaaaggtcagcactctggtatgtttatggatagaacagcat

SEQ ID NO: 7781 - DNA, 303 bp, Homo sapiens
  chr4.fa.O7frz.172933088
  Located on chromosome 4
  Distance between a terminus base of telomere on chromosomal short arm and 5'-terminus of this base sequence : 162509532
  Distance between 3'-terminus of neighbour sequence of sequence listing upward to telomere on chrosomal short arm and 5'-terminus of this base sequence : 224958
atgttagaattacaagtcacattgctcccaaggggtacagttctcttcggtttatcccacacgactctactcagcaggagatgctgtctgttacataatagttctcagtattaaagggtacaataactacaccctttctcatggtaaagctatgtccaaagacacatggacatctacccaatgtctcttttctcccttctctccttctctctctctctctctctcacagacacacacacacacacacacacacacacacacacacacgcgcgcgcgcctaaagtacctgccacctaatgatta

SEQ ID NO: 7782 - DNA, 336 bp, Homo sapiens
  AC068369.2_21950
  Located on chromosome 4
  Distance between a terminus base of telomere on chromosomal short arm and 5'-terminus of this base sequence : 162675822
  Distance between 3'-terminus of neighbour sequence of sequence listing upward to telomere on chrosomal short arm and 5'-terminus of this base sequence : 165987
tacttgaggtctgaagttcgagaccagcctggccaacatggtgaaactctgtctctactaaaaatacaaaaattagctaggcctggtgatgggcacctgtaatcccagctattcaggaggctgaagcaagagaattgcttaaacctgggaggcagaggttgcagtgaaccaagatggcgccactgcactccagcctgggcgacagagcgagactctgtcccaaaaataaatgagtaagtgaataaataaataaataaataaacaaataaatacttaatatgggaaccccatcaatatggcactgaatcctgcaaggctgactatacctcataggat

SEQ ID NO: 7783 - DNA, 442 bp, Homo sapiens
  chr4.fa.O7frz.174605514
  Located on chromosome 4
  Distance between a terminus base of telomere on chromosomal short arm and 5'-terminus of this base sequence : 162721174
  Distance between 3'-terminus of neighbour sequence of sequence listing upward to telomere on chrosomal short arm and 5'-terminus of this base sequence : 45016
atcacgattacacagtaagcagtttggtgtgtgtattcctccagacttttttctgtatacttttgtagcatatagtttcatgttaaaatatttgatttttctattacacatatattttttcatgaataaaattatatcatagctgtttttgtatacacacacacacatatatatatatatatatatacacatgtatatatatttatttatttttgtagacaagggcttgctccgtcacccaggctggagttcagtggcatgatcttggctcactgtagccttaagctcccaggttcaaacaatcctcccacctcagcctcctgagtcgctgagactacaagagtgcaccaaggttttaccaagtttcccaggctgatctccaacttctgggctcaagggatcttcctgccccaacctcccaaagtgctaggattatggtcat

SEQ ID NO: 7784 - DNA, 305 bp, Homo sapiens
  X78713.1_1975
  Located on chromosome 4
  Distance between a terminus base of telomere on chromosomal short arm and 5'-terminus of this base sequence : 162875707
  Distance between 3'-terminus of neighbour sequence of sequence listing upward to telomere on chrosomal short arm and 5'-terminus of this base sequence : 154091
gtttgagtatgtttgatggaagattccaatggtgaggatctgaattcttcgtacatcttagagggaatggagcaggatgttatggcaatggagggggtcagccccaaaggtagctggcccaaccttaactgtggatgttaaaaacacacacacacacacacacacacacacacacacacaccaaatatttctatagcattctttttgctgcattttctttattttaagccacaggtctacttggagggtcacgcagcaagtggcttataaataaaatcaaagtctatgaatagtgtcatcgcatt

SEQ ID NO: 7785 - DNA, 237 bp, Homo sapiens
  chr4.fa.O7frz.178655359
  Located on chromosome 4
  Distance between a terminus base of telomere on chromosomal short arm and 5'-terminus of this base sequence : 163248107
  Distance between 3'-terminus of neighbour sequence of sequence listing upward to telomere on chrosomal short arm and 5'-terminus of this base sequence : 372095
cacataatcttaatggtatggaagtgaggggaagggtgggcaaggttggggaagggtaagcaaaaatcagtcacaaaggaataaaacactacacacatgtgcatatgcatggatacatacacacatacatacacacatacacacacacacacacacacacacacacacacacacacacagagtccagatagatcaactgacccacccatccatccatctatccaacagtgcattaaa

SEQ ID NO: 7786 - DNA, 123 bp, Homo sapiens
  DISO7_10016328
  Located on chromosome 4
  Distance between a terminus base of telomere on chromosomal short arm and 5'-terminus of this base sequence : 163646463
  Distance between 3'-terminus of neighbour sequence of sequence listing upward to telomere on chrosomal short arm and 5'-terminus of this base sequence : 398119
ctgttctgtttaattcatgaattgtatagttaagcattacctttctacattccagaagagcctttatttctctctctctctctctctctctctctctctctactgagctgtaacaaagcctct

SEQ ID NO: 7787 - DNA, 304 bp, Homo sapiens
  chr4.fa.O7frz.179195471
  Located on chromosome 4
  Distance between a terminus base of telomere on chromosomal short arm and 5'-terminus of this base sequence : 164028227
  Distance between 3'-terminus of neighbour sequence of sequence listing upward to telomere on chrosomal short arm and 5'-terminus of this base sequence : 381641
ctccaactaataacatgatctgacagcatttataggaaacagaagtacggtgtacagaaaactgaattggatacagcttcattggttaactggctacggagcgtcctgcagtaactaaagctcagctcctggagttcaactttatgttggtttggtctgtcaggcctagtgcaggaacctagtttattttggttaacaatactaagtatatatatatatatatatatattatatatatagtgcttaatgtttatctctatcacacttcttttagagtttggttcatctttctatcatgttagga

SEQ ID NO: 7788 - DNA, 247 bp, Homo sapiens
  chr4.fa.O7frz.179415829
  Located on chromosome 4
  Distance between a terminus base of telomere on chromosomal short arm and 5'-terminus of this base sequence : 164303928
  Distance between 3'-terminus of neighbour sequence of sequence listing upward to telomere on chrosomal short arm and 5'-terminus of this base sequence : 275397
agcaatcctacaactggttatctacccagaagaaaagaagtcattattcaaaaaagatacttgcacatgcatgtttatagcagcacaattcacaattgcaaagtcatggaaccaacccaaatgcccaatcaatgagtggataaagaaactgtgatatatatatatatatatatatatatatatatatatatatatatacacacacacacacacatacatatatgatagaatactatgcagccataaa

SEQ ID NO: 7789 - DNA, 422 bp, Homo sapiens
  chr4.fa.O7frz.179519686
  Located on chromosome 4
  Distance between a terminus base of telomere on chromosomal short arm and 5'-terminus of this base sequence : 164379181
  Distance between 3'-terminus of neighbour sequence of sequence listing upward to telomere on chrosomal short arm and 5'-terminus of this base sequence : 75006
aaagagtttcaattgtcaatgtactagggtgttaacatatgttaacaccatagaagcagtatggtgtaacaaatataatttacattttatctgggatcaaattaagaaatcttctgtctggcatttactgtctctggcaagttcaaatgcttttggaaacttagtttgcttatatgtaaaacaggggtgtgtgtgtgtgtgtgtgtgtgtgtgtgtgtgtgtgtatgagatatacatatatcatatttttgtgtatatatgggtatctatctactatgatatatttttcgagaataggatgtggaaagtactgggcaatgagtagaccctgaattaaagaaagctaatatcaccacagtactaatagttcaagtattctaaatgaaagcaaaaagatactggagtatccatcaaactagtta

SEQ ID NO: 7790 - DNA, 139 bp, Homo sapiens
  D4S2373
  Located on chromosome 4
  Distance between a terminus base of telomere on chromosomal short arm and 5'-terminus of this base sequence : 164521685
  Distance between 3'-terminus of neighbour sequence of sequence listing upward to telomere on chrosomal short arm and 5'-terminus of this base sequence : 142082
ccttttgggacagggatttaataatagatgtatcagtagatagatagataggtaatagatagatagatagatagatagatagatagatagatagatagataatttgttataggaactggctcacgtgattatggaggct

SEQ ID NO: 7791 - DNA, 248 bp, Homo sapiens
  D4S2910
  Located on chromosome 4
  Distance between a terminus base of telomere on chromosomal short arm and 5'-terminus of this base sequence : 164676810
  Distance between 3'-terminus of neighbour sequence of sequence listing upward to telomere on chrosomal short arm and 5'-terminus of this base sequence : 154986
ccttaggctcagtcttgctttaggaagacttctctagatagatagatggatttgaaagggtatacctagcgtaattatattaacaaacttccctactgccagtatattcctacatgtttgtatgcacacacacacacacacacacacacacacacacacgtatagcagatagatcttggctgggtcaagtttttttttattcgtgcaggttagatcttatttaatcaatagcctaattggtttttagt

SEQ ID NO: 7792 - DNA, 388 bp, Homo sapiens
  chr4.fa.O7frz.179980887
  Located on chromosome 4
  Distance between a terminus base of telomere on chromosomal short arm and 5'-terminus of this base sequence : 164867771
  Distance between 3'-terminus of neighbour sequence of sequence listing upward to telomere on chrosomal short arm and 5'-terminus of this base sequence : 190713
caattaccatatgatccaacagttccacttttggatatttattcaaaatatttgaaatccttatgaagagatgtctatactacatgctcattgcagcattatttaaagtaagttataaaaccaatcaaaaagtgttcattaaatgataaatggataaacaatttgtggcatatatgtgtgtacacacagacacgcacacatacacacacacacacacacacacacacacaaaatggaataccaagaatactattcagccttaataaagaaaattctgtcatccaataacatggatgaatatggaggacattgcagtaacagtaaatgaattaagccagggatagaaagacaaatgccacacaatctcacttgtaagtggaatctaaag

SEQ ID NO: 7793 - DNA, 448 bp, Homo sapiens
  chr4.fa.O7frz.180186935
  Located on chromosome 4
  Distance between a terminus base of telomere on chromosomal short arm and 5'-terminus of this base sequence : 165074116
  Distance between 3'-terminus of neighbour sequence of sequence listing upward to telomere on chrosomal short arm and 5'-terminus of this base sequence : 205957
cctttgttacattatgaaccagttgacagaaatagacacaaacatggcctatgtgttgagactaacaaacagatattaaaataactatcaatgatatatgaaatatattgtgaaaaatgtggacaacgttcaaatgggtggaaaaattgtgcctgcaaagtcttaccccttgtggctggcaccatcccacacatgtccccactcaaaacaggaatatactgtccacacactgctcaccagtgaaaggcttgtctttctctagaattctgtttattaagactttctttaccctggctctttacttatttatttatttatttatttatttatttattttaatatattttatctaaccaagaaatgaacccctggctctctgatagcacactagaaaacctggatttttatcgtatctggttttagcttgttgagaatatgaaagcaaaca

SEQ ID NO: 7794 - DNA, 110 bp, Homo sapiens
  DISO7_10001685
  Located on chromosome 4
  Distance between a terminus base of telomere on chromosomal short arm and 5'-terminus of this base sequence : 165218608
  Distance between 3'-terminus of neighbour sequence of sequence listing upward to telomere on chrosomal short arm and 5'-terminus of this base sequence : 144044
tccacctctacctttacattgacatttcttaatttttaggagatatatatatatatatatatatatatatatatatccatatatatcaatgtacagaaatcatgaatgtg

SEQ ID NO: 7795 - DNA, 203 bp, Homo sapiens
  D4S1545
  Located on chromosome 4
  Distance between a terminus base of telomere on chromosomal short arm and 5'-terminus of this base sequence : 165289954
  Distance between 3'-terminus of neighbour sequence of sequence listing upward to telomere on chrosomal short arm and 5'-terminus of this base sequence : 71236
gagggctgatctggaaggaggttaggggaagggaggagcctgctaatatatagggaaaagacggtaaagatgtgtgtgtgtgtgtgtgtgtgtgtgtgtgtgtgttcatatttatgtatcaaaaggaaaaataaacaatttaaaaagaaacatatgaaaaatatataatctgcagtttccatatgccatgttatatgagcgta

SEQ ID NO: 7796 - DNA, 185 bp, Homo sapiens
  D4S1617
  Located on chromosome 4
  Distance between a terminus base of telomere on chromosomal short arm and 5'-terminus of this base sequence : 165303727
  Distance between 3'-terminus of neighbour sequence of sequence listing upward to telomere on chrosomal short arm and 5'-terminus of this base sequence : 13570
tctggtttgatatttgtgtgacttttgccatttatatcaataatgtgtgtgtgtgtgtgtgtgtgtgtgtgtgtgtatatatatatgtgtgtgtgtgtgtgtgtgtgtgtgtatatatatatatatatgtatgtatatatatagttttaaggcctctattctctccctgtaaaaactcagtcaat

SEQ ID NO: 7797 - DNA, 168 bp, Homo sapiens
  HUMUT2442
  Located on chromosome 4
  Distance between a terminus base of telomere on chromosomal short arm and 5'-terminus of this base sequence : 165426448
  Distance between 3'-terminus of neighbour sequence of sequence listing upward to telomere on chrosomal short arm and 5'-terminus of this base sequence : 122536
gcagatggcctattgtgagacttctcagtctctataattgtgtaagctaactcacctaataaggcccctcttatctattatctatctatctatctatctatctatctatctatcatctatctatctatctatctatctattatatcctattggttctgtctttctgga

SEQ ID NO: 7798 - DNA, 174 bp, Homo sapiens
  G08351
  Located on chromosome 4
  Distance between a terminus base of telomere on chromosomal short arm and 5'-terminus of this base sequence : 165426498
  Distance between 3'-terminus of neighbour sequence of sequence listing upward to telomere on chrosomal short arm and 5'-terminus of this base sequence : -118
ctcacctaataaggcccctcttatctattatctatctatctatctatctatctatctatctatcatctatctatctatctatctatctattatatcctattggttctgtctttctggagaactcagggtaaaacaattagtcaaatacttctcttcaagacaaagtggtacatt

SEQ ID NO: 7799 - DNA, 169 bp, Homo sapiens
  chr4.fa.O7frz.180924712
  Located on chromosome 4
  Distance between a terminus base of telomere on chromosomal short arm and 5'-terminus of this base sequence : 165628656
  Distance between 3'-terminus of neighbour sequence of sequence listing upward to telomere on chrosomal short arm and 5'-terminus of this base sequence : 201984
gagaatttgttaccataagacctaacttacaagtagttcttaatggagtgctaaacgtggaaatgaaaggccattatcagtcaccaaagaaacacacacacacacacacacacacacacttatgcacatagaccattatgatggttaatactgaatgtcaacttgattg

SEQ ID NO: 7800 - DNA, 463 bp, Homo sapiens
  chr4.fa.O7frz.181028678
  Located on chromosome 4
  Distance between a terminus base of telomere on chromosomal short arm and 5'-terminus of this base sequence : 165732411
  Distance between 3'-terminus of neighbour sequence of sequence listing upward to telomere on chrosomal short arm and 5'-terminus of this base sequence : 103586
ttgaacttctaacatttctctgacactgtattaaactgctcttaagtcctcaacacaaatccattttatatatatatatatatatatatatatatatatgtaaaatattactatcttatattacaaatgcaaagagattttaaaaagttgtcaaggtagtacagggatttttctatcaatatcaactattgagattatatgaagttcaccatatattacaactgcatcggaaatatcctaggtcattgcaacaaaagaaatggtataataatttaactgtgaaagtcaatatgcacagtggtgaagggcatggacactagctccagactccctggtgttagttccagttccattatttaactactcaaagaccttggacaaattacttatcttccctgtgtcttagatttctcatttctaaaaagagtataaaaagagtgtctaatggatttagatggtgtaa

SEQ ID NO: 7801 - DNA, 402 bp, Homo sapiens
  chr4.fa.O7frz.181199196
  Located on chromosome 4
  Distance between a terminus base of telomere on chromosomal short arm and 5'-terminus of this base sequence : 165917205
  Distance between 3'-terminus of neighbour sequence of sequence listing upward to telomere on chrosomal short arm and 5'-terminus of this base sequence : 184331
tcagtggattatcacttcaaagcccaaaggcaaaggaaagaatacttgagaaattagtatgtgagaggattgattatcagtttctagttatttctaatctataagtagaccagaagttgagtttgattatatgtgtgtgtgtgtgtgtgtatatatatatatatatatatatatacacatatatatacatatatatatgattatgtatattacatatttgagcaaaatttgctactatggttatatttttagtgaatatttgaggaaataaataaaatccaagaaaatagcaattcaatcttatgtcaataagtaactgtgtaattgtcaaataaaaaaatccataaaatgaacattattaacaactaatacaagaccagctcttgagtagaccatgaagtg

SEQ ID NO: 7802 - DNA, 90 bp, Homo sapiens
  D4S622
  Located on chromosome 4
  Distance between a terminus base of telomere on chromosomal short arm and 5'-terminus of this base sequence : 166067468
  Distance between 3'-terminus of neighbour sequence of sequence listing upward to telomere on chrosomal short arm and 5'-terminus of this base sequence : 149861
gctatgactgataggactaatgacaagaacacacacaaacacacacacacacacacacacacacacaccccccacactcattcctgaaat

SEQ ID NO: 7803 - DNA, 259 bp, Homo sapiens
  D4S621
  Located on chromosome 4
  Distance between a terminus base of telomere on chromosomal short arm and 5'-terminus of this base sequence : 166067472
  Distance between 3'-terminus of neighbour sequence of sequence listing upward to telomere on chrosomal short arm and 5'-terminus of this base sequence : -86
tgactgataggactaatgacaagaacacacacaaacacacacacacacacacacacacacacaccccccacactcattcctgaaataaagataggataaacaaagcaaaactgagaaaaataacatgtcatagatttgctgaaagaatcagtgtacacacacaaaaatttgtttttagttctagtggcacacttcctagatttattcttcagaaaaaactagaaagatggattttcttatggtctctggtacaccgtta

SEQ ID NO: 7804 - DNA, 441 bp, Homo sapiens
  chr4.fa.O7frz.181595742
  Located on chromosome 4
  Distance between a terminus base of telomere on chromosomal short arm and 5'-terminus of this base sequence : 166310066
  Distance between 3'-terminus of neighbour sequence of sequence listing upward to telomere on chrosomal short arm and 5'-terminus of this base sequence : 242335
accttatgtgagctgtacatttattgttgtaataaaaaatggatttaactctcctagaaataagtatctcatttatttatttatttatttatttatttatttaaaatggagtctcgctctgtcgccaggctggagtgcagtggtgcggtctctgctcaccgcaacctttgcctcccagattcaagcaattctcctgcctcagcctcccaagtagctgagatgacaggcatgtgttaccacgcccagctaatttttgtattttttagtagagacagggtttcaccatgttggccaggatggtctcgatctcttgaccttgtgatcctcccaccttggcctccaaaagtgccaggattacaggcatcagcaactgtgcctggccactatcttttatttttatcttttctaaatataattgttgccagtatagtacaagctaaa

SEQ ID NO: 7805 - DNA, 130 bp, Homo sapiens
  chr4.fa.O7frz.171166253
  Located on chromosome 4
  Distance between a terminus base of telomere on chromosomal short arm and 5'-terminus of this base sequence : 166626237
  Distance between 3'-terminus of neighbour sequence of sequence listing upward to telomere on chrosomal short arm and 5'-terminus of this base sequence : 315730
ttactaactcacagtatctggacataaataacaaggctaactgaaagttcatatataataactgtgtgtgtgtgtgtgtgtgtgtgtgtataaatcctagatgtagctgataagtaattgattcatctgc

SEQ ID NO: 7806 - DNA, 267 bp, Homo sapiens
  chr4.fa.O7frz.171060130
  Located on chromosome 4
  Distance between a terminus base of telomere on chromosomal short arm and 5'-terminus of this base sequence : 166775407
  Distance between 3'-terminus of neighbour sequence of sequence listing upward to telomere on chrosomal short arm and 5'-terminus of this base sequence : 149040
ccacagctattaaacagtgaattttgtttccatccttaacattacatattgtttaaatgacacacacacacacacacacacacacacacacacacacacagctatagtaagtaatttctatagttagtaaatttcctcttctgtgtctttgcccatcttctccttgaagcatgcatccttttattattaattggtaaaatatctgtatatattaaagatgttcttgtgtgtaaaagacagagagaaagtgacaagttaatcttcctt

SEQ ID NO: 7807 - DNA, 381 bp, Homo sapiens
  chr4.fa.O7frz.170970317
  Located on chromosome 4
  Distance between a terminus base of telomere on chromosomal short arm and 5'-terminus of this base sequence : 166863181
  Distance between 3'-terminus of neighbour sequence of sequence listing upward to telomere on chrosomal short arm and 5'-terminus of this base sequence : 87507
ggagatctattacttgcctgacaaataattccaaattcaaaattcttgaaaaagctcagtgagttccagtaaaatagaggtagacaaatcagtgaaatcaggaaaataatacatactaatacatacatacatacatacatacacacacacacacacacacacacacacaaatgagaataccaacaaaaagcaatcatacattaaaaaaatctgaaatactggagctgaagaatacctcacttgaattttgcagtggcagacttcatcaagtaggacaaagaatcagcgagttggaagacaaatcatttaaattgctcaagcagaaaagcaaccatttttaaaaataacataagaaataagacagaagctacaagtcttaca

SEQ ID NO: 7808 - DNA, 160 bp, Homo sapiens
  D4S2993
  Located on chromosome 4
  Distance between a terminus base of telomere on chromosomal short arm and 5'-terminus of this base sequence : 167026463
  Distance between 3'-terminus of neighbour sequence of sequence listing upward to telomere on chrosomal short arm and 5'-terminus of this base sequence : 162901
tttacctgtccctgactcttagaaagtatgtgtatattggtgtgtgtgtgtgtgtgtgtgtgtgtgtgtgtgtaattactctctgaaatgtatttctacaataattctcacatttcacatagaatacacttcaagcaattggctgtgtttcatccaactt

SEQ ID NO: 7809 - DNA, 106 bp, Homo sapiens
  D4S393
  Located on chromosome 4
  Distance between a terminus base of telomere on chromosomal short arm and 5'-terminus of this base sequence : 167193189
  Distance between 3'-terminus of neighbour sequence of sequence listing upward to telomere on chrosomal short arm and 5'-terminus of this base sequence : 166566
gaatccccaagcacaatgtcaataaacacacacacacacacacacacacacacacacacacacacaaacagtatgcctccatttatgtagcatccaaaaacagcca

SEQ ID NO: 7810 - DNA, 299 bp, Homo sapiens
  AC011831.4_82790
  Located on chromosome 4
  Distance between a terminus base of telomere on chromosomal short arm and 5'-terminus of this base sequence : 167345067
  Distance between 3'-terminus of neighbour sequence of sequence listing upward to telomere on chrosomal short arm and 5'-terminus of this base sequence : 151772
tgtttgaatgcaaggtttagtctttcagagataattcatgagctctaggccagaggtgaattcagttgctctggtaaactttgttgttttattttttaaatagcagagatacaaaatagtgacacattatgatgtataaatcagtacacttgaacaaagtaaggatgcctgtgaaaccactatagatgttaaatatagacagatgatagatggacagatagatagatagatagatagatagatagatagatagatagatagatggaatgtttccagcaccatagatgacctgatgtttc

SEQ ID NO: 7811 - DNA, 274 bp, Homo sapiens
  D4S2419
  Located on chromosome 4
  Distance between a terminus base of telomere on chromosomal short arm and 5'-terminus of this base sequence : 167345112
  Distance between 3'-terminus of neighbour sequence of sequence listing upward to telomere on chrosomal short arm and 5'-terminus of this base sequence : -254
taggccagaggtgaattcagttgctctggtaaactttgttgttttattttttaaatagcagagatacaaaatagtgacacattatgatgtataaatcagtacacttgaacaaagtaaggatgcctgtgaaaccactatagatgttaaatatagacagatgatagatggacagatagatagatagatagatagatagatagatagatagatagatagatggaatgtttccagcaccatagatgacctgatgtttccatcccattccttttccttt

SEQ ID NO: 7812 - DNA, 175 bp, Homo sapiens
  G08368
  Located on chromosome 4
  Distance between a terminus base of telomere on chromosomal short arm and 5'-terminus of this base sequence : 167345211
  Distance between 3'-terminus of neighbour sequence of sequence listing upward to telomere on chrosomal short arm and 5'-terminus of this base sequence : -175
tacacttgaacaaagtaaggatgcctgtgaaaccactatagatgttaaatatagacagatgatagatggacagatagatagatagatagatagatagatagatagatagatagatagatggaatgtttccagcaccatagatgacctgatgtttccatcccattccttttccttt

SEQ ID NO: 7813 - DNA, 283 bp, Homo sapiens
  AC011831.4_68107
  Located on chromosome 4
  Distance between a terminus base of telomere on chromosomal short arm and 5'-terminus of this base sequence : 167359818
  Distance between 3'-terminus of neighbour sequence of sequence listing upward to telomere on chrosomal short arm and 5'-terminus of this base sequence : 14432
ggtgtagacaacggctgtataggcacttctggattatttatgtttcccaagcaagtcgttttccagatagataattagaaatatacagatataaaagatagatggatatacagatacagatagatagacaatagatgatagatcgattgatagatagatagatagatagatagatagatagatagatagatagatctcactcctttgaatctcaggccattcggttacatgactctcctatcctctccccaaagtttagctcctgtttctcagtatttctgtc

SEQ ID NO: 7814 - DNA, 227 bp, Homo sapiens
  G08376
  Located on chromosome 4
  Distance between a terminus base of telomere on chromosomal short arm and 5'-terminus of this base sequence : 167359826
  Distance between 3'-terminus of neighbour sequence of sequence listing upward to telomere on chrosomal short arm and 5'-terminus of this base sequence : -275
caacggctgtataggcacttctggattatttatgtttcccaagcaagtcgttttccagatagataattagaaatatacagatataaaagatagatggatatacagatacagatagatagacaatagatgatagatcgattgatagatagatagatagatagatagatagatagatagatagatagatctcactcctttgaatctcaggccattcggttacatgactc

SEQ ID NO: 7815 - DNA, 422 bp, Homo sapiens
  chr4.fa.O7frz.171704610
  Located on chromosome 4
  Distance between a terminus base of telomere on chromosomal short arm and 5'-terminus of this base sequence : 167506439
  Distance between 3'-terminus of neighbour sequence of sequence listing upward to telomere on chrosomal short arm and 5'-terminus of this base sequence : 146386
tatcagccagttatttaagcacaaataaattaaattaaacattgagacctctgctcagaaaagaacaaaaaataacaatagcagacacaatgacaaaaaagtgttgctatatccactactgttaagtttgtttcatcataattcagtcatatctctaggaacacttagaaagcaaaataattctctattgtttctgaatctctgttttgtattatctctatctatcatctatctatctatctatctatctatctatctatcatctatctacctatcatctataatctatcagtctatctgtctgtttttctatctacttctatcatctctcatatttataccactgagtctctatactttctaaattttcaatgtttctcagacattttatcttttgctacaatatccttaatggtaccttt

SEQ ID NO: 7816 - DNA, 270 bp, Homo sapiens
  D4S1598
  Located on chromosome 4
  Distance between a terminus base of telomere on chromosomal short arm and 5'-terminus of this base sequence : 167648325
  Distance between 3'-terminus of neighbour sequence of sequence listing upward to telomere on chrosomal short arm and 5'-terminus of this base sequence : 141464
gctctgaggtgccaatataaaataaagaaaataaaggagaatctgaacacatggttgcaaaaaaataaactgaaagcagtgtatatgtacatgagggagagagagagagagagagagtgtgtgtgtgtgtgtgtgtgcgtgtgtgtgtgtagactgcaggcgccataatacatttattgtcccaaatacacacttttaatttgattagatatagtcttaacataatattttcctatggtttcatatacataagaatatttgctttatacg

SEQ ID NO: 7817 - DNA, 163 bp, Homo sapiens
  chr4.fa.O7frz.171974078
  Located on chromosome 4
  Distance between a terminus base of telomere on chromosomal short arm and 5'-terminus of this base sequence : 167770507
  Distance between 3'-terminus of neighbour sequence of sequence listing upward to telomere on chrosomal short arm and 5'-terminus of this base sequence : 121912
caattcgaccttaacgaatatccaggagtggaaatgctggctcatacggtagaagagtgtgtgtgtgtgtgtgtgtgtgtgtgttactttacaatcccagtcccatgaaaaatgaatgagaattccaatttcacaaagctcgtatagcaagtttgaggtgaca

SEQ ID NO: 7818 - DNA, 144 bp, Homo sapiens
  DISD22_0004203
  Located on chromosome 4
  Distance between a terminus base of telomere on chromosomal short arm and 5'-terminus of this base sequence : 167906493
  Distance between 3'-terminus of neighbour sequence of sequence listing upward to telomere on chrosomal short arm and 5'-terminus of this base sequence : 135823
aatacagtcaagttgctcaaattagaatatatagctgctttgtgtgtgtgtgtgtgtgtgtgtgtgtgtgtgtgtgtgtgtgacagagagagagagagagagaaaacataggctgaacttttctcctcatgtctcctctcatga

SEQ ID NO: 7819 - DNA, 99 bp, Homo sapiens
  D4S3046
  Located on chromosome 4
  Distance between a terminus base of telomere on chromosomal short arm and 5'-terminus of this base sequence : 167994629
  Distance between 3'-terminus of neighbour sequence of sequence listing upward to telomere on chrosomal short arm and 5'-terminus of this base sequence : 87992
gtctggcacgggatactttcccagaaaacgttagttctgtacacacacacacacacacacacacacacacactcacagactttttgtttcctaactttg

SEQ ID NO: 7820 - DNA, 235 bp, Homo sapiens
  chr4.fa.O7frz.172503442
  Located on chromosome 4
  Distance between a terminus base of telomere on chromosomal short arm and 5'-terminus of this base sequence : 168227166
  Distance between 3'-terminus of neighbour sequence of sequence listing upward to telomere on chrosomal short arm and 5'-terminus of this base sequence : 232438
ataggtatgactaaccggctacaattacttataattgaaacttatttagttcaagtgtatttggtgttctgaaaattgttgtgaggtgtttttgaagcacctatgttgtctggagtataaagcctgagtttgtcgtcatacaccatgaaaatttaggacttaaggagtttaggagcagaggggtgtgtgtgtgtgtgtgtgtgtgtgtgtatgtgtgtttgagatggagtctcac

SEQ ID NO: 7821 - DNA, 204 bp, Homo sapiens
  D4S1603
  Located on chromosome 4
  Distance between a terminus base of telomere on chromosomal short arm and 5'-terminus of this base sequence : 168359343
  Distance between 3'-terminus of neighbour sequence of sequence listing upward to telomere on chrosomal short arm and 5'-terminus of this base sequence : 131942
tggtgtgtctctgatgcttttagaaatgtgtgtgtgtgtgtgtgtgtgtgtgtgtgtgtgtgtgtgtgtgtgtgtgtatctcctgcttcttcagaaatgttggtctaagtacttagttcacaattgcctaaaatcaaccattcacatgctaatttataaattataataaagactattaagacagcatataaaatgacatatttg

SEQ ID NO: 7822 - DNA, 199 bp, Homo sapiens
  DISD22_0004215
  Located on chromosome 4
  Distance between a terminus base of telomere on chromosomal short arm and 5'-terminus of this base sequence : 168550801
  Distance between 3'-terminus of neighbour sequence of sequence listing upward to telomere on chrosomal short arm and 5'-terminus of this base sequence : 191254
catgcaactgaggtcagttctataaaattaactttgaaataaaaaggggctctctctctctatatatattttttacacatacatatatatttatgaatagtttatatatctatgtataaccaaacacacacacacatatatacatttatatatatatatatatatattctgtttacagagattctaatatgcaattgtg

SEQ ID NO: 7823 - DNA, 117 bp, Homo sapiens
  DISD22_0004219
  Located on chromosome 4
  Distance between a terminus base of telomere on chromosomal short arm and 5'-terminus of this base sequence : 168632075
  Distance between 3'-terminus of neighbour sequence of sequence listing upward to telomere on chrosomal short arm and 5'-terminus of this base sequence : 81075
tcaaggcaatcttctctacaagtctctctctctctctctctctctctctctctctctctctctctctctctctctctctctctctttctctctctctgctttgtgttctggtacctg

SEQ ID NO: 7824 - DNA, 327 bp, Homo sapiens
  chr4.fa.O7frz.176950149
  Located on chromosome 4
  Distance between a terminus base of telomere on chromosomal short arm and 5'-terminus of this base sequence : 168712127
  Distance between 3'-terminus of neighbour sequence of sequence listing upward to telomere on chrosomal short arm and 5'-terminus of this base sequence : 79935
actgagcaccattgtcactccttcttatacatcttttgtatgttgtgctttggtttttctttatttctaagtattttcacacacacacacacacaaacacgtatatatatatatatatatatatatatacagaagcacatatatatgtatatacacacaaatatattcttaaactttaaagaatctataaggaacttaaacaattcaatgagtaaaaaataaataactccattaaagattgggcaaaaaacataaacagatttgtctcaaaagaaaatatacaagtggccaagagacatgaaaaaatgctcagtatcactaatcagc

SEQ ID NO: 7825 - DNA, 115 bp, Homo sapiens
  DISO7_10001678
  Located on chromosome 4
  Distance between a terminus base of telomere on chromosomal short arm and 5'-terminus of this base sequence : 168878886
  Distance between 3'-terminus of neighbour sequence of sequence listing upward to telomere on chrosomal short arm and 5'-terminus of this base sequence : 166432
gaatgaagcatggagaagcaaaatattaaaagtacagggaaaaaaagcacattagatactaagaaaaggttttatatatatatatatatataatctcgaattctcagaagaaagg

SEQ ID NO: 7826 - DNA, 110 bp, Homo sapiens
  DISO7_10001677
  Located on chromosome 4
  Distance between a terminus base of telomere on chromosomal short arm and 5'-terminus of this base sequence : 168881403
  Distance between 3'-terminus of neighbour sequence of sequence listing upward to telomere on chrosomal short arm and 5'-terminus of this base sequence : 2402
cacagaccctgaactcttagttacaactataaacacacacacacacacacacacacacacacacacacatacacacagagatttaaaaatcactgcaaattatcgttgga

SEQ ID NO: 7827 - DNA, 416 bp, Homo sapiens
  chr4.fa.O7frz.177047743
  Located on chromosome 4
  Distance between a terminus base of telomere on chromosomal short arm and 5'-terminus of this base sequence : 168904184
  Distance between 3'-terminus of neighbour sequence of sequence listing upward to telomere on chrosomal short arm and 5'-terminus of this base sequence : 22671
gctattcaaatatttaatgagcactgttgttcaagatattccgttaggcagtttctctctctctctctctctctctctctctgtctctctctgtctgtctctctctgtctctctccctctctcctgcatgtgtgtgtgtgtgtgtgtgtgtgtgtgcatgtgtgtgtgttgaaagaggtagagggcagaatggtgtcctcacgatcttgattagacagcagaactttcagaaatatttcaaagataaaatttatggacttccctcaagtatgttattagactataaactattttattggaggccaatattcatacgcataagtcatcttaatgaagtatagattattgatcttaaacatgttagttacttgatactgaggatggatttctgaaactgtagcttcatactgaatgct

SEQ ID NO: 7828 - DNA, 299 bp, Homo sapiens
  chr4.fa.O7frz.177513213
  Located on chromosome 4
  Distance between a terminus base of telomere on chromosomal short arm and 5'-terminus of this base sequence : 169031491
  Distance between 3'-terminus of neighbour sequence of sequence listing upward to telomere on chrosomal short arm and 5'-terminus of this base sequence : 126891
gttatcctatttaacaaaggcactcaggaatgcaaagagaaagagggtcagtgttcagctcttaatttctaaaagagaatctcaaaggccacagctgagaaacatgtcttaaaagccagaattttggtttggtttggttttgtgtttcgtgtgtgtgtgtgtgtgtgtgtgtgtgtgtgtgtgtgtgtgtgtgtgtgtttgaaatgaagcaagagtttctaaacctccaaacctttcctttacacatcaaaggcatagtagttagcaaagaattagtagtcaccaaagaatttcactaa

SEQ ID NO: 7829 - DNA, 228 bp, Homo sapiens
  chr4.fa.O7frz.177766201
  Located on chromosome 4
  Distance between a terminus base of telomere on chromosomal short arm and 5'-terminus of this base sequence : 169285545
  Distance between 3'-terminus of neighbour sequence of sequence listing upward to telomere on chrosomal short arm and 5'-terminus of this base sequence : 253755
atgaaattatctgataccactgagtattctctttgatcctccttgattttaaacacacacacacatacacacacacacacacacacacacacatgagatagatagatagatagatagatagatagatagatagatagacagacagacagacagacagatattacatatcatgtatatggtgacaatgggcaaatgaatgactttctattgaatatctggttcatgatt

SEQ ID NO: 7830 - DNA, 474 bp, Homo sapiens
  chr4.fa.O7frz.177848666
  Located on chromosome 4
  Distance between a terminus base of telomere on chromosomal short arm and 5'-terminus of this base sequence : 169343991
  Distance between 3'-terminus of neighbour sequence of sequence listing upward to telomere on chrosomal short arm and 5'-terminus of this base sequence : 58218
caggtaccaataaatcatgaaccaagaaaagcataccagtatgacagccaaaatatcttttaaagtgtatggatctagagatagacagatgatggatcgatggatggacggatggttggatggctggatgatggatggatggatggatggatggatggatggatggatggatagagagataggagctatagacaaaaacttgtctctttgtagagtatcaggaaggattcacactaaactatccccaatatctttgggatagaaggcgaagagccttggaagcataactcaccctcatttattttagtaccctcaactctcagcacctgagttccaccaaacttcaaactgcaaatcttagattgaatggtatgttactgttttcaggagaacactcgaaatcatgaaggtctgtatgtcgttgatgttatggtttggacttcttattgtgtctttaaaggacttgcttctgtt

SEQ ID NO: 7831 - DNA, 204 bp, Homo sapiens
  chr4.fa.O7frz.177875732
  Located on chromosome 4
  Distance between a terminus base of telomere on chromosomal short arm and 5'-terminus of this base sequence : 169412231
  Distance between 3'-terminus of neighbour sequence of sequence listing upward to telomere on chrosomal short arm and 5'-terminus of this base sequence : 67766
tgatttaacctttcagaaactaagtttccctgtttgtaaagtagaaaagccaatttctggcaaacttgcctcaggttattaggaaaaccaagtggggagtgtgtgggagtgtgtgtgttgtgtgtgtgtgtggccagcataacaccgccaataacaccacaatgaacgtggagccctctggggtaactgtgaagatctccttcc

SEQ ID NO: 7832 - DNA, 155 bp, Homo sapiens
  D4S2979
  Located on chromosome 4
  Distance between a terminus base of telomere on chromosomal short arm and 5'-terminus of this base sequence : 169649067
  Distance between 3'-terminus of neighbour sequence of sequence listing upward to telomere on chrosomal short arm and 5'-terminus of this base sequence : 236632
tagtttgccaacccctagtctaaagaaaacagcatttctactcacaaattttatatatatatgtgtgtgtgtgtgtgtgtgtgtgtgtgtgtgtgtgtgtatagtactgtttctgttgaacagataaaaccatatattcatggtagctgcagaaa

SEQ ID NO: 7833 - DNA, 122 bp, Homo sapiens
  Z67176
  Located on chromosome 4
  Distance between a terminus base of telomere on chromosomal short arm and 5'-terminus of this base sequence : 169660518
  Distance between 3'-terminus of neighbour sequence of sequence listing upward to telomere on chrosomal short arm and 5'-terminus of this base sequence : 11296
acacatagacatacgcgcagcgcacagacgtacgtgcacacgcacacacacatgcacgcacacacacacgcacacacacacacacacacacacacacacacacccctctggctgcctcaacc

SEQ ID NO: 7834 - DNA, 200 bp, Homo sapiens
  Z67341
  Located on chromosome 4
  Distance between a terminus base of telomere on chromosomal short arm and 5'-terminus of this base sequence : 169677748
  Distance between 3'-terminus of neighbour sequence of sequence listing upward to telomere on chrosomal short arm and 5'-terminus of this base sequence : 17108
tagaggttgcagtgagccataatcgcaatcataccactgcataacagcctgagtgacagagcaagaccctgtctctctttctctctctctttctctctctctctctctctcacacacacacacacacacacacacacacacacatttattgaattgagagaaacaggaaattttggatattatggtggcttctgttcagc

SEQ ID NO: 7835 - DNA, 268 bp, Homo sapiens
  D4S2406
  Located on chromosome 4
  Distance between a terminus base of telomere on chromosomal short arm and 5'-terminus of this base sequence : 169903543
  Distance between 3'-terminus of neighbour sequence of sequence listing upward to telomere on chrosomal short arm and 5'-terminus of this base sequence : 225595
tcaagtgatccatctgccttgtcctcccaaagtgctaggattacaggcttgagccaccatgcctggcctggacttcatttttaacattcttcctagagatagatagatagatagatagatagatagatagatagatagatagatagaatacatgtataatatacacacatatataatatatacatatatataatatatattttctatgaccttactggacttcaaaagtacacaagatagtttaaatattgttgtgtgtgatatgggc

SEQ ID NO: 7836 - DNA, 432 bp, Homo sapiens
  chr4.fa.O7frz.173092519
  Located on chromosome 4
  Distance between a terminus base of telomere on chromosomal short arm and 5'-terminus of this base sequence : 170083142
  Distance between 3'-terminus of neighbour sequence of sequence listing upward to telomere on chrosomal short arm and 5'-terminus of this base sequence : 179331
gtgaggttagccttagataaagactcatctgtagaaacaacagatagatggcagagcatatacaggacagattgaggctggctacatactttgtgacccaaatgcaaaatgaaaacatggggccctggttaagggaagtcaatctattttcctcaggagctggctgccccaaccacagtggatgggcatattaagttaaggttctccagagaagcagaacctgtagggtgtgtgtgtgtgtgtgtgtgtgtgtctgtgtgtgtgtgtatgtgtgtgtgcaattgttgaggcaagaaagtccaaaatcttccttcccaggctggaaacctggaaagaactgacgctgcagttcaagtccgaaggtaatctgctggcagaatcccctctcacttgtgatgggtcagtcttttgttgtattgaagccttcaacta

SEQ ID NO: 7837 - DNA, 244 bp, Homo sapiens
  AC015457.4_142358
  Located on chromosome 4
  Distance between a terminus base of telomere on chromosomal short arm and 5'-terminus of this base sequence : 170141876
  Distance between 3'-terminus of neighbour sequence of sequence listing upward to telomere on chrosomal short arm and 5'-terminus of this base sequence : 58302
aggctacaatgagtcatgattaagccagtgccctccagcctaggtgacagagtgaaaccctgtcttaaaaaaagggaaggaaggaagggaggaaggaagggagggaggaaggaaggaaggaaggaaggaaggaaggaaggaaggaacggagaaagcaagctatctcagtgttacatggcaccaaaagatggaaagacacagataattttggcccgaaatccagcagtacattagcttgctgtac

SEQ ID NO: 7838 - DNA, 161 bp, Homo sapiens
  chr4.fa.O7frz.173281354
  Located on chromosome 4
  Distance between a terminus base of telomere on chromosomal short arm and 5'-terminus of this base sequence : 170301108
  Distance between 3'-terminus of neighbour sequence of sequence listing upward to telomere on chrosomal short arm and 5'-terminus of this base sequence : 158988
aatcagagtcacagtgaaatgtcacctcgcacccatcagaatggctattatcaaaacacaaacacacacacacacacacacacacacacccaaacccaaacaagataaatgctcctgaggatgtgaagaagttggagcccttgtacgctgttaggaataaa

SEQ ID NO: 7839 - DNA, 440 bp, Homo sapiens
  chr4.fa.O7frz.173384885
  Located on chromosome 4
  Distance between a terminus base of telomere on chromosomal short arm and 5'-terminus of this base sequence : 170376443
  Distance between 3'-terminus of neighbour sequence of sequence listing upward to telomere on chrosomal short arm and 5'-terminus of this base sequence : 75174
acttagtctgtaattacaagccaccatcagtgacttcttccaaagtttctttctttaatatcatttattaaacacaaattgctcatcagacataataaaaaatttcagttaggttaaaaagattaaaattaaaaatatgatataaaattagggaaaatcagaaagataattttagtttgataagggtttttctaagtcagacataaaaactagaaaccaggaagaaggggccatggggggagagagagatttttttatataataaatatttctgtttattaaaaaataacatgacatcaaaagacaaattatagacctagagtaggatctatctatctatctatctatctgtctgtctatctatctatctatctatctatctatctatggaaaaattcttatatatgtggaaaattttatttacacgcatctattaatcc

SEQ ID NO: 7840 - DNA, 109 bp, Homo sapiens
  Z66612
  Located on chromosome 4
  Distance between a terminus base of telomere on chromosomal short arm and 5'-terminus of this base sequence : 170476888
  Distance between 3'-terminus of neighbour sequence of sequence listing upward to telomere on chrosomal short arm and 5'-terminus of this base sequence : 100005
tagttgttagaatacattttccctcactgaacacacacacacacacacacacacacacacacacacacacacaaacacacacacacatacccacatgcactcacgtaat

SEQ ID NO: 7841 - DNA, 257 bp, Homo sapiens
  chr4.fa.O7frz.173586878
  Located on chromosome 4
  Distance between a terminus base of telomere on chromosomal short arm and 5'-terminus of this base sequence : 170534344
  Distance between 3'-terminus of neighbour sequence of sequence listing upward to telomere on chrosomal short arm and 5'-terminus of this base sequence : 57347
ctgattcagttgatttaagatgacggacagatatgaacatcctccctccaaaagtgtgcgcaggcatacacacacacacacacacacacacacacacacacacacacagacacaccttgtcattctcctcctcctcagcacttctgatgttcatcctggttgaaaacgtatgcttttggtttactttaaaaatgttctttgtttaatagttgctcttcactttatagaagtatcttgaatgacactattagattggt

SEQ ID NO: 7842 - DNA, 139 bp, Homo sapiens
  G09999
  Located on chromosome 4
  Distance between a terminus base of telomere on chromosomal short arm and 5'-terminus of this base sequence : 170667049
  Distance between 3'-terminus of neighbour sequence of sequence listing upward to telomere on chrosomal short arm and 5'-terminus of this base sequence : 132448
tgttggatacaatttaggaaagcatatttttaaatctttccatgtgatatcaaaatcatcatcatcatcatcatcagcagcagcagcagcagcagcagcagcaggccaaaacctaagtgaagttggaaaccaagaaggg

SEQ ID NO: 7843 - DNA, 480 bp, Homo sapiens
  chr4.fa.O7frz.173755428
  Located on chromosome 4
  Distance between a terminus base of telomere on chromosomal short arm and 5'-terminus of this base sequence : 170720079
  Distance between 3'-terminus of neighbour sequence of sequence listing upward to telomere on chrosomal short arm and 5'-terminus of this base sequence : 52891
tacaatcattgagcctcattacttgtccttgtaggcaggttagagatccagcaacagcagtagccaagtaagcctcggtgagaagagaccttgttgattgtttgcatatatccctcaccaacatgatgactttgtacccattgtatcttggagtaagtgtggaaaaaagatgccagacatgcacattttgggtcattttttttaacctaattattgggatcctccatataaacaaacacacagacacacatacagacacacacacacacacacacacacacacacacaaaagtatacatatacttcccatttcactagcacattattactcttcttagatatttcctttagtcaaatttctctgaaatttcaaaaattaattaaatgctgttttttgtcacatatccagtatttagtcacaatacaacatttctaacacagtattacaattgccttttgagcataatttccaatttgact

SEQ ID NO: 7844 - DNA, 384 bp, Homo sapiens
  chr4.fa.O7frz.174002804
  Located on chromosome 4
  Distance between a terminus base of telomere on chromosomal short arm and 5'-terminus of this base sequence : 171051318
  Distance between 3'-terminus of neighbour sequence of sequence listing upward to telomere on chrosomal short arm and 5'-terminus of this base sequence : 330759
atgtagcgcttatttgtaagttagaatgattcgttaaccatggagttcttgtgttcagaaaggagccttactttttatgcacacacacacacacacacacacatacacacatgtgtctgtgtctgtatttttgggtgtgtattagtcctaaaagaaacaaaagttttaccaatttattatgtttagttaccaataactttaatctattggctatttgaattactggtcttcactgtcacaaagatttacctcaaaatttaaaaaacagacaaacagtctcaatataaaatggcacatagtatattaatggctgtttgatagaacctgccttcgttttataccacttctaaaaatacgtttggagttagctgtattgcgtaggag

SEQ ID NO: 7845 - DNA, 303 bp, Homo sapiens
  chr4.fa.O7frz.174084038
  Located on chromosome 4
  Distance between a terminus base of telomere on chromosomal short arm and 5'-terminus of this base sequence : 171099018
  Distance between 3'-terminus of neighbour sequence of sequence listing upward to telomere on chrosomal short arm and 5'-terminus of this base sequence : 47316
tatctagttcatgctcctgaatacaggctagaccttatatccagctaaaaaagaaaatttttgagactacatatggaaaaatgagtgtgtgtatgtgtgtgtgtgtgtgtgtgtgtgtgaatgtggcatgtaaaatgcaataaaaaatatcatgtttttaaatcaacgataacctattcaagagccttttcatagtatagagaaattactcctggatattactaattttgtaaatatatacacttcattcagtggcttggagtcatcagattggttagtctattctgtttcctagcttatcaa

SEQ ID NO: 7846 - DNA, 112 bp, Homo sapiens
  DISD22_0004227
  Located on chromosome 4
  Distance between a terminus base of telomere on chromosomal short arm and 5'-terminus of this base sequence : 171287238
  Distance between 3'-terminus of neighbour sequence of sequence listing upward to telomere on chrosomal short arm and 5'-terminus of this base sequence : 187917
gaattataggagaaataccacggggtgtgtgtgtgtgtgtgtgtgtgtgtgtgtgtgtcatagaaactaaggagaaagattgtttcaaaaaggagggaatagtcaacagtgt

SEQ ID NO: 7847 - DNA, 284 bp, Homo sapiens
  chr4.fa.O7frz.174337035
  Located on chromosome 4
  Distance between a terminus base of telomere on chromosomal short arm and 5'-terminus of this base sequence : 171475506
  Distance between 3'-terminus of neighbour sequence of sequence listing upward to telomere on chrosomal short arm and 5'-terminus of this base sequence : 188156
gaactgcgaacactgtacttaggggacataactttttgcaagttataaggagcagagatactagatggcaaagatttaacaataaggcagatgtcaatgttttccaaatgggagaatgatgtgtgtgtgtgtgtgtgtgtgtgtgtgtgtgtgtgtgtgtgtgtgtctgcttacacttcacctggcggcacttcccaaggaaccaagagaaattgggtataacccagtaaagagaaagaagaataaggtggtcttaggttgtaaatttcagaacttctgaaaga

SEQ ID NO: 7848 - DNA, 192 bp, Homo sapiens
  AC068363.3_149515
  Located on chromosome 4
  Distance between a terminus base of telomere on chromosomal short arm and 5'-terminus of this base sequence : 171643395
  Distance between 3'-terminus of neighbour sequence of sequence listing upward to telomere on chrosomal short arm and 5'-terminus of this base sequence : 167605
ctgtcaagccatcctaaagtacgttggcaacaacatgacagtttatccctaaatattttagcatatagctctcacaaacaaggacattctctcacacaacctaacgccattaccaggccttttgtttattgttgttgtagttgttgttgttgttgttgttttgagacggagtttcactcttattgctcatgc

SEQ ID NO: 7849 - DNA, 189 bp, Homo sapiens
  D4S2952
  Located on chromosome 4
  Distance between a terminus base of telomere on chromosomal short arm and 5'-terminus of this base sequence : 171660422
  Distance between 3'-terminus of neighbour sequence of sequence listing upward to telomere on chrosomal short arm and 5'-terminus of this base sequence : 16835
taggtagattccaaaatgacctccaatgactcccacctcctggtcatcatgccttatgtaatcccgtgtgtgtgtgtgtgtgtgtgtgtgtgtgtgtgtgttaggattggacctagtaacttgcttctcatgaacagaatgcagaaagagtgatggggtctcaccaatagcctgtgaggaactgagact

SEQ ID NO: 7850 - DNA, 420 bp, Homo sapiens
  chr4.fa.O7frz.175081063
  Located on chromosome 4
  Distance between a terminus base of telomere on chromosomal short arm and 5'-terminus of this base sequence : 171892118
  Distance between 3'-terminus of neighbour sequence of sequence listing upward to telomere on chrosomal short arm and 5'-terminus of this base sequence : 231507
aggaattcctgaaatctaaattacacattctcagggcaagactccacaggaataggcaataaataaataaataaataaatagaaaacctaccagagagctaagaacacagcaacttcaatagcttgcaaagggctggaagctattgcaagctttaatttcaactaactggatggaggaatatcaggagacacttgggatttcagtagaagtttcaggcagccatcacttaggaatagggctaacgtatccctagagtaaaggcaactctagaccatgctaacaatgtttgaaaacaagccttgaaaggattgagcagagctacacatgaatgaactgcctaccagaacaaaacaaaagttttaaggaagacaacaaaattcagacatgcaaaaaggcagtactcataatgtccagcacac

SEQ ID NO: 7851 - DNA, 239 bp, Homo sapiens
  HUMUT444
  Located on chromosome 4
  Distance between a terminus base of telomere on chromosomal short arm and 5'-terminus of this base sequence : 172105429
  Distance between 3'-terminus of neighbour sequence of sequence listing upward to telomere on chrosomal short arm and 5'-terminus of this base sequence : 212891
agaaaatggccagatgagaggcgttctaatgtcagtcactatattattggggaatttataaagaacaccagtaatgtttattttttagtttgaggggttttgtattattaatggaatttttcaaagaaaattatcctagttttatttaatctgtagccagatttgtgtgtgtgtgtgtgtgtgtgtgtgtgtgtgtgtgcatgctgaatttcttgcctgccagtggaaaaactatgtat

SEQ ID NO: 7852 - DNA, 260 bp, Homo sapiens
  chr4.fa.O7frz.175341796
  Located on chromosome 4
  Distance between a terminus base of telomere on chromosomal short arm and 5'-terminus of this base sequence : 172191622
  Distance between 3'-terminus of neighbour sequence of sequence listing upward to telomere on chrosomal short arm and 5'-terminus of this base sequence : 85954
accttcgagataggtcatctatttgctctgtcatatatatatatatatatataaatattatgtacaaatgaatagagtgaatttcactcagtctagtcaaggacgaaatgccatttacacacctctttatttaacactggagtgtacttttctttaaatctccttttgcagctttttaagggagaaggggtttctgaaatggaattatgtgaatgttagcattttataattgaaattataattacattggaaacgtaagg

SEQ ID NO: 7853 - DNA, 203 bp, Homo sapiens
  D4S1566
  Located on chromosome 4
  Distance between a terminus base of telomere on chromosomal short arm and 5'-terminus of this base sequence : 172274715
  Distance between 3'-terminus of neighbour sequence of sequence listing upward to telomere on chrosomal short arm and 5'-terminus of this base sequence : 82833
aatgtcaggccagttatgttcctccatggtgcttggtgtttaaactagaagattaaaaacaagttagaaaaattttctgcttagagttatccctatccaactgtgtgtgtgtgtgtgtgtgtgtgtgtgtgtgtgtgtgtgtttcaagagagcaaatattaactatttctttgcaatccaaatgcactttttaattttggatg

SEQ ID NO: 7854 - DNA, 461 bp, Homo sapiens
  chr4.fa.O7frz.175862167
  Located on chromosome 4
  Distance between a terminus base of telomere on chromosomal short arm and 5'-terminus of this base sequence : 172467333
  Distance between 3'-terminus of neighbour sequence of sequence listing upward to telomere on chrosomal short arm and 5'-terminus of this base sequence : 192415
ctgctcttgtagtgttcttagaataataaaagttctaaattgcacccaacacatacatatattatcagattatcagttttatttatttatttatttatttatttatttatttatttattttgagatggactttcactctgtcactcaggctggagtgcagtggcatgatcttggctggctgcagcctctgcctcctcagattcaagcgattcttctgcctcagcctcctgagtagcttggattacaggaacctgccactatgcccagctaagtttttgtatttttagtagagatggggtttcactgtgttggccaggctggtctcgaactcctgatcttgtgattcagcctcccaaagtgctgggattataggtgtgagccaccgcaccaggcctatatgttttctaacttcctgtttctttggaaagttgaattgcctcagcaagtaaatttgatttaaa

SEQ ID NO: 7855 - DNA, 392 bp, Homo sapiens
  chr4.fa.O7frz.175780204
  Located on chromosome 4
  Distance between a terminus base of telomere on chromosomal short arm and 5'-terminus of this base sequence : 172536139
  Distance between 3'-terminus of neighbour sequence of sequence listing upward to telomere on chrosomal short arm and 5'-terminus of this base sequence : 68345
tctgacctcatgattcaattacctcccaccaggccttgcctccaacactgggcattacaattcaataagagatttggcaggaacacagatccaaatcataccagtatatatatgtatacacacacacacacacacacacacacacacacacacttcatttagccaatgctgtgtgtaaagctacccccaaacctagtggtattatataaaaattattgtattatgctaagagattctggcctcattaatgtatgcttttattccatgacgaatgggatcttggattgaaagcttcaaatgcctagggtgacttgaacacctgagggctggagttatctggatactttttactcacatgtctggtgcctgggatggtaagacttgaactcgtt

SEQ ID NO: 7856 - DNA, 444 bp, Homo sapiens
  chr4.fa.O7frz.175660435
  Located on chromosome 4
  Distance between a terminus base of telomere on chromosomal short arm and 5'-terminus of this base sequence : 172695815
  Distance between 3'-terminus of neighbour sequence of sequence listing upward to telomere on chrosomal short arm and 5'-terminus of this base sequence : 159284
cactcaagctaccttaagattagttttagaatagtacattctaatagtacattctttttcatccttttttttttttaacatatagttgtccctccagtatccgtggattattggttttaggtcatatatattatatatatatacatatatatataaataatatgtattttatagatatataatatatatgtgtattgtcagggataatatgagtcatttcataatgataaatcaatcaatctttagttgcctgatagaagagctccaaaataaatgaagcaaaaactaatagaactgcaagaaaatatagacaaatcaacaagtatattcaaagagcttagcaccactcttaatagctgatagaacaagtagacacaaattagtaattatgcagaagacatgaacaatatagtccaccaactcgatctaaataacattaatcga

SEQ ID NO: 7857 - DNA, 437 bp, Homo sapiens
  chr4.fa.O7frz.176224428
  Located on chromosome 4
  Distance between a terminus base of telomere on chromosomal short arm and 5'-terminus of this base sequence : 172917372
  Distance between 3'-terminus of neighbour sequence of sequence listing upward to telomere on chrosomal short arm and 5'-terminus of this base sequence : 221113
ctttatggtacatggctaaactttgatttgccaagacaaatctatataagaacttattattattattattattattattattattattatcattattatttctgagatggagtctcgctctgttacccaggctggtgtacggtggtgccatctcggctcactgcaacatcttcctccccggttcaagcaattctcctgcttcaggcgccagagtagctgtgattacaggcacacaccaccacgccaggctaatttttgtattttcagtagaggtggggttttgccatattggccagggtggtctcgaactcctgacctcaggtgatctgcctaccttggcctcctaaagtgttgggattacaggcgtgagccactgtacccagccagaatgtattattttcatttgtgagctgtggtatctcctgcatcttgtaaca

SEQ ID NO: 7858 - DNA, 476 bp, Homo sapiens
  chr4.fa.O7frz.176340715
  Located on chromosome 4
  Distance between a terminus base of telomere on chromosomal short arm and 5'-terminus of this base sequence : 173033322
  Distance between 3'-terminus of neighbour sequence of sequence listing upward to telomere on chrosomal short arm and 5'-terminus of this base sequence : 115513
caatttgatcattctgtaatgaatacattgtacatcatattttaccccataaatatatgtaattgttatttgtcatttaaaaatcataaaaatatatacagtcggccaggcacggtggctcacagctgtaatcccagtactttgggagaccgaggtgggtggatcacgaggtcaggagatcaagacaatcctggccaacatggtgaaaccctgtctttactaaaactacaaaaattagcagggtgtggtgacatgtgcctgtagacccagctactcagggggctgaggcaggagaattgcttgaacccgggaggcggaggttgcattgagccgagatcttgccactgcactccagcctaggtgacagagcaaggcacttctcaaaaaaattatctatctatctatctatctatctatctagatatctagatatctagatatctctctatatatagatagatatgcaatcgactgga

SEQ ID NO: 7859 - DNA, 321 bp, Homo sapiens
  chr4.fa.O7frz.176540550
  Located on chromosome 4
  Distance between a terminus base of telomere on chromosomal short arm and 5'-terminus of this base sequence : 173209007
  Distance between 3'-terminus of neighbour sequence of sequence listing upward to telomere on chrosomal short arm and 5'-terminus of this base sequence : 175209
ttttcttgtcatgctatcttaaagtttacttatcacttaaaatttagtttcgtcccttgcttactatattttttccatagtactaattaagaaattatatatttccatgtatttatccttcttatggggtagctcctccattagaaggttctttgtatgagcacagagattttttatttatttatttatttatttatttatttatttatttttatttatttttattttttggctggggtagaggactgctgttcactcttggtagaatctagaaaagtgccaggcatatagcactctgtaaacgtttattgaataccttga

SEQ ID NO: 7860 - DNA, 181 bp, Homo sapiens
  D4S417
  Located on chromosome 4
  Distance between a terminus base of telomere on chromosomal short arm and 5'-terminus of this base sequence : 173283126
  Distance between 3'-terminus of neighbour sequence of sequence listing upward to telomere on chrosomal short arm and 5'-terminus of this base sequence : 73798
acagcactgattgatgcctgaaatttctaatacataaagtcacagaaatcattgttagtataaaaaatttcaaggaagtatattagttatgatcctcaatatgctaaatatttgtttgtgtgtgtgtgtgtgtgtgtgtgtgtgtgtgtgtgtatttagtagatgtagtgttccccagaca

SEQ ID NO: 7861 - DNA, 434 bp, Homo sapiens
  AC023492.3_75022
  Located on chromosome 4
  Distance between a terminus base of telomere on chromosomal short arm and 5'-terminus of this base sequence : 173283446
  Distance between 3'-terminus of neighbour sequence of sequence listing upward to telomere on chrosomal short arm and 5'-terminus of this base sequence : 139
ttcaaatactagtcaatgtgcaagaacaaagactggccccttgcctcaagagattgaattcttaagagccattttagctccacagttcttcatgtgattggttatgacagctgctgtgaattcattctaggtcagcttcttcctctactcagttctctcgccttgtcctctcacagatgtttgcaagaatagcccccaggaaaactcttccattcaaatctgaaagctggttttctgtgaaacccaacttataatgtgtgaaataaataataataataataataataataataataataataataataactttaagtgccaatacaagtatctatgattatctctgggtaatgaaatcatagaaaaatttttctgcactttcctgtacttatcatatgtactattctaaactctgagcatctttacaaatttgg

SEQ ID NO: 7862 - DNA, 121 bp, Homo sapiens
  D4S620
  Located on chromosome 4
  Distance between a terminus base of telomere on chromosomal short arm and 5'-terminus of this base sequence : 173318887
  Distance between 3'-terminus of neighbour sequence of sequence listing upward to telomere on chrosomal short arm and 5'-terminus of this base sequence : 35007
ctttcatgttaaaggttgcagtttctttttttcttttcctttgtgtgtgtgtgtgtgtgtgtgtgtgtgtgtgtgtgttttgttttgagagacagaagcataacgaggtagggcgtttgag

SEQ ID NO: 7863 - DNA, 136 bp, Homo sapiens
  DISO7_10001683
  Located on chromosome 4
  Distance between a terminus base of telomere on chromosomal short arm and 5'-terminus of this base sequence : 173442089
  Distance between 3'-terminus of neighbour sequence of sequence listing upward to telomere on chrosomal short arm and 5'-terminus of this base sequence : 123081
gtaaggaagtaaacgctgtccatttttggcaatctgtgtgtgtgtgtgtgtgtgtgtgtgtgtgtttaagacttcctgtgtcaaaacactttctattcaggagtcttttagaaaatttgtttcaacgcattgttgg

SEQ ID NO: 7864 - DNA, 99 bp, Homo sapiens
  DISO7_10001681
  Located on chromosome 4
  Distance between a terminus base of telomere on chromosomal short arm and 5'-terminus of this base sequence : 173547188
  Distance between 3'-terminus of neighbour sequence of sequence listing upward to telomere on chrosomal short arm and 5'-terminus of this base sequence : 104963
aggattcccattacatgtacatcttttataattgtctaatggatatatatatatatatatatatggcattcttggagtggctaaggattgtctgatgtg

SEQ ID NO: 7865 - DNA, 104 bp, Homo sapiens
  DISO7_10001680
  Located on chromosome 4
  Distance between a terminus base of telomere on chromosomal short arm and 5'-terminus of this base sequence : 173619529
  Distance between 3'-terminus of neighbour sequence of sequence listing upward to telomere on chrosomal short arm and 5'-terminus of this base sequence : 72242
tggtgacactaatggttataaacagatctcatacacacacacacacacacacacacacacgatcattagtattttttagaaacctactgaagagcccagtaatt

SEQ ID NO: 7866 - DNA, 161 bp, Homo sapiens
  DISO7_10001679
  Located on chromosome 4
  Distance between a terminus base of telomere on chromosomal short arm and 5'-terminus of this base sequence : 173623233
  Distance between 3'-terminus of neighbour sequence of sequence listing upward to telomere on chrosomal short arm and 5'-terminus of this base sequence : 3600
atacgtatgcgtgcatgcatgcacacacacacacacacacacacacagtgcaaatacatgtttgttgccatattttctgtgttgtggtggtctggaaggaaacctgcaatatatccaaggtaagccagtacctgcaaagcaaagggtagcctgttccatca

SEQ ID NO: 7867 - DNA, 385 bp, Homo sapiens
  chr4.fa.O7frz.181779197
  Located on chromosome 4
  Distance between a terminus base of telomere on chromosomal short arm and 5'-terminus of this base sequence : 173795434
  Distance between 3'-terminus of neighbour sequence of sequence listing upward to telomere on chrosomal short arm and 5'-terminus of this base sequence : 172040
cttcatggtaagcattatgtaaagatttactactagtttgtgttgttgttacagatggtgaagataaaaaggcatcactaaattttgcaaaacactctcagagaattccagtactcattgggaaatcacacacacacagacacacacacacacacacacacacacacacactcaacgttctccattcaaattcctttgtttttactttctgactctataattaaggttatgtttatgattgaataccctttcacttttattctgaacatgcattaaaaagtctgcatccttcaaatatctatgtttgatagattatgtctatccctttctctaagaaatcttgtcatcccagtaattagaccttcacttgaaattgagaaagtac

SEQ ID NO: 7868 - DNA, 464 bp, Homo sapiens
  chr4.fa.O7frz.181942342
  Located on chromosome 4
  Distance between a terminus base of telomere on chromosomal short arm and 5'-terminus of this base sequence : 173941232
  Distance between 3'-terminus of neighbour sequence of sequence listing upward to telomere on chrosomal short arm and 5'-terminus of this base sequence : 145413
tcattactaaggacaatttgtcacttccccaaatttctgggtgtcaacactttgatttccactttatcctttgtgcctattgtggtgactgcctccaccttttctctctcgtggtgaaagacttatctctcagttggcctctgccattctaggatcccatcatcactgttgataccaagaagtcaatctcatagtgccatttcaaacaagacacaaaaggatagattttaagagtgcgcgtgcgtgtgtgtgtgtgtgtgtgtgtgtgtgtgtgtatttcagatcataatatccaccaattttgtattttctgtttcatgcaacatttattagggaacattttcccttgccattcaatattgtttcatgttatttgattttagtataataatcaatcatgtttatataccaaagattaagagcatacttggaggtgatcattgaagtaactaggcttgaaagga

SEQ ID NO: 7869 - DNA, 255 bp, Homo sapiens
  chr4.fa.O7frz.182068918
  Located on chromosome 4
  Distance between a terminus base of telomere on chromosomal short arm and 5'-terminus of this base sequence : 174063459
  Distance between 3'-terminus of neighbour sequence of sequence listing upward to telomere on chrosomal short arm and 5'-terminus of this base sequence : 121763
tcagtatctgaagtgaggctacatccacagaggcactggttttgacaagatcatcactcccgccttcaacaaaataatcaagaaatgactatgatgctaaatcggtgggacaattcttttttcttttttttttttttggttatcttttctttctttctttctttctttctttctttctttctttctttctttctttcttcctttctttcctttttggtctaatacttcttggtatagatccacctggaaatacat

SEQ ID NO: 7870 - DNA, 124 bp, Homo sapiens
  DISD22_0004238
  Located on chromosome 4
  Distance between a terminus base of telomere on chromosomal short arm and 5'-terminus of this base sequence : 174312862
  Distance between 3'-terminus of neighbour sequence of sequence listing upward to telomere on chrosomal short arm and 5'-terminus of this base sequence : 249148
acagcaagagcgttaaaccccgtgtgtgtgtgtgtgcacgctgcatgtgtgtgctgtgtgtgtgtgtgtgtgtgtgtgtgtgtttgatgcagtccttttcagagtccatttgtaacatagtctg

SEQ ID NO: 7871 - DNA, 218 bp, Homo sapiens
  D4S2383
  Located on chromosome 4
  Distance between a terminus base of telomere on chromosomal short arm and 5'-terminus of this base sequence : 174392564
  Distance between 3'-terminus of neighbour sequence of sequence listing upward to telomere on chrosomal short arm and 5'-terminus of this base sequence : 79578
aaatgtgactctggggacaacagtggagcatgaattccttgggacatgaacttgggccgttattcatcctgctgtgtttccaaagctgattttccagcaaaacaataataataataataataataataataataataataataataatgacaacaacttagcaagcttggagataagttaccagaactcatagagttacagattaatgcttcggccta

SEQ ID NO: 7872 - DNA, 361 bp, Homo sapiens
  chr4.fa.O7frz.182421912
  Located on chromosome 4
  Distance between a terminus base of telomere on chromosomal short arm and 5'-terminus of this base sequence : 174490135
  Distance between 3'-terminus of neighbour sequence of sequence listing upward to telomere on chrosomal short arm and 5'-terminus of this base sequence : 97353
ctcaggtttgtgacatgtttagctcaccacctagcacatggtaagcagcaagtacatgctagctgttttactagcagtgatggtggcgtaagcatctctctctctctctctctctctctctctctctgtctctgtctctccacccccaagaccccctcattccccccaatctccctccctcccccaccccccaccctgtctctctcccttcttccttctctgaagcaatatgggattgtcttgaatttcttccacatgtcttttcagagtttttacctttttcatttcttttttctgagtctagcgctttgctttcatctcagtcttcaaatggcccagataaactgcttatcagaatgga

SEQ ID NO: 7873 - DNA, 190 bp, Homo sapiens
  D4S1595
  Located on chromosome 4
  Distance between a terminus base of telomere on chromosomal short arm and 5'-terminus of this base sequence : 174621318
  Distance between 3'-terminus of neighbour sequence of sequence listing upward to telomere on chrosomal short arm and 5'-terminus of this base sequence : 130822
aaagttccacacctagcaagtacctactggtagttttgtgtgtgtgtgtgtgtgtgtgtgtgtgtgtgtgtgtatgcattataaattacatgttttggcccagcacagtggctcacacctgtaatcccagcactctgggaggccgaggcgggcagatcacgaggtcaagagattgagaccatgttggcca

SEQ ID NO: 7874 - DNA, 236 bp, Homo sapiens
  D4S2992
  Located on chromosome 4
  Distance between a terminus base of telomere on chromosomal short arm and 5'-terminus of this base sequence : 174623954
  Distance between 3'-terminus of neighbour sequence of sequence listing upward to telomere on chrosomal short arm and 5'-terminus of this base sequence : 2446
ttccaaaccaggcgagaacgaatagaacagcttctttacagagggaaataactagtctatacaagaacctcagggaggcagactctggtagcaataaaacataaaacctgagggattttaaaagaacacagagtgatttttcccttaagaaaagtgtgtgtgtgtgtgtgtgtgtgtgtttgtgtgtctgtgtgtgagagagagagagagagagaagaggaaagtggggaatggct

SEQ ID NO: 7875 - DNA, 245 bp, Homo sapiens
  AC015531.4_102490
  Located on chromosome 4
  Distance between a terminus base of telomere on chromosomal short arm and 5'-terminus of this base sequence : 174656757
  Distance between 3'-terminus of neighbour sequence of sequence listing upward to telomere on chrosomal short arm and 5'-terminus of this base sequence : 32567
atgaagcattctagttgagtaggaagaatttagagccagtatcatgggatctggaaaatcagccagcagtaatttttccctccctccctccctctttctatctactttacaggtccttctttcctttcttccttctttccttccttccttattccctttctttcttccttccttccttcctccccccctccctccctccttcccttccttccttccttccttcctctttcatgtttcctgacatc

SEQ ID NO: 7876 - DNA, 228 bp, Homo sapiens
  D4S2991
  Located on chromosome 4
  Distance between a terminus base of telomere on chromosomal short arm and 5'-terminus of this base sequence : 174891822
  Distance between 3'-terminus of neighbour sequence of sequence listing upward to telomere on chrosomal short arm and 5'-terminus of this base sequence : 234820
taagctgtgattgaccactgcactccagccttggcaacacagcaagactctgtctctaaacatatgtgtgtgtgtgtgtgtgtgtgtgtgtgtgtgtgtgtgtgtgtgttgcaataaccaggtgagacatgtaatggtgtaatggcttggactaaggtggtagtagtggagattttcctatttctatttattccccagaatgaatacatcctacaaaagacctggaaa

SEQ ID NO: 7877 - DNA, 174 bp, Homo sapiens
  AC012055.9_98728
  Located on chromosome 4
  Distance between a terminus base of telomere on chromosomal short arm and 5'-terminus of this base sequence : 175198822
  Distance between 3'-terminus of neighbour sequence of sequence listing upward to telomere on chrosomal short arm and 5'-terminus of this base sequence : 306772
tcagacctgtttagaattaaccatttttattcaggtgcatgcatgagtgcgtacacacacacacacacacacacacacacacacacacacacacgccccatccaaacattctacaggtataaagatgactctactgcaaaaagacttgaaaactctacatctgcgtaagaggaa

SEQ ID NO: 7878 - DNA, 388 bp, Homo sapiens
  AC012055.9_82845
  Located on chromosome 4
  Distance between a terminus base of telomere on chromosomal short arm and 5'-terminus of this base sequence : 175214634
  Distance between 3'-terminus of neighbour sequence of sequence listing upward to telomere on chrosomal short arm and 5'-terminus of this base sequence : 15638
aggcagtgactttacaattcacagagaataaattggaatcaaaataaggcttggcttctgtcaatggtgtgctggtgcgtgtgccaggcttaacgccaggctttccaaaagggaaataaataaatatgtatatatgtatatattatatatatatatatatatataatatacctgtgtttattatttcttataaattttactaatatacacaatgtatagtatacaaattataagtaataatgaaatacctaaaactattttacattttatatagccaatttattctcacagaaggcttttgtttatttttgccagattcttaaatccataatcaatctttttacaattaatgaatgcggtatcaacgtgaatgttggctaatattcca

SEQ ID NO: 7879 - DNA, 415 bp, Homo sapiens
  AC012055.9_76424
  Located on chromosome 4
  Distance between a terminus base of telomere on chromosomal short arm and 5'-terminus of this base sequence : 175221057
  Distance between 3'-terminus of neighbour sequence of sequence listing upward to telomere on chrosomal short arm and 5'-terminus of this base sequence : 6035
attcgtatgtcatggagatgacaaatatgtctcctgctaattgaaatgctctaatgttgttaaatagtattttcggatatgtttactcttctatagcctttttcattcttattatacagtcagatgttaaaatatgtgcatatatatatatatatatatatatgcacacatgcatatacacacataattttatagttggattagacctagaatgtcttcaaaaaaattatgaaaaaattcctccttctccacttatcatcattatctaaaaagcatgcattcagctcaaattttattgagcacgcacaatgcatcttaagtagtattatatattgtccctgaaattaataggggaaaaatatttcagtctagatgaaaatcgtgttcattagtaaccgatacaatgttatttcca

SEQ ID NO: 7880 - DNA, 260 bp, Homo sapiens
  AC012055.9_16473
  Located on chromosome 4
  Distance between a terminus base of telomere on chromosomal short arm and 5'-terminus of this base sequence : 175281095
  Distance between 3'-terminus of neighbour sequence of sequence listing upward to telomere on chrosomal short arm and 5'-terminus of this base sequence : 59623
aggcatacacctaggacaaatattgcgtttgaaccagacgagtttgggcaacacacacacacacacacacacacactcccagatgtacacctctatctctatttatcattttatacctttctgttttaaaatttctttattgtgttttcctaagctacacaagtagaaactgcatgactgttgctgtccattaaaagactttcagtgaattactttcatctaattgatctagatttgtatttcagctgcagatttgtatc

SEQ ID NO: 7881 - DNA, 101 bp, Homo sapiens
  DISD22_0004342
  Located on chromosome 4
  Distance between a terminus base of telomere on chromosomal short arm and 5'-terminus of this base sequence : 175357480
  Distance between 3'-terminus of neighbour sequence of sequence listing upward to telomere on chrosomal short arm and 5'-terminus of this base sequence : 76125
tcttgaggctgagatataggaagaaactttattagtgtgtgtgtgtgtgtgtgtgtgtgtgtgtgtgttttcattaatacttctttctgccttcgaacact

SEQ ID NO: 7882 - DNA, 383 bp, Homo sapiens
  chr4.fa.O7frz.183173283
  Located on chromosome 4
  Distance between a terminus base of telomere on chromosomal short arm and 5'-terminus of this base sequence : 175501312
  Distance between 3'-terminus of neighbour sequence of sequence listing upward to telomere on chrosomal short arm and 5'-terminus of this base sequence : 143731
cctgtcagtagctagaggtttcccacgttccttgacatatagtgcatatacacacacacacacacacacacacacacacatgtgtatatgtatatacatatgtgtatatatatacacatatgtgtgtgtatatatatagtgtgtatatatgtataaagtttatttatatatatatatatatatatatatatatatatatatataaactttaatgaggattgtgaacctgctgaaagcccttaggacattccaaagtccaaaggtccaaagtgagtcacttgagattatgtgtggctctgcttgcccaattaatgtacacatctgtagttgaagtatagctattctaatgtcatcatgctgaaggtaatctagttggtgtcttt

SEQ ID NO: 7883 - DNA, 417 bp, Homo sapiens
  AC021528.3_90278
  Located on chromosome 4
  Distance between a terminus base of telomere on chromosomal short arm and 5'-terminus of this base sequence : 175542068
  Distance between 3'-terminus of neighbour sequence of sequence listing upward to telomere on chrosomal short arm and 5'-terminus of this base sequence : 40373
ggtactaataccaaggcaggaggatttttaaaaatacacaaaaactagccaggcatggtggcgcatgcctgtgatcctagctacttgggaggctgcggccagaggatcacttgagctcaggaagttgagactgcagtgagccgcatcatgccactgcactccagcctgagtgacaaagtgagactttgtctcagaaaaaaagaaggaaagaaggaaggaagggagggagggagggagggagggagggaaggaaggaagggaaggaaggaatgaagggaaatgaaagacagaaatgaaagagagaaaggaaagaaagaaaagaaaaggaaagaaaggaggaaagaaagaaaagaaaaggaaagaaagaaggaagggaggctaataagcttgaatgtaatggtagaattaaggtggtca

SEQ ID NO: 7884 - DNA, 394 bp, Homo sapiens
  AC009887.5_114826
  Located on chromosome 4
  Distance between a terminus base of telomere on chromosomal short arm and 5'-terminus of this base sequence : 175558003
  Distance between 3'-terminus of neighbour sequence of sequence listing upward to telomere on chrosomal short arm and 5'-terminus of this base sequence : 15518
tacttaagaactgcgcctgtaatcccagcacttcgggaggctgaggcaggcagatcacctgaggtcaggagttcgataccagcctggctagcatgatgaaatcccgtttctactaaaaatacaaaaaaaaaaaaagccagacgtggtggtgtgcacctgtaatcccagctactggggaggctgaggcaggagaattgctttaacctgagaggtgttggttgtagtgagccgagatcgcgccattgcactccagcctgggtgacacgagtgaaactctgtctcaaaacaaacaaacaaacaaacaaacaaacaaacaaacaaacggagtgcatttgactcatgagatgttttaatggagcatagctgtttgattatctgcattaaaccagacttc

SEQ ID NO: 7885 - DNA, 270 bp, Homo sapiens
  HUMUT880B
  Located on chromosome 4
  Distance between a terminus base of telomere on chromosomal short arm and 5'-terminus of this base sequence : 175597638
  Distance between 3'-terminus of neighbour sequence of sequence listing upward to telomere on chrosomal short arm and 5'-terminus of this base sequence : 39241
ggcgacagagaaagactctgtctgaagaagaaagaaagaaagaaagaaagaaagaaagaaagaaagaaagaaagaaagaaaggaaggaaggaaggaaggaaggaaggaaggaaaagaaagaaagaaagaaacagggaggaaggaaggaaggaaggaaggagaaagaaaagaaaaggaaagaaaagagctgtgaagccattaaaagacggggggcggggaaccttaaatgtacatttctaagtgaagtaagccaatctgaaaagggtacct

SEQ ID NO: 7886 - DNA, 152 bp, Homo sapiens
  G08399
  Located on chromosome 4
  Distance between a terminus base of telomere on chromosomal short arm and 5'-terminus of this base sequence : 175799193
  Distance between 3'-terminus of neighbour sequence of sequence listing upward to telomere on chrosomal short arm and 5'-terminus of this base sequence : 201285
cagtttcaaaacaaagtttacccttatatcagctaacccagaaaaaagagaagcctgtctgtctgtctatctatctatctatctatctatctatctatctatctatctatcaatcatctatctacctacctaccttcctgctacctacctat

SEQ ID NO: 7887 - DNA, 227 bp, Homo sapiens
  D4S1539
  Located on chromosome 4
  Distance between a terminus base of telomere on chromosomal short arm and 5'-terminus of this base sequence : 175815195
  Distance between 3'-terminus of neighbour sequence of sequence listing upward to telomere on chrosomal short arm and 5'-terminus of this base sequence : 15850
gaatatgttgcatgtgacattaactggagggcctgaaaaagagatgaaaacataagggctgtttagagacttatctaaaacattttcaaataattccttgcattccattattattattccattttacacacacacacacacacacacacacacacacagatgcttaaaattgaagcaataattccacacaacaatatgtactgagaatcacaaggttcacaaggaac

SEQ ID NO: 7888 - DNA, 275 bp, Homo sapiens
  D4S1555
  Located on chromosome 4
  Distance between a terminus base of telomere on chromosomal short arm and 5'-terminus of this base sequence : 175910822
  Distance between 3'-terminus of neighbour sequence of sequence listing upward to telomere on chrosomal short arm and 5'-terminus of this base sequence : 95400
tcggtgttgctctaggcatgtgtgtgtgtgtgtgtgtgtgtgtgtgtatgtgtgtgagcatatttgagttgttattagattctctccaatttatggtatattttatattcttgtaaaactgcctacaggaataggttctactatatctaagaaataagaatgacttttttaaacttagaaagaatgatacataaactgatatttcttattcaaaaatatctaataaattatataaatagcagatatttaagcacttattatctttcctttcagct

SEQ ID NO: 7889 - DNA, 450 bp, Homo sapiens
  chr4.fa.O7frz.183602899
  Located on chromosome 4
  Distance between a terminus base of telomere on chromosomal short arm and 5'-terminus of this base sequence : 175927485
  Distance between 3'-terminus of neighbour sequence of sequence listing upward to telomere on chrosomal short arm and 5'-terminus of this base sequence : 16388
ttcttgaaagctaacatgctacataaaagaaaacgtcctttggaaattgcaatgctgatgtaaaacatagcaaaacaaaacaacacaaaaacaaaatttagagtttccaagtaaagtctatcaatcagaccacatcatgtgaaatatctgaggtgttctggaaactcagtaatattaaatactgattatatggagtatacttcatagcctctaattcatcatcctgctcattcattgtatatagacatttcttacttcatctgaattggtgtcctttcttctccaaaatgtacttagatggaaatacagatataagcaaatgtgtgtatgtgtgtggtgtgtgtgtgtgtgtgtgtgtgtgtgtgtgtatgttgctgtgtctcaggaaagaattcatgtgactgagattttttatatatatcatgttggtaaggaatagaattgagctgg

SEQ ID NO: 7890 - DNA, 243 bp, Homo sapiens
  DISO7_10001688
  Located on chromosome 4
  Distance between a terminus base of telomere on chromosomal short arm and 5'-terminus of this base sequence : 176022409
  Distance between 3'-terminus of neighbour sequence of sequence listing upward to telomere on chrosomal short arm and 5'-terminus of this base sequence : 94474
ccaatgtaaagcacataaggtgatcaaataaaaatcaaagttgccacatttagttttgtttcagtttaagtcaagggaaagtgtatatagtaaatattttatttttaatttcattaatctctaaagtaattgaatagccttttctttcatgatctctctgtcttctctctctctgtctctgtgcgtgtgtgtgtgtgtgtgtgtgtgtctattttaagagattttctgcaataagaaggcgct

SEQ ID NO: 7891 - DNA, 130 bp, Homo sapiens
  DISD22_0004352
  Located on chromosome 4
  Distance between a terminus base of telomere on chromosomal short arm and 5'-terminus of this base sequence : 176308658
  Distance between 3'-terminus of neighbour sequence of sequence listing upward to telomere on chrosomal short arm and 5'-terminus of this base sequence : 286006
ttaagtggaaaccaggcagatacacacacacacacacacacacacacacacacacacacacagaggtgtgtctcatattctgttttcaagagtatgctctacttacttgttaaaggctatacatagctca

SEQ ID NO: 7892 - DNA, 378 bp, Homo sapiens
  chr4.fa.O7frz.184648907
  Located on chromosome 4
  Distance between a terminus base of telomere on chromosomal short arm and 5'-terminus of this base sequence : 176502092
  Distance between 3'-terminus of neighbour sequence of sequence listing upward to telomere on chrosomal short arm and 5'-terminus of this base sequence : 193304
cagcatttgttattgcctatcttttggataaaagccattttaactggggtgagatgatatctcattgcagttttgatttgcatttctctgatgatcaatgatgttgagcactttttcatatgcttttttttttgccatttgtatgtcttcttttgagatgggtttgttcatattttttgcccattttttgaccggattattagattttctcctatagagcttcttatatattctggctttttcctttcctttcctttcctttcttttcctttcctttcttttcctttcctttcctttcctttcctttcctttcctttcctttccttcttttcttttcttctctctttttttttttttaagacagagtcttgctcttgt

SEQ ID NO: 7893 - DNA, 206 bp, Homo sapiens
  D4S3028
  Located on chromosome 4
  Distance between a terminus base of telomere on chromosomal short arm and 5'-terminus of this base sequence : 176733998
  Distance between 3'-terminus of neighbour sequence of sequence listing upward to telomere on chrosomal short arm and 5'-terminus of this base sequence : 231528
tatccctaaactttaatgccttttaaaataaacacacacacacacacacacacataaacgtttgaatcctaaactgtgggaatagaattcctagaacaaagctttgcctctttctagaaacttaagacaacatcatttttttttccagattttaactggtttctcagcaaggaagatttggggggtggggtgtaggaggtgtagac

SEQ ID NO: 7894 - DNA, 287 bp, Homo sapiens
  AC013567.3_24513
  Located on chromosome 4
  Distance between a terminus base of telomere on chromosomal short arm and 5'-terminus of this base sequence : 176752060
  Distance between 3'-terminus of neighbour sequence of sequence listing upward to telomere on chrosomal short arm and 5'-terminus of this base sequence : 17856
ccaacatagtgaaatcctgtctgtactaaaaattaaaaaattagccaggcatggtggcacatgcctgtagtcccagctacgtgggaggctgaggcaggagaatttcttgaacccaggaggcagaggttgtagtgagctgagatggtgccactgcattccagactgggcaacagagtgagactccatctcaaaataaataaataaataaataaataaataaataaataaataaataaataaaataatgaaatcaaagagtgccaaataagtgagcagtcctctttgtt

SEQ ID NO: 7895 - DNA, 291 bp, Homo sapiens
  chr4.fa.O7frz.184857417
  Located on chromosome 4
  Distance between a terminus base of telomere on chromosomal short arm and 5'-terminus of this base sequence : 176792136
  Distance between 3'-terminus of neighbour sequence of sequence listing upward to telomere on chrosomal short arm and 5'-terminus of this base sequence : 39789
ttggactcaaactaagagttacattatcagctcccctagttctgaggctttcgggcttggaccaagccacactaccagtatccctgattctgatgcttgcatgtggcctatagtgggactgcacagtctccataatcatgtgagtcagttcccctaataaatcccctatctatctatctatctatctatctatctatctatctatctatccttcctactggttgtgtctctctagagaactctggctaatacactatatggcaaggtccctgagtctagatggttccattt

SEQ ID NO: 7896 - DNA, 183 bp, Homo sapiens
  DISD22_0004360
  Located on chromosome 4
  Distance between a terminus base of telomere on chromosomal short arm and 5'-terminus of this base sequence : 176925707
  Distance between 3'-terminus of neighbour sequence of sequence listing upward to telomere on chrosomal short arm and 5'-terminus of this base sequence : 133280
ggagttgagagttaatgagcagttttccatcctgagtttcaatttcaggtataaatgatggaaatatttcagcttatgagtttaatagtaatacttcaagccccacttacacacacacacacacacacatacacacacacacacacacacacacacacaatgccaatatccttgtttgtattg

SEQ ID NO: 7897 - DNA, 217 bp, Homo sapiens
  DISD22_0004364
  Located on chromosome 4
  Distance between a terminus base of telomere on chromosomal short arm and 5'-terminus of this base sequence : 177057614
  Distance between 3'-terminus of neighbour sequence of sequence listing upward to telomere on chrosomal short arm and 5'-terminus of this base sequence : 131724
tgctgaatctttgctaaggtataggttaaacagttattacaaactttgtcaaagacaatctttatagtccctgacatttcataacatgatttatatatatatatatatatatatatatatatacacaacatacaagtgaaaagattaacaacttgagagtgttttttctttacaacaatattttactgcaaaggtagagagccatgggaatgtgtat

SEQ ID NO: 7898 - DNA, 123 bp, Homo sapiens
  DISO7_10001690
  Located on chromosome 4
  Distance between a terminus base of telomere on chromosomal short arm and 5'-terminus of this base sequence : 177204337
  Distance between 3'-terminus of neighbour sequence of sequence listing upward to telomere on chrosomal short arm and 5'-terminus of this base sequence : 146506
gcatttatagctcttgctgcccttgggaatatatatatacacacacacacacacacacacacacacacacacatatatacatatatatatgtttcatgtttgtcagtttcatgagcaagaagg

SEQ ID NO: 7899 - DNA, 292 bp, Homo sapiens
  chr4.fa.O7frz.185159200
  Located on chromosome 4
  Distance between a terminus base of telomere on chromosomal short arm and 5'-terminus of this base sequence : 177275313
  Distance between 3'-terminus of neighbour sequence of sequence listing upward to telomere on chrosomal short arm and 5'-terminus of this base sequence : 70853
tgaaatactgttaacgccatagtctgattggagagcaaatttgagtccctctctctctctctctgtgtgtgtgtgtgtgtgtgtgtgtgtgttagagagaaaaagctcattaaaatggttaatattctttccttccagaattgatccaacacaaatgatgagcgatagatgcctactgatgtaaatatgtttctctcttcagtgtcatttataataatgaaattaaacttcagtagtttatgataagagaattgattatgtctgttgtagtaggaccaaattatgacatacc

SEQ ID NO: 7900 - DNA, 373 bp, Homo sapiens
  chr4.fa.O7frz.185277238
  Located on chromosome 4
  Distance between a terminus base of telomere on chromosomal short arm and 5'-terminus of this base sequence : 177390050
  Distance between 3'-terminus of neighbour sequence of sequence listing upward to telomere on chrosomal short arm and 5'-terminus of this base sequence : 114445
ccagtttagcatcactaacaagccaccttacgggtgtagataaaggactggcgccacaacgtctatatggactaaacttttcattttcatcactttttggtaaggacctgaaaacaaaactgagtaactgctcttgcttgggatggaattgctcactgtagtctttggaaaaagaaaaggaaaggccaagaggtagcaacaaacaaacaaacaaacaacaaaatcttgcctggtttgcagtgggtctctccctgtttcctctcttcccttggccctttagtgcccagggccctcatatcacccatggctttctcgagctgttctgcatctcaaaatgggtttccatatcattatccttctttcaaagatttcc

SEQ ID NO: 7901 - DNA, 299 bp, Homo sapiens
  D4S2427
  Located on chromosome 4
  Distance between a terminus base of telomere on chromosomal short arm and 5'-terminus of this base sequence : 177702034
  Distance between 3'-terminus of neighbour sequence of sequence listing upward to telomere on chrosomal short arm and 5'-terminus of this base sequence : 311611
ccaattttgctgtcctgctgggaacccttttcagagagaacaagatatatagatacatgattgatagatagaaagatagatagatagatagatagatagatagatagatagatagatagatagagatagatgatagagagacagatagatgctattgtaaataacattctactgtctctttattaaataccacgttcccaattatttatgtgtaaattatctgcagtgtctattaatagtctgaatttctcactcttattgcactttattgtcttggtagactgggatcaccatcagag

SEQ ID NO: 7902 - DNA, 353 bp, Homo sapiens
  chr4.fa.O7frz.185721538
  Located on chromosome 4
  Distance between a terminus base of telomere on chromosomal short arm and 5'-terminus of this base sequence : 177817763
  Distance between 3'-terminus of neighbour sequence of sequence listing upward to telomere on chrosomal short arm and 5'-terminus of this base sequence : 115430
gtaaatgtagaaatccaaaccatgcccaatcatatataatatgacgcatctcccaaaatacacacacataaacacacgcacacattcacctccaagcccatgcacaattatatataatatggtgcctctcccaaaatacatacacataaacacacacacacacacacacacacacacacacacacacattcacctccaagccccatttctcaaagttaatccctgttaacaattggtataattttctatattctctctatagattttaaagatttttttcactctatgatacatcttagccatctttgaatatgtagatatagttcattttctcatggctatgtagcatttaa

SEQ ID NO: 7903 - DNA, 460 bp, Homo sapiens
  chr4.fa.O7frz.185986689
  Located on chromosome 4
  Distance between a terminus base of telomere on chromosomal short arm and 5'-terminus of this base sequence : 178065018
  Distance between 3'-terminus of neighbour sequence of sequence listing upward to telomere on chrosomal short arm and 5'-terminus of this base sequence : 246902
gcataggatgtatattactcagctttctccagagaaacagaatcaaaaggatgtgtgaagacaatagatagatagatagatagatagatagatagatagatagatagatagatgataggaattcattataaggaattggcttatgtgattgtggggttgaccagtcccaagctctgcagggtgagttagcaagctgtggacctggagagctgatagcgtagttccattctgaagaccagcatgctcaacacccaggaagggtcaatgttacagttcaagattgaaggcaggaaaagtctgatgttccagttcaagagaagtcaggcagaaagaattcttactcagaggagagtaagcttttttgttgtgttcaggctttcaactgattgattgaggccccccgctccattaggtagggcaatccgctttattcagtctaccaatttaagtgctaatctca

SEQ ID NO: 7904 - DNA, 305 bp, Homo sapiens
  chr4.fa.O7frz.186282036
  Located on chromosome 4
  Distance between a terminus base of telomere on chromosomal short arm and 5'-terminus of this base sequence : 178363024
  Distance between 3'-terminus of neighbour sequence of sequence listing upward to telomere on chrosomal short arm and 5'-terminus of this base sequence : 297546
accagatgtcctctgagactaccagataggaaagagacttgaagggaaggtagggttgtgtgttaagcagatataaacagggcatacgccagtggaattttaattacgactgctaataatagtaattattatgtagaatttttaaaatttattttattttatttttccataatttattgggagatatatatatatatatatatatgccccagtttctttattcactcattgattaatgggcatttgggctggttccatggttttgcaattgtgaattgtgctgctataaacatgcgtatgcaagt

SEQ ID NO: 7905 - DNA, 454 bp, Homo sapiens
  chr4.fa.O7frz.186365020
  Located on chromosome 4
  Distance between a terminus base of telomere on chromosomal short arm and 5'-terminus of this base sequence : 178429879
  Distance between 3'-terminus of neighbour sequence of sequence listing upward to telomere on chrosomal short arm and 5'-terminus of this base sequence : 66550
agtggtcatctgacatacaaaggaaaatgatagaggtttgtacaagttttttatcaaagcaaggaaggaaaattatcctgacttgtgaagtttaaggatggatgaagtgtttaagctcataagcaatcataaagtccatttccttgaccttgtgattattttgggtctttctataaaaaatttcattttctagctcatgttacaccatgtgcagttttgattactgcaatatggtgttactgctttaccaaaggtaaatattcatgcctcatttttccaaccatatttaagctggtctgtgaagctttgttttttgttttgttttgttttgttttgttttattattatactttaagttacagggtacatgtgcacaacatgcaggtttgttacatatgtatacatgtgccatgttggtgtgctgcacccattaactcgtcatttacattaggta

SEQ ID NO: 7906 - DNA, 196 bp, Homo sapiens
  D4S415
  Located on chromosome 4
  Distance between a terminus base of telomere on chromosomal short arm and 5'-terminus of this base sequence : 178708270
  Distance between 3'-terminus of neighbour sequence of sequence listing upward to telomere on chrosomal short arm and 5'-terminus of this base sequence : 277937
gggctaaggcaactccacacacacacacacacacacacacacacacacacacacacacacacacgtatgtatacatatacataaatgcttatattcatgtaccaacgtttgatttcaagtatccattaaacagataaaatgaccatatagtaaacatttttcaaaaacaaaaatacgttttgcagttaatctaacc

SEQ ID NO: 7907 - DNA, 427 bp, Homo sapiens
  chr4.fa.O7frz.186915574
  Located on chromosome 4
  Distance between a terminus base of telomere on chromosomal short arm and 5'-terminus of this base sequence : 178738635
  Distance between 3'-terminus of neighbour sequence of sequence listing upward to telomere on chrosomal short arm and 5'-terminus of this base sequence : 30169
gaataggtctcatctgtacctttaattagatgaattcacctgtgagtagtcccaattccactctcccaagctttcacatttaaaaatgtgcaaatatttaacctgggatgggttgactactattttagatatttttcgggttttattctgatacggcccctggattcaaccactgtgagaatgtctgtgacataatttacttaccatttcttttccactgatgctttctagtcataattttagcagtgtgtgtgtgtgtgtgtgtgtgtgtgtgtgtgtgtgtgtgagacttgctatactgaatgttttatttttggatttacatttcttccgattccagtttatcttgccatcccacactatcttctaaggcttgattgatttcatattattactgttatctcagtctggtacatccattatcaga

SEQ ID NO: 7908 - DNA, 193 bp, Homo sapiens
  D4S1552
  Located on chromosome 4
  Distance between a terminus base of telomere on chromosomal short arm and 5'-terminus of this base sequence : 178873330
  Distance between 3'-terminus of neighbour sequence of sequence listing upward to telomere on chrosomal short arm and 5'-terminus of this base sequence : 134268
aattccgaaacagcaaagttattaaatattcagttagaaactattttggtaatatgcatatctatatctatatctatatctatatctatatctatatctatatctgtgtgtgtgtctctctctctctctgtgtgtgtgtgtgtgtgtgtgtgtgtgtgtgtgttaaaagttagacttatttccaggatttttt

SEQ ID NO: 7909 - DNA, 138 bp, Homo sapiens
  chr4.fa.O7frz.187104430
  Located on chromosome 4
  Distance between a terminus base of telomere on chromosomal short arm and 5'-terminus of this base sequence : 178961766
  Distance between 3'-terminus of neighbour sequence of sequence listing upward to telomere on chrosomal short arm and 5'-terminus of this base sequence : 88243
cctaagtcactgtattcgtcagggttacctggagagacagaactaataggatgtgtgtgtgtgtgtgtgtgtgtgtgtgtgtgtatgatttatatatataaaggggagtttattaagtattaacttacaggatcgcaa

SEQ ID NO: 7910 - DNA, 226 bp, Homo sapiens
  D4S2374
  Located on chromosome 4
  Distance between a terminus base of telomere on chromosomal short arm and 5'-terminus of this base sequence : 179099682
  Distance between 3'-terminus of neighbour sequence of sequence listing upward to telomere on chrosomal short arm and 5'-terminus of this base sequence : 137778
atttgaaattaaaaacagattagcaataaaaaagtactacttaggtataaccctatctatctatctatcatctatctatctatcatctatcatctatctatctatctatctatctatctatctatctatctatctatagatagatatgacctatatgagaaaaactataaaactctgatgaaagaaatcaaaggactaaataaatggagaccaatattggacaggt

SEQ ID NO: 7911 - DNA, 476 bp, Homo sapiens
  chr4.fa.O7frz.187351918
  Located on chromosome 4
  Distance between a terminus base of telomere on chromosomal short arm and 5'-terminus of this base sequence : 179167093
  Distance between 3'-terminus of neighbour sequence of sequence listing upward to telomere on chrosomal short arm and 5'-terminus of this base sequence : 67185
atacatctaatgaaggatgcttatccaaaatgtaaaagtaccacttggccgggtgtggtggtttacctgtaatcccagcacttagggaggccgaggtaggttgattgcttgagctcaggagttcaagaccagcctgggcaacatggcaaaaccctgtctctacaaaaaatatataaaaattagcctggtgtggtggcacatgcctatagtcccagctgcttcctggggctgaggtgggaggatcacttaagcccagatagttgaggctgcagtaagccaagattgtgccagtgcactacatccagggtgacgaagttagactctatctcaaaaataaaataaaataaaataaaataaaataaaataaaataaaataaaatgtcttaaaattcaacaataaataatctaatttaaaaatgggttaaaaaccttatcaaatacctcatcaaaatacatagtaatggcaaataagcatg

SEQ ID NO: 7912 - DNA, 109 bp, Homo sapiens
  DISD22_0004372
  Located on chromosome 4
  Distance between a terminus base of telomere on chromosomal short arm and 5'-terminus of this base sequence : 179369519
  Distance between 3'-terminus of neighbour sequence of sequence listing upward to telomere on chrosomal short arm and 5'-terminus of this base sequence : 201950
gatgtgagcacatctctttctctttctgtctgcacacacacacacacacacacacacacacacacacacacacacacacacaatcaagattatagacctactgagcaga

SEQ ID NO: 7913 - DNA, 400 bp, Homo sapiens
  chr4.fa.O7frz.187685909
  Located on chromosome 4
  Distance between a terminus base of telomere on chromosomal short arm and 5'-terminus of this base sequence : 179515750
  Distance between 3'-terminus of neighbour sequence of sequence listing upward to telomere on chrosomal short arm and 5'-terminus of this base sequence : 146122
gcctgatacttaacatcagaatagatattttacaaggaaaaaattatcaccattgttcatattaaccatgaactagaaatagctcaataactcaatgcccattctattccattccattcactcttctattctattctattctattctattctattctattctattctattctattctattctattctattctattctaattttttctaattgattctgttcttcatttgtatatagttgatattacacagcaatggaaattttctattgttccctacaagaatatgaatagtgtagcaccacataatacaggcaaaaacaaaacaaaacaaaacaaaattcaatgatttcatttatacattggaagttaacaccaaatctacattctattgcataacgtt

SEQ ID NO: 7914 - DNA, 181 bp, Homo sapiens
  DISO7_10001691
  Located on chromosome 4
  Distance between a terminus base of telomere on chromosomal short arm and 5'-terminus of this base sequence : 179592565
  Distance between 3'-terminus of neighbour sequence of sequence listing upward to telomere on chrosomal short arm and 5'-terminus of this base sequence : 76415
aatgtatttcacatggatcagcttatacacacacatacatacacatgtataagcttataaatatgtatatgcacgtgtgtgtgtgtatatatatatatatatatatatatacacacaataagatatttgagtttatttttaatcatagagttgagaaaaccctctacagaaagccaagaag

SEQ ID NO: 7915 - DNA, 390 bp, Homo sapiens
  chr4.fa.O7frz.187975023
  Located on chromosome 4
  Distance between a terminus base of telomere on chromosomal short arm and 5'-terminus of this base sequence : 179768364
  Distance between 3'-terminus of neighbour sequence of sequence listing upward to telomere on chrosomal short arm and 5'-terminus of this base sequence : 175618
cttcaatgaagtcatacgttaatcatacaaagttcttcagaactgaatgggaaaacataaggaccgatttgtctgtatgatgttctcatattcgatattcttgattttttgaaatattaggactttagattctatgaagccattagatttccacaattgcctaattattgagtgttctcttcactgtagggtgtgtgtgtgtgtgtgtgtgtgtgtgtgtgttgtgtctgtgtataagtgcatgtgttaagtcaactactaagttaaagctatttccactaccagcattccattccacttggtttaaatttatttcataccaaaaaagaagaaatgctatgaaaattcagagtgataaaatgactagtctaccacatagtgcagttatgt

SEQ ID NO: 7916 - DNA, 191 bp, Homo sapiens
  D4S1649
  Located on chromosome 4
  Distance between a terminus base of telomere on chromosomal short arm and 5'-terminus of this base sequence : 179951595
  Distance between 3'-terminus of neighbour sequence of sequence listing upward to telomere on chrosomal short arm and 5'-terminus of this base sequence : 182841
aaaggttttgttagaattttctgcatagaaaattagctaaatgacagtagagatgtagagattaagatctctctatgtctacctcaagatacatcagatagagaaacagacagtcagatacatagatagatagatagatagatagatagatagatagatagaaacttaaacatatatgatagatggcagtg

SEQ ID NO: 7917 - DNA, 204 bp, Homo sapiens
  chr4.fa.O7frz.188281914
  Located on chromosome 4
  Distance between a terminus base of telomere on chromosomal short arm and 5'-terminus of this base sequence : 180075467
  Distance between 3'-terminus of neighbour sequence of sequence listing upward to telomere on chrosomal short arm and 5'-terminus of this base sequence : 123681
gatgcaaagtgtagacagaaacataaagggttcctggatctgagaattgaggttctgaaattatgctgcttatatatatatatatatatatatagtgcttatgtaagagagaaataaattatattatttcaacttaaatttgttgtgcattttatatcactagtagctgaacatactaataatacagttctcaatgctaattcc

SEQ ID NO: 7918 - DNA, 287 bp, Homo sapiens
  chr4.fa.O7frz.188393606
  Located on chromosome 4
  Distance between a terminus base of telomere on chromosomal short arm and 5'-terminus of this base sequence : 180180026
  Distance between 3'-terminus of neighbour sequence of sequence listing upward to telomere on chrosomal short arm and 5'-terminus of this base sequence : 104355
gatgcaagatgcttacaagtcttggccatcattgtagttcttcatatttctcatgcaaactcacatgataaactataaggtgtgtgtgtgtgtttgtgtgtgtgtgtgtgtgtgtttctgttttgcttcttagacatgctcttggaaaacagaaaatgtggttcttcatgactgattgataacagtcatctcttgcgtgtagtgtggcagtgacattcttatgacagggaatgaagctatacaggcaggtggaaaaaataggactttcaaatgataatcaaagctat

SEQ ID NO: 7919 - DNA, 134 bp, Homo sapiens
  Z67592
  Located on chromosome 4
  Distance between a terminus base of telomere on chromosomal short arm and 5'-terminus of this base sequence : 180253297
  Distance between 3'-terminus of neighbour sequence of sequence listing upward to telomere on chrosomal short arm and 5'-terminus of this base sequence : 72984
ggctcattacctcagactcaggtacatggtaaatgattatagcttcggatgatgtgtgtgtgtgtgtgtgtgtgtgtgtgtgtgtgtgcacgcacttaattcttgccaagatatggaatcaagaatggttcaca

SEQ ID NO: 7920 - DNA, 264 bp, Homo sapiens
  D4S2967
  Located on chromosome 4
  Distance between a terminus base of telomere on chromosomal short arm and 5'-terminus of this base sequence : 180285552
  Distance between 3'-terminus of neighbour sequence of sequence listing upward to telomere on chrosomal short arm and 5'-terminus of this base sequence : 32121
gctaatttgattaccagagataaaatatttcacttaacacaatgaatatatatatatgtgtgtctgtacgtatacacacacacatatatatgtgtgtacatatatacactgtgtataatttatatatatacacacacataacctacacacacacacacacacacacatacacacacacacacacacatatatatatatatatataacttcactcttttccctgataacactttctctatcttcctgaaacatttagaatcaaac

SEQ ID NO: 7921 - DNA, 218 bp, Homo sapiens
  chr4.fa.O7frz.188588370
  Located on chromosome 4
  Distance between a terminus base of telomere on chromosomal short arm and 5'-terminus of this base sequence : 180377639
  Distance between 3'-terminus of neighbour sequence of sequence listing upward to telomere on chrosomal short arm and 5'-terminus of this base sequence : 91823
gactttatcatgttacgaaatgtccatttactaccacccatacggtgaatataatatgtagtgaaagagaatacacacacacacacacacacaaacacacacacacacacacacgtgtatggagagaaagagtagaaattatttttgctcatctaactttgagcattttttccagaatttattgtattcaggaataagataggagtaaaattgaatgg

SEQ ID NO: 7922 - DNA, 106 bp, Homo sapiens
  DISO7_10925117
  Located on chromosome 4
  Distance between a terminus base of telomere on chromosomal short arm and 5'-terminus of this base sequence : 180452750
  Distance between 3'-terminus of neighbour sequence of sequence listing upward to telomere on chrosomal short arm and 5'-terminus of this base sequence : 74893
ttcacagtctatttgagaagacagatatctatgtgtgtgtatacacacacacacacacacacacacacagaaacatatacacccctaaacaataagcatatgcaca

SEQ ID NO: 7923 - DNA, 451 bp, Homo sapiens
  chr4.fa.O7frz.189207242
  Located on chromosome 4
  Distance between a terminus base of telomere on chromosomal short arm and 5'-terminus of this base sequence : 180778802
  Distance between 3'-terminus of neighbour sequence of sequence listing upward to telomere on chrosomal short arm and 5'-terminus of this base sequence : 325946
gatgcttctgtcaggacagatgtgaagtgaaaaaacatgtaaggaaagccaagaagccccagttggttgatagagagagagagatatgcagatagatagatgatagacagatagataagagatagagatagctagatattagatagattagatagatacatagatagagatgattagagagaaagagagattcctcaggctgtttttttttttttttatgagatggagtcttgctctgttgcccaggctggagtgcagtggcatgatcttggctcactgcaacctctaccccacgggttcaagcgattctcatgcctcagcctcccaagtagctggtactacaggtgcccgccaccatgcctggctgttttgtgtgtgtgtgtgtgtgtgtgtttttagtcgagaaggagtctcaccatgttggccaggctggtcttgagaactcttggcc

SEQ ID NO: 7924 - DNA, 199 bp, Homo sapiens
  HUMUT1653
  Located on chromosome 4
  Distance between a terminus base of telomere on chromosomal short arm and 5'-terminus of this base sequence : 180921905
  Distance between 3'-terminus of neighbour sequence of sequence listing upward to telomere on chrosomal short arm and 5'-terminus of this base sequence : 142652
ttctgatatatagtgagggcttcattctggtaataaatatttctgaaggcaggcttgcttgcttttctttctctctttctttctttctttctttctttctttctttctttctttctttctttctttcttccttccttccttccttccttcctttttctttttcttttattttttttgagatagaatttcactcttttgc

SEQ ID NO: 7925 - DNA, 323 bp, Homo sapiens
  chr4.fa.O7frz.190227052
  Located on chromosome 4
  Distance between a terminus base of telomere on chromosomal short arm and 5'-terminus of this base sequence : 181045976
  Distance between 3'-terminus of neighbour sequence of sequence listing upward to telomere on chrosomal short arm and 5'-terminus of this base sequence : 123872
tgtctgttccagaagtctgtatttgatcgttaaaagatcaaattcttttgtttcacttgtaaaattgaaataaacagtaatttgactagactgcctagcacacacacacacacacacacacacacacacataaaaagaccataatcattttttatttttattcagcaaaattcaagcacaaatattaaaactttcaacaatgcactgtctacttagattttgacctggaatgttttaaaaccttataactttaaaataatttaaaggacttagaagtgtatcaaatatttatttccctttatccattacataaatccaggtat

SEQ ID NO: 7926 - DNA, 394 bp, Homo sapiens
  chr4.fa.O7frz.189940396
  Located on chromosome 4
  Distance between a terminus base of telomere on chromosomal short arm and 5'-terminus of this base sequence : 181219546
  Distance between 3'-terminus of neighbour sequence of sequence listing upward to telomere on chrosomal short arm and 5'-terminus of this base sequence : 173247
gaatcctgtaatatgctactgaagttgagttcaagtttatggagggaaatattggatacatacatacatacatacatacatacatacatacatacatatatacatacacacatgggtcatcagttttcactgggaatcttggtaatgggagtggcaatgtgcctattgaagaattttggaaaatagtctaatcatcaactttaaattctcattttaaaaacttgatcaaaaatagatatctgttaagtagaggacctgtgtttaacctaagcctcgtggtaatagttgaagcttggcattcaccaagtgtttgcacttgttattacagtaattttaatgcactttctgcattatttgtattttcattccatctccttaggacattgttctaata

SEQ ID NO: 7927 - DNA, 163 bp, Homo sapiens
  DISO7_10001704
  Located on chromosome 4
  Distance between a terminus base of telomere on chromosomal short arm and 5'-terminus of this base sequence : 181289625
  Distance between 3'-terminus of neighbour sequence of sequence listing upward to telomere on chrosomal short arm and 5'-terminus of this base sequence : 69685
cattctcaaagagaatcaagactctatttgattaagaaatactgaggaaatacagaatatcaaatggggtatatatatatatatatatatatatatatatatatatgcactcattttcagatttttaactctactagtcctaatcaggatatctgatagatcc

SEQ ID NO: 7928 - DNA, 360 bp, Homo sapiens
  chr4.fa.O7frz.190102370
  Located on chromosome 4
  Distance between a terminus base of telomere on chromosomal short arm and 5'-terminus of this base sequence : 181432571
  Distance between 3'-terminus of neighbour sequence of sequence listing upward to telomere on chrosomal short arm and 5'-terminus of this base sequence : 142783
aatctatcaatccatttatccttccactttattagaaaaagcctggtctagctactcaggaggatgaggcaggagaatcgcttgaaccaatggaggttgcagtgagccgagatcacaccactgcactccagcctgggcaacagagcaagactccttctcaaaaaaaagaaaaaagaaaagaaagaaaagaaaagaaaagaaaagaaaagaaagaaaagaaaagaaaagaaaaagactggtctaacaaataatagttgggacattgggaatatgataggtttttgacatatttaggaactgaaattcaggcattttagagatttatgggacatccaggtagagttctatgataggcaactg

SEQ ID NO: 7929 - DNA, 401 bp, Homo sapiens
  chr4.fa.O7frz.190624387
  Located on chromosome 4
  Distance between a terminus base of telomere on chromosomal short arm and 5'-terminus of this base sequence : 181544116
  Distance between 3'-terminus of neighbour sequence of sequence listing upward to telomere on chrosomal short arm and 5'-terminus of this base sequence : 111185
gtcgttgattatacgtttgagtagtattgataatagtaggacaacctaggagctgttttactgctcttaaatcctactttgatagaggctgtcactactataacatattcagatactttcgctccaattttcttctgtcagttcttccttcttatgaatttatacacacacacacgcacacacacacacacacacacacacacacacgagagcagctgattattccccaaagagaccgaaaatatacttaaaattgaagataggcccattttttgtcaatagcaaaaatgttattagaaacaagttctatctactattacgttagtaattaccatattaataagcccatgagaatatataaaattaaagcctaatattttacattgccaatccttataatc

SEQ ID NO: 7930 - DNA, 275 bp, Homo sapiens
  HUMUT1950
  Located on chromosome 4
  Distance between a terminus base of telomere on chromosomal short arm and 5'-terminus of this base sequence : 181644902
  Distance between 3'-terminus of neighbour sequence of sequence listing upward to telomere on chrosomal short arm and 5'-terminus of this base sequence : 100385
tgttctggctctaatggcatcgtgaaaccaggaaggatgcgttagtcttgggagaccctgggcccttctggcaatgactcctttcaccttccctcccacttcctcataccctgtaaaagagacggcactctattccaagagtgacaagctgggagttaggagtcttttttctttctttccttccttccttccttccttccttccttccttccttccttccttccttccttcctcccttcctttctttttttgagatggagtgtcactctgttgcc

SEQ ID NO: 7931 - DNA, 161 bp, Homo sapiens
  Z23300.1_69
  Located on chromosome 4
  Distance between a terminus base of telomere on chromosomal short arm and 5'-terminus of this base sequence : 181817276
  Distance between 3'-terminus of neighbour sequence of sequence listing upward to telomere on chrosomal short arm and 5'-terminus of this base sequence : 172099
gctagttatttcatggtttctgacatgtcattgcttccaggcctactcggtgaacaaagcatgaaaatggtgtgtgtgtgtgtgtgtgtgtgtgtgtgtgtgtgtgtgtgcatgtgatgggtctaaaaatgtatctccctagtgacttcacgaaaggactg

SEQ ID NO: 7932 - DNA, 125 bp, Homo sapiens
  D4S1537
  Located on chromosome 4
  Distance between a terminus base of telomere on chromosomal short arm and 5'-terminus of this base sequence : 181817315
  Distance between 3'-terminus of neighbour sequence of sequence listing upward to telomere on chrosomal short arm and 5'-terminus of this base sequence : -122
ggcctactcggtgaacaaagcatgaaaatggtgtgtgtgtgtgtgtgtgtgtgtgtgtgtgtgtgtgtgtgcatgtgatgggtctaaaaatgtatctccctagtgacttcacgaaaggactgtgt

SEQ ID NO: 7933 - DNA, 261 bp, Homo sapiens
  AC069349.2_86183
  Located on chromosome 4
  Distance between a terminus base of telomere on chromosomal short arm and 5'-terminus of this base sequence : 182084773
  Distance between 3'-terminus of neighbour sequence of sequence listing upward to telomere on chrosomal short arm and 5'-terminus of this base sequence : 267333
aagttatgtcaatctgctactcagaaatgtttagtgactcagcaaggtttaaaatttttaaatcaaggccaggcatggtggttcatgcctataatcccagcactttgggagaccaaggcaggcagatcccttgagccctgaagttcaagaccagtctggacagcgagaccctctctctaccaaaaataaataaataaataaataaataaataaataaataaataaataaataaaatccttaacactgcattcatagttctt

SEQ ID NO: 7934 - DNA, 178 bp, Homo sapiens
  D4S1607
  Located on chromosome 4
  Distance between a terminus base of telomere on chromosomal short arm and 5'-terminus of this base sequence : 182089621
  Distance between 3'-terminus of neighbour sequence of sequence listing upward to telomere on chrosomal short arm and 5'-terminus of this base sequence : 4587
aattatgtagattcattgcaccattctctttttttatttctccctcaacacacacacacacacacacacacacacacacacacacacaccccaaactgaaaatcgagtatataatttagtaatgtttgatcatccctaaggtagggagtaaaattgtgtgaatcctcagtggccttaa

SEQ ID NO: 7935 - DNA, 191 bp, Homo sapiens
  Z67591
  Located on chromosome 4
  Distance between a terminus base of telomere on chromosomal short arm and 5'-terminus of this base sequence : 182202817
  Distance between 3'-terminus of neighbour sequence of sequence listing upward to telomere on chrosomal short arm and 5'-terminus of this base sequence : 113018
ccctgagctatgggataagaaataagtcaccgttatctttgtgtgtgtgtgtgtgtgtgtgtgtgtgtgtgtgtgtgtgtgtgtgttactttgaacctattaaattggtactaaaggactaaaggtcagatgcaaaagcattggaaaaaaatcaaaaattttctttgcattttgagtattagttatttccc

SEQ ID NO: 7936 - DNA, 355 bp, Homo sapiens
  AL079351.2_121123
  Located on chromosome 4
  Distance between a terminus base of telomere on chromosomal short arm and 5'-terminus of this base sequence : 182232597
  Distance between 3'-terminus of neighbour sequence of sequence listing upward to telomere on chrosomal short arm and 5'-terminus of this base sequence : 29589
aggaaaggatagttccatgaaccatgtgtaacatgctcagggtatggattctggatggcatcaaagaaagcaaaggcaaataagcctttttcatgagacaggaaataaatgtcagcaagctttagaaacggattgtagagttttcaaaaattatttgtgaatcgtattgcccaaaatattgaactgttagctagcagatactgtatctagtcaaaaatttgggaattgtggtaaaacatatgatgtgagcagattttatgggggttatttatttgcttgttttttgtttgtttgtttgttttgttttagggatttgttttgtttttattagtggatttctcaggactcatggttt

SEQ ID NO: 7937 - DNA, 284 bp, Homo sapiens
  chr4.fa.O7frz.191064721
  Located on chromosome 4
  Distance between a terminus base of telomere on chromosomal short arm and 5'-terminus of this base sequence : 182281027
  Distance between 3'-terminus of neighbour sequence of sequence listing upward to telomere on chrosomal short arm and 5'-terminus of this base sequence : 48075
aattagatttaaaggcgagattagattgggaaataaatctacgtgtgtgtgtgtgcctctgtgtgtgtgtgtgtgtgtgtgtgtgtgtgtgtgtttcaatattggaattagatttaaaggagagatcgaattgagaagtaaatcgtgtgcatgtacctgtgtgtgtgtgtgtgagtgtggttaactttactgaaaaagaactccctttctagtctgtgaatctgttgatctattgtttgtctttcatgtatgtattctagaaagcattacatgtagaagtacgg

SEQ ID NO: 7938 - DNA, 471 bp, Homo sapiens
  AL079351.2_68911
  Located on chromosome 4
  Distance between a terminus base of telomere on chromosomal short arm and 5'-terminus of this base sequence : 182284517
  Distance between 3'-terminus of neighbour sequence of sequence listing upward to telomere on chrosomal short arm and 5'-terminus of this base sequence : 3206
taccactgaagcctattctgagcacccataaaaaaaagcaaccccactccttaagctccctaactccctgcctggtttatttttctccacagagttgtcaagttaccaccatttgacatttttaatctctctctatcatctatctctgtctcttatctatctatcatctatccctctcatctttttcatctgcttatctattatctatcatctatctctctcttatttctctttcattattttctacttatatacctattatctataaatcatccatctctcacatatctctatgtatgtatgtatgtatgatctgtctgtctatctatctatctatctatctatctatctatctatctattagctgtctgtctgtctctccctgtgaaaatgtggaatccatgaatacagtgttcttgtccattgctatatgcctgatatttagaacagtgtctggtaaacaataggtgc

SEQ ID NO: 7939 - DNA, 321 bp, Homo sapiens
  chr4.fa.O7frz.191291074
  Located on chromosome 4
  Distance between a terminus base of telomere on chromosomal short arm and 5'-terminus of this base sequence : 182508944
  Distance between 3'-terminus of neighbour sequence of sequence listing upward to telomere on chrosomal short arm and 5'-terminus of this base sequence : 223956
atgctaattagcaacatttcagatccaaagcctgcgaagctaagcacaaattataaacctatttgtgtgtgtgtgtgtgtgtgtgtgtgtgtgttataaacctaacccaactggctaaatcatattaacttttgtgaaaaatttgatcctgggttatgatttgtgacatactatgaatttgaaaatcataccaaactgcgtctggaaagaagaaatataattaataggtttggaaacccttttaacttttagtaactgtaatcagtgatacatttctagcagcacattttttttttttcctacaagctgtttacaaaggaa

SEQ ID NO: 7940 - DNA, 196 bp, Homo sapiens
  DISD22_0004385
  Located on chromosome 4
  Distance between a terminus base of telomere on chromosomal short arm and 5'-terminus of this base sequence : 182658660
  Distance between 3'-terminus of neighbour sequence of sequence listing upward to telomere on chrosomal short arm and 5'-terminus of this base sequence : 149395
aaagctacagaggttccagcattatttgtctcattttatcaagaagaaaattgtgctcttagaggttaggtaatttgctcaagagaagaaaggaaaacccaattcattcattcattcattcattcattcattcattcattcatctatttaaacacttattgaaagaatatttatcaagttctactcagcgccagtt

SEQ ID NO: 7941 - DNA, 148 bp, Homo sapiens
  G09409
  Located on chromosome 4
  Distance between a terminus base of telomere on chromosomal short arm and 5'-terminus of this base sequence : 182658706
  Distance between 3'-terminus of neighbour sequence of sequence listing upward to telomere on chrosomal short arm and 5'-terminus of this base sequence : -150
aaaattgtgctcttagaggttaggtaatttgctcaagagaagaaaggaaaacccaattcattcattcattcattcattcattcattcattcattcatctatttaaacacttattgaaagaatatttatcaagttctactcagcgccag

SEQ ID NO: 7942 - DNA, 297 bp, Homo sapiens
  chr4.fa.O7frz.191521857
  Located on chromosome 4
  Distance between a terminus base of telomere on chromosomal short arm and 5'-terminus of this base sequence : 182794102
  Distance between 3'-terminus of neighbour sequence of sequence listing upward to telomere on chrosomal short arm and 5'-terminus of this base sequence : 135248
acagaacatggtaagttcacactactctgaggtcattaacacctaattagaaacagcttagagatccaaatgattctttggttaagatgtgtgtgtgtgtgtgtgtgtgtgtgtgtgtgtcagagagagagagagctgacaatatttaacttcttcattgccagtatggtctttatcaccaacggctggggcaatacctcattgtgttttatcaaaccttaagtaggagtatttgtatgtgtgtgttttccttttctttttttctttttatgtgataggatacgcagtctgttaaac

SEQ ID NO: 7943 - DNA, 310 bp, Homo sapiens
  chr4.fa.O7frz.191602001
  Located on chromosome 4
  Distance between a terminus base of telomere on chromosomal short arm and 5'-terminus of this base sequence : 182872789
  Distance between 3'-terminus of neighbour sequence of sequence listing upward to telomere on chrosomal short arm and 5'-terminus of this base sequence : 78390
agtcatgcattgttattagcagaaaaattattttagtttaaatatacactcagagactgaataagaatttatttttgaaataaaatcaaagataattgtacttcttctttctggctctgcaattcaaagtgacaaatatgatcttgtgtgtgtgtgtgtgtgtgtataattaagtacatgtatatgtgtgcataataagtgtgtgtataagtatatgtatacacaaactcatatacataagctgtgtgtttaagtgtgtatatacttattatacacacacacgataagatcgtacatttcatatcagcat

SEQ ID NO: 7944 - DNA, 134 bp, Homo sapiens
  D4S3005
  Located on chromosome 4
  Distance between a terminus base of telomere on chromosomal short arm and 5'-terminus of this base sequence : 182942601
  Distance between 3'-terminus of neighbour sequence of sequence listing upward to telomere on chrosomal short arm and 5'-terminus of this base sequence : 69502
aacccatgaggattatttatgctttctttgatttttttcttccattatctcccccaccacacacatacacacacacacacacacacacacacacacacacacacacacaccccgaataatcattttggtaagtc

SEQ ID NO: 7945 - DNA, 175 bp, Homo sapiens
  D4S2956
  Located on chromosome 4
  Distance between a terminus base of telomere on chromosomal short arm and 5'-terminus of this base sequence : 182967410
  Distance between 3'-terminus of neighbour sequence of sequence listing upward to telomere on chrosomal short arm and 5'-terminus of this base sequence : 24675
gccactgaaaaatgaaatccgacacacctgtagttcccaagtatttcagataagggatactcatcctgtatctttctctttttctgtcttgtcacacacacatacacacacacacacacacacacaaacacacacactttttgtttctaagtaaagcggaatagtctcacagtgt

SEQ ID NO: 7946 - DNA, 127 bp, Homo sapiens
  D4S1584
  Located on chromosome 4
  Distance between a terminus base of telomere on chromosomal short arm and 5'-terminus of this base sequence : 182979763
  Distance between 3'-terminus of neighbour sequence of sequence listing upward to telomere on chrosomal short arm and 5'-terminus of this base sequence : 12178
catgttaacgcatatttcaaaataagtgtgtgtgtgtgtgtgtgtgtgtgtatagttttgtcttttttactcttaagaatcaaactcatagaatttacacactgataagtacaagaactgagtctca

SEQ ID NO: 7947 - DNA, 338 bp, Homo sapiens
  chr4.fa.O7frz.191717799
  Located on chromosome 4
  Distance between a terminus base of telomere on chromosomal short arm and 5'-terminus of this base sequence : 183013540
  Distance between 3'-terminus of neighbour sequence of sequence listing upward to telomere on chrosomal short arm and 5'-terminus of this base sequence : 33650
aaaggaatttactaggagcaatacactaagagtccaaaaagatcccagagttaattcagcacactctgtgtcaaccctgcatgaagcatcagggaatatacatctatacagtaatatatatatattacattgtgtgtgtgtgtgtgtgtgtgtgtgtgtgtgtgtgtgtgtgtgtgtgtataaaatgtaaaagacccagctcctgccctcaggtcattcacggtatggagaaattcggaggaacaataggaagccataggtaattatatgggaggaaattactgaagtgcacaatgtgtttcgtgtctgccataccacattatgaactcagagtggag

SEQ ID NO: 7948 - DNA, 388 bp, Homo sapiens
  chr4.fa.O7frz.191840262
  Located on chromosome 4
  Distance between a terminus base of telomere on chromosomal short arm and 5'-terminus of this base sequence : 183134727
  Distance between 3'-terminus of neighbour sequence of sequence listing upward to telomere on chrosomal short arm and 5'-terminus of this base sequence : 120849
tcacattaatcatagcggttaccacctattgtgtatttaccaattgctaagtagtgtcctaagtgctttctatatgcttcaaatttaatcctcaatataactccatgaagtggatgctcttattattatgtgcgatttggataatgatgatggccaccaccaccaccaccaccaccatcatcatcatcatcatcatgatcatcagtctttgtgaatgtcaagggaccatacttcatcacttcaacacataggaaggatattttatgtatctatactttgttatatgcatgaataagcatgcatgcacatacccacacaaacacacacacatcagcccactaccatcatatgttaatccccaggctgtcctgctacatcgatggataca

SEQ ID NO: 7949 - DNA, 472 bp, Homo sapiens
  chr4.fa.O7frz.192034747
  Located on chromosome 4
  Distance between a terminus base of telomere on chromosomal short arm and 5'-terminus of this base sequence : 183276230
  Distance between 3'-terminus of neighbour sequence of sequence listing upward to telomere on chrosomal short arm and 5'-terminus of this base sequence : 141115
gccagtgagttcactttctttctctcccccgcgctccccctctccccgcccgccggcccctccagcctcctccaaggcggcggaccaggccgggccggagttttcggggttcagcccgcgagcgggaggaccggggaggcgagggaggaggaaggcgagaagggccaggtgaggaggcccgcgggacgcccggccagggagcggcatccaggaccgtaattgtgcggcgggggacgcgccgggccgagtgtgcccgagcccgggcgcgtacacgtgtccgtgtgtgtgtgtgtgtgtgtgtgtgcgggagtgtgcgagggagaggaggagaggagaggagcctaccatgcgcttcccccggtgcagatcgcgggagagcccaatcacggggcgagctggacctggctgtgatcatttataatccttgactcctccgctccgccacttgtcaagatgacaggtactttatttc

SEQ ID NO: 7950 - DNA, 148 bp, Homo sapiens
  D4S2951
  Located on chromosome 4
  Distance between a terminus base of telomere on chromosomal short arm and 5'-terminus of this base sequence : 183462699
  Distance between 3'-terminus of neighbour sequence of sequence listing upward to telomere on chrosomal short arm and 5'-terminus of this base sequence : 185997
ccccaagaatattcttagactttaaaaatctttatgtgtgtgtgtgtgtgtgtgtgtgtgtgtgtgtgtgtgtgtatttttttttttctttttttgagacggcgtctcgctgtgtctcccaggctggagtgcaatggcacgatctcga

SEQ ID NO: 7951 - DNA, 432 bp, Homo sapiens
  chr4.fa.O7frz.192395864
  Located on chromosome 4
  Distance between a terminus base of telomere on chromosomal short arm and 5'-terminus of this base sequence : 183610776
  Distance between 3'-terminus of neighbour sequence of sequence listing upward to telomere on chrosomal short arm and 5'-terminus of this base sequence : 147929
tgaataccttaggcagttgtagcacaatggtatgtattggtgtatctaagcagaaaagatacagtaaaaatataatattacaatcttatgagaccagcatcatcatatatgtggttcatcattgaaatgttatgtggcacatgcctctgtgtgtgtgtgtgtgtgtgtgtgtaagtatatgtttataacatgtataaatgcttttacttataaagtaattatattataaaataaacatgtcatgaaatagtgtacttaagaaataatccgaggtgaatagattatttaagcactattccttaggatagcacagtacatcatatgtcttattcacctgttttcttaaaaattgtattcagaagtcaacttttattttaaaacctcattaaatcatccttataagcaaaggtaattaagatggtgtcatttcat

SEQ ID NO: 7952 - DNA, 114 bp, Homo sapiens
  D4S3015
  Located on chromosome 4
  Distance between a terminus base of telomere on chromosomal short arm and 5'-terminus of this base sequence : 183628092
  Distance between 3'-terminus of neighbour sequence of sequence listing upward to telomere on chrosomal short arm and 5'-terminus of this base sequence : 16884
gagggcctcaaaaattctcctccccatcacacacacacacacacacacacacacacacagactttcttatgttttaatgcactgttgatgttggtacccagcatctttttgcct

SEQ ID NO: 7953 - DNA, 324 bp, Homo sapiens
  AC060763.2_79960
  Located on chromosome 4
  Distance between a terminus base of telomere on chromosomal short arm and 5'-terminus of this base sequence : 183806856
  Distance between 3'-terminus of neighbour sequence of sequence listing upward to telomere on chrosomal short arm and 5'-terminus of this base sequence : 178650
gaccttgtgatccacctgtccccgcctccctaagtgctgggattacaggtgtgagccaccacgtctgaccctatttcttgagacagagtcttactctgtcaccaggctggaatgcagtggtgtagtctcagctcactgcaacctccatctcctgggttcaagcaattctcctgccccagcctccctagcagctgggattacaggcccccgccatcacatctggctaattttttgtattttgtttgtttgtttgtttgtttgtttgtttttactggagacagggtttcagtgtgttggccgggctggtctcgactcctgagcttg

SEQ ID NO: 7954 - DNA, 103 bp, Homo sapiens
  DISO7_10016361
  Located on chromosome 4
  Distance between a terminus base of telomere on chromosomal short arm and 5'-terminus of this base sequence : 184039109
  Distance between 3'-terminus of neighbour sequence of sequence listing upward to telomere on chrosomal short arm and 5'-terminus of this base sequence : 231929
atctttgcatccacgatgctcgctctctctctctctctctctcgctctctctcgttgcaatgggtcaggttgaatctaaccctctctgtcctttaaggcttgg

SEQ ID NO: 7955 - DNA, 120 bp, Homo sapiens
  DISD22_0004397
  Located on chromosome 4
  Distance between a terminus base of telomere on chromosomal short arm and 5'-terminus of this base sequence : 184176891
  Distance between 3'-terminus of neighbour sequence of sequence listing upward to telomere on chrosomal short arm and 5'-terminus of this base sequence : 137679
cttgtttggtgtggcatgcatgcatgtgtgtgcctggtcctgtgtgtgtgtgtgtgtgtgtgtgtgtgtgtgtgtgtgtgcacctgttggttttaggggatgtctgcccgatgacatatc

SEQ ID NO: 7956 - DNA, 218 bp, Homo sapiens
  D4S2943
  Located on chromosome 4
  Distance between a terminus base of telomere on chromosomal short arm and 5'-terminus of this base sequence : 184294701
  Distance between 3'-terminus of neighbour sequence of sequence listing upward to telomere on chrosomal short arm and 5'-terminus of this base sequence : 117690
ccttatgaaccaggtaaccctgtgaggaatgcacattacaaactcctgaacacactaaatatataaattgcttttcagaatatctttagcaataagttctttggtgatatgttagtggcagcctcaaaaggtcctaattttatgtgtcagacacacacacacacacacacacacacacacatatttgtttgttttctaaatcgacatatctggaaaag

SEQ ID NO: 7957 - DNA, 447 bp, Homo sapiens
  chr4.fa.O7frz.192933575
  Located on chromosome 4
  Distance between a terminus base of telomere on chromosomal short arm and 5'-terminus of this base sequence : 184340416
  Distance between 3'-terminus of neighbour sequence of sequence listing upward to telomere on chrosomal short arm and 5'-terminus of this base sequence : 45497
ctccagaactgactagattgtaacgccactgaacttagccagccaagtgtctttttgcaccttgctttttttcacttaacatatactggagatctctccttaccagcacatatatgtttatctaatgcttttaaaatgcttgctaactatggataattcataatttatttaattagtcccttaccgatggctactggtggtttttctggctttgttattatcaaacatgcttcagtgaatatccttgtatatcttgagcaactttaatgtcacaggaaaataattgtactgggattgctggattaaaggggtgtgtgtgtgtgtgtgtgtgtgtgtgtgtgtgtttacatataaacattttttttaagaggtagggtctccttatgttgcccaggctggaatgcagtggctattcaaaggcacggttatagtgccttgaactcctag

SEQ ID NO: 7958 - DNA, 143 bp, Homo sapiens
  DISO7_10001705
  Located on chromosome 4
  Distance between a terminus base of telomere on chromosomal short arm and 5'-terminus of this base sequence : 184447831
  Distance between 3'-terminus of neighbour sequence of sequence listing upward to telomere on chrosomal short arm and 5'-terminus of this base sequence : 106968
tgccttcttcatttggaagaaatgtgactaggggatctttaggggccctccccattctaaacactgtgtgtgtgtgtgtgtgtgtgtgtgtgtgtgtgtgtgtgtgtgtgtgtgtgtgcatgtgtttaatctgtgacttgatt

SEQ ID NO: 7959 - DNA, 140 bp, Homo sapiens
  DISO7_10001706
  Located on chromosome 4
  Distance between a terminus base of telomere on chromosomal short arm and 5'-terminus of this base sequence : 184596783
  Distance between 3'-terminus of neighbour sequence of sequence listing upward to telomere on chrosomal short arm and 5'-terminus of this base sequence : 148809
cacatacctcaccctgtggccccccagcctctcgggatgcccctatcttttggcctggcctgacctggcctgacctggcctggttcttctctactactttgggatatttacgaagttttccattcttacaagtctagcgc

SEQ ID NO: 7960 - DNA, 118 bp, Homo sapiens
  DISD22_0004406
  Located on chromosome 4
  Distance between a terminus base of telomere on chromosomal short arm and 5'-terminus of this base sequence : 184851124
  Distance between 3'-terminus of neighbour sequence of sequence listing upward to telomere on chrosomal short arm and 5'-terminus of this base sequence : 254201
ttgctaggtttctcaatctcagtctataactacatgtacgtgtgtgtgtgtgtgtgtgtgtgtgtgtgtgtgtgtgtgtgtggggttccagctgaattttctgtcccgaggttgagtt

SEQ ID NO: 7961 - DNA, 137 bp, Homo sapiens
  D4S2348
  Located on chromosome 4
  Distance between a terminus base of telomere on chromosomal short arm and 5'-terminus of this base sequence : 184925814
  Distance between 3'-terminus of neighbour sequence of sequence listing upward to telomere on chrosomal short arm and 5'-terminus of this base sequence : 74572
atctggactgttaccacagccttgtgtgtgtgtgtgtatgtgtgtgtgtgtgtgtgtgtgtgtttttaatcacatctacatattctgaagaatgcagcccccttctcctttttttagtggaacattcctcattttgg

SEQ ID NO: 7962 - DNA, 191 bp, Homo sapiens
  D4S1535
  Located on chromosome 4
  Distance between a terminus base of telomere on chromosomal short arm and 5'-terminus of this base sequence : 185048674
  Distance between 3'-terminus of neighbour sequence of sequence listing upward to telomere on chrosomal short arm and 5'-terminus of this base sequence : 122723
acttgtgatatatacctgccgctaacacacacacacacacacacacacacacacacacacacacacacaccttgagaggctgttgccaattgttctttaggcatcacacacagccccggcacacagcaggggcttaatagatattccttacatcgaagttgaaagtcttgtctcaacattctgctctcaca

SEQ ID NO: 7963 - DNA, 229 bp, Homo sapiens
  D4S408
  Located on chromosome 4
  Distance between a terminus base of telomere on chromosomal short arm and 5'-terminus of this base sequence : 185133455
  Distance between 3'-terminus of neighbour sequence of sequence listing upward to telomere on chrosomal short arm and 5'-terminus of this base sequence : 84590
tagactgggttgttagggactctcttttcctcctttcttcctttgatcatacgtacttgaagcaactcgtgaatttgtttcccttctgaagaatacatcttccaagagaatgttcattgtgtgtgtgtgtatgtgtgtgtgtgtgtgtgtgtgtgtgagagagagagagagagagagagacaaagagagtaaaggggtcttgaaggcttgagaacattttcatcagacc

SEQ ID NO: 7964 - DNA, 126 bp, Homo sapiens
  D4S2954
  Located on chromosome 4
  Distance between a terminus base of telomere on chromosomal short arm and 5'-terminus of this base sequence : 185231754
  Distance between 3'-terminus of neighbour sequence of sequence listing upward to telomere on chrosomal short arm and 5'-terminus of this base sequence : 98070
ggaagccaattcctcataatatacctctttatatatatatatatgtgtgtgtgtgtgtgtgtgtgtgtgtgttctattggtccttgtttctctacagactcttgatagtcacagacactgaaatgg

SEQ ID NO: 7965 - DNA, 101 bp, Homo sapiens
  DISD22_0004409
  Located on chromosome 4
  Distance between a terminus base of telomere on chromosomal short arm and 5'-terminus of this base sequence : 185370419
  Distance between 3'-terminus of neighbour sequence of sequence listing upward to telomere on chrosomal short arm and 5'-terminus of this base sequence : 138539
tggttgctccagtctgacactacttctcttctcttctcttctcttctttacatctctgacatctctgagcttctttccagtgacatcactcatcttagggt

SEQ ID NO: 7966 - DNA, 411 bp, Homo sapiens
  chr4.fa.O7frz.194263870
  Located on chromosome 4
  Distance between a terminus base of telomere on chromosomal short arm and 5'-terminus of this base sequence : 185735235
  Distance between 3'-terminus of neighbour sequence of sequence listing upward to telomere on chrosomal short arm and 5'-terminus of this base sequence : 364715
gaagtgacatgttacttccaatagaacttcttctcattcccctgggtatcatcttcctttcctctggggatgctcccacagcaccctaccatctttctagtgtaggacttgtgacactgagctgtgatgacttgtttgcgtaacatgcacacataaagaattttccttatttctttatattacacagagctccccagtaccatgactagcggtagcagcaaatactctataaatacctgttacatttatttatttatttatttatttatttatttatttttgagaccgagtctcactctgtcacccaggctggagtgaagtggtgcaatctcagctcactgcaacctccacctcccggttcaagtgattctcgtgcctcagcctcccgagtagttaggattacaggcacct

SEQ ID NO: 7967 - DNA, 206 bp, Homo sapiens
  D4S1648
  Located on chromosome 4
  Distance between a terminus base of telomere on chromosomal short arm and 5'-terminus of this base sequence : 185771861
  Distance between 3'-terminus of neighbour sequence of sequence listing upward to telomere on chrosomal short arm and 5'-terminus of this base sequence : 36215
ccataatcacaggagcgaatcccttatactaaatctcttttatctatctatgtctatctatctatctatctatctatctatctatctatctatcatctatctacctatcaattatctatctatctatctatctatctatctatctatctatctatctttatctatcatctccaatcatttctggatgaaatgtttcatttagaaga

SEQ ID NO: 7968 - DNA, 147 bp, Homo sapiens
  D4S3032
  Located on chromosome 4
  Distance between a terminus base of telomere on chromosomal short arm and 5'-terminus of this base sequence : 186010879
  Distance between 3'-terminus of neighbour sequence of sequence listing upward to telomere on chrosomal short arm and 5'-terminus of this base sequence : 238812
tgaaattctattgaccaatgatgtgttattttaatttgttaatctttctgtcaaacacacacacacacacacacacacacacacaaaagaaaagaaaaagaaaaagaaaaagaaaaatggaccttgtcatggtaaatccaggtgcta

SEQ ID NO: 7969 - DNA, 121 bp, Homo sapiens
  D4S2349
  Located on chromosome 4
  Distance between a terminus base of telomere on chromosomal short arm and 5'-terminus of this base sequence : 186038135
  Distance between 3'-terminus of neighbour sequence of sequence listing upward to telomere on chrosomal short arm and 5'-terminus of this base sequence : 27109
ggccaaattcagtcaagtatcatcatttccatatagtttaacgtgtgtgtgtttgtgtgtgtgtgtgtgtgtgtgtgtgtaattaagacatacatccaaaagttgtttctgggaactgatt

SEQ ID NO: 7970 - DNA, 284 bp, Homo sapiens
  chr4.fa.O7frz.194708129
  Located on chromosome 4
  Distance between a terminus base of telomere on chromosomal short arm and 5'-terminus of this base sequence : 186157746
  Distance between 3'-terminus of neighbour sequence of sequence listing upward to telomere on chrosomal short arm and 5'-terminus of this base sequence : 119490
aatgcaattatgtgctcactatattcatattataattaattctattttacatcaaatcagggagtaaaagattatgtaatctgtatcctaaaccagccacaacactctgcagcctttaggcaggagaattgctgaaacccaggagacagaggctgcagtgagctgagatcgcaccactgcactccagcctgggtgacagagagagactccatctgataaataaataaataaataaataaataaataaataaataagggaattctaacattacttggaacatgga

SEQ ID NO: 7971 - DNA, 193 bp, Homo sapiens
  D4S1540
  Located on chromosome 4
  Distance between a terminus base of telomere on chromosomal short arm and 5'-terminus of this base sequence : 186298577
  Distance between 3'-terminus of neighbour sequence of sequence listing upward to telomere on chrosomal short arm and 5'-terminus of this base sequence : 140547
tgaacccgtgaagtggaggttgcagtcagccgagatcacgccattgcactccagcctgggcaatagagtgaaaaagtctctcacacacacacacacacacacacacacacacacacacacacaacaaaaacaaaaaaccttaagattgatgttgaaaaaggttttgacaatctagcaattaacatatcccacc

SEQ ID NO: 7972 - DNA, 236 bp, Homo sapiens
  D4S2924
  Located on chromosome 4
  Distance between a terminus base of telomere on chromosomal short arm and 5'-terminus of this base sequence : 186514500
  Distance between 3'-terminus of neighbour sequence of sequence listing upward to telomere on chrosomal short arm and 5'-terminus of this base sequence : 215730
tattgcagtgcttgggttcaagcaacccttatttcacttaataatggccccaaagtgcaagagcgctgtgcccaagttataaattaaactttatcataggtatgcatgcatagaaacacacacacacacacacacacacacacacacacacacacacacacgtatatatatatagggtttggtactaatgtaggttttaggcaaccattgggggtcttggaatgtgtcccctgtgg

SEQ ID NO: 7973 - DNA, 461 bp, Homo sapiens
  AC023524.4_179082
  Located on chromosome 4
  Distance between a terminus base of telomere on chromosomal short arm and 5'-terminus of this base sequence : 186533526
  Distance between 3'-terminus of neighbour sequence of sequence listing upward to telomere on chrosomal short arm and 5'-terminus of this base sequence : 18790
aaatttacaatcatggcagaaggtgaagggggagccagtacttcacatgactggaagcaggaggaggagtgtgggggaggtgccacacacttttaaacaaggagatcttgtgagaactcactcactatcacaacaacagcaccaaagggaaaaatccatccccatgttccaatcatagcccaccaggtcccacctccaacactggggattaaaattggacatgagatttgggtagggacacagatccaaacttttatctatctatctatctatctatctatctatctatctatctatctatctatcatcaatctatcttctatcatttatcaacaatagatatattcacagatatatacttgtggattggctttggagccaccctgagtaaccctgagtaacacagatttcatctagattcattggtataagctggcactgttggtgtaaacagttgtagg

SEQ ID NO: 7974 - DNA, 455 bp, Homo sapiens
  chr4.fa.O7frz.195977018
  Located on chromosome 4
  Distance between a terminus base of telomere on chromosomal short arm and 5'-terminus of this base sequence : 186926935
  Distance between 3'-terminus of neighbour sequence of sequence listing upward to telomere on chrosomal short arm and 5'-terminus of this base sequence : 392948
gttctgactggacagtgaaacccactgctcccgccatccctttctctgtcacacacacacacctagtgaccttcaaaagtgtctcgggagaatttggcaggatgctcgtgtcctgtgccagtgacagcactgtcatcactgttagtgtgaccctatctgtttttcaggcttgtaaggtgaccaggaggaacatacgtacacacacacacacacacacacaagcgcagccaccgtcccatgggaaagtgaggacaggttcacactctggggacatgggaagcaaaatatcacagtggaagctgcccccaagccgaagacgtgggacaccaagttcacccgtctcttctgcaaccacgagaagtctaatgatgggaaaatggaaccagcccacacaccgacactggagtcacctcttgcacttgtgtaaacacacacaaccaagctacaagttacat

SEQ ID NO: 7975 - DNA, 234 bp, Homo sapiens
  chr4.fa.O7frz.196342245
  Located on chromosome 4
  Distance between a terminus base of telomere on chromosomal short arm and 5'-terminus of this base sequence : 187289465
  Distance between 3'-terminus of neighbour sequence of sequence listing upward to telomere on chrosomal short arm and 5'-terminus of this base sequence : 362075
tctgtctagcattgaaactcagcattgatattttaggcctaaataacccttaggggctattgaacaatttgtgtggttaagagtaaggcttcggagaggaagagcatatgtgtgcgtgtgtgtgtgtgtgtgtgtgtgtgtgtgtgtgtgtgtatgtagtatttgggagctggaatcagaaacaagcaaaaataagttttctctgcatttgtgctgtaaactggtaatatgaac

SEQ ID NO: 7976 - DNA, 316 bp, Homo sapiens
  AC046186.2_7421
  Located on chromosome 4
  Distance between a terminus base of telomere on chromosomal short arm and 5'-terminus of this base sequence : 187342592
  Distance between 3'-terminus of neighbour sequence of sequence listing upward to telomere on chrosomal short arm and 5'-terminus of this base sequence : 52893
ctggtgcaaatcacttgaacccgggaggcggaggttgcagtgagctgagatcgcgtcactgcagtctagcctggtgacagagcgagactccatatcaaaaaagaaagaaaagaaagataggaagaaagaaagaaagaaagatgaaagaaagaaagaaagaaagaaagaaagaaagaaagaaagaaagaaagaaagaaagaaagaaagaaagaaagaaagaaagaaagaaaagaaagaaagaaaaagcaagcaagctttctggagggcagctgtgggataagtccctattcaacgctcctttctgagagtctggatt

SEQ ID NO: 7977 - DNA, 377 bp, Homo sapiens
  chr4.fa.O7frz.196076602
  Located on chromosome 4
  Distance between a terminus base of telomere on chromosomal short arm and 5'-terminus of this base sequence : 187480999
  Distance between 3'-terminus of neighbour sequence of sequence listing upward to telomere on chrosomal short arm and 5'-terminus of this base sequence : 138091
aacttactattcactcagctctgtcagctttttctttaattttccagtgggaatacactctgcatgtcctccagagaacactagagctatcttcctttttggatcaacatttttatactgaataatgacattcatcaagatgaaccttactaggaaacacacgtgcatgcacacacacacacacacacacacacacatactctactcccctgtacagaaaaattccctggaagacttgcccatgactactgtcttggatttctctcttcttcttttctcccaaacccactgcaagcctactttcgccttgtccattcacctagcagatcttgtcaaggccaccagtaacttccatgtggctagacctttagtctgat

SEQ ID NO: 7978 - DNA, 236 bp, Homo sapiens
  chr4.fa.O7frz.196604606
  Located on chromosome 4
  Distance between a terminus base of telomere on chromosomal short arm and 5'-terminus of this base sequence : 187572024
  Distance between 3'-terminus of neighbour sequence of sequence listing upward to telomere on chrosomal short arm and 5'-terminus of this base sequence : 90648
tttgacagtttgttagccaaggtattatgctttaatagatacttcattacatatatatatatatatatatatatatatatatatatatatatatatatatatatatgcctgtaaaaaactgagatatatccaccatatgtacatgtgtatatcttcacatatgatgtgtaaatatgtgaagatatctccatttttacaggcttagagagattaagttgcttactcaacgtcattta

SEQ ID NO: 7979 - DNA, 468 bp, Homo sapiens
  chr4.fa.O7frz.196698740
  Located on chromosome 4
  Distance between a terminus base of telomere on chromosomal short arm and 5'-terminus of this base sequence : 187718708
  Distance between 3'-terminus of neighbour sequence of sequence listing upward to telomere on chrosomal short arm and 5'-terminus of this base sequence : 146448
gccggagaatcacttaaacccggaagatggagactgtggtgagctgagatcgctccactgcactccagtctgggctggacagagcgagactccgtctcaaaaaataaataaataaataaataaataaataaataaataagataaaaataaataaaaggagaatgctggaaaattggacagggccacatcgagaccatctgtaacctgaaagctatcagtgtgtcagtttaacactcttttgacaagtatatgaagaaacagagtagcaagaatggatataacctccagcctagaaatggaaaatgctctgcacatgtgtggaagtgagaagagctgttatcgtgagtaatagagaaatgggctatacatcagctggtaagataaaagttttatccatcacaaaaaagcttttctagatgcttaaaatcacaagagtcatgctttgagtaaagatgaattagtgcaatg

SEQ ID NO: 7980 - DNA, 393 bp, Homo sapiens
  chr4.fa.O7frz.196796311
  Located on chromosome 4
  Distance between a terminus base of telomere on chromosomal short arm and 5'-terminus of this base sequence : 188006951
  Distance between 3'-terminus of neighbour sequence of sequence listing upward to telomere on chrosomal short arm and 5'-terminus of this base sequence : 287775
atgctaattgatgtgaagtcactcaattcctcactacaatgaaatactgaagaaataaaatgtcctgggaagatgtgtctgcataaatattataaaggagggggaaagaacaggttggggcattagagcaaagcctaggttctcaccttgaccgtggtgttctctcactgaatgaccttgagcaactcacctaccttgcctgggctccaggttcatgatctgttaagtatggaggtaggaattcattttcttttattattattattattattattattattattatactttaagttttagggtacatgtgcacaacgtgcaggtttgttacatatgtatacatgtgccatgctggtgtgctgcacccattaactcgtcatttagcattaggta

SEQ ID NO: 7981 - DNA, 230 bp, Homo sapiens
  D4S3051
  Located on chromosome 4
  Distance between a terminus base of telomere on chromosomal short arm and 5'-terminus of this base sequence : 188182434
  Distance between 3'-terminus of neighbour sequence of sequence listing upward to telomere on chrosomal short arm and 5'-terminus of this base sequence : 175090
tttgtttggtctatcaaaagtcataatgatgactactgaaatgattttgaaatcagtagttattctttgtaaaaggaggattttgaagatccaatgtcttttatcaaacatctcaccagtaaattaagaagatctaaatcttgccacacacacacaaacacacacacacacacacacacccttatgctttaaaatctatctttccaatgtggttcccactgcacatcttg

SEQ ID NO: 7982 - DNA, 369 bp, Homo sapiens
  AC024020.2_55188
  Located on chromosome 4
  Distance between a terminus base of telomere on chromosomal short arm and 5'-terminus of this base sequence : 188200273
  Distance between 3'-terminus of neighbour sequence of sequence listing upward to telomere on chrosomal short arm and 5'-terminus of this base sequence : 17609
gaagttattgcaagtccaaattacttcaggcatcaagcgagagactagtttctcttcctttctttctttccttctttctttctttctttctcccttccttccttccctccctccctcccttcctccttccttccttcctctcctctcctcctctctttttcttttctttctttctttcttctctttctctttcttcctttctttcttcctcccttccttccttccttcctctcctcctctctttctttccttcctttcttccttccttccttccttccttcctcttatataaatttaaggtatacaagtgcaattttgttccatggatatattacacagtggtaaagtcttggcttttaatgtaaccac

SEQ ID NO: 7983 - DNA, 329 bp, Homo sapiens
  chr4.fa.O7frz.197519586
  Located on chromosome 4
  Distance between a terminus base of telomere on chromosomal short arm and 5'-terminus of this base sequence : 188286248
  Distance between 3'-terminus of neighbour sequence of sequence listing upward to telomere on chrosomal short arm and 5'-terminus of this base sequence : 85606
ccaatgatttgctaatcaatagttatatatatatatatatatatatatatatatatatatatatatatttccattctaaatgtgcagtgctctgtaactgaacccacatcttggctcaatgcccagtggaaatttcaggaacaagggacagtgtgtctcagtccattgtttcaaataactctccttggcttctttagggggatgaaacaggcattcacattaggccagaaggttattagatctccacgagatgctgcccaggtctggctgcacaccgtgaatattattctgtcaacgcaaatgtccttagaatctgctagaattgaatg

SEQ ID NO: 7984 - DNA, 462 bp, Homo sapiens
  chr4.fa.O7frz.197407136
  Located on chromosome 4
  Distance between a terminus base of telomere on chromosomal short arm and 5'-terminus of this base sequence : 188461726
  Distance between 3'-terminus of neighbour sequence of sequence listing upward to telomere on chrosomal short arm and 5'-terminus of this base sequence : 175149
tcacttcctgagtcgctacgattaaaagtgcatgccaccacacccagctaagttttgtattttttcgtagtgatgggggtctcactaagttgcccagactgatctcaaatgcctgggctcaagcagtcctctctcagtgcagcctctgaaagtgcggggattacagatgtgagccaacacgatcccccaggatttttttttaacaatttttttcaaattagcctagaaatattggaaactaatataatgaatccacaagatacatttatttatttatttaatttatttcgtggttcagccatcctatcaattaagggaaatattgatagggtggctaaaccatgaaataaataaatgtattgtgtggattcattatatacttgccaaaatttttcggtgtaattaattatgcaaatattttgtctagtcttaacaaacattaaaacttgctcaccatacgtg

SEQ ID NO: 7985 - DNA, 335 bp, Homo sapiens
  chr4.fa.O7frz.197648979
  Located on chromosome 4
  Distance between a terminus base of telomere on chromosomal short arm and 5'-terminus of this base sequence : 188656636
  Distance between 3'-terminus of neighbour sequence of sequence listing upward to telomere on chrosomal short arm and 5'-terminus of this base sequence : 194448
aacataaagtattgtgaaatggagttaatatcttacttgtaatatttctagactttttaaaagggctaatattaaaagagaaagagagagagagagagagagagaagcttgattagccatcagggaaatgcaaatacaaaccaaaattagataccacttcacaccgagcgtgaagtgaatggctacagtagaaaagacagacaatcacaagtactggtgaggatgtggtgagatcggacccctcatgttctgctggtgtgtatataaaatgtgcaacttctttggaaaacagtctggcagttccccacacagttaaacagagttaccacatgatc

SEQ ID NO: 7986 - DNA, 264 bp, Homo sapiens
  chr4.fa.O7frz.197770783
  Located on chromosome 4
  Distance between a terminus base of telomere on chromosomal short arm and 5'-terminus of this base sequence : 188686603
  Distance between 3'-terminus of neighbour sequence of sequence listing upward to telomere on chrosomal short arm and 5'-terminus of this base sequence : 29632
aaagtaacatttcattaaggttcagcagtgattttactaaccataccctttaaccacacacacacacacacacacacacacacacacaccacacacacatgtaaaagagacttctggctctgccactttctagctgtctgacgtctgtttcagttttcccatctgtaaattggggcttaataattgtacctaatttttagagttcttatagagattagatatcttcatacagataagtcccttagaaagattcctgacacaata

SEQ ID NO: 7987 - DNA, 330 bp, Homo sapiens
  chr4.fa.O7frz.197772494
  Located on chromosome 4
  Distance between a terminus base of telomere on chromosomal short arm and 5'-terminus of this base sequence : 188688172
  Distance between 3'-terminus of neighbour sequence of sequence listing upward to telomere on chrosomal short arm and 5'-terminus of this base sequence : 1305
gcaaactattcactggaatagtctctttcctccaaattacttttcagagaacttttgttcttcctctcctccttccttcctttctttccttccttctttttctttctttatcccttccttttttcccttcttactctctttctttctttccttcctccctccctctctctttccttcctccctccctctctccttccttcctttcttcctttggaaaaaaaaaaaaagaaagaaaattcttgttttacaatactggtagaacacaggcttcgtcaggttgagggcttctacccaccatgcagtggtgttacagaccgtttctacatctta

SEQ ID NO: 7988 - DNA, 335 bp, Homo sapiens
  DISO7_00004984
  Located on chromosome 4
  Distance between a terminus base of telomere on chromosomal short arm and 5'-terminus of this base sequence : 188770902
  Distance between 3'-terminus of neighbour sequence of sequence listing upward to telomere on chrosomal short arm and 5'-terminus of this base sequence : 82400
cagctcctacctccgttcctgtccacaagtgggacacttaactttgaccagactccatggcaaagaggcattccttgacctctgtttattgacgaagaaaaccttctcaatcagctctggaagagcctttgaaaaggctccagaatatcctccctgaggagcagagaaagggttgctggaacctttccctgcacctgttgttgctgctgcattgtgtgtgtgtgtgtgtgtgtgtgtgtgtctgtgtgtgtgtgcacgcacagtattgttggggagagggcaataaaaattccttcttttttaaacccatattggccacccagtatgcaggatct

SEQ ID NO: 7989 - DNA, 172 bp, Homo sapiens
  DISO7_10001710
  Located on chromosome 4
  Distance between a terminus base of telomere on chromosomal short arm and 5'-terminus of this base sequence : 188909017
  Distance between 3'-terminus of neighbour sequence of sequence listing upward to telomere on chrosomal short arm and 5'-terminus of this base sequence : 137780
  misc_feature (1)...(172): n = A,T,G or C
acatgatatgtaatacaccacagcaattaaaaagaccgaggcagatatatatgtgtgtgtgtgtgtgtgtngtgtgtgtataaaatgcatatatataatgcatatatatatgtattgacataaaagttttcacagataagtggaaaaaaggcaggtcatttaataggatatg

SEQ ID NO: 7990 - DNA, 414 bp, Homo sapiens
  chr4.fa.O7frz.198201799
  Located on chromosome 4
  Distance between a terminus base of telomere on chromosomal short arm and 5'-terminus of this base sequence : 189051572
  Distance between 3'-terminus of neighbour sequence of sequence listing upward to telomere on chrosomal short arm and 5'-terminus of this base sequence : 142383
agtatgtcgctgatagtttgataggaatagcattgaatctgtaaattgctttgtccagcatagctattttatttatattgaatcttcctatccacgagcatggaatgtttctccatttgtttgtgtcttctctaacttctttgagcagtgtttcataattctcattgtagacatctttcccctccttggttagctgcattcccaggtcttttttattttattttattttattttattttattttattttattttttctgtgtggtggcaaattatctttctgatgtggctctcagtttggttgtcggtggtgtacaggaatgctagtgatttttataaactaattattaattatgaaaatatctttctggtttccattcaaacatccctactaccacatttaattaccaaagtg

SEQ ID NO: 7991 - DNA, 156 bp, Homo sapiens
  DISD22_0004425
  Located on chromosome 4
  Distance between a terminus base of telomere on chromosomal short arm and 5'-terminus of this base sequence : 189127009
  Distance between 3'-terminus of neighbour sequence of sequence listing upward to telomere on chrosomal short arm and 5'-terminus of this base sequence : 75023
gctctggaattgtatttctgggaaactgcaaggaagctgtgtgtgtgtgtgtgtgtgtgtgtgtctgtgtgtgtgtgtgtgtgtgtctgtgtgtgtgcaagtatttgaaagaaactaaaaatagagaaattcaatcatactagtatctccaactgc

SEQ ID NO: 7992 - DNA, 207 bp, Homo sapiens
  HUMUT5785
  Located on chromosome 4
  Distance between a terminus base of telomere on chromosomal short arm and 5'-terminus of this base sequence : 189345059
  Distance between 3'-terminus of neighbour sequence of sequence listing upward to telomere on chrosomal short arm and 5'-terminus of this base sequence : 217894
tgagcatgtgaaccaatgcccatgttaattagtgtgtgcatatgtatacacacataccgatagattagatagacagatgatagatgatagacagatgatagatgatagacagatagatgatagatagatagatagatagatagatagatagatagatagatagattctctggagaaccttgactaatacagttgggaatgaagtgag

SEQ ID NO: 7993 - DNA, 147 bp, Homo sapiens
  chr4.fa.O7frz.198711142
  Located on chromosome 4
  Distance between a terminus base of telomere on chromosomal short arm and 5'-terminus of this base sequence : 189419407
  Distance between 3'-terminus of neighbour sequence of sequence listing upward to telomere on chrosomal short arm and 5'-terminus of this base sequence : 74141
tacctatgtaacaaacctgcacattctgcacatgtatcccagaacttaaagcaaataaataaataaataaataaataaataaataaataaataaaaaatgggggaagaaaaatagaggagagagggaggttatccatctatgcatct

SEQ ID NO: 7994 - DNA, 102 bp, Homo sapiens
  D4S2390
  Located on chromosome 4
  Distance between a terminus base of telomere on chromosomal short arm and 5'-terminus of this base sequence : 189597741
  Distance between 3'-terminus of neighbour sequence of sequence listing upward to telomere on chrosomal short arm and 5'-terminus of this base sequence : 178187
ctcattttcccctttccactaattgcaaaatgatacataataataataataataataataataaacaggaggagttgccttgcatctcatgatgaaaaccac

SEQ ID NO: 7995 - DNA, 463 bp, Homo sapiens
  chr4.fa.O7frz.198521605
  Located on chromosome 4
  Distance between a terminus base of telomere on chromosomal short arm and 5'-terminus of this base sequence : 189708412
  Distance between 3'-terminus of neighbour sequence of sequence listing upward to telomere on chrosomal short arm and 5'-terminus of this base sequence : 110569
cagtgtagtgatacctaatgcttctgattattattgtcttcaagtaaatattttcaagttttactaatagttttctaaacaatcattgccccgtttttgtctatgatatgactatatcaagaacatttaatggtttaatgagataagagttgtcatgactggtggttatatggttttgctctatgtccccacctaaatctcatgtcaagttgtaatccccttgggttaggggaggggcctggagggaagtgattggatcaaggggacggatttcccctttgctgttctggtgatggtaagttctcttgagatctgatagtttgaaagtgtgtgacacctcccctttctctctctctctctctctctctctctctctctggctctaccacggtaagatgtgcttgcttccccttccgccatgattgtaactttcctgaggccttccagccatacttctatacag

SEQ ID NO: 7996 - DNA, 359 bp, Homo sapiens
  HUMUT2219
  Located on chromosome 4
  Distance between a terminus base of telomere on chromosomal short arm and 5'-terminus of this base sequence : 189967655
  Distance between 3'-terminus of neighbour sequence of sequence listing upward to telomere on chrosomal short arm and 5'-terminus of this base sequence : 258780
ctaaagcaaaatgcagacacataactgctactatttatgccactgatttacaaaaataagttgtaaaataaatttagttactaattaccagcatttttttaaaaaagaaatcgaccaggatataattgaaattatacaaatatattacaaaaaaagaaaatgtcattttattaaacttttatttcagaagacagatagtcagatgagtgggtgagtgggtggatggatggatgggagaatggatggatggatagatagatagatagatagatgcaaccacacaggtagaggccatgtaaatgcatttctgctgtagaaatgctatgtcccaaaaattagtagatggaaaaataacgggg

SEQ ID NO: 7997 - DNA, 297 bp, Homo sapiens
  HUMUT1366
  Located on chromosome 4
  Distance between a terminus base of telomere on chromosomal short arm and 5'-terminus of this base sequence : 190096447
  Distance between 3'-terminus of neighbour sequence of sequence listing upward to telomere on chrosomal short arm and 5'-terminus of this base sequence : 128433
tctactcacatgcggctggaaaaaacaacagctcacaaaggaaagaaaacctaaataatagcttatttatatagtaattagatgatagatgatagatagatagatagatagatagatagatagatagatagatagatgagagagagagagagagagaggtgaggaaaactctttaaaatatcaccatggtaaatataatatcagagattcttcatatttgtttgttttgcttttggaagtactcatatgtcaccatctagcaggactagatggtgatgcaaattccaccaaacacta

SEQ ID NO: 7998 - DNA, 470 bp, Homo sapiens
  chr4.fa.O7frz.200816445
  Located on chromosome 4
  Distance between a terminus base of telomere on chromosomal short arm and 5'-terminus of this base sequence : 190215835
  Distance between 3'-terminus of neighbour sequence of sequence listing upward to telomere on chrosomal short arm and 5'-terminus of this base sequence : 119091
ttcgttacctgacacgaacctttggaaagtgatttttggtgggaaagatatgctcagaaaaaagttggctgaacttattaaggatgtcctccctgaagattttcagtatgtggggacttcccattcctcagtgcaaggctgcaggtgctcgtgccaggctaagcctgtccagccccacgctcaaagcactctctctcctcaaccgcggcattcgtctgcaccattcttttagaaattaacatctgtaatggcccacatttgagtgtgtgtgtgtgtgtgtgtgtgtgtgtgtgtgtgtgtgtacacatcaatatatgtagaaatatgtaggttattaaatatatatttacattatgtgtgaagcagcatcattgtcagtggtaagtaccaggggttcatcctcttgtgctgagaaaattaaggacatgaacacatgtgggtgggttaaggagtagaaagtttaataggca

SEQ ID NO: 7999 - DNA, 128 bp, Homo sapiens
  HUMUT6952
  Located on chromosome 4
  Distance between a terminus base of telomere on chromosomal short arm and 5'-terminus of this base sequence : 190314361
  Distance between 3'-terminus of neighbour sequence of sequence listing upward to telomere on chrosomal short arm and 5'-terminus of this base sequence : 98056
agcctcccaaaatattgggattataagcatgagccactgcgcctggccttttctctttctttctttctttctttctttctttcatttctttctttcatttctttctctttctttcttggctttctttc

SEQ ID NO: 8000 - DNA, 175 bp, Homo sapiens
  HUMUT5197
  Located on chromosome 4
  Distance between a terminus base of telomere on chromosomal short arm and 5'-terminus of this base sequence : 190389328
  Distance between 3'-terminus of neighbour sequence of sequence listing upward to telomere on chrosomal short arm and 5'-terminus of this base sequence : 74839
tcctggctggtcttccctcagtctcactcccatctcttctctctatggaggcaactgagcatgcgttttctttttcctttctttctttctttctttctttctttctttctttctttctttctttctttttttttttgaaacagagtctcgctctgtcaccaggttgggatgcagt

SEQ ID NO: 8001 - DNA, 244 bp, Homo sapiens
  DISD22_0004435
  Located on chromosome 4
  Distance between a terminus base of telomere on chromosomal short arm and 5'-terminus of this base sequence : 190710690
  Distance between 3'-terminus of neighbour sequence of sequence listing upward to telomere on chrosomal short arm and 5'-terminus of this base sequence : 321187
agctcacaataccatacaggagtaagtaccaacacacacacacacacacacacacacacacacacacatacatacacacacacacagacacacacagagacacatgcatactcacaagacacacagagacaaacacacatacacacatacatacacacacacacacaagcgcatgcgcatgcatgaacgcctatatattttgtattcaaactgaaaacaaaacacaaacaggtaatcctgaagt

SEQ ID NO: 8002 - DNA, 448 bp, Homo sapiens
  chr4.fa.O7frz.201061392
  Located on chromosome 4
  Distance between a terminus base of telomere on chromosomal short arm and 5'-terminus of this base sequence : 190786053
  Distance between 3'-terminus of neighbour sequence of sequence listing upward to telomere on chrosomal short arm and 5'-terminus of this base sequence : 75119
gaaggtatctggtcttatggactgtataattaaactttcttatcattgtacctaaaccaaaatatgcttcctatacaaagaaggtttctttcaagagttaagactgcctcctgccatcctccttaacacacacacacacacatgcacacacacacacacacacacacacagagagagagagagagaattgagagcattagtccttttctcccttagactgattttttcttactgttattttcagccactttgttaacggtggggttaaagggcaggatagatgtaacacccatttcacatacatattgcaacatcagagatgctggttttcattaaaaacaccagatctaaattccttctaaaatatattttaaaaaatcagtacacttggcaccttggaaatgctgaaatgttatcatgaatgctcgttatttgttatgagtcaatt

SEQ ID NO: 8003 - DNA, 104 bp, Homo sapiens
  DISD22_0004438
  Located on chromosome 4
  Distance between a terminus base of telomere on chromosomal short arm and 5'-terminus of this base sequence : 191007309
  Distance between 3'-terminus of neighbour sequence of sequence listing upward to telomere on chrosomal short arm and 5'-terminus of this base sequence : 220808
caacggcatcaaagtatacaagtaaaaagccccatgcaaaacaaacaaacaaacaaacaaacaaacaaacaaacaaacttcaatgattaaaggaagattagctc

SEQ ID NO: 8004 - DNA, 452 bp, Homo sapiens
  chr4.fa.O7frz.200231577
  Located on chromosome 4
  Distance between a terminus base of telomere on chromosomal short arm and 5'-terminus of this base sequence : 191255806
  Distance between 3'-terminus of neighbour sequence of sequence listing upward to telomere on chrosomal short arm and 5'-terminus of this base sequence : 248393
agttgactcataacaaataaccagcattcatgataacatttcagcatttccaaggtaccaagtgtactgatttttaaaaatatattttagaaggaatttagaactagtatttttaacgaagactagcatctctgatgttgcaacatgtatgttaaatgggtgttacatctatcctgccctttaaccccaccgttaacaaagtggctaaaaataacagcaagaaaaaatcagtctaagggagaaaaccactaatgctctcaattctctctctctctttctctctctctctctctctctgtgtgtgtgtgtgtgtgtgtgtgtgtgtgttaagggggatggcgggaggtggtcttaactcttgaaagaaaccttctttgtataggaagcatatttcggtttaggtacaatgataagaaagtttaattttataatccataagaccagataccttc

SEQ ID NO: 8005 - DNA, 306 bp, Homo sapiens
  chr16.fa.O7frz.2349660
  Located on chromosome 4
  Distance between a terminus base of telomere on chromosomal short arm and 5'-terminus of this base sequence : 191258914
  Distance between 3'-terminus of neighbour sequence of sequence listing upward to telomere on chrosomal short arm and 5'-terminus of this base sequence : 2656
ggataaactaggtctgcagatatatctgtaggcagaacagggaaggtgtcactgaggaggtgctatttgagttagttgtgaaaaatgagtacgggtttatgaggcagatatgagaggcactttgttgaagttacaactcctaccaggcactcatttgaattttctgtttcatttgctctttggaggttgcttgttggtacacttacatcttctatgccagtcttaaaagagaggagtgtgtgtgtgtgtgtctgcgttcagtatttttagcagagtttctttgtgtttccaagcttactttagagc

SEQ ID NO: 8006 - DNA, 250 bp, Homo sapiens
  DISD22_0004442
  Located on chromosome 5
  Distance between a terminus base of telomere on chromosomal short arm and 5'-terminus of this base sequence : 201758
  Distance between 3'-terminus of neighbour sequence of sequence listing upward to telomere on chrosomal short arm and 5'-terminus of this base sequence : 0
accgactcaccctctacggctacgccgccgccgccgccgccgccgccgcccccgccgccccctccgccttcgctgcctccgcctccggggtcccggccggaagtggacagcgcgcgggcacttccgcttccggcaacggcgccggaagcacgggtccgggccctcccgcggggcgggtactcgtctcccggccgagcgacttcagctcggggacctgccccatggccgctccccagcaggacagggtaac

SEQ ID NO: 8007 - DNA, 394 bp, Homo sapiens
  chr5.fa.O7frz.1144743
  Located on chromosome 5
  Distance between a terminus base of telomere on chromosomal short arm and 5'-terminus of this base sequence : 399698
  Distance between 3'-terminus of neighbour sequence of sequence listing upward to telomere on chrosomal short arm and 5'-terminus of this base sequence : 197690
ccattcttggttatttcacttaaaataatggtctctacttccatccaggttgctgcaaatgccattattttgttcttttttatggctgagtagtattccatcacatatatatatatatatatatatatatatatatatatatatatatattctatcatatatatatattctatcatatatatattctatctatatatattccatcatatatgtagtccatctcatatatatatattccatcatatatagtccatctcatatatatatattccaccatatatatatgtgtgtgtgtgtgtgtgtgcgtgtgtgtcacattttctttatccactcgattggtgggcatttgagctgggttcatatttttgcagttgcaaattgtactgctataaac

SEQ ID NO: 8008 - DNA, 253 bp, Homo sapiens
  AC010443.5_205253
  Located on chromosome 5
  Distance between a terminus base of telomere on chromosomal short arm and 5'-terminus of this base sequence : 406491
  Distance between 3'-terminus of neighbour sequence of sequence listing upward to telomere on chrosomal short arm and 5'-terminus of this base sequence : 6399
tgaaatgaccttacggttacacctcaggctgggccttggcacagaggcagcctataataataataataataataataataataataataataaaaaccaacaataagcagaaacaatgatataggagttaagaagaaattaggcagatagtgagggaaagaaagtctgtagtaacgtttccttttaatgaaaatcagcccccaaatcattttcttttctaacaaagagcagcctttaaaatcgagctgcagac

SEQ ID NO: 8009 - DNA, 97 bp, Homo sapiens
  D5S392
  Located on chromosome 5
  Distance between a terminus base of telomere on chromosomal short arm and 5'-terminus of this base sequence : 563631
  Distance between 3'-terminus of neighbour sequence of sequence listing upward to telomere on chrosomal short arm and 5'-terminus of this base sequence : 156887
gctattcccacaaaggcaggtgcacctgaacccaaggcacacacacacacacacacacacacacacacacacacagagcagcactcaatgatccgcc

SEQ ID NO: 8010 - DNA, 317 bp, Homo sapiens
  chr5.fa.O7frz.441634
  Located on chromosome 5
  Distance between a terminus base of telomere on chromosomal short arm and 5'-terminus of this base sequence : 669118
  Distance between 3'-terminus of neighbour sequence of sequence listing upward to telomere on chrosomal short arm and 5'-terminus of this base sequence : 105390
accaagatgttcactagattgtagaatggcatggatggctcccagctaaatccccagaaggatatagtctctactaaaaataaaaaagttagcctggtgtggtggcaggcacctgtaatccaagctattcaggaggctgaggcaggaaaatcgcttgaatccagtaggaggaggttgcagtgaactgagattgcaccattgcactccagcctgggtgacagagtgagactctatctcaaaaaataataataataataataataataataataataataattcatcagatgggttcaccaataaactgactatagttg

SEQ ID NO: 8011 - DNA, 252 bp, Homo sapiens
  D5S678
  Located on chromosome 5
  Distance between a terminus base of telomere on chromosomal short arm and 5'-terminus of this base sequence : 1011688
  Distance between 3'-terminus of neighbour sequence of sequence listing upward to telomere on chrosomal short arm and 5'-terminus of this base sequence : 342253
catgagtcccgtgactttgttcttcaattttgtgttggttgtgctgggtctttcctctctctatgtaaacttcagaatcatttctcaatagccacaaaataacttgctaggattttgattgagtatacacacacacacacacacacacgcgcgcacacacacacacacatatttgagatgctcctggagtgcagtgatgcgatctcggcttactgcaacctccacctcccggattcatgcaattctcctgcc

SEQ ID NO: 8012 - DNA, 174 bp, Homo sapiens
  D5S2005
  Located on chromosome 5
  Distance between a terminus base of telomere on chromosomal short arm and 5'-terminus of this base sequence : 1035406
  Distance between 3'-terminus of neighbour sequence of sequence listing upward to telomere on chrosomal short arm and 5'-terminus of this base sequence : 23466
cctcaggtgggttattgacctctcagcctcctgagatggaggcaggaagtgcgggccgttttgctttcggctgtaggcgcccacacctgtgccgagttctcaggacgcgcacgcgtgcgcgcgcgcacacacacacacacacacacacacacacacgactcgtaaagccctggg

SEQ ID NO: 8013 - DNA, 242 bp, Homo sapiens
  AC026748.4_156808
  Located on chromosome 5
  Distance between a terminus base of telomere on chromosomal short arm and 5'-terminus of this base sequence : 1084787
  Distance between 3'-terminus of neighbour sequence of sequence listing upward to telomere on chrosomal short arm and 5'-terminus of this base sequence : 49207
aataccacaaggacaacgtagagcctagtgctccagctaggaagaataggcagccccaggaggaggcaaaacaaacaccagtgcatgtgaaaagatgctcactggagaacaaattacaaagatgagatgtcagaaattaggtggagacagtgaatagtttggatggatggatggatggatggatggatggatggatggatggatggatggatgaatgctagtaagtaggtggataggatgga

SEQ ID NO: 8014 - DNA, 436 bp, Homo sapiens
  AC010446.4_47261
  Located on chromosome 5
  Distance between a terminus base of telomere on chromosomal short arm and 5'-terminus of this base sequence : 1225889
  Distance between 3'-terminus of neighbour sequence of sequence listing upward to telomere on chrosomal short arm and 5'-terminus of this base sequence : 140860
tgcaagtactgttgctattaacatgggtgtggaagttctgttctagacccttccttcaattagtttgggtacagacccaaagcaaacttgctgcatcatatggcaattctattcgtaattttttgaggagctgccatactgcttttcacagaagctgcaccatttgacattcccaggaaatgtacacgaggttccagtttctctacctcctccccaacaggtattattattattattattattattatttcttgccttctaatgggcatgaggttgcatctcattgtggttttgattgagtttccctcttgatgagtgaggctcagagtattttcatgggttcactgccatttataaaaccttacattttaaaacactttctgtttgcttctgctcacctgtaaaaatacagcttgtatgttgaccttgtactcaa

SEQ ID NO: 8015 - DNA, 392 bp, Homo sapiens
  chr5.fa.O7frz.1859820
  Located on chromosome 5
  Distance between a terminus base of telomere on chromosomal short arm and 5'-terminus of this base sequence : 1309053
  Distance between 3'-terminus of neighbour sequence of sequence listing upward to telomere on chrosomal short arm and 5'-terminus of this base sequence : 82728
tttcaaggtgcaaattgacctcatttttgtaatcaagaagaatccatttgtgatattaactagggagtcattgtttcctttgaggagaccagggagggccctgggtgtgaactctcaacacagtataggtatgaacatgcatgtacacacgtgtgtgtgtgtgtgtgtgtgcatgtgagtagaaacacgcagcacagccacctccttccaaaggagatgtaacccttgctcagggagggcgctggctcacactggaagcctgcaaccctacggctgacgacacttacaaggattcgcagagtccacagaaaggaaatggctttgggggtccagggagggtggaagggaaggtaggaaaatcaaacggtgccttgaaggatagaatttggttc

SEQ ID NO: 8016 - DNA, 413 bp, Homo sapiens
  chr5.fa.O7frz.2055330
  Located on chromosome 5
  Distance between a terminus base of telomere on chromosomal short arm and 5'-terminus of this base sequence : 1376278
  Distance between 3'-terminus of neighbour sequence of sequence listing upward to telomere on chrosomal short arm and 5'-terminus of this base sequence : 66833
atgccatcaaacctagctaattttttttttttttttgagacagtcttgctctgtcgcccaggctggagtgcagtggcacaatctcggctcactgcaagctccgcctcctgggttcacgccattctcctgcctcagcctcccgagtagctgggagtacaggtgcctgccactacgcctggctaatccttttgtatttttagtagagacagggtttcaccgtgttagccaggacagtcttgatctcctgtcctctttatctgctgtctcggcctccccacatgctccatcttttgaccatcagttacacacacacacacacacacacacacacacgcacactatttattccccacctgtctcctatatgcagttttcccaatattttattaaaatttcaaacataaacaggactg

SEQ ID NO: 8017 - DNA, 234 bp, Homo sapiens
  chr5.fa.O7frz.3587861
  Located on chromosome 5
  Distance between a terminus base of telomere on chromosomal short arm and 5'-terminus of this base sequence : 1913525
  Distance between 3'-terminus of neighbour sequence of sequence listing upward to telomere on chrosomal short arm and 5'-terminus of this base sequence : 536834
caaattaactgttgactctttcagatgtttttcctagcattccattttgtattttaagtaacacatttatactgctactttctgattatttagggttagaagctgagtactgactctctcctatggaaggtgatgattcagtggatgtattcctcaaactccactgcacatacacacacacacacacacacacacacattcacaaccaccgtccaaagtagactacaatttcct

SEQ ID NO: 8018 - DNA, 309 bp, Homo sapiens
  AC026709.3_98470
  Located on chromosome 5
  Distance between a terminus base of telomere on chromosomal short arm and 5'-terminus of this base sequence : 1934545
  Distance between 3'-terminus of neighbour sequence of sequence listing upward to telomere on chrosomal short arm and 5'-terminus of this base sequence : 20786
gactcacattcttaatgccagaaaacactaagtaaaatagggttagacaggagtgaagtgaagctcatggtccaggacatttaagaatatttgtaataacatagaagatgtttatgtgataatgttaagtataaatgcatttacatgtatgtgtaaaatatagtgtgtgtgtgtgtgtgtgtgtgtgtgtgtgtatgcttaggaagaaattttaaaaacaaaataaaatacaaattaactcaggcccagagctggaagaacagttaagagaggctgggactgctatgtcataaattaatcttgatgtcc

SEQ ID NO: 8019 - DNA, 122 bp, Homo sapiens
  D5S1970
  Located on chromosome 5
  Distance between a terminus base of telomere on chromosomal short arm and 5'-terminus of this base sequence : 2062056
  Distance between 3'-terminus of neighbour sequence of sequence listing upward to telomere on chrosomal short arm and 5'-terminus of this base sequence : 127202
cttcaagagggtatttcagagcaaacaagacacatacacgctcacacacacacacacacacacacacacacacacaactggtatcattttgcacatcaaggctgggaatctggacatcacca

SEQ ID NO: 8020 - DNA, 272 bp, Homo sapiens
  AC025228.2_13679
  Located on chromosome 5
  Distance between a terminus base of telomere on chromosomal short arm and 5'-terminus of this base sequence : 2075815
  Distance between 3'-terminus of neighbour sequence of sequence listing upward to telomere on chrosomal short arm and 5'-terminus of this base sequence : 13637
ctaaggatctgaagtgaaatgtacaatctcttcagtggtgagtggtgtccatctgctcccaggtccaaggtcaaaataaagatcccaactttcttgtcctaaatagatcctaattaaacacacgcacacacacacacacacacacacacacacacacacacgcacacacaatgttttctggtttgagggaactgtattagtaagcattttcatgagaagctgatttcttcttaaacttcagtcttttaaagttttctgttaggaaactgctc

SEQ ID NO: 8021 - DNA, 233 bp, Homo sapiens
  AC026791.2_57892
  Located on chromosome 5
  Distance between a terminus base of telomere on chromosomal short arm and 5'-terminus of this base sequence : 2157748
  Distance between 3'-terminus of neighbour sequence of sequence listing upward to telomere on chrosomal short arm and 5'-terminus of this base sequence : 81661
agacctttaagacactcaggagttacatcttataataagtcctaagaatgatgtggttgtcaacacttattttcccccaattatccatccattcctctatctatctatctatctatctatctatctatctatctatctatcttttatctatccatccatttatccatccatctatgtatccatccatccatccatgcgaccatttatctatctatttacctgcctattcatcc

SEQ ID NO: 8022 - DNA, 383 bp, Homo sapiens
  AC026791.2_45816
  Located on chromosome 5
  Distance between a terminus base of telomere on chromosomal short arm and 5'-terminus of this base sequence : 2207475
  Distance between 3'-terminus of neighbour sequence of sequence listing upward to telomere on chrosomal short arm and 5'-terminus of this base sequence : 49494
ccaaagctcctacattctttactcaccgtttttgtctttctatcaatcagctatttcccagacttaatcgaatgctgataaagggtgcagagttttgtgtcatgcgctgttaggagacacaggtgagggagggcagagacagagagagagagagagagagagagagagagagagagagagagagaatatttgctcctgttgagataggatacaaggcctgcccatgatcacaaaactttattttgtacagcataatggtaaaagaactgacaaggcacaacagatgacagtgtaaatgaattagcaattgtaagacaccagagagccacagtgactttctacgaggcatttccaaaagtctaaacatttcctaaacaacgata

SEQ ID NO: 8023 - DNA, 118 bp, Homo sapiens
  Z66889
  Located on chromosome 5
  Distance between a terminus base of telomere on chromosomal short arm and 5'-terminus of this base sequence : 2257852
  Distance between 3'-terminus of neighbour sequence of sequence listing upward to telomere on chrosomal short arm and 5'-terminus of this base sequence : 49994
ggcctggcaaaatacagtttttaatttttaaaagaaatgtatatatatgtgtgtgtgtgtgtgtgtgtgtgtgtgtgtatgctagaaaattcaaaacgccccttgtagagagcctccc

SEQ ID NO: 8024 - DNA, 324 bp, Homo sapiens
  chr5.fa.O7frz.3181983
  Located on chromosome 5
  Distance between a terminus base of telomere on chromosomal short arm and 5'-terminus of this base sequence : 2312997
  Distance between 3'-terminus of neighbour sequence of sequence listing upward to telomere on chrosomal short arm and 5'-terminus of this base sequence : 55027
atctaatctggaattgtaatcctcatgtgtgaggggagggacctggtaggtgacaggatcatgggaacagtttcccccatgctgttctcctgatagtgagggagttctcaggcaacctggttgtttgataaatgtctggcacttcccccttctctctctctctctctctctctcctggcaccatgtaagatgtgccttgcttccccttcaccttctgccatgattgtaagcttcctgaggtctctccagccatgtggaactgtgaatcaattaaacctcttttcgttatagattgcccagtctcaggtagttctttagagtgca

SEQ ID NO: 8025 - DNA, 292 bp, Homo sapiens
  chr5.fa.O7frz.3069957
  Located on chromosome 5
  Distance between a terminus base of telomere on chromosomal short arm and 5'-terminus of this base sequence : 2335929
  Distance between 3'-terminus of neighbour sequence of sequence listing upward to telomere on chrosomal short arm and 5'-terminus of this base sequence : 22608
caagctaaagtccaaattcatacaaaatgctacctggccaggtgtatttctgcctttgcagtcttgttctcattcacacctttcatggcacccagagggggtcactgccccagtggctcactggcattagcagcatgtctgctggagtcatcatccttcaggacccagctctaccatcagtgtgcattattctctttgaaagcaacacacacacacacacacacacacacacaccccaaacaccagaaataatctctacaatttacactttcatctattactagaccaatcc

SEQ ID NO: 8026 - DNA, 117 bp, Homo sapiens
  DISD22_0004460
  Located on chromosome 5
  Distance between a terminus base of telomere on chromosomal short arm and 5'-terminus of this base sequence : 2523752
  Distance between 3'-terminus of neighbour sequence of sequence listing upward to telomere on chrosomal short arm and 5'-terminus of this base sequence : 187531
cagtaagcgtcagctttccctgttttcagaaacacacacacacacacacactcacactcacactcaagaatggaagataaaaagcaccaagagcaaaggggctgcctaaaggacaga

SEQ ID NO: 8027 - DNA, 420 bp, Homo sapiens
  AC025460.3_104402
  Located on chromosome 5
  Distance between a terminus base of telomere on chromosomal short arm and 5'-terminus of this base sequence : 2722916
  Distance between 3'-terminus of neighbour sequence of sequence listing upward to telomere on chrosomal short arm and 5'-terminus of this base sequence : 199047
tttcatctgtcgatttgactatctgtcatctgtctgtctgtctatctatctatctatctatctatctatctatctatctatctatcatctacctctctatcatctctgtctccctatctatctctctatctctctctctttctctcctgtctccatctctttatccatgaagatatctctatatcttcatctctctatctctctatctcattatttatctgtctccatccatgtctttacctatctctcacatctcatctctctatctctctctatcaacatatctctctctatctagctctctatctccatccatccacatatctgtctctctatcaatgtcttatctgtctatccacttatctatctatctatctatctatctatctatctatcatccagctatctagttatcattga

SEQ ID NO: 8028 - DNA, 100 bp, Homo sapiens
  D5S417
  Located on chromosome 5
  Distance between a terminus base of telomere on chromosomal short arm and 5'-terminus of this base sequence : 2800328
  Distance between 3'-terminus of neighbour sequence of sequence listing upward to telomere on chrosomal short arm and 5'-terminus of this base sequence : 76992
gcaggctttagggtggggtgtgtgtgtgtgtgtgtgtgtgtgtgtgtgtgtgtgtgtgtttatccctggctttgtcatcctccaagatacatagtttcca

SEQ ID NO: 8029 - DNA, 340 bp, Homo sapiens
  chr5.fa.O7frz.2627177
  Located on chromosome 5
  Distance between a terminus base of telomere on chromosomal short arm and 5'-terminus of this base sequence : 2886123
  Distance between 3'-terminus of neighbour sequence of sequence listing upward to telomere on chrosomal short arm and 5'-terminus of this base sequence : 85695
gcaggagaatccttgatacctgggaggcagaggttgcagtgagccaagatcacaccattgcattccaacctgggcaacaagagcaaaactccatctcaaaaatgataaataaataaataaataataactaaaacaaaataaaataaaactcagtgtggtttaaatgagaatgccatggctgcccagagacagagttttgcacaataatctcttcttttcagggacatgcaagatagacattttaagtgttatttttagcttcagaattaactttttaaaagagattttaacttttattttaagttcacagttacctgtgtgcaggattgtcatctagata

SEQ ID NO: 8030 - DNA, 454 bp, Homo sapiens
  AC010390.4_1324
  Located on chromosome 5
  Distance between a terminus base of telomere on chromosomal short arm and 5'-terminus of this base sequence : 3117901
  Distance between 3'-terminus of neighbour sequence of sequence listing upward to telomere on chrosomal short arm and 5'-terminus of this base sequence : 231438
tccttcagttgagacactgtattctgaatttttttcaagctaaagatccttttttctgctttaacttttattattccctctttctctacacacacacacacacacacacacacttactccctctttctttatacattcacacacatttgatatattatagctttccattttagaatgaatatttggggttacttttcgctcaggctttttcttcttcatttgcccatattatcctctgctttatttaacattaattatagtttttttgaagttcttatctgctaataacaaaacctgagttacttttgatctgcttcaatcatctgttttctctcttgattctttgatacttactgctttatctttgatgatattttacaaaatacatgctggagtttacataaaatacattgtagagactctggcttctgttatcttcctttgaagagtgttg

SEQ ID NO: 8031 - DNA, 269 bp, Homo sapiens
  chr5.fa.O7frz.4078499
  Located on chromosome 5
  Distance between a terminus base of telomere on chromosomal short arm and 5'-terminus of this base sequence : 3197803
  Distance between 3'-terminus of neighbour sequence of sequence listing upward to telomere on chrosomal short arm and 5'-terminus of this base sequence : 79448
ataaatctccacatcagttcaacccccaccttgtgctagttacggtgactctttttttttaataaataaacttgagacaagacatacagagttataaaatacatggcttatctaaaacagttcattcctagcttcccccctacacacacacacacaacacacacacacacacacacacacacacacactcactcactcagaaacagcgatgaaagtggagcccggcccagcttttcagcaaatcgctgagattaccgagataacgtttg

SEQ ID NO: 8032 - DNA, 318 bp, Homo sapiens
  DISO7_00047369
  Located on chromosome 5
  Distance between a terminus base of telomere on chromosomal short arm and 5'-terminus of this base sequence : 3312954
  Distance between 3'-terminus of neighbour sequence of sequence listing upward to telomere on chrosomal short arm and 5'-terminus of this base sequence : 114882
caaggtcggtgaaatcttccaaattgaagggcttttattttaaattccgattcccctttgaaacagccctttcgatgagggaagaagccagctcggtttctgcgtgcgtgtttatgatctacctgtgagcgcggcgctctggaaggtcacccaggctgcggacgccctgatagcggggtgacagcctgcaggattccccagctggtcactttcattcttggtgtgtgtgtgtgtgtgtgtgtggtgtgtgtgtgtgtgtttctctgtcttctcctgtttgctgtttgtcgctgctgtatctttgcttgttactgaatt

SEQ ID NO: 8033 - DNA, 116 bp, Homo sapiens
  D5S1492
  Located on chromosome 5
  Distance between a terminus base of telomere on chromosomal short arm and 5'-terminus of this base sequence : 3419670
  Distance between 3'-terminus of neighbour sequence of sequence listing upward to telomere on chrosomal short arm and 5'-terminus of this base sequence : 106398
ccacccatccattcataaatctattatctatctatctatctatctatctatctatctatctatctatcatctatctatccatccatccatcctattggctctgtgtctttggagaa

SEQ ID NO: 8034 - DNA, 300 bp, Homo sapiens
  AC024436.3_113258
  Located on chromosome 5
  Distance between a terminus base of telomere on chromosomal short arm and 5'-terminus of this base sequence : 3655603
  Distance between 3'-terminus of neighbour sequence of sequence listing upward to telomere on chrosomal short arm and 5'-terminus of this base sequence : 235817
ttagaatttccaattactgcatagccacattgacacatgaagctctatataggtaatttagctaataggtaatttagctaagaattaagcaggagatgatcttgcccaggctcagtcctctttctctctctttcaatctttctctctctctctgtgtgtgtgtgtgtgtgtgtgtgtgtgtgtgtgtgtgtgtgtgtgtgtgttggtcagggttctttaaagggacagaactaataggatagatgaatatatgaagaggagcttattaggagaattgactcacatagtcacaaggtgaag

SEQ ID NO: 8035 - DNA, 234 bp, Homo sapiens
  AC025773.3_45505
  Located on chromosome 5
  Distance between a terminus base of telomere on chromosomal short arm and 5'-terminus of this base sequence : 3655674
  Distance between 3'-terminus of neighbour sequence of sequence listing upward to telomere on chrosomal short arm and 5'-terminus of this base sequence : -229
atttagctaagaattaagcaggagatgatcttgcccaggctcagtcctctttctctctctttcaatctttctctctctctctgtgtgtgtgtgtgtgtgtgtgtgtgtgtgtgtgtgtgtgtgtgtgtgtgttggtcagggttctttaaagggacagaactaataggatagatgaatatatgaagaggagcttattaggagaattgactcacatagtcacaaggtgaagtctca

SEQ ID NO: 8036 - DNA, 135 bp, Homo sapiens
  D5S405
  Located on chromosome 5
  Distance between a terminus base of telomere on chromosomal short arm and 5'-terminus of this base sequence : 3655688
  Distance between 3'-terminus of neighbour sequence of sequence listing upward to telomere on chrosomal short arm and 5'-terminus of this base sequence : -220
taagcaggagatgatcttgcccaggctcagtcctctttctctctctttcaatctttctctctctctctgtgtgtgtgtgtgtgtgtgtgtgtgtgtgtgtgtgtgtgtgtgtgtgtgttggtcagggttctttaa

SEQ ID NO: 8037 - DNA, 173 bp, Homo sapiens
  D5S675
  Located on chromosome 5
  Distance between a terminus base of telomere on chromosomal short arm and 5'-terminus of this base sequence : 3659404
  Distance between 3'-terminus of neighbour sequence of sequence listing upward to telomere on chrosomal short arm and 5'-terminus of this base sequence : 3581
gcctggactacaagagtgaaactccatctcaaaaaagaaaaaaaaaaagtgtgtgtgtgtgtgtgtgtgtgtgtgtgtgtgtgtgtgtatatatatatatatagtggaaacaatattttgaagaggttttagagatcggattctgaaacttcaaaacttgcagacaatggagc

SEQ ID NO: 8038 - DNA, 436 bp, Homo sapiens
  AC024436.3_43323
  Located on chromosome 5
  Distance between a terminus base of telomere on chromosomal short arm and 5'-terminus of this base sequence : 3683693
  Distance between 3'-terminus of neighbour sequence of sequence listing upward to telomere on chrosomal short arm and 5'-terminus of this base sequence : 24116
accaacttctagccagattaacataagtacacattgaaggctcttttcctgtctttatacctgatacagtatgtctggctttcatgcacacaccaacatgtgtgtgcacacacacacacgataaaaaccaaaggggaaaagcctagagaacatcaaacagtataagtaacaaatgcacacacacacacacacacacacacacacacacacacacacacacaagtccacaagtccctagggaaaccatattcaaactgcagaaagcaaacaaaaaagaaaatcttgaaagaagctgatgtgaaacaagaaattcacatacacctatagagggacaaaactagaaattacagcaaacttcttgtaagaaaccatgcaaacaaaaatgatgcaaaatatttaaagtgtggggaaaacaatcactaggctagaattgtat

SEQ ID NO: 8039 - DNA, 406 bp, Homo sapiens
  AC025773.3_85289
  Located on chromosome 5
  Distance between a terminus base of telomere on chromosomal short arm and 5'-terminus of this base sequence : 3728964
  Distance between 3'-terminus of neighbour sequence of sequence listing upward to telomere on chrosomal short arm and 5'-terminus of this base sequence : 44835
ctaatagaggtaaggccaatctgtgtataacaagttaggagtttagaaaatgtgatactagattctgatttggcatatatatatctcatatatatatctcatatatatatatctctctcagatatgcatatatacatatctcagatatatatatctgagatatatatatatatctgagatatatatatatatctgagatatatatacatacctgagatatatatatatatgagagagagatatatatatacctgatatatacacatatatatacatacacacacacacacacacacacacacacacatatatatatgtgtataacctatgttcctaagtcataattttggtttcaatctctaggatcacattttaatcacctctatacttaaggcagaatgttgaa

SEQ ID NO: 8040 - DNA, 374 bp, Homo sapiens
  chr5.fa.O7frz.5014886
  Located on chromosome 5
  Distance between a terminus base of telomere on chromosomal short arm and 5'-terminus of this base sequence : 3885994
  Distance between 3'-terminus of neighbour sequence of sequence listing upward to telomere on chrosomal short arm and 5'-terminus of this base sequence : 156624
tcaattgctttatctctggaccttgggttgctttcttccctttatataagccctagatagatagatagatagatagatagatagatagatagatagaccatgtaaaatatatataatattgtatataattaatatatatatataattatatatatatattttattcaatggcagatgttgtgtttagaaaaagaaagaatggagactgtggtcactcatatgttgctgggaacaggcatgtctcttctggcaggctcagtgtaaggtgctgagtcaatcttccaggagctgagctgagtgaggttttgttgtgtttttcattatctttgatgcctcataggttttgaattctactggcagtaggttgtagttac

SEQ ID NO: 8041 - DNA, 425 bp, Homo sapiens
  chr5.fa.O7frz.202417
  Located on chromosome 5
  Distance between a terminus base of telomere on chromosomal short arm and 5'-terminus of this base sequence : 4111710
  Distance between 3'-terminus of neighbour sequence of sequence listing upward to telomere on chrosomal short arm and 5'-terminus of this base sequence : 225342
gattttaagatgcatgttcataacatgtatggcctcctctggccggcgaaggatagggcagatgaaccctgtgtgtacatctgtgtgtgtgtgaggccccatttccgctggaccatgtccttccttctcggggctccatccagggcctgcaggtgctggtccagcccctgagcagggctgagctgtctctgtccccggcccagcaggcagcagggcagggtgtgccgaggacacaacctccaggctggcaggagcaccagagcatccctgcaggattctggaagcatttccaggaaacccgagccagtcaagcacaccacacaggccctgcctttgtccgcacaccctgccaccccccctaccactacacacacacacacacacacacacacacacacacacacactagtccttgctgaaaccat

SEQ ID NO: 8042 - DNA, 272 bp, Homo sapiens
  chr5.fa.O7frz.9077137
  Located on chromosome 5
  Distance between a terminus base of telomere on chromosomal short arm and 5'-terminus of this base sequence : 4413724
  Distance between 3'-terminus of neighbour sequence of sequence listing upward to telomere on chrosomal short arm and 5'-terminus of this base sequence : 301589
tccttgagaagtcatgactattagtatatacaaacacacacacacacacacacatctataatgtagatgtaaatgtgtgtgggcctcaccttggtgcagtgacacccaacacctaatgcctagatcatgcctctaaatgctgttcactaaaaaaaaagaaaaagaaaaaaagtcagggctcccgattctttcatcagaatcaggaccctaaaatcagagagggttgattttaggcctggagcagacaggaataagatcagccagaaagatct

SEQ ID NO: 8043 - DNA, 237 bp, Homo sapiens
  D5S676
  Located on chromosome 5
  Distance between a terminus base of telomere on chromosomal short arm and 5'-terminus of this base sequence : 4497573
  Distance between 3'-terminus of neighbour sequence of sequence listing upward to telomere on chrosomal short arm and 5'-terminus of this base sequence : 83577
ccattattccattttgtttgatatgaacttaataaattacaagtgttctaatagagaatagttaatattaatgaggttactatatgcataatgtatatgtacacacatacttttgtgtgtgtgtgtgtgtgtgtgtgtgtgtgtgtgtatcttaacccaatttggctatgtctccacccaaatctcaccttgagttgtaataatccccatgtgtcaagggtggggccaggtagagat

SEQ ID NO: 8044 - DNA, 370 bp, Homo sapiens
  chr5.fa.O7frz.9390154
  Located on chromosome 5
  Distance between a terminus base of telomere on chromosomal short arm and 5'-terminus of this base sequence : 4781699
  Distance between 3'-terminus of neighbour sequence of sequence listing upward to telomere on chrosomal short arm and 5'-terminus of this base sequence : 283889
acctagataagtatatgcctggacactggaattatttgtgtgtgtgtgtgtgtgtgtgtgtgtatatatatatatgtatatatatacctgtatagtatagtatatatatacaggtatatatatacatatatatacacgtatatatatatacacaatatatatgcacgtatatatatgtgtgtatatatacacgtgtgtatatatatatatatacgttcaaatatatatatatatatttgaacaaagaaggaagacactatctatgtcttcacagacacataatgtcagtgtggtggggagtgctgggtctccccagtatctgatctgcctttttacccttagtaaaataaagaattaagatttctggctg

SEQ ID NO: 8045 - DNA, 290 bp, Homo sapiens
  AC026670.3_164248
  Located on chromosome 5
  Distance between a terminus base of telomere on chromosomal short arm and 5'-terminus of this base sequence : 4973354
  Distance between 3'-terminus of neighbour sequence of sequence listing upward to telomere on chrosomal short arm and 5'-terminus of this base sequence : 191285
atctatccatttctggactaatttatttatgcacatattctatcattcagtaagaatgaattcagaaatctatgcactgagagagactacatttatctcatatctctcttgaagacattcattatatatttctctctctctctctctctctctctctctctttcattcttttaactttgtttcctcgggtgttaattctttgcttaagtttgcttttcgtcaaacgtttgattgagaatgaggtacacacttccagaaggaaggaattcgtacttgtcatcaaggtgacc

SEQ ID NO: 8046 - DNA, 309 bp, Homo sapiens
  AC026670.3_34858
  Located on chromosome 5
  Distance between a terminus base of telomere on chromosomal short arm and 5'-terminus of this base sequence : 5024326
  Distance between 3'-terminus of neighbour sequence of sequence listing upward to telomere on chrosomal short arm and 5'-terminus of this base sequence : 50682
gtcctaaggagagtttggtaagaccactgagaagcccccaaaccaaaatcgctcaccagcagagtccccaggaatggacaaaccttagccttcctgcatcactcactcagtcattggctgagcagcccatggaggcaaaaagtgcaatagatttcaaaggagagcattagggcccttggttaattctgcccttaccatcagatatctgaaagatgcattcttgtgggtgccacattaggataagcaacagtaatgatgatgatgatgatgatgatgatgatgatgatgatgccatttattgacaaccta

SEQ ID NO: 8047 - DNA, 440 bp, Homo sapiens
  AC026670.3_79694
  Located on chromosome 5
  Distance between a terminus base of telomere on chromosomal short arm and 5'-terminus of this base sequence : 5074848
  Distance between 3'-terminus of neighbour sequence of sequence listing upward to telomere on chrosomal short arm and 5'-terminus of this base sequence : 50213
gaaggcagcctctaagtaatagagctaattcatttcaatatgacaatatatatacacacatatgtgtgtatccatatgtatgtacttacaagctccatgtgcatgcatctgtgtgtgtgtgtgtgtgtgtgtgtgtgtgtgtgtagtcatccagtcttttagggacttagggataaggcagggcaattggggaagtttgcacatgggagcctggactgggttgaatggttcttcccccaaaatcgtgaatcgtgtccacctgaaacctcagaatgtgactttatttatttttatttttatttttatttatttatttatttatttatttattatactttaagttttagggtacatgtgcgcattgtgcaggttagttacatacgtatacatgtgccatgctggtgcgctgcacccactaactcgtcatctagcattaggta

SEQ ID NO: 8048 - DNA, 166 bp, Homo sapiens
  D5S635
  Located on chromosome 5
  Distance between a terminus base of telomere on chromosomal short arm and 5'-terminus of this base sequence : 5126800
  Distance between 3'-terminus of neighbour sequence of sequence listing upward to telomere on chrosomal short arm and 5'-terminus of this base sequence : 51512
gtccattacatcacagttacttttgtctctctctctctctctctctgtgtgtgtgtgtgtgtgtgtgtgtgtgtgtgtgtggtgagaacactctagatctacctctttgctttaaaaaggaagaaaatcctccatccaacaacgtagatggccctggaggatgtta

SEQ ID NO: 8049 - DNA, 420 bp, Homo sapiens
  chr5.fa.O7frz.10553708
  Located on chromosome 5
  Distance between a terminus base of telomere on chromosomal short arm and 5'-terminus of this base sequence : 5329775
  Distance between 3'-terminus of neighbour sequence of sequence listing upward to telomere on chrosomal short arm and 5'-terminus of this base sequence : 202809
agtatcttcacggtattggtttcagaaccccatgtgaataccaaaatccaggaatgctcaagtccctgatataaaatgatgtagtgtttttgtagaacctatacacatcctctcatatactttaaatcatctctagcttgcttatgatacctaatccagtgcctacacatcactacatctatgtgcatgcaatgtagtccttggcatgtggcaaattcaagttttgtttttggaactttgcggaatattttttcctgaatatttttttatccacagttgattgagtcaatgggttcagaactcaggacaaactcaactacacacacacacacacacacacacacacacacacacgctattagtactggaagaagaatgcaaaaactcaaagaaacattaatgagctgaggtttactaagg

SEQ ID NO: 8050 - DNA, 89 bp, Homo sapiens
  D5S2054
  Located on chromosome 5
  Distance between a terminus base of telomere on chromosomal short arm and 5'-terminus of this base sequence : 5638535
  Distance between 3'-terminus of neighbour sequence of sequence listing upward to telomere on chrosomal short arm and 5'-terminus of this base sequence : 308340
tgagattttcagcccacctgtgaaacacacacacacacacacacacacacacacacacacacacccatgggaaacatcgggaagtggct

SEQ ID NO: 8051 - DNA, 337 bp, Homo sapiens
  chr5.fa.O7frz.9706115
  Located on chromosome 5
  Distance between a terminus base of telomere on chromosomal short arm and 5'-terminus of this base sequence : 5790177
  Distance between 3'-terminus of neighbour sequence of sequence listing upward to telomere on chrosomal short arm and 5'-terminus of this base sequence : 151553
caataaagtgatacatgaggctgggatatatatatatatagatatatatctatctatctccatatatatatatagatatagatatggagatatatttggatatatatatatatatatatatatatggtttatttggctcatgattctgctgactggaaaactgagtctctggtgaggcctcaggctgctaccactcatggttaaaggcaaaggggagatggcgtatacagagatcacatggcaagaaagggagcaagagggagagagtggaggtgccaggctctttttaacaaccactcttttgggaactaatagagcaagaagtcactcattactg

SEQ ID NO: 8052 - DNA, 363 bp, Homo sapiens
  AC025462.3_148565
  Located on chromosome 5
  Distance between a terminus base of telomere on chromosomal short arm and 5'-terminus of this base sequence : 6079619
  Distance between 3'-terminus of neighbour sequence of sequence listing upward to telomere on chrosomal short arm and 5'-terminus of this base sequence : 289105
agcaaagatagactgctatcaacttaagataactgggttccagaggtgactcttgggtaagtcatcaacccccacctgcataggaaagacccctttcctaagctagccaatgcaggacacctcgtgaacaggacttttcaatcactgtattttcatatattcacacggctttcctgcaaacttttatttatttatttatttatttatttatttatttatttatttattttgagacagagtctcgctctgtcaccaggctagagtgctgtggtgcgatctcggctcactgcaacctccaactccccggttcaaaggattctcctgcctctgcctcccgagtagtcctgcaaacttttcttaaat

SEQ ID NO: 8053 - DNA, 457 bp, Homo sapiens
  AC010366.3_16077
  Located on chromosome 5
  Distance between a terminus base of telomere on chromosomal short arm and 5'-terminus of this base sequence : 6119648
  Distance between 3'-terminus of neighbour sequence of sequence listing upward to telomere on chrosomal short arm and 5'-terminus of this base sequence : 39666
atgttgaaagttaaacaagcttatttccccactgtggtagtagccagcttttgttgactacacacacacacaccccccacacacacacacgatacacactgcacatacacacacaccacgcacagatacacacacaccccacacagatacaccacacagacatacataccacatacacacacatacacacacacacacacacaccacacacacataccacatacacaccacacatacagatgcacacactgcacaggtacacagatacacagcacatgtacacacatacatacacaaaccacacatatacacacacatatagtgacacacaaacacatacaccacagatatagtcacacaccaccacacacaccaactctgttatggatggaactgtgtgcccaagttcctatattgaagccctgcacccagtgtaactgtatttacagatggaagc

SEQ ID NO: 8054 - DNA, 427 bp, Homo sapiens
  chr5.fa.O7frz.10070453
  Located on chromosome 5
  Distance between a terminus base of telomere on chromosomal short arm and 5'-terminus of this base sequence : 6248456
  Distance between 3'-terminus of neighbour sequence of sequence listing upward to telomere on chrosomal short arm and 5'-terminus of this base sequence : 128351
ggagtgtctgcagatctaagtgtgcaactctgctctgctcactggtgtgggaggcggacatgccgtctcctccttcagccttaaagagaccccagtccttcctcgtgagctgtgtgaggccacgtgtccctgtggggacccttccagcaggcctgatctccttacctccctctctcaatccttcttggaattcttatttttacacgtgcacacaggtttgtatgattctatactgatttataaacgtgatcacattatacttattgctgtgtgtgtgtgtgtgtgtgtgtacacaaaatctccctttcacactttgggaggccaggagttcaagactagcctgaccaacatggcaaaacctcatctccactaaaaatacaaacaattagccaggcgtggtggcgcatgcctgtaatccaacatactg

SEQ ID NO: 8055 - DNA, 456 bp, Homo sapiens
  AC022129.3_13014
  Located on chromosome 5
  Distance between a terminus base of telomere on chromosomal short arm and 5'-terminus of this base sequence : 6258437
  Distance between 3'-terminus of neighbour sequence of sequence listing upward to telomere on chrosomal short arm and 5'-terminus of this base sequence : 9554
gtggatacattacagagtggataaaatacttttttgcatggccgagttctggtgagggccctcttcctggcttgtagatggcctgtgtcctcatgtgaccttgctctctgtgtgtgtgtgtgtgtgtgtgtgtgcgtgtgtgtgtgtgtaaacatggagtgggggagagagagagagacagaggagggataaaagagctctcttgctttttcttataaggacactggtctccccatcaggaccccaccttcacgacctcatctaaacctaattacctcccaaagagcccacctccacgtaccatcacgctggtgtttagggcttccacatgtgaactttggagagacacaaacattccatccatcacagggcccaaactgaaggaaacacttagtcccattcatcccgaccctcttctgtccctttttgaagatgtcacagtgactttgacaagat

SEQ ID NO: 8056 - DNA, 328 bp, Homo sapiens
  AC027334.2_123389
  Located on chromosome 5
  Distance between a terminus base of telomere on chromosomal short arm and 5'-terminus of this base sequence : 6270840
  Distance between 3'-terminus of neighbour sequence of sequence listing upward to telomere on chrosomal short arm and 5'-terminus of this base sequence : 11947
cttacaactggctcattatcagaggacactggtcctttctaaatctctagcctttcttcatgtcccttatcacgtgttttaagatgtctgtgggaggccatcaaggcaaaagagaactttaagttccttgttccagcccagagttttggtaaagaaagagagagagagagagagagagagagagagagagagagagagagagagagaggaaggaaggaaggaaggaggaggaggagaaggagaaggagaaggagaaagacaaggaggaggaggaggagaaggacaaggagaaggagagtcacggtgacctaggattagaacctttctg

SEQ ID NO: 8057 - DNA, 101 bp, Homo sapiens
  DISO7_10001753
  Located on chromosome 5
  Distance between a terminus base of telomere on chromosomal short arm and 5'-terminus of this base sequence : 6523801
  Distance between 3'-terminus of neighbour sequence of sequence listing upward to telomere on chrosomal short arm and 5'-terminus of this base sequence : 252633
agatagtaggacaggtgtggcttcctctcctaacaagaacaccttttcccaacacacacacacacacacacacacacacacccttgagtctccttgcgatg

SEQ ID NO: 8058 - DNA, 265 bp, Homo sapiens
  DISO7_10001752
  Located on chromosome 5
  Distance between a terminus base of telomere on chromosomal short arm and 5'-terminus of this base sequence : 6535487
  Distance between 3'-terminus of neighbour sequence of sequence listing upward to telomere on chrosomal short arm and 5'-terminus of this base sequence : 11585
tgcatatgcacatgcatgtgtgtataagtgtgtgtgtgtgtgtgtgtgtgtgtgtaagctatgatgagtttatttagcagagatatatcttcactttgggaactataaaagaagacaaaaagcaaaggtgaaaaagcaaagataaaagaagacaaaaagcaaagatgaaaaagcaaagatgacttttagaagggaacaccgcaagccaccaagtggctcacccctgtgacttggccagtgcatgctgggtggctctttaggctca

SEQ ID NO: 8059 - DNA, 143 bp, Homo sapiens
  DISO7_10001755
  Located on chromosome 5
  Distance between a terminus base of telomere on chromosomal short arm and 5'-terminus of this base sequence : 6614727
  Distance between 3'-terminus of neighbour sequence of sequence listing upward to telomere on chrosomal short arm and 5'-terminus of this base sequence : 78975
ccattacagtggtcctcaaagtatatttcaaggtgttctttctcatgctctcttctctctctctctctctgtctcacacacatacacacacacacacacacacacacaaaaccctagatgctatattatgacatactctgccc

SEQ ID NO: 8060 - DNA, 99 bp, Homo sapiens
  DISO7_10001759
  Located on chromosome 5
  Distance between a terminus base of telomere on chromosomal short arm and 5'-terminus of this base sequence : 6766648
  Distance between 3'-terminus of neighbour sequence of sequence listing upward to telomere on chrosomal short arm and 5'-terminus of this base sequence : 151778
gtaacaattcaaactctcatccagatgagtgtgtgtgtgtgtgtgtgtgtgtgtgtgtgtgtgttggggggtgggggtgttaatgtcacctctgagaaa

SEQ ID NO: 8061 - DNA, 396 bp, Homo sapiens
  chr13.fa.O7frz.25288423
  Located on chromosome 5
  Distance between a terminus base of telomere on chromosomal short arm and 5'-terminus of this base sequence : 6766658
  Distance between 3'-terminus of neighbour sequence of sequence listing upward to telomere on chrosomal short arm and 5'-terminus of this base sequence : -89
aaactctcatccagatgagtgtgtgtgtgtgtgtgtgtgtgtgtgtgtgtgtgttggggggtgggggtgttaatgtcacctctgagaaatctgccaggcctaaacagcaggcttcactcactttcaccctttgccctcagcccacactactgtccttgtcacccagcaactgcctcgctctgagtcccatctcctgcgtatagtgccacggcacgaaaaggacaggcaggaccaggctctgctgctcctctcctgtgctggtgcacctgtgcacacgtggcagcccactaggctgtgctccagcctccccacacccatcttgctcatgcacacgacttcatcagcagacctgagaagggcttattcttcctgactttgctcctactttgacattac

SEQ ID NO: 8062 - DNA, 113 bp, Homo sapiens
  DISO7_10001762
  Located on chromosome 5
  Distance between a terminus base of telomere on chromosomal short arm and 5'-terminus of this base sequence : 6868253
  Distance between 3'-terminus of neighbour sequence of sequence listing upward to telomere on chrosomal short arm and 5'-terminus of this base sequence : 101199
ggcatggatgttagcatggtgtgtgtgtgtgtgtgtgtgtgtgtgtgtctaaaaattttgccttatttcacactaaacattttaataaaatgactccagtcactctcgtatca

SEQ ID NO: 8063 - DNA, 151 bp, Homo sapiens
  DISO7_10001761
  Located on chromosome 5
  Distance between a terminus base of telomere on chromosomal short arm and 5'-terminus of this base sequence : 6873791
  Distance between 3'-terminus of neighbour sequence of sequence listing upward to telomere on chrosomal short arm and 5'-terminus of this base sequence : 5425
gatagactctgtgcccttccaaataaaccttgccaagtccaatacacacacacagacacacacacacacacacacacacacacacacacacacacacatagacttcctctctctctatatagagggattcacacaggatgtgcatggaaag

SEQ ID NO: 8064 - DNA, 220 bp, Homo sapiens
  Z66739
  Located on chromosome 5
  Distance between a terminus base of telomere on chromosomal short arm and 5'-terminus of this base sequence : 6998176
  Distance between 3'-terminus of neighbour sequence of sequence listing upward to telomere on chrosomal short arm and 5'-terminus of this base sequence : 124234
tggagagaccttagaagcccctttaaaacacacatctctgtgcctctccaggagtgcgcgcacacacacacacacacacacacacacacacacacacacagagaagagacagacagggtgatgaaccagttcaagtacctttcttagcagaaggcagaatagaagtcagtcccaaacagcaccctctccaccacaccatccatcacaccagggtcctgct

SEQ ID NO: 8065 - DNA, 351 bp, Homo sapiens
  chr5.fa.O7frz.11885221
  Located on chromosome 5
  Distance between a terminus base of telomere on chromosomal short arm and 5'-terminus of this base sequence : 7127376
  Distance between 3'-terminus of neighbour sequence of sequence listing upward to telomere on chrosomal short arm and 5'-terminus of this base sequence : 128980
catggacattcaatctctgtaccccttctctcattccttccctcagcagtcagcacagagtagaagagaatttagacctttatattttaggacatgaagaaagtttaagcctttatttatttatttatttatttatttatttatttatttatctttaccaaatagccagacttcaaggagatgtttaagcctttcaattcaatgtatgccgacatatttttaaattatttgggctgcacctttttcattctttaggatgggatgactagaagtgaagaagggttaatcaggttccagggaaggaactaaacaaggggaggcctaagtgggctttcatacctcaataggcac

SEQ ID NO: 8066 - DNA, 163 bp, Homo sapiens
  G12431
  Located on chromosome 5
  Distance between a terminus base of telomere on chromosomal short arm and 5'-terminus of this base sequence : 7137779
  Distance between 3'-terminus of neighbour sequence of sequence listing upward to telomere on chrosomal short arm and 5'-terminus of this base sequence : 10052
catagatgcagataaatatagatctagatatacagatagatcaagatagatagataaatacatacatacatacatacatagatggatacatagatagatagatagatagatagatagatagatagatagatagataagaaggggctattaggggaattggctc

SEQ ID NO: 8067 - DNA, 178 bp, Homo sapiens
  D5S406
  Located on chromosome 5
  Distance between a terminus base of telomere on chromosomal short arm and 5'-terminus of this base sequence : 7254787
  Distance between 3'-terminus of neighbour sequence of sequence listing upward to telomere on chrosomal short arm and 5'-terminus of this base sequence : 116845
tggatgctaactgctgactatgcatatatatgcaaatacactgtgtgtgtgtgtgtgtgtgtgtgtgtgtgtgtgtgtgtgtgtgtggtgtgtatacatacaaactgtgcatgtgcatacaatgcaaagggaaatttaagtattttgatatttctgtttttcttgaagtattggcagg

SEQ ID NO: 8068 - DNA, 289 bp, Homo sapiens
  AC022127.4_21674
  Located on chromosome 5
  Distance between a terminus base of telomere on chromosomal short arm and 5'-terminus of this base sequence : 7353832
  Distance between 3'-terminus of neighbour sequence of sequence listing upward to telomere on chrosomal short arm and 5'-terminus of this base sequence : 98867
tctgatgctgtgagttaatacttaataaactcccctatctatctatctatctatctaatctatctatctgtctgtctgtctgtctgtctgtctatctatctatctatctatctatctatctatctatctatctatctacctacctacctacctacctacctatctatcctgttagttctgtccctctagagaaccctaactaatacagatggggacagagattcaaaccttatcattggaatatttgaactcattacaggaatatacatacaaagcagtgataagacca

SEQ ID NO: 8069 - DNA, 448 bp, Homo sapiens
  AC022127.4_21629
  Located on chromosome 5
  Distance between a terminus base of telomere on chromosomal short arm and 5'-terminus of this base sequence : 7353832
  Distance between 3'-terminus of neighbour sequence of sequence listing upward to telomere on chrosomal short arm and 5'-terminus of this base sequence : -289
tctgatgctgtgagttaatacttaataaactcccctatctatctatctatctatctaatctatctatctgtctgtctgtctgtctgtctgtctatctatctatctatctatctatctatctatctatctatctatctacctacctacctacctacctacctatctatcctgttagttctgtccctctagagaaccctaactaatacagatggggacagagattcaaaccttatcattggaatatttgaactcattacaggaatatacatacaaagcagtgataagaccaatactcttttctgtagagtgggagttaatgtccagctagccaatattctttaaatatttgttgaaatgtataaataattgagtccacaacttaatcacagtctggtgttaaggacttgtcacttcccttactgcttttcaccatttgatcttgaaatac

SEQ ID NO: 8070 - DNA, 321 bp, Homo sapiens
  AC018886.4_100067
  Located on chromosome 5
  Distance between a terminus base of telomere on chromosomal short arm and 5'-terminus of this base sequence : 7397196
  Distance between 3'-terminus of neighbour sequence of sequence listing upward to telomere on chrosomal short arm and 5'-terminus of this base sequence : 42916
tgctaccttactggacttatttactagttctaacagtttgtgtatgtgtgtgcatgtgtgtgtgtgtgtgtgtatggagtctttaaagttttctagctatagaatcatgaaatctttaaacaggcctaattttacttcttttttttctagatgccttttatttatttatttatttacttatttattttttgtctgagtgttctttctagtacttctggtactatgttaaaaagaagtgaaaaagtcttttccttgtatcagatcatagaggaaatgatttcagtttttcccaattttttatgctgttagcaataagctcta

SEQ ID NO: 8071 - DNA, 469 bp, Homo sapiens
  chr5.fa.O7frz.12250948
  Located on chromosome 5
  Distance between a terminus base of telomere on chromosomal short arm and 5'-terminus of this base sequence : 7481962
  Distance between 3'-terminus of neighbour sequence of sequence listing upward to telomere on chrosomal short arm and 5'-terminus of this base sequence : 84445
ggaaattctgatacatagtacgacatggataaacttttaagacgttcctctcaatgaaataaaacagttacaaaaagacaaaaaaggccgggcacagtggctcacacctgtaatcctagcactttgggaggctgaggtgggcagatcacctgaggtcaggagttcgagaccagcctggccaacatggcaaaacctcttctctactaaaaaatacagaaattagtggggtgtggtgttgcacatctgtaatcctagctactcaggaggctgaggcaggagaaccatttgaacctgacagaggttgcagtgagccgagatcacaccattgccctccagcctgggtgataagaggaaaactctgtcacacacacacacacacacacacacacacacacacacacacacacagaatggcgattcctgagagctgagaaacaagcaagctgaaccctaagtttggctgcatgtc

SEQ ID NO: 8072 - DNA, 107 bp, Homo sapiens
  DISO7_10001764
  Located on chromosome 5
  Distance between a terminus base of telomere on chromosomal short arm and 5'-terminus of this base sequence : 7606758
  Distance between 3'-terminus of neighbour sequence of sequence listing upward to telomere on chrosomal short arm and 5'-terminus of this base sequence : 124327
ggattagagacgcatgagcaacacacacacacacacacacacacacacacacaccctgcccccaactcacaaacagtagaaagcatgtgacattaaataattgcatc

SEQ ID NO: 8073 - DNA, 223 bp, Homo sapiens
  DISO7_10001768
  Located on chromosome 5
  Distance between a terminus base of telomere on chromosomal short arm and 5'-terminus of this base sequence : 7703910
  Distance between 3'-terminus of neighbour sequence of sequence listing upward to telomere on chrosomal short arm and 5'-terminus of this base sequence : 97045
tctgcatgtgtatgtgtaggggtgtgtgtttttgtgtatgtgtgtgtgtgtgtgtgtgtgtgtgtgtgtgtggggtgaatgagtgtgtattgcattttaagggggaaaatggccatagctcatttgtttctccaaaaggttcccactgttttcatctcttcacacaaagtccctcttttcagaactccacaatgtcttttggtcttcattccttaatcccact

SEQ ID NO: 8074 - DNA, 414 bp, Homo sapiens
  chr5.fa.O7frz.12698069
  Located on chromosome 5
  Distance between a terminus base of telomere on chromosomal short arm and 5'-terminus of this base sequence : 7879733
  Distance between 3'-terminus of neighbour sequence of sequence listing upward to telomere on chrosomal short arm and 5'-terminus of this base sequence : 175600
aaacaggactattacgtatgtcagaggtataaaatgacaacagatctttaagtccatgattaggtttgggacaatatgatttgacccatatctgaatccataaaagaagaattcatacactaggaaatgctggaggggcccttcattgaaaatataactcattattttttaagtaggaagagacatatgcaaaatcatttaaacgatagactttaaaaatacaacttacttttcttcacaaactgcattatattaatatgccagaaaacacacacacacacacacacacatacacgagagagagcccaagccagggccaaaaaagtcatttgttagcatatattttgttaagacaacaagctctccatatttctactccaattccccatgggagtcttcagtccacagaatgat

SEQ ID NO: 8075 - DNA, 450 bp, Homo sapiens
  AC010281.3_154073
  Located on chromosome 5
  Distance between a terminus base of telomere on chromosomal short arm and 5'-terminus of this base sequence : 7951237
  Distance between 3'-terminus of neighbour sequence of sequence listing upward to telomere on chrosomal short arm and 5'-terminus of this base sequence : 71090
gtctttgagtctgctaacagatcttggtgcttccactcttgctgtcttccacctattcctagccaggggcacccttaaacacacacacacacacacacacacacacacacacacacacacacacaccaatttagatcatattgcttctctgatcaaaattctccaatggcttcttacccccttggaaaaatgttggcagtcctacagcccagaaggtcctacatcagccagcctcccaccagtcctccgacattagctactctctccctctctgtctgtctcctgtttcccgtctggctctgcccatttctcatgctcatcttcctgttctcctgcacagggtttcactcttattacccctatagctggggaagctctttccttgataagcccttgactgtcttcttcccctccttgggagctctgcttaaatgtcaccttgtcatagag

SEQ ID NO: 8076 - DNA, 149 bp, Homo sapiens
  D5S2088
  Located on chromosome 5
  Distance between a terminus base of telomere on chromosomal short arm and 5'-terminus of this base sequence : 8001996
  Distance between 3'-terminus of neighbour sequence of sequence listing upward to telomere on chrosomal short arm and 5'-terminus of this base sequence : 50309
agctggaatctgtgtgtaacaaatacacacacacaaacacacacacacacacacacacacacacacacacaaccttttcactttcaccccctcattcttgtcagtgagaggctggtttcaagcctcgctgacacacagcaaaggtcagc

SEQ ID NO: 8077 - DNA, 459 bp, Homo sapiens
  AC010281.3_98677
  Located on chromosome 5
  Distance between a terminus base of telomere on chromosomal short arm and 5'-terminus of this base sequence : 8006478
  Distance between 3'-terminus of neighbour sequence of sequence listing upward to telomere on chrosomal short arm and 5'-terminus of this base sequence : 4333
cctgacttcagaagtaagcacaatggctgcaccatgtctcacggaccatcttcagggagctgggcaaagctctctcaaggacaacacccattaccccacactgcccgctcccatgctccctgcttgcattgtggctcagagctgcattgtgtcagccccagaagggtcagcaaagtcaggaaaagttctaaatgaaggaggagaaagagagagaattgtgtttctgggtatgtaggcttgaactgtgtgtgtgtgtgtgtgtgtgtgtgtgtgtgtgatttgctgtaacttctggttcaaacaaaaatcaactaaattataagacatttaagatttatgttactgagataaatccctcactcttaatataacaccctgataagagaaaataattgtttctacaaaaatgaggaaaagcaaaaaacattttgataatgagtaaccgttcctaaaagatgt

SEQ ID NO: 8078 - DNA, 332 bp, Homo sapiens
  AC010281.3_81897
  Located on chromosome 5
  Distance between a terminus base of telomere on chromosomal short arm and 5'-terminus of this base sequence : 8023363
  Distance between 3'-terminus of neighbour sequence of sequence listing upward to telomere on chrosomal short arm and 5'-terminus of this base sequence : 16426
gaggaccttggtctaacttagatttttttttccacctgtgcaacataacactggtcttcaggagttactgccttgtaaacctgagtgtatagatagatgatcttctgaaaaacccttacaactccatgagtgtctatttttctatctagacacacacacacacacacacacacacacacacacacacacatatatatatatatatatatatatatatatcccttctacactggctggctgtaattcctcctaaaacccagagtcagctgcaagccctcccaaaggtggctgtggagaccccgaattgggaatggtgagtattggtacataga

SEQ ID NO: 8079 - DNA, 118 bp, Homo sapiens
  D5S432
  Located on chromosome 5
  Distance between a terminus base of telomere on chromosomal short arm and 5'-terminus of this base sequence : 8328088
  Distance between 3'-terminus of neighbour sequence of sequence listing upward to telomere on chrosomal short arm and 5'-terminus of this base sequence : 304393
agatttgaccagattcccagtttcactactactacgcacgtgtgtgtgtgtgtgtgtgtgtgtgtgtgcgtgtgcatgtttctccccatcccagaattcaccttcgtggtaactaagc

SEQ ID NO: 8080 - DNA, 257 bp, Homo sapiens
  D5S478
  Located on chromosome 5
  Distance between a terminus base of telomere on chromosomal short arm and 5'-terminus of this base sequence : 8591843
  Distance between 3'-terminus of neighbour sequence of sequence listing upward to telomere on chrosomal short arm and 5'-terminus of this base sequence : 263637
gaggttcaaaggccgtttgcacatttgaggctgttctgccgagtccaacacacacacacacacacacagagacacacacacgctgcaacaggcgtgaggagagggcctcaggggacgttgccttctttttcagttctttatgtatgttggatgaaagtttatgtttaaaattccaggttatttcacatgagtcacactgaaaaggaaatacaaacgtgttgcatttactttacctggttgtgtttgatgtcttcagc

SEQ ID NO: 8081 - DNA, 291 bp, Homo sapiens
  D5S667
  Located on chromosome 5
  Distance between a terminus base of telomere on chromosomal short arm and 5'-terminus of this base sequence : 8691352
  Distance between 3'-terminus of neighbour sequence of sequence listing upward to telomere on chrosomal short arm and 5'-terminus of this base sequence : 99252
cctgagcaacacatgagaccctgtcacacacacacacacacacacacacacacacacactcacacacacacacaaacatgctttgtagaagcagaaggtagaatggtggttatgagagactgaaggtaagaggaatggggagatgttggtggaagggtgcaaagtttcacttgagaagaacagattttttgagatttattatgcaacaaggtgactacagttaataataatgtattttatatttcaaaattgctaagagtaaattttcaaatgttcccaccaaagataaga

SEQ ID NO: 8082 - DNA, 346 bp, Homo sapiens
  AC004648.1_131758
  Located on chromosome 5
  Distance between a terminus base of telomere on chromosomal short arm and 5'-terminus of this base sequence : 8712100
  Distance between 3'-terminus of neighbour sequence of sequence listing upward to telomere on chrosomal short arm and 5'-terminus of this base sequence : 20457
gagcacatgaagacaaagtatttccaggacagcagtggtggcaatgccagaaaaggactttttattatgttatctgcatgacgaccacatatgtgtgtgtgtgtgtgtgtgtgtgtgtgtgtgtgtgtttacatcttcactcctcaggttgcagtttaaaaattaagcagaatagagaaagtgagagaaatagcacgaagacagaggcatttgtggttttaaaaaagcttttttgctgggtttcatcttgttccagcttgggggaaattttcaatgaaaatatcccttcctcctcagaattttactccttatgtttgagagttacataaatgttccacaattctgt

SEQ ID NO: 8083 - DNA, 327 bp, Homo sapiens
  chr5.fa.O7frz.14410133
  Located on chromosome 5
  Distance between a terminus base of telomere on chromosomal short arm and 5'-terminus of this base sequence : 8915198
  Distance between 3'-terminus of neighbour sequence of sequence listing upward to telomere on chrosomal short arm and 5'-terminus of this base sequence : 202752
cgagtttaagaagcacgttatcccaagttccttgcagcatggagggtttatgtgcttccttgcttgcttgcttgcttgctgaatgaatgcatctcggcattgcatccactgagccaccaggcagcagtctgagaaatgcctgtggtcactgcgcttgcatctcccagtcaccactctcactgccttgctcccttcagaggtggtgtcttaccaggtgctaatgtagctcttactacacacaaaacattgttctgagcgcctttcaaatacaaactcctttcatcttaagcaccacccgacagggcaggtactattaccatctccgtt

SEQ ID NO: 8084 - DNA, 173 bp, Homo sapiens
  AC003954.1_58855
  Located on chromosome 5
  Distance between a terminus base of telomere on chromosomal short arm and 5'-terminus of this base sequence : 8986584
  Distance between 3'-terminus of neighbour sequence of sequence listing upward to telomere on chrosomal short arm and 5'-terminus of this base sequence : 71059
ctgagcttaagacctgagtgatgaatgcctttgtgtgtgtgtgtgtgtgtgtgtgtgtgtgtgtgtatttcttattctaaagagaaataaatactgacttcccctttctacatcaattttctattttggtctctctttttcatgccactaactctttccaattcctcagtaat

SEQ ID NO: 8085 - DNA, 207 bp, Homo sapiens
  D5S1987
  Located on chromosome 5
  Distance between a terminus base of telomere on chromosomal short arm and 5'-terminus of this base sequence : 8992810
  Distance between 3'-terminus of neighbour sequence of sequence listing upward to telomere on chrosomal short arm and 5'-terminus of this base sequence : 6053
gaatcacttgaatccaggagatggatgttgcagtgagccgagatcgcaccactgcactccagcctgggcaaccgacagagtgagactctgtgtgtgtgtgtgtgtgtgtgtgtgtgtgtgtgtgtgtgtgtgtgtgtgtagaatgatgaattagtgaaagtcactacatatcctgtatccacccttcctagtcatcagtgacaaatc

SEQ ID NO: 8086 - DNA, 467 bp, Homo sapiens
  AC008881.4_38501
  Located on chromosome 5
  Distance between a terminus base of telomere on chromosomal short arm and 5'-terminus of this base sequence : 9045363
  Distance between 3'-terminus of neighbour sequence of sequence listing upward to telomere on chrosomal short arm and 5'-terminus of this base sequence : 52346
atggctaccttgactgatactctatttacagattagcaaacgttttcttttttactatttatttatttatttatttatttatttatttaattttttgagacagagtctcactctgtcacccaggatggagtacagtggcgcgatcacagctcaccgcaagctctgcctcccaggttcacaccattcccctgcctcagcctcccgagtagctgggactacaggtggccgccaccaagcccggctaattttttttttgtatttttagtagagatggggtttcaccgtgttagccaagatggtctcgatctcctgacctcgtgatccgccctcctcggcctcccaaagtgcagggattacaagcctgagccaccgcgccccgccgtttgacaaacgttttctgtaaaggcaccgctatttcaggctttacaagccctaggtctctactgtagttactgaactctggtgtc

SEQ ID NO: 8087 - DNA, 234 bp, Homo sapiens
  AC004633.1_47359
  Located on chromosome 5
  Distance between a terminus base of telomere on chromosomal short arm and 5'-terminus of this base sequence : 9090853
  Distance between 3'-terminus of neighbour sequence of sequence listing upward to telomere on chrosomal short arm and 5'-terminus of this base sequence : 45023
ctaacgcgattcagtaatagctctctgttctgatgaaattactttgacatgtttctgttacctaactccccccaccaaacatgcttgttctatgatttgaaaatacatatgtgtgtgtgtgtgtgtgtgtgtgtgtgtgtgtgtgtgtgtaagtgcatataattagaggttataatagagtttttctttctgtagaaaaagagttgcacagagacctaggcaggtaagttcagt

SEQ ID NO: 8088 - DNA, 228 bp, Homo sapiens
  AC004633.1_83047
  Located on chromosome 5
  Distance between a terminus base of telomere on chromosomal short arm and 5'-terminus of this base sequence : 9126575
  Distance between 3'-terminus of neighbour sequence of sequence listing upward to telomere on chrosomal short arm and 5'-terminus of this base sequence : 35488
aataagacaaggatgtccactctcaacacttctactcaacatggtaaaggaagtcctggacgaggcaattaggcaaaataaataaataaataaataaataaaaataaaaggcacccatataggaaatgaagaagtaagacaacctccatttgcagaagatatgatcttacatatagaaactgctgagaattcagaaaacaatgtgttgaactgataatcaacttcagt

SEQ ID NO: 8089 - DNA, 452 bp, Homo sapiens
  AC005572.1_68812
  Located on chromosome 5
  Distance between a terminus base of telomere on chromosomal short arm and 5'-terminus of this base sequence : 9195639
  Distance between 3'-terminus of neighbour sequence of sequence listing upward to telomere on chrosomal short arm and 5'-terminus of this base sequence : 68836
caagtgataaccttcaatattcactactgtatctgtttcacttttttaatcgggggaaaaagaacactgtatatttgatgttagaaaaaaatgtattttttctaacacactatatttatttatatatataacacactatatttatatattttatctatctatatctatctatctatctatctatctatctatctatctatctatatcagattctcatttgtttgttcagtaaatacaccaggcacagcctaagtgctagaaatgcatcaatgaaaaaaatcagacaaaaatccctgccttcatgaagtttacattctaatggagaaaacagacagtgaaccaaataaacagattacatagagctacctgtggtcaaggcaatttaaaaaagcaattcaggaaaataagacgatggggagacaacttaagtagaataattaagaacagcgtca

SEQ ID NO: 8090 - DNA, 262 bp, Homo sapiens
  G08444
  Located on chromosome 5
  Distance between a terminus base of telomere on chromosomal short arm and 5'-terminus of this base sequence : 9195690
  Distance between 3'-terminus of neighbour sequence of sequence listing upward to telomere on chrosomal short arm and 5'-terminus of this base sequence : -401
gggggaaaaagaacactgtatatttgatgttagaaaaaaatgtattttttctaacacactatatttatttatatatataacacactatatttatatattttatctatctatatctatctatctatctatctatctatctatctatctatctatatcagattctcatttgtttgttcagtaaatacaccaggcacagcctaagtgctagaaatgcatcaatgaaaaaaatcagacaaaaatccctgccttcatgaagtttaca

SEQ ID NO: 8091 - DNA, 210 bp, Homo sapiens
  AC005572.1_72614
  Located on chromosome 5
  Distance between a terminus base of telomere on chromosomal short arm and 5'-terminus of this base sequence : 9199554
  Distance between 3'-terminus of neighbour sequence of sequence listing upward to telomere on chrosomal short arm and 5'-terminus of this base sequence : 3602
tgctttgaatgtatctggattcttagctatctgtatgttaacattaaaacacacacacacacacacacacacacacacacacacgacaacaacaacaacaaaaaaacacatcatgaaatgattatcaaactcaaaatagactttatttccttgatgaattcaaaagcaagaggcagtttcaagattgtttagagttcttattcaaagcca

SEQ ID NO: 8092 - DNA, 181 bp, Homo sapiens
  DISO7_10001772
  Located on chromosome 5
  Distance between a terminus base of telomere on chromosomal short arm and 5'-terminus of this base sequence : 9199557
  Distance between 3'-terminus of neighbour sequence of sequence listing upward to telomere on chrosomal short arm and 5'-terminus of this base sequence : -207
tttgaatgtatctggattcttagctatctgtatgttaacattaaaacacacacacacacacacacacacacacacacacacgacaacaacaacaacaaaaaaacacatcatgaaatgattatcaaactcaaaatagactttatttccttgatgaattcaaaagcaagaggcagtttcaaga

SEQ ID NO: 8093 - DNA, 391 bp, Homo sapiens
  chr5.fa.O7frz.16098966
  Located on chromosome 5
  Distance between a terminus base of telomere on chromosomal short arm and 5'-terminus of this base sequence : 9315635
  Distance between 3'-terminus of neighbour sequence of sequence listing upward to telomere on chrosomal short arm and 5'-terminus of this base sequence : 115897
aaacaatgagttcttagttgtcacatatctgcacaaggtgaatattgttttttatttatgtctgctttaaaagtgaagctctgcttttgaaatacacatcccccttaaacacacacacacacatatgtatacaccacataacctgcaactgagaacggcaagaagcaagagatgaaagacatttttgatgtattattaacaaaatctctaggcataagaatgcattggttatttacatggcaaattagtgtctcagaatcactaattttaatgaataagatacaaaggggaagttgatttcatatatatatatatatatatactattataaatatcttttaatctgctaataaattttacactgtgagattacatcaattatgatccatgt

SEQ ID NO: 8094 - DNA, 306 bp, Homo sapiens
  AC004225.1_76616
  Located on chromosome 5
  Distance between a terminus base of telomere on chromosomal short arm and 5'-terminus of this base sequence : 9415681
  Distance between 3'-terminus of neighbour sequence of sequence listing upward to telomere on chrosomal short arm and 5'-terminus of this base sequence : 99655
ttcctatgtaacaaacctgcacattttccatatgtatcccttttttttggaagaaataaaaaaaaccaacatatatattaattatacttatatttaaaccaacatatatattaattataaacatacactataaatatgtttatatataatatgtattgtttcattgtaaacactatatatatatatatatatatatatatatatatacacacacacactcttttctgatgtaaaaatattggaaaacataattcaaatgagtaagtttaaaagcaacaaagaaacgtgagttgaactgagtctact

SEQ ID NO: 8095 - DNA, 273 bp, Homo sapiens
  AC004225.1_56678
  Located on chromosome 5
  Distance between a terminus base of telomere on chromosomal short arm and 5'-terminus of this base sequence : 9435682
  Distance between 3'-terminus of neighbour sequence of sequence listing upward to telomere on chrosomal short arm and 5'-terminus of this base sequence : 19695
aacatctttgtcatcctacaagagatgagaactgacagatccaaggggggaaagaggaatgctcttattgtttatgcttcacacctcacagctttatcctcaagccagtcacacacacacacacacacacacacacacacacacactctcacacacacatgcctgcacgtgcgcgcgcgtgcacacacacttgacagttttttaatctatataaaagcataaactccataaggcaatcaagtacccattgttctttagctactttgaggcttt

SEQ ID NO: 8096 - DNA, 464 bp, Homo sapiens
  chr5.fa.O7frz.16461495
  Located on chromosome 5
  Distance between a terminus base of telomere on chromosomal short arm and 5'-terminus of this base sequence : 9652500
  Distance between 3'-terminus of neighbour sequence of sequence listing upward to telomere on chrosomal short arm and 5'-terminus of this base sequence : 216545
tagattcaatgctatttgcatcaagctacaattgactttcttcaaagaatttgaaaaaaaaattctttaaatttcatatggaatcaaaaaagggcccatatatccaatacaatcctaaccaaaaacaaacaaacaaacaaacaaacaaacaaacaaagctggaggcatcatgctacccgacttcaaactatactaaaaggctacagtaaccaaaacagcgtggtacccataccaaaacagaaatacagaccaatggaacagaacagagacctaagaaataaacacaacatatctaccaccatctgatcttcaacaaacctgacaaaaacaaggaatggggaaaggattccctgtttaacaaatggtgctgagaaaactggctagccatatgcagaaaactgaaactgtacccctttccttacactttatacaaaaattaactcaagatggattaaagactttaa

SEQ ID NO: 8097 - DNA, 197 bp, Homo sapiens
  D5S2081
  Located on chromosome 5
  Distance between a terminus base of telomere on chromosomal short arm and 5'-terminus of this base sequence : 9815874
  Distance between 3'-terminus of neighbour sequence of sequence listing upward to telomere on chrosomal short arm and 5'-terminus of this base sequence : 162910
agcttatttaagaccacagaaaagaccatctccggaaggaaaaggaagtgtgtgtgtgtgtgtgtgtgtgtgtgtgtgtatgcatgtgcacacgtgcacacacacatgcatagtcaggtgtgtcttgtgcatttatgagtattcctgaacaattttaacttctaaaatgtcacaagagtttggcttctggtttatca

SEQ ID NO: 8098 - DNA, 468 bp, Homo sapiens
  chr5.fa.O7frz.16866576
  Located on chromosome 5
  Distance between a terminus base of telomere on chromosomal short arm and 5'-terminus of this base sequence : 9852054
  Distance between 3'-terminus of neighbour sequence of sequence listing upward to telomere on chrosomal short arm and 5'-terminus of this base sequence : 35983
tctattgctctaggcagaaagaataatgccccccaccacatacacacacacacacacacacacacacacacacacacacacacacacaaacacacaaagatctccacatcctaatccctgggacctgtgactaggttgttgtatggcaaggggaaattaagtttgtaaatgaaattaaggttactagtcatgtgactttaaaataaacagaaaacagattacatgggattattccagcaggcccagagtaattaccatttttcttaaatgggtgacaaggcagtaaaaatggcaacactagaagaactccactggccattgctggctttgaaaatggaagcaggccatgggccaggacatgcagatggcatttgatatggtcaggctttgcattcccacccacatctcatcttgaattataatccctataatccccaagtgtcaagggagagaccaggtggaggtaaa

SEQ ID NO: 8099 - DNA, 197 bp, Homo sapiens
  AC010364.3_92216
  Located on chromosome 5
  Distance between a terminus base of telomere on chromosomal short arm and 5'-terminus of this base sequence : 9926117
  Distance between 3'-terminus of neighbour sequence of sequence listing upward to telomere on chrosomal short arm and 5'-terminus of this base sequence : 73595
catgcgtggcatctagatatctgcaccaaatttgagtaggtaccgatcccatgcttctacaggggaaccacaggacagcaagtatttatgtggaacttagttctcaaggtagatattcttttattattattattattattattattattattattatactttaagttctagggtacttagacgtgcaggtttcttac

SEQ ID NO: 8100 - DNA, 324 bp, Homo sapiens
  chr5.fa.O7frz.16941348
  Located on chromosome 5
  Distance between a terminus base of telomere on chromosomal short arm and 5'-terminus of this base sequence : 10137351
  Distance between 3'-terminus of neighbour sequence of sequence listing upward to telomere on chrosomal short arm and 5'-terminus of this base sequence : 211037
acaactgtccttgagaatcttcacagtaattgcacagtgtacattttcatcatgattttatttattttatttatttatttatttatttatttatttatttatttatttatttattttgagacagtgtcttgctctgttacccaggctggagtgcaatgttggctaactgcagcctttgcctcccgggttcaagcgattctcctgcctcagcctcccagtagttgggattacaggtgcacaccaccacaccctgctaatttttgtatttttagtagagatgggatttcactatgttggccaagctagtctcaaactcctgacctc

SEQ ID NO: 8101 - DNA, 358 bp, Homo sapiens
  chr5.fa.O7frz.17064091
  Located on chromosome 5
  Distance between a terminus base of telomere on chromosomal short arm and 5'-terminus of this base sequence : 10259925
  Distance between 3'-terminus of neighbour sequence of sequence listing upward to telomere on chrosomal short arm and 5'-terminus of this base sequence : 122250
atcctttggaaagcgtaatgccccttccccaatcccagcaggatcagcattcctgggagaggagggcagagtgtcacactgtcatcattaccataggatccatttccctacctgcccctacatgcctgatctgggctctgtcatctctcttattaccttatcttctctctctctccctctctctctgtctctctctctctctctctctcttgctctatctctctctcacacacacacacacacacacacacacacacacacacacacacaagcgtacatccatcaacctctgccccaagtaatcacaaacacagacttattataaacagcacaaatcatacagaaactaaatgtcacc

SEQ ID NO: 8102 - DNA, 216 bp, Homo sapiens
  DISO7_10001775
  Located on chromosome 5
  Distance between a terminus base of telomere on chromosomal short arm and 5'-terminus of this base sequence : 10330093
  Distance between 3'-terminus of neighbour sequence of sequence listing upward to telomere on chrosomal short arm and 5'-terminus of this base sequence : 69810
tgtcagacagacccagacccaaggagccaagggtagggattagggggaagaaaggaaggaaaagtggaaggaggaggaggaacagaaggagaaggaggaagaggaggggaggaggggaggggagggggaggaggaagaggaggaggaggaagaggagaaagaggaggaggagggggaagaggaggaggaaggggagagggagattgtatacaagga

SEQ ID NO: 8103 - DNA, 381 bp, Homo sapiens
  AC027344.2_60880
  Located on chromosome 5
  Distance between a terminus base of telomere on chromosomal short arm and 5'-terminus of this base sequence : 10460073
  Distance between 3'-terminus of neighbour sequence of sequence listing upward to telomere on chrosomal short arm and 5'-terminus of this base sequence : 129764
atgaccatagctcatgtaacctacaactcctgaccttaaggggcttcccaagtagctaggactacaggcatgcaccaccacacccagttattattattattattattattattaaagagatgggttctcattatgttgcctaggcttgtcttgaactcctgacctcgtcatcccatctcagcctcccaaagcactgggattgcaggtgtgagccaccatgcacatcctttattacttttgacaaagacctgaattcaaatcagattattactctttaatatgccaacatctgttatatcattaaattatagtgttctgggtataatcattacctacagatctctggggggaaaaaggctgtcagttcaccaaagtccatta

SEQ ID NO: 8104 - DNA, 408 bp, Homo sapiens
  AC027344.2_87458
  Located on chromosome 5
  Distance between a terminus base of telomere on chromosomal short arm and 5'-terminus of this base sequence : 10489802
  Distance between 3'-terminus of neighbour sequence of sequence listing upward to telomere on chrosomal short arm and 5'-terminus of this base sequence : 29348
cttcgttcctacatgagtaactataggaggtcatttgccctctgttcttaggcattcttgtatataattgacagctacctatttcacggtattgacaattaataaatgtatttatgaagtgttagccccacctacttttaagactcataaccataaaactatgcatgaacttgagaaaaacacagttcaaatttacacgtataatcctaaaatatttttaaatggggtttgttggtgcctgttttttcattgtgtgtgtgtgtgtgtttgtgtgtgtgtgtgtgtgtgtatgtatgtatgtaggtatatctcttggaaagtcataaaatacccctctttggatttctgtggaataggtggtttcagtgcaagaatgaatgaatatatcggagactaatacttgaaatc

SEQ ID NO: 8105 - DNA, 446 bp, Homo sapiens
  chr5.fa.O7frz.17401958
  Located on chromosome 5
  Distance between a terminus base of telomere on chromosomal short arm and 5'-terminus of this base sequence : 10568926
  Distance between 3'-terminus of neighbour sequence of sequence listing upward to telomere on chrosomal short arm and 5'-terminus of this base sequence : 78716
gtacacttccaaactgaagtagagatttcctccacttatgtgatagttcctctcctgaaaaatattgtgtataaaacctgtgcccaaaaatgggtgaaatggagttgggtctatgctcaggatttttacttactggagaatgtctggaaattggaaagtcaggcaagatgtttgtgtgtgtgtgtgtgtgtgtgtgtgtgtgtgtgttgggtgatgaggggaggctgtcacacacaatgtctgtcccccatcattgtgacaactgcagatacccccacagatttccaaatataaaatgaaacaaaggagcatgcaggtgaggatctggggagagtggttacatgtggggatcatactttcctgtgctctcatagtgcagaggaaccgcagagggatgataaaagcagctgaactctctcctgtgcttcctcagaatttctgacttg

SEQ ID NO: 8106 - DNA, 157 bp, Homo sapiens
  DISD22_0004476
  Located on chromosome 5
  Distance between a terminus base of telomere on chromosomal short arm and 5'-terminus of this base sequence : 10784344
  Distance between 3'-terminus of neighbour sequence of sequence listing upward to telomere on chrosomal short arm and 5'-terminus of this base sequence : 214972
atgccagccagtggttaggggctcagaactgtatccatttttttcttttttcccttatttaattatttatttatttattttattttattttattttattttattttattttattttattttattttattttttcctgtaatgcaaggaaactcataa

SEQ ID NO: 8107 - DNA, 142 bp, Homo sapiens
  DISD22_0004477
  Located on chromosome 5
  Distance between a terminus base of telomere on chromosomal short arm and 5'-terminus of this base sequence : 10856224
  Distance between 3'-terminus of neighbour sequence of sequence listing upward to telomere on chrosomal short arm and 5'-terminus of this base sequence : 71723
cacattgttgaggaatcccatttgacatttttgtgttagtcataactcaagaaagtgttgtttgtttgtttgtttgtttgtttaagaaacctaaggggaaaatatcccctatctttgtttctttgacatacattcttaggcc

SEQ ID NO: 8108 - DNA, 282 bp, Homo sapiens
  chr5.fa.O7frz.13268924
  Located on chromosome 5
  Distance between a terminus base of telomere on chromosomal short arm and 5'-terminus of this base sequence : 11124389
  Distance between 3'-terminus of neighbour sequence of sequence listing upward to telomere on chrosomal short arm and 5'-terminus of this base sequence : 268023
ataaaactgaatagcgaaagtagaggtggagagccagtgttgcaagagagccttagtgtggtggggaattccagctgatagggaaagagagagagagagagagagagagagagagagagagagagagagtgtgtgtgtgtgtgtgtgtgtgtgtgtgtgtgtgtgtgtgtgtgtgtgtgtgtgtgtgtgtacaggggtactgaagagcttattctccttaaaaatcccagttatctgatataaagcattttttcccaaattacatgaactcaatgaatcatg

SEQ ID NO: 8109 - DNA, 203 bp, Homo sapiens
  D5S2004
  Located on chromosome 5
  Distance between a terminus base of telomere on chromosomal short arm and 5'-terminus of this base sequence : 11133036
  Distance between 3'-terminus of neighbour sequence of sequence listing upward to telomere on chrosomal short arm and 5'-terminus of this base sequence : 8365
aacatggaatcaagatttaatgacacagtactttctctcactgtgttctatgtacctggtatttttctagtaggttttgtgtgtgtgtgtgtgtgtgtgtgtgtgtgtgtgtgtgtgtgttttcagacagggtctcagtctattacccagtttggatgcagtggtgcaatctcggctcactgcagcctcaacctcctgggcta

SEQ ID NO: 8110 - DNA, 307 bp, Homo sapiens
  AC063975.3_48859
  Located on chromosome 5
  Distance between a terminus base of telomere on chromosomal short arm and 5'-terminus of this base sequence : 11133038
  Distance between 3'-terminus of neighbour sequence of sequence listing upward to telomere on chrosomal short arm and 5'-terminus of this base sequence : -201
catggaatcaagatttaatgacacagtactttctctcactgtgttctatgtacctggtatttttctagtaggttttgtgtgtgtgtgtgtgtgtgtgtgtgtgtgtgtgtgtgtgtgttttcagacagggtctcagtctattacccagtttggatgcagtggtgcaatctcggctcactgcagcctcaacctcctgggctagcaatcctcccacctcagcctcccaagtagctgggactccaggcacccactgccacgcccagctaattttttttctcttagtagagacaaagtctcactatgttgc

SEQ ID NO: 8111 - DNA, 102 bp, Homo sapiens
  DISO7_10001718
  Located on chromosome 5
  Distance between a terminus base of telomere on chromosomal short arm and 5'-terminus of this base sequence : 11437275
  Distance between 3'-terminus of neighbour sequence of sequence listing upward to telomere on chrosomal short arm and 5'-terminus of this base sequence : 303930
aagcaaaggacctcaaggatgtgtgtgtgtgtgtgtgtgtgtgtgtgtgtgtgtgtgtgagggggtggggagagattgaagagggaactcttgggaaggatt

SEQ ID NO: 8112 - DNA, 386 bp, Homo sapiens
  chr5.fa.O7frz.5747753
  Located on chromosome 5
  Distance between a terminus base of telomere on chromosomal short arm and 5'-terminus of this base sequence : 11483828
  Distance between 3'-terminus of neighbour sequence of sequence listing upward to telomere on chrosomal short arm and 5'-terminus of this base sequence : 46451
ggcactaatctcaatcatgaggagtccacctgcatgacctaatcacctccccacagcctacccccaaataccatcaccttgggggcaaggagttcaacacgtgagttttgaggggacacaagcattccatccatagcagctgtctagaggaaccagcttagccaaccaactttcataatttactggggaatgctcacacttcaacaaagcaaatgttctgagagagaagggcctaaacaaggctagactgtatctgtctatctatctatctatctatctatctatctatctatctatctatctatctatcatctatctatttattgtagagatgggggtctcactatgttgcccaggctagtctccaactcctgaccttaagccat

SEQ ID NO: 8113 - DNA, 259 bp, Homo sapiens
  M5_11725727
  Located on chromosome 5
  Distance between a terminus base of telomere on chromosomal short arm and 5'-terminus of this base sequence : 11725641
  Distance between 3'-terminus of neighbour sequence of sequence listing upward to telomere on chrosomal short arm and 5'-terminus of this base sequence : 241427
ttccacaggaactttacaggacactaaagataacattggtttagaattcaccttttactctttggagcattgtatgtatgtgcgtttgtgtgtgcgtgtgtgtgtgtatgtatataaacatttgtatagctgtttagtattttttttgtgtgtataaacatttgtatagctgtttagtattttgtgtgtgtgtgtgtgtgtgtgtgtgtgtgtgtataaacatttgtatagccattttcatctacacattccattgcat

SEQ ID NO: 8114 - DNA, 384 bp, Homo sapiens
  M5_11894708
  Located on chromosome 5
  Distance between a terminus base of telomere on chromosomal short arm and 5'-terminus of this base sequence : 11894385
  Distance between 3'-terminus of neighbour sequence of sequence listing upward to telomere on chrosomal short arm and 5'-terminus of this base sequence : 168485
atctcactggaccacaggtaggctttccctactactttattccatagcattcttgtatgaagagttggtgggatatagcacatctcacacacatgattttaatggaatccaaataaacttctcttataattactcttccctttaaattattaatacagtatctagttatatgtatgtgtatgtttaaaaaattcattaagaatacatatttaattctgaaaaacgtcctaaaaaataaaaatggatttgactcactttgcaaatctcttttaatacatatgaaaatatactaaaaaataggatgagaaactataagactaaatacacacacacacacacacacacacacacacacacaaaaggtgtcatgcagtataatagcaa

SEQ ID NO: 8115 - DNA, 229 bp, Homo sapiens
  D5S1976
  Located on chromosome 5
  Distance between a terminus base of telomere on chromosomal short arm and 5'-terminus of this base sequence : 11899450
  Distance between 3'-terminus of neighbour sequence of sequence listing upward to telomere on chrosomal short arm and 5'-terminus of this base sequence : 4681
aggcaggaaactaaaccaatgccatggttgggaacttctaccttcttacgctttggttaaagaaatgccttttaagagaatttgtgcccattgtttcttgtcctagtgtatctcaacatgcctagaacactctgaagtaaaccaaaaccaaacacacacacacacacacacacacacacacacacacaaaagaaaaaaaatgtcttatcacacacattcaaagttagct

SEQ ID NO: 8116 - DNA, 202 bp, Homo sapiens
  AC002479.1_13338
  Located on chromosome 5
  Distance between a terminus base of telomere on chromosomal short arm and 5'-terminus of this base sequence : 11899554
  Distance between 3'-terminus of neighbour sequence of sequence listing upward to telomere on chrosomal short arm and 5'-terminus of this base sequence : -125
agtgtatctcaacatgcctagaacactctgaagtaaaccaaaaccaaacacacacacacacacacacacacacacacacacacaaaagaaaaaaaatgtcttatcacacacattcaaagttagctaccaacccaagcactaaagggtatcatcctttattttttaaaaataaaacataaagtttgcctcaacataggttatg

SEQ ID NO: 8117 - DNA, 444 bp, Homo sapiens
  AC002123.1_62788
  Located on chromosome 5
  Distance between a terminus base of telomere on chromosomal short arm and 5'-terminus of this base sequence : 12079297
  Distance between 3'-terminus of neighbour sequence of sequence listing upward to telomere on chrosomal short arm and 5'-terminus of this base sequence : 179541
tcatccacctatctgtcaatcatctgtcatctgtgtctgtcaactatctacctacctatctgtatttctgtatatatctgtcatctttctttgtcatctgtctatatctaactatctatgtctatcatctctccctttgttatctgtctgtctgtctgtctatctgtctatccatccatccatccatccatccatccatccaatctgttctcttgctcctgtttttatccagtaaatcttggagcaggcctagtacccttaagagctacttcccttcatggccaaagctgtgggtggtctatgcaaaaatgcttgtggcctcccacctgctgtgggagcagctttatcttatccttgtgaccatgtgtgacaaggtcaatggtcacaaagataaggtcacaaagataagatcaaatctcagggtcctgaggtattcttagagga

SEQ ID NO: 8118 - DNA, 396 bp, Homo sapiens
  AC002380.1_25385
  Located on chromosome 5
  Distance between a terminus base of telomere on chromosomal short arm and 5'-terminus of this base sequence : 12208144
  Distance between 3'-terminus of neighbour sequence of sequence listing upward to telomere on chrosomal short arm and 5'-terminus of this base sequence : 128403
gtcattgtaccaggttataagcacgtgcaatatctgtaagatactgaggaggagttttgaaacacccaatgtcaccctttcatatttcattcttcttgtcagaaaggcagtttgctccctgcagtaactgaaagttactcaacctagagctagaaaagctgccattcatcttgttgccagatgggtaaagagaaggaatttcattggaaggaggggtccgggaagaaacagatgaatatgattataagactgtgtgtgtgtgtgtgtgtgtgtgtgtgtgtgtgtgtgtgtctgcgtgtctgccatgttgctaatgaaataataatcttgttcagcatgaatcccttgtctccccttctccacacacgcacataaggaaatataatttgttctgcc

SEQ ID NO: 8119 - DNA, 236 bp, Homo sapiens
  D5S2064
  Located on chromosome 5
  Distance between a terminus base of telomere on chromosomal short arm and 5'-terminus of this base sequence : 12276279
  Distance between 3'-terminus of neighbour sequence of sequence listing upward to telomere on chrosomal short arm and 5'-terminus of this base sequence : 67739
ggaaccagtctaaatgcccatcgatgaatgagtggataaagaacatttgtgtatatatatatatatatatatatataatatacacacacacacacacacacacactatggaatactactcagccataaaaaatgaatgagacctattgctcagaaaaaaatcgtttttaaaaaatagtactgctcattgacaatgcatctagttacctaagagtagttacctaagagctttgatgg

SEQ ID NO: 8120 - DNA, 345 bp, Homo sapiens
  AC003015.1_56706
  Located on chromosome 5
  Distance between a terminus base of telomere on chromosomal short arm and 5'-terminus of this base sequence : 12281256
  Distance between 3'-terminus of neighbour sequence of sequence listing upward to telomere on chrosomal short arm and 5'-terminus of this base sequence : 4741
gcactctgaacagacaataacttgcaaagatgttttattttgtatttgtgtgcctgactttgagaccctttcaacccagagtggtaatttggaactcctcctgcattgcctgtcttcccaatgaagcaacatcagtaggtgggtggggctgggggtgtctccgtctgcttcaagtcacaaatgcattttctgtttggttgagattttgaatactaagagatagatagatagatagatagatagatagatagatagatagatagataaattatggagatagatatacttgtatatttccaaaacagcttcagaaccattttgcttccagacaagtaaatgaagtaa

SEQ ID NO: 8121 - DNA, 221 bp, Homo sapiens
  AC003015_103384
  Located on chromosome 5
  Distance between a terminus base of telomere on chromosomal short arm and 5'-terminus of this base sequence : 12327999
  Distance between 3'-terminus of neighbour sequence of sequence listing upward to telomere on chrosomal short arm and 5'-terminus of this base sequence : 46398
tacctaaatacatagcctctgtatgaacctaaatatgcatattctacaatgccctagatgttaactatttaaatggcaaactgggtatttatatataattctatgttataaatacaaatattaaccttgtttatatttatatttattttattttattattattattattatttgagacggattctcactctgtcgccaggctggagtgcagtggtacaatc

SEQ ID NO: 8122 - DNA, 258 bp, Homo sapiens
  D5S630
  Located on chromosome 5
  Distance between a terminus base of telomere on chromosomal short arm and 5'-terminus of this base sequence : 12348472
  Distance between 3'-terminus of neighbour sequence of sequence listing upward to telomere on chrosomal short arm and 5'-terminus of this base sequence : 20252
catgacgatgtgggcagcccactgagaatggcagagccacagacagaaggagccacatccctaggaaatttgcagatggttgcaagccaacagttctggctcttcgctcttctttctccttcttctcctccttctccttctccttctccttctccttctccttctccttctccttcttcttcttcttctcccctttattacacacacacacacacacacacacacacacacacacacacacacttctacactgaaagg

SEQ ID NO: 8123 - DNA, 179 bp, Homo sapiens
  D5S2095
  Located on chromosome 5
  Distance between a terminus base of telomere on chromosomal short arm and 5'-terminus of this base sequence : 12541936
  Distance between 3'-terminus of neighbour sequence of sequence listing upward to telomere on chrosomal short arm and 5'-terminus of this base sequence : 193206
atgagccaccatgcctggccacgtgtctgaaacttgatgtgcgcgcgcgcgcacacacacacacacacacacacacacacacacacacacacacacacacacaaaatgattctaatctcatctaaacaaaatccatctgctgtttatcctattaaaatgaatggcatcactatccttga

SEQ ID NO: 8124 - DNA, 332 bp, Homo sapiens
  AC004615.1_14443
  Located on chromosome 5
  Distance between a terminus base of telomere on chromosomal short arm and 5'-terminus of this base sequence : 12549096
  Distance between 3'-terminus of neighbour sequence of sequence listing upward to telomere on chrosomal short arm and 5'-terminus of this base sequence : 6981
agttataggaagccaactccacctccagtgagcctggagggcaggaggccaaagcacccaggatgcaggaaagcttgtgggtgggggtgggtgcgggagaggaaggagttcctgaagatctctgtcttggctgaagaggggtaggcaggccccaggccaagagtacagggccttagaaaggaagtgcttctctgaggagggaataaaactatttttctctctctctgtcacacacacacacacacacacacacacacacacacgatgtcttgtgatgttatgcacccagtcaggccttgaaatggctcatgttacagctgaacaagtggtct

SEQ ID NO: 8125 - DNA, 212 bp, Homo sapiens
  DISO7_10001719
  Located on chromosome 5
  Distance between a terminus base of telomere on chromosomal short arm and 5'-terminus of this base sequence : 12618053
  Distance between 3'-terminus of neighbour sequence of sequence listing upward to telomere on chrosomal short arm and 5'-terminus of this base sequence : 68625
tctggaagatgacaaagctgctgatatattggaccaggggaccaagatttcccctgagaacttcccttaaaaaagaaggggagaattcagtatatatgtatatgtatgtatgtgtatatatgtgtgtgtgtgtgtgtgcgtgtaaatatatatatatatatatatacgcacacacacacagtatatatactgtatattgagatcctagccct

SEQ ID NO: 8126 - DNA, 110 bp, Homo sapiens
  DISO7_10001720
  Located on chromosome 5
  Distance between a terminus base of telomere on chromosomal short arm and 5'-terminus of this base sequence : 12632252
  Distance between 3'-terminus of neighbour sequence of sequence listing upward to telomere on chrosomal short arm and 5'-terminus of this base sequence : 13987
actcacagggactgcatgccattgctccttggtatctgtctctgtctcctttctctctctctctctctctttctctctctctctctctttcctgcttctacatcctcctt

SEQ ID NO: 8127 - DNA, 218 bp, Homo sapiens
  DISO7_10001721
  Located on chromosome 5
  Distance between a terminus base of telomere on chromosomal short arm and 5'-terminus of this base sequence : 12639767
  Distance between 3'-terminus of neighbour sequence of sequence listing upward to telomere on chrosomal short arm and 5'-terminus of this base sequence : 7405
tttggcacagacagcatctatctcttatctctctctctctctctctctctctctaatatctatctatctattacctgttatctatcatctatcatctgttatctatcatttgatatttatttatcatctgttatctatcatctgcctattatctgttatctatctatctatctatctattttttagtaagaccatgtatcacatgcgtggagatgtac

SEQ ID NO: 8128 - DNA, 464 bp, Homo sapiens
  AC022446.3_158084
  Located on chromosome 5
  Distance between a terminus base of telomere on chromosomal short arm and 5'-terminus of this base sequence : 12715794
  Distance between 3'-terminus of neighbour sequence of sequence listing upward to telomere on chrosomal short arm and 5'-terminus of this base sequence : 75809
cgtttgattctcacaatgatactgtatgttggatgttgttgttattcaaaaacaggaaacagagaaaatatactggtaaataatgtgagtaaattcacacagccagtaggtggaagtattgagccatgtatacatatatctctatactcatgtatgtgatacacacatatacacagacacaaatgtgcgcatccatctattaaaatctatctattatctatctatctatgtatctatctatctatctatctatctatctatctatctatctatctatctatcatcatctgtcttttagtagaaacctcaggaaaagaactttagtctaccagtagcttttaacctatgtttaatttaatttaattttaagttatccgcttttaattttaatgaatatctagataaaaatagatttgccctggaagcttctacagcagttttatctacataaactgtgacaatgg

SEQ ID NO: 8129 - DNA, 453 bp, Homo sapiens
  AC004615.1_181143
  Located on chromosome 5
  Distance between a terminus base of telomere on chromosomal short arm and 5'-terminus of this base sequence : 12715805
  Distance between 3'-terminus of neighbour sequence of sequence listing upward to telomere on chrosomal short arm and 5'-terminus of this base sequence : -453
cacaatgatactgtatgttggatgttgttgttattcaaaaacaggaaacagagaaaatatactggtaaataatgtgagtaaattcacacagccagtaggtggaagtattgagccatgtatacatatatctctatactcatgtatgtgatacacacatatacacagacacaaatgtgcgcatccatctattaaaatctatctattatctatctatctatgtatctatctatctatctatctatctatctatctatctatctatctatctatcatcatctgtcttttagtagaaacctcaggaaaagaactttagtctaccagtagcttttaacctatgtttaatttaatttaattttaagttatccgcttttaattttaatgaatatctagataaaaatagatttgccctggaagcttctacagcagttttatctacataaactgtgacaatgg

SEQ ID NO: 8130 - DNA, 201 bp, Homo sapiens
  G08443
  Located on chromosome 5
  Distance between a terminus base of telomere on chromosomal short arm and 5'-terminus of this base sequence : 12715902
  Distance between 3'-terminus of neighbour sequence of sequence listing upward to telomere on chrosomal short arm and 5'-terminus of this base sequence : -356
ggtggaagtattgagccatgtatacatatatctctatactcatgtatgtgatacacacatatacacagacacaaatgtgcgcatccatctattaaaatctatctattatctatctatctatgtatctatctatctatctatctatctatctatctatctatctatctatctatcatcatctgtcttttagtagaaacctca

SEQ ID NO: 8131 - DNA, 468 bp, Homo sapiens
  AC022446.3_95830
  Located on chromosome 5
  Distance between a terminus base of telomere on chromosomal short arm and 5'-terminus of this base sequence : 12825391
  Distance between 3'-terminus of neighbour sequence of sequence listing upward to telomere on chrosomal short arm and 5'-terminus of this base sequence : 109288
ttctgtagctcaccttgtctacttctgattctaccgagcacttgctactgaaattaaaagacagtagtctcctggagtagtgttgcttgttcattttatttatttatttatttatttatttatttatttatttatttattgagacagagtctcactctgttgcctggagtgcagtggcatgatctcagttcactgcaacctctgcctcccatgttcaagtgattcttctgcctcagcctcccgagtaactggattacaggcacttgataccacagtcagctaatttttatgtttttagtagagacggggtttcaccatgttggccaggctggtcttaaactcccgacctcaagtgacccacctgtttcagcctcccaaagtgctgggattatagccatgagccaccacactcagcccttattttttaaaaagagatttggctatccagccaacttaagtgatgtactg

SEQ ID NO: 8132 - DNA, 446 bp, Homo sapiens
  AC022446.3_94137
  Located on chromosome 5
  Distance between a terminus base of telomere on chromosomal short arm and 5'-terminus of this base sequence : 12827115
  Distance between 3'-terminus of neighbour sequence of sequence listing upward to telomere on chrosomal short arm and 5'-terminus of this base sequence : 1256
ttcatttggaaacagcttaagtgtccatcaatagatgaatggataaagaagctgtgggacacacacacacacacacacacacacacacacacacacacacacacacagtggaatattatacagccttaaaaatgagatcctgtgatttgtcacagcatggatggatgtggcacacattatgctaaataaaataaaccaaacaaagaaagagaaatagtgcattatctcacttagatgtgaaatataaaaaacaaaaggtctcatatatggagagagaaaataaaacagtggttgttaggttggcaggagagtgcagggggaatgaggagatataggtcaaataacacaaagtagcaaatatgtagaatgaacaccttgaaagacctaacgtataacattaggactatagttaatgatggtgtgttgtattcagaaatttgctacat

SEQ ID NO: 8133 - DNA, 474 bp, Homo sapiens
  chr5.fa.O7frz.7185380
  Located on chromosome 5
  Distance between a terminus base of telomere on chromosomal short arm and 5'-terminus of this base sequence : 12937135
  Distance between 3'-terminus of neighbour sequence of sequence listing upward to telomere on chrosomal short arm and 5'-terminus of this base sequence : 109574
gatggaaattagatcagtttgtagaagagacatctgaactttcatgttcttagtgccactctttacattagccgagatgtggaatcaacctgagtgttcatcaatacatgaataggtagtaaaaatacacacacacacacacacacacacacacacacacacacacacacaatggaatactattcagccataaaaagaatgaaaccctgtcattttgacaacatggatgattctggaggacattatgataactgaaataagataagccaggcacagaaagacaaatagcacatgatctcacgcgtgtgtggaattttaaaaagttcatattacagaagtagagagtataatggtggttaccagggcctgggatggctatggggagagattatgaggagatgttggtcaaagccttaataattatagttaggagaaataaatttatatctattgtgtagcaaggtaaggctagat

SEQ ID NO: 8134 - DNA, 464 bp, Homo sapiens
  chr5.fa.O7frz.7814519
  Located on chromosome 5
  Distance between a terminus base of telomere on chromosomal short arm and 5'-terminus of this base sequence : 13197160
  Distance between 3'-terminus of neighbour sequence of sequence listing upward to telomere on chrosomal short arm and 5'-terminus of this base sequence : 259551
ttccataggaactttacaggacactaaagataacattggtttagaattcaccttttactctttggagcattgtatgtatgtgcgtttgtgtgtgcgtgtgtgtgtgtatgtatataaacgtttgtatagctgtttagtattttttttgtgtgtataaacatttgtatagctgtttagtattttgtgtgtgtgtgtgtgtgtgtgtgtgtataaacatttgtatagccattttcatctacacattccattgcatgaagaattacccagagattcttaatgattatattttaaggcaagaagctatgtttaatctgcaaagtatgtgtttatgttttggtgcatggaattttatgtatataacccaggtagtttgtcagaagtgatacatttcatcctgtctaggacagtgttaggcaaatattaataagtggattaatacagtcgtatgtgaatactagttggtt

SEQ ID NO: 8135 - DNA, 310 bp, Homo sapiens
  AC002087.1_58814
  Located on chromosome 5
  Distance between a terminus base of telomere on chromosomal short arm and 5'-terminus of this base sequence : 13299005
  Distance between 3'-terminus of neighbour sequence of sequence listing upward to telomere on chrosomal short arm and 5'-terminus of this base sequence : 101381
agaaacatgctcttcagatgacaaaaatccaaatatttttactgagaactcaactcattcatatgcacacacacaaaaacaacgaattgaatttcagagtatagtaggttgaatagtggcctcccaaaagatatgcttacatcctaatttatttttagtgttaactatatcctaggtattattccaagtaattatatgtgcgtgcacacacacacacacacacacacacacacacagagggagagagagagagagaattaaagtaattggcttatatgtttatgggggctggcaagtctgaaatttgtag

SEQ ID NO: 8136 - DNA, 197 bp, Homo sapiens
  AC002087.1_101014
  Located on chromosome 5
  Distance between a terminus base of telomere on chromosomal short arm and 5'-terminus of this base sequence : 13341298
  Distance between 3'-terminus of neighbour sequence of sequence listing upward to telomere on chrosomal short arm and 5'-terminus of this base sequence : 41983
tagtcatggaagttgaggtaagtcttcaccccagttttctcatccactgaatggggtttattatgtcaatttttctagaattaacattgatcaaatgagtatcaactgtcagtgtgtgtgtgtgtgtgtgtgtgtgtgtgtgtgtaatgagggggagttgtctgtgcaagttaaaagcctatggtagaaataggatc

SEQ ID NO: 8137 - DNA, 424 bp, Homo sapiens
  AC002087.1_136866
  Located on chromosome 5
  Distance between a terminus base of telomere on chromosomal short arm and 5'-terminus of this base sequence : 13377045
  Distance between 3'-terminus of neighbour sequence of sequence listing upward to telomere on chrosomal short arm and 5'-terminus of this base sequence : 35550
tgcatagtaagacttgcagtgtggaggagccaaggccacttatattttccttggacaggcctgctgaagagacagaagacagaggccacctgaccatgagcccttatcctccccaaattgactagttagaggaatcagtcccctacctggaggcaaaaagctatagaggtgatcacaggcccatcatataggtcacatctaatcaatgttctcttaacacacacacacacacacacacacacacacacacacacacacaagctttaacatattgctaaatgaagaaactccataccagtttagaacactgagtagaagttactatgatatgttgtatgtcataaattaaagctaagagagttaataagggataatatgagagatatgctaaaaatactttgtacatggtatgtagtcaaacgaa

SEQ ID NO: 8138 - DNA, 436 bp, Homo sapiens
  AC017010.3_16253
  Located on chromosome 5
  Distance between a terminus base of telomere on chromosomal short arm and 5'-terminus of this base sequence : 13379195
  Distance between 3'-terminus of neighbour sequence of sequence listing upward to telomere on chrosomal short arm and 5'-terminus of this base sequence : 1726
acacttataagcagaaccagtcacataatttgtgaagccagcgcaaaaatgaaaatgtatcatttgaccaacaagtctcagtttccctaataccaacccctatccatcactgcccctctccccagtccttgatagccaccattctactctgtttctattaatgcactgcagtttattgttgttattattattattattattattattattccacatataagtaagaccatgctatatttttccttctgtatctggcttatttgatttagaatgtttttcaggttcacccaccttgtcccaagcagcaagagtttcttccttttttagggctgaataatattccattgttaatatcccactattgcttaattcatgtattcattgttggatgcttaggttgattccatttcttgtctattgtcagtaatgttgcaag

SEQ ID NO: 8139 - DNA, 213 bp, Homo sapiens
  D5S1957
  Located on chromosome 5
  Distance between a terminus base of telomere on chromosomal short arm and 5'-terminus of this base sequence : 13428690
  Distance between 3'-terminus of neighbour sequence of sequence listing upward to telomere on chrosomal short arm and 5'-terminus of this base sequence : 49059
ggtttgtagatctccatttctgttgtgtgtgtgtgtgtgtgtgtgtgtgtgtgtgtgtgtgtgtgtctgtgttttcctttggtagtgttatgtttctctgattagttttgactcctgtgactttgtcatggtgtctccacactcaaggtaatggacacctcttgaagtcttcactgactggttttggtaggaaaagtccttcaccaatcagcc

SEQ ID NO: 8140 - DNA, 449 bp, Homo sapiens
  chr5.fa.O7frz.8133011
  Located on chromosome 5
  Distance between a terminus base of telomere on chromosomal short arm and 5'-terminus of this base sequence : 13550366
  Distance between 3'-terminus of neighbour sequence of sequence listing upward to telomere on chrosomal short arm and 5'-terminus of this base sequence : 121463
tttcaataacacagcttctgactgctggaatagagtccaaaatgcatgtttacatggagctggaaataagacagctcagatctttggaattagaagtgcaactgatatatatatatagatatatatatacacacacacatatatgtagagagagagatatgtatatatgtacacatatatacacattaagatatgtatgttactgatatatatatatatatatatatacacacacacacacaaacacacaattaatggacaccaccaccattgtaattatagtatcaatatagaaataaataatagtacttgaaatgtggcttttgtgaagcatatgggaagcatttcaatgtttacgagtattgctctccagccatggctgcaactcccagtaaatatacttgtatttcatttttccaatgcaactaccatagataactgcacaattc

SEQ ID NO: 8141 - DNA, 420 bp, Homo sapiens
  chr5.fa.O7frz.8256089
  Located on chromosome 5
  Distance between a terminus base of telomere on chromosomal short arm and 5'-terminus of this base sequence : 13655777
  Distance between 3'-terminus of neighbour sequence of sequence listing upward to telomere on chrosomal short arm and 5'-terminus of this base sequence : 104962
ctccatgtgacaaattcagtagttcgggtactgtaccgccattttattttattttattttattttattttatttattttattttaattaattaatttattttttgagacggagtctcgctctgttgcccaggctggagtgcagtggcgtgatctcggctcactgcaagctctgcctcccgggttcacaccattctcctcctcagccacccgagtagttgggactacaggcgcccgccaccacgcccagctaattttttgtatttttagtagagacggggtttcaccgtgttagccaggatggtcttgatctcctgacctggtgatctgccccctcggcctcctaaagtgatgggattacagcgtgagccaccacgcccagcctctaccaccattttattaactatccttactgcacttgg

SEQ ID NO: 8142 - DNA, 148 bp, Homo sapiens
  DISO7_10001742
  Located on chromosome 5
  Distance between a terminus base of telomere on chromosomal short arm and 5'-terminus of this base sequence : 13700286
  Distance between 3'-terminus of neighbour sequence of sequence listing upward to telomere on chrosomal short arm and 5'-terminus of this base sequence : 44089
tgaacagttcagtttctcaggtaaagatgggacggtttcaccaatgggatctgtaaactagaacaaatttatttatttatttatttatttatttatttatttatttatctatctagctacatgaaaaatggccttggtagtgacattg

SEQ ID NO: 8143 - DNA, 352 bp, Homo sapiens
  chr5.fa.O7frz.8363980
  Located on chromosome 5
  Distance between a terminus base of telomere on chromosomal short arm and 5'-terminus of this base sequence : 13833317
  Distance between 3'-terminus of neighbour sequence of sequence listing upward to telomere on chrosomal short arm and 5'-terminus of this base sequence : 132883
gtgattcctaatctacagtgtgagagaataaatatgtgttgttttgtatcaggatcactagggtatctatctattaataactaaatatctatcatctatcaatccatccatctacctatctaatttattgttctgtgtctatctctatgaataaattggcttgtatctatctatctatctatctatctatctatctatctatcatctatctatctatcatctatctctatctctctctatctctatcgctctatatgtttatctctatctccatctctctccctgaaaaaattggcttgtgcaactgcaggggctgccaagtctaaaatctgatgagttagcttgctagcag

SEQ ID NO: 8144 - DNA, 155 bp, Homo sapiens
  DISO7_10001741
  Located on chromosome 5
  Distance between a terminus base of telomere on chromosomal short arm and 5'-terminus of this base sequence : 13898678
  Distance between 3'-terminus of neighbour sequence of sequence listing upward to telomere on chrosomal short arm and 5'-terminus of this base sequence : 65009
catgttcgaagcagaaaccctgatccccccaatacacacacacacacacacacacacacacacaaaataattactccagaattctctcctatctcagtaaaagacaagcctcttttcagtcagttgagctaaaaaccctggaataatccttgtct

SEQ ID NO: 8145 - DNA, 217 bp, Homo sapiens
  DISO7_10001743
  Located on chromosome 5
  Distance between a terminus base of telomere on chromosomal short arm and 5'-terminus of this base sequence : 14124569
  Distance between 3'-terminus of neighbour sequence of sequence listing upward to telomere on chrosomal short arm and 5'-terminus of this base sequence : 225736
tgtgtatgtttgcatatacatgtgtgtgcctgtgcatgtgtgtgtgtgtgtgtgtgtatcagttactttactgttatgccctttaaaagtgcccatggccaaatttttgttggtgtcttttatgatgtttgctaagattctttgcattttattttcccttgcaatattttagacttggtacccattagggttttcttaagctgcaagtaacacaaac

SEQ ID NO: 8146 - DNA, 101 bp, Homo sapiens
  DISO7_10001745
  Located on chromosome 5
  Distance between a terminus base of telomere on chromosomal short arm and 5'-terminus of this base sequence : 14147195
  Distance between 3'-terminus of neighbour sequence of sequence listing upward to telomere on chrosomal short arm and 5'-terminus of this base sequence : 22409
aatgtgtaattccctattgccctgaatacatacacacacacacacacacacacacacacacacacccttatcccacattggtattataaccatgtttgcca

SEQ ID NO: 8147 - DNA, 253 bp, Homo sapiens
  DISO7_10001746
  Located on chromosome 5
  Distance between a terminus base of telomere on chromosomal short arm and 5'-terminus of this base sequence : 14165408
  Distance between 3'-terminus of neighbour sequence of sequence listing upward to telomere on chrosomal short arm and 5'-terminus of this base sequence : 18112
agcttcctccaccttatcaccctcccctcccactggccaaaaccctgaaggggctatatcaacatatatatatatataaaacactcctatattctatcaacaataaactgcaaatgaaagaaagggaaaaaggaaggaaggaaggaaggaaggatggataaagtctacaaactctttaaaattactgcttatatcatgggaaaatgccaatgtctgttttgacatatttttagaactggcagactaatttgct

SEQ ID NO: 8148 - DNA, 292 bp, Homo sapiens
  DISO7_10001748
  Located on chromosome 5
  Distance between a terminus base of telomere on chromosomal short arm and 5'-terminus of this base sequence : 14217436
  Distance between 3'-terminus of neighbour sequence of sequence listing upward to telomere on chrosomal short arm and 5'-terminus of this base sequence : 51775
aattcaagtgttaactcagagggtttgattataaaatactttggtttcctgggttatttctgtatccagaatttttccaatgagcatactatttttgaaaaaacccatatatatatatatatatatatatatatatatatatatgcacacacacacacacaaatatatacatacacacacatatatacacacacatatatatacacatatacagacatacacacacactttacacaaattttaaaagggtagagctgaaccaaaattgtgacttaatcggtaagctttcatt

SEQ ID NO: 8149 - DNA, 258 bp, Homo sapiens
  D5S1953
  Located on chromosome 5
  Distance between a terminus base of telomere on chromosomal short arm and 5'-terminus of this base sequence : 14423078
  Distance between 3'-terminus of neighbour sequence of sequence listing upward to telomere on chrosomal short arm and 5'-terminus of this base sequence : 205350
cagcagagtgagactccatctcaaatatatatatatatatatacacacacacacacacacacacacacacacacacaattctcttcactggtgaaaaggagaaacaaaaacttatagaaaaaaagcaagtgaacatgacaaagatctgcacaacccaagagtggacaaatcttcaggagaagggattcaaggaaccggttcatgagaaaaactggagaggacagcaactatatggaaacagaaacttcagttgaggaa

SEQ ID NO: 8150 - DNA, 260 bp, Homo sapiens
  DISD22_0004489
  Located on chromosome 5
  Distance between a terminus base of telomere on chromosomal short arm and 5'-terminus of this base sequence : 14612978
  Distance between 3'-terminus of neighbour sequence of sequence listing upward to telomere on chrosomal short arm and 5'-terminus of this base sequence : 189642
ttcctcatgtctatgaatgaatatcattacaactagtgtgatctttctttttctttctttctctttctttctttctttctttctttctctttctctttctctctctctctcttctttctctctctctctctttctttctctctctctctttctcccccctcctctgctataagataatataaagatattttacctttgaattcgcccttgggaactttcatacccactaagccctttcctcccactcacgggaggtagct

SEQ ID NO: 8151 - DNA, 334 bp, Homo sapiens
  AC016648.5_54805
  Located on chromosome 5
  Distance between a terminus base of telomere on chromosomal short arm and 5'-terminus of this base sequence : 14729252
  Distance between 3'-terminus of neighbour sequence of sequence listing upward to telomere on chrosomal short arm and 5'-terminus of this base sequence : 116014
caaacatcctgtcaaagtttaaacccaaaaatcttttaagaataaaattctgcttggcatttggtaccaggaaaatttcctcactaggatgtcttggatgttgccttagaactgtgtgggcttgaatgatttaacgttatctcctttggaatgggaccactacacacacacacacacgtgcacaaacacacacacacacacacacacacacacacacaccccatctcaaagcattgcatgaaagttaaatgctgttttcaaactagcatctgtaactctaaaagtatagaaaatcagaaccaacccaaatgtccaacaatgatagactggatta

SEQ ID NO: 8152 - DNA, 180 bp, Homo sapiens
  DISO7_10001782
  Located on chromosome 5
  Distance between a terminus base of telomere on chromosomal short arm and 5'-terminus of this base sequence : 14797610
  Distance between 3'-terminus of neighbour sequence of sequence listing upward to telomere on chrosomal short arm and 5'-terminus of this base sequence : 68024
gtgcatactggcctactgacaaaacaacaaattgcagttttatttagcctcaatttctttgtaattatttaaactgactcccattaaacacacacacacacacacacacacacacacacacacacacacacgccatatttttatgacaaataactgaatagttaacagttccaagactca

SEQ ID NO: 8153 - DNA, 144 bp, Homo sapiens
  DISO7_10001781
  Located on chromosome 5
  Distance between a terminus base of telomere on chromosomal short arm and 5'-terminus of this base sequence : 14799305
  Distance between 3'-terminus of neighbour sequence of sequence listing upward to telomere on chrosomal short arm and 5'-terminus of this base sequence : 1515
ccatatctgagatgctcacttatactctttacaaggacatcaatagatcatatatatatatatatatatgcacatatatatgtacacacatatatatatatattatatatgcatgtaatatagagatcattgcacatgtcatga

SEQ ID NO: 8154 - DNA, 102 bp, Homo sapiens
  DISO7_10001777
  Located on chromosome 5
  Distance between a terminus base of telomere on chromosomal short arm and 5'-terminus of this base sequence : 14942328
  Distance between 3'-terminus of neighbour sequence of sequence listing upward to telomere on chrosomal short arm and 5'-terminus of this base sequence : 142879
ggatctaaactgcatctgtctctccctctccctctctctctctctctccctctctctctctgctatacttttgtttctgttggcttccctcctaggcagact

SEQ ID NO: 8155 - DNA, 157 bp, Homo sapiens
  DISO7_10001776
  Located on chromosome 5
  Distance between a terminus base of telomere on chromosomal short arm and 5'-terminus of this base sequence : 14963888
  Distance between 3'-terminus of neighbour sequence of sequence listing upward to telomere on chrosomal short arm and 5'-terminus of this base sequence : 21458
gattcaactgatactgatttcctctttcctatcccacttcagggaaaggaaagtcaagtttggggactatttatggtaagtatacacacacacacacacacacacacacacacacacacacctgtgtatatatgtatcatacagaaggagtgtgctt

SEQ ID NO: 8156 - DNA, 231 bp, Homo sapiens
  D5S1991
  Located on chromosome 5
  Distance between a terminus base of telomere on chromosomal short arm and 5'-terminus of this base sequence : 15045854
  Distance between 3'-terminus of neighbour sequence of sequence listing upward to telomere on chrosomal short arm and 5'-terminus of this base sequence : 81809
tgtgtcttttcacaaatataaccaaattcacacacacacacacacacacacacacacacacacccccatattcatatttctctccctttttgcccccaaaatagcataataccattttatgatttggcaccttgcttttctcacttaacaaaatattctacagattattccatatcagtatatagaattcttccccattcctttttacagcacacattttgaagcatctgt

SEQ ID NO: 8157 - DNA, 225 bp, Homo sapiens
  AC025456.3_33715
  Located on chromosome 5
  Distance between a terminus base of telomere on chromosomal short arm and 5'-terminus of this base sequence : 15102534
  Distance between 3'-terminus of neighbour sequence of sequence listing upward to telomere on chrosomal short arm and 5'-terminus of this base sequence : 56449
caggagtgagatcttaatttacaccatagtatttggtccaaaatatatgggcatgtgtctcccattggcgttatataatgagttgcaaaggttgttagagattaggcttaatgtgtgtgtgtgtgtgtgtgtgtgtgtgtgtgtgtgtgtatatttttgttgttgttgttgttgttgttattgttgagacgagctttcactctgtcattcagactgtagtgcagt

SEQ ID NO: 8158 - DNA, 252 bp, Homo sapiens
  AC025456.3_33760
  Located on chromosome 5
  Distance between a terminus base of telomere on chromosomal short arm and 5'-terminus of this base sequence : 15102608
  Distance between 3'-terminus of neighbour sequence of sequence listing upward to telomere on chrosomal short arm and 5'-terminus of this base sequence : -151
ataatgagttgcaaaggttgttagagattaggcttaatgtgtgtgtgtgtgtgtgtgtgtgtgtgtgtgtgtgtgtatatttttgttgttgttgttgttgttgttattgttgagacgagctttcactctgtcattcagactgtagtgcagtggtgccatctcctctcactatagcctcgaccttccaggttctagggatcctcccacctcagcctcccaagtagttgggactatagacgcacactaccatgc

SEQ ID NO: 8159 - DNA, 252 bp, Homo sapiens; identical to SEQ ID NO: 8158
  AC016649.3_39577
  Located on chromosome 5
  Distance between a terminus base of telomere on chromosomal short arm and 5'-terminus of this base sequence : 15102608
  Distance between 3'-terminus of neighbour sequence of sequence listing upward to telomere on chrosomal short arm and 5'-terminus of this base sequence : -252

SEQ ID NO: 8160 - DNA, 276 bp, Homo sapiens
  AC026793.2_32212
  Located on chromosome 5
  Distance between a terminus base of telomere on chromosomal short arm and 5'-terminus of this base sequence : 15286771
  Distance between 3'-terminus of neighbour sequence of sequence listing upward to telomere on chrosomal short arm and 5'-terminus of this base sequence : 183911
taagctagtcatttcatgcatcccttcaaaaatattttttcgtatagtaggccctgaggatacaacagtaaacaaagcaaaatccctttcctcatggatcttacattccagtgaaatagacaataaattgtgtgtgtgtgtgtgtatgtgtgtgtcaagttcagtggaaaaaaatgaaggagaataaaggggtagtgactgacagatattctgtttgttgttgttgtttttgagttccgggatacatgtgcagaactcacaggtttgttacatagg

SEQ ID NO: 8161 - DNA, 168 bp, Homo sapiens
  DISO7_10016437
  Located on chromosome 5
  Distance between a terminus base of telomere on chromosomal short arm and 5'-terminus of this base sequence : 15518123
  Distance between 3'-terminus of neighbour sequence of sequence listing upward to telomere on chrosomal short arm and 5'-terminus of this base sequence : 231076
aattacagcagaaaccgaccctacaaaaaccatatccacaagaaccttttctttaagtcattctttttccagatcatcatgttttgacttccatatgtgcatgtgtatgtgtgtgtgtgtgtgtgtgtgtgtgtatctatgtatatttccttgtcttgggcagtgatt

SEQ ID NO: 8162 - DNA, 176 bp, Homo sapiens
  D5S1989
  Located on chromosome 5
  Distance between a terminus base of telomere on chromosomal short arm and 5'-terminus of this base sequence : 15642813
  Distance between 3'-terminus of neighbour sequence of sequence listing upward to telomere on chrosomal short arm and 5'-terminus of this base sequence : 124522
gggaattatcttccaaaatgcatcatccagaatgaccagaatatcatatgatagtcttagaagaaaattcgtttcgtgtgtgtgtgtgtgtgtgtgtgtgtgtgtgtgtgtgtgtatgtgtacaccatgcacttaaggaaattgtaaagtaatatttaatcgagatgtccagagct

SEQ ID NO: 8163 - DNA, 235 bp, Homo sapiens
  D5S1954
  Located on chromosome 5
  Distance between a terminus base of telomere on chromosomal short arm and 5'-terminus of this base sequence : 15835040
  Distance between 3'-terminus of neighbour sequence of sequence listing upward to telomere on chrosomal short arm and 5'-terminus of this base sequence : 192051
tgaatgtcccattatttcgtgtgtgtgtgtgtgtgtgtgtgtgtgtgtgtgtgtgtgtgagagagagagagatttaaaattcccatgggataaattataaaaatagaaatgaagaagaacatattagttattcatatacctgtgcatctgaaattagccattttcctcactgaatacataatgatttccgagatgaagagcagttaacccaatggcctcctaaatactaaactcc

SEQ ID NO: 8164 - DNA, 319 bp, Homo sapiens
  AC022120.4_86364
  Located on chromosome 5
  Distance between a terminus base of telomere on chromosomal short arm and 5'-terminus of this base sequence : 16056263
  Distance between 3'-terminus of neighbour sequence of sequence listing upward to telomere on chrosomal short arm and 5'-terminus of this base sequence : 220988
ctgttcgattgaacactagaacatattccttctaattaactgtacatttgcaccctttaaccaacttctcttcctcctttccccctttcccattctggtaactgtcattccactctctaccttcatgagaccaacacctttagcgcccacatataaatgagaacgtgtgtgtgtgtgtgtgtgtgtgtatgtgtgtgtgtgtgtgagagagagagagagagagttgctggtgatgaagccaagatcaaaaactagagcctgatttccacccatgttttactgtataatgccccttcttctgagtgcctatcttccaata

SEQ ID NO: 8165 - DNA, 99 bp, Homo sapiens
  D5S1992
  Located on chromosome 5
  Distance between a terminus base of telomere on chromosomal short arm and 5'-terminus of this base sequence : 16056405
  Distance between 3'-terminus of neighbour sequence of sequence listing upward to telomere on chrosomal short arm and 5'-terminus of this base sequence : -177
gcgcccacatataaatgagaacgtgtgtgtgtgtgtgtgtgtgtgtatgtgtgtgtgtgtgtgagagagagagagagagagttgctggtgatgaagcca

SEQ ID NO: 8166 - DNA, 220 bp, Homo sapiens
  Z66863
  Located on chromosome 5
  Distance between a terminus base of telomere on chromosomal short arm and 5'-terminus of this base sequence : 16121112
  Distance between 3'-terminus of neighbour sequence of sequence listing upward to telomere on chrosomal short arm and 5'-terminus of this base sequence : 64608
ctggaaggttgtaggctggctaatgagtttggactctgaggtcagatttgaattgagggtctgttactccatctctttgctgtatggctttgagcaaaaagaacctattttcctcacctttaaaattgtataatagtaattattacataaggttatggtaaggactaaaggaaacacacacacacacacacacacacacacatcccacatcccacagtgc

SEQ ID NO: 8167 - DNA, 281 bp, Homo sapiens
  DISO7_00001299
  Located on chromosome 5
  Distance between a terminus base of telomere on chromosomal short arm and 5'-terminus of this base sequence : 16456610
  Distance between 3'-terminus of neighbour sequence of sequence listing upward to telomere on chrosomal short arm and 5'-terminus of this base sequence : 335278
tgagcaatccctgaatacagccgacaggctgcacccacacaaccgtggagcaccttattcactaccagaccctccatgacccagagccagccatcgccactgccactttaaactttgatactctgttcctctcatccgtattccgtgtagttaaacatacatcacacacagacacacacacacacacacacatgcacatatgtgtgcgtatgtatgcgtgtgtatgtgtgtgcagctcataagcctggtgccaaaagaaatgtgcaccagaaactacgtca

SEQ ID NO: 8168 - DNA, 215 bp, Homo sapiens
  DISO7_10001789
  Located on chromosome 5
  Distance between a terminus base of telomere on chromosomal short arm and 5'-terminus of this base sequence : 16537247
  Distance between 3'-terminus of neighbour sequence of sequence listing upward to telomere on chrosomal short arm and 5'-terminus of this base sequence : 80356
tccaaccttcacatgaaatatcagagaaaaatgactccctttttggttttgcttttcaagtttttgtagggcaactgcaccccgctggagaacattttcagacagtgttgtcctctctctctctctctctctctctctctctcacacacacacacacacacacaccattcttgttaggttttaactttttcacatccttatgaatttatagtgca

SEQ ID NO: 8169 - DNA, 258 bp, Homo sapiens
  AC024588.2_84493
  Located on chromosome 5
  Distance between a terminus base of telomere on chromosomal short arm and 5'-terminus of this base sequence : 16674620
  Distance between 3'-terminus of neighbour sequence of sequence listing upward to telomere on chrosomal short arm and 5'-terminus of this base sequence : 137158
gatggtgttatggtgatgtaagaggacggctctattctgagtgatgcaagatccaacatttaggcatgaaatgccatgatgacagccgcctactttagcaaaagggaagttgtgtgtgtgtgtgtgtgtgtgtgtgtgtgtgtgtgtgtgtgtgtgtttttacgcgtatgcatataaatagaggaagtcgctgcagctagatggtgaatctacgtgaggagtatctggctgttccttgtactgttctttcaactttct

SEQ ID NO: 8170 - DNA, 290 bp, Homo sapiens
  D5S416
  Located on chromosome 5
  Distance between a terminus base of telomere on chromosomal short arm and 5'-terminus of this base sequence : 16765083
  Distance between 3'-terminus of neighbour sequence of sequence listing upward to telomere on chrosomal short arm and 5'-terminus of this base sequence : 90205
agtgaaactcggtccctaaagaaataaatgtgtgtgcgtgcgtgtgtgtgtgtgtgtgtgtgtgtgtgtgtgtgtgtgtgtgtatgtatgtatgtattagaagcctcccatagactaagcacccacacaaataactaatggtgtgggatgtccaagagcaaacccagtccctgctctgccctgacaaatgcaggcccttcccagattagatctgcttaggatgcaaaatggtagagagcccgagatctggcaacacaggagatcctcagagccctgacaaacagccccag

SEQ ID NO: 8171 - DNA, 284 bp, Homo sapiens
  AC010310.3_177797
  Located on chromosome 5
  Distance between a terminus base of telomere on chromosomal short arm and 5'-terminus of this base sequence : 16802300
  Distance between 3'-terminus of neighbour sequence of sequence listing upward to telomere on chrosomal short arm and 5'-terminus of this base sequence : 36927
cacctgtagtgccagctactcaggaggctgaggggggagaatcacttgcgcctgggagtttgaggctgcagtgaggcgtgattacaccactgcactccagtctgggtgacagaacaagaccctgtctcacacacacacaaacacacacacacacacacacacacacacacacacacacacacggaaaaaaaaaaagctttctcagagaagtcctggcaaaccgaccttctagaaaaagaaaactgaaaacctctgctggaagattaagagcctaggacaaggta

SEQ ID NO: 8172 - DNA, 253 bp, Homo sapiens
  AC010358_118072
  Located on chromosome 5
  Distance between a terminus base of telomere on chromosomal short arm and 5'-terminus of this base sequence : 16816504
  Distance between 3'-terminus of neighbour sequence of sequence listing upward to telomere on chrosomal short arm and 5'-terminus of this base sequence : 13920
catgattatctgacagaattgtcctaggtatataatatgtatataatactagaattttcatatctgagagaaaaaccaacaacaaaggttcagagaagaaaaataactttctcagggtcgcgcaaccaaaattcaaactctggcccaactgacccaaatctaggaacttactattatgatttattattattattattattattattattattattattattattttgatacagggtctcactcctgtcacctg

SEQ ID NO: 8173 - DNA, 360 bp, Homo sapiens
  AC010310.3_61573
  Located on chromosome 5
  Distance between a terminus base of telomere on chromosomal short arm and 5'-terminus of this base sequence : 16910684
  Distance between 3'-terminus of neighbour sequence of sequence listing upward to telomere on chrosomal short arm and 5'-terminus of this base sequence : 93927
tatccaagaggaaagcagtttaaaaataaattacaatgcctgtaatcccagcactttgggaggccgaggtgggtggatcacctgaggtcaggagttcaagaccagcgtgaccaatatggtgaaaccccgtctctcctaaaaatacaaaaattagccgggcgtggtggcaggcgtctgtagtcccagctactcgggaggcttagacaggagacttgcttgaacccaggaggtggaggttgcagtgagccaagatcgcaccactacactctagcctgggtgacagagttagactccgtctcgataataataataataataataatagtaaaaaataaataacaaacggagttattgcttaac

SEQ ID NO: 8174 - DNA, 266 bp, Homo sapiens
  D5S1997
  Located on chromosome 5
  Distance between a terminus base of telomere on chromosomal short arm and 5'-terminus of this base sequence : 17027380
  Distance between 3'-terminus of neighbour sequence of sequence listing upward to telomere on chrosomal short arm and 5'-terminus of this base sequence : 116336
gatgacaaaagcacatttacatacgagaaaatgctaatatgactaatgtttaagactaattcttatttaatagagaatataatcataacattctagatggtagggtgtgtgtgtgtgtgtgtgtgtgtgtgtgtgtgtgtgtgtgtgtgtattaattttttttaattttttgagacaaggtctggctctgtttcccaggctggagtgcagtggcacgatctccactcactgcaacctcgacctcatgggctctggtgatcctccca

SEQ ID NO: 8175 - DNA, 403 bp, Homo sapiens
  chr5.fa.O7frz.93668560
  Located on chromosome 5
  Distance between a terminus base of telomere on chromosomal short arm and 5'-terminus of this base sequence : 17322528
  Distance between 3'-terminus of neighbour sequence of sequence listing upward to telomere on chrosomal short arm and 5'-terminus of this base sequence : 294882
gatgtagcaaattggtaatgactcttgaagttgaaaattttataatttaaatttgggacaggattaaaagagaaaggtagtgatataattacaagctacatagctctcctttccatctttgcccacaattattgacaatctttaaaaggaattagttagattttccagtggaaacagttttagttcaataaatgccattttccatctaattatagttaataataataataataataataataatagctgagatttaccaagatttaggtaggtactagcatatcctaataactttacataaatttataaatttgatacttaacatactttacaattttgtccattttgggtaggggttgggagtgaggagattgaaatacaaagagattcaatgccttgactg

SEQ ID NO: 8176 - DNA, 169 bp, Homo sapiens
  D5S486
  Located on chromosome 5
  Distance between a terminus base of telomere on chromosomal short arm and 5'-terminus of this base sequence : 17583591
  Distance between 3'-terminus of neighbour sequence of sequence listing upward to telomere on chrosomal short arm and 5'-terminus of this base sequence : 260660
gagtgcttgagccccaggagtgtcaagagtcgagacagcctgggcttatggcaaaacctgatctctacacgctgtgtgtgtgtgtgtgtgtgtgtgtgtatacatatatagatatagatatgatattacacaatatttaagagactgggtctcattctgccactcaggc

SEQ ID NO: 8177 - DNA, 264 bp, Homo sapiens
  chr5.fa.O7frz.21660978
  Located on chromosome 5
  Distance between a terminus base of telomere on chromosomal short arm and 5'-terminus of this base sequence : 17691581
  Distance between 3'-terminus of neighbour sequence of sequence listing upward to telomere on chrosomal short arm and 5'-terminus of this base sequence : 107821
agtacgtaacttccattgtgatagtttcactctttacctacttccttccttccttctttccttccttccttccttctttccttccttcctctctccctcccttccttccttccttccttccttccttccttccttccactgactgcactctgaggcaaacgcttacattgggccagagcttgctggtttttcggactgcataaccctcattcttcatttgttcgggaagaacaaatataatttacttggaactttactcatcgt

SEQ ID NO: 8178 - DNA, 106 bp, Homo sapiens
  DISO7_10001792
  Located on chromosome 5
  Distance between a terminus base of telomere on chromosomal short arm and 5'-terminus of this base sequence : 17749063
  Distance between 3'-terminus of neighbour sequence of sequence listing upward to telomere on chrosomal short arm and 5'-terminus of this base sequence : 57218
aattgggtgagtcatgtgcacggtcatctgcgtgtgtgtgtgtgtgtgtgtctgtgtgtgtgtgtgtgtgtgaataagattagggacatggacatcaaattcctaa

SEQ ID NO: 8179 - DNA, 446 bp, Homo sapiens
  chr5.fa.O7frz.21859297
  Located on chromosome 5
  Distance between a terminus base of telomere on chromosomal short arm and 5'-terminus of this base sequence : 17751723
  Distance between 3'-terminus of neighbour sequence of sequence listing upward to telomere on chrosomal short arm and 5'-terminus of this base sequence : 2554
tccgaatatctaatggtgaattgtatgtgctcaaaaataatttattggtggggtgtggcagctcacacctataatccccatgctttgggaggccaaggtgggaggatagcttgagcccaggggttcaagatcagcctaggcaacatagtgagatctcatttgtacaaaataataataataataataataataataataatgagggtgtggtggctcatgcctgtggtctcagctactctggaggctgaggtgggaggatcgcttgaacccaggaggttggggctgcagggattgtaccactgcactctagtctgggtgacagagtgagatcctctctctctctctctcccaaaagaaaaaaatatgtacataaatttacacacacacacattatatatgttttattgatgtatgtggatcaaatggtttcggaagtatggttaggt

SEQ ID NO: 8180 - DNA, 121 bp, Homo sapiens
  DISO7_10001791
  Located on chromosome 5
  Distance between a terminus base of telomere on chromosomal short arm and 5'-terminus of this base sequence : 17913303
  Distance between 3'-terminus of neighbour sequence of sequence listing upward to telomere on chrosomal short arm and 5'-terminus of this base sequence : 161134
tcatcttactgaagataccctctcccctgatttcacatctcaaagcaaatgaatacagacacacacacacacacacacacacacacacgccaagacggcaaaggatggttccaaattcaca

SEQ ID NO: 8181 - DNA, 208 bp, Homo sapiens
  D5S2096
  Located on chromosome 5
  Distance between a terminus base of telomere on chromosomal short arm and 5'-terminus of this base sequence : 17934717
  Distance between 3'-terminus of neighbour sequence of sequence listing upward to telomere on chrosomal short arm and 5'-terminus of this base sequence : 21293
ttgactgtgacttgagaggaggtttctagaagaaattcaaagtttagatgaatgcctgagggtagtctcttcttaccttaatctacatgtttctaacccatcattatctcaaagttatcacacacacacacacacacacacacacacacacacacaccacagtttctcgacttcactgaaacccactgtcccctaaggatactgcttc

SEQ ID NO: 8182 - DNA, 456 bp, Homo sapiens
  chr5.fa.O7frz.24536920
  Located on chromosome 5
  Distance between a terminus base of telomere on chromosomal short arm and 5'-terminus of this base sequence : 18118352
  Distance between 3'-terminus of neighbour sequence of sequence listing upward to telomere on chrosomal short arm and 5'-terminus of this base sequence : 183427
atgaaaggaaatcctgagttagagagatggatagatggatggatggatggatggatggatggatggatggatagcaagacagatgaatggatggatgagtggacagataggtagttgatagatagatagatagatagatagatagatagatagatagataattgtgttctgcatcactctttttaaaatcttcattagatttttaatattgctcagaatgaaattgaacccttttattgtgaagtacctatctctataacataaagggttagttcctgcctaactttcaaatctcatctactttctgccaccctttgtttaaagtgattcaagcacactggtcttctcttgtcccataagcccaccaagttctcctctgccatgaaaattgtcactctttttgatatggtttggctgtgtccctacccaaatcttgtcttgaactgtagttctcat

SEQ ID NO: 8183 - DNA, 224 bp, Homo sapiens
  D5S419
  Located on chromosome 5
  Distance between a terminus base of telomere on chromosomal short arm and 5'-terminus of this base sequence : 18238214
  Distance between 3'-terminus of neighbour sequence of sequence listing upward to telomere on chrosomal short arm and 5'-terminus of this base sequence : 119406
tgcccagacttctcacctacagaaactgtgatataataaatatgtgtgtgtgtgtgtgtgtgtgtgtgtgtgtgtgtgtgtgtgtgtaaggccctatatttgtggtaatttgttatctaggaatagataaccaattaaaagtactcctggcatctagtaggtagagatcagggattgtgttaaatatgctaaaatgttcaggacagcaccccacaataaaagat

SEQ ID NO: 8184 - DNA, 256 bp, Homo sapiens
  DISD22_0004501
  Located on chromosome 5
  Distance between a terminus base of telomere on chromosomal short arm and 5'-terminus of this base sequence : 18394433
  Distance between 3'-terminus of neighbour sequence of sequence listing upward to telomere on chrosomal short arm and 5'-terminus of this base sequence : 155995
aacttgaattaagaaacaggtgcaaaataataaacaataactattatttttttcatcaagacttgaagtataaaaattatatatgttactcactacactgaaagtttaagaaagaaaatcacaaaatattattttgtgaactaatataggtaataatttaactaaaattaacaaaacttaaggatatatatatatatatatatatatatatatttacaaactaagaatttaaggaagaatctttaaccacataagg

SEQ ID NO: 8185 - DNA, 348 bp, Homo sapiens
  chr5.fa.O7frz.15117083
  Located on chromosome 5
  Distance between a terminus base of telomere on chromosomal short arm and 5'-terminus of this base sequence : 18598337
  Distance between 3'-terminus of neighbour sequence of sequence listing upward to telomere on chrosomal short arm and 5'-terminus of this base sequence : 203648
actgtagcatctattgcttcaattatttctttctggttcgtctagcttgatcgttctgatgaaacatcctgccatgttgtgagctgctccatggagagacccacatggcaaggaattgagggtggcgtctgaccaacagccagtgagcaactgaggctctcatcaaagagcccatgtggaactgcatcttgccacaccacacacacacacacacacacacacacacacacacacacacacacacgtaaacccggaagtgaatccttccaaaaccaagacatagttgactgcagccctggccagcaacttgactgaaacttgtgagagaccttgaatcagtggtcaagc

SEQ ID NO: 8186 - DNA, 462 bp, Homo sapiens
  chr5.fa.O7frz.109684320
  Located on chromosome 5
  Distance between a terminus base of telomere on chromosomal short arm and 5'-terminus of this base sequence : 18808040
  Distance between 3'-terminus of neighbour sequence of sequence listing upward to telomere on chrosomal short arm and 5'-terminus of this base sequence : 209355
agccagaaattccttgaacctgggaagcacatgttgcagtgagcctagattgcaccattgcactccagcctgggtgacaggaagaaactctgtctcaaaaaaaaaaaaaaaaagctagaaatttatagtggaaggaaaactggagaatcacaaatatgtgcaaattaaacaatacactcatcaataaccattgggtcaaagaaaaaaacaaaaaaaatttaaaaaattaaaaatacctaaagacaaattaaacacacacacacacacacacacacacacacacacacacacacacaacctcaaacataccaaaattcacgggatgaagcgaaagcagtactgagaaggaaatatatagcagtaaatacctacattgaaaaataagaaaaatttgaaataaatgacttatctttgtatctcaaaggactagaaaaataggtacaaagtaagctcaaagttagc

SEQ ID NO: 8187 - DNA, 326 bp, Homo sapiens
  AC018883.4_142520
  Located on chromosome 5
  Distance between a terminus base of telomere on chromosomal short arm and 5'-terminus of this base sequence : 19046449
  Distance between 3'-terminus of neighbour sequence of sequence listing upward to telomere on chrosomal short arm and 5'-terminus of this base sequence : 237947
gtttcagaatacaaagtcaatgtccagtagtcagtagtatttctatatagcaataatattcaagctgagaacaaaatcaagaactcaatctcatttacaatagccacacacacacacacacacacacacacacacacacacacataactgagaaatacgtttaaccaaggaggtaaaatatttctacaataagaactacaaaagatgggtggaagaaacctgaaataaaacaaactaatggaaaaatatcccatgttcatgggttaaaaaaaattaaaaatgaccatggtgtccaaagcaatctaaagattcaatgcaatttctat

SEQ ID NO: 8188 - DNA, 449 bp, Homo sapiens
  AC025779.4_46573
  Located on chromosome 5
  Distance between a terminus base of telomere on chromosomal short arm and 5'-terminus of this base sequence : 19077682
  Distance between 3'-terminus of neighbour sequence of sequence listing upward to telomere on chrosomal short arm and 5'-terminus of this base sequence : 30907
ttgataaaattctgtagcttcaacttctttctcctcaagattctttattacttatataatcactactttcaaaagctcctcaatttttggtatattaatgtttcttagggtcatttggacttggacatagagttacagcttctgtgaaaatatttttatgtgattgttctcgaggagtagacatgaggataaatcaaaagaaggtacatttcatttttgttgttgttgctactgttcttgttctgtagggagtgtgtgtgtgtgtgtgtgtgtgtgtgtgtgtgtgtgtggattgggggcctggggattgtaattattcttgtttatgttgtacaggcagagattgacctttgtattaagttccctagggctgctgtaaccaagtactacaaactaggtggcttaaaaaaaattttattgtctagcagttcaggatactagaggtccaa

SEQ ID NO: 8189 - DNA, 478 bp, Homo sapiens
  AC018883.4_87099
  Located on chromosome 5
  Distance between a terminus base of telomere on chromosomal short arm and 5'-terminus of this base sequence : 19077856
  Distance between 3'-terminus of neighbour sequence of sequence listing upward to telomere on chrosomal short arm and 5'-terminus of this base sequence : -275
gagtagacatgaggataaatcaaaagaaggtacatttcatttttgttgttgttgctactgttcttgttctgtagggagtgtgtgtgtgtgtgtgtgtgtgtgtgtgtgtgtgtgtggattgggggcctggggattgtaattattcttgtttatgttgtacaggcagagattgacctttgtattaagttccctagggctgctgtaaccaagtactacaaactaggtggcttaaaaaaaattttattgtctagcagttcaggatactagaggtccaaaatcaaagtatctgcagggccatgctcacattgaaacataagggaatcttttcctggctctacctggcttctggtagttggctggcactatttgacattccacagtttgtagagtcatcactccaatcctcagtcttcacagagcctgtgtctctgccttctttaaagacaccaggcttctaggattaggacactagcctact

SEQ ID NO: 8190 - DNA, 472 bp, Homo sapiens
  chr5.fa.O7frz.22751228
  Located on chromosome 5
  Distance between a terminus base of telomere on chromosomal short arm and 5'-terminus of this base sequence : 19119951
  Distance between 3'-terminus of neighbour sequence of sequence listing upward to telomere on chrosomal short arm and 5'-terminus of this base sequence : 41617
gaatgtctctagcactagataggagaacaataccttcttgttatatataatatttgttcaatatatttttcttttaaaaaatttatgtcatgtaggccctccaccagtggtgatatgtgtacaattttcttctaacatacagtatttataaaagttgttaagttgtttattactgagatgttttgtacctctgatatagatagatagatagatttatagataggagatagatagataaattatagatagatgatagatagatggatagatgatagatagatgatagatgatagataggtagatacatagatacatatatagatgatagatacatatatgatagatagatgatagatagatagatagatagatagatagatagatagatagataatcttttagtgccccatagaagtagctcttcattattgaaggataatccactaaatatgttaaggcgattcatcttaaa

SEQ ID NO: 8191 - DNA, 259 bp, Homo sapiens
  AC018883.4_4117
  Located on chromosome 5
  Distance between a terminus base of telomere on chromosomal short arm and 5'-terminus of this base sequence : 19189616
  Distance between 3'-terminus of neighbour sequence of sequence listing upward to telomere on chrosomal short arm and 5'-terminus of this base sequence : 69193
acacctaaggctagatgacgagttagtgggtgcagcgcaccagcatggcacatgtatacatatgtaactaacctgcacaatgtgcacatgtaccctaaaacttaaagtataataaaaaaaaaagaaaaataaaataaaataaaataaaataaaataaaataaaaaaagaaaaatattttttttccttctttgttgaaggaaagtatctggcagaaattcagctaacaatcagtgctcctagacagccaggagataaagt

SEQ ID NO: 8192 - DNA, 160 bp, Homo sapiens
  D5S411
  Located on chromosome 5
  Distance between a terminus base of telomere on chromosomal short arm and 5'-terminus of this base sequence : 19282995
  Distance between 3'-terminus of neighbour sequence of sequence listing upward to telomere on chrosomal short arm and 5'-terminus of this base sequence : 93120
aatcaaaggaatcttgtcccagaaagagtgtgtgtgtgtgtgtgtgtgtttgtgtgtgtgtgtgtgtgtgtgtgtgtgtgagagagatttctattaatatttgtgtttctttttcttttttaaaaatctcccctctcggttgtattttagcctccacgac

SEQ ID NO: 8193 - DNA, 448 bp, Homo sapiens
  chr5.fa.O7frz.22946919
  Located on chromosome 5
  Distance between a terminus base of telomere on chromosomal short arm and 5'-terminus of this base sequence : 19473611
  Distance between 3'-terminus of neighbour sequence of sequence listing upward to telomere on chrosomal short arm and 5'-terminus of this base sequence : 190456
ctgataagattggtactggagagtgtagattatacatgcagatagtaagggttttgagtttgaaatgccagatttagacagcttttccatcagcagtgatagactgggtcacaaaccctgctgttatttctcctccccagaataccaagcctaccaaccagtggaggggcacaccccttacttgggatggggaaaatgagtaattgtgtagggtatggagggaggtcatgctcaagaaaacagcaggaggaagaaagacaagttacgctccatccgctaagccttgggtacaccagtttctgatcatttgtgctgtgtgtgtgtgtgtgtgtgtgtgtgtgtgtgtgtgtgtgtgttcatgtattaaaagaagtgaacaatataagggttaggaaaggaaaaaaaataaaagacctagagggaggggtagaaaacaaggccttcatac

SEQ ID NO: 8194 - DNA, 392 bp, Homo sapiens
  chr5.fa.O7frz.29275601
  Located on chromosome 5
  Distance between a terminus base of telomere on chromosomal short arm and 5'-terminus of this base sequence : 19682564
  Distance between 3'-terminus of neighbour sequence of sequence listing upward to telomere on chrosomal short arm and 5'-terminus of this base sequence : 208505
tggacctaattgacatctacagaatactatactcaagaaccacaaaatatacattcttctcatcttcacactgaacatattctaatatcatgtttagtcataaaagtaagtctcagtaaattaaaaataaaataaaataaaataaaatcatgccaaacaccctcttggaccacgttgccttcaaaataaaagttagtatcaagaagatctctttaaattacataaatatatggaaattttggaacttgctctcaaataactcctggatgaactatgaaattagggcagaatcaaaaaattaataaaaacaggaacacagcttaccaaaattttggggatgcagctaaagctattaaaagtttatagtgctagatgccttcatgaataagtta

SEQ ID NO: 8195 - DNA, 166 bp, Homo sapiens
  DISD22_0004509
  Located on chromosome 5
  Distance between a terminus base of telomere on chromosomal short arm and 5'-terminus of this base sequence : 19881309
  Distance between 3'-terminus of neighbour sequence of sequence listing upward to telomere on chrosomal short arm and 5'-terminus of this base sequence : 198353
gctgagctatattcaggatcatcttatatatatatatatatatatatatatatatatatatatatatatatatatataaaactgcagtaaaaatgagacctctgtactcttcttttaaaagatggacataagattaattaagtccaacatagatctgacatctatc

SEQ ID NO: 8196 - DNA, 101 bp, Homo sapiens
  DISD22_0004513
  Located on chromosome 5
  Distance between a terminus base of telomere on chromosomal short arm and 5'-terminus of this base sequence : 19961456
  Distance between 3'-terminus of neighbour sequence of sequence listing upward to telomere on chrosomal short arm and 5'-terminus of this base sequence : 79981
tcagatgtttctgttgtggcagtatctctctctctctctctctctctctctctctctgtgtgtgtttctcattatttcaatttcagctgactaccaatatc

SEQ ID NO: 8197 - DNA, 201 bp, Homo sapiens
  chr5.fa.O7frz.28857322
  Located on chromosome 5
  Distance between a terminus base of telomere on chromosomal short arm and 5'-terminus of this base sequence : 20041639
  Distance between 3'-terminus of neighbour sequence of sequence listing upward to telomere on chrosomal short arm and 5'-terminus of this base sequence : 80082
tttaactttaagcagacgatttacaaggcaaaatacccaagaaactaactagagtttttattacaaaaaatctcaccatgaatcaaaattactctatgttaatattgctattgacgtgtgtgtgtgtgtgtgtgtgtgtgtgtgtgtgtgggtgtgtgtgggtgtgtgtgtatgtgtgtccttgaagtcaaaagtattaca

SEQ ID NO: 8198 - DNA, 133 bp, Homo sapiens
  DISD22_0004527
  Located on chromosome 5
  Distance between a terminus base of telomere on chromosomal short arm and 5'-terminus of this base sequence : 20138508
  Distance between 3'-terminus of neighbour sequence of sequence listing upward to telomere on chrosomal short arm and 5'-terminus of this base sequence : 96668
gagtacttgctctcgcctgataaaaatattctataatataccttctttgccaacaacacgcacacacacacacacacacacagacacagacacacacacacacacacaggcattcatgtatacacatataaca

SEQ ID NO: 8199 - DNA, 407 bp, Homo sapiens
  chr5.fa.O7frz.25992435
  Located on chromosome 5
  Distance between a terminus base of telomere on chromosomal short arm and 5'-terminus of this base sequence : 20308990
  Distance between 3'-terminus of neighbour sequence of sequence listing upward to telomere on chrosomal short arm and 5'-terminus of this base sequence : 170349
tgctaatttggcttacagatacaaattcctattttagatggcttgttctcccaaaaagtgagagtccctttcttcaccattcaaaagctgtgaacattaataataataataataataataataataataataataaagattcatttgtaaataatacctcaccacaagtcaaaaataaattcatactgagtagttttctgaagagttaatttctaaagggttttagaaaatattatgtaaaacataaagacatatgtcaatgaaaaatacattacatcatcaatcccacatttgtttaaaaattattggatatctatacctcatgcatacacaaaacaaacagtaaaatgaactgttttattttattttaaaatctcggtctagtttctttaacttgaatcacaaac

SEQ ID NO: 8200 - DNA, 105 bp, Homo sapiens
  DISO7_10001802
  Located on chromosome 5
  Distance between a terminus base of telomere on chromosomal short arm and 5'-terminus of this base sequence : 20464301
  Distance between 3'-terminus of neighbour sequence of sequence listing upward to telomere on chrosomal short arm and 5'-terminus of this base sequence : 154904
tagtcagggacgcctgtcatcccagacttttttattttattttattttattttattttatttactttcttgctttggatttgaactttctggatctcatgcattc

SEQ ID NO: 8201 - DNA, 398 bp, Homo sapiens
  chr5.fa.O7frz.25916291
  Located on chromosome 5
  Distance between a terminus base of telomere on chromosomal short arm and 5'-terminus of this base sequence : 20619850
  Distance between 3'-terminus of neighbour sequence of sequence listing upward to telomere on chrosomal short arm and 5'-terminus of this base sequence : 155444
ctcaagttatccactgctatgtttcctttcctgttttgtgtccttccaagtgaagccagcaccaagtacagcctacttaagtcccgtaagtctaactgatatattgagcccgagaaaactcagagaggggacatggtagaacgataataatcatgctacttaaaaaaaacgaaaccactatatcagaaaaatagcagcactcccatgttcattgctgcattagtcacgataaccaaaagaaggaaacaacctaaatctccacagacagattaatagataaaagaaatgtaatatacatacatacatatatatgtgtatatatgcatgtgtgtatatatatatatatatatatatatatacacacacacacacacacaaagaaatactattcagcctta

SEQ ID NO: 8202 - DNA, 397 bp, Homo sapiens
  AC025113.2_78042
  Located on chromosome 5
  Distance between a terminus base of telomere on chromosomal short arm and 5'-terminus of this base sequence : 20823336
  Distance between 3'-terminus of neighbour sequence of sequence listing upward to telomere on chrosomal short arm and 5'-terminus of this base sequence : 203088
agacctgaattagaactggaacagatttttgaagtacgagccaaggagcttcatggttttctagcctggagttgacagatcagagtgagcggccagttcccacttagttccatcagtggattttgcttatggtcagggcagaaaaaagggatacttagatatgaatattttcttttatagatagatgatagatagatagatagatagatagatagatagatgatagaaattgtatacacttaaggtgaaaaatgatgttttattatacatatacatagtgaaacagttgttacagtcaagcaaattgacatatatcattatattacatagttacccttttcaatatattttgaagttaatatattcaatatataggtcagcaaactatagcctgtta

SEQ ID NO: 8203 - DNA, 355 bp, Homo sapiens
  AC025113.2_144284
  Located on chromosome 5
  Distance between a terminus base of telomere on chromosomal short arm and 5'-terminus of this base sequence : 21132815
  Distance between 3'-terminus of neighbour sequence of sequence listing upward to telomere on chrosomal short arm and 5'-terminus of this base sequence : 309082
tagcctaatattctagcacgtaattcacacaaaatagtttttaactaaaatttttttaaacataaatgtacttgatttattcactagaacaacaaatacataattttaaaatgaacctttttagaatcaaataataggaaaaaaatcacattaagtattaccagagagtgttatcatatatattattcaggattctccagagagacagaacacataagagatagatggatggatggatagatggatagatggatagatggttagatagatagatagatagatagatagatagatagatagacagtaaaaggtagatgaaagggaatttattagggtatgtggctcatgcaatagt

SEQ ID NO: 8204 - DNA, 105 bp, Homo sapiens
  DISO7_10001793
  Located on chromosome 5
  Distance between a terminus base of telomere on chromosomal short arm and 5'-terminus of this base sequence : 21346858
  Distance between 3'-terminus of neighbour sequence of sequence listing upward to telomere on chrosomal short arm and 5'-terminus of this base sequence : 213688
gaacatagatatgctccagtggaaataaatatacaaaccttagtaatgtgagatgtgtggaatgtgagagagagagagagagagactggagcatagacggttaca

SEQ ID NO: 8205 - DNA, 247 bp, Homo sapiens
  Z66901
  Located on chromosome 5
  Distance between a terminus base of telomere on chromosomal short arm and 5'-terminus of this base sequence : 21428656
  Distance between 3'-terminus of neighbour sequence of sequence listing upward to telomere on chrosomal short arm and 5'-terminus of this base sequence : 81693
ctagcaagtacagagcaaaagtcatgcctctgtctgataactccacgtttattgttatgttcactgagtcacaggagaaacatgttacattgagtcatagtgtggctaatttaaagacagttctctctctcacacacacacacagagacacacatatacgtgcgcgcacacacacacacacacacacacagacaaaacagagagataagagtaagaccataaaggaaatcttaacactatgagacct

SEQ ID NO: 8206 - DNA, 426 bp, Homo sapiens
  chr5.fa.O7frz.28142182
  Located on chromosome 5
  Distance between a terminus base of telomere on chromosomal short arm and 5'-terminus of this base sequence : 21509051
  Distance between 3'-terminus of neighbour sequence of sequence listing upward to telomere on chrosomal short arm and 5'-terminus of this base sequence : 80148
actgtacatgtactccagcctgggtgacagagcaagactccatctaaataataataataataataataataataataataataataattggaaagtgaaaacattctatattagtggaactggtaaaataaagtgcattctaaatatttatagtagatatttatttaacataaatgaaactatctgtcagcaaaaacaaattcagattcagtgcctcacttaaaaatcactggctaatagataaattgactaaactattctctgagcactgaagaactggaattaatctactatttcaaccattcaccgttccataaagatgattataaatccaatatttagaatgtcactttttgagagatgtgcttgaatattcattcatggaatctagacagtatatgttaaagttagtcaatcagtcacatg

SEQ ID NO: 8207 - DNA, 202 bp, Homo sapiens
  Z66809
  Located on chromosome 5
  Distance between a terminus base of telomere on chromosomal short arm and 5'-terminus of this base sequence : 21518717
  Distance between 3'-terminus of neighbour sequence of sequence listing upward to telomere on chrosomal short arm and 5'-terminus of this base sequence : 9240
ctaggtctcagtcttttagtgagcctgtgtctctggactgtgaacttcacaggttctcattcctcttccacacacacacacacacacacacacacacacatcttttaggtgggacaggaagcctacttaggcttgagagtgctggagttggatgctgtattagtccattttcttactgcagataaagacatacccaagactt

SEQ ID NO: 8208 - DNA, 293 bp, Homo sapiens
  D5S502
  Located on chromosome 5
  Distance between a terminus base of telomere on chromosomal short arm and 5'-terminus of this base sequence : 21807620
  Distance between 3'-terminus of neighbour sequence of sequence listing upward to telomere on chrosomal short arm and 5'-terminus of this base sequence : 288701
cacatgctacaaatcagggtttcatttatcttcttgacttaatgaagtgataaataatttgttaattatgtttataaaacataaaattgcattaggtatagccattacactgaacagcacaaaaatttgaaaaattgtcttaggtagtttctcaagaaaaaaatacacacacacacacacacacacacacacacacacacacacacagagtcatgcattgcttaatgaccaaggacatgtcagatatgtttcaagaaatgtgttgttatttgatttcattgtgtggacatcat

SEQ ID NO: 8209 - DNA, 159 bp, Homo sapiens
  Z23787.1_211
  Located on chromosome 5
  Distance between a terminus base of telomere on chromosomal short arm and 5'-terminus of this base sequence : 21807707
  Distance between 3'-terminus of neighbour sequence of sequence listing upward to telomere on chrosomal short arm and 5'-terminus of this base sequence : -206
tgcattaggtatagccattacactgaacagcacaaaaatttgaaaaattgtcttaggtagtttctcaagaaaaaaatacacacacacacacacacacacacacacacacacacacacacagagtcatgcattgcttaatgaccaaggacatgtcagata

SEQ ID NO: 8210 - DNA, 250 bp, Homo sapiens
  AC010498.4_94597
  Located on chromosome 5
  Distance between a terminus base of telomere on chromosomal short arm and 5'-terminus of this base sequence : 21918290
  Distance between 3'-terminus of neighbour sequence of sequence listing upward to telomere on chrosomal short arm and 5'-terminus of this base sequence : 110424
gtctttccttggattacctgtcagggcaaataaagtttagccatatatacaagtcccaattttgtaaaaaataatttgaaaacagccgtctttagtaaaataatgagtttgcgatattgtctcatgactagagttctgaggtaaaagctcttggatctttgagggtgtgtgtgtgtgtgtgtgtgtttagatgtgtttaagcatatgtacatgtattatgttatttgttgtttctagaatgctaccaact

SEQ ID NO: 8211 - DNA, 125 bp, Homo sapiens
  D5S648
  Located on chromosome 5
  Distance between a terminus base of telomere on chromosomal short arm and 5'-terminus of this base sequence : 21919147
  Distance between 3'-terminus of neighbour sequence of sequence listing upward to telomere on chrosomal short arm and 5'-terminus of this base sequence : 607
ggttttgatatggtgccttaatcacatttctgagcctgttattaaaaaataaaatctgtgtgtgtgtgtgtgtgtgtgtgtgtgtgtgtgtgtgtgtgtgaaacattggcagacctcagcgagct

SEQ ID NO: 8212 - DNA, 157 bp, Homo sapiens
  AC010498.4_93828
  Located on chromosome 5
  Distance between a terminus base of telomere on chromosomal short arm and 5'-terminus of this base sequence : 21919150
  Distance between 3'-terminus of neighbour sequence of sequence listing upward to telomere on chrosomal short arm and 5'-terminus of this base sequence : -122
tttgatatggtgccttaatcacatttctgagcctgttattaaaaaataaaatctgtgtgtgtgtgtgtgtgtgtgtgtgtgtgtgtgtgtgtgtgtgaaacattggcagacctcagcgagctggataaaaggaaggactgaggccataatgtaatca

SEQ ID NO: 8213 - DNA, 444 bp, Homo sapiens
  AC010498.4_4252
  Located on chromosome 5
  Distance between a terminus base of telomere on chromosomal short arm and 5'-terminus of this base sequence : 22006184
  Distance between 3'-terminus of neighbour sequence of sequence listing upward to telomere on chrosomal short arm and 5'-terminus of this base sequence : 86877
ctacctattccataaccaattaaagggttaaataaatttcaacgttggcttcttctattttgtatgaaagtcatatttttaactttttgaaagttatacttgggtggttttacaggtcatctcccaagatatccaagtggactcagctgtcagaaccaattttactagaaaagtaaacctcatggacttttccagcacagatcccctcaatctttctgtctctctgtctctttctctctctttctgcctttctcgctccctctctctctgtcactttttttatatctatctatctatctatctatctatctatctatctatctatctatctatctgagtcttgatagctcgatttaacttcttttgtagagatagctaatttgcttatttatttatttatttatttattgttttgttttgctcctataagtgaattccaagtct

SEQ ID NO: 8214 - DNA, 189 bp, Homo sapiens
  D5S814
  Located on chromosome 5
  Distance between a terminus base of telomere on chromosomal short arm and 5'-terminus of this base sequence : 22006366
  Distance between 3'-terminus of neighbour sequence of sequence listing upward to telomere on chrosomal short arm and 5'-terminus of this base sequence : -262
tggacttttccagcacagatcccctcaatctttctgtctctctgtctctttctctctctttctgcctttctcgctccctctctctctgtcactttttttatatctatctatctatctatctatctatctatctatctatctatctatctatctgagtcttgatagctcgatttaacttcttttgtagag

SEQ ID NO: 8215 - DNA, 400 bp, Homo sapiens
  AC010498.4_4178
  Located on chromosome 5
  Distance between a terminus base of telomere on chromosomal short arm and 5'-terminus of this base sequence : 22006514
  Distance between 3'-terminus of neighbour sequence of sequence listing upward to telomere on chrosomal short arm and 5'-terminus of this base sequence : -41
tatctgagtcttgatagctcgatttaacttcttttgtagagatagctaatttgcttatttatttatttatttatttattgttttgttttgctcctataagtgaattccaagtctttttagtcttgggtcaagattcattctaatgtatgtttgtgcataacaaataatttcatataggtgccagaatatttgcaaattaatatttttggtttgaccacatggtgaccttctttctagatgatagttatctattctatctcagaggaaagacaaaataaaagtggtgtgttagacttttttatggtctgttagtccatttgtgagaagaaaatatttcaagctgccctttaagatctggtgcattgagtttttcagtttatacttaagccatagctgaggt

SEQ ID NO: 8216 - DNA, 197 bp, Homo sapiens
  DISO7_10004989
  Located on chromosome 5
  Distance between a terminus base of telomere on chromosomal short arm and 5'-terminus of this base sequence : 22229621
  Distance between 3'-terminus of neighbour sequence of sequence listing upward to telomere on chrosomal short arm and 5'-terminus of this base sequence : 222707
gcaccaatttctatggttctctatttacaccaaatttataatggtgtaaatatatactcactccaatccattctctctctgcacatgcagatatatataaaaatatgcatatatacacacacacacacacacacacacacagagtaatatatcaaagcaacttagcaacatatatacacatgcttatttctgagtgc

SEQ ID NO: 8217 - DNA, 398 bp, Homo sapiens
  chr5.fa.O7frz.27318578
  Located on chromosome 5
  Distance between a terminus base of telomere on chromosomal short arm and 5'-terminus of this base sequence : 22272780
  Distance between 3'-terminus of neighbour sequence of sequence listing upward to telomere on chrosomal short arm and 5'-terminus of this base sequence : 42962
actcacagagtacttgagttcaataaatgtggtttgctttaagccactaggtttgtgataacattttcatgaagaaatacataaccaacacattaactaaagatttgagttttatcagaggcaatattatgacagaaatctcagaaaaaactgaaacattattatttataatgctctcaaaacatggagaactgtaaatgccagtattgtttaaacattttcctgtaagcactgtgtgtgtgtgtgtgtgtgtgtgtgtgtgtgtgtgtgtgtgtgtgtagaaagggttatattttttggtaaatatagaaataggataaaataattcaagatggattaaagacttaaatataagatgtgaaatcataaaaaccctagaataaaacctagccaatacc

SEQ ID NO: 8218 - DNA, 104 bp, Homo sapiens
  DISO7_10016429
  Located on chromosome 5
  Distance between a terminus base of telomere on chromosomal short arm and 5'-terminus of this base sequence : 22570631
  Distance between 3'-terminus of neighbour sequence of sequence listing upward to telomere on chrosomal short arm and 5'-terminus of this base sequence : 297453
ccttccatatcagccatttcaaatatatatatatatatatatatatatatatatatggagagagagagagagagagagagatttctttatgcagacacctgctt

SEQ ID NO: 8219 - DNA, 236 bp, Homo sapiens
  D5S1502
  Located on chromosome 5
  Distance between a terminus base of telomere on chromosomal short arm and 5'-terminus of this base sequence : 22681105
  Distance between 3'-terminus of neighbour sequence of sequence listing upward to telomere on chrosomal short arm and 5'-terminus of this base sequence : 110370
actgactcctctcataatcatgcgctctctctctgtgtgtttatatatatgtagatagatagatagatagatagatagatagatagatagatagacagatagatagatagatgatagatagagtgcaaggggataagtgagaattattcactcatccccttgcattgacatgctcaatatttaattagagcatctctcttttctagaaaatcgaagacacaaagtcataagtacct

SEQ ID NO: 8220 - DNA, 147 bp, Homo sapiens
  HUMUT7757
  Located on chromosome 5
  Distance between a terminus base of telomere on chromosomal short arm and 5'-terminus of this base sequence : 22681119
  Distance between 3'-terminus of neighbour sequence of sequence listing upward to telomere on chrosomal short arm and 5'-terminus of this base sequence : -222
taatcatgcgctctctctctgtgtgtttatatatatgtagatagatagatagatagatagatagatagatagatagatagacagatagatagatagatgatagatagagtgcaaggggataagtgagaattattcactcatcccctt

SEQ ID NO: 8221 - DNA, 369 bp, Homo sapiens
  chr5.fa.O7frz.26288359
  Located on chromosome 5
  Distance between a terminus base of telomere on chromosomal short arm and 5'-terminus of this base sequence : 22807474
  Distance between 3'-terminus of neighbour sequence of sequence listing upward to telomere on chrosomal short arm and 5'-terminus of this base sequence : 126208
gaaggtagcaaatccatacagtattgtgtcattcccttcagggcaatgagttttcccaggccccagagagatccaagatgactcctgggagtcggggcctaaagtcaaaaaccccagaaatcttcctggtgctctattattattattattattattattattattattattattattattttgtgtgtgtggctaagctggcaccacaccataagacaaagcctttcccagtcttccctctcttttccccaggcaggtgaatcactctgcatttcacaaccaccacagtttcatggggactacttccaggctgctaccaatcttcacttaaggcccaagtgttcttcagtcagcttatggtcaatccta

SEQ ID NO: 8222 - DNA, 448 bp, Homo sapiens
  chr5.fa.O7frz.26376911
  Located on chromosome 5
  Distance between a terminus base of telomere on chromosomal short arm and 5'-terminus of this base sequence : 22897027
  Distance between 3'-terminus of neighbour sequence of sequence listing upward to telomere on chrosomal short arm and 5'-terminus of this base sequence : 89184
caaggagatgtaatctaattcaaggtgtaaatgcatcactctggctaggtacatacacacacacacacacacacacacacacacaatctggttaatatagaatgcactgttacgtgaaaaacaaagaaaatgttggctttctgtctattcctgtctcttcctttttcccttttacatgaacatgtatttcttttattaaaaacaaagatattttaaataatacttttaagatgatatagaaggatatagagtattaatacctctcttcacactttcctctactggcaattttcctgtctactgccaattttcctgtattttttgtgtgtttatatatgtatacatgtgaggattatacaagcttaccataaaaatagcattttttaaatttagaaatattctggaaatattttcacattagtggctgtgaattatgccaacatatgac

SEQ ID NO: 8223 - DNA, 348 bp, Homo sapiens
  chr5.fa.O7frz.26388659
  Located on chromosome 5
  Distance between a terminus base of telomere on chromosomal short arm and 5'-terminus of this base sequence : 22908545
  Distance between 3'-terminus of neighbour sequence of sequence listing upward to telomere on chrosomal short arm and 5'-terminus of this base sequence : 11070
gaggtcaggagttccagagcagcctggccaacatggtgaaaccccatctctactaacaatacaaaaattagcctggcgtggtggcatgcacctgtaatcccagctccttaggaggctgaggcacaagaatagcttgaaccaggaggtggatgttgcagtgagctaagatcgcaccattgcactccagcctgggtaacagagtgagatttcgtctcaaaaacaaacaaacaaacaaactatatatatatatatatatatatatatatgtatatatatatatatacacacacacacacacacacacacacgcacacacagatacatttagcacatgtatagttgaggatc

SEQ ID NO: 8224 - DNA, 140 bp, Homo sapiens
  Z67713
  Located on chromosome 5
  Distance between a terminus base of telomere on chromosomal short arm and 5'-terminus of this base sequence : 23063082
  Distance between 3'-terminus of neighbour sequence of sequence listing upward to telomere on chrosomal short arm and 5'-terminus of this base sequence : 154189
tgctaggaacataagcatcgtcaagacaaaacttcccctgcactgagtgttgttttcctctctctctctctctctctctctcacacacacacacacacacacacacacacacacacatcactcactttccagtggggaat

SEQ ID NO: 8225 - DNA, 257 bp, Homo sapiens
  chr5.fa.O7frz.29145706
  Located on chromosome 5
  Distance between a terminus base of telomere on chromosomal short arm and 5'-terminus of this base sequence : 23108309
  Distance between 3'-terminus of neighbour sequence of sequence listing upward to telomere on chrosomal short arm and 5'-terminus of this base sequence : 45087
tcaattaactaggaaatggttaaggaagagatgaaagttgattaatgtgattaattaatacagaaatccaatgattaatgatgggattttttttaaaagactcaatttacaggctttctctccatatatgtgtgtgtgtgtgtgtgtgtgtgtgtgtgtgtgtgtgagtgtaggtagatattattgctatattatatatagatgtcacatatatacatatgatgataaagacatgataatggagcatgctactgtag

SEQ ID NO: 8226 - DNA, 318 bp, Homo sapiens
  AC010439.3_88948
  Located on chromosome 5
  Distance between a terminus base of telomere on chromosomal short arm and 5'-terminus of this base sequence : 23148894
  Distance between 3'-terminus of neighbour sequence of sequence listing upward to telomere on chrosomal short arm and 5'-terminus of this base sequence : 40328
ccattgcagtttcagatagtacttagtagagttataactgttagaaagatatgtatatgagaattgcaatataaaataggaaaactgtgcttttgtaaaccttggatctccacaatctggccaaagataagtcatcacaaattgagtatccaatgaacccccatgtctggccagaaaacaaacaaacaaataaataaataaataaataaataaataaataaaactgttctcatggatataaacaataaaactaaagcatctgtatgattttgaaaagttgatccaagacagagtttgtacaatgaatactggtccaga

SEQ ID NO: 8227 - DNA, 247 bp, Homo sapiens
  Z67652
  Located on chromosome 5
  Distance between a terminus base of telomere on chromosomal short arm and 5'-terminus of this base sequence : 23280806
  Distance between 3'-terminus of neighbour sequence of sequence listing upward to telomere on chrosomal short arm and 5'-terminus of this base sequence : 131594
tgcagtccagcaggttaaggaggcacaaagtgcactcctgccacagcagtgagagagtaggatgcacacacacacacacaaacacacacatacatacacaccacacacacactggcagggcaagtaagactaaaaccacccatgcacacatgcaccagcaatgtgatgtggagggttgtggttggctgggagcaagctgcagtgtgggtaggaagtgggcaggctggtgcatggctgtaggagctgc

SEQ ID NO: 8228 - DNA, 402 bp, Homo sapiens
  AC025452.2_115473
  Located on chromosome 5
  Distance between a terminus base of telomere on chromosomal short arm and 5'-terminus of this base sequence : 23407192
  Distance between 3'-terminus of neighbour sequence of sequence listing upward to telomere on chrosomal short arm and 5'-terminus of this base sequence : 126139
cagtgctcatctatggatttacagcaggaattaaattagattaacagtgcaactagaaacctgttccacacatgataagcattcaataaatattttatattatagagcattgtgttattcagtgttatccagagaaatagaacaaataggagaaacagaaccaacaaaacctgatatatagatatctatgtgtgtgtacatgtatacatatatagatagatatccatattttaggttatgttgtgtgtgtatgtgtgtgtggatgcgtgtgtgtatagatagatagatagatagatagatagatagatagatagatttcttataggaattggcttatgatattatggagtcaggaatttccaccatctgccatatgcaagatcgagaactaagaaacttggt

SEQ ID NO: 8229 - DNA, 230 bp, Homo sapiens
  Z66989
  Located on chromosome 5
  Distance between a terminus base of telomere on chromosomal short arm and 5'-terminus of this base sequence : 23579203
  Distance between 3'-terminus of neighbour sequence of sequence listing upward to telomere on chrosomal short arm and 5'-terminus of this base sequence : 171609
aaggcccagttgccaatatgagttttgtgtgtgtgtgtgtgtgtgtgtgtgtttgtgtgtgtgtgtgtctgtgtgtgtgtctctagagggaggcacaaaagacagaaatagtaaaaatgacttaactagaatggtttgttggcttgcatggttaagaaataaacatgattctgaaaagaactcattccgctggttaaagaaaattcttagacgccatacaaaggggttta

SEQ ID NO: 8230 - DNA, 282 bp, Homo sapiens
  AC009757.8_132436
  Located on chromosome 5
  Distance between a terminus base of telomere on chromosomal short arm and 5'-terminus of this base sequence : 23737120
  Distance between 3'-terminus of neighbour sequence of sequence listing upward to telomere on chrosomal short arm and 5'-terminus of this base sequence : 157687
cgtcagtctaacatgtcagaaatattatgtaggttttctggtatagggaataaggaaaaacggagttatttggctaccatatagttttaagggaaggtattaagctagagtagactgtgttggaatattagaataataaactcactttaaaatacctgtggctaagccagaaaagattgtgtgtgtgtgtgtgtgtgtgtgttacatactcattgtgcatgtgttcatgagtgagacatcttgtgttcaaagtcaccaggagcactggtttactgaaactgt

SEQ ID NO: 8231 - DNA, 292 bp, Homo sapiens
  AC009757.8_163404
  Located on chromosome 5
  Distance between a terminus base of telomere on chromosomal short arm and 5'-terminus of this base sequence : 23768169
  Distance between 3'-terminus of neighbour sequence of sequence listing upward to telomere on chrosomal short arm and 5'-terminus of this base sequence : 30767
agaattgcttgagttaagattgaggctgcagtgttctatgattgtgttactgtattacagcctgggcaacagagtgattctctctctctctttctcaccgcacacacacacacacacacacacacacacacacacgcactcgtgtttttagtttagattgataatatttacaaacgaaaggactttgagtatttttcctatatacagaaattcaattttatgctctcaaaatatttctgtatgatcttactctcctgtgccagagccggattcctttcattctagctaagct

SEQ ID NO: 8232 - DNA, 399 bp, Homo sapiens
  AC010385.3_45663
  Located on chromosome 5
  Distance between a terminus base of telomere on chromosomal short arm and 5'-terminus of this base sequence : 23975176
  Distance between 3'-terminus of neighbour sequence of sequence listing upward to telomere on chrosomal short arm and 5'-terminus of this base sequence : 206715
cagatgaaatgcctaattacacgcatacttctacacttgtgcactggtgaactgcttattgtggagagttaactgtgaagtttgtaattttctttaataatgttcgtgtatatttatgatatttatgtttatgcgtgacttttttctggattgtagagattctttctctttctctcttttctttctctcttttctctttctttctttctttctttctttctttctttctttctttctttctttctttctttctttctcttctttctttcattccttacatccttccttccattttgctgtcattttatttactttttttgtattaatgatactatactgcttcttagagaattaatgccagtcatttgaagcattaattacttcctgtaataccaagtg

SEQ ID NO: 8233 - DNA, 190 bp, Homo sapiens
  DISD22_0004542
  Located on chromosome 5
  Distance between a terminus base of telomere on chromosomal short arm and 5'-terminus of this base sequence : 24272446
  Distance between 3'-terminus of neighbour sequence of sequence listing upward to telomere on chrosomal short arm and 5'-terminus of this base sequence : 296871
tgtaggcaatgtttaactgaggaaacctatgtgtgtgtgtgtgtgtgtgtgtgtgtgtgtgtgtatgtacatatatatatgtgtatatatatatatataacttgttctaataaacttagattttatttggatattaacaattttcatgttttactttgttcatatatgttatgtgatttgatcttcacca

SEQ ID NO: 8234 - DNA, 347 bp, Homo sapiens
  chr5.fa.O7frz.30713175
  Located on chromosome 5
  Distance between a terminus base of telomere on chromosomal short arm and 5'-terminus of this base sequence : 24544754
  Distance between 3'-terminus of neighbour sequence of sequence listing upward to telomere on chrosomal short arm and 5'-terminus of this base sequence : 272118
ggaagccttaagacggtaggtaaataggaagtaaaaactaagatgtagttaaaaactacttttcagagtattaaaaacatgctttctctctctctctttctctctctctctctctctctcacacacacacacacacagagacacacacacaaacacacacacagagcccattcgcaaaggctaaaagacttactggtgtgagtaacttaagagaatatattagatgactactaagtgaaccaagcagagactttagtggctgcagaattcctccaggataatccctaaatgaacaaatagcaacgatgaaaactgcaacaaacagtaacaggaaatactgaagattg

SEQ ID NO: 8235 - DNA, 472 bp, Homo sapiens
  chr5.fa.O7frz.30811775
  Located on chromosome 5
  Distance between a terminus base of telomere on chromosomal short arm and 5'-terminus of this base sequence : 24643390
  Distance between 3'-terminus of neighbour sequence of sequence listing upward to telomere on chrosomal short arm and 5'-terminus of this base sequence : 98289
tgtaatgtagctgaaattgcttatcagctcaaggagcttttgggcagagacaatgggaatccttagcatatatatgtatgtgtatatatatatatatatatacatatatatgatagttaggtcttcttgtggaactgaactttttaccgttatgtattttccttctttgtctttttttaatctttgttggtttaaagtctgttttgtctgaaattaagattgcaactcttgcttttttctgtttttcttttgcttggtagattttcttccatctctccattttgagcctgtgggtttccctgtaagtaagatgggtctcttgaacacagcatatcattagatcatacttctttatccagcttgccactctttttgccttttgattggtgtatttagcctatttatattcaatgttagtattgatatttgtgaatttgatcctgtcatcatgtcgttagctagttcatatgca

SEQ ID NO: 8236 - DNA, 301 bp, Homo sapiens
  chr5.fa.O7frz.31611729
  Located on chromosome 5
  Distance between a terminus base of telomere on chromosomal short arm and 5'-terminus of this base sequence : 24885465
  Distance between 3'-terminus of neighbour sequence of sequence listing upward to telomere on chrosomal short arm and 5'-terminus of this base sequence : 241603
taatcgcaaatagaacttgaagaaaatttatatatggcatcaaaggaaatgatgtggttgcaaatgtgctttgagaaaaagcttataaataactataaaatggaatgcttatttcagtctataaaaggtctccatatatatatatatatatatatatatatatatacacacacacacacatatatatacacatacatatatatatgtatctcttaacaattcatacagaggattttgagggagagagatgtatatatatatatgttggaaaatgcattagtgtcctacaattgctgtaata

SEQ ID NO: 8237 - DNA, 456 bp, Homo sapiens
  chr5.fa.O7frz.31685981
  Located on chromosome 5
  Distance between a terminus base of telomere on chromosomal short arm and 5'-terminus of this base sequence : 24959482
  Distance between 3'-terminus of neighbour sequence of sequence listing upward to telomere on chrosomal short arm and 5'-terminus of this base sequence : 73716
caactttatccttcaacatcagttctatcatctttttctccaagaaataacaaaaacaaacaaacaaaaatccctgatcggattcatagtctcttgaattacctgtatcttactcaggccattttcctcactgataaatatttctttcttctctacctctctacacttatttaagccttatgtagaccatatcgcattgcctataaggaattttctttgaaaattctgggcaagattgactactctgttctttgaatcctctcctccccccaccctttattgtagtgtgtgtgtgtgtgtgtgtgtgtgtgtgtgtgtgtgtgtctgtgtgtagtgtgttaatggcatctcagcatattaaagttctattactcagaataaatcacatatatttagtggcttaaaacaacacaaatgtattggtttacaatgttctgagttagaagtttaggtgca

SEQ ID NO: 8238 - DNA, 480 bp, Homo sapiens
  AC004768.1_51769
  Located on chromosome 5
  Distance between a terminus base of telomere on chromosomal short arm and 5'-terminus of this base sequence : 25097752
  Distance between 3'-terminus of neighbour sequence of sequence listing upward to telomere on chrosomal short arm and 5'-terminus of this base sequence : 137814
ataagattctttagcaaggcaggtgggaggtgaacatcccctaacttacagcaacatcagtgtagagggaagggggataattgaaacttcttcaggaggcagagccaggaggacctgatgagggacatgaaccacaagagagatgagtaggcaaaaatactgactgagttccaggacagggcagaaacatgatgccgtttacacctggggtcaaataggaagagcacattgtgagtggaagatgatcagttcaatttgggacatattagcttaaagatactttcaaaatcatctagccatctatctataaatctatctatctatcacctatgtagtatgtatgtacgtatgtgtctatctatctatctatctatctatctatctatctatctatctatctatccagtcatattcttagctgcatttgtagttctggaaatgatcaaactatagatggtaatgaaggctacagttgtagat

SEQ ID NO: 8239 - DNA, 319 bp, Homo sapiens
  AC004768.1_69880
  Located on chromosome 5
  Distance between a terminus base of telomere on chromosomal short arm and 5'-terminus of this base sequence : 25116183
  Distance between 3'-terminus of neighbour sequence of sequence listing upward to telomere on chrosomal short arm and 5'-terminus of this base sequence : 17951
cacggattgttcttggaacctgcagtaatgaaaacacacacacacacacacacacacacacacacacatatgcacacatcgatattcatgaatattaaggtggggaagacagtcaaaaagcaaaccaacaaatacataaaaatatatgtcaaatatgggaacagactttatatgggtgagcgttttaatatttgatggttaaggaaactatttctaatatgagcttcatgtatgaatctggtgagcaatccatagggcaaataaatttagacagaagaaagaagaatagttaaagatctacaggtatttgtgcctgttc

SEQ ID NO: 8240 - DNA, 302 bp, Homo sapiens
  AC004768.1_73598
  Located on chromosome 5
  Distance between a terminus base of telomere on chromosomal short arm and 5'-terminus of this base sequence : 25119902
  Distance between 3'-terminus of neighbour sequence of sequence listing upward to telomere on chrosomal short arm and 5'-terminus of this base sequence : 3400
agttacacatccatgtaaccaaaccaatacatacacacacacacacacacacacacacacacacacacacacacacggaaatataacttttattttaattttaacaatgtatccttttgaagtacagatatttcatcccctgacatttcaaatttcaaattttgatgaagtccatttgactgttttttaaagatatagttatttttatgctgtatcaggtctattgtgaagattttatcctgttttcttctagagattttagagttttaggatttgtattactaaatgattcttgctccatt

SEQ ID NO: 8241 - DNA, 417 bp, Homo sapiens
  chr5.fa.O7frz.15636073
  Located on chromosome 5
  Distance between a terminus base of telomere on chromosomal short arm and 5'-terminus of this base sequence : 25228566
  Distance between 3'-terminus of neighbour sequence of sequence listing upward to telomere on chrosomal short arm and 5'-terminus of this base sequence : 108362
ccaccatcaaatagatacagttatgcacacatgaccaaaatgaatggaattaaaacaacacaacaaccaaaatacacaaccccaaagatatgttttatataatcgacattttcatacacatgctcacatacacacacacacacacacacacacacacacacacacacacacacacgatgccagctaagacatgtcaaaatctaaagcagctggagtgcaaaccaatgtattgcttaaatactcaaaatgtagattgttgtgacaacactggatttccatattgtatcatcagtgtactatagaaggtatgtactcctggtgcccacgttaccttttccggttctggaagatacattatcttctcagtcccatccataagaaggagtgactatagtgaatctatgaagtgctgttaat

SEQ ID NO: 8242 - DNA, 414 bp, Homo sapiens
  chr5.fa.O7frz.15437830
  Located on chromosome 5
  Distance between a terminus base of telomere on chromosomal short arm and 5'-terminus of this base sequence : 25405530
  Distance between 3'-terminus of neighbour sequence of sequence listing upward to telomere on chrosomal short arm and 5'-terminus of this base sequence : 176547
aataagttgaaggcctgaatagaacaaaatgctgactctctcccaagtaagagaattctcctgcatgatggccttggaactggatgctggctcttctgattttagacttgttagcctccataatagcatgagccaattctttataataaatttctatctatctattatctatctatctatctatctatctatctatcatctatttatcgtctatcatctatctatctatctatctatctatctatctatctatctatctatctatctatctgtcatctctatcatctatctcttcatcttcttcatcggtttctctggagaaccctgagtaatacataaagtctatttgagcaaagccttaagtaagatgttttaaagaatttattgctggtttcctgagttacttgatgtaag

SEQ ID NO: 8243 - DNA, 288 bp, Homo sapiens
  DID22N_0024787
  Located on chromosome 5
  Distance between a terminus base of telomere on chromosomal short arm and 5'-terminus of this base sequence : 25488474
  Distance between 3'-terminus of neighbour sequence of sequence listing upward to telomere on chrosomal short arm and 5'-terminus of this base sequence : 82530
aatgctgaagaggcatggtattttcaaatgcctcccacctctgaggcatatatatatatatatatatgtgtatatatatatgtgtatatgtgtatatatatatgtgtatatatatgtgtatatatgtgtatatatatatatataacaagaggctgtaaataatatatacacacatatataatgtatataaacataaaatgcatgtacacacaaatatgtgcatgtgtgtattttatgtgtatatataacatgtgtgtatacatatattctttgcagcctcttatctca

SEQ ID NO: 8244 - DNA, 259 bp, Homo sapiens
  D5S819
  Located on chromosome 5
  Distance between a terminus base of telomere on chromosomal short arm and 5'-terminus of this base sequence : 25846236
  Distance between 3'-terminus of neighbour sequence of sequence listing upward to telomere on chrosomal short arm and 5'-terminus of this base sequence : 357474
gtcacccaaaagtcatgaggcattgcactggttcttcaataccctcagttgccaatattttaccctttcttgggagtatcacctctccactggttgtgcttatagatagataagtaggtagaatatatctctatgtatgtatgtatgtatgtatgtatgtatgtatgtatctatgtatctatctatctatctatctatctatctatctatctatagatacagatatatctatatctatcttgtatagcatgcgggtaca

SEQ ID NO: 8245 - DNA, 256 bp, Homo sapiens
  Z66940
  Located on chromosome 5
  Distance between a terminus base of telomere on chromosomal short arm and 5'-terminus of this base sequence : 25949214
  Distance between 3'-terminus of neighbour sequence of sequence listing upward to telomere on chrosomal short arm and 5'-terminus of this base sequence : 102719
agctgtaagagtgattttaatggacattttctatctttgaaaagaaacagttctttaatgcttttgttcatgcatcgtgtgtgtgtgtgtgtgtgtgtgtgtgtgtgtactagaaaatagtggttgtcctgtgggaagagatgataggtgattatatcctttcaaatgcctttctttgctttctacaaaagtacatgcattatttaatttctaaaactttattagaccatatgggtcaaataattcttatctgcct

SEQ ID NO: 8246 - DNA, 254 bp, Homo sapiens
  chr5.fa.O7frz.31801178
  Located on chromosome 5
  Distance between a terminus base of telomere on chromosomal short arm and 5'-terminus of this base sequence : 25956908
  Distance between 3'-terminus of neighbour sequence of sequence listing upward to telomere on chrosomal short arm and 5'-terminus of this base sequence : 7438
ttgatataagctgaggttgattatatttattgttaacttacttccaactaacgtagtttttttctttacttaaaaacaactttagaagacgtagtgccataccatatgcacacacacacacacacacacatatatataccttctttatttttagtctattcctattagaacataagctcttttctcttttgttatggttattgttctctcaataacccctaaaacagtacctgatacaaggtagactttcaaac

SEQ ID NO: 8247 - DNA, 477 bp, Homo sapiens
  chr5.fa.O7frz.32545065
  Located on chromosome 5
  Distance between a terminus base of telomere on chromosomal short arm and 5'-terminus of this base sequence : 26107595
  Distance between 3'-terminus of neighbour sequence of sequence listing upward to telomere on chrosomal short arm and 5'-terminus of this base sequence : 150433
ggtccagcaattctactcttacatatatacccgaaagaattgaagcattattcacaatattcagaatgtggaaacaaaccaagtgtccatcacagatgaatgaatgaataaaatgtggtgtgtgtgtgtgtgtatatatatatatatatatatatatatatgatgggatattattcagccacaagaaggaattaaattctgataggctacaacatggatgaactgtaaaagcatatgctaagtgaaataagccaaacacaaaaggacaaatattgtatgaagtacctataatatgaggtacctataataggtatatgatatggtttggctgtgtccccacccaaatctgatcttgaattgtagctcccataattcccacgtatcatgggagggacccaatgggacgtaatggaatcatgggggtgggtttttactgctgttctcatgataatgagtaagtcttatgaaatctgatgg

SEQ ID NO: 8248 - DNA, 248 bp, Homo sapiens
  chr5.fa.O7frz.32462232
  Located on chromosome 5
  Distance between a terminus base of telomere on chromosomal short arm and 5'-terminus of this base sequence : 26121036
  Distance between 3'-terminus of neighbour sequence of sequence listing upward to telomere on chrosomal short arm and 5'-terminus of this base sequence : 12964
cagtaccagcaataaagctaatgaactggcctctttttctgaaaagccttcctatgtccctatgtcctttgctcctttgcttttagtgttttgttttgttttgttttgttttgttttgttttaagacagagtctggctctgtcacccaggctggagtgcagtggtgtaatctcctctcactgcaacctccacctcctgggttcaagcaattatcctacctcagcctctggagtagctaggattacagg

SEQ ID NO: 8249 - DNA, 101 bp, Homo sapiens
  DISD22_0004570
  Located on chromosome 5
  Distance between a terminus base of telomere on chromosomal short arm and 5'-terminus of this base sequence : 26473118
  Distance between 3'-terminus of neighbour sequence of sequence listing upward to telomere on chrosomal short arm and 5'-terminus of this base sequence : 351834
gagctgcactcacagagcgtgtgtgtgtgtgtgtgtgtgtgtgtgtgtgtgtgtgtgtgtagtcatctcccacttggctccagggtaacgtgttggccttc

SEQ ID NO: 8250 - DNA, 179 bp, Homo sapiens
  D5S477
  Located on chromosome 5
  Distance between a terminus base of telomere on chromosomal short arm and 5'-terminus of this base sequence : 26593805
  Distance between 3'-terminus of neighbour sequence of sequence listing upward to telomere on chrosomal short arm and 5'-terminus of this base sequence : 120586
ttgcctcatcagattcctatttgatactctcgtgtgtgtgtgtgtgtgtgtgtgtgtgtgtgtgtgtgtgtgtgtatgtgtgtgtgtgaaatatccacctacctagggtcacagtttagtgcctaggtcttgggctcacccacctcagcaatgttttaaaccttggactttacccagct

SEQ ID NO: 8251 - DNA, 306 bp, Homo sapiens
  AC022444.4_64672
  Located on chromosome 5
  Distance between a terminus base of telomere on chromosomal short arm and 5'-terminus of this base sequence : 26822062
  Distance between 3'-terminus of neighbour sequence of sequence listing upward to telomere on chrosomal short arm and 5'-terminus of this base sequence : 228078
gcaatagactcacaatttaaccagactatatacaaactaaaaactaccgggggctatcccagtggattcaagcaagatgccaggaacactggcatagttttctattctccccatatccccactaacacacccgggaaacacacaacacacacacacacacacacacacacacacagttaatatagaaaaacacagtaaacatccacaataaaactagatacaaaggtatccccacaaactccaaaatatacaagtgtgtgggggaaatgccaccaccaccaccaagaccaatttgaaatcaccatc

SEQ ID NO: 8252 - DNA, 134 bp, Homo sapiens
  D5S1996
  Located on chromosome 5
  Distance between a terminus base of telomere on chromosomal short arm and 5'-terminus of this base sequence : 26822147
  Distance between 3'-terminus of neighbour sequence of sequence listing upward to telomere on chrosomal short arm and 5'-terminus of this base sequence : -221
acactggcatagttttctattctccccatatccccactaacacacccgggaaacacacaacacacacacacacacacacacacacacacagttaatatagaaaaacacagtaaacatccacaataaaactagat

SEQ ID NO: 8253 - DNA, 180 bp, Homo sapiens
  D5S1470
  Located on chromosome 5
  Distance between a terminus base of telomere on chromosomal short arm and 5'-terminus of this base sequence : 27085033
  Distance between 3'-terminus of neighbour sequence of sequence listing upward to telomere on chrosomal short arm and 5'-terminus of this base sequence : 262752
taggattttactatattccccaggctggagatacatatgtgtagatagatagatagatagatagatagatagatagatagatagatagatagatgcagagacagagagagacatgaagagagatacagatagagacacaaagtgagcacgtgtacaattccagtaaacacactgtgcatg

SEQ ID NO: 8254 - DNA, 417 bp, Homo sapiens
  AC017039.6_13997
  Located on chromosome 5
  Distance between a terminus base of telomere on chromosomal short arm and 5'-terminus of this base sequence : 27094995
  Distance between 3'-terminus of neighbour sequence of sequence listing upward to telomere on chrosomal short arm and 5'-terminus of this base sequence : 9782
acttggactgaattacaccactcacttttctcgttctccagcttgcagatagcagatcgtgggacttcttggctctatctacctagctacctacctatctatctatctatctatctatctatctaactctttatctatgattgtgttagtcagagttctacagggagacagaccaataggagataaatatatacatgagagggaacttattaggggggttggcttacatgattatggaggctgggaagcaccacaacaggccatctgcaagctggggaccctgggatgctggtagagtggcccagaaccagagaagctagtggtgtaactggcagaggccaaaggcctgaaaacagttgttgtccaaaggcaggagaggaagggtatgtcccagctccaggagatagttcaacatac

SEQ ID NO: 8255 - DNA, 427 bp, Homo sapiens
  chr5.fa.O7frz.33575169
  Located on chromosome 5
  Distance between a terminus base of telomere on chromosomal short arm and 5'-terminus of this base sequence : 27161864
  Distance between 3'-terminus of neighbour sequence of sequence listing upward to telomere on chrosomal short arm and 5'-terminus of this base sequence : 66452
ccaatattaagcctaactgaagtagactgactagtgcgcgcgcgcgcgcgcgcacacacacacacacacacacacacacacactccttttcagaaaagtttgtttagtggtagcactgctatttcagttagttgtaagttttgccaaaataatcattttggaaatacatagaaagcatttggcagaagatagtatatttatttgtatattctattcatattggtaataagagttttatgccttttgctaaggagaaattgctggcataaaatttatagttaatgatgtttgtacctattctttccagctttttaaggatactggtacagtaactatagtggcttactcttctaattttctgatgtctctttcctacttcagcccccaaagcaggttacagccaaggtgcaactcagtatactcaagc

SEQ ID NO: 8256 - DNA, 214 bp, Homo sapiens
  chr5.fa.O7frz.33669034
  Located on chromosome 5
  Distance between a terminus base of telomere on chromosomal short arm and 5'-terminus of this base sequence : 27341110
  Distance between 3'-terminus of neighbour sequence of sequence listing upward to telomere on chrosomal short arm and 5'-terminus of this base sequence : 178819
aactgttatgcaactcagtctaatttacattgtaaggctgccagagggaactagatttctcccttggtctaaacgtcccctctgacaattctaagggcccaacaattgatatcaatcaatcaacaataataataataataatagtaataatgatataccttgcccatatttgacctacagttcaaggcccatagctttggataatcagaagtta

SEQ ID NO: 8257 - DNA, 149 bp, Homo sapiens
  chr5.fa.O7frz.33751026
  Located on chromosome 5
  Distance between a terminus base of telomere on chromosomal short arm and 5'-terminus of this base sequence : 27423195
  Distance between 3'-terminus of neighbour sequence of sequence listing upward to telomere on chrosomal short arm and 5'-terminus of this base sequence : 81871
cgaaaccacaatttctagaaccatccctttcccccagtcctggtttttttttttttttgcacggtgtgtgtgtgtatatgtgtgtgtgtgtgtgtgtgtgtatgtgtgcgtgcgcgcgcgcatttctctactttaaagcacgtttcctt

SEQ ID NO: 8258 - DNA, 450 bp, Homo sapiens
  AC008421.4_94508
  Located on chromosome 5
  Distance between a terminus base of telomere on chromosomal short arm and 5'-terminus of this base sequence : 27590377
  Distance between 3'-terminus of neighbour sequence of sequence listing upward to telomere on chrosomal short arm and 5'-terminus of this base sequence : 167033
ctgttccactggtctacgtgtctgttttttatgcctgtaccatgatgttttggttactataattttgtagtgtattttgaagtttggtagtgtgatggtgtctccagctttattcgttttccttaggattgctttggctattaggggtcttttgtggttccatacaaatttcaggatttaaaaaaatttctgtgaagaatgtcattgacatctatctatctatctatctatctatctatctatctatcatctatctctatgtctatgtctgtatctcagacatagatatatgtctcatgtattaattgatagatgagatacagacatagacatatcaaatagacatccattgatagacagatattctttaagagacagggtctggctccaatcctaagcaaaaagaacaaagctggaggcatcacgctacctgacttcaaactatgctac

SEQ ID NO: 8259 - DNA, 303 bp, Homo sapiens
  AC010647.4_68087
  Located on chromosome 5
  Distance between a terminus base of telomere on chromosomal short arm and 5'-terminus of this base sequence : 27772447
  Distance between 3'-terminus of neighbour sequence of sequence listing upward to telomere on chrosomal short arm and 5'-terminus of this base sequence : 181620
ggccatgtcaatatgatttaacaaattgttgatgacaattaacaattaaataattcagctgaattcaagattattgcgaatcttatgtatgactgctttttctcacctgagaagggttttctaggcaaaagcactggggtcagattcaggtctatattctgcctgattcttccatctttcccagcactatctccagagaagaaactgggagaactgcctttttctttctttctttttattattattattattattattattatactttaagttttagggtacatgtgcacaatgtgcaggtta

SEQ ID NO: 8260 - DNA, 213 bp, Homo sapiens
  chr5.fa.O7frz.34219038
  Located on chromosome 5
  Distance between a terminus base of telomere on chromosomal short arm and 5'-terminus of this base sequence : 27797866
  Distance between 3'-terminus of neighbour sequence of sequence listing upward to telomere on chrosomal short arm and 5'-terminus of this base sequence : 25116
aatgactgcaaatactcaagttactaacatttctttggaaatgattattgctatatcttcaatcactcctttacacacacacacacacacacacacacacaaaagatgacatgaaatgaacaaaataggtaggaaactgttagtattgcaaatgtattttatttaccaaaccattataggtttaaacttgtattcataccttgactcgtacat

SEQ ID NO: 8261 - DNA, 449 bp, Homo sapiens
  AC010218.4_201436
  Located on chromosome 5
  Distance between a terminus base of telomere on chromosomal short arm and 5'-terminus of this base sequence : 28003609
  Distance between 3'-terminus of neighbour sequence of sequence listing upward to telomere on chrosomal short arm and 5'-terminus of this base sequence : 205530
ggaggtaaggtttctatacttcacttgaagcaataacgtgataataccagcagactatgaagagtaatgtatacataatgtgatatatagagcaatcactaaacaagttattcaaagagatacatcaaaatcactatagaatataataaaaaagaacaaactattgatacatgcaatgccctggatgaaactccggagaattcggctgagtgaaaaaagccagtccctaaatgttacatcatgcattgttcaatttacatgtgtgtgtgtgtgtgtgtgtgtgtgtgtgtaaaacaaaattatataaatggtcaacagattagtgattaccagaagttaaggtggtgttggaggcaggcagtaactggatatggctattataaatgagagattgttgtgatgatggaaatgttctgtatcttcactgaataaatgtcagtatcctggct

SEQ ID NO: 8262 - DNA, 181 bp, Homo sapiens
  D5S651
  Located on chromosome 5
  Distance between a terminus base of telomere on chromosomal short arm and 5'-terminus of this base sequence : 28090513
  Distance between 3'-terminus of neighbour sequence of sequence listing upward to telomere on chrosomal short arm and 5'-terminus of this base sequence : 86455
cccaccttggtatcccaaaatcctaggattacaagcatgagccaccacacctggcctcagaaatagaactttgttatgagtgtgttacctggatgcaataaagtgctatagtcgtgtgtatgtgtgtgtgtgtgtgtgtgtgtccaggtcttattctgttgcccaggctgagggcagtgac

SEQ ID NO: 8263 - DNA, 441 bp, Homo sapiens
  AC025472.2_137507
  Located on chromosome 5
  Distance between a terminus base of telomere on chromosomal short arm and 5'-terminus of this base sequence : 28090533
  Distance between 3'-terminus of neighbour sequence of sequence listing upward to telomere on chrosomal short arm and 5'-terminus of this base sequence : -161
tcctaggattacaagcatgagccaccacacctggcctcagaaatagaactttgttatgagtgtgttacctggatgcaataaagtgctatagtcgtgtgtatgtgtgtgtgtgtgtgtgtgtgtccaggtcttattctgttgcccaggctgagggcagtgacacaatcacatgtaactgcagccttgacctcctaggctcaagcgatcctcttacctcagcctctcaagtagctaggactacaggcatgcaccactacacctggctaatttttgatttatagagacaaggtcatgctatgttgcctaggccagtctaaaactcctggacacaagcagtcctcccactttggctttccaaagtgctgggattacaggtgttagccattgcacctagtccagtgctataatcattaatattcattcagcaagtatgtgttgaat

SEQ ID NO: 8264 - DNA, 238 bp, Homo sapiens
  HUMUT716
  Located on chromosome 5
  Distance between a terminus base of telomere on chromosomal short arm and 5'-terminus of this base sequence : 28096317
  Distance between 3'-terminus of neighbour sequence of sequence listing upward to telomere on chrosomal short arm and 5'-terminus of this base sequence : 5343
ggctgaggcagaagaatctcttgaacccaggaggcagaggttgcagtgagccaagatggcaccactgcactccagcctgggcaacaagagtgagactctgtctcaaaaaaaagaaagaaaaggaaaggaaaggaaggaaggaaggaaggaaagaaagaaagaaagaaagaaagaaagaaagaaagaaagaaagaaagaaagaaagacaaacataaaaacatgtgaagacctcccatga

SEQ ID NO: 8265 - DNA, 442 bp, Homo sapiens
  AC025472.2_160646
  Located on chromosome 5
  Distance between a terminus base of telomere on chromosomal short arm and 5'-terminus of this base sequence : 28113701
  Distance between 3'-terminus of neighbour sequence of sequence listing upward to telomere on chrosomal short arm and 5'-terminus of this base sequence : 17146
cctatgtaacaaacctgtacgttctgcacatgtatcccattttttttagaaggaaggaagacagacgaaagtaagaaagaaagaaagaaagaaagaaagaaagaaagaaagaaagaaagagaaagaaaaagaaagaaacctttgggaggtgattaggtcatgagggcagagcacttatggatgggatgatacccttgtcaaaggacttgagggaactagctaggcccttttgtcttctgtcccttctactatctgaggacacagtgtttgtcccttccagaggaaacagtgtttaaggcaccatcttggaagcagagaacaggccctcactggacactgaacctgccagcactttgatcttggactatcgagcctccataactatgagcaataaacttacaatgtgtatacattacccagtctaaggtacttcgttatagca

SEQ ID NO: 8266 - DNA, 442 bp, Homo sapiens; identical to SEQ ID NO: 8265
  AC010218.4_63348
  Located on chromosome 5
  Distance between a terminus base of telomere on chromosomal short arm and 5'-terminus of this base sequence : 28113701
  Distance between 3'-terminus of neighbour sequence of sequence listing upward to telomere on chrosomal short arm and 5'-terminus of this base sequence : -442

SEQ ID NO: 8267 - DNA, 447 bp, Homo sapiens
  AC008899.4_91964
  Located on chromosome 5
  Distance between a terminus base of telomere on chromosomal short arm and 5'-terminus of this base sequence : 28198108
  Distance between 3'-terminus of neighbour sequence of sequence listing upward to telomere on chrosomal short arm and 5'-terminus of this base sequence : 83965
cagactttaaaccgtcttcagcttgaaggtcgggtttcaccagggtcccacccccatctgcctcggcatttgactgcctcctgccgctatcaagatcaccattgaaaactcttagattgtctgggtgtggtggccacacctgtaatcccagcacttgggaagccaaggcgggtcacttgagtctaggagtttgagagcagcctgggtaacatggtgaggcccccatctctaaactaaaaggtaattaaaaataaataaataaataaataaataaataaataaataaaactctaaggtaagtgctgacaatgttgaattttacctgggccctgtgatcctggaaaatagccatggttaaagatatccccccactctctgtgttcccaatatcactttattgccaagaaatacacttttccatatgacttagataagatgcacagatgc

SEQ ID NO: 8268 - DNA, 266 bp, Homo sapiens
  D5S674
  Located on chromosome 5
  Distance between a terminus base of telomere on chromosomal short arm and 5'-terminus of this base sequence : 28299406
  Distance between 3'-terminus of neighbour sequence of sequence listing upward to telomere on chrosomal short arm and 5'-terminus of this base sequence : 100851
cttccaggtccagggctcaggagccatggtccagttgttctctgctgcccatctcattcttttgggtgtttgccataatcccacctcttgttggagatttctaaaatactgtttttatatttatggagattttatgttttatctaaatgtctaagtgtgtgtgtgtgtgtgtgtgtatgtgtgtgcctatgtttgagatctttgaagagcctgtagttgttccagaattctgtaaaagtttactgtagtttggatatgagtcctct

SEQ ID NO: 8269 - DNA, 254 bp, Homo sapiens
  D5S2062
  Located on chromosome 5
  Distance between a terminus base of telomere on chromosomal short arm and 5'-terminus of this base sequence : 28474296
  Distance between 3'-terminus of neighbour sequence of sequence listing upward to telomere on chrosomal short arm and 5'-terminus of this base sequence : 174624
tctcagggacaagggtgggagccccataaatgacaccacctgaaaatatggctctttgaagccctgagcaaaaagaggaatgccagagttttctggtcattttttactacctatcttgcacccaacaatcttctatcagaaaagttttctgcttctcataatttctttgtctttgctctgtgtgtgtgtgtgtgtgtgtgtgtgtgtgtgtgtgtgtgtgcgtatgcgcttctaagcagcaatccataaaccca

SEQ ID NO: 8270 - DNA, 340 bp, Homo sapiens
  AC008880.3_90759
  Located on chromosome 5
  Distance between a terminus base of telomere on chromosomal short arm and 5'-terminus of this base sequence : 28504229
  Distance between 3'-terminus of neighbour sequence of sequence listing upward to telomere on chrosomal short arm and 5'-terminus of this base sequence : 29679
ctcctgtaaattggtcaacagagctaaaggctttattaaagtgtgtgtgtgtgtacacacacgcacatgtgtgcacatagagattcaggtatacacacaaacacacatatacttgactctaatcaaacttctagcttgacatacaaacatatatatatatatatatatatatatatgcatgttgatatatatatggctaaggtgcagacatcagctacatgtatatgtgtatatgtaagaatactgaataggtggtgctgtgttcttcctgttgcatcccacaggagaaacccctaatgtctggttcttgcacatttagtgatgttaacattggtcagag

SEQ ID NO: 8271 - DNA, 383 bp, Homo sapiens
  D5S1506
  Located on chromosome 5
  Distance between a terminus base of telomere on chromosomal short arm and 5'-terminus of this base sequence : 28543145
  Distance between 3'-terminus of neighbour sequence of sequence listing upward to telomere on chrosomal short arm and 5'-terminus of this base sequence : 38576
ttgtggtagcttattatgcagcaatagaaagctattacctcagcaaatttcctttatccccacttccctgtcttactcacccattaaaaaaacatgttaataaaaaaatagtaaccactctgttgtgctttgacatgtatcctcgcatttggatatgtccttggagaaaaaaaaatagatagatagatagatagatagatagatagatagatagatagaatgtttttgtttgctaatgtagtttattttatatcaatagtattgtgtcataaatactatgctatttattgtcttataaaaaaactcaaatataccttgttaccatctatccatttgctgtgggcatatctagtgggttccttctaactgctacaaaatattcc

SEQ ID NO: 8272 - DNA, 303 bp, Homo sapiens
  chr5.fa.O7frz.35134578
  Located on chromosome 5
  Distance between a terminus base of telomere on chromosomal short arm and 5'-terminus of this base sequence : 28683048
  Distance between 3'-terminus of neighbour sequence of sequence listing upward to telomere on chrosomal short arm and 5'-terminus of this base sequence : 139520
ttgtagaaggttaaccaggttcatatttagtctagcattttttattttgctagacacacacacacacacacacacacacacacacatttcctgcaagaacctgggcgaaactcttcttatatcttccccattggttcctttattaatgtgttaatttaaaaccttgacataatctataacttagagaattattagcactctcttatcttagggaagggggtaaaaaaaaaaaaaagggaagaactgtcttatttgtcccaaagctactgttttgaagtagttgtagctgcaagttagaatagt

SEQ ID NO: 8273 - DNA, 373 bp, Homo sapiens
  chr5.fa.O7frz.35242691
  Located on chromosome 5
  Distance between a terminus base of telomere on chromosomal short arm and 5'-terminus of this base sequence : 28791041
  Distance between 3'-terminus of neighbour sequence of sequence listing upward to telomere on chrosomal short arm and 5'-terminus of this base sequence : 107690
caacagaattactctatgaaccacaaatttcacttctggggatatattttaaaaaaatgaaatgcagagtctcaaagagataattgtgcacccatgttcataatagcattgtttacgatagccaaaagatggaaggacccccaggtgtcacacagtcaatgaatggataaacaattatggtgtgtgtgtgtgtgtgtgtgtgtgtgtatacacacacacacggtggaatattcatcagccttaaaaaggaaaagaattttgacacaagttggaatatgagggaaacttaaagacattgtactaaatgaaataaatcagtcacaaaaagacaaacactgaatgattacacatgtatgaggtagctagagtcatc

SEQ ID NO: 8274 - DNA, 114 bp, Homo sapiens
  DISO7_10016472
  Located on chromosome 5
  Distance between a terminus base of telomere on chromosomal short arm and 5'-terminus of this base sequence : 28880121
  Distance between 3'-terminus of neighbour sequence of sequence listing upward to telomere on chrosomal short arm and 5'-terminus of this base sequence : 88707
tctaatcacagtgtttcaattccatttttctcaaaacacacacacacacacacacacacacgaaaagcctgtaacctttgaaagcctaaaatgtaggagttcctccaggtactc

SEQ ID NO: 8275 - DNA, 475 bp, Homo sapiens
  chr5.fa.O7frz.35945466
  Located on chromosome 5
  Distance between a terminus base of telomere on chromosomal short arm and 5'-terminus of this base sequence : 29146563
  Distance between 3'-terminus of neighbour sequence of sequence listing upward to telomere on chrosomal short arm and 5'-terminus of this base sequence : 266328
gtcattgctaatagcaattgtatctccttactcaatatcctccttcaccctgccctcaagaacatagtagaataataggccatcagtcaatcctcaataaatattttgtattagtgtgaaatctgaaaaataaaagcaatctacctgtctattatctatctttatctatctgtctatctgtctatctatctatctatctatctatcatctatctgcctatatagctaatatattaaatcatctactgtctatttttatttctctgtcttcatttcaattttacctataccctattttttacattttaattgttaaattgaggtttttagttagaaaacatatagtggtgttttaataaattgttattctcctacttaaaaaaaaataaactggaagtgtttgattaattctttgtgaagatgaaaaccaaaaaggtcttaataagattttattcagaaccttgtttctaattaga

SEQ ID NO: 8276 - DNA, 212 bp, Homo sapiens
  HUMUT1237
  Located on chromosome 5
  Distance between a terminus base of telomere on chromosomal short arm and 5'-terminus of this base sequence : 29301084
  Distance between 3'-terminus of neighbour sequence of sequence listing upward to telomere on chrosomal short arm and 5'-terminus of this base sequence : 154046
ctctcagaaaagcagaagtcaaaatgtcacttaaccttttattgtttttaagaattagttaaatcaaagatttataacaatataattatattatcctaaaaagtatatagataaatagacagatagatgatagatagatagatagatagatagatagatgatagatagatagatagagcaattattttggtgcagcatgcctagtgtaaact

SEQ ID NO: 8277 - DNA, 285 bp, Homo sapiens
  AC018763.3_112831
  Located on chromosome 5
  Distance between a terminus base of telomere on chromosomal short arm and 5'-terminus of this base sequence : 29408828
  Distance between 3'-terminus of neighbour sequence of sequence listing upward to telomere on chrosomal short arm and 5'-terminus of this base sequence : 107532
gaaacaagcagaaagtgacaacaacaacaacaacaacaaaaaggccctcacaaaaaccccatccaagggtcagcagcctcaaagaccaaaactagaaaaactcatgaaggtgagaaagaatcaatgaaaaaatgtggaaaacccaaaaggtcagagtgcctcttgtcctccaaatgatagcaaggtctctccatcaagttcacagaactagatggaggatcagatgacgaattcacagaagtaggcttccgaagatggataataaccaactacgatgagctaaag

SEQ ID NO: 8278 - DNA, 261 bp, Homo sapiens
  Z66638
  Located on chromosome 5
  Distance between a terminus base of telomere on chromosomal short arm and 5'-terminus of this base sequence : 29488503
  Distance between 3'-terminus of neighbour sequence of sequence listing upward to telomere on chrosomal short arm and 5'-terminus of this base sequence : 79390
tgccactgtttgttttgcttaactgcttttttgttgttgtttgtttctgtttttgctgttttcgtctttttcccattgggtttgattaactctatccaatttgatcaaatccaaataaaggaaaagaaagttccaaattatgaggagcaaggcctctgaagtggctaaattctctctctctctctctctcacacacacacacacacacacacacacacacacacaaacacacacacacaataaagggtggtaggtggtgtg

SEQ ID NO: 8279 - DNA, 363 bp, Homo sapiens
  chr5.fa.O7frz.36373962
  Located on chromosome 5
  Distance between a terminus base of telomere on chromosomal short arm and 5'-terminus of this base sequence : 29533502
  Distance between 3'-terminus of neighbour sequence of sequence listing upward to telomere on chrosomal short arm and 5'-terminus of this base sequence : 44738
ccagttagtaacagatttgagaacaaaacacaggagtgacatgatgcctggttcagtagtgtcttccactgtgtgtttgtctctctttctgtgtgtgtgcgtgtgtgtgtgtgtgtgtgtgtgtgtgtgtgtgtgtgtgttcatcttggtcaattgagagaccatcctgggaagataataaagaatgatccacttcattgtgcaattactctgtacaataagtaaaaatatttcttgaaatctataaacaagaaatcattttttcccacttcaattctctactttcttcgggtaaaatcttgtttatggtttttggattttgaataagaatcttacttgttcttatcaggagtggttcaattt

SEQ ID NO: 8280 - DNA, 290 bp, Homo sapiens
  Z66823
  Located on chromosome 5
  Distance between a terminus base of telomere on chromosomal short arm and 5'-terminus of this base sequence : 29582689
  Distance between 3'-terminus of neighbour sequence of sequence listing upward to telomere on chrosomal short arm and 5'-terminus of this base sequence : 48824
tcaaggttgtgttctatattacgagaaattagattatgatttttgattctcgttatcttctaaccaatggaagatagataatggcacaaatgagaacctgctttctccagaggagttcatgctgttaaaaaaataaagaaaaagaaagtcaaaatgtttttgataatattcaatgtaagtcctctttctttctctacctaatctctcattctctttctctctctctcacacacacacacacacacacacacatgcatttacatataaaaccactatcaataaagcaatgc

SEQ ID NO: 8281 - DNA, 308 bp, Homo sapiens
  chr5.fa.O7frz.36997416
  Located on chromosome 5
  Distance between a terminus base of telomere on chromosomal short arm and 5'-terminus of this base sequence : 29828043
  Distance between 3'-terminus of neighbour sequence of sequence listing upward to telomere on chrosomal short arm and 5'-terminus of this base sequence : 245064
gaagtttcagtgagtcgagatagcgccatcgcactccagcctgggcaacaaaagcaaaactctgtctcaaaataataataataataataataataataataataataatatattagtctgaggaagtcaagagaatagaaaattatatgtgtctagaccttattcaaacaaactttgttttactttactaaacttgttcaagtattgaataactctaggtggaatctagaagctggtaataaattagttctgcctcactatctctgcctagtgttttctctttgctcttagtcaagatgaagctacat

SEQ ID NO: 8282 - DNA, 437 bp, Homo sapiens
  AC025742.4_87177
  Located on chromosome 5
  Distance between a terminus base of telomere on chromosomal short arm and 5'-terminus of this base sequence : 29950287
  Distance between 3'-terminus of neighbour sequence of sequence listing upward to telomere on chrosomal short arm and 5'-terminus of this base sequence : 121936
tgctctgattaaggagactaaagaagcgtaaaacctcagtaccatatatgatttttaattggtctctagatttgaaaaaaagctatgaaggacatcttgggtacaattaggaaaacttgattatgtacttatacattaggtaatattataataccatatcagtaataaatatttgggatatagtaatggtatattaccactgttcttaggagatgcctgctgaagtatttggggacaaggagtcttgatgactgcaactttaattttaaaacatgcaaagaaagagagagagagagagagagtatgtaccagaatatattgtataattctttcaaattttctgtatctttaaacttttttacaaattgaaattaaaaacctatataaagcacttcattacatcccactatttaatagtaaatgtgcttcagacactt

SEQ ID NO: 8283 - DNA, 384 bp, Homo sapiens
  AC025742.4_56976
  Located on chromosome 5
  Distance between a terminus base of telomere on chromosomal short arm and 5'-terminus of this base sequence : 29997715
  Distance between 3'-terminus of neighbour sequence of sequence listing upward to telomere on chrosomal short arm and 5'-terminus of this base sequence : 46991
catgctagagattgtttagcaccacaaaaagaaaataatggaagacacagtggagaagaggtggagcaagatgatggaatggaaaaccccaacaattctgccctccacaggaacaccaagttcaacaactatctacacacacacacacacacacacacacccacacacacatcttcgtaagaatcaataataaagtgagcactcacagtacctggttttgacttcatatttttcaaagaggcactggagagggaaagaaagacagtcttcaactgtcaatgctaccccttcccctatcatcccacagtgccctcatgctgcagagaaatctgtgcacttggaagagggagagtgcagcaattgtaagactttgcattgaactca

SEQ ID NO: 8284 - DNA, 204 bp, Homo sapiens
  DISO7_10001950
  Located on chromosome 5
  Distance between a terminus base of telomere on chromosomal short arm and 5'-terminus of this base sequence : 30214008
  Distance between 3'-terminus of neighbour sequence of sequence listing upward to telomere on chrosomal short arm and 5'-terminus of this base sequence : 215909
ggacagctctgtttctatacatgatatgttaagtctctcattacttaggcaaaaaaaaaaaaaaaaatgtgtgtgtgtgtgtgtgtgtatacacatacatagttataataaatatcgagaattattaactttaacattatagataatgtcagttatttatagggtaggtggttggattttcagggatggataccttctttgtgt

SEQ ID NO: 8285 - DNA, 443 bp, Homo sapiens
  chr5.fa.O7frz.23197150
  Located on chromosome 5
  Distance between a terminus base of telomere on chromosomal short arm and 5'-terminus of this base sequence : 30489851
  Distance between 3'-terminus of neighbour sequence of sequence listing upward to telomere on chrosomal short arm and 5'-terminus of this base sequence : 275639
aacatcactaaggtattctgtgagtcagtaaaaagaggttttttgttttgttttgtttgcttttggtgtgttcttgataatctctggtgtttctgctagtgtatttgtgtgtatgtgtgtatctattgaactatatttctatcttctatttatccaatctgtatgtatatacatatctatatctatttatcttactatataatctacccagtatctatctatctatctatctatctatctatctatctatctatctaatctaaacaagtagtgtaacattttcaactcttcacagttttacacctaagagatgtatatgtggcagcaaggatatgacacaaagcaaacatgtaagaattgtactaagtaatttttttgagaattgtattgaaaaaataaaaacaacaaaaacgtaatcaaataatatttcaaacctagcctga

SEQ ID NO: 8286 - DNA, 352 bp, Homo sapiens
  chr5.fa.O7frz.23523028
  Located on chromosome 5
  Distance between a terminus base of telomere on chromosomal short arm and 5'-terminus of this base sequence : 30809890
  Distance between 3'-terminus of neighbour sequence of sequence listing upward to telomere on chrosomal short arm and 5'-terminus of this base sequence : 319596
attaacaaggtctgtcaaacatactgttttttcataacaaatccaaaatcgtgtcatctaaccctcagctcctgattcttgagattttggtagtaatgcaaactgtctagtttccatttcacaatattaattcaaagtaaactttttgcaaaaataatggtttcattaagaaatcaacacacatgcacacacacacacacacacacacacacacaaacacacaccaatgcaccatttaggcacatatgtatttcccaaattataaaatgggaattattaaaacccttacaatattatagtatttttgggaggaaaaaataaagagcactcctcaaattcagtaaatggtgtg

SEQ ID NO: 8287 - DNA, 413 bp, Homo sapiens
  chr5.fa.O7frz.23628584
  Located on chromosome 5
  Distance between a terminus base of telomere on chromosomal short arm and 5'-terminus of this base sequence : 30901862
  Distance between 3'-terminus of neighbour sequence of sequence listing upward to telomere on chrosomal short arm and 5'-terminus of this base sequence : 91620
gtcagtttaattgacaccttaaatggtgatttaaaatatttgcaaattatttctattgttaaatttatgattaatctttaagaaaatgtataataaatcacaaaagaagaaagtagattttgtgcataaaaccgttaaaatacaaacaaaaccttgtgtcagacttagcatgtgttactgatatgtactttaatcttctacaaaatttcagtttgtaatttctcaaacacacacacacacacacacacacaatcacacacataacctagtgttataaaggtgccaatggtataaagaaagattatgaacttcaaagtcatagtttcccagagagaaaaaaattgtatattcagagatgtaaattgattcaggtaaaatacctagttagtagttaaactggcaatcaaagtcta

SEQ ID NO: 8288 - DNA, 352 bp, Homo sapiens
  HUMUT890
  Located on chromosome 5
  Distance between a terminus base of telomere on chromosomal short arm and 5'-terminus of this base sequence : 31178878
  Distance between 3'-terminus of neighbour sequence of sequence listing upward to telomere on chrosomal short arm and 5'-terminus of this base sequence : 276603
ggcaggagaatcacttgaacctggggcagtgagcagagattgtgccattgcactccagcctgggagacaagagtgaaactccatctcaaaagaaagaaagaaagaaagaaagaaagaaagaaagaaagaaagaaagaaagaaagaaagaaagaaagagaaagaaagaaagagacagaggatatcaatgaggagagctaggaaagatttctgagtagcaaaaggaggtgacttcaagtgcacatttagatatgtatctacctaattatagtattaaaactactcctatacaattaagcttgtttgattaccttgttaattcctacttcaagagactgctctttgtttctttcc

SEQ ID NO: 8289 - DNA, 479 bp, Homo sapiens
  chr5.fa.O7frz.24082480
  Located on chromosome 5
  Distance between a terminus base of telomere on chromosomal short arm and 5'-terminus of this base sequence : 31327864
  Distance between 3'-terminus of neighbour sequence of sequence listing upward to telomere on chrosomal short arm and 5'-terminus of this base sequence : 148634
acatagttgatccatacaagatctctcatatttaattttctctttttaccccaatcatcatgatgcaatctccttagatagcaattgtcatgtgttgtgacatgttcacaaagatatgtttccaagaaaaatatgttctgaggtgtgtgtgtgtgtgtgtgtgtgtgtgtgtacattaccataaagctgcctcttccagttctgagacagcaagaccaacccttcctcttcctcctcttcctcagggtactcagtttgaagacaaggaagatgaagacctttatgatgattcactgccacttcatgaatagtaaatactcccttctttgtttttctcaatagcatttccttttctctagcttcctttattgtaagaatacagcacattatatatatatataaacatataaaatatatatatatataaacatataaaatacatgttaatcaactgtttgttaccaataaggcttctgatc

SEQ ID NO: 8290 - DNA, 421 bp, Homo sapiens
  chr5.fa.O7frz.24186527
  Located on chromosome 5
  Distance between a terminus base of telomere on chromosomal short arm and 5'-terminus of this base sequence : 31431816
  Distance between 3'-terminus of neighbour sequence of sequence listing upward to telomere on chrosomal short arm and 5'-terminus of this base sequence : 103473
gtcttaaacttaatgcaaaggataaaactaataataacaacaacaaaaatagaaatgaatgtcccaaaaccaggatcaatttgaaaatcttcaacaaacacataatagtaatactaaaagaggaataaagagatagtgtagcagaagtaatacttcaaggaacaatggctaagaactttacaaaattaagaatagacacgaaaacaaacactcaggaagctcagagataacaggcatgataaacacacacacacacacacacacacacacacacactcacaaaataacacatattattttcaaattgcagacagctaaaagtgaaaaaaaaactcttgaggaaacacaagagggaaaatacctagagaagaataaggttaggaattacagcaaacttcttatcataagtccataagcaaga

SEQ ID NO: 8291 - DNA, 424 bp, Homo sapiens
  chr5.fa.O7frz.38833304
  Located on chromosome 5
  Distance between a terminus base of telomere on chromosomal short arm and 5'-terminus of this base sequence : 31529170
  Distance between 3'-terminus of neighbour sequence of sequence listing upward to telomere on chrosomal short arm and 5'-terminus of this base sequence : 96933
tgcttttgtcaataaactagaaacctttgtgggttttgaaatacccaaagatttttagatttgactccaaaattggctgggtgtggtagttcatgcctgcaatccatactttgtgaggctgaggcagtaagattgtttgatgccagcagttcaagaccagcctggacaacacagcaagaccctgtctcaaaataaagaaagaaagaaagaaagaaagaaagaaagaaagaaagaaagaaagaaagaaagaaagaaagaaagaaactaaaaaacaaaaaaagatttgattccattccattccatgtgccaaaagtcatacccataattcttttaaactatgcttctctctttagacataattactgctaatttaggcataccaggctgctgtggaaacatgcccttaagcttcctaagactcgtt

SEQ ID NO: 8292 - DNA, 316 bp, Homo sapiens
  chr5.fa.O7frz.38725226
  Located on chromosome 5
  Distance between a terminus base of telomere on chromosomal short arm and 5'-terminus of this base sequence : 31637609
  Distance between 3'-terminus of neighbour sequence of sequence listing upward to telomere on chrosomal short arm and 5'-terminus of this base sequence : 108015
aaagaaatactcactttattgcagtgttctggaaacaaacctgcaatatctccgaagtatgtctctctctctctctctctctctctctctctctctctgtctctctctctccccctgtctctgtgtttgtgtgttttaaccaaatgtgcaaaatatctaggctcaattatttacacaccacattaaagaaactcaaaattgaggaaatctttttacattacagaatatttgggatccattgcaaatttttgcatgaccttaatgatctcaatacatactttcactattacaaataaagctagttgctaaggttaca

SEQ ID NO: 8293 - DNA, 109 bp, Homo sapiens
  DISD22_0004581
  Located on chromosome 5
  Distance between a terminus base of telomere on chromosomal short arm and 5'-terminus of this base sequence : 31844105
  Distance between 3'-terminus of neighbour sequence of sequence listing upward to telomere on chrosomal short arm and 5'-terminus of this base sequence : 206180
ttgctctgccaactgttccccaccattgtacacacacacacacacacacactgcacacactacacacactacacacacacacacacaccccattgttatttctgcaagg

SEQ ID NO: 8294 - DNA, 460 bp, Homo sapiens
  AC010599.5_39405
  Located on chromosome 5
  Distance between a terminus base of telomere on chromosomal short arm and 5'-terminus of this base sequence : 32106180
  Distance between 3'-terminus of neighbour sequence of sequence listing upward to telomere on chrosomal short arm and 5'-terminus of this base sequence : 261966
aactattgtacagcatggtgactatagttaataataatatattacatacttgaaaattgctaagagagtggatcttatgaccaaaacatatgtgaggcaatagatatgttaattagcttgaatcaatcatttcacaagatctatctatctatctatctatctatctatctatctatctatctatctatatgtcaaaacatcacattatatactgtaaaatatataaaatttttatttgtcaattataccttaataaaactgggagaaattgttaagaggataaatcacatgttaagtgttctcacagcaacaaaaagcagagcaaaacaaaatgaaacaacaaacaagaagcacaagacaacttttggaggtgatgaacatgtgtattactttgcggtgatgatttcacgggtgtatgcctatgtccaaactgatcgaattgtatctattaaacgtgcag

SEQ ID NO: 8295 - DNA, 247 bp, Homo sapiens
  D5S2101
  Located on chromosome 5
  Distance between a terminus base of telomere on chromosomal short arm and 5'-terminus of this base sequence : 32113849
  Distance between 3'-terminus of neighbour sequence of sequence listing upward to telomere on chrosomal short arm and 5'-terminus of this base sequence : 7209
atgtcagtcaccgctttccacctgccctgctgtatgccgttctctgcccatgcctcctcttccacctggagcccttagattcctactcaggaaagaaaacgtgtggggtgtgtgtgtgtgtgtgtgtgtgtgtgtgtgtgtgtgtgtgtgataaagaggaggtgttcttatttgccctacttctgtttactacaacatctttttaaatgtgcctttcaactatttgcctgagctagatgcctatgca

SEQ ID NO: 8296 - DNA, 168 bp, Homo sapiens
  D5S1436
  Located on chromosome 5
  Distance between a terminus base of telomere on chromosomal short arm and 5'-terminus of this base sequence : 32123204
  Distance between 3'-terminus of neighbour sequence of sequence listing upward to telomere on chrosomal short arm and 5'-terminus of this base sequence : 9108
aaacagaggactagaaaggcatattaaaattacttagattcatattaagaagtcttaaaataactgtgattggtgtgtgtgtgtgtgtgtgtgtgtgtgttttctcagagatgattcgaatattttctctttcaaaatatcttcctttgtgactgtactctttattag

SEQ ID NO: 8297 - DNA, 418 bp, Homo sapiens
  chr5.fa.O7frz.40177778
  Located on chromosome 5
  Distance between a terminus base of telomere on chromosomal short arm and 5'-terminus of this base sequence : 32318841
  Distance between 3'-terminus of neighbour sequence of sequence listing upward to telomere on chrosomal short arm and 5'-terminus of this base sequence : 195469
tatctatgcctagaccattcatacacacacacacacacacacacacacacacacgcacacgaatttctagcaaatgaggcaagagggaaagtcagttggtgatggacaagagaggattctgggatgaatgagacctagagagagtatctcaggctggatttcctaaagaaaagcctgagatgtggattcttgtgcaagatatttgctgagggtgtattccctggagacgaagagtgagggaagcagaatagagtgcaggaagaaggctaagcaagagtatgttctcaggtggagaacggcttcagcctggtcctacaggaagctctgggacaaacacttcacatggagttggtcccatgatgaggcaaaggattgatcttttgtaaccccgtgttggtcaatcactagtcattggttg

SEQ ID NO: 8298 - DNA, 208 bp, Homo sapiens
  D5S2025
  Located on chromosome 5
  Distance between a terminus base of telomere on chromosomal short arm and 5'-terminus of this base sequence : 32764566
  Distance between 3'-terminus of neighbour sequence of sequence listing upward to telomere on chrosomal short arm and 5'-terminus of this base sequence : 445307
ccaagtccttgaaatacgtgtgtgtgtgtgtgtgtgtgtgtgtgtgtgtgtgtgtgtccaattggtactgtttttctgatttcctaggattctggtttcctaggattggttctctattatgagaacaaagtgattcaaatattgattatatttgaaaccgataactcttttcagtggtaaagagggcactcatcctgtggcattaggt

SEQ ID NO: 8299 - DNA, 461 bp, Homo sapiens
  AC022136.3_72784
  Located on chromosome 5
  Distance between a terminus base of telomere on chromosomal short arm and 5'-terminus of this base sequence : 32785784
  Distance between 3'-terminus of neighbour sequence of sequence listing upward to telomere on chrosomal short arm and 5'-terminus of this base sequence : 21010
tctctattgacgtctagtaaccatggagggatcctgagtgaaagtgacccagcctgcagcctctcatctctcgtgtttggttccggcttgggcaccttatagcccaaaccaataggacaattttctgaagtccaggatctctttcctccagggatccctgatcttccaaagtttttcagggatctaggagtctgaggtttatatgctgttattaaacaaacaaacaaacaaacaaacaaaaagctccttttttatgggagtttccacttgtttccttcaaggagggcgagcctatctgcttctgtatcagggatcttgcggtctgaggtttatttgctgtttaaaaaaaaactccttttttgtgggagtttccactcatttccatcaaggaaggtgagcctgtctgcttttgtatcagcagaaagcagacttcagcttggacctccatcactaggtaaaga

SEQ ID NO: 8300 - DNA, 136 bp, Homo sapiens
  Z66972
  Located on chromosome 5
  Distance between a terminus base of telomere on chromosomal short arm and 5'-terminus of this base sequence : 33075634
  Distance between 3'-terminus of neighbour sequence of sequence listing upward to telomere on chrosomal short arm and 5'-terminus of this base sequence : 289389
tggtatgggtcttgcctatgctctgtatataaaaatacacacacacacacacacacacacacacacacacacatctttatctgccactttatgtctctgcagacaagtaaagttgaatacagccaatcgtagacca

SEQ ID NO: 8301 - DNA, 188 bp, Homo sapiens
  D5S2085
  Located on chromosome 5
  Distance between a terminus base of telomere on chromosomal short arm and 5'-terminus of this base sequence : 33089422
  Distance between 3'-terminus of neighbour sequence of sequence listing upward to telomere on chrosomal short arm and 5'-terminus of this base sequence : 13652
tcattttgagtaggctgaggagggggaggaagaggaagggttgatcttgctgtctcaagggtggcaaaggaagaaaatccacatataagtggatctgaacagttcaaatttgtgttgttcaggagtcacctgtatacacacacacacacacacacgcacacacacacatcctattggttctgtttccc

SEQ ID NO: 8302 - DNA, 121 bp, Homo sapiens
  D5S1994
  Located on chromosome 5
  Distance between a terminus base of telomere on chromosomal short arm and 5'-terminus of this base sequence : 33238547
  Distance between 3'-terminus of neighbour sequence of sequence listing upward to telomere on chrosomal short arm and 5'-terminus of this base sequence : 148937
ctcaaagagtgcataacccaagagagagataagttatctgttttacagcaggaaacacacacacacacacacacacacacacacacacacacacagatctgggtttcagtttcatctttaa

SEQ ID NO: 8303 - DNA, 418 bp, Homo sapiens
  chr5.fa.O7frz.41529913
  Located on chromosome 5
  Distance between a terminus base of telomere on chromosomal short arm and 5'-terminus of this base sequence : 33456946
  Distance between 3'-terminus of neighbour sequence of sequence listing upward to telomere on chrosomal short arm and 5'-terminus of this base sequence : 218278
  misc_feature (1)...(418): n = A,T,G or C
gtctttgtcatgttcaagtcacagaacactgactctttccatggctagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatatgtataaataggaatgcatagaattgagtggtagttttacctgaaggcattcacaaacacagtaaactagcagctttctctgatgttggtcttggcgcacgcgcacacacacacacacgcacacacacacacacagagtttgcatttgagttctcctttttctgatggtctccttgcacagttcacatttgagttctcctttctctgatattgatctctcacacacacacacatacacacacactcacagagtttacatttgagttc

SEQ ID NO: 8304 - DNA, 355 bp, Homo sapiens
  AC010386_41192
  Located on chromosome 5
  Distance between a terminus base of telomere on chromosomal short arm and 5'-terminus of this base sequence : 33548208
  Distance between 3'-terminus of neighbour sequence of sequence listing upward to telomere on chrosomal short arm and 5'-terminus of this base sequence : 90844
tattgagccaataaggagaagttgagttcaaaacttaacaccttcctacatcttatgcccttactcatcctggctccatctcaccagtatctattttactttggggaaggaagcagttaaatttcaatatgaaacaacagctcccagaactttcattaccgccagtaattactgctcagggaaaggataaataataataataataataataataaagcataactccaattccccataatctgcctgctagttcaagtggccaacataatatttacaatatattttaagtcaagcatgaaaaagttgagaataccaacaaactttattatttggagtgctgacaaagaacataata

SEQ ID NO: 8305 - DNA, 324 bp, Homo sapiens
  AC010386.5_70220
  Located on chromosome 5
  Distance between a terminus base of telomere on chromosomal short arm and 5'-terminus of this base sequence : 33577375
  Distance between 3'-terminus of neighbour sequence of sequence listing upward to telomere on chrosomal short arm and 5'-terminus of this base sequence : 28812
acatgaaatggaattgtatcacttttcatgaaaatatactagttacacaccacacacacacacacacacacacacacacacacaccccttcactaccctataattaatggagatttctccctgcaaggaagtggtcagatctgtgtgaaccgggtagtgtgaagttaagttccaaggtatgtataatgtgttgtaattcctctactctccatacgctgtttttgtccccaaagaatcagggagttcctggggaaatctctaaaagactcaacaggactgggaacaaatctcactgctttgttgagtacttccaacatagtcatt

SEQ ID NO: 8306 - DNA, 175 bp, Homo sapiens
  DISD22_0004599
  Located on chromosome 5
  Distance between a terminus base of telomere on chromosomal short arm and 5'-terminus of this base sequence : 33873787
  Distance between 3'-terminus of neighbour sequence of sequence listing upward to telomere on chrosomal short arm and 5'-terminus of this base sequence : 296088
ggaaccagaatgctagccttttggatgatgattctatggatgcttactttataactctgttaaactgtgtgtgtgtgtgtgtgtgtgtgtgtgtgtgtgtgtgtgtgtgcgcgcgcgcgcgcgcgcgcatgtgtgtgtgtagcagtttaatgtacctttgtgcaataggtcttat

SEQ ID NO: 8307 - DNA, 482 bp, Homo sapiens
  chr5.fa.O7frz.41953789
  Located on chromosome 5
  Distance between a terminus base of telomere on chromosomal short arm and 5'-terminus of this base sequence : 33958323
  Distance between 3'-terminus of neighbour sequence of sequence listing upward to telomere on chrosomal short arm and 5'-terminus of this base sequence : 84361
gttctaaaggttaccagcattacctggagttttattagaaatgcaaattcttaggccctactccagacttaattcatcagtaactctgagggtagagcccatcattctgtattttaacagtctctctccagatgattcagatataagttgacgattgagaacaactgttctgtatattggtgtagggacttgagttacagtggtgaatgcatttgacaaaactgagcaaatgtacactaaaaatttgtgcattttattgcatgtacattttatctcaaggaaaaaacggggagtatactgaagtctccagtttaccttgaaatgcattgaaagtaaaatggatataggtgtgtgtgtatgcatatgcatacatgtatacgtgtgtgtgtgtgtgtgtgtgtgtgtgtgtgtgtgtgtgtgtgtgtgtgtgtagtgtgtgtgttcatcccagcagaaaaaatcttaaaggtaggatccaggag

SEQ ID NO: 8308 - DNA, 161 bp, Homo sapiens
  D5S2023
  Located on chromosome 5
  Distance between a terminus base of telomere on chromosomal short arm and 5'-terminus of this base sequence : 34239762
  Distance between 3'-terminus of neighbour sequence of sequence listing upward to telomere on chrosomal short arm and 5'-terminus of this base sequence : 280957
cataaaatgaagtaggagtggtgtatatgtgtgtgtgtgtgtgtgtgtgtgtgtgtgtgagagagacagagagagacagggtctcactctgtcacccaggctggggtgcagtggcaccatcatggctaagtggcgcctcaacctcccaggctcaagtgctc

SEQ ID NO: 8309 - DNA, 407 bp, Homo sapiens
  AC068049.3_141660
  Located on chromosome 5
  Distance between a terminus base of telomere on chromosomal short arm and 5'-terminus of this base sequence : 34422116
  Distance between 3'-terminus of neighbour sequence of sequence listing upward to telomere on chrosomal short arm and 5'-terminus of this base sequence : 182193
attcctgagttacttcacttagaataatagtcttcaattccatccaggctgctatgaatgcaattattttgttcctttttgtggctgagtagtagtccaagtatacacacacacacacacacacacacacacacacacacacccacatgttctttatcaacttgttgattgatgggcatttgggctggttccatgtttttgcaattgcaaattgtgaccctataaacatgtgtgttcaagtatcttttttgcataatgacttcttttcctctggatagacacctgtagatccagtgggattgctggatcaaatggtacatctacttttagttctttaagtaatcttcatactttggttgtggtagtttacattcccgcaaacagtgtgaagattgtaagtgttgcat

SEQ ID NO: 8310 - DNA, 195 bp, Homo sapiens
  D5S1998
  Located on chromosome 5
  Distance between a terminus base of telomere on chromosomal short arm and 5'-terminus of this base sequence : 34455072
  Distance between 3'-terminus of neighbour sequence of sequence listing upward to telomere on chrosomal short arm and 5'-terminus of this base sequence : 32549
agccttaaagtggtcaaagcaaggcagaaataagcagaagcagtgaacagaataaactgtaggctgttaccttttaggctaacagacacacacacacacatactcacacacgcatgcacctgcacgcacacacacacacacacacacacacacattttaaatagacagggtattgctatgttacccaggctggag

SEQ ID NO: 8311 - DNA, 113 bp, Homo sapiens
  D5S2021
  Located on chromosome 5
  Distance between a terminus base of telomere on chromosomal short arm and 5'-terminus of this base sequence : 34662428
  Distance between 3'-terminus of neighbour sequence of sequence listing upward to telomere on chrosomal short arm and 5'-terminus of this base sequence : 207161
caaaagcaacttaaccacgtgtgtgtagagtgtgtgtgtgtgtgtgtgtgtgtgtaatatataaaacatatgatatataataatgaaaagactggtgattggaatccgtagaa

SEQ ID NO: 8312 - DNA, 128 bp, Homo sapiens
  D5S1964
  Located on chromosome 5
  Distance between a terminus base of telomere on chromosomal short arm and 5'-terminus of this base sequence : 34704172
  Distance between 3'-terminus of neighbour sequence of sequence listing upward to telomere on chrosomal short arm and 5'-terminus of this base sequence : 41631
ttatcaccaaataggcaggaccagcaaaataattaggagacaaatttctgcctttttctgtgtgtgtgtgtgtgtgtgtgtgtgtgtgtgtgtgttgtatgtgtgcctctgtgtgcttttgtgtcaca

SEQ ID NO: 8313 - DNA, 154 bp, Homo sapiens
  DISO7_10001816
  Located on chromosome 5
  Distance between a terminus base of telomere on chromosomal short arm and 5'-terminus of this base sequence : 34754254
  Distance between 3'-terminus of neighbour sequence of sequence listing upward to telomere on chrosomal short arm and 5'-terminus of this base sequence : 49954
ggcttataatcctcatacccacttttgctgtgtgtgtctgcatacacatacacacacacacacacacacacacacacacacaatacactgtttaaatgtgtgatttttagcccttgaaaacctataagaaaattgaagaggatgtttcctctgg

SEQ ID NO: 8314 - DNA, 101 bp, Homo sapiens
  DISO7_10001819
  Located on chromosome 5
  Distance between a terminus base of telomere on chromosomal short arm and 5'-terminus of this base sequence : 34951378
  Distance between 3'-terminus of neighbour sequence of sequence listing upward to telomere on chrosomal short arm and 5'-terminus of this base sequence : 196970
tctccattctctggtccctgttttatactctaggttctcagagccgtgtgtgtgtgtgtgtgcgtgtgtgtgtgtgtttggtggtggaggactctgtctca

SEQ ID NO: 8315 - DNA, 196 bp, Homo sapiens
  DISO7_10001830
  Located on chromosome 5
  Distance between a terminus base of telomere on chromosomal short arm and 5'-terminus of this base sequence : 34994056
  Distance between 3'-terminus of neighbour sequence of sequence listing upward to telomere on chrosomal short arm and 5'-terminus of this base sequence : 42577
gaacagtgacatctgatgaaatcaaagtgggcatcaagggcaatgctggaagaaaatcaaagagaagtcatagtgggaaagtgggaagatactgtccaatgtgtgtgcgtgtgtgtgtgtgtgtgtgtgtaagccccagtctttgaaactcaaagtgttaactataaaaattccaatacatttggatatgtacctt

SEQ ID NO: 8316 - DNA, 202 bp, Homo sapiens
  DISO7_10001828
  Located on chromosome 5
  Distance between a terminus base of telomere on chromosomal short arm and 5'-terminus of this base sequence : 35178651
  Distance between 3'-terminus of neighbour sequence of sequence listing upward to telomere on chrosomal short arm and 5'-terminus of this base sequence : 184399
ctcaaggtggagaaagccctcttccgctggggcttcctgctcagggccctttgtgcaggggaagtacacacgcgcacacacacacacacacacacacacacacacacttttaagaaagtcttcctggtgattctgatactgtttaaaatttgagaactaaaatttcagtccctactttgtaggtacaaatcaagacctcagt

SEQ ID NO: 8317 - DNA, 479 bp, Homo sapiens
  AC010351.5_133521
  Located on chromosome 5
  Distance between a terminus base of telomere on chromosomal short arm and 5'-terminus of this base sequence : 35189661
  Distance between 3'-terminus of neighbour sequence of sequence listing upward to telomere on chrosomal short arm and 5'-terminus of this base sequence : 10808
aaactattcctacatggcttactcgatgggtcttttctgctttcctacatagcctgcttcttcctggctacaagtgtgttttgaaattatttatttatttatttatttatttatttatttatttatttttgagatagaatctagtcttgctctgtcacttaggccggagtgcagtggtgtgatcttggctcactgcaacctccacttcccaggttcaagcaatcctcctacctcagcctcccgagtagctaggattacaggcatgtgccaccacgcccagctaattttttttttttttttgtatttttagtagacacggggtttcaccatgttagccaggctggtcttgaactcctgacctcaagtgatccacccacctcagcctcccaaactgctgggattgtaggcatgagccaccgcaccctccctggccacaagtctttatgcttgctatcctgtcaggacagctattctacctc

SEQ ID NO: 8318 - DNA, 171 bp, Homo sapiens
  Z67436
  Located on chromosome 5
  Distance between a terminus base of telomere on chromosomal short arm and 5'-terminus of this base sequence : 35270516
  Distance between 3'-terminus of neighbour sequence of sequence listing upward to telomere on chrosomal short arm and 5'-terminus of this base sequence : 80376
ctgaggaatatgaatcgctgctttgtacacacacacacacacacacacacacacacacacacacgcattcacgtacacgaaatgggaggaggcttctatggtgaaatacatttggataatcctgagtaaacagacaattctctctcttctgcagaatttctcagagccttt

SEQ ID NO: 8319 - DNA, 240 bp, Homo sapiens
  chr5.fa.O7frz.43593934
  Located on chromosome 5
  Distance between a terminus base of telomere on chromosomal short arm and 5'-terminus of this base sequence : 35522512
  Distance between 3'-terminus of neighbour sequence of sequence listing upward to telomere on chrosomal short arm and 5'-terminus of this base sequence : 251825
atggtagctgtcattagtatcaacttttcagactccagctaggcttatggaacatggatctttcctctcgtatttgtgtaactatataagcctttattcattccctctcctgccattttttaaacaggcatgtgtgtgtgtgtgtgtgtgtgtgtgtatgtgtgtgtctatgggggtagagggtgtctctggcaatgcaaaaaaagagtggattgcatatctattcctgccttgagtatt

SEQ ID NO: 8320 - DNA, 446 bp, Homo sapiens
  chr5.fa.O7frz.44154474
  Located on chromosome 5
  Distance between a terminus base of telomere on chromosomal short arm and 5'-terminus of this base sequence : 35633788
  Distance between 3'-terminus of neighbour sequence of sequence listing upward to telomere on chrosomal short arm and 5'-terminus of this base sequence : 111036
gcaatctgctattaatgttcatcaaattaaatgttaaattcatccaaaaatactctccaagttgacacataaaactaaccatcacagtcacctttccaatgcccaggaaggtctctctcccataatctcccttcccttccctgccccatacatatgcacgtgcacacacacacacacacacacacacacacccctaggtgtagaggtttgcacttatggcagtaaaatagagcaagctggctggtttcatcacccctcccatgctctgtaatgctattagactttacagaatccttgggaaaagagcctttttaggcactgcaatattaacttcaggaaaggtaagagaggctgggatccaaccaaaatttaagaagattatctccctctattcagtacaggacatggtaccagctgtttagtagattactaggccataaagcatc

SEQ ID NO: 8321 - DNA, 280 bp, Homo sapiens
  chr5.fa.O7frz.44760321
  Located on chromosome 5
  Distance between a terminus base of telomere on chromosomal short arm and 5'-terminus of this base sequence : 35923210
  Distance between 3'-terminus of neighbour sequence of sequence listing upward to telomere on chrosomal short arm and 5'-terminus of this base sequence : 288976
tttacaactgattggagatgtaacagagctttactgggatgctgaaaatgttctaaatcttgttacttggttgtgtgtgtgtgtgtgtgtatatatatatatatacacacacacaaaattcatcaaagttacactacagtacaaatctatacactttatggcaggcatgctaaaaactcaacacaaaatttcaaaaatatataaacaagtctaggaaatttacctagctattaaatagtccactttcaattttagcaccttctggagaatactggagtct

SEQ ID NO: 8322 - DNA, 253 bp, Homo sapiens
  chr5.fa.O7frz.44636242
  Located on chromosome 5
  Distance between a terminus base of telomere on chromosomal short arm and 5'-terminus of this base sequence : 36045725
  Distance between 3'-terminus of neighbour sequence of sequence listing upward to telomere on chrosomal short arm and 5'-terminus of this base sequence : 122235
tgctctgaaatcagaattaagtggcatttggctgcaacagaagaagacccatgcttctattttctgaaatatgacttctaaatacactccacacacacacacacacacacacacacacacacacacacgtacacacacaaacacaccacggaaagaatggtgcacagaacagaaatgactggttagaatagaatgtgagggatcattaattcaaatgatcccaaatcagatttggatagtatgtaattgaagc

SEQ ID NO: 8323 - DNA, 398 bp, Homo sapiens
  AC022135.3_116940
  Located on chromosome 5
  Distance between a terminus base of telomere on chromosomal short arm and 5'-terminus of this base sequence : 36168667
  Distance between 3'-terminus of neighbour sequence of sequence listing upward to telomere on chrosomal short arm and 5'-terminus of this base sequence : 122689
ttgagcatctagtatatgccagcaccatagtgtgcttttagaaaagtttgtactaataaacattgaaagtttgatgcattggcaataactttttttcttggctttgggcttactttcttgtttttgttttgttttgttttgttttgttttcagacaatctgctttctcttctttgaggtcttaggaatttgctccagcagtttagaaagagtcaaagcaagcacattggttactcaagtgtaataagaagaaagttatttctatttaaaggagtccctactcttgaccactttctgggtgggtggagagagtcaggtggaagcactccacagcagacttcatttgtcaaagaactataaataaagaaaagggacttacatgttgaaaataagtttgaa

SEQ ID NO: 8324 - DNA, 218 bp, Homo sapiens
  AC022135.3_107796
  Located on chromosome 5
  Distance between a terminus base of telomere on chromosomal short arm and 5'-terminus of this base sequence : 36216501
  Distance between 3'-terminus of neighbour sequence of sequence listing upward to telomere on chrosomal short arm and 5'-terminus of this base sequence : 47436
aatctacagattcagtgcaatctctatcaaaatgacaatgacattcctcacagaaattgaaaaaaaaatcttaaaatttgtgtagaaccacaaagacctcaaatagccaaagcaatcttaaacaaacaacaacaacaacaaaaacaaagctaggagtatcgcattatcggatctcgaaatatattacaaagctgtagtaaccaaatcagcattgtact

SEQ ID NO: 8325 - DNA, 339 bp, Homo sapiens
  chr5.fa.O7frz.44018306
  Located on chromosome 5
  Distance between a terminus base of telomere on chromosomal short arm and 5'-terminus of this base sequence : 36357778
  Distance between 3'-terminus of neighbour sequence of sequence listing upward to telomere on chrosomal short arm and 5'-terminus of this base sequence : 141059
gtgacgtatttacaggtgaaatgatatgataccttagattaaaaaaataacatagctcacctctaaaaatgagggaatagacaaaacaagattgttgaagcagagtgatgggtatatatagattcaatatacagttctatttttatttatatttgaaaattttcgtaacaaagaaaaataacgatcactgccaccattaggtgccccatggagttcattcatccatctgttcattcattcattcattcattcattcattcattcgacatttttcttatgccagttactgctaggttacctgtgggtgctgcagacaagtcgtaacctcactctaggatt

SEQ ID NO: 8326 - DNA, 128 bp, Homo sapiens
  G09375
  Located on chromosome 5
  Distance between a terminus base of telomere on chromosomal short arm and 5'-terminus of this base sequence : 36562976
  Distance between 3'-terminus of neighbour sequence of sequence listing upward to telomere on chrosomal short arm and 5'-terminus of this base sequence : 204859
aaggttgatgccacaacagtggcaaattatctgtctatctatctatctatctatctatctatctatctatatctatctatccatctgtatatactagaaaatgtatttccttcatgaagtgtccttgg

SEQ ID NO: 8327 - DNA, 164 bp, Homo sapiens
  HUMUT516
  Located on chromosome 5
  Distance between a terminus base of telomere on chromosomal short arm and 5'-terminus of this base sequence : 36564124
  Distance between 3'-terminus of neighbour sequence of sequence listing upward to telomere on chrosomal short arm and 5'-terminus of this base sequence : 1020
aggcagaggttgcagtgagctaagattgtaccattgcactccagcctgggcgataagagcaaaactccgtctcaaataaataaataaataaataaataaataaataatctaacagtcaataatagctttcacagaaaatttaactgaatgctggatttacacac

SEQ ID NO: 8328 - DNA, 333 bp, Homo sapiens
  chr5.fa.O7frz.45200270
  Located on chromosome 5
  Distance between a terminus base of telomere on chromosomal short arm and 5'-terminus of this base sequence : 36727572
  Distance between 3'-terminus of neighbour sequence of sequence listing upward to telomere on chrosomal short arm and 5'-terminus of this base sequence : 163284
atttactatgagtcagcattcaacattaatccacttagtcctttcagcaattacaaagttaggaattgttactgtttttgtttcacagatgaaacacaaacacacacacacacgcacacacacacacacacacacacacacacacatagatgttaagtaaggagcaaaattggattttgagctcaggcgtgtctggcctgaaattcatctctcctgagtatcatcaccatctgacctctcaacagaaatcctcagcctggggtgtctgctcagtcctctccatttgaatttctccaacattgctacctatactattcgctcgacttacaataa

SEQ ID NO: 8329 - DNA, 454 bp, Homo sapiens
  chr5.fa.O7frz.133904075
  Located on chromosome 5
  Distance between a terminus base of telomere on chromosomal short arm and 5'-terminus of this base sequence : 36936194
  Distance between 3'-terminus of neighbour sequence of sequence listing upward to telomere on chrosomal short arm and 5'-terminus of this base sequence : 208289
aaactcataggcttctaccttaagatgcttactgttagatgggaaagacagatagatgatagatagatagatagatagatagatagatagatagatagatagatagatagatggtagaatgatagatagatagatagataggtaggtagatagatagaaggtagaaagatagagagatgagtagaaaatttcatacaaaaaataaaagatacaaatctgctttatcctggggaaatctaatctctcttacctacaatttttttatccttttcactttatcaccgtatgggagaaaaagttccaatacattgatatgcttcctagcctttaaaaacacagtgctaggcttcatgagaaacacgtaacagaaacagaatccattatcccacatatgctcagagagctctaacaagtgcctgcaaactggccaacacatgtgctttacattaagtcc

SEQ ID NO: 8330 - DNA, 278 bp, Homo sapiens
  chr5.fa.O7frz.133767635
  Located on chromosome 5
  Distance between a terminus base of telomere on chromosomal short arm and 5'-terminus of this base sequence : 37072588
  Distance between 3'-terminus of neighbour sequence of sequence listing upward to telomere on chrosomal short arm and 5'-terminus of this base sequence : 135940
aaatgtaaagatggcttgtaataccagcattttggaaggctaaggtgagacaatcacttgaactcaggaattagagaccagcctagaaaaaataaggagaccttgtgtctctccacacacacacacacacacacacacacacacacacacacacacactcaaattagcgggcatggggatgcatgcctgcagtctcagctacttagaaggctgaggttggtggatcacttgagcctaggaggctgaggctgcggtggatccttattctactgcactcc

SEQ ID NO: 8331 - DNA, 161 bp, Homo sapiens
  chr5.fa.O7frz.133659532
  Located on chromosome 5
  Distance between a terminus base of telomere on chromosomal short arm and 5'-terminus of this base sequence : 37192602
  Distance between 3'-terminus of neighbour sequence of sequence listing upward to telomere on chrosomal short arm and 5'-terminus of this base sequence : 119736
attctaagcagaaaaccaagattagagagagagagagagagagagagagagagagatagaacttaagaaggactaaatgtgtttttattaaaggatcagaaacataattcaaagaatataattaactgagaaaaaattatctgctccatacctaaagtatt

SEQ ID NO: 8332 - DNA, 154 bp, Homo sapiens
  chr5.fa.O7frz.46437588
  Located on chromosome 5
  Distance between a terminus base of telomere on chromosomal short arm and 5'-terminus of this base sequence : 37432630
  Distance between 3'-terminus of neighbour sequence of sequence listing upward to telomere on chrosomal short arm and 5'-terminus of this base sequence : 239867
atctaatgcctggtatccttacaagaagaggagagcacacacacacacacacagagagagagagagagagagagagagagagagagagagagcaagcgagcgcagccatttgaagacagaggcagagactggagttatgctatcacaaaccaag

SEQ ID NO: 8333 - DNA, 97 bp, Homo sapiens
  D5S1457
  Located on chromosome 5
  Distance between a terminus base of telomere on chromosomal short arm and 5'-terminus of this base sequence : 37721300
  Distance between 3'-terminus of neighbour sequence of sequence listing upward to telomere on chrosomal short arm and 5'-terminus of this base sequence : 288516
tgcttggcacacttcaggggggcattatctatctatctatctatctatctatatctatctctcctaccttgttcatcacagacatgcccagaaccta

SEQ ID NO: 8334 - DNA, 257 bp, Homo sapiens
  AC008863.5_62559
  Located on chromosome 5
  Distance between a terminus base of telomere on chromosomal short arm and 5'-terminus of this base sequence : 37729081
  Distance between 3'-terminus of neighbour sequence of sequence listing upward to telomere on chrosomal short arm and 5'-terminus of this base sequence : 7684
ggcagagtttgcagtgaaccaagatcgtgtcactgcactccaccccgggtgacagagcgacactctgtctcaacaacaacaacaacaacaacaaaatacacatcttctccttcctccacatttatatatgctctatagccacaggctatggtaggaagtaagtagagctttgcagaagcactttaggttatctttacattctctctagattagtctagattagtctataagtaatttcagcttgtaaattcaatcat

SEQ ID NO: 8335 - DNA, 188 bp, Homo sapiens
  D5S634
  Located on chromosome 5
  Distance between a terminus base of telomere on chromosomal short arm and 5'-terminus of this base sequence : 37976898
  Distance between 3'-terminus of neighbour sequence of sequence listing upward to telomere on chrosomal short arm and 5'-terminus of this base sequence : 247560
tctattgtttagtgggcctgagatgtttctgattttgaagtgtgtgtgtgtgtgtgtgtgtgtgtgtgtgtgtttaaatggtaatcaatgcatattttcaaatgttttcgagacttacaaggatatacaataaaagtgctcctataatcactgcctcttaaaccacccaatcccaatcttggaggcaa

SEQ ID NO: 8336 - DNA, 157 bp, Homo sapiens
  D5S420
  Located on chromosome 5
  Distance between a terminus base of telomere on chromosomal short arm and 5'-terminus of this base sequence : 38038675
  Distance between 3'-terminus of neighbour sequence of sequence listing upward to telomere on chrosomal short arm and 5'-terminus of this base sequence : 61589
tgcaaacagtcaaatatcttggtaagtgtccaattatttaccatgtttcatcctttactccaaatttatacatacatatgtgtacacacacacacacacacacacacacacacacacacattcaggtcactaaagcctctaactttacagatcccaa

SEQ ID NO: 8337 - DNA, 160 bp, Homo sapiens
  Z16946.1_86
  Located on chromosome 5
  Distance between a terminus base of telomere on chromosomal short arm and 5'-terminus of this base sequence : 38038702
  Distance between 3'-terminus of neighbour sequence of sequence listing upward to telomere on chrosomal short arm and 5'-terminus of this base sequence : -130
gtccaattatttaccatgtttcatcctttactccaaatttatacatacatatgtgtacacacacacacacacacacacacacacacacacacattcaggtcactaaagcctctaactttacagatcccaactttaactcatttaactcatggttaactcc

SEQ ID NO: 8338 - DNA, 443 bp, Homo sapiens
  AC008830.3_118921
  Located on chromosome 5
  Distance between a terminus base of telomere on chromosomal short arm and 5'-terminus of this base sequence : 38058794
  Distance between 3'-terminus of neighbour sequence of sequence listing upward to telomere on chrosomal short arm and 5'-terminus of this base sequence : 19932
atcctagtatcaagcggattatattactttcttccccacctcaattttttttagtattgtatctgcttcattttaatgtttcattcacttttcctaagttacatctactcacttgaaatatctcaagcggaaccctttttgtaaaatagagttttgaagctattctttgtccttgttctcaataggtcaccatttatttatttatttatttatttatttatttatttatttattttattatactttaagttctagggtacttgtgcacaacgtgcaggtttgttacatatgtatacatgtgccatgttggtgtgctgcacccgttaactcgtcatttatattaggcatatctcctaatgctatccctccccactctcccagccccacgacaggccctggtgtgtgatgttccccaccctgtgtccaagtattctcattgttca

SEQ ID NO: 8339 - DNA, 128 bp, Homo sapiens
  Z67603
  Located on chromosome 5
  Distance between a terminus base of telomere on chromosomal short arm and 5'-terminus of this base sequence : 38417133
  Distance between 3'-terminus of neighbour sequence of sequence listing upward to telomere on chrosomal short arm and 5'-terminus of this base sequence : 357896
gtaatcgtttattagtcccaggaagagtatgtatgtgtgtgtgtgtgcgtgtgtgtgtgtgtgtgtgtgtgtgtgtgaattctttgattgtctattgtctacctagacaattatgcaaacaaagacag

SEQ ID NO: 8340 - DNA, 223 bp, Homo sapiens
  AC008817.5_124555
  Located on chromosome 5
  Distance between a terminus base of telomere on chromosomal short arm and 5'-terminus of this base sequence : 38426843
  Distance between 3'-terminus of neighbour sequence of sequence listing upward to telomere on chrosomal short arm and 5'-terminus of this base sequence : 9582
ttattgctccagaaagtttcagtttctctttgatgccctcaaacatttgtgtgtgtgtgtgtgtgtgtgtgtgtggtggtggtggtggtggtggtagagatagtggaacaggggtgggggtattttatccagccttcctggtagctttctattgccagatttatctataccaatctatgccaccattcctggcagtagataactcctagcttggtttctaaga

SEQ ID NO: 8341 - DNA, 299 bp, Homo sapiens
  AC023273.5_10517
  Located on chromosome 5
  Distance between a terminus base of telomere on chromosomal short arm and 5'-terminus of this base sequence : 38719285
  Distance between 3'-terminus of neighbour sequence of sequence listing upward to telomere on chrosomal short arm and 5'-terminus of this base sequence : 292219
cctacatttgatatttgaatggacaaataaactgtatgtaatattttttgggtcaactgggggaattttgaacatagtctcagcagtagatgagataaaatgtactgaaagagaaagttactaaaaaaacaaaaccagattgaggaatggtatgtacaataaaattttatattgatgtaaaactagagagaggtgtgtgtgtgtgtgtgtgtgtgtgtgtatgtgtgtgtgtgtgtataaagacctggaaaggtaaacattaaggtgatgagcattggtggacactgatggtaattaaa

SEQ ID NO: 8342 - DNA, 139 bp, Homo sapiens
  DISO7_10001842
  Located on chromosome 5
  Distance between a terminus base of telomere on chromosomal short arm and 5'-terminus of this base sequence : 38719419
  Distance between 3'-terminus of neighbour sequence of sequence listing upward to telomere on chrosomal short arm and 5'-terminus of this base sequence : -165
ccagattgaggaatggtatgtacaataaaattttatattgatgtaaaactagagagaggtgtgtgtgtgtgtgtgtgtgtgtgtgtatgtgtgtgtgtgtgtataaagacctggaaaggtaaacattaaggtgatgagc

SEQ ID NO: 8343 - DNA, 313 bp, Homo sapiens
  chr5.fa.O7frz.47897203
  Located on chromosome 5
  Distance between a terminus base of telomere on chromosomal short arm and 5'-terminus of this base sequence : 38878131
  Distance between 3'-terminus of neighbour sequence of sequence listing upward to telomere on chrosomal short arm and 5'-terminus of this base sequence : 158573
tgattcagactggaaatgatactgatcaagaggggaagagtgtttagcctggtggacaagtttacttgtcagatgtgaggatgaggaaaaataatctctgtgtgtgtgtgtgtgtgtgtgtgtgtgtgtgtgtgtgtgtgtagagagggagcatgtttgaatgttacattatttcaagactttaaattagcttttataacataatagatcttccatatagtttttatttagtgtgtgaatgtttagaaaagtctgtggcatccttctgaaatccagattatcccttactgtttaccagtctagaaaggatacc

SEQ ID NO: 8344 - DNA, 438 bp, Homo sapiens
  chr5.fa.O7frz.47970006
  Located on chromosome 5
  Distance between a terminus base of telomere on chromosomal short arm and 5'-terminus of this base sequence : 38950997
  Distance between 3'-terminus of neighbour sequence of sequence listing upward to telomere on chrosomal short arm and 5'-terminus of this base sequence : 72553
aaatgagaagcagtctgtattagtcagtgttgtccagagagacagaaccaatagaagatagatagatgattagatagatagatagatagacagatagatagatagatagacagatacatggtagatgagagggaatttctcagataaattggctcatgcaattgatcaaaccataaatcccgtaacaggccatctacaagctagagaaccagagaagccaaactctcagtctgaggccaaaggtctgagaacccaggaaggccgctggtgcaagttccaaacaaattatttactgtaaccttgtgtttctaaaggtttctgtatcaagcccaaagctaaaacaatgaaaaacatagtcactctccatagaattaaaatcatagtagttggtggaaatgctggtagcaccaggttctctgttaggtatgatcaagttca

SEQ ID NO: 8345 - DNA, 198 bp, Homo sapiens
  DISD22_0004603
  Located on chromosome 5
  Distance between a terminus base of telomere on chromosomal short arm and 5'-terminus of this base sequence : 39166603
  Distance between 3'-terminus of neighbour sequence of sequence listing upward to telomere on chrosomal short arm and 5'-terminus of this base sequence : 215168
caactagaaagaattgtgaagtgcttttatatatatatatatatatatatatatatatatatatatatatatatatatattttaattatttaaatccataggctaccctcctacccaaactaggcatactgaaaatggtttaaaaactttagttttaataaaacactgtttttaaaagttgcttataaggcatgaaca

SEQ ID NO: 8346 - DNA, 189 bp, Homo sapiens
  DISO7_00040853
  Located on chromosome 5
  Distance between a terminus base of telomere on chromosomal short arm and 5'-terminus of this base sequence : 39246041
  Distance between 3'-terminus of neighbour sequence of sequence listing upward to telomere on chrosomal short arm and 5'-terminus of this base sequence : 79240
tttattccggatgacttggctgtgctcccctcctccttgcgaagaagttgttttctgctggtgggttgttgtaacccaatctagtgtgtgtgtgtgtgtgtgtgtgtgtgtgtgtgtgtgtgtgtgtgtgtgtgtgtctggaagttggtgagggcggcagggagttgcgggcgacagacgaaccatcac

SEQ ID NO: 8347 - DNA, 252 bp, Homo sapiens
  AC025446.3_142089
  Located on chromosome 5
  Distance between a terminus base of telomere on chromosomal short arm and 5'-terminus of this base sequence : 39417310
  Distance between 3'-terminus of neighbour sequence of sequence listing upward to telomere on chrosomal short arm and 5'-terminus of this base sequence : 171080
atgacaatacctcactttacagagttgtcatgtcgtgtcattctttcattcattcattcattcattcattcattcattcaatgcatgcatttaatgagcactgttgcctgttgtaaaacgcctagcatcttattacaaatattatattttttgatgtggctaattttaacaattattttaaaaattgtattagcaattttagatatacacaaaaatggtgtatagaacattacaactctccatgtactcatc

SEQ ID NO: 8348 - DNA, 110 bp, Homo sapiens
  HUMUT1125
  Located on chromosome 5
  Distance between a terminus base of telomere on chromosomal short arm and 5'-terminus of this base sequence : 39438835
  Distance between 3'-terminus of neighbour sequence of sequence listing upward to telomere on chrosomal short arm and 5'-terminus of this base sequence : 21273
tggtgacagagccagactctgtctcaaaaaaaaaagaaagaaagaaagaaagaaagaaagaaagaaagagcaggaggggagatagaaagcattgaggatgacagttttta

SEQ ID NO: 8349 - DNA, 351 bp, Homo sapiens
  chr5.fa.O7frz.48333217
  Located on chromosome 5
  Distance between a terminus base of telomere on chromosomal short arm and 5'-terminus of this base sequence : 39609792
  Distance between 3'-terminus of neighbour sequence of sequence listing upward to telomere on chrosomal short arm and 5'-terminus of this base sequence : 170847
gaatagctttgtccattcctacaagttgcctggcaggataagtagaacaaacaggaatccagacaaaatctcttgaactgagataatatggaggaatgtatgccaatttttaattgtgggcatagaagccagtgtgtcttgacctgttttaaactgtttaacctcctcagtaccatgaaatatctattaaaagctatgaatcctcactgagaaaaatgcgcgcgcgcacacacacacacacacacacacacacatacacacacacaaataaatacatgtataattttaccttaaaatttggaagttgatcaaaagcctattcactggctctaggttaacagttctgaccta

SEQ ID NO: 8350 - DNA, 291 bp, Homo sapiens
  AC019232.5_206523
  Located on chromosome 5
  Distance between a terminus base of telomere on chromosomal short arm and 5'-terminus of this base sequence : 39702228
  Distance between 3'-terminus of neighbour sequence of sequence listing upward to telomere on chrosomal short arm and 5'-terminus of this base sequence : 92085
ccaagcaaacaatactagtcactcaccctgcagtattagagaaactccttgaggctagaagactctacagtcagtcctggattctggtagttcccatttttacacacacacacacacacacacatacacatattcatacatatatcccctcttacatacactcacacacgtaaacacatatacacattcacatatattcactcatacacactttcacacttttcctccaagatgtctcaggaagacacaatcaagagggatttacagcctcagctaactgttacactcaaa

SEQ ID NO: 8351 - DNA, 452 bp, Homo sapiens
  AC019232.5_94512
  Located on chromosome 5
  Distance between a terminus base of telomere on chromosomal short arm and 5'-terminus of this base sequence : 39824861
  Distance between 3'-terminus of neighbour sequence of sequence listing upward to telomere on chrosomal short arm and 5'-terminus of this base sequence : 122342
gtttggacttgtaaggacctactttaagagagaaagttagttcagtatttctctataaacagtggttttgttttgttttgttttgttttgttttgttttgacaggaactagctctgtcacctgggttggaatgcagtggcatgatcctggctcactgcaacctccatctcccagacacaagcgatcctgccacctcagcctcctgagtagctgggactgcaggtgtgtaccaccatgcctggctaatttttgtattttttgtagagacagtgtttcatcacattgccaaggctagtctcaaactcctgagatcaaggaatccacccacctatgcctctcaaagtactgagattacagatgtgagccacaatggccagcctataaagattaatataaaaggaacactgatgcaagaccagcctgtgggcccctgtgtcagattagcaatgttt

SEQ ID NO: 8352 - DNA, 235 bp, Homo sapiens
  D5S1958
  Located on chromosome 5
  Distance between a terminus base of telomere on chromosomal short arm and 5'-terminus of this base sequence : 39875315
  Distance between 3'-terminus of neighbour sequence of sequence listing upward to telomere on chrosomal short arm and 5'-terminus of this base sequence : 50002
atcaactcttggtgcaaatttaaggctcatcttctaatgtagtgtgtgtgtgtgtgtgtgtgtgtgtgtgtgtgtgtgtgattttactgtgtcccttctccctaacactccagttcaagatagcaacctaagttctgagttgattattctggacacactctctcaaaatttgactgttggacaccagaatacaccaccccaatataccaatatacctctggcatattgattattt

SEQ ID NO: 8353 - DNA, 189 bp, Homo sapiens
  DISO7_10001844
  Located on chromosome 5
  Distance between a terminus base of telomere on chromosomal short arm and 5'-terminus of this base sequence : 40080543
  Distance between 3'-terminus of neighbour sequence of sequence listing upward to telomere on chrosomal short arm and 5'-terminus of this base sequence : 204993
tacttcatgcccagcttggttctctctctctctctctcccccacccccctctccgtgtgtgtgtgtgtgtgtgtgtgtgtgtgtgtgtgtgagagagagagagagagagagagagagatgttcttcaatctcacatcagttatactgatattttgccttcagtaagatcccctagctcttattgcctct

SEQ ID NO: 8354 - DNA, 471 bp, Homo sapiens
  chr5.fa.O7frz.49053327
  Located on chromosome 5
  Distance between a terminus base of telomere on chromosomal short arm and 5'-terminus of this base sequence : 40365062
  Distance between 3'-terminus of neighbour sequence of sequence listing upward to telomere on chrosomal short arm and 5'-terminus of this base sequence : 284330
ttgtggaattcagactataagaatcctatttccttattttaatctctccttcaataatttgcttattaaaactcctcttttggccgggtgcggtggctcaagcctgtaatcccagcactttgggaggccgaggctggcggatcacgaggtcaggagttcgagaccatcctggccaatgtggtgaaaccctgtctctactaaaaatacaaaaaaattagccaggtgtggtggcgggcacctgtagtcccagctactcaggaggctgaggcaggagaatggcgtgaacccggaaggcggagcttgcagtgggctgagatcgtgccactgcactccagcctaggggacagagccagactccgtctcaaaaacaaacaaacaaacaaacaaacaaaaactcctcttttgttgcattccatttgctagtggatgcagccatccatctctctactgtccactcatatctgataattc

SEQ ID NO: 8355 - DNA, 354 bp, Homo sapiens
  chr5.fa.O7frz.49168874
  Located on chromosome 5
  Distance between a terminus base of telomere on chromosomal short arm and 5'-terminus of this base sequence : 40480878
  Distance between 3'-terminus of neighbour sequence of sequence listing upward to telomere on chrosomal short arm and 5'-terminus of this base sequence : 115345
ctgtaatgctcgcgtttagtgagtttaaaacacacagtatcttttggttttataatcagtttctattttgctgtgcctgagattaagatctgtgtatgtgtgtgtgtgtgtgtgtgcgtttgtgtgttaaagcagaaaagacttttttaaaagttttaagtgataaatgcaatttgttaattgatcttagatcactagtaaactcagggctgaattataccatgtatattctattagaagaaagtaaacaccatctttattcctgccctttttcttctctcaaagtagttgtagttatatctagaaagaagcaattttgatttcttgaaaaggtagttcctgcactcagtttaa

SEQ ID NO: 8356 - DNA, 252 bp, Homo sapiens
  D5S2087
  Located on chromosome 5
  Distance between a terminus base of telomere on chromosomal short arm and 5'-terminus of this base sequence : 40693035
  Distance between 3'-terminus of neighbour sequence of sequence listing upward to telomere on chrosomal short arm and 5'-terminus of this base sequence : 211803
ccaaaagtcatttaggagcaggtcattttatttccatgttattgtatggttttgagtgttgtgtgtgtgtgtgtgtgtgtgtgtgtgtgtgtgtgtgtgttgatttctatttttattgttctgtggttcaagaatgtggtcggtaggatttcctatcttattgaatttgctgaggattgttttatgtacaattatataaccaaataattttttttatagttttattatgggctaggcactggctaggtgcta

SEQ ID NO: 8357 - DNA, 226 bp, Homo sapiens
  D5S2063
  Located on chromosome 5
  Distance between a terminus base of telomere on chromosomal short arm and 5'-terminus of this base sequence : 40736348
  Distance between 3'-terminus of neighbour sequence of sequence listing upward to telomere on chrosomal short arm and 5'-terminus of this base sequence : 43061
aaagcaagatttccaggagtttaacgcctctggaatacaaacacacacacacacacacacacacacacacacacacacacacgctatacattaagtttcctgtagctacttttgtccaaaaagatagcttaaaggagagaatattccatttagaatgtgctgctattatctagacagactatttttaagaatagattaggctgggtgctgtggctcactcctgtaa

SEQ ID NO: 8358 - DNA, 471 bp, Homo sapiens
  chr5.fa.O7frz.49533904
  Located on chromosome 5
  Distance between a terminus base of telomere on chromosomal short arm and 5'-terminus of this base sequence : 40917530
  Distance between 3'-terminus of neighbour sequence of sequence listing upward to telomere on chrosomal short arm and 5'-terminus of this base sequence : 180956
atgaattcttagttggtcaagtatttttaaagaactaccagtttggggaataaaataagacagtatagaaaggaaggaaaagaatgggaatgaaagaaagagaaagaaagaaagaaaagaaagaaagaaagaaagaaaaaagaaagaaagaaaaacaaagcaagagaaagagagaaaggaaagaaagaaagaaagaaagaaagagaaagaaagaaagaaaggaaagaaagaaaaggaagaaaagaaaaaagaaaaggaaagaaaggaaggaggggaggaagaaagggaaggagaaagaaagaaaaaagagggaagaaaaaagaaagtataactcaggctaagcttaaagtatgaaagaatacacagaagtaaaatatatttaacacatatttataacaatgatttaaaaatcaaaattcacaacttgcattttaaattgaggaatataaagcaatactcagctcaagtaga

SEQ ID NO: 8359 - DNA, 130 bp, Homo sapiens
  DISD22_0004614
  Located on chromosome 5
  Distance between a terminus base of telomere on chromosomal short arm and 5'-terminus of this base sequence : 41161053
  Distance between 3'-terminus of neighbour sequence of sequence listing upward to telomere on chrosomal short arm and 5'-terminus of this base sequence : 243052
aatgcatgtgatgttcagaacttaaaagatgagacatctttttgcttgtgcctgtgtgtgtgtggggggggtgtgtgtctctgtttgtgtgtgtgtttgtgtgtgtgatttcctgttattaagggctggc

SEQ ID NO: 8360 - DNA, 466 bp, Homo sapiens
  chr5.fa.O7frz.49844303
  Located on chromosome 5
  Distance between a terminus base of telomere on chromosomal short arm and 5'-terminus of this base sequence : 41322847
  Distance between 3'-terminus of neighbour sequence of sequence listing upward to telomere on chrosomal short arm and 5'-terminus of this base sequence : 161664
ttaatgcagatacttcaaggaggactaactaatgcatgtgttttaagacattttaaagataagggtttgctttcataaaactatattttcttggccaggcgaggtggctcacgcctgcaatcccagcactttgggaggcggaggtgggcagatcatctgaggtcaggagtttgagaccagcctggccaacatggcaaaacgctgtctctactaaaaaatgcaaaaattagccgggcatggtgatgcacacctgtaactccagctactcaggaggcagaggtaggagaatcacttgaactcaggaggtaggggttgcagtgagccgagatcgtgccactgtactccaggctgaacgacagagcaagaccctgtctcaaacaaacaaacaaacaaacaaccaaacaaacagaaaaacaaacaaaaaactatattttctcaagtatatgctctattgaattgttattca

SEQ ID NO: 8361 - DNA, 199 bp, Homo sapiens
  G08476
  Located on chromosome 5
  Distance between a terminus base of telomere on chromosomal short arm and 5'-terminus of this base sequence : 41507246
  Distance between 3'-terminus of neighbour sequence of sequence listing upward to telomere on chrosomal short arm and 5'-terminus of this base sequence : 183933
ggaggtcaaggctacagtgagccatgatcacatcactgaactccagcccaggtgacagaatagaccctgtctctatctatctatctatctatctatctatctatctatctatctatctataatttttcttttgtcaataaaaaataattaatttttaaaatgtatctcaattatggagacaacttttctaaaaaaaaag

SEQ ID NO: 8362 - DNA, 148 bp, Homo sapiens
  Z66616
  Located on chromosome 5
  Distance between a terminus base of telomere on chromosomal short arm and 5'-terminus of this base sequence : 41704930
  Distance between 3'-terminus of neighbour sequence of sequence listing upward to telomere on chrosomal short arm and 5'-terminus of this base sequence : 197485
tcagggctttacagagaaacagaatcaataaggtgcatgtgtgtgtgtgtgtgtgtgtgtgtgtgtagagagagagagagagattgatttcttttaagaaattggctcacatgaatgtgagggctggcaagtgcaaaacgtacaaggc

SEQ ID NO: 8363 - DNA, 306 bp, Homo sapiens
  AC027350.2_98344
  Located on chromosome 5
  Distance between a terminus base of telomere on chromosomal short arm and 5'-terminus of this base sequence : 41731773
  Distance between 3'-terminus of neighbour sequence of sequence listing upward to telomere on chrosomal short arm and 5'-terminus of this base sequence : 26695
aaagtttggtcatgtgacaaagtgtacttccaagaccatgtcctgggagctgagagaaaccactcaaaaggagcccaggggttctgaccaagatcaggtgagagaacacagtgatttcagacatatgagacaacctatggttcttcttcttcttcttctttttctgctttatactggatatataatatattgcatgaaatgatttatttattttcaattaaaactttttttttttgagttgaggtcttgctctgttgcccaggctggagtgcagtggtatgatcatcactcattacagccttgaac

SEQ ID NO: 8364 - DNA, 311 bp, Homo sapiens
  AC026788.2_82032
  Located on chromosome 5
  Distance between a terminus base of telomere on chromosomal short arm and 5'-terminus of this base sequence : 41731773
  Distance between 3'-terminus of neighbour sequence of sequence listing upward to telomere on chrosomal short arm and 5'-terminus of this base sequence : -306
aaagtttggtcatgtgacaaagtgtacttccaagaccatgtcctgggagctgagagaaaccactcaaaaggagcccaggggttctgaccaagatcaggtgagagaacacagtgatttcagacatatgagacaacctatggttcttcttcttcttcttctttttctgctttatactggatatataatatattgcatgaaatgatttatttattttcaattaaaactttttttttttgagttgaggtcttgctctgttgcccaggctggagtgcagtggtatgatcatcactcattacagccttgaactcaag

SEQ ID NO: 8365 - DNA, 179 bp, Homo sapiens
  D5S466
  Located on chromosome 5
  Distance between a terminus base of telomere on chromosomal short arm and 5'-terminus of this base sequence : 41811352
  Distance between 3'-terminus of neighbour sequence of sequence listing upward to telomere on chrosomal short arm and 5'-terminus of this base sequence : 79268
ctggttattggtcaacatacccgcacacgggtatgtacacacacacacacacacacacacacacacacacacaagcacacacagcattgtccggcatgtctgcacacataaacacagcctgacccacccacaggtacaagaagacccaagtgccatggggcagagttgccatcacctat

SEQ ID NO: 8366 - DNA, 138 bp, Homo sapiens
  DISO7_10016555
  Located on chromosome 5
  Distance between a terminus base of telomere on chromosomal short arm and 5'-terminus of this base sequence : 41883709
  Distance between 3'-terminus of neighbour sequence of sequence listing upward to telomere on chrosomal short arm and 5'-terminus of this base sequence : 72178
agatcaggcaactgcatgccaataaaagcaggataatactggcattttctctctctctctctctctctctctctctctctctctgtctcccctatctatctctatctctctatctcatatctccttggaatatcttcc

SEQ ID NO: 8367 - DNA, 442 bp, Homo sapiens
  chr5.fa.O7frz.38151363
  Located on chromosome 5
  Distance between a terminus base of telomere on chromosomal short arm and 5'-terminus of this base sequence : 42073377
  Distance between 3'-terminus of neighbour sequence of sequence listing upward to telomere on chrosomal short arm and 5'-terminus of this base sequence : 189530
gctaggaatgaaatttaaggactgagtcctttaaagtcagggaaatgagaaatagcaatcactaggatgaggaaagtaggaaatgggctgtgatgttctggaagtactaagagaaaaacgagatttgtagtagcttggtggtatctatctatctatctatctatctatctaatctatctatatctatatctatatctatctatctatctatctatcatcatcatcctctatctacttatcagggcaaaactttcagattctattagaacacatagtactcataagcttcagggttactagaacacctccatggaccttttccaaaatgaccttcttaaaactaagaggtaaataatatctgatgtaactgatttccaagtttaattccaggaactagtgatgatacagtgttcaggtgggctgtcattaggaactggtgtta

SEQ ID NO: 8368 - DNA, 361 bp, Homo sapiens
  chr5.fa.O7frz.38381582
  Located on chromosome 5
  Distance between a terminus base of telomere on chromosomal short arm and 5'-terminus of this base sequence : 42324952
  Distance between 3'-terminus of neighbour sequence of sequence listing upward to telomere on chrosomal short arm and 5'-terminus of this base sequence : 251133
ccagatacctagattgttagtcacaatcatattacacttttaatgatttaatacatgtcgatgaaaatttcaagccaaataaaattgtgataaagtagtatataacagttaagaattgaaaaagtatgttaggaatcatctaatgactttaaccactgccctggcccccaacactcatacacacacacacacacacacacacacacacacacacacacacacccctacattcacaaatccattaagactcaaaggtaattcaagagcagagagattcagagtggagaaatctcagctggtatcagctgcttctaccaagcagcattatcagcttctcctagttagaaatagcctgaccttc

SEQ ID NO: 8369 - DNA, 252 bp, Homo sapiens
  D5S660
  Located on chromosome 5
  Distance between a terminus base of telomere on chromosomal short arm and 5'-terminus of this base sequence : 42572222
  Distance between 3'-terminus of neighbour sequence of sequence listing upward to telomere on chrosomal short arm and 5'-terminus of this base sequence : 246909
tcatttctaagaattaggtagcctatatatgtggggtgtgtgtgtgtgtgtgtgtgtgtgtgtgcatattttggtagaacatgtggtagagaagaactgattctcccttaagaaaaaatactcatcaagcctcactgaatacacccatattggtctgttctcatgctgctaatagagacatacctgagactgggtaatttagggaaagaagtttaatggactcacagttccacatggctggggaggcttcac

SEQ ID NO: 8370 - DNA, 139 bp, Homo sapiens
  Z66871
  Located on chromosome 5
  Distance between a terminus base of telomere on chromosomal short arm and 5'-terminus of this base sequence : 42724313
  Distance between 3'-terminus of neighbour sequence of sequence listing upward to telomere on chrosomal short arm and 5'-terminus of this base sequence : 151839
ctgaaggctacatggcaagtgctttgtgagtgtgtgtgtgggcagtgagtgtgtgtgtgtgtgtgtgtgtgtgtgtgtgtagtgaatgaaaggcatagcattagaggaatgaggaaattcagggatttacaaccaaagc

SEQ ID NO: 8371 - DNA, 169 bp, Homo sapiens
  D5S2035
  Located on chromosome 5
  Distance between a terminus base of telomere on chromosomal short arm and 5'-terminus of this base sequence : 43025477
  Distance between 3'-terminus of neighbour sequence of sequence listing upward to telomere on chrosomal short arm and 5'-terminus of this base sequence : 301025
cattacaaaactgtagtgctctgcatggtatttcagaataaggcatgtgtttgtgtgtgtgtgtgtgtgtgtgtgtttcattttatagacttgaaatccatatttttctctgaagtgcaaagttaatacagttaattcaacagagaagaagtaactcaatggaacctca

SEQ ID NO: 8372 - DNA, 240 bp, Homo sapiens
  D5S822
  Located on chromosome 5
  Distance between a terminus base of telomere on chromosomal short arm and 5'-terminus of this base sequence : 43259723
  Distance between 3'-terminus of neighbour sequence of sequence listing upward to telomere on chrosomal short arm and 5'-terminus of this base sequence : 234077
ctgttggtaacacaaatgtattcctttatgaaagaatttgggatgattatatagagatttttgttttcatttcacagttacactatgtttataatatttttgtgtgtgtgtgtgtgtgtgcaaattacagtgctcatactggggcagaataaaatttagactcccaaaacaaaaattctcagtctgataacccctcaattttcttggagtggcactactatggaaattgagccattgagc

SEQ ID NO: 8373 - DNA, 305 bp, Homo sapiens
  AC010478.5_103439
  Located on chromosome 5
  Distance between a terminus base of telomere on chromosomal short arm and 5'-terminus of this base sequence : 43430499
  Distance between 3'-terminus of neighbour sequence of sequence listing upward to telomere on chrosomal short arm and 5'-terminus of this base sequence : 170536
agtccaccttctaacctctgacaaatgagcgttttcattgtttactagattggtgtgtaaacgcaagattctagagaaggagagcccacttcaggagtatctttactgctatggaaatagtattttgctcaattgcacacaggcttgcatgtgcctaattctggatacacacatgtgtagaaggaactaatcatttttaccttctcttcactctctctcaactctgtgtgtgtgtgtgtgtgtgtgtgtgtgtgtgtgtgtaatcttgtagttgtaaaagcagaacagactggacagttagattt

SEQ ID NO: 8374 - DNA, 292 bp, Homo sapiens
  DISD22_0004620
  Located on chromosome 5
  Distance between a terminus base of telomere on chromosomal short arm and 5'-terminus of this base sequence : 43607942
  Distance between 3'-terminus of neighbour sequence of sequence listing upward to telomere on chrosomal short arm and 5'-terminus of this base sequence : 177138
gaagcctttctagtcatgatccaaaaaagagagaacataagactatattatacaatataataagaaagaaaatatacatagtggaaaatcaaacaagaaaagcatatatagtatgtacataatatgcatataatttataatatttatatttataatgcatatatatgtataaatacctatgtgtacattcacatatttgtgtgtgtgtgtgtgtgtgtgtgtatatatatatatatatatatatatatatatatatatatataaaatagagcatgtaggtgagtagctatct

SEQ ID NO: 8375 - DNA, 200 bp, Homo sapiens
  DISO7_10016571
  Located on chromosome 5
  Distance between a terminus base of telomere on chromosomal short arm and 5'-terminus of this base sequence : 43929375
  Distance between 3'-terminus of neighbour sequence of sequence listing upward to telomere on chrosomal short arm and 5'-terminus of this base sequence : 321141
tgaagtggataatcagttcttcactatatatatatatatatatatatatatatatatatatatatacacacacacacacacacatatgtaaatagctatatatataaatatatatattttatggatatatatttttatataactagttacatatatattaatatatatatgaatacttgataggacagagcaacaggtga

SEQ ID NO: 8376 - DNA, 194 bp, Homo sapiens
  DID22N_0025115
  Located on chromosome 5
  Distance between a terminus base of telomere on chromosomal short arm and 5'-terminus of this base sequence : 43929375
  Distance between 3'-terminus of neighbour sequence of sequence listing upward to telomere on chrosomal short arm and 5'-terminus of this base sequence : -200
tgaagtggataatcagttcttcactatatatatatatatatatatatatatatatatatatatatacacacacacacacacacatatgtaaatagctatatatataaatatatatattttatggatatatatttttatataactagttacatatatattaatatatatatgaatacttgataggacagagcaac

SEQ ID NO: 8377 - DNA, 101 bp, Homo sapiens
  DISD22_0004639
  Located on chromosome 5
  Distance between a terminus base of telomere on chromosomal short arm and 5'-terminus of this base sequence : 44095811
  Distance between 3'-terminus of neighbour sequence of sequence listing upward to telomere on chrosomal short arm and 5'-terminus of this base sequence : 166242
aatatgtgaacatcatgaagaaccagtgtagtcaaggttcttgactacacacacacacacacacacaatgagaaacacaattccttgcaaatagaatactc

SEQ ID NO: 8378 - DNA, 187 bp, Homo sapiens
  D5S2092
  Located on chromosome 5
  Distance between a terminus base of telomere on chromosomal short arm and 5'-terminus of this base sequence : 44285295
  Distance between 3'-terminus of neighbour sequence of sequence listing upward to telomere on chrosomal short arm and 5'-terminus of this base sequence : 189383
tttgttgaaatccctgtggtaatcatggttgaaatgcgggataacagaagaacccaaaataaatagccttaaatattatgaatctttttatatgctgtgtggataccaaacacacacacacacacaaacacaacacaaacacacacacacacacacacacacacacacaaaggctccacaactgcgt

SEQ ID NO: 8379 - DNA, 158 bp, Homo sapiens
  DISO7_10995141
  Located on chromosome 5
  Distance between a terminus base of telomere on chromosomal short arm and 5'-terminus of this base sequence : 44285330
  Distance between 3'-terminus of neighbour sequence of sequence listing upward to telomere on chrosomal short arm and 5'-terminus of this base sequence : -152
gcgggataacagaagaacccaaaataaatagccttaaatattatgaatctttttatatgctgtgtggataccaaacacacacacacacacaaacacaacacaaacacacacacacacacacacacacacacacaaaggctccacaactgcgttcttag

SEQ ID NO: 8380 - DNA, 162 bp, Homo sapiens
  DISO7_10001850
  Located on chromosome 5
  Distance between a terminus base of telomere on chromosomal short arm and 5'-terminus of this base sequence : 44501847
  Distance between 3'-terminus of neighbour sequence of sequence listing upward to telomere on chrosomal short arm and 5'-terminus of this base sequence : 216359
gacagattacacgatagacagatagatagatagatagatagatagatagatagatagatagatagatattgatagagaacatgttgtgtctatatacatatccaatgacacacagtataatcatgttttaaattatgccaaaagtactgattatatcaagcc

SEQ ID NO: 8381 - DNA, 147 bp, Homo sapiens
  D5S623
  Located on chromosome 5
  Distance between a terminus base of telomere on chromosomal short arm and 5'-terminus of this base sequence : 44536228
  Distance between 3'-terminus of neighbour sequence of sequence listing upward to telomere on chrosomal short arm and 5'-terminus of this base sequence : 34219
ttgcgtccccattaggcgcgtctcgccctgtctgttaagcaccctccaaagtcatctcagtgagtgctttgttttaggtacacacacgcacacacacacacacacacacagacagacacgcacgcactcaagcatggacagtgtggg

SEQ ID NO: 8382 - DNA, 446 bp, Homo sapiens
  AC027329.3_100182
  Located on chromosome 5
  Distance between a terminus base of telomere on chromosomal short arm and 5'-terminus of this base sequence : 44804793
  Distance between 3'-terminus of neighbour sequence of sequence listing upward to telomere on chrosomal short arm and 5'-terminus of this base sequence : 268418
ctaaagttctgtcgccaagtatggatctctaccagcaccaaatctcaaccttttttttttaacccctagcacttccccatcaataatccagtcacctgaggcaattaaaataggcttattttattaccaactcaatccactgacaactcaaagcaaaacaattaatgaacaaatgtctgcatgtccccagttgaattacttgtgtgcacatttacacacacacacacacacacacacacacacacacacacttctttgcatcatattctttccccactacccaatacaaaagcttggtctatgggacaggtgatgggaagtaagaagagtttgtgacaaattagaagtcaagttagtcaacaaatcataatctctgtcttttcctgttataggctttgctggattaacctaatcagtacaaactaatacaactttgcattgtcttg

SEQ ID NO: 8383 - DNA, 311 bp, Homo sapiens
  AC027329.3_51197
  Located on chromosome 5
  Distance between a terminus base of telomere on chromosomal short arm and 5'-terminus of this base sequence : 44853915
  Distance between 3'-terminus of neighbour sequence of sequence listing upward to telomere on chrosomal short arm and 5'-terminus of this base sequence : 48676
tctcaggtattctgttatagcaacacaaaatagactaagacagacagataggtaggtagagagactatgatagatagatagatagatagatagatagatagatagatagatagacactcttggccctcaaagaattcccattcaggaaaggcctcagacaagtaaatattttctactgactaaaagtccaaagacataattaagtattcagggccagaacatggattttgaaactcccctgaggaatttatgtgcccaagccattgaattggattggtccttgatatatttatagcactcagtgtcaattt

SEQ ID NO: 8384 - DNA, 310 bp, Homo sapiens
  AC027329.3_38347
  Located on chromosome 5
  Distance between a terminus base of telomere on chromosomal short arm and 5'-terminus of this base sequence : 44866624
  Distance between 3'-terminus of neighbour sequence of sequence listing upward to telomere on chrosomal short arm and 5'-terminus of this base sequence : 12398
aaacagatcagttgaatggaacagtagtagatttggttatgagatgaaaggcaacccctggagttttgcattagagagtctacatcactatatgtgacaaccccatttcctagttcaggcatgcattagggcttctctgctagtaagtgataaagatatgtccacatttcccaattattcttgtatctctctagtttcctattggtaactctggacacacacacacacacacacacacacacacacacacacacaggtttcccttttccttgggcaaacaatcattctcagagatagtgcagttccttac

SEQ ID NO: 8385 - DNA, 274 bp, Homo sapiens
  D5S2037
  Located on chromosome 5
  Distance between a terminus base of telomere on chromosomal short arm and 5'-terminus of this base sequence : 44866661
  Distance between 3'-terminus of neighbour sequence of sequence listing upward to telomere on chrosomal short arm and 5'-terminus of this base sequence : -273
tatgagatgaaaggcaacccctggagttttgcattagagagtctacatcactatatgtgacaaccccatttcctagttcaggcatgcattagggcttctctgctagtaagtgataaagatatgtccacatttcccaattattcttgtatctctctagtttcctattggtaactctggacacacacacacacacacacacacacacacacacacacacaggtttcccttttccttgggcaaacaatcattctcagagatagtgcagttccttacc

SEQ ID NO: 8386 - DNA, 459 bp, Homo sapiens
  chr5.fa.O7frz.24385859
  Located on chromosome 5
  Distance between a terminus base of telomere on chromosomal short arm and 5'-terminus of this base sequence : 45119942
  Distance between 3'-terminus of neighbour sequence of sequence listing upward to telomere on chrosomal short arm and 5'-terminus of this base sequence : 253007
atcatttgatgttgaacctataatattctggttgccacttttacagtttgaactgctcttgcagagttgtaatatttatgttgctaatttttatgttttatcatatttcaccattctatactctatgacacattgtcctatatgctgttttaaatgatttttttttcctttagtgtctttgaccctttctttacaaggtttgacctctatttcttttggtgttcatttcagactcctgtccaagatataactgtgtgatgtctgtttctttgtatgcacacacacagatacacacacacacacacacacacacacacaccatctttatcaaaccattatagaacatatgtttgcattgaacacatcacttaaagagaaattcgaaccataaagttttgatacaagaagcattttaatgaaaagtttaagatgaaagtctttggcttaagatatttatcc

SEQ ID NO: 8387 - DNA, 101 bp, Homo sapiens
  DISO7_10016480
  Located on chromosome 5
  Distance between a terminus base of telomere on chromosomal short arm and 5'-terminus of this base sequence : 45298878
  Distance between 3'-terminus of neighbour sequence of sequence listing upward to telomere on chrosomal short arm and 5'-terminus of this base sequence : 178477
ctgctgagattgtattcagtgttatgtgcagtgtgtgtgtgtgtgtgtgtgtgtgtgtgtgtgtgtgtattcacgattgagctggatgtgaggaatgtact

SEQ ID NO: 8388 - DNA, 154 bp, Homo sapiens
  Z66784
  Located on chromosome 5
  Distance between a terminus base of telomere on chromosomal short arm and 5'-terminus of this base sequence : 45379582
  Distance between 3'-terminus of neighbour sequence of sequence listing upward to telomere on chrosomal short arm and 5'-terminus of this base sequence : 80603
ttatcatgtactctatccccctgtggtgatgtgtgtgtgtgtgtgtgtgtgtgtgtgtgtgtgtgctcttgtgggtatacatatatataatgcttagtttgtcctctacccctaaatttcagagatgagaaaagtaaggttaaatggggccggg

SEQ ID NO: 8389 - DNA, 429 bp, Homo sapiens
  chr5.fa.O7frz.37538918
  Located on chromosome 5
  Distance between a terminus base of telomere on chromosomal short arm and 5'-terminus of this base sequence : 45451174
  Distance between 3'-terminus of neighbour sequence of sequence listing upward to telomere on chrosomal short arm and 5'-terminus of this base sequence : 71438
tactttcttgctatgtcctcacatggcagagagagagatgaagagatagaaacacacacacacacacacacacagacacacacacacacacacacacacacacatggagaaagagagacatcatctctctcatgtgtcttcatcttcttataagagaactgatcccattcgtgagggcttacccttatgaactaattacctctcaaaggccccatctacaaatactaacaaattggggattagggatttaacttataaaatttttggggaaacaaacattcagtccataacaggtataaagttgtatcttagaatatgagctgtgttgtatagttgaacactgaagttggattctgtacactccctggatcctgactacatattttttgaaatatagtttggaaactctaactagcctttcatagatca

SEQ ID NO: 8390 - DNA, 151 bp, Homo sapiens
  chr5.fa.O7frz.37640551
  Located on chromosome 5
  Distance between a terminus base of telomere on chromosomal short arm and 5'-terminus of this base sequence : 45604907
  Distance between 3'-terminus of neighbour sequence of sequence listing upward to telomere on chrosomal short arm and 5'-terminus of this base sequence : 153304
caatcaacagcaatcaagttactaaacacattcatcaccctcaaaattttccttatgtatgtggtgtgtgtgtgtgtgtgtgtgtgtgtgtgtgtgtgtgttgagaatatttaacatgggaacattcctgttaacatgttttaaggtgaac

SEQ ID NO: 8391 - DNA, 113 bp, Homo sapiens
  DISO7_11005116
  Located on chromosome 5
  Distance between a terminus base of telomere on chromosomal short arm and 5'-terminus of this base sequence : 46211580
  Distance between 3'-terminus of neighbour sequence of sequence listing upward to telomere on chrosomal short arm and 5'-terminus of this base sequence : 606522
aatgtaccatttgcatcctggtttacatacacacacacacacacacacacacacacacacacacacacacacacacgggggagggtttcttaccctgagtatgaatcccactg

SEQ ID NO: 8392 - DNA, 261 bp, Homo sapiens
  D5S1969
  Located on chromosome 5
  Distance between a terminus base of telomere on chromosomal short arm and 5'-terminus of this base sequence : 46336933
  Distance between 3'-terminus of neighbour sequence of sequence listing upward to telomere on chrosomal short arm and 5'-terminus of this base sequence : 125240
gacaagggctgggatgaagggaaggagatagccaattgccagttgtgttaaatcttagttggtgctaacatgaggttcgctagtctgtatcagagtttactgtatcttaaacagtaaacaaaggtctagccaaagagaaaaataaataagggtgtgtgtgtgtgtgtgtgtgtgtgtgtgtgtgtgtgtgtgtgtgtgtgtgtgttgagggctgggagagaaggagaattaaaggcagaaaattcccaggtgaggttccct

SEQ ID NO: 8393 - DNA, 243 bp, Homo sapiens
  D5S1508
  Located on chromosome 5
  Distance between a terminus base of telomere on chromosomal short arm and 5'-terminus of this base sequence : 46393445
  Distance between 3'-terminus of neighbour sequence of sequence listing upward to telomere on chrosomal short arm and 5'-terminus of this base sequence : 56251
tgttttccctcaaacaaagcctgagctatgaaaacaggtttaagttgccaaagaattcacctgtgattgtttgtagtctaacatctaaaggactggaatggaatgtcagaatgtcagtcagaaaatattttctttctatctatctatctatctatctatctatctatctatctatctatctatctatctctactttggcctggaattaaacttgagaaatttagaaacatcattcttgtgccc

SEQ ID NO: 8394 - DNA, 103 bp, Homo sapiens
  D5S628
  Located on chromosome 5
  Distance between a terminus base of telomere on chromosomal short arm and 5'-terminus of this base sequence : 46482004
  Distance between 3'-terminus of neighbour sequence of sequence listing upward to telomere on chrosomal short arm and 5'-terminus of this base sequence : 88316
gtggttaatagactgctcaaattgaaaacacacacacacacacacacacacaccaccaccaccaccaccatcaccaggatatggaatctatacacgttcgttc

SEQ ID NO: 8395 - DNA, 264 bp, Homo sapiens
  Z67266
  Located on chromosome 5
  Distance between a terminus base of telomere on chromosomal short arm and 5'-terminus of this base sequence : 46507234
  Distance between 3'-terminus of neighbour sequence of sequence listing upward to telomere on chrosomal short arm and 5'-terminus of this base sequence : 25127
acacaggacacctggaaattcaacttgtgcagtcaactctttcaatgagaaactatgttttcattggccacatttaggagtacatatggtacctgcaaatagtgagacacatacacacacacacacacacacacacacacacacacacaaacccaaagagaaataccataactttaaaaaatgtcccttatatgacataatgtatgaataatatattaatagtgaaaagatccttttctttaatctcctgctacagtttcaccc

SEQ ID NO: 8396 - DNA, 480 bp, Homo sapiens
  AC016580.5_48349
  Located on chromosome 5
  Distance between a terminus base of telomere on chromosomal short arm and 5'-terminus of this base sequence : 46530272
  Distance between 3'-terminus of neighbour sequence of sequence listing upward to telomere on chrosomal short arm and 5'-terminus of this base sequence : 22774
gttcctgaagtatgaattgtttattataatatggtaatcccactaccagctctggttgtaccaccaactatgattttgaaataaagggtttaaatatatatatatgcgtgtgtggatagacagatagatagatagatagatagatagatagatagatagatagatagatagagatagagatagagatatgcttacacagcccacatttaaaatctaccattatcttaaagaaaaagaacatgatagtggtggctcccactccatggagatcactgatggcaaagtacagagtgggaaaacatatttatgttttacccgcttggcatattataaatagaacaatctcaaccaggcattttgccaagatgtggaaaaatgaaatgaggcaaaatgcaaatggaaaataaaattactttttatgccaaaataaggtctggatggaaaactttaaccaaagatatggtctggatatggtaagac

SEQ ID NO: 8397 - DNA, 107 bp, Homo sapiens
  DISO7_10016607
  Located on chromosome 5
  Distance between a terminus base of telomere on chromosomal short arm and 5'-terminus of this base sequence : 46551924
  Distance between 3'-terminus of neighbour sequence of sequence listing upward to telomere on chrosomal short arm and 5'-terminus of this base sequence : 21172
cagtaccctccttccaccccctttgttcttctttacttacacacacacatacacacacacacacacacacacacacagagagagatacacacctgctatgaacaacc

SEQ ID NO: 8398 - DNA, 429 bp, Homo sapiens
  AC008873.4_1923
  Located on chromosome 5
  Distance between a terminus base of telomere on chromosomal short arm and 5'-terminus of this base sequence : 46626158
  Distance between 3'-terminus of neighbour sequence of sequence listing upward to telomere on chrosomal short arm and 5'-terminus of this base sequence : 74127
actgatagtgtctgatcggataactatgttcctttttaaactctcaaattctataatttctgaagtgctgagatactgtcatagttatggaagcattttctagctttgagtttttatagatctagcctcagccatacagcctggtgggtacaggtactttaagtgaataactggctttattaatctcaactggaagtggccgagttgaactgaaactaaacacagacacacacacacacacacacacacacacacacacacacaaatcagtagtattaccaaactacaaccactaaggagcatactcatccaattttaatttgagcatcagacgcaaaaagacagaaacaatatgtatgcttcgtctgtcattctaatctgaacacacaatgtcttcaagtcaacaacttaggtagatggagcagactg

SEQ ID NO: 8399 - DNA, 220 bp, Homo sapiens
  D5S1968
  Located on chromosome 5
  Distance between a terminus base of telomere on chromosomal short arm and 5'-terminus of this base sequence : 46636715
  Distance between 3'-terminus of neighbour sequence of sequence listing upward to telomere on chrosomal short arm and 5'-terminus of this base sequence : 10128
ggttctcaccacctcctgcttaagaggcaaaacctctttttatatacaaagcatgcatacacacacacacacacacacacacacacacacacacacacacacacacagagtacataaaacatatacacagtatctctgtggtattaaaatgtcataagggagagggtgattaagaaaaaaatgtctaaaaagcccaggatggtcggggaagcataatgat

SEQ ID NO: 8400 - DNA, 338 bp, Homo sapiens
  AC008873_107805
  Located on chromosome 5
  Distance between a terminus base of telomere on chromosomal short arm and 5'-terminus of this base sequence : 46732021
  Distance between 3'-terminus of neighbour sequence of sequence listing upward to telomere on chrosomal short arm and 5'-terminus of this base sequence : 95086
cttgtatctaaggtttggatacacaatcaaattctggctgttgaaatttcagtgaaagtatgatgatggcttcttggaaagttttcttcttgcttaaatgtacaagttcccacgctttctattcactttgggacacgcataagcttctgcagctgtcttgacatcatgagagaccacacagataacaatttgaagatggtagagcaaaaagacctaattctaggttcttctttttctttttaaattattattattattattattattattattattattatttgacacagggtcctattctgtcacccaggctggagtgcagtagtgtgatcacagct

SEQ ID NO: 8401 - DNA, 255 bp, Homo sapiens
  HUMUT6396
  Located on chromosome 5
  Distance between a terminus base of telomere on chromosomal short arm and 5'-terminus of this base sequence : 46732071
  Distance between 3'-terminus of neighbour sequence of sequence listing upward to telomere on chrosomal short arm and 5'-terminus of this base sequence : -288
agtgaaagtatgatgatggcttcttggaaagttttcttcttgcttaaatgtacaagttcccacgctttctattcactttgggacacgcataagcttctgcagctgtcttgacatcatgagagaccacacagataacaatttgaagatggtagagcaaaaagacctaattctaggttcttctttttctttttaaattattattattattattattattattattattattatttgacacagggtcctattctgtca

SEQ ID NO: 8402 - DNA, 265 bp, Homo sapiens
  AC016583.3_181384
  Located on chromosome 5
  Distance between a terminus base of telomere on chromosomal short arm and 5'-terminus of this base sequence : 47018047
  Distance between 3'-terminus of neighbour sequence of sequence listing upward to telomere on chrosomal short arm and 5'-terminus of this base sequence : 285721
caatttcttgaatgtccattatagtagcagtctccagagagacagaaccaataaaatatagacagatagatagatagatagatagatagataggtagacatgagaggggatttattagaattggcttatatgattatagaggctgagaagtctcatgacatgctgtctgtaagctggaaaccctgggatgctggtagcatggctcagccaaagtctgaaagcttttacagaattaagaaagctgatggtataattatcagtccaa

SEQ ID NO: 8403 - DNA, 198 bp, Homo sapiens
  D5S2031
  Located on chromosome 5
  Distance between a terminus base of telomere on chromosomal short arm and 5'-terminus of this base sequence : 47440524
  Distance between 3'-terminus of neighbour sequence of sequence listing upward to telomere on chrosomal short arm and 5'-terminus of this base sequence : 422212
tgtgagccaatccctcgtaatacatttctctttctctttctctctctctctctctctctctctctctgtgtgtgtgtgtgtgtgtgtgtgtgtatctgtttctctggagaacctttactaatacatttcctcagtaaaatcctttcacaccaaatccccttcagaggacctcagctggctcaagtaccagtagaggct

SEQ ID NO: 8404 - DNA, 247 bp, Homo sapiens
  D5S2074
  Located on chromosome 5
  Distance between a terminus base of telomere on chromosomal short arm and 5'-terminus of this base sequence : 47491363
  Distance between 3'-terminus of neighbour sequence of sequence listing upward to telomere on chrosomal short arm and 5'-terminus of this base sequence : 50641
ctggaacctaggggcaacacacacacacacacacacacacacacacacacacacacacacagacaaacacacactcttttccaaatattggagtgttaaagtattaaactagtcatctataaagtagagtgtttcctgtgcagcaagtagaagtgtaattaattatacatgtactgtattttgaagtccatttggaagtacatgagttgactgatttgtcaagggtcttaaacacaatcattaatct

SEQ ID NO: 8405 - DNA, 343 bp, Homo sapiens
  chr5.fa.O7frz.77716055
  Located on chromosome 5
  Distance between a terminus base of telomere on chromosomal short arm and 5'-terminus of this base sequence : 48002350
  Distance between 3'-terminus of neighbour sequence of sequence listing upward to telomere on chrosomal short arm and 5'-terminus of this base sequence : 510740
tttaatggattgagtaatgcataaaaatttgcagaagtatgcagaaagtttgtatgcagggccatgtagagcttttatcctacagtaaatcctagtagtttgctggtgctgtgtgattttttttttgtttagggttgtgtgtgtgtgtgtgtgtgtgtgtgtgtgtgtgtgtgaagcttatttattccatttcaagaaaaagaaaaatagacaaattagaataccaaaaataatttgcagccagtatcaaccaatttatattcaagctaaaaaattaaaatagctttaagagaatggtagaagcatattatttaaaaacaaactatgaagaaatggacagaag

SEQ ID NO: 8406 - DNA, 107 bp, Homo sapiens
  DISO7_10000300
  Located on chromosome 5
  Distance between a terminus base of telomere on chromosomal short arm and 5'-terminus of this base sequence : 48472335
  Distance between 3'-terminus of neighbour sequence of sequence listing upward to telomere on chrosomal short arm and 5'-terminus of this base sequence : 469642
aactattggcttcatgagccatatttgaaacccaagcctgtgtgtgtgtgtgtgtgtgtgtgtgtatgacttgaagccaaaccccacatctaagatggtagatataa

SEQ ID NO: 8407 - DNA, 444 bp, Homo sapiens
  AC024736.3_100437
  Located on chromosome 5
  Distance between a terminus base of telomere on chromosomal short arm and 5'-terminus of this base sequence : 48929749
  Distance between 3'-terminus of neighbour sequence of sequence listing upward to telomere on chrosomal short arm and 5'-terminus of this base sequence : 457307
cgcataagaatttacatgaaagaatgttaagaatttactccagaatcattcatgttgttgaaaatggtagaaattaaaggatatgtaaaatcagaatatgtatggtgacctatatatacgtataatcacaatatttcatgtgtgtgtgtgtgtgtgcgtgtgtgtgtgtgtgtgtgtgtgtgtgtgtgttccccatggaaataaactctgtaaatatgtcagatattagaattcatacatccaaatacattctcttctcacaactctgcacggtggttattattcttctacttcatggaaagaaattagatttcaatgaggttaaatggatttctcaattcacagaattattaaactttagacctgtgatccaactgtctttctgacataaaaaccatgatatgaaaattgaagattagagtcttaaagcatttgagtttgtaa

SEQ ID NO: 8408 - DNA, 415 bp, Homo sapiens
  chr5.fa.O7frz.77247844
  Located on chromosome 5
  Distance between a terminus base of telomere on chromosomal short arm and 5'-terminus of this base sequence : 48973761
  Distance between 3'-terminus of neighbour sequence of sequence listing upward to telomere on chrosomal short arm and 5'-terminus of this base sequence : 43568
gtatggtacatttgtaggcataacacagacattacattttggaaaattgtgttctatgcaacagtgccaagtctaatgaaagtaagaggaagaggaattcagccaaagtaccaacccctgttatccattccttaagaaaggaacttctttatacactcaaaagaggggattctttttaaatttgtttccagaggggcatctgcatacacatacacatacacatacacacacacacacacacacacacacacatttacattatatttaaatgtgtgtgcatgatatatatatatacatgtatttatttatttaatatatatgtgttatctgggtcctatataggaacacacacacacacacattttgaatcaaacactctttcgtataattttggtgacaaacgtatgcaataaat

SEQ ID NO: 8409 - DNA, 166 bp, Homo sapiens
  DISD22_0004712
  Located on chromosome 5
  Distance between a terminus base of telomere on chromosomal short arm and 5'-terminus of this base sequence : 49107737
  Distance between 3'-terminus of neighbour sequence of sequence listing upward to telomere on chrosomal short arm and 5'-terminus of this base sequence : 133561
gacaggatgtcagaaatacttgacagaatacttttaaggtgtattatgtgtgtgtggtgtgtgtgtgtgtgtgtgtgtgtatttttattaatcataaaaatgctcattttacaaaaactttttactgagttgtggaaaaaataaacagcttcatgaagtccattaa

SEQ ID NO: 8410 - DNA, 470 bp, Homo sapiens
  chr5.fa.O7frz.32324429
  Located on chromosome 5
  Distance between a terminus base of telomere on chromosomal short arm and 5'-terminus of this base sequence : 49221568
  Distance between 3'-terminus of neighbour sequence of sequence listing upward to telomere on chrosomal short arm and 5'-terminus of this base sequence : 113665
atgactgaagcatatcagtgacagttttgctttagcctgctttagaataaatgaagggccagcctctgttaggtagtaggtctaccacaggcaatagcacacagctagaaccttaaattttcctttgagttcatttttgttttacaaaataccccctctgtttttgctgattgtttggatggtaggttggtggattggttggttggttggttggttggttggttggtgggttggttggtgggttggttggttggttggtgggttggttggttggttggttggttggttggtgagttggttggttggttggttggttggttggttggtgggttggtgggtttgttggttggtgagttggttggttggttggtgggttggttggtgggttggtggcttggctggttggtgggttgcttggtgggttggttgatggattggttggttggtgggttgattggttgtttggtaag

SEQ ID NO: 8411 - DNA, 436 bp, Homo sapiens
  chr5.fa.O7frz.32232117
  Located on chromosome 5
  Distance between a terminus base of telomere on chromosomal short arm and 5'-terminus of this base sequence : 49313874
  Distance between 3'-terminus of neighbour sequence of sequence listing upward to telomere on chrosomal short arm and 5'-terminus of this base sequence : 91836
ttggtagataatcacaagtgagtcaatataagaaataattaaacattctaacattgattagtacaaccatcagaaaacaaggggagaataagaaatacataaagagtaggatgaggttgctgtctgccttattaacttgcaacaaaaggatatcacttcaaattaggtgccaggtgagagagaggattatgggaagaagcagagagaagctatttttactaaaagacaacaagatacacacacacacacacacacacacacacacagacacacacacacagagagaggaagagaagtaagggagaaatgtaattatactataaagttgtcagtataaaggtaatcattagaataaaaatacaagccttcccgaatacaaaggatatgaagaggaaaaaacaaagccaatataatggatttcatagtaaccactaac

SEQ ID NO: 8412 - DNA, 125 bp, Homo sapiens
  D5S2076
  Located on chromosome 5
  Distance between a terminus base of telomere on chromosomal short arm and 5'-terminus of this base sequence : 49432909
  Distance between 3'-terminus of neighbour sequence of sequence listing upward to telomere on chrosomal short arm and 5'-terminus of this base sequence : 118599
gctttcaacttaaaagatattgttgacacttgtgtgtgtgtgtgtgtgtgtgtgtgtgtgtgtgtgtgtgtgtgtgtaagagaatgagacagagatggagaataagaatgagtccaccgtgtatg

SEQ ID NO: 8413 - DNA, 170 bp, Homo sapiens
  AC010436_70710
  Located on chromosome 5
  Distance between a terminus base of telomere on chromosomal short arm and 5'-terminus of this base sequence : 49457013
  Distance between 3'-terminus of neighbour sequence of sequence listing upward to telomere on chrosomal short arm and 5'-terminus of this base sequence : 23979
cttcctttattacttccagacctcctccattttcccttttgcacttccagctcttccaacacctatgaaacttcccggtattgaaatgcacagtgttgttgttgttgttgttgttgttgttgttgttgttgttgttgttgctgctgctgctgttgttgtttctgaccagg

SEQ ID NO: 8414 - DNA, 106 bp, Homo sapiens
  DISO7_11025103
  Located on chromosome 5
  Distance between a terminus base of telomere on chromosomal short arm and 5'-terminus of this base sequence : 49711626
  Distance between 3'-terminus of neighbour sequence of sequence listing upward to telomere on chrosomal short arm and 5'-terminus of this base sequence : 254443
gaggcacatatcaggttataattcttattttaagtatatatttgtctgtatatatatatatatatatatatatatatgtatatatacgcaaaggagcctggatgtt

SEQ ID NO: 8415 - DNA, 117 bp, Homo sapiens
  DISO7_11025105
  Located on chromosome 5
  Distance between a terminus base of telomere on chromosomal short arm and 5'-terminus of this base sequence : 49901418
  Distance between 3'-terminus of neighbour sequence of sequence listing upward to telomere on chrosomal short arm and 5'-terminus of this base sequence : 189686
gtgctttccttccactccccaaatctccctgacacacacacacacacacacacacacacacacacacactcagagagacacatgcattgttttcatgtagctgtgatcttccttgca

SEQ ID NO: 8416 - DNA, 134 bp, Homo sapiens
  DISO7_10001851
  Located on chromosome 5
  Distance between a terminus base of telomere on chromosomal short arm and 5'-terminus of this base sequence : 50034620
  Distance between 3'-terminus of neighbour sequence of sequence listing upward to telomere on chrosomal short arm and 5'-terminus of this base sequence : 133085
ttgtgccaaacctatacaatgaaatactatgtatttccaaagtcaaaagagtaaaatacattataaactacacacacacacacacacacccctttggggaaagaaacaaggtatggggagctcctctaatggaa

SEQ ID NO: 8417 - DNA, 91 bp, Homo sapiens
  D5S474
  Located on chromosome 5
  Distance between a terminus base of telomere on chromosomal short arm and 5'-terminus of this base sequence : 50130793
  Distance between 3'-terminus of neighbour sequence of sequence listing upward to telomere on chrosomal short arm and 5'-terminus of this base sequence : 96039
ctgaggtagccctgtacacatacacacacacacacacacacacacacacacacacatctacatctatatacgcatttgtcctattcgttct

SEQ ID NO: 8418 - DNA, 121 bp, Homo sapiens
  D5S664
  Located on chromosome 5
  Distance between a terminus base of telomere on chromosomal short arm and 5'-terminus of this base sequence : 50199917
  Distance between 3'-terminus of neighbour sequence of sequence listing upward to telomere on chrosomal short arm and 5'-terminus of this base sequence : 69033
gccaccttctgaggggtccctctaaatcaatactttttttttctttattgtgtgtgtgtgtgtgtgtgtgtgtgtgtgtgtgtgtagtgtgttgggagggagggtagtggctggaacaatt

SEQ ID NO: 8419 - DNA, 443 bp, Homo sapiens
  AC022265.3_114766
  Located on chromosome 5
  Distance between a terminus base of telomere on chromosomal short arm and 5'-terminus of this base sequence : 50271781
  Distance between 3'-terminus of neighbour sequence of sequence listing upward to telomere on chrosomal short arm and 5'-terminus of this base sequence : 71743
gtgcaactagtatttggaacaatctttacagtgtcaggcacatttcacttttcttcacaccattggttctgtgtacgtgggcttcctccccttcagtaaagtcgttttgatattgaaggtcttgggaatgtccacaggtgttttctccttgatcttattggcagcagtcttgcatgtaacaaacctttgataatagcttgcagctagaataaggtcaaagagagttccttggtgaattttcaggaattcctggtcccaaacaggatttttatctcttcatttttcttctcattattctcaggaggaggaggagggtcatctttatgggggggtgcaccactgaatgaccttttaaaatactgcttcattatttggtagaggactgggtcatcatatccttcaatcattcattcccaaatcttccaacgtgatcttgatagtat

SEQ ID NO: 8420 - DNA, 429 bp, Homo sapiens
  AC022265.3_81537
  Located on chromosome 5
  Distance between a terminus base of telomere on chromosomal short arm and 5'-terminus of this base sequence : 50304983
  Distance between 3'-terminus of neighbour sequence of sequence listing upward to telomere on chrosomal short arm and 5'-terminus of this base sequence : 32759
agacctgtggacatacaagataagaaaattagagttcacatataaaaaatgttacatctcattagcttttgaatctaatgcagtcatagtacctaaaagtggaacaacagattactcgttatctaaaaaccagaaaggtaatatatagaaaggagttaacaggcctgattgttcatcaaaaattcatcagtaaacgaaattgaaaatcttacttaaaaggctgttccttggctagtgtatattagttagggttctccacaaagacagaccaaaaggaaggagggaggagatggatggatggatggatggatggatggatggatggatggatgaatggatggatgaatggatggatggatgagaaggaactaattaggggaattggctcgtgagattatggagcctgagaaagtcctatgataggctgtc

SEQ ID NO: 8421 - DNA, 408 bp, Homo sapiens
  AC016632.4_62174
  Located on chromosome 5
  Distance between a terminus base of telomere on chromosomal short arm and 5'-terminus of this base sequence : 50314429
  Distance between 3'-terminus of neighbour sequence of sequence listing upward to telomere on chrosomal short arm and 5'-terminus of this base sequence : 9017
cagaggaaattcaaaggttaagtttttttcttaaaaataatttaattatatatatatacatacttttatcaaagtggaagcactgtgaatatcctatttttagagatttgtcgttaagattttaatataggtagtttaaaaagtagatgtatttctaaaacgtttgccacattttccattgtttcttacctttattcctggctttgtgttaacatcacattttatttaaaaagtgtgtgtgtgtgtgtgtgtgtgtgtgtgtgtttgtgtgtgttgttgttgttgttgcatagaatccagctagggtttaataagtgcttactaaattaagttatttttattattatgccttcttttcaaacctaaatctataggatttgggagaactgaggctttggtagaaaattc

SEQ ID NO: 8422 - DNA, 448 bp, Homo sapiens
  chr5.fa.O7frz.60122263
  Located on chromosome 5
  Distance between a terminus base of telomere on chromosomal short arm and 5'-terminus of this base sequence : 50442522
  Distance between 3'-terminus of neighbour sequence of sequence listing upward to telomere on chrosomal short arm and 5'-terminus of this base sequence : 127685
gagctgtagtgaagattaaatgagatcatgtatgtaaaatgctttgtctggtgctaattattactattgtcattattattattattattattattattattattattattaatttttgagatggagtttcgctcttgttgcccaggctggagtgcaatggtgtgatctcagctcaccacaacctccacctcctaggttcaagcaattatcctgcctcagcctcctgagtagctgggattacaggcatgtgccaccacaccaggctcattttgtatttttagtagcgacggggtttctccatgttggtcaggctggtctcgaactcctgacctcaggtgatccacctgcctcagcctccctaagtgctgggattacaggcgtgagccactgctcctggcttattgtcattcttaataaaatttctgattgatcaaatttctgttagaca

SEQ ID NO: 8423 - DNA, 184 bp, Homo sapiens
  D5S645
  Located on chromosome 5
  Distance between a terminus base of telomere on chromosomal short arm and 5'-terminus of this base sequence : 50551020
  Distance between 3'-terminus of neighbour sequence of sequence listing upward to telomere on chrosomal short arm and 5'-terminus of this base sequence : 108050
ctggtcttgaactcccaacctcaggtaatccgcctgccttggcctcccaaagtgctgggattacaggcgtgagccactgcgcctggcccagacctttattttacacacacacacacacacacacacacacacacacacacacacacactgcagtttgtttcactgaagacattgggacttggtt

SEQ ID NO: 8424 - DNA, 223 bp, Homo sapiens
  D5S1966
  Located on chromosome 5
  Distance between a terminus base of telomere on chromosomal short arm and 5'-terminus of this base sequence : 50773682
  Distance between 3'-terminus of neighbour sequence of sequence listing upward to telomere on chrosomal short arm and 5'-terminus of this base sequence : 222478
ctcatgcacacccacgcacatgaacacacacacacacacacacacacacacacttctctttctctccttacaactgtaaatccataccatgagactaaggatgctaacaaccaaagaatgtgttaaagcagcattttacctctttgctgatcaaacacagaaggggtgctgaaatccatggtagcctgtctcatcatttaccatcagaatggcaaaaagcatc

SEQ ID NO: 8425 - DNA, 247 bp, Homo sapiens
  D5S2068
  Located on chromosome 5
  Distance between a terminus base of telomere on chromosomal short arm and 5'-terminus of this base sequence : 50869369
  Distance between 3'-terminus of neighbour sequence of sequence listing upward to telomere on chrosomal short arm and 5'-terminus of this base sequence : 95464
atgtaagagtctttagaaacaggcaaacagattagaaacacttttcttccttttttacttccttccttttcttttttccttctctttgctttgttcttttctctttttttttttaaatacaggcataaatatagaagggaggatcatatatatgtgtgtgtgtgtgtgtgtgtgtgtgtgtgtgtgtatatatatatatatatgtatatgaatcatagtttgcctttttgctcctccactaaattgt

SEQ ID NO: 8426 - DNA, 237 bp, Homo sapiens
  AC008774.4_19630
  Located on chromosome 5
  Distance between a terminus base of telomere on chromosomal short arm and 5'-terminus of this base sequence : 50882254
  Distance between 3'-terminus of neighbour sequence of sequence listing upward to telomere on chrosomal short arm and 5'-terminus of this base sequence : 12638
acacatcgcatttaatactcaccacaactttgtgaaataggtaacctaccttccttccttccttccttccttccttccttccttccttcccatctttctttctttctttctctctctctctttctttctctctctgtctctttttctttctctctctctctctgtctctctctctctttctttctttctctctttctttcttctccagcttctgtatcaagaacaggtgatactgtt

SEQ ID NO: 8427 - DNA, 193 bp, Homo sapiens
  D5S633
  Located on chromosome 5
  Distance between a terminus base of telomere on chromosomal short arm and 5'-terminus of this base sequence : 50966876
  Distance between 3'-terminus of neighbour sequence of sequence listing upward to telomere on chrosomal short arm and 5'-terminus of this base sequence : 84385
tcaagttcccccatacactctatgtactttctctctcactccctctgagatcttcgttccactcctttggttatttgtcttgaactcttaagtagtcccaagttttaaagtgtatagagagtgtatacacatacacacacacacacacacacacacacacacacacatacacaaagcaacataactggtctgg

SEQ ID NO: 8428 - DNA, 184 bp, Homo sapiens
  D5S461
  Located on chromosome 5
  Distance between a terminus base of telomere on chromosomal short arm and 5'-terminus of this base sequence : 51087116
  Distance between 3'-terminus of neighbour sequence of sequence listing upward to telomere on chrosomal short arm and 5'-terminus of this base sequence : 120047
taagggtatcgggttggaagcctaattgcaactcttatccaaagtgaccagaaccttcccagttacccagaataaaggacccccagttccttctttgtgtgtgtgtgtgtgtgtgtgtgtgtgtgtgtgtgtgtgtgtgagagagagagagagagagagagagagtgccatgtccttaagttgc

SEQ ID NO: 8429 - DNA, 269 bp, Homo sapiens
  chr5.fa.O7frz.61555983
  Located on chromosome 5
  Distance between a terminus base of telomere on chromosomal short arm and 5'-terminus of this base sequence : 51165486
  Distance between 3'-terminus of neighbour sequence of sequence listing upward to telomere on chrosomal short arm and 5'-terminus of this base sequence : 78186
gctgacaagtgccaattagagccccaatttgctatcagttgcccatgtggttaagtactgtctttttgtttatttgtttaaactcaaagttgtagcagcagttgacctacttgccaacataacccaattcctacacacacacacacacacacacacagacacatacacacacacacacacacacacacacacacacacacacacacacacacaggtaatgggggaaaatcattttaaactgtctttagttacatggaaatgcattagaa

SEQ ID NO: 8430 - DNA, 111 bp, Homo sapiens
  D5S407
  Located on chromosome 5
  Distance between a terminus base of telomere on chromosomal short arm and 5'-terminus of this base sequence : 51239874
  Distance between 3'-terminus of neighbour sequence of sequence listing upward to telomere on chrosomal short arm and 5'-terminus of this base sequence : 74119
tggtttagagaatttgccccgtctgcaataactagcatacacacacacacacacacacacacacacacacacagtcttctttcttgacttccaatgaacaacaaatcacag

SEQ ID NO: 8431 - DNA, 323 bp, Homo sapiens
  chr5.fa.O7frz.61838851
  Located on chromosome 5
  Distance between a terminus base of telomere on chromosomal short arm and 5'-terminus of this base sequence : 51442137
  Distance between 3'-terminus of neighbour sequence of sequence listing upward to telomere on chrosomal short arm and 5'-terminus of this base sequence : 202152
ccgcttctaacagtctacaacaaaaggagaggctgtagcaagatacttgatgccctttcctggtctcttgttctcagaaccactctactctcagctggctgggtcatccatccattcatccatccatccatccatccaaccatccatccatccatccatccatccatccatccatccatccatccatctgtccatccatccatccatatccatccatgcatctatccatccatgcatcctgccaactactgttcctctgagcttttcaaactctatttccagctagtactctgctactagaacattcaatgactatctactgc

SEQ ID NO: 8432 - DNA, 476 bp, Homo sapiens
  AC034165.3_82626
  Located on chromosome 5
  Distance between a terminus base of telomere on chromosomal short arm and 5'-terminus of this base sequence : 51549214
  Distance between 3'-terminus of neighbour sequence of sequence listing upward to telomere on chrosomal short arm and 5'-terminus of this base sequence : 106754
ctgaagaccggagtattagttttctcatatggatgggaggtgaggcttggggcctccaaaaaaagccagggcggccgggcactgtggctcacgcctgtcatctcagcattttgggaggccaaggcgggcagatcacgaggtcaagagatggagaccatcatggtcaacatggtgaaaccccgtctctactaaaaatacaaaaattagccaggtgtggtggtgtgcgcctgtagtcccagctacttaggaggctgaggcaggggaattgcttgaacccgggaggcggagcttgcagtgagccgagattgtgccattgcactccagcctggcgacagagcgagactctgtctcaaaaataaataaataaataaataaataaataaataaataaataataaaaaagccaggactcgcagggctgctccacccacaataatgaaccactatctagagaagtgtcagcgaagctacttatc

SEQ ID NO: 8433 - DNA, 440 bp, Homo sapiens
  AC008435.4_126384
  Located on chromosome 5
  Distance between a terminus base of telomere on chromosomal short arm and 5'-terminus of this base sequence : 51871030
  Distance between 3'-terminus of neighbour sequence of sequence listing upward to telomere on chrosomal short arm and 5'-terminus of this base sequence : 321340
aggcaagctacagtcttacttcctagccccatactctctctattctttctcatctcagtatggctccaccagctacctatttattcaggctaaaacacgtgggaatcatctttggctttcttctttccccccatctaatccattagcaaattatgtgttctaccttcaaaatctcctaaatgtattcattaatatcccactgctactagacttgtacaagcctctttctgtctgtctgtctgtctgtctttctttgcgacgaagtttcactcttgttgcctaggctggagtatagtggtgtgatcttggctcactgcaacctctgcctcccaagtagctgggattacaggcatgcaccaccatacccggctaattttttttttggaagacagtctcgctctgtcccccaggctggaatgtattgccactatctcagttca

SEQ ID NO: 8434 - DNA, 122 bp, Homo sapiens
  D5S2102
  Located on chromosome 5
  Distance between a terminus base of telomere on chromosomal short arm and 5'-terminus of this base sequence : 52130489
  Distance between 3'-terminus of neighbour sequence of sequence listing upward to telomere on chrosomal short arm and 5'-terminus of this base sequence : 259019
ccacaatggtgtcagccaatttttttataataaatatacatgcacgcatgcacatgtgcgtgcacacacacacacacacacacacacatatcctattggttctgtttctctggagaggcagg

SEQ ID NO: 8435 - DNA, 220 bp, Homo sapiens
  Z66709
  Located on chromosome 5
  Distance between a terminus base of telomere on chromosomal short arm and 5'-terminus of this base sequence : 52202100
  Distance between 3'-terminus of neighbour sequence of sequence listing upward to telomere on chrosomal short arm and 5'-terminus of this base sequence : 71489
tgtggttttctaagacattccctggcaattgcctaggggttgaaataatttttggataagttttctacacacacacacacgaacacacacacacacacacacacacacacacagcacagcaaagttatttatgagaccaacaggtcatcttttaatgtttataactcaacttggagggttcttttccaatggattcaggagccacttaggtgagataaac

SEQ ID NO: 8436 - DNA, 444 bp, Homo sapiens
  chr5.fa.O7frz.62256547
  Located on chromosome 5
  Distance between a terminus base of telomere on chromosomal short arm and 5'-terminus of this base sequence : 52328829
  Distance between 3'-terminus of neighbour sequence of sequence listing upward to telomere on chrosomal short arm and 5'-terminus of this base sequence : 126509
gagactttcagcattacatatcacgctcatcagtacttttaccaggaccctagagaggggtgtgtgtgtgtgtgtgtgtgtgtgtgtgtgtgtgtaacagagagagagagagaagtagctgtagtgcggtagcatcaacttatgatttctcacaaccactttttaaggaaaggaaggcaggattggagagggagaactgcagctcagtgaggataaatgtggcccccagcaaactctaaaagcctcacggaggccatgctgaggaaatgagtagagggcagccccctgggccacaacctctaccccaaccagagcaactccacaccctgagctctacacgtgggcttccacctaagattccaatgaggaaaggattctgcgtctaaactttgaaaaccgctagattaggaacaactctaggttcctttaccacttaaacattct

SEQ ID NO: 8437 - DNA, 197 bp, Homo sapiens
  D5S631
  Located on chromosome 5
  Distance between a terminus base of telomere on chromosomal short arm and 5'-terminus of this base sequence : 52545181
  Distance between 3'-terminus of neighbour sequence of sequence listing upward to telomere on chrosomal short arm and 5'-terminus of this base sequence : 215908
gcttgaacccgagaggcagaggctgcagtgagtcgacattgcaccattgcattccagcctgggcaacgagagcgaaacgccctctcaaaaacacacacacacacacacacacacacacacacaccagagttctagttttgactcttctctgtagacaaatacctaagactctctgaaactgcttttcaaatctgcaa

SEQ ID NO: 8438 - DNA, 158 bp, Homo sapiens
  Z23929.1_121
  Located on chromosome 5
  Distance between a terminus base of telomere on chromosomal short arm and 5'-terminus of this base sequence : 52545206
  Distance between 3'-terminus of neighbour sequence of sequence listing upward to telomere on chrosomal short arm and 5'-terminus of this base sequence : -172
cagtgagtcgacattgcaccattgcattccagcctgggcaacgagagcgaaacgccctctcaaaaacacacacacacacacacacacacacacacacaccagagttctagttttgactcttctctgtagacaaatacctaagactctctgaaactgct

SEQ ID NO: 8439 - DNA, 312 bp, Homo sapiens
  chr5.fa.O7frz.39095972
  Located on chromosome 5
  Distance between a terminus base of telomere on chromosomal short arm and 5'-terminus of this base sequence : 52627924
  Distance between 3'-terminus of neighbour sequence of sequence listing upward to telomere on chrosomal short arm and 5'-terminus of this base sequence : 82560
atattgcttctggtatctggactctgaatgccttgtgatcaaaactatgttgtttatatagatatgtgtgtgtatgtatgtagatgtagatgtgtatatatatatatatatatatatatatatatatagatgtgtatgtatgtatattgtatacatacatataaaatatgtacatatatttatgtacataaatatgtagatatgtaaaatatgtacatatgttaaaaataatacaaggatctcacatcatgcctagtccagagctcaagagggatgtagcaactaaatgtattatgaccatctagattgcag

SEQ ID NO: 8440 - DNA, 203 bp, Homo sapiens
  D5S426
  Located on chromosome 5
  Distance between a terminus base of telomere on chromosomal short arm and 5'-terminus of this base sequence : 52669571
  Distance between 3'-terminus of neighbour sequence of sequence listing upward to telomere on chrosomal short arm and 5'-terminus of this base sequence : 41335
agactaaataaaatcactgccggcactgtagtatttgaacaaataccacctgggcatgtgtgtgtagatataaggagtgtgtgcatgtgtgtgtgtgtgtgtgtgtgtgtgtgtgtgtgtgtgtgtgtgtgtatgtgtctgtatcattttatgttgcccacttttcagaaacctgatctttttggctatgaaagcaagaattt

SEQ ID NO: 8441 - DNA, 372 bp, Homo sapiens
  AC025769.3_25572
  Located on chromosome 5
  Distance between a terminus base of telomere on chromosomal short arm and 5'-terminus of this base sequence : 52706166
  Distance between 3'-terminus of neighbour sequence of sequence listing upward to telomere on chrosomal short arm and 5'-terminus of this base sequence : 36392
ggttacgttagtaacagtgcttagtggtcatcactagtcctaaacgtttgttgtggtggttaggggatgaattaaatggcttagcttttacaggtattgtctttccatgtggaacctaccttaagttttgccactttattactgagatgcagtcaccttcaatctgaagatccagtgagaactggtacaaagatctgttaccataaatcctgccctgtagaatttttgaaaaaaacaaaacacacacacagacacacacacacacacacacacacacacacacacacacacacacacaaaaccacctttcaaaatctattacactggctctttttattctttttatccatgattaatgtcttcaggatggtc

SEQ ID NO: 8442 - DNA, 228 bp, Homo sapiens
  D5S663
  Located on chromosome 5
  Distance between a terminus base of telomere on chromosomal short arm and 5'-terminus of this base sequence : 52706304
  Distance between 3'-terminus of neighbour sequence of sequence listing upward to telomere on chrosomal short arm and 5'-terminus of this base sequence : -234
ttactgagatgcagtcaccttcaatctgaagatccagtgagaactggtacaaagatctgttaccataaatcctgccctgtagaatttttgaaaaaaacaaaacacacacacagacacacacacacacacacacacacacacacacacacacacacacacaaaaccacctttcaaaatctattacactggctctttttattctttttatccatgattaatgtcttcagg

SEQ ID NO: 8443 - DNA, 452 bp, Homo sapiens
  AC008690.4_84339
  Located on chromosome 5
  Distance between a terminus base of telomere on chromosomal short arm and 5'-terminus of this base sequence : 52800798
  Distance between 3'-terminus of neighbour sequence of sequence listing upward to telomere on chrosomal short arm and 5'-terminus of this base sequence : 94266
catgtagtggtaaggaatggactagtgccagatggcctgggttataatcccagctctgtctttagctgtgagatcttggacaaatcgctttacttctcagtttcctcatccataaaatggggatgataataatataatatctacttcatagggttgttatgaataaataagttaatgtaagtaaaactgcaaagaaaggtgcctggcacatagtatgtgctaattagagatgatgagagtgttaatgatgatgatgatgatgatgatgatgatgatgttaatggtgatgatgaagatgacaatgattgcagatggaaagggaaggatgactaatcagaagccattatattggcaaatagaaaataatcactgacatcactgatattagcatgagctgtatttgtagagaagacctttgagattactgtttgtccagtacctgattaaatacc

SEQ ID NO: 8444 - DNA, 280 bp, Homo sapiens
  D5S493
  Located on chromosome 5
  Distance between a terminus base of telomere on chromosomal short arm and 5'-terminus of this base sequence : 52858213
  Distance between 3'-terminus of neighbour sequence of sequence listing upward to telomere on chrosomal short arm and 5'-terminus of this base sequence : 56963
agctcctctgttgcttctctggagtggtgtggacactggccacctactgagaagtgtttttttaaaaaatgtgtgtgtgtgtgtgtgtgtgtgtgtatagtatttttaaaaaataaaggtcttagatatcagcttcagagatgtaactgtctttcataatataagtgatgtttgccaggaatattatcctaaatttgttagacatatttctgacatatctgtgatgatagtttgaaaattagtatgtattatttgttgccttttatgccattgtgtcctt

SEQ ID NO: 8445 - DNA, 246 bp, Homo sapiens
  chr5.fa.O7frz.39805752
  Located on chromosome 5
  Distance between a terminus base of telomere on chromosomal short arm and 5'-terminus of this base sequence : 52987828
  Distance between 3'-terminus of neighbour sequence of sequence listing upward to telomere on chrosomal short arm and 5'-terminus of this base sequence : 129335
taatttcagaacatttcttgctttcattgttttaccttcaaatattataatgcttgagggtaaggcaatacacaaacacacacacacacacacacacacacacacacacacccctcctgggctacactaagcaccaggctgtctcctctgactttaacagtgacaccccctcttctacttttggggctggcatcgccctcaacaaccactttgtcaagcccatttcctggtatgacagtgaattag

SEQ ID NO: 8446 - DNA, 440 bp, Homo sapiens
  chr5.fa.O7frz.37223416
  Located on chromosome 5
  Distance between a terminus base of telomere on chromosomal short arm and 5'-terminus of this base sequence : 53269876
  Distance between 3'-terminus of neighbour sequence of sequence listing upward to telomere on chrosomal short arm and 5'-terminus of this base sequence : 281802
atcacgaggtcaggagtttgagaccagcctggccaatatggtgaaagcccgtctttattaaatatacaaaaaaattttagccgggcacggtgacacatgcctataatcccagctactcgggaggctgaggcagaagaatctcttgaaccccagaggcggagtttgcaatgagccgagatcgcgccactacactccagcctaggcaacaagagcaagactccataaaaagaaagaaagaatgaaagaaagaaaggaaagaaagaaagaaagaaagaaagaaagaaagaaagaaagaaagaaagaaagaaagagaaagaaaagaaagaaaaagaaagaaagaaaaagcaggaaggaaggaaggaggaaggaaggcaagtgcacataattcatttatctttccttgatcaatttgtaaagttatcatgtagttaggaaaccaa

SEQ ID NO: 8447 - DNA, 442 bp, Homo sapiens
  AC023884.5_46204
  Located on chromosome 5
  Distance between a terminus base of telomere on chromosomal short arm and 5'-terminus of this base sequence : 53408598
  Distance between 3'-terminus of neighbour sequence of sequence listing upward to telomere on chrosomal short arm and 5'-terminus of this base sequence : 138282
aattccttgaatcagaacagtttaaataactgctgtatacccagcagacagtacataacactggaaaaattaactagcagaagaaaaacaatgttaagaactgtctacagaatttctcttaagaagaaaggcgttctttccaaggaacataaggaagggtgatgataaataataatttgatgtgaggctagagtggtacatgctggacagatagcttaaaatgtcagcccgagggaattggggtgtgtgtgtgtgtgtgtgtgtgtgtgtgtgtaaagcgtttgtcttcattttgaattaggtccaataagtgaatatattcatattgacaatatgcaaagtgtatttaatagacatttcataagaaatcctatattttcaatcaatttatcattgtttttatatgtgattatattcaacacttcattgtttctggtaaatg

SEQ ID NO: 8448 - DNA, 203 bp, Homo sapiens
  chr5.fa.O7frz.37428197
  Located on chromosome 5
  Distance between a terminus base of telomere on chromosomal short arm and 5'-terminus of this base sequence : 53505750
  Distance between 3'-terminus of neighbour sequence of sequence listing upward to telomere on chrosomal short arm and 5'-terminus of this base sequence : 96710
gatttcatacaatccaaatagaaaagtatatgtatacaagtagctagacagatggatagatagatagatagatagatagacagacagacagatagatagatagatagacaacaggctcacatcaacatctacagtaggcacattagaataaaatatctcagcctgttatctaaatagttctactgtagaatcacctggagtac

SEQ ID NO: 8449 - DNA, 150 bp, Homo sapiens
  DISD22_0004728
  Located on chromosome 5
  Distance between a terminus base of telomere on chromosomal short arm and 5'-terminus of this base sequence : 53668790
  Distance between 3'-terminus of neighbour sequence of sequence listing upward to telomere on chrosomal short arm and 5'-terminus of this base sequence : 162837
ctggttgaagttattggtaattatgtacacacacacgcacacacacacacacacacacacatatatatatagagagagagagagcattatatagagatatataatatataattggtactttttattaaatcctgataaaccttcagctcc

SEQ ID NO: 8450 - DNA, 233 bp, Homo sapiens
  chr5.fa.O7frz.50670392
  Located on chromosome 5
  Distance between a terminus base of telomere on chromosomal short arm and 5'-terminus of this base sequence : 53932818
  Distance between 3'-terminus of neighbour sequence of sequence listing upward to telomere on chrosomal short arm and 5'-terminus of this base sequence : 263878
tgatcttgaagactggtgatacctacctcatctttccaaagattaaacacatacacacacacatacacacacacacacacacacacacatacacacacacactataacgttaaacagaaaagttttagtagcattttcccaaattctccagtacatctgtttctttctaattctgtttggggttcggcttcctcggattatttacatagctctacagtccaaataagtgatgg

SEQ ID NO: 8451 - DNA, 140 bp, Homo sapiens
  D5S2086
  Located on chromosome 5
  Distance between a terminus base of telomere on chromosomal short arm and 5'-terminus of this base sequence : 54007847
  Distance between 3'-terminus of neighbour sequence of sequence listing upward to telomere on chrosomal short arm and 5'-terminus of this base sequence : 74796
ttggattcagcctccttaacatgattcttaaaggatgtgccttttgcttgtaaaatgcataacacctctatcttactttcatatgtgaagtacacacacacacacacacacacacatatacacacactgctatctatggt

SEQ ID NO: 8452 - DNA, 364 bp, Homo sapiens
  chr5.fa.O7frz.49963159
  Located on chromosome 5
  Distance between a terminus base of telomere on chromosomal short arm and 5'-terminus of this base sequence : 54222407
  Distance between 3'-terminus of neighbour sequence of sequence listing upward to telomere on chrosomal short arm and 5'-terminus of this base sequence : 214420
gttcaactttccatgaactatagtatagttctctctctctctctctgtctctctctatatatatacccatgaaccaaaaataagttttacaaaatcacttgaagaaaaagatatctatctatctacatatatatggttttatatatatatatatacacacatatatatatatattcatagtattttgcaagtattttgttgaggagttttgtatctgtgttcatcaagcatatttacctgaagttttctttttttgttgtctctgccgggttttggtatcaggatgatgctggcctcatagaatgagttaggaaggagtccctccccaagtttttggaatagtttaagtagaaatgctaccagc

SEQ ID NO: 8453 - DNA, 200 bp, Homo sapiens
  DISO7_10000292
  Located on chromosome 5
  Distance between a terminus base of telomere on chromosomal short arm and 5'-terminus of this base sequence : 54506911
  Distance between 3'-terminus of neighbour sequence of sequence listing upward to telomere on chrosomal short arm and 5'-terminus of this base sequence : 284140
caagatgcctatatcttgatgtctttatatgaaagtgaatgaatatttatctttcctggaaagagacagagagagagggagagggagagagggggagagagagagagagggagggagagagaatatacatattatatatatattatatatatattatatatatatatatatatatattctagtgcttctgcttacattcc

SEQ ID NO: 8454 - DNA, 206 bp, Homo sapiens
  D5S2008
  Located on chromosome 5
  Distance between a terminus base of telomere on chromosomal short arm and 5'-terminus of this base sequence : 54743420
  Distance between 3'-terminus of neighbour sequence of sequence listing upward to telomere on chrosomal short arm and 5'-terminus of this base sequence : 236309
ggtggctcacgcatataattccagcactttgggaggctgaggcaggaggatcacttgagcccctaggagttaaagaccagcctaggcaacaaagacactgtttctacacacacacacacacacacacacacacacacaattataaaatgaaaaaaagttaaaaatagaaaagtaagttgaaaacaaaatgtaaatgggaatcatct

SEQ ID NO: 8455 - DNA, 140 bp, Homo sapiens
  DISO7_10002106
  Located on chromosome 5
  Distance between a terminus base of telomere on chromosomal short arm and 5'-terminus of this base sequence : 54844124
  Distance between 3'-terminus of neighbour sequence of sequence listing upward to telomere on chrosomal short arm and 5'-terminus of this base sequence : 100498
ggatcaagacctcacagaccgtgtgtgtgtgtgtgtatttgtgtgtgtgtgagtcctatttgggccccgcctttcagccctgtcttgcagcccaaactccagccacagctgtggccccgtgcagctcagaggaatcaggt

SEQ ID NO: 8456 - DNA, 102 bp, Homo sapiens
  DISD22_0005997
  Located on chromosome 5
  Distance between a terminus base of telomere on chromosomal short arm and 5'-terminus of this base sequence : 55113651
  Distance between 3'-terminus of neighbour sequence of sequence listing upward to telomere on chrosomal short arm and 5'-terminus of this base sequence : 269387
tctggatgattcaggcacaagggaaaaaaaagacagagagagagagagagagagaggtgagtatggtttaaaaatacctgaattggctgctaggcttgaatt

SEQ ID NO: 8457 - DNA, 391 bp, Homo sapiens
  chr5.fa.O7frz.63711783
  Located on chromosome 5
  Distance between a terminus base of telomere on chromosomal short arm and 5'-terminus of this base sequence : 55255485
  Distance between 3'-terminus of neighbour sequence of sequence listing upward to telomere on chrosomal short arm and 5'-terminus of this base sequence : 141732
agtaagactccaggtgcctattccaaattctcttgccagcactgtaaaatcagaactttcttctccaattatcaccctgccacacacacacacacacacacacacacacacacacacaccacaaattaaaacaagtggggcactgaaaagtctcagagaatgaccactgtccaggtgtctctccacccacccttgactggcttgtgggttccattttgtctagcagccatgccttggtggttactttgacctagatattcagaaaaagagcaggtcagccagtatactttgttgagtgctttcttttcttttttctctggggtgctggatggggattttgagtggtggccataaatggtaagacagaaacttagaattggaccttcaagtt

SEQ ID NO: 8458 - DNA, 257 bp, Homo sapiens
  G08433
  Located on chromosome 5
  Distance between a terminus base of telomere on chromosomal short arm and 5'-terminus of this base sequence : 55285362
  Distance between 3'-terminus of neighbour sequence of sequence listing upward to telomere on chrosomal short arm and 5'-terminus of this base sequence : 29486
agcttgtcatgatgcacgtatgagataatatgcatgacagtgcttttcagactgaaaatgaagtgtcacagagaagacctggagtcattgtttcaacatgtctgtctatctatctatctatctatctatctatctatctatctatctatccatccatgtgtctgtctgtccatccatccatccatcaatccatccatccttccatccatccaatctatctagctacctagctacctgtttttcccccaacttttacc

SEQ ID NO: 8459 - DNA, 458 bp, Homo sapiens
  AC008786.6_161423
  Located on chromosome 5
  Distance between a terminus base of telomere on chromosomal short arm and 5'-terminus of this base sequence : 55299350
  Distance between 3'-terminus of neighbour sequence of sequence listing upward to telomere on chrosomal short arm and 5'-terminus of this base sequence : 13731
cactttcttgacttacggaattactttttttttggccacataatccaccgtagtcaagcaaggtcagacaatagaactttttgtgatgacagaaatacacatacatacacaaagatatgcatatatatgcacagcatatatgtaaatatatgtgtgtgtgtgtgtgtgtgtgtgtgtgtgtgtgtatgctgcctaccagccatgtggctgttgattatttgaaatgtagctattgaaacaaagcatattttaacttttagtttaaatttaaataaccacacatattactctgttgaacaacctgctctaatacatatgatattattgcaggaaacaactagattctagtcagggactctcataggtacatgtgacccagatgccttcagtcagacttagcaccaacatatcaccttttcccttggaggggagagctgaagtagaaagtggacaacttt

SEQ ID NO: 8460 - DNA, 106 bp, Homo sapiens
  AC008786_58507
  Located on chromosome 5
  Distance between a terminus base of telomere on chromosomal short arm and 5'-terminus of this base sequence : 55402396
  Distance between 3'-terminus of neighbour sequence of sequence listing upward to telomere on chrosomal short arm and 5'-terminus of this base sequence : 102588
ggtgacagtgtgagactccatctcaaataataataataataataataataataatgctgaaattaacatgtttgtatatatggatgctacatactgatgctttcct

SEQ ID NO: 8461 - DNA, 382 bp, Homo sapiens
  AC008786.6_24065
  Located on chromosome 5
  Distance between a terminus base of telomere on chromosomal short arm and 5'-terminus of this base sequence : 55436632
  Distance between 3'-terminus of neighbour sequence of sequence listing upward to telomere on chrosomal short arm and 5'-terminus of this base sequence : 34130
gcattctatcacagaatggaagtaaaaagaaagataaaaggcaaaggaaaaataaaataaagggagaaattttgaaaaacatttaggaaaaaattgtactctctggcttctcttatatagaacaccccttaccatagattatcatacagctgaagaatagaagacatatatgagacatctatacatatacacatgtacatatatgccccattcagctgtgtaactgtgtgtgtgtgtgtgtgtgtgtgtgtgtgtgtgtgtaggtgtgggagagatgaggtccagggtgtaaaataatgaaaaaagatatttaaaagtatatattaaaatctatttctactaactatgtactttccttctagcaaacttggtttcttgtaat

SEQ ID NO: 8462 - DNA, 451 bp, Homo sapiens
  AC010391.3_102804
  Located on chromosome 5
  Distance between a terminus base of telomere on chromosomal short arm and 5'-terminus of this base sequence : 55466286
  Distance between 3'-terminus of neighbour sequence of sequence listing upward to telomere on chrosomal short arm and 5'-terminus of this base sequence : 29272
tgctaagaacatctgctctaagctagtgttagactaagattgattgtcacccctttaaaaggaattcctgtttcctttacacacacacacacacacacacacacacacacacacacacaccttatctggcaatcttgagagaagacagagaaatctgagaaactaaagagtgaagtctgaatccacccttgtcactcaccatcttcctcagcagaaaggaaatatattttaggtttcattgaaattataaacaatactatgtctgcagctgtgcttgaaagtctgatgtcaatactactaaatacatgttttcattttgagcaaaacttatcaaatacatacagaaccagattataagatcctattgaaaacagcccacacaaaatatctctattccctttgtcactatgtcacatgtgtttatccttggttatggccgacatagttatct

SEQ ID NO: 8463 - DNA, 113 bp, Homo sapiens
  D5S398
  Located on chromosome 5
  Distance between a terminus base of telomere on chromosomal short arm and 5'-terminus of this base sequence : 55466313
  Distance between 3'-terminus of neighbour sequence of sequence listing upward to telomere on chrosomal short arm and 5'-terminus of this base sequence : -424
gttagactaagattgattgtcacccctttaaaaggaattcctgtttcctttacacacacacacacacacacacacacacacacacacacacaccttatctggcaatcttgaga

SEQ ID NO: 8464 - DNA, 247 bp, Homo sapiens
  DISO7_10001856
  Located on chromosome 5
  Distance between a terminus base of telomere on chromosomal short arm and 5'-terminus of this base sequence : 55517227
  Distance between 3'-terminus of neighbour sequence of sequence listing upward to telomere on chrosomal short arm and 5'-terminus of this base sequence : 50801
tgcaatcagcaagtttgccaaacaggaggaaacatcccatttgtctaactacttaattttcttcaggtttcttctatcttctatcttctaacacacacaccatatatgtatatatgtttgtgtatctctctctctatatatatgtgtgtatatatgtatagtatgtgtatgcgtgtgtgtatgtgtgtatgtgcatgtgtgtgtgtgtgtgtgtgtgtgtgtgtaatatggtggaaagcatggctta

SEQ ID NO: 8465 - DNA, 233 bp, Homo sapiens
  chr5.fa.O7frz.63027145
  Located on chromosome 5
  Distance between a terminus base of telomere on chromosomal short arm and 5'-terminus of this base sequence : 55814565
  Distance between 3'-terminus of neighbour sequence of sequence listing upward to telomere on chrosomal short arm and 5'-terminus of this base sequence : 297091
agaaattcaaatttactgtgacttattattttcagtacttcaaactaaaaagacaaaatttacacacacacacacacacacacactctcagcacatttattattcgactaactcttaaacctatcctccagcttcaatactatgggcttaattaattcctttattgtttcgcccttgatgttaatatattcctaggggtatagctataccaatttcgttagatacctagagcc

SEQ ID NO: 8466 - DNA, 458 bp, Homo sapiens
  chr5.fa.O7frz.64839304
  Located on chromosome 5
  Distance between a terminus base of telomere on chromosomal short arm and 5'-terminus of this base sequence : 55999735
  Distance between 3'-terminus of neighbour sequence of sequence listing upward to telomere on chrosomal short arm and 5'-terminus of this base sequence : 184937
cttcagttgtagaaatgtccagagggtgccctactttcgaaacaggaagtaacttgatccagcagtcccacttcttggtatatatccaaaagaactgaaatctggatcttaaagagatattttcactgcagcatatttgtaatagctaagatacagaggcaacctaaatgtccatcaacagatgaatggacaaaggaaatgtgatatatatatatacacacacacacacacacacacacacacacacacacacacacacatatacaatgaaatattattcagccctaaaaaaggaaggaaatcctgtcatttacaacaagttggatggaactggaggacatcatgctaagtggtataaaccagacacagaaggacaaatactgcatgatctcacttacatgtataatccaaaatagtcacactgatggaagcagaaagtagaatggtagttgccagag

SEQ ID NO: 8467 - DNA, 452 bp, Homo sapiens
  AC026095.3_41930
  Located on chromosome 5
  Distance between a terminus base of telomere on chromosomal short arm and 5'-terminus of this base sequence : 56014400
  Distance between 3'-terminus of neighbour sequence of sequence listing upward to telomere on chrosomal short arm and 5'-terminus of this base sequence : 14207
agatagcactagagctggaagagatggctcatgcctgtaatccctacactttgcatgactgaggccagagaattgcttgaggccaggagtttgagaccagcctgggcaacatagcaggacccatctctacaaattaataataataataataataataataagctgggcataatggtgtgtgcctattgtccttgctacccagaggctgaggcaggaggactggttgagccctggaagttcaaggctgcagtaagctatgattgcattacactctacccagtgtcaaggaaaggaaaggaaaggaggggagaggaggggagaggagaggagaggagaggagaggagaggagaaggggaatgggcaggggcaggggcaaggcaaggaaaggggcaggggcagaggcaagggaaggggaaagggcactaggacctatgagccaacataggctatg

SEQ ID NO: 8468 - DNA, 305 bp, Homo sapiens
  AC026095.3_77421
  Located on chromosome 5
  Distance between a terminus base of telomere on chromosomal short arm and 5'-terminus of this base sequence : 56058028
  Distance between 3'-terminus of neighbour sequence of sequence listing upward to telomere on chrosomal short arm and 5'-terminus of this base sequence : 43176
atcctcagtattcaagatccagcttaaggagcactttttctgggaccaatcattctggtcctctgtattgaatactcgaactcctctacaggacaggaacataatgtattattaccctatcattcattaacacacaacaggcttacattatatggctggttgtattttcagaggtatgtctatatgtttcgctatctatctatctatctatctatctatctatctatctatctatgtgtttgaatacagatacataaaaatctcatttcacctataagaacctctggagcagatacatgtcatac

SEQ ID NO: 8469 - DNA, 209 bp, Homo sapiens
  HUMUT2092
  Located on chromosome 5
  Distance between a terminus base of telomere on chromosomal short arm and 5'-terminus of this base sequence : 56058179
  Distance between 3'-terminus of neighbour sequence of sequence listing upward to telomere on chrosomal short arm and 5'-terminus of this base sequence : -154
atggctggttgtattttcagaggtatgtctatatgtttcgctatctatctatctatctatctatctatctatctatctatctatgtgtttgaatacagatacataaaaatctcatttcacctataagaacctctggagcagatacatgtcatacaataattgggctaaaacaaaaatccctcagtgaaaacctaaagactgggttgtgg

SEQ ID NO: 8470 - DNA, 297 bp, Homo sapiens
  HUMUT5438
  Located on chromosome 5
  Distance between a terminus base of telomere on chromosomal short arm and 5'-terminus of this base sequence : 56143131
  Distance between 3'-terminus of neighbour sequence of sequence listing upward to telomere on chrosomal short arm and 5'-terminus of this base sequence : 84743
gctccctccattttgtccccacttagaaatgcacagttgtggttacatttataaaggggcaactgtgactctgctatcttctgtttatctatctatctatctatctatctatctgtcatctatctatctgtcatctatctatctatctacctatctacctacctatctatctatttatctatcatcgggagtagatggacacacacacagtctccttcctgtttaagtatctcagtctattgtcagagacactccacaactgagttctgaacacagtgaagaacagcagtttcaggc

SEQ ID NO: 8471 - DNA, 174 bp, Homo sapiens
  D5S2107
  Located on chromosome 5
  Distance between a terminus base of telomere on chromosomal short arm and 5'-terminus of this base sequence : 56176248
  Distance between 3'-terminus of neighbour sequence of sequence listing upward to telomere on chrosomal short arm and 5'-terminus of this base sequence : 32820
caaaccaacaggagtatgtactttttaaaagtcttgttcttttaaatataaatttagttaggccattgataaaaatgacctgcatttatttatgtatttagactattgatagatgatggtatagtgtgtgtgtgtgtgtgtgtgtgtgtgtgtgtgtgtgttggccaaaaggct

SEQ ID NO: 8472 - DNA, 238 bp, Homo sapiens
  D5S2028
  Located on chromosome 5
  Distance between a terminus base of telomere on chromosomal short arm and 5'-terminus of this base sequence : 56356840
  Distance between 3'-terminus of neighbour sequence of sequence listing upward to telomere on chrosomal short arm and 5'-terminus of this base sequence : 180418
aaatccttgggtcaaaccctataaaatgtatgatgtctttttagttgtagtttctataaaatgggaacagtcaagcctactttaagagattgtcataaatgaggattgaaaattgtatgtgtgtgtgtgtgtgtgtgtgtgtgtgtgtgtgtgtgtgtataactagttcgttgagaagaagaaagaaaccgctccccactttccccctacagtttccaaattggaccaggcttgatgg

SEQ ID NO: 8473 - DNA, 100 bp, Homo sapiens
  D5S468
  Located on chromosome 5
  Distance between a terminus base of telomere on chromosomal short arm and 5'-terminus of this base sequence : 56560324
  Distance between 3'-terminus of neighbour sequence of sequence listing upward to telomere on chrosomal short arm and 5'-terminus of this base sequence : 203246
tgggaaaataaatacatgcgtgtgtgtgtgtgtgtgtgtgtgtgtgtgtgtgtgttaatcaagagtgacagtgcactcaggttaaatctaccattcattt

SEQ ID NO: 8474 - DNA, 226 bp, Homo sapiens
  D5S2000
  Located on chromosome 5
  Distance between a terminus base of telomere on chromosomal short arm and 5'-terminus of this base sequence : 56663916
  Distance between 3'-terminus of neighbour sequence of sequence listing upward to telomere on chrosomal short arm and 5'-terminus of this base sequence : 103492
catgctaatttcaaatatgagagagtacatatatatgtgtgtgtgtgtgtgtgtgtgtgtgtgtgtgtgttttcccaagacctttctccttccctatttaaaacaataacattttgtcaagggaaaataaacaaaataaaatagtttgaggttgacccaaaactctgaatatttgaattctaatttgattctaaagtcagaaaaaaagtctactctcctggtataa

SEQ ID NO: 8475 - DNA, 233 bp, Homo sapiens
  D5S2091
  Located on chromosome 5
  Distance between a terminus base of telomere on chromosomal short arm and 5'-terminus of this base sequence : 56671754
  Distance between 3'-terminus of neighbour sequence of sequence listing upward to telomere on chrosomal short arm and 5'-terminus of this base sequence : 7612
gcatttgtcatgtgccaggtcctgtgagaggaggtaattttacacctaaccatcttccacctttttttagcactattctttattcttggcaactctttgagaaatatctatggaatgaatggacacattattattctgctgtctcatatgttaatacagaaacagaaatacacacacacacacacacacacacacacacacacacactccagactggctgtgaatgaaatacc

SEQ ID NO: 8476 - DNA, 454 bp, Homo sapiens
  AC008791.4_73076
  Located on chromosome 5
  Distance between a terminus base of telomere on chromosomal short arm and 5'-terminus of this base sequence : 56731179
  Distance between 3'-terminus of neighbour sequence of sequence listing upward to telomere on chrosomal short arm and 5'-terminus of this base sequence : 59192
attacgtgacttctaagagctttaaatatactaattggaatgtgactattctagaaggtggagagcatttgcagagtaattagaccattcccctgtagacggcagttaatatcagagtaagccatgttttagaatatgacttgggcctgggcatggtggctcatgtctgcaatcccaggatttctgggaggctgaggtgggaggatagcttgagcccaggtactccagcctggggcacaaagcaggaccttgtcaagaaagaaagaaagaaaaagaaaagaagggcagggcagcgcaggaggaagggagggagggagggagggagggaaagaaagagaaagagaaaagacaaaaagaaatatgccatgggaattgctgcacaaagcatcttaatctaagttttatactaatcacagggcttctattactcctacaagaattcctttaccttagc

SEQ ID NO: 8477 - DNA, 238 bp, Homo sapiens
  AC008791.4_87828
  Located on chromosome 5
  Distance between a terminus base of telomere on chromosomal short arm and 5'-terminus of this base sequence : 56746146
  Distance between 3'-terminus of neighbour sequence of sequence listing upward to telomere on chrosomal short arm and 5'-terminus of this base sequence : 14513
aacgttcaaggttacagtgacctatggtcatgccactgcactccagcctgggcaacacagactctgtttctaatacatatattagagactatctatctatctatctatctatctatctatctatctatctattttgatcccatgggggagatcactcctttaataatgcaagagagtgaataagatgggggagggtggcgtgcaattgagagatgagctttatactggaataccaagt

SEQ ID NO: 8478 - DNA, 444 bp, Homo sapiens
  AC008791.4_89527
  Located on chromosome 5
  Distance between a terminus base of telomere on chromosomal short arm and 5'-terminus of this base sequence : 56747735
  Distance between 3'-terminus of neighbour sequence of sequence listing upward to telomere on chrosomal short arm and 5'-terminus of this base sequence : 1351
gcaaagtaacgtttactgataaaccaaatgatgtgccataattatgttttatttatggaacaactttttgttttttctggagttatatattaccttctttatttgattatgtgacattatcaccaatttttctagacgtctccaaaacataattttttaaattttaaatttctgttggtacataataggtaggtaggtagacagacagacagacagacagacagacagacagatagatagatagattgattgatttatggggcccacgagatattttcatacaggcaagcaatgcataataatatcagggtaaacagggaatctattactgcaaacatttaccctttaagttacaaacaattcaattatattctcttagttattttgagatgtatgataaactactgttgactgtagtcaccctgttgagctatcaaataccag

SEQ ID NO: 8479 - DNA, 369 bp, Homo sapiens
  AC008791.4_113677
  Located on chromosome 5
  Distance between a terminus base of telomere on chromosomal short arm and 5'-terminus of this base sequence : 56771955
  Distance between 3'-terminus of neighbour sequence of sequence listing upward to telomere on chrosomal short arm and 5'-terminus of this base sequence : 23776
taaagtcagtgctacatgcagtttctacagggaaacaaggaaagggaatttaattgatccaaatgaataacagaagcaaaaatcttgccaaagactccatactgtggcatacagggaagtgattttatacacacacacacacacacacacacacacacacacacacacacacacgcccctatgccaaaatatgtaccatgcattttctaatcatttatttattaaacaaacatttattatttaacctgttctgggctctatgctggacactggggaagtaacaacaaccaagacgtgatccacacactcaaaaactttacagtccaattgggtgaggatgggttagaagagccagattaaatctgattt

SEQ ID NO: 8480 - DNA, 181 bp, Homo sapiens
  D5S431
  Located on chromosome 5
  Distance between a terminus base of telomere on chromosomal short arm and 5'-terminus of this base sequence : 56849719
  Distance between 3'-terminus of neighbour sequence of sequence listing upward to telomere on chrosomal short arm and 5'-terminus of this base sequence : 77395
tactttcatactttcttggtaggggtatatgtgtgtgtgtgtgtgtgtgtgtgtgtgtgtgtgtgtgcgtgcgcgtgtgtttgtgtatgtgtgtgtgtgaaagtgagagagagagaagtgtagggctgctcattagtcttaacatttgaaccatattttgggtggaggcttatctgaatcc

SEQ ID NO: 8481 - DNA, 373 bp, Homo sapiens
  chr5.fa.O7frz.65382258
  Located on chromosome 5
  Distance between a terminus base of telomere on chromosomal short arm and 5'-terminus of this base sequence : 56954052
  Distance between 3'-terminus of neighbour sequence of sequence listing upward to telomere on chrosomal short arm and 5'-terminus of this base sequence : 104152
aagttaggcatggtaaccttactttggcaaataaaatgtgagcagcatgagaaacacgtatatctctctaatttgtatatgtacacacacacacacacacacacacacacacacacacatatatatatgtagttaatttgaatatcactatgatttgatgaaacaagacaaaaaagaaaaaagatatgtgagcagaagcaatacgtgtcacttctgggggaaaccactgaggtctgtgtatgaagtgccctgtcttctgccacaatgactgggaactttcccgactgtggtgtctcccattaactgtgttcctaagtgaagagcagaaccctctccctccaccacaaacctgtcatgaacatgtagcttgagt

SEQ ID NO: 8482 - DNA, 259 bp, Homo sapiens
  D5S2080
  Located on chromosome 5
  Distance between a terminus base of telomere on chromosomal short arm and 5'-terminus of this base sequence : 57077174
  Distance between 3'-terminus of neighbour sequence of sequence listing upward to telomere on chrosomal short arm and 5'-terminus of this base sequence : 122749
gcactgtgaatttcaaatgtcaggagacattcacacacacacacacacacacacacacacacactcactcacgcacagagagaaaggaagagaaaacaaagagacagaatttcctccctaccaaaggggctttgttttgatcagcaagtttttttttggctcattgaactaaattcacaaattaacaaaactccactatgaagatctgatggaagaaggaatggaaaactcttgaccttttggatcccagtcccctgac

SEQ ID NO: 8483 - DNA, 338 bp, Homo sapiens
  chr5.fa.O7frz.65586042
  Located on chromosome 5
  Distance between a terminus base of telomere on chromosomal short arm and 5'-terminus of this base sequence : 57158015
  Distance between 3'-terminus of neighbour sequence of sequence listing upward to telomere on chrosomal short arm and 5'-terminus of this base sequence : 80582
ggcaaagattactaaccaagtcaagtttacattggctcaagcctctcctacatgaatgccaccaataattgttgctgtctctttattacacgtctttgaggcactgactgcctccataaaactggagaaggcatatgtgtatatatactatatataatgattacccaccagtaccagctttaatgttttcctctccacctaatttctttttgctgttcaattttcacaagcatacacttgtacacacacacacacacacacacacacacacacacacatatgcctgtcattggttacctttcccccggggaattaaaatccgtatgattcaataaggt

SEQ ID NO: 8484 - DNA, 116 bp, Homo sapiens
  D5S2018
  Located on chromosome 5
  Distance between a terminus base of telomere on chromosomal short arm and 5'-terminus of this base sequence : 57217027
  Distance between 3'-terminus of neighbour sequence of sequence listing upward to telomere on chrosomal short arm and 5'-terminus of this base sequence : 58674
cctgtaaacaatgcaaaaccactgatggattcacaacagaagagttacacacacacacacacacacacacacacacacacacacaagagcacacaggcacacacacagcatagtct

SEQ ID NO: 8485 - DNA, 257 bp, Homo sapiens
  D5S2071
  Located on chromosome 5
  Distance between a terminus base of telomere on chromosomal short arm and 5'-terminus of this base sequence : 57259596
  Distance between 3'-terminus of neighbour sequence of sequence listing upward to telomere on chrosomal short arm and 5'-terminus of this base sequence : 42453
taactggcttggcccggcgtggaagaagtaggtaggagaaggggaagtatagttaaggcttggttataatttactgataggggtgtgtgtgtgtgtgtgtgtgtgtgtgtgtgtgtgtgtgtgtgtgtatgtgtgtaaaaggaaagaaaggaaaagaaattgaagatgtttggtcttagcaacccaaattatagtgcttctattgagtgaagtggggtttctggggaaggagcaggtttgaaggttgtaaatccaga

SEQ ID NO: 8486 - DNA, 346 bp, Homo sapiens
  AC008934.4_107347
  Located on chromosome 5
  Distance between a terminus base of telomere on chromosomal short arm and 5'-terminus of this base sequence : 57410350
  Distance between 3'-terminus of neighbour sequence of sequence listing upward to telomere on chrosomal short arm and 5'-terminus of this base sequence : 150497
atcactttgcttgttaaatcttactgaaataacatagaatgtcacagtggatgagaaacaataagtaaggcaatattaccactttaaaaatccatacttcaggctgataaagacattatatgtatatgtgtgtataaatacatataactatgtgtgtatgtatgtgtgtgtatatatatatgtatgaataagctctacacatataatcacatagattagatagatacatggatggatggatggatggatggatggatggatggatggctagataatacttaggatgcctcacaacagttcctaaaagccattatatagaaaaaaacggacagtattcagtagattg

SEQ ID NO: 8487 - DNA, 379 bp, Homo sapiens
  AC008934.4_103732
  Located on chromosome 5
  Distance between a terminus base of telomere on chromosomal short arm and 5'-terminus of this base sequence : 57413935
  Distance between 3'-terminus of neighbour sequence of sequence listing upward to telomere on chrosomal short arm and 5'-terminus of this base sequence : 3239
aagttgaggtttacttatgctgactgtcatgcttccgcttttgttccagttactctacttcacacttgagggtttgatgaagtttttctcaggaatcccatgcacttgcttttcttgaatgcttttcaatttgtgcctgggtttttaagctgatggtttctttcctcagcttggtcctccaggcactatatatggcagatatacgtcacagtttttgacctctgcatggaaacctttcctgtttttcaggatggatgtaggttgtgtgtgtgtgtgtgtgtgtgtgtgtgtgtgtgtttactgagaatctgcaataaataaataaataaaacatgtgggctcaaatggccattcagaattgaaattccacctcttactt

SEQ ID NO: 8488 - DNA, 247 bp, Homo sapiens
  AC008934.4_78678
  Located on chromosome 5
  Distance between a terminus base of telomere on chromosomal short arm and 5'-terminus of this base sequence : 57439105
  Distance between 3'-terminus of neighbour sequence of sequence listing upward to telomere on chrosomal short arm and 5'-terminus of this base sequence : 24791
atcttcaagacatttggaacagtggctgtcaactccagcggcacattagaatcacctgcagagctttaaagaacgccattgcctgagtcctaacctgagttctggtataaatgacctaggagcagcttgggaattgtgtgtgtgtgtgtgtgtgtgtgtgtgtgtgtgtgtgtgtgtgtgtatgtgtgtgtgttttggggagggggcggttaagctcgctagatgattttaatgcgaaaccatggtt

SEQ ID NO: 8489 - DNA, 249 bp, Homo sapiens
  AC008934.4_50028
  Located on chromosome 5
  Distance between a terminus base of telomere on chromosomal short arm and 5'-terminus of this base sequence : 57467879
  Distance between 3'-terminus of neighbour sequence of sequence listing upward to telomere on chrosomal short arm and 5'-terminus of this base sequence : 28527
accttatgccaagtacttcaatacacacacacacacacacacacacacacacacacaaatatgcaaaatatttgaacgtattcagacttctgtgggcaatacaataaacaaaaccatctccccacataacaatgggacatttagagcccttcccagtatttctgggaaatacctccaaagggacaggtgcttcaccaaccctaattatttgtcacagcttcctctgcacagttgttccaattccacagc

SEQ ID NO: 8490 - DNA, 232 bp, Homo sapiens
  DISO7_10001857
  Located on chromosome 5
  Distance between a terminus base of telomere on chromosomal short arm and 5'-terminus of this base sequence : 57629366
  Distance between 3'-terminus of neighbour sequence of sequence listing upward to telomere on chrosomal short arm and 5'-terminus of this base sequence : 161238
ggacaactaactaaagtggtgtgattttggtataagtttgtgtgtgtgtgtgtgtgtgtgttgtgtgtgtgtgtatgtgtatacatttagttttattgtaacaaagcaacttgtacttttcacgtttaaaactgagcatcatctttcctttacagtgaaacaaaaagaaaacttaaaaataagcaggaacaaaattacaatagagaaagtcaattccaaataagatcctaca

SEQ ID NO: 8491 - DNA, 170 bp, Homo sapiens
  DISO7_10001859
  Located on chromosome 5
  Distance between a terminus base of telomere on chromosomal short arm and 5'-terminus of this base sequence : 57774183
  Distance between 3'-terminus of neighbour sequence of sequence listing upward to telomere on chrosomal short arm and 5'-terminus of this base sequence : 144585
ttcctgttaagagactgcagagagatgcttatctgagcaatttttaaacctccttttacacgattttaaatatacatatatatatatatatatatacacacacatacacacatataaatatatgaaaacaaattttgaaaatcattatcaccatgacttgaatcatgtag

SEQ ID NO: 8492 - DNA, 446 bp, Homo sapiens
  chr5.fa.O7frz.65816125
  Located on chromosome 5
  Distance between a terminus base of telomere on chromosomal short arm and 5'-terminus of this base sequence : 57913867
  Distance between 3'-terminus of neighbour sequence of sequence listing upward to telomere on chrosomal short arm and 5'-terminus of this base sequence : 139514
acctaagagtggatcctaatgtttacataaatatattcctgtattgaggttcttcctttctccccaattaccaaattctttctttctttttctttctctttttctttctttctttccttctttctttctttctttctttctttctttctttctttctttctttctttctttctttcttctttctttctttctttcttctttaagttttgggatacatatacagaacatgcaggtttcttacacagtatatgtgtgtcacgatgatttgctgcacctatcaacccatcacctgggttttaagccctgcatgcattagctatttgtcttgatgctctccctcccctcgtgcccccatgacccaacaggccctggtgtgtgttgttcccctccctgtgtccatgtgttcccattgttcaactcccacttatgagtaagatggatttctg

SEQ ID NO: 8493 - DNA, 425 bp, Homo sapiens
  chr5.fa.O7frz.66742194
  Located on chromosome 5
  Distance between a terminus base of telomere on chromosomal short arm and 5'-terminus of this base sequence : 58164066
  Distance between 3'-terminus of neighbour sequence of sequence listing upward to telomere on chrosomal short arm and 5'-terminus of this base sequence : 249753
tgtctttcatccaaatgtttactgaatttcctgtctttttgggttgtcaatttgactattaaattaggttatttagtgagagtttattaaaagacatcttgtcattgggggttagctgactcctcttccctactctgtctctagaagcctttaacttgcctttgataactaccaaaaatagccctgggaaaacacacacacacacacacacacacacacacacacacgtctgtaggtggataagccacatgagggccatgcttcctaatcctactatggaagcccagtgtgtaacctattaaaaattttaatttcagttgaaaactcaacagaaaagcaaaattatacttcatcataaattatttttgtatggtaagcaaagaaacaaaaataaatgaaaatcataatcagttgcatacaaatta

SEQ ID NO: 8494 - DNA, 266 bp, Homo sapiens
  AC008498.3_200284
  Located on chromosome 5
  Distance between a terminus base of telomere on chromosomal short arm and 5'-terminus of this base sequence : 58315954
  Distance between 3'-terminus of neighbour sequence of sequence listing upward to telomere on chrosomal short arm and 5'-terminus of this base sequence : 151463
caaggacagttgctcaaattagtaaaatataataccagaaagactaaatctcagaaagagatgagatatgtaaaagtctcaaatgacacaaaatagctgtctgcttttatatgtgaattcatgtatgtgtacatatttgggtttttttaggtaggcaaatatatgtgtgtgtgtgtgtgtgtgtgtgtgtgtgtgtaacaaatatgttctcttttgttaacattcctctgtctaaatatgaatattaaatatccacgtggagctaa

SEQ ID NO: 8495 - DNA, 244 bp, Homo sapiens
  AC008498.3_128132
  Located on chromosome 5
  Distance between a terminus base of telomere on chromosomal short arm and 5'-terminus of this base sequence : 58388083
  Distance between 3'-terminus of neighbour sequence of sequence listing upward to telomere on chrosomal short arm and 5'-terminus of this base sequence : 71863
ttatggctgaatagcacttcactgtgtgtatatatcacattttctttatcagttgatctgttggtggacatttaggttgcttccaagtctgcactatcctgaatggtgctgcagtaaacatgggagtacaggtatctcttcgatattctgatttcctttcctttggataaatatacacacacacacacacacacacacacacacacacacacacacacatatatgcctagcagtagaattgcta

SEQ ID NO: 8496 - DNA, 150 bp, Homo sapiens
  D5S624
  Located on chromosome 5
  Distance between a terminus base of telomere on chromosomal short arm and 5'-terminus of this base sequence : 58435195
  Distance between 3'-terminus of neighbour sequence of sequence listing upward to telomere on chrosomal short arm and 5'-terminus of this base sequence : 46868
atttgctgaacgaatgacccaaatgtgtgtgtgtgtgtgtgtgtgtgtgtgtgtgtgtgtgtgattacaaatgcttttcttttgtatttttttattattatactttaagttctagggtacatgtgcacaacatgcaggtttgttacatag

SEQ ID NO: 8497 - DNA, 279 bp, Homo sapiens
  AC008498.3_11236
  Located on chromosome 5
  Distance between a terminus base of telomere on chromosomal short arm and 5'-terminus of this base sequence : 58504973
  Distance between 3'-terminus of neighbour sequence of sequence listing upward to telomere on chrosomal short arm and 5'-terminus of this base sequence : 69628
atggatacatgaccatagaatcaccatatgatccagaaatttcacttctgggtatatatccaaaagaattaaaagcaggggcttaaataaatatttgtatacatcatgttcacagaagcattattcaaattgccaaaaagtggaaacagcccaaatgtccatgtatagatggataaaccaaatcacacacacacacacacacacacacacacacacacacacacatgaatatcattcagcttttaaaaggagtgatagtctgatacatgctacagcatg

SEQ ID NO: 8498 - DNA, 363 bp, Homo sapiens
  AC008836.4_159021
  Located on chromosome 5
  Distance between a terminus base of telomere on chromosomal short arm and 5'-terminus of this base sequence : 58700787
  Distance between 3'-terminus of neighbour sequence of sequence listing upward to telomere on chrosomal short arm and 5'-terminus of this base sequence : 195535
ccagtctagacaatgtcctcagctttattattattattattattattattatcattatcattattattttgagacagagtcgctgtgtcgcctaggctggagttcagtagtgcgatcacggctcaccacaatctctgcctcccaggttccagtaattctcctaccttagcctcctgggtagctgggactacaggcgctggttgccacacctggctaattttttgtatttttagtagagatggggtttcactacgttaaccaggctggtctcgaactcctgacctcgtgatatgcccacctcagcctcccaaagtgctaggattacagacatgagccaccgtacctagccagcttattgttaaa

SEQ ID NO: 8499 - DNA, 448 bp, Homo sapiens
  chr5.fa.O7frz.67540565
  Located on chromosome 5
  Distance between a terminus base of telomere on chromosomal short arm and 5'-terminus of this base sequence : 58768642
  Distance between 3'-terminus of neighbour sequence of sequence listing upward to telomere on chrosomal short arm and 5'-terminus of this base sequence : 67492
tgaaggataatctatgactgaaagattctctttctttctttcccttccttcgttcctttgttccttccttccttccttcctccctccctccccccttctctttctctttctttctctctttctttctcttccttccttccttccttccttccttccttccttccttccttccttccttccttcctttctttctttctttctttctttcttttctttctttttctttcctttgacggattttcactcttgttgctcagaggctggagtgcaatagcgccatcttagctcaccacaacctccacctcccgggttcaagtgattctcctgcctcagcttcccaagtacctgggattacaggcatgtgccaccacacccggctaattttgtctttttagtagagacgggtttctccatgttggccaggctggtctcaaactcgtgacctcag

SEQ ID NO: 8500 - DNA, 219 bp, Homo sapiens
  D5S1990
  Located on chromosome 5
  Distance between a terminus base of telomere on chromosomal short arm and 5'-terminus of this base sequence : 58879956
  Distance between 3'-terminus of neighbour sequence of sequence listing upward to telomere on chrosomal short arm and 5'-terminus of this base sequence : 110866
caaggatggaagtgggcctggcaatatctgggctagaagtcatatttcctcattttcttttgaacatggaacccttttcccgaaaggctttgttctcttcaaagcacagtttcccagtgtctgtcctgcagggacactttcatcacacacacacacacacacacacacacgtatctataaaattgatttaatttcttcctgggttctcatttaccaaaa

SEQ ID NO: 8501 - DNA, 417 bp, Homo sapiens
  chr5.fa.O7frz.67842539
  Located on chromosome 5
  Distance between a terminus base of telomere on chromosomal short arm and 5'-terminus of this base sequence : 59048777
  Distance between 3'-terminus of neighbour sequence of sequence listing upward to telomere on chrosomal short arm and 5'-terminus of this base sequence : 168602
tggtgactgagcctattagagtctttaaaaatactgtttgtagaaactacaaattgcaaaacagaagctgctgaaagcaaaacccttcccctcttttccctaaaaaagaaggaaggaaggaaggaaggaaggaagggagagagggagggagggagggagggagggaatgaatgaatgaaggaaggaaggaaggaaggaaggaaggaaggaaggaaggaacgaaagaaaggaaacaagaacattaagaatgtagtcaactgtgtaagtaatggcccctctcataactctagatcatttttctccctatcaaaggtactaaattatgtgaaaagccatctcatctactatatacaaaggaagagggagcataaaacaaaagagaagatcatactagtagttcaaattccttaagtgatg

SEQ ID NO: 8502 - DNA, 424 bp, Homo sapiens
  chr5.fa.O7frz.67945855
  Located on chromosome 5
  Distance between a terminus base of telomere on chromosomal short arm and 5'-terminus of this base sequence : 59151951
  Distance between 3'-terminus of neighbour sequence of sequence listing upward to telomere on chrosomal short arm and 5'-terminus of this base sequence : 102757
ccactctaaccagttcaagttaaaaaataaaaacaggctgggcacggtggctcacgcctgtaatcccagcactttgggaggccgaggcaggcggatcacgaggtcaagagatcaagaccatcctggctaacatggtgaaaccccatctctactaaaaatacaaaaaattagtcaggtgtggtggcgggcgcctgtagtcccagctactcgggaggctgaggcaggagaatggcgtgaacccgggaggcggagctggcagtgagccgccatcgcgccactgcactccagcttgggtgacggagcgagactccatctcaataaataaataaataaataaataaataaataaataaataaataaataaaataaaataacaatcccaaaaagatgagtcagttattgttagacctcatctgacaatca

SEQ ID NO: 8503 - DNA, 250 bp, Homo sapiens
  D5S1474
  Located on chromosome 5
  Distance between a terminus base of telomere on chromosomal short arm and 5'-terminus of this base sequence : 59229683
  Distance between 3'-terminus of neighbour sequence of sequence listing upward to telomere on chrosomal short arm and 5'-terminus of this base sequence : 77308
gaaccaatcctgcacatttcttcccagtccctcattcagtgataccacgttggtagctcaaaacaggacacggtggttgtgctaccaccacggaaatcagtaaataccattcataaagcctccctccctcctttccttctttccttccttccttccttccttccttccttccttccttccgtctttccttccttccttccttccctcctccaagctggttataaaacatttaccagtggctaggcacagt

SEQ ID NO: 8504 - DNA, 182 bp, Homo sapiens
  Z67264
  Located on chromosome 5
  Distance between a terminus base of telomere on chromosomal short arm and 5'-terminus of this base sequence : 59277444
  Distance between 3'-terminus of neighbour sequence of sequence listing upward to telomere on chrosomal short arm and 5'-terminus of this base sequence : 47511
attatcctggtcccaaagatggggatatgacactaaaaactgccaatgcagagagcagtgtactacttatcgtgtgtgtgtgtgtgtgtgtgtgtgtgtgtgtgtatgcagaggaaggcagcacaataatgataacaatcactgagatccattttaaaaggcacagccacagtctcaggtga

SEQ ID NO: 8505 - DNA, 372 bp, Homo sapiens
  chr5.fa.O7frz.68332938
  Located on chromosome 5
  Distance between a terminus base of telomere on chromosomal short arm and 5'-terminus of this base sequence : 59420798
  Distance between 3'-terminus of neighbour sequence of sequence listing upward to telomere on chrosomal short arm and 5'-terminus of this base sequence : 143172
atgtaattgcatgctgaagtattcaatcgtgccttctctcactcttatttgcaccaggcaagggttgtggtttcttgttgttgttgttgttgttgttgttgttgttgttgttgttgttaatggtacgtatcacttattgaaattgttgaaatgttgtcaagacggaaataatcatgtgatctctcctataatgtagttgtttctgttgagaaaactgcagaaagatctaaaattgtctcctaacttatttttcaaaaaaaaaaatgtatgcacttctcttttcttttgtcctctactgaaatacacttgctaagaaatcacattaggcatatcctgccagcttcgtttctcctatagatttgcaatacagac

SEQ ID NO: 8506 - DNA, 290 bp, Homo sapiens
  AC008820.4_103352
  Located on chromosome 5
  Distance between a terminus base of telomere on chromosomal short arm and 5'-terminus of this base sequence : 59514903
  Distance between 3'-terminus of neighbour sequence of sequence listing upward to telomere on chrosomal short arm and 5'-terminus of this base sequence : 93733
gcacattaacctgaaatgatagtagtaaccctttagttggcaatctgggtagcttaaatataagcacaaatttgaattgctgatgtaacagttagcaaagagcatgtcagtatatcaagtgcagatgatagatagatagatagatagatagatagatagatagatagatagatagatagatcagacatttagcttcacaaggtttttgtaatgactaattaatgtgaatttgaaatatataaagtttttcttcttgggaaggaaatgtggagtactataaccttgttcag

SEQ ID NO: 8507 - DNA, 355 bp, Homo sapiens
  AC008820.4_45222
  Located on chromosome 5
  Distance between a terminus base of telomere on chromosomal short arm and 5'-terminus of this base sequence : 59518070
  Distance between 3'-terminus of neighbour sequence of sequence listing upward to telomere on chrosomal short arm and 5'-terminus of this base sequence : 2877
agattatcctggattatccaagtggaacctaaatgccaccacaagagtcctcataagagaaacacagaggaagatttggcacagactcacagatgaagacaaagattgaagtgatggggccacagccaagaaagtcaaggaatgccaatagcctccaaaatctgaaagagacaagtaaggattctctgagacacacacagagagagagagagatactgattgattgattgattgattgattgattgattttaaggaactggctcatgtaattgtgggagctggcaaatcttaaatctgcaggataggccagcaggctggagacccagggagaagtcagtgttgcagtcttaagtc

SEQ ID NO: 8508 - DNA, 384 bp, Homo sapiens
  chr5.fa.O7frz.68778648
  Located on chromosome 5
  Distance between a terminus base of telomere on chromosomal short arm and 5'-terminus of this base sequence : 59671138
  Distance between 3'-terminus of neighbour sequence of sequence listing upward to telomere on chrosomal short arm and 5'-terminus of this base sequence : 152713
gcagtgagctgagattgtatcactgcactccagcctgggtgacagagcaagactcacatacatacatacatacatacatacatacatacatacggcatgcagacctgtaccctgctgcaccactcccgtatgttttttataccaagtttttcttcttaaaccccttcactcagcccgaaaaaactgaaatggttcctttgaggcttgagctgggctattttcccatttactaacacttaagtaaaagctgctttccttttaccacaccgtactttgactgctgagtggcaaacggccaaacttgatttgggtactttatttatcctggtgtggtacctctgctctttgagcaagctgttgtggacgtgatagaggctcactatt

SEQ ID NO: 8509 - DNA, 324 bp, Homo sapiens
  chr5.fa.O7frz.69057735
  Located on chromosome 5
  Distance between a terminus base of telomere on chromosomal short arm and 5'-terminus of this base sequence : 59898289
  Distance between 3'-terminus of neighbour sequence of sequence listing upward to telomere on chrosomal short arm and 5'-terminus of this base sequence : 226767
tatcttgacaaagcctagtgaggaagggctggaaaggggaatgaatgagtggcagcttcccgcttgaaatttcacatagagggtttctgcttggcattcctcctatagagctcacattttcaccaggggagacaatcacttaaaaatgtagacacacacacacacacacacacacacacacactgttgctaggaagaaaatctgagctgtgtatagggactgagaaggtgatgccggggatgctgtttgagaagggtggtcttagaaagcgctctcttaaggtgatatttaagcagagacctgagtggaaatggagctaaatac

SEQ ID NO: 8510 - DNA, 109 bp, Homo sapiens
  DISO7_10000293
  Located on chromosome 5
  Distance between a terminus base of telomere on chromosomal short arm and 5'-terminus of this base sequence : 59904518
  Distance between 3'-terminus of neighbour sequence of sequence listing upward to telomere on chrosomal short arm and 5'-terminus of this base sequence : 5905
agctcagggtaacttaaggatccctgtggggactgtgtgtgtgtgtgtgtgtgtatgtgtgtgtgtgtgtgtgtgtgtgtgtgtgtgtctgcatgcatgcacaatttac

SEQ ID NO: 8511 - DNA, 108 bp, Homo sapiens
  DISO7_10000297
  Located on chromosome 5
  Distance between a terminus base of telomere on chromosomal short arm and 5'-terminus of this base sequence : 60132022
  Distance between 3'-terminus of neighbour sequence of sequence listing upward to telomere on chrosomal short arm and 5'-terminus of this base sequence : 227395
gcctgaagtgagatccttgtaatgtaaaataataaataaataaataaataaataaataaataaatataatgaaaagtcaccatcatcttccccaatgtgatcaacagg

SEQ ID NO: 8512 - DNA, 101 bp, Homo sapiens
  DISO7_10000027
  Located on chromosome 5
  Distance between a terminus base of telomere on chromosomal short arm and 5'-terminus of this base sequence : 60305206
  Distance between 3'-terminus of neighbour sequence of sequence listing upward to telomere on chrosomal short arm and 5'-terminus of this base sequence : 173076
tactttgccttcaccaacacacatacacgtaggtgcgcacgtgcacgcacacacacacacacacacacacacacaatccttcagcagtactgaattagttg

SEQ ID NO: 8513 - DNA, 400 bp, Homo sapiens
  chr5.fa.O7frz.69676132
  Located on chromosome 5
  Distance between a terminus base of telomere on chromosomal short arm and 5'-terminus of this base sequence : 60435437
  Distance between 3'-terminus of neighbour sequence of sequence listing upward to telomere on chrosomal short arm and 5'-terminus of this base sequence : 130130
ttaaggctcaaatgatcattagtatttttagcaatttatttagcaatttagcaaagtattttttaattacagtatatacgtttttaagagttgatcctattgcacacctaatagtctacagtgtaaacatgacttttatttgtactgggaaaacaaaaatattgtgtgactttattgcaatattcacttttattgctgtggtctggaactgaatccacaatatcttcaaggtctacctatacacacacacacacacacacacacacacacagagagagagagagagagagtgagtgagacatagagagagagagaagaaaatgtaatgaaattaaaaacctgcagcatgttaatggaatatcaggcagataagcttctttcaaactaatcctttctgata

SEQ ID NO: 8514 - DNA, 120 bp, Homo sapiens
  DISD22_0006001
  Located on chromosome 5
  Distance between a terminus base of telomere on chromosomal short arm and 5'-terminus of this base sequence : 60515392
  Distance between 3'-terminus of neighbour sequence of sequence listing upward to telomere on chrosomal short arm and 5'-terminus of this base sequence : 79555
tgcagtatctgcaaagtatccataaacataaaattgatatttcatttagtgtgtgtgtgtgtgtgtgtgtgtgtgtgtgtgtgtgtgtgtgtgtttggtaactggaatatgtctattgca

SEQ ID NO: 8515 - DNA, 304 bp, Homo sapiens
  AC018765.4_119456
  Located on chromosome 5
  Distance between a terminus base of telomere on chromosomal short arm and 5'-terminus of this base sequence : 60749023
  Distance between 3'-terminus of neighbour sequence of sequence listing upward to telomere on chrosomal short arm and 5'-terminus of this base sequence : 233511
ttaaacatccatttaccaggtaagtaatcacagaagaatgtttctgtgtatgtgcttatttatctacacacacacacacacacacacacacacacacacacacacacacgcacccatgcacgcacatgcgtattctactacatggtgcagagacattgggattttgaatcctgtgatttggattcaagaattcttccatttaccaagtttgggaatttacttaactaacttagttcatcggggagggcaactttaaacacaaaaacgaaaattgtataatgactcaagcacagtagaactttgt

SEQ ID NO: 8516 - DNA, 132 bp, Homo sapiens
  D5S661
  Located on chromosome 5
  Distance between a terminus base of telomere on chromosomal short arm and 5'-terminus of this base sequence : 60749056
  Distance between 3'-terminus of neighbour sequence of sequence listing upward to telomere on chrosomal short arm and 5'-terminus of this base sequence : -271
aagaatgtttctgtgtatgtgcttatttatctacacacacacacacacacacacacacacacacacacacacacacgcacccatgcacgcacatgcgtattctactacatggtgcagagacattgggatttt

SEQ ID NO: 8517 - DNA, 255 bp, Homo sapiens
  D5S2061
  Located on chromosome 5
  Distance between a terminus base of telomere on chromosomal short arm and 5'-terminus of this base sequence : 60781522
  Distance between 3'-terminus of neighbour sequence of sequence listing upward to telomere on chrosomal short arm and 5'-terminus of this base sequence : 32334
ttttgcctgcaatttagtcattatcaacaataaatttaatcttttgacctcctcctcacctcctcacatttaattcccataatatccatttgtttcagaacttggtgtattaattctgttaagctaagaccaaacaatgcgcgcgcgcgcacacacacacacacacacacacacacatcacctcatcctacatattcaaagcaagttagcgagtatcagttcttcatatcaggactcatgaaactccacgatggg

SEQ ID NO: 8518 - DNA, 378 bp, Homo sapiens
  chr5.fa.O7frz.31030688
  Located on chromosome 5
  Distance between a terminus base of telomere on chromosomal short arm and 5'-terminus of this base sequence : 61162640
  Distance between 3'-terminus of neighbour sequence of sequence listing upward to telomere on chrosomal short arm and 5'-terminus of this base sequence : 380863
ctgagttagacacttaccagaaagcctgagcatgtattatgtcaattggtattatttgcatttatgaatgaatgaatgaagaattcattatcacactagggcctccaaaatttggaaaataaaaaagaacatatatgaagtaccacatccacactaaataatataattgctgctcctccatacacacatgctctttatcttccctccactacacacacacacacacacacacacacacacacacacacacacagacatatctctctgttagggaataaagactcgtgttcccacattctacacacagaaaaacagtttttgcctagttggtctgctatggcacttcttattcattctcaaggataatacttgttgttt

SEQ ID NO: 8519 - DNA, 321 bp, Homo sapiens
  chr5.fa.O7frz.31127325
  Located on chromosome 5
  Distance between a terminus base of telomere on chromosomal short arm and 5'-terminus of this base sequence : 61234112
  Distance between 3'-terminus of neighbour sequence of sequence listing upward to telomere on chrosomal short arm and 5'-terminus of this base sequence : 71094
tgtccatatgtactcaacgttcagctcccacttttaagtgagaacaagtggtatttggttttctgttcttgtgtttgtttgcttcaggtaatgggctctggctctgtctatgttgctgcctcaaagaacatgatcttgttcttttttatgactgaatactattccattgtgtgtgtgtgtgtgtgtgtgtgtgtgtgtgtgtgtgtacctaaatgtccatcagtggcaggctggatatatatatatttatatattatataatatatacatttataattatatatacaattataatattattggtagtctcataggaatagc

SEQ ID NO: 8520 - DNA, 415 bp, Homo sapiens
  chr5.fa.O7frz.78341994
  Located on chromosome 5
  Distance between a terminus base of telomere on chromosomal short arm and 5'-terminus of this base sequence : 64289585
  Distance between 3'-terminus of neighbour sequence of sequence listing upward to telomere on chrosomal short arm and 5'-terminus of this base sequence : 3055152
tctgccatgattgttaagtttcctgagttttctgaggcttcccagccatgcctcctgtagagcctgtggaacggtgagtaaatttaacctcttttctttataaattactgtctcaggtagttctttatagcaatgtgaaaacagactaatatagatggatagatagatagatagatagatagatagatagatacatagatagatagatagataatacatatagtgtaagctgtaatttgctacacaagtataccagtaatattgttattgttactattattattcttacttttttaggagttccatatatctctgacattaacttattttatatattgcaattgttatttccaatttttaaaacaagggtttaattaaaaaatatttattaagtgccatatactgacaaatttaa

SEQ ID NO: 8521 - DNA, 406 bp, Homo sapiens
  AC025776.3_46334
  Located on chromosome 5
  Distance between a terminus base of telomere on chromosomal short arm and 5'-terminus of this base sequence : 64289590
  Distance between 3'-terminus of neighbour sequence of sequence listing upward to telomere on chrosomal short arm and 5'-terminus of this base sequence : -410
catgattgttaagtttcctgagttttctgaggcttcccagccatgcctcctgtagagcctgtggaacggtgagtaaatttaacctcttttctttataaattactgtctcaggtagttctttatagcaatgtgaaaacagactaatatagatggatagatagatagatagatagatagatagatagatacatagatagatagatagataatacatatagtgtaagctgtaatttgctacacaagtataccagtaatattgttattgttactattattattcttacttttttaggagttccatatatctctgacattaacttattttatatattgcaattgttatttccaatttttaaaacaagggtttaattaaaaaatatttattaagtgccatatactgacaaat

SEQ ID NO: 8522 - DNA, 351 bp, Homo sapiens
  chr5.fa.O7frz.69864041
  Located on chromosome 5
  Distance between a terminus base of telomere on chromosomal short arm and 5'-terminus of this base sequence : 64419303
  Distance between 3'-terminus of neighbour sequence of sequence listing upward to telomere on chrosomal short arm and 5'-terminus of this base sequence : 129307
tttgactttagtaatatggaccttagtttttttttttttccggaagcttaagtacctatatactatgtaattgtaaagtacatctgataaaagggtagctacaaattttttcagattatataatacacacacacacacacacacagacacacacagacacacacacacacacacacttcttgcataagaaggaagagaaagaacaggaacaggaatgggagatagcagggaagaaaatgagaaggaatttctggataaaataatcctccttgaactcttttttccagagatgtttagttaaaaaactgataagccaaattattaaatgtctacgatggcaataaattataa

SEQ ID NO: 8523 - DNA, 282 bp, Homo sapiens
  D5S427
  Located on chromosome 5
  Distance between a terminus base of telomere on chromosomal short arm and 5'-terminus of this base sequence : 64554009
  Distance between 3'-terminus of neighbour sequence of sequence listing upward to telomere on chrosomal short arm and 5'-terminus of this base sequence : 134355
gtcttcactaagcaatctctaaataatattctcctaaggataatttgttatgtttttactaagactagacattataaacacacacacacacacacacacacacacacgacattgaaacactgaggcaaaactttatggacatctattatgaaaaaatagttctatttattcttttggagtaagaggctcctatgaagtggtggagagggtagtctttgaatggaacagaagtcaaataaattctgcatgtatcactctctaatcaggtgattcagagcatgt

SEQ ID NO: 8524 - DNA, 355 bp, Homo sapiens
  chr5.fa.O7frz.70081952
  Located on chromosome 5
  Distance between a terminus base of telomere on chromosomal short arm and 5'-terminus of this base sequence : 64611582
  Distance between 3'-terminus of neighbour sequence of sequence listing upward to telomere on chrosomal short arm and 5'-terminus of this base sequence : 57291
gcatgctgataaatgtttaactactggattttcttgggggaaaagaaaactaatttgtagcagttgctaatttttacgtgtaaattacttctaacaatgtcaaattccaagctgtcaacatcaactgacttgtaaagttcttcaaaatttaccaataggctctcccaagcatgtattcaccagctccagcacccactgattatctcacttattaaaaagtatatatatatacacacacacacacacacacacacacatgtctatagaaatggggaagccaaattataattacaaattgattttgtaagcacggaattatgaaatcaaactatggtttggtgaaactgaactatga

SEQ ID NO: 8525 - DNA, 141 bp, Homo sapiens
  D5S1956
  Located on chromosome 5
  Distance between a terminus base of telomere on chromosomal short arm and 5'-terminus of this base sequence : 64770880
  Distance between 3'-terminus of neighbour sequence of sequence listing upward to telomere on chrosomal short arm and 5'-terminus of this base sequence : 158943
tgcgctccagcctaagcaaaagagcaagaccccatctcaaacaaaacaaaacacacacacacacacacacacacacacacacacacacagtctctgactctagaacacttaccatctaatggaggttagaaacatcaatcg

SEQ ID NO: 8526 - DNA, 439 bp, Homo sapiens
  chr5.fa.O7frz.70332053
  Located on chromosome 5
  Distance between a terminus base of telomere on chromosomal short arm and 5'-terminus of this base sequence : 64893030
  Distance between 3'-terminus of neighbour sequence of sequence listing upward to telomere on chrosomal short arm and 5'-terminus of this base sequence : 122009
atgtagctttgtcaaatagttcacatatctaagtatattactattaaaatgatggcagattaaataaaatgtctcacttatgtgagctcagtgattaaagatatatttatcaaagatttaggacagcaggagatcaaaactgaacttgccaaaataatgactgtcctatcttccagctacttgtgaatattccctttgtgttcttgagttattacatagatcaatcatcttctttattccatacacccaggattgtagtttatcccttataaactcggatttgaaaacatttttaccatgctgtaaatgtgatctctgctgtgtgtgtgtgtgtatgtgtgtgtgtgtgtgtgtgtgtgtgtgtgtatttgtgtgtgtgtgtgtgtgtgtgtatccttcctgaacagtgaatgtgctgtcattgataggaccttgttct

SEQ ID NO: 8527 - DNA, 101 bp, Homo sapiens
  DISO7_10001864
  Located on chromosome 5
  Distance between a terminus base of telomere on chromosomal short arm and 5'-terminus of this base sequence : 64961823
  Distance between 3'-terminus of neighbour sequence of sequence listing upward to telomere on chrosomal short arm and 5'-terminus of this base sequence : 68354
tctctgctggcagaacagagtcggcacacgcacaagacacacacacacacacacacacacacacacatacacacacataggagaatctaaatgcagtatgg

SEQ ID NO: 8528 - DNA, 101 bp, Homo sapiens
  DISO7_10001865
  Located on chromosome 5
  Distance between a terminus base of telomere on chromosomal short arm and 5'-terminus of this base sequence : 64976010
  Distance between 3'-terminus of neighbour sequence of sequence listing upward to telomere on chrosomal short arm and 5'-terminus of this base sequence : 14086
aactgaaagttggcattgggaaacacacacacacacacacacacacacacacacacagacaaagataatttttaaagtcagaggctattaagcacagttct

SEQ ID NO: 8529 - DNA, 147 bp, Homo sapiens
  DISO7_10001866
  Located on chromosome 5
  Distance between a terminus base of telomere on chromosomal short arm and 5'-terminus of this base sequence : 65142518
  Distance between 3'-terminus of neighbour sequence of sequence listing upward to telomere on chrosomal short arm and 5'-terminus of this base sequence : 166407
gccatgaacttgttctctatctagatttttttcaaaggcataaattatgccatatatatatatatatatatatatatatatatatatatatgtatttatttctttcctgagtcatacataatacctagaacagtggttaatagcagt

SEQ ID NO: 8530 - DNA, 102 bp, Homo sapiens
  DISO7_10001867
  Located on chromosome 5
  Distance between a terminus base of telomere on chromosomal short arm and 5'-terminus of this base sequence : 65189082
  Distance between 3'-terminus of neighbour sequence of sequence listing upward to telomere on chrosomal short arm and 5'-terminus of this base sequence : 46417
ttcttcagttgatctaggttggggtgtgtgtgtgtgtgtgtgtgtgtgtgtgtgtgtgtgtgtgtacatacatatttatatctcaagttattccagggtcaa

SEQ ID NO: 8531 - DNA, 239 bp, Homo sapiens
  DISO7_10001870
  Located on chromosome 5
  Distance between a terminus base of telomere on chromosomal short arm and 5'-terminus of this base sequence : 65241329
  Distance between 3'-terminus of neighbour sequence of sequence listing upward to telomere on chrosomal short arm and 5'-terminus of this base sequence : 52145
ggataaccagaactgggaacaaaaaatacattggtgtgtgtgtgtgtgtgtgtgtgtgtgtgtgtgtgtgtgtacaaaaaccacattggtgtgtgtgtgtgtgtgtttatttattttctccacaaagaaacaaaggagaaaggaataaagcaggaaaagaggcccaagagatttagtaaaggagagaaaagactaaatgacctctttattctttaaagtaatgtatgacatgcctgtga

SEQ ID NO: 8532 - DNA, 381 bp, Homo sapiens
  AC035143.2_39129
  Located on chromosome 5
  Distance between a terminus base of telomere on chromosomal short arm and 5'-terminus of this base sequence : 65492440
  Distance between 3'-terminus of neighbour sequence of sequence listing upward to telomere on chrosomal short arm and 5'-terminus of this base sequence : 250872
gatttggtaattcactagaatgacacagcactcaggaaagagcttttcttactattaccagtctattctaaagaatacaactcaggagcggccaactcaggcatgtctgtggaactactcagaagtctgcactacagcctgggaaacagagtgagactccgtagaatgaacgaatgaacaaaagaatgaaagaaagagagagagaaggaagagagagaggaaggaaggaaggaaaaaaggaaggaaggaaggaaggaaggaaggaaggaaggagggaaggaaggaaggaaaaaaaggagggagggaggaagggaggggaggtaattgagattgcaggaaagagaaagggtcagggagctgactaagcactaacctgttatc

SEQ ID NO: 8533 - DNA, 261 bp, Homo sapiens
  AC035143.2_92006
  Located on chromosome 5
  Distance between a terminus base of telomere on chromosomal short arm and 5'-terminus of this base sequence : 65504686
  Distance between 3'-terminus of neighbour sequence of sequence listing upward to telomere on chrosomal short arm and 5'-terminus of this base sequence : 11865
cctttgctttacaagacatgactttaaaaaaggtaaaacttcatgaaaaacatttaattacttgcctatatgcatacacacacacacacacacacacatataatgcacacacacagagtaaacttatttgtgagattgactctggttaggataaagtatctgagcctttaaatagaactgatttagcaaataataataattattattattatttatttttagagatgaggtctcactctgctgatactgaactcctaggct

SEQ ID NO: 8534 - DNA, 264 bp, Homo sapiens
  Z67173
  Located on chromosome 5
  Distance between a terminus base of telomere on chromosomal short arm and 5'-terminus of this base sequence : 65504687
  Distance between 3'-terminus of neighbour sequence of sequence listing upward to telomere on chrosomal short arm and 5'-terminus of this base sequence : -260
ctttgctttacaagacatgactttaaaaaaggtaaaacttcatgaaaaacatttaattacttgcctatatgcatacacacacacacacacacacacatataatgcacacacacagagtaaacttatttgtgagattgactctggttaggataaagtatctgagcctttaaatagaactgatttagcaaataataataattattattattatttatttttagagatgaggtctcactctgctgatactgaactcctaggctcaag

SEQ ID NO: 8535 - DNA, 373 bp, Homo sapiens
  AC008854.3_19318
  Located on chromosome 5
  Distance between a terminus base of telomere on chromosomal short arm and 5'-terminus of this base sequence : 65658729
  Distance between 3'-terminus of neighbour sequence of sequence listing upward to telomere on chrosomal short arm and 5'-terminus of this base sequence : 153778
atactatgatctgatggctcatcctaatggcaaggcaataactggtcctgcagctctccccagatccactggatctcttccatcaacttctttagatactgagccaggtacatgtttagctccttgcttaagggtactgtattagtcagggttctccagagaaacacaaccaatagaatagatagatgatagatgattagatagatagacagatagatagatagatagatagatagatagatagatagatagatagatagattattatgaggaactggctcatgcaattatgacgactaaatcctatgatctgctgtctgcaagctggagccatgggaaagacacagagctatacttccagttcaagtctgaa

SEQ ID NO: 8536 - DNA, 303 bp, Homo sapiens
  chr5.fa.O7frz.71365660
  Located on chromosome 5
  Distance between a terminus base of telomere on chromosomal short arm and 5'-terminus of this base sequence : 65765029
  Distance between 3'-terminus of neighbour sequence of sequence listing upward to telomere on chrosomal short arm and 5'-terminus of this base sequence : 105927
tagacgtaattatcaggtgaagatttaagaaatgaaaaatacccagataccaccccctctccaaaagagagaggtggggaggagtggagcgagagagagagagagagagagagagagagagagagagagagagagagagagagaatgaaaggacatctgcagagaccattattaataattgctgtggcaggcaagaaagaaatagagtcaggtaggtagttcagtcagagaggcctcatatatctgttaaccaagttgagacacacaggagacatgaaaaagtcacacttgtttctggtaaga

SEQ ID NO: 8537 - DNA, 265 bp, Homo sapiens
  chr5.fa.O7frz.71608353
  Located on chromosome 5
  Distance between a terminus base of telomere on chromosomal short arm and 5'-terminus of this base sequence : 65914361
  Distance between 3'-terminus of neighbour sequence of sequence listing upward to telomere on chrosomal short arm and 5'-terminus of this base sequence : 149029
taacagactaaagctttggtagacagattactagcattcttgattacatctggcttatcgtttgtcttccagccaaagagaagagagagagagagagggagtgtgtgtgtgtgtgtgtgtgtgtgtgtgtgtgtgttttagtcacaaatttcattgatatttacacatgtgaggtattataaaatgttactagttgggtttgttggcttgtttgtttttgaggcaaaactgtgttttatgaaccaagatgttaactaatcttcac

SEQ ID NO: 8538 - DNA, 324 bp, Homo sapiens
  chr5.fa.O7frz.71712732
  Located on chromosome 5
  Distance between a terminus base of telomere on chromosomal short arm and 5'-terminus of this base sequence : 66018389
  Distance between 3'-terminus of neighbour sequence of sequence listing upward to telomere on chrosomal short arm and 5'-terminus of this base sequence : 103763
gacaagttactccactttacctatctcagagcaaaatgaactataggtaaaggtcagctagtctctctctctctgtctctgtctctctgtctctgtctctctctctctctgtctctctttctctctctctgtcacacacacacacacacacacacttacacaaactgttccaaatcgtgcttattatagtaccatgctcaaacacaaaagttgtctacctaaacataaagggcgacttacaggttgaatcccatatggaatagtaggggagagaaagcatacttccatttctatatgggataacattaaactctgtcactgatg

SEQ ID NO: 8539 - DNA, 276 bp, Homo sapiens
  DISO7_10001872
  Located on chromosome 5
  Distance between a terminus base of telomere on chromosomal short arm and 5'-terminus of this base sequence : 66105592
  Distance between 3'-terminus of neighbour sequence of sequence listing upward to telomere on chrosomal short arm and 5'-terminus of this base sequence : 86879
acaggtacttggaccctaccaaatgtgggttcagatcctgactctactacttcctaatctttaaactgggcaaatcactatcttcccctgtgcctcactttcttcattaataataccaactcttagaagcttgttgtcaggattatataagatactacacacacacacacacacacacacacacacacacacacacttgcagagagagatctatttgtgtatgtgagatatataagacagataatatatataaagggcctaacataatacccaaca

SEQ ID NO: 8540 - DNA, 101 bp, Homo sapiens
  DISO7_10001873
  Located on chromosome 5
  Distance between a terminus base of telomere on chromosomal short arm and 5'-terminus of this base sequence : 66123035
  Distance between 3'-terminus of neighbour sequence of sequence listing upward to telomere on chrosomal short arm and 5'-terminus of this base sequence : 17167
tcatctttgcatgcttgtgtgcatgcaaacacacacatgtgcacgcacgcgcacacacacacacacacacacacatcccccaggagccagctgaggactct

SEQ ID NO: 8541 - DNA, 205 bp, Homo sapiens
  DISO7_10001874
  Located on chromosome 5
  Distance between a terminus base of telomere on chromosomal short arm and 5'-terminus of this base sequence : 66358266
  Distance between 3'-terminus of neighbour sequence of sequence listing upward to telomere on chrosomal short arm and 5'-terminus of this base sequence : 235130
tggtgtctgcctacaaattaacttctttatttttccagcaaaatgaagaaaaatctctcatcaaagttcccaagtttgagagtgacaaaatctatttcagtagttttattatttctgcaacacacacacacacacacacacacacacacacacacacacacacacacacagagtttattctgaaattccagatacttaatgcagt

SEQ ID NO: 8542 - DNA, 214 bp, Homo sapiens
  DISO7_10001875
  Located on chromosome 5
  Distance between a terminus base of telomere on chromosomal short arm and 5'-terminus of this base sequence : 66377474
  Distance between 3'-terminus of neighbour sequence of sequence listing upward to telomere on chrosomal short arm and 5'-terminus of this base sequence : 19003
caatgaagagcatatgtaaataacctaccttcaaaaagcagaatatatatatagggagagacagtgagggtatatatatatatatatatatatatagagagagagagagagagagagagagagtgtatatgtgcaaatgtgtgtatgtgtgtatatacacatttcttcaaatatagatacactagaaaaatactagctctggctaatatgtgca

SEQ ID NO: 8543 - DNA, 401 bp, Homo sapiens
  chr5.fa.O7frz.72161663
  Located on chromosome 5
  Distance between a terminus base of telomere on chromosomal short arm and 5'-terminus of this base sequence : 66572639
  Distance between 3'-terminus of neighbour sequence of sequence listing upward to telomere on chrosomal short arm and 5'-terminus of this base sequence : 194951
ttctaaggagtttacagacttcattccctagggagacatgaaagattttatgctgaaaatgattaaacatattattattcaatgattactgcaatttcaaaagtcttattaacaccatatatatatatatatatatatatatatatatatatatatatatatatatatatatgaactgttcacaatcttctgccactcaataaaatatttatttgctttttcagaaaaggtttatttcattatagctactattaaaatagtcaataacttacattaatctgtaacaaattttaaacatcattcttttgatttaaaaagttgtacatactcatcacagaaaattgaaaaaattgtgaaaagcaaaaaaccacccacaatcctagctgtcagacataagcact

SEQ ID NO: 8544 - DNA, 136 bp, Homo sapiens
  DISO7_10001877
  Located on chromosome 5
  Distance between a terminus base of telomere on chromosomal short arm and 5'-terminus of this base sequence : 66636841
  Distance between 3'-terminus of neighbour sequence of sequence listing upward to telomere on chrosomal short arm and 5'-terminus of this base sequence : 63801
ttcccaatccaagattcctttatatatatatatatatatatgcatcctaaattaccatcttttgagatgtataatttcttaaaacatactatgtgcaaagttacttttaaccacaaaacttcaaacaactgctgcc

SEQ ID NO: 8545 - DNA, 254 bp, Homo sapiens
  DISO7_10001878
  Located on chromosome 5
  Distance between a terminus base of telomere on chromosomal short arm and 5'-terminus of this base sequence : 66832334
  Distance between 3'-terminus of neighbour sequence of sequence listing upward to telomere on chrosomal short arm and 5'-terminus of this base sequence : 195357
catattcctatgcaaagtgtcctcttgagaggctaaagtgcgaggatcccttgaatctgagagttggagtccagcctgggcaacatagcaaaactcactcactctctctctctctctttatatatatatatatgtatgtgtgtgtgtgtgtgtgtgtatacatacatgcgcacacacagacacatgcacgcacacatgcacatggatatatatatggaaaactatatctttgtatcctccatgagtttcctcac

SEQ ID NO: 8546 - DNA, 241 bp, Homo sapiens
  DXS6792
  Located on chromosome 5
  Distance between a terminus base of telomere on chromosomal short arm and 5'-terminus of this base sequence : 66948109
  Distance between 3'-terminus of neighbour sequence of sequence listing upward to telomere on chrosomal short arm and 5'-terminus of this base sequence : 115521
ctagcagcatcccacagtctccagtttgcagatggcttatgggatttctcggcctctgtaaccgtgtgagccgttaccctagtaaattccctatcatctgtctatctgtctatttatctatctatctatctatctatcatctatctatctatctatctatctatccatcctatttcttcagtcttgctggagaaccctgactaacacaccaagtaaggataggccagaagtaagggacaat

SEQ ID NO: 8547 - DNA, 221 bp, Homo sapiens
  D5S616
  Located on chromosome 5
  Distance between a terminus base of telomere on chromosomal short arm and 5'-terminus of this base sequence : 67122867
  Distance between 3'-terminus of neighbour sequence of sequence listing upward to telomere on chrosomal short arm and 5'-terminus of this base sequence : 174517
aattggtcaccagtcgttcataatttgctacattgtctttatcatttattctcctctttcttctctttttctccctccctccctctacacacacacacacacacacacacacacacacacatacacacacacacacagtcacactcactcatacagttatacacatttatttttctgaaccatttgggtttcaatttgtgactgagcaagttactttgcct

SEQ ID NO: 8548 - DNA, 340 bp, Homo sapiens
  AC008772.6_84534
  Located on chromosome 5
  Distance between a terminus base of telomere on chromosomal short arm and 5'-terminus of this base sequence : 67236952
  Distance between 3'-terminus of neighbour sequence of sequence listing upward to telomere on chrosomal short arm and 5'-terminus of this base sequence : 113864
tgactcttgagatttatggttaaggtatttgggtggatggtggggccactcagtgaggtagggaaatccagggcaagaagtagagtcggtcattcattcattcattcattcattgacaggatctttctctgtcacccaggcagaagggcagtggcatgatcctagctcatggcaccttcaaactctggggctcaagtgatccttttgcttcagcctcccaagtagctgggactacaagcgtgtcccaccacacctggctatggggtttagatgtgttgaacttcgggtaccttgctacatctaagtggagactccagaaggtagtggtagatacagacct

SEQ ID NO: 8549 - DNA, 177 bp, Homo sapiens
  HUMUT1152
  Located on chromosome 5
  Distance between a terminus base of telomere on chromosomal short arm and 5'-terminus of this base sequence : 67433727
  Distance between 3'-terminus of neighbour sequence of sequence listing upward to telomere on chrosomal short arm and 5'-terminus of this base sequence : 196435
agggaggagctgggacttgaaggactagatgattttgccagaggtagactgttgcttaaaccagtggttctcaaagccagtgaaaggtgtggtgtgtgtgtatgtgtgtgtgtgtgttttgtgtgtgtgtgtgtgtgtgcacaagggtgtgtgttttaaccagccttccaggtgatt

SEQ ID NO: 8550 - DNA, 451 bp, Homo sapiens
  chr5.fa.O7frz.73470305
  Located on chromosome 5
  Distance between a terminus base of telomere on chromosomal short arm and 5'-terminus of this base sequence : 67508042
  Distance between 3'-terminus of neighbour sequence of sequence listing upward to telomere on chrosomal short arm and 5'-terminus of this base sequence : 74138
ctcagttactgcacttaggataatggtctccaactccatccaggttgatgtggatgccattatttcatttctttttatgtctgagtagtatcccacagtgtgtgtgtgtgtgtgtgtgtgtgtgtgtgtgtgtgtgtgtgtgtatgatatatatcacgttttctttatccactcgttgtttgatgagcatttgggctggttccctatttttgcaattgtgaattgtgctgctataagcatgcatgtacaagtgtttttttcatataatgacttattttcctctggatagatacccagtagtgtgattgctggatcaaatggtataaatagttctacttttagttctttaaggaatctccatactattttccattgtggttgtactggtttacattcccaccagcagtgtaagaatgttcccttttcaccacatccacatcaacatctactt

SEQ ID NO: 8551 - DNA, 161 bp, Homo sapiens
  D5S2072
  Located on chromosome 5
  Distance between a terminus base of telomere on chromosomal short arm and 5'-terminus of this base sequence : 67799887
  Distance between 3'-terminus of neighbour sequence of sequence listing upward to telomere on chrosomal short arm and 5'-terminus of this base sequence : 291394
ccttggggctgtgatgaaattgtattgctggtggtggatgtgtgcatgcgcatggtgtgtgtgtgtgtgtgtgtgtgtgtgtgtgtgtatgtatgtgtgtgtagagaaaaggaattgactttcttgaagttgacagtcacgagatagcagtatcaaagtgc

SEQ ID NO: 8552 - DNA, 134 bp, Homo sapiens
  Z67459
  Located on chromosome 5
  Distance between a terminus base of telomere on chromosomal short arm and 5'-terminus of this base sequence : 67889790
  Distance between 3'-terminus of neighbour sequence of sequence listing upward to telomere on chrosomal short arm and 5'-terminus of this base sequence : 89742
aaagcaaataaaatgtgcatcatacacagatacatagacatacatacatgtgtctgggtaaaagaccatgcaggatcatgtgtgtgtgtgtgtgtgtgtgtgtgtgtatgtatactgtagcctagtgggataga

SEQ ID NO: 8553 - DNA, 142 bp, Homo sapiens
  D5S647
  Located on chromosome 5
  Distance between a terminus base of telomere on chromosomal short arm and 5'-terminus of this base sequence : 68004392
  Distance between 3'-terminus of neighbour sequence of sequence listing upward to telomere on chrosomal short arm and 5'-terminus of this base sequence : 114468
ctggggattgctacatctttagagaggccattattttgcctcccatgatatgtgtgtgtgtgtgtgtgtgtgtgtgtgtgtgtgtgtgtgtgtgtgtgtgtgtgtattttttcccactgatgaaccaatgataatgttcctc

SEQ ID NO: 8554 - DNA, 472 bp, Homo sapiens
  AC008480.3_58600
  Located on chromosome 5
  Distance between a terminus base of telomere on chromosomal short arm and 5'-terminus of this base sequence : 68168939
  Distance between 3'-terminus of neighbour sequence of sequence listing upward to telomere on chrosomal short arm and 5'-terminus of this base sequence : 164405
atgaacagtgatctttgacaagtttggagtttaatcactgggagttgtgtttttaactcttgacaatttaagatctaaggctagttttgtttgtttgtttgtttgtttgtttgttttgttttgttttggagatgaagacttgcttcgttgcccaggctggagtgtagtggcatgatctcggctcactgcaacctccgtctcctcagttcaagtgattctcctgcctcagcctcccgagtatctgggattacagacgtgtgtcaccatgctcagctaatttttgtatttttagtagagataaggtttcaccatgttggccaggctggtcttgaactcctaacctcaggtgatctgtctgcctcggcctcccaaagtgctgggattacaggcgtgagccaccgcacctggccttgaggctagtttttaatctatttgttaacatttgaaatatgacttctccaggtaatttaat

SEQ ID NO: 8555 - DNA, 203 bp, Homo sapiens
  D5S2121
  Located on chromosome 5
  Distance between a terminus base of telomere on chromosomal short arm and 5'-terminus of this base sequence : 68371750
  Distance between 3'-terminus of neighbour sequence of sequence listing upward to telomere on chrosomal short arm and 5'-terminus of this base sequence : 202339
tgttcttggtgataatgtgactgtgtgtgtgtgtgtgtgtgtgtgtgggtgtgtgtgtgtgtgtctatgtatgtatgtctgtgtactgaaagtatggtgtaactaactgcagtagcattgggagtctaggctacaatgatacagaataaatagagttacaatagaaattttctccatttactggaaatctggggctcttcatt

SEQ ID NO: 8556 - DNA, 250 bp, Homo sapiens
  D5S2048
  Located on chromosome 5
  Distance between a terminus base of telomere on chromosomal short arm and 5'-terminus of this base sequence : 68384591
  Distance between 3'-terminus of neighbour sequence of sequence listing upward to telomere on chrosomal short arm and 5'-terminus of this base sequence : 12638
tgttgttatgtaaaaatgctactgatttttataagttgattgtttatcttaacactttactgaattcctttattcagtaaaggaataaattactaaaaatacaatttggctttgtaatacattcctaaatatattacaaagctatggtagttccacctttgcgtgtgtgtgtgtgtgtgtgtgtgtgtgtgtgtttgtgaagtctttagagttttctaagtataagaagaggccatcaacagagacaatc

SEQ ID NO: 8557 - DNA, 329 bp, Homo sapiens
  chr5.fa.O7frz.74604591
  Located on chromosome 5
  Distance between a terminus base of telomere on chromosomal short arm and 5'-terminus of this base sequence : 68418789
  Distance between 3'-terminus of neighbour sequence of sequence listing upward to telomere on chrosomal short arm and 5'-terminus of this base sequence : 33948
gctttaagaatagcttttcgagatatagttatgaggacatgctaggtgggaggaagggagagacccaaggctcagaacctccaaatgtcagaatgtgtgtgtgtgtgtgtgtgtgtgtgtgtttaacccattctgaaggacaagaatcaaagccaccaaaatgtggaattcttttaacttgttatgtttcatctaagcccttcttacagtcctcaggacggactgagaaatgtgctgccatttccttttctcctcgtaaggcctcctgtacctcaaagccaaaaagcagaaatggatataaggttttgtctgacatgaatctgcttaga

SEQ ID NO: 8558 - DNA, 453 bp, Homo sapiens
  chr5.fa.O7frz.74736036
  Located on chromosome 5
  Distance between a terminus base of telomere on chromosomal short arm and 5'-terminus of this base sequence : 68550036
  Distance between 3'-terminus of neighbour sequence of sequence listing upward to telomere on chrosomal short arm and 5'-terminus of this base sequence : 130918
atagcttgacctttaggatgagaaattgcaataaaatatccattaaaggagaaagtaaaaatgatatttgccaaaggctgaggcaagagaatcgcttgaacccgggaggcagaggttgcagtgagccaagattgcaccactgcactccagcctgggtgacagagtgagaatctgtctaaaaataaataaatagatagaaagatagatagatagatagatagatatagatagatagataggattttcaatatttaaacctcatgaggccagaactgcctcactgcacaactccgggaggaaaggatgggcgccccctggaattgtggcatgtgtcactattatctgttcttttaaatgcatgtgtccatctggggtagagctgcaagtcaaaggaaaggatgacagaggtaaaaatctttttagaatgaagtgttagtcaaatgtttagccatg

SEQ ID NO: 8559 - DNA, 271 bp, Homo sapiens
  chr5.fa.O7frz.154076228
  Located on chromosome 5
  Distance between a terminus base of telomere on chromosomal short arm and 5'-terminus of this base sequence : 68739800
  Distance between 3'-terminus of neighbour sequence of sequence listing upward to telomere on chrosomal short arm and 5'-terminus of this base sequence : 189311
tagacaatgaccagtggctgagcaccgtctcccagtacgaccgggacaagtactggaaccgctttcgagacgtgagtaccggcgccacccggccctggggggcgcggagcctctcggaggggacccctgaagcggggttggggtgtgtgtgtgtgtgtgtgtgtgtgtgtgtgtgtggttgggagggggacaggtgggcatctcccgcgggggctggtcggtcccagcttcctgggtgcggtcttgcctgaaaggaactttaaagagaact

SEQ ID NO: 8560 - DNA, 293 bp, Homo sapiens
  chr5.fa.O7frz.153960117
  Located on chromosome 5
  Distance between a terminus base of telomere on chromosomal short arm and 5'-terminus of this base sequence : 68817891
  Distance between 3'-terminus of neighbour sequence of sequence listing upward to telomere on chrosomal short arm and 5'-terminus of this base sequence : 77820
gtcatacctcaataaagcaattacaacaacaacaacaacaacaacaacaacaacaacaacaaacaataaagaggcaatatagcccagtagtgaagaagctgtgccctggatatcccctagtaggtttattagaattaaatgagctcatgcctgcaaaaacttgccacgtgcaatgcctagtcctcagtattagttattaaggttactaggtttccttaatgtccccactgctgacatatttcaaaacttttctggcattacttttggcacgctacataggctactgtgactcg

SEQ ID NO: 8561 - DNA, 420 bp, Homo sapiens
  chr5.fa.O7frz.153734127
  Located on chromosome 5
  Distance between a terminus base of telomere on chromosomal short arm and 5'-terminus of this base sequence : 69056089
  Distance between 3'-terminus of neighbour sequence of sequence listing upward to telomere on chrosomal short arm and 5'-terminus of this base sequence : 237905
tattttcttgcctcatgtaactacttctgatgttgatattctttgaagtattttcccacctccaaattatccattctctaggaatagcgtatatattatatattagagatatatatactctaggaatattatatatattatatattagatatatatattatataatatgtaatatatattagagatatataatatattagagagatatatataaaatatatgtaatatatatatatatatatatatctcacagtttcttcattcattgattgatgggcatttggattggttccaagattttgctattatgaattgtgccactataaacatgtgtgtgtgagtatctttttcgaataatgacttcttttcctctgggtagatactcagtagtgggattgatggatcaaatggtagttacat

SEQ ID NO: 8562 - DNA, 332 bp, Homo sapiens
  AC004592.1_120357
  Located on chromosome 5
  Distance between a terminus base of telomere on chromosomal short arm and 5'-terminus of this base sequence : 69094955
  Distance between 3'-terminus of neighbour sequence of sequence listing upward to telomere on chrosomal short arm and 5'-terminus of this base sequence : 38446
aagctcaactgttcgtttacatttccctaatagcttgcaattacactgctgcttggcacttttccttggcaaagcagaattttagtcagagcctgagagtgcctctgtgtgtgtgtgtgtgtgtgtgtgtgtgtgtgtgtgtgtgtgtataactgcttttgcatgcaggcctcaggggccttgcttgttcaacaactgaactttgaggtaaaaccccactggtgtctgcctcacagataccgttagtgttactgggtgtgctctgtcactctcttaatggaaagtgcagactgcagtctcataccagttagtagactttacgtggtcacgtc

SEQ ID NO: 8563 - DNA, 138 bp, Homo sapiens
  D5S479
  Located on chromosome 5
  Distance between a terminus base of telomere on chromosomal short arm and 5'-terminus of this base sequence : 69247174
  Distance between 3'-terminus of neighbour sequence of sequence listing upward to telomere on chrosomal short arm and 5'-terminus of this base sequence : 151887
gcaatagcaagactctgaccaaaacacaaacacacacacacacacacacacacacacacacacacacacacacacacatccaaaggaaggcagtaatggaggaaatgaggggggaaaaaactgtaaggcacacagaaa

SEQ ID NO: 8564 - DNA, 363 bp, Homo sapiens
  AC002448.1_26259
  Located on chromosome 5
  Distance between a terminus base of telomere on chromosomal short arm and 5'-terminus of this base sequence : 69412645
  Distance between 3'-terminus of neighbour sequence of sequence listing upward to telomere on chrosomal short arm and 5'-terminus of this base sequence : 165333
agaactcaagattatctcacctttgaactctgcaacttgcacaaatccctcccccaaccaaggcctttggccttgaactgagagttacacattcagctctcccagttcttcggccttcagacttggactgagccaggctgctggcttccctgattttccagcttgcagatcaaaaactgtgggactgcttagcctccaaaattatgtaagccaattcccataataaatacccatagatagatagatagatagatagatagatagatagatagatagatataaatttttgagacatggtctggctctgttgcctaggctggagtgcagtggtgccatcttggcttactgtaacctccacaggat

SEQ ID NO: 8565 - DNA, 244 bp, Homo sapiens
  AC002448.1_29929
  Located on chromosome 5
  Distance between a terminus base of telomere on chromosomal short arm and 5'-terminus of this base sequence : 69416492
  Distance between 3'-terminus of neighbour sequence of sequence listing upward to telomere on chrosomal short arm and 5'-terminus of this base sequence : 3484
catactggcaacctgagtttagtagagtgggatgctcccatcctactatgtgcccagagagagagagagagagagagagagagagagagagagagagaactaggacattggagaacagccctcctatcaaccacactgtggaatgccacacaggggattaaaataatgtcaggtctctacatgctgatgtgaaaagagtccaagacaaattgttgagtaaaaaagcaagttctttaacaatacg

SEQ ID NO: 8566 - DNA, 312 bp, Homo sapiens
  AC002448.1_68541
  Located on chromosome 5
  Distance between a terminus base of telomere on chromosomal short arm and 5'-terminus of this base sequence : 69454958
  Distance between 3'-terminus of neighbour sequence of sequence listing upward to telomere on chrosomal short arm and 5'-terminus of this base sequence : 38222
ggtctggctgtatgctagttacatgcaaaataaaatctaatagatctaatcaagtcattcaaatacatttatttgtgcttaattaggagcaaaggggctatagtgttcaacatctctattctcttggcatttggcttctaaaattcactgctatggcctatgcttctccaaaacatgattttttcctacaaatttgatctctgtgtgtgtgtgtgtgtgtgtgtgtgtgtgtgtgtgtgctacaaattattggggggtttataaccacatttgataataaattaacacattgctagaatttacacttctggt

SEQ ID NO: 8567 - DNA, 118 bp, Homo sapiens
  D5S399
  Located on chromosome 5
  Distance between a terminus base of telomere on chromosomal short arm and 5'-terminus of this base sequence : 69589470
  Distance between 3'-terminus of neighbour sequence of sequence listing upward to telomere on chrosomal short arm and 5'-terminus of this base sequence : 134200
gagtgtatcagtcagggtgctccagaaaacaaacacaataagagatcacacacacacacacacacacacacacacacacacgagatttactatgggaattgattatgaagttgaggcc

SEQ ID NO: 8568 - DNA, 309 bp, Homo sapiens
  AC026706.3_90114
  Located on chromosome 5
  Distance between a terminus base of telomere on chromosomal short arm and 5'-terminus of this base sequence : 69717291
  Distance between 3'-terminus of neighbour sequence of sequence listing upward to telomere on chrosomal short arm and 5'-terminus of this base sequence : 127703
agtttgcatttcattacgatagtaccttttagtgtatatcctgaaagtatagaaaaaactaataccactagttttatcttgaaagtggtagaaaaaactaatgccatgtgatattggcagtaatgtatgtgactaagatggaaaaatttggttcagtagataacaactactactactactactactatatactactttcatgatatacactaaatggtattttttaaaactttctttattgcttcctggactttaagtgatattatttgtacaagtaggagcacatgggtcaatgagtcggtagctacc

SEQ ID NO: 8569 - DNA, 142 bp, Homo sapiens
  chr5.fa.O7frz.79002213
  Located on chromosome 5
  Distance between a terminus base of telomere on chromosomal short arm and 5'-terminus of this base sequence : 70099574
  Distance between 3'-terminus of neighbour sequence of sequence listing upward to telomere on chrosomal short arm and 5'-terminus of this base sequence : 381974
agattacgccactggactccagcctaagctacagagggagactccatctcacaaagataagataagatgagataagataagataagataagataagataagataagataaaataaagtgggacgtacatatgaagcactttg

SEQ ID NO: 8570 - DNA, 212 bp, Homo sapiens
  D5S1491
  Located on chromosome 5
  Distance between a terminus base of telomere on chromosomal short arm and 5'-terminus of this base sequence : 70115711
  Distance between 3'-terminus of neighbour sequence of sequence listing upward to telomere on chrosomal short arm and 5'-terminus of this base sequence : 15995
ctaagacactgggttattttggaaatcttaagaatatctaggtgattatctatctatctatctatctatctatctatctatctatctatcatctatattttactaacaggcattctagtattaaagctatgttgactaatttccatctattcctcttccttaaagctcgaattccccagtcttctatgataccatgtttgcacattttgctc

SEQ ID NO: 8571 - DNA, 207 bp, Homo sapiens
  Z67633
  Located on chromosome 5
  Distance between a terminus base of telomere on chromosomal short arm and 5'-terminus of this base sequence : 70188375
  Distance between 3'-terminus of neighbour sequence of sequence listing upward to telomere on chrosomal short arm and 5'-terminus of this base sequence : 72452
ctcagtcctggttaccaatagttcaggaccctcctcatcatctccctttcatactgagtagaaatcagaggcttgctttattcttcaactaccatttctatttccttcttccaaaaccagggtgaagcctctgaggggtgtgtgtgtgtgtgtgtgtgtgtgtgtgtgtgtgtgtgtgtgtgtagatgaatgctaaactctgtggag

SEQ ID NO: 8572 - DNA, 359 bp, Homo sapiens
  chr5.fa.O7frz.79209764
  Located on chromosome 5
  Distance between a terminus base of telomere on chromosomal short arm and 5'-terminus of this base sequence : 70280560
  Distance between 3'-terminus of neighbour sequence of sequence listing upward to telomere on chrosomal short arm and 5'-terminus of this base sequence : 91978
atcacctaaggtctggagtttgagaccagcctggccaacatggtgaaatcccatctctactaataatacaaaaattagccaggcatggcgtcacatgcctgtaatgccagctactcaggaggctgaggcgggagaatctcttgaacccaggaggcggaggttacagtgagctgagattgcatcattatgctccagcctgggcgacaaaagagaaactccatctcaataataataataataataataataataataataataataatattaaaatgcctacatagcaaaaactatcataaagcaaagtaataaaaaaagaaaaaatactcattaattaaaggctattccttaaatcagta

SEQ ID NO: 8573 - DNA, 371 bp, Homo sapiens
  chr5.fa.O7frz.79326158
  Located on chromosome 5
  Distance between a terminus base of telomere on chromosomal short arm and 5'-terminus of this base sequence : 70396882
  Distance between 3'-terminus of neighbour sequence of sequence listing upward to telomere on chrosomal short arm and 5'-terminus of this base sequence : 115963
ccagacataggactttatttgtcctatatacagatgaagggtctctctgcttggggattatgtatgttaaccaaggccacagagactgatatatacaaaccagaatgctgattcttttcatgtatgatgaaaaatatacaattactggtgagggggtgggcagtggtgggggtagggtgagacaatttattagaagtacaaaccaagggaaattggctccacagtgtcaatgcttaggtcaccctaacagatctctctctctctctctgtgtctctccctgtctctctctctctctctctctctcacacacacacacacacacacacacacggtttcatttttctatgttctagtctgtgctattctgttc

SEQ ID NO: 8574 - DNA, 248 bp, Homo sapiens
  G09376
  Located on chromosome 5
  Distance between a terminus base of telomere on chromosomal short arm and 5'-terminus of this base sequence : 70546148
  Distance between 3'-terminus of neighbour sequence of sequence listing upward to telomere on chrosomal short arm and 5'-terminus of this base sequence : 148895
ccttattggcctataggattatgtttttattctgacagatatttttctatcatctatctgtctatctatctatctatctatctatctatctatctatctatctatcatctatctatctaatctatccatatatctatctatctccctgtctatctagttatctgaatatgtgtgcatgtatcagagagagacatgaagattttgttactcggtaggtgtgcacaagccagagcagagtcccattcctt

SEQ ID NO: 8575 - DNA, 217 bp, Homo sapiens
  D5S650
  Located on chromosome 5
  Distance between a terminus base of telomere on chromosomal short arm and 5'-terminus of this base sequence : 70653270
  Distance between 3'-terminus of neighbour sequence of sequence listing upward to telomere on chrosomal short arm and 5'-terminus of this base sequence : 106874
tgcacacagcagcaagtctttattcatgtacaacatgattatgtacctagaatataccaaggaatcctcaaagaagaaaaaaaaggactatgagatttaataaacaaattcagcaaagcctcaaaacaaggtcaatgtttatgtacatgcacgtgtgtgtgtgtgtgtgtgtgtgtgtgtgtgtgtgtataccccatgtttatgggttggaaaactc

SEQ ID NO: 8576 - DNA, 269 bp, Homo sapiens
  D5S2122
  Located on chromosome 5
  Distance between a terminus base of telomere on chromosomal short arm and 5'-terminus of this base sequence : 70667115
  Distance between 3'-terminus of neighbour sequence of sequence listing upward to telomere on chrosomal short arm and 5'-terminus of this base sequence : 13628
aacttgggttgtcagatccttagtccagttaccttaaaccctaccactcattttgcctccgtctctaattttgactttttctgcagcctataatcctgctggagttttccccttatagaaataattgagcagacagatttgaaaaagcccagggattatgctcctagaatttgagagaactcgcacacacacacacacacacacacacacacacacacacaccccccaccatgaaacagaaaagattttctccttgtgcctaactccat

SEQ ID NO: 8577 - DNA, 111 bp, Homo sapiens
  DISO7_10000303
  Located on chromosome 5
  Distance between a terminus base of telomere on chromosomal short arm and 5'-terminus of this base sequence : 70900572
  Distance between 3'-terminus of neighbour sequence of sequence listing upward to telomere on chrosomal short arm and 5'-terminus of this base sequence : 233188
cattaactctgacctgtgggtttttgtgtgtgtgtgtgtgtgtgtgtgtgtgtgtgtggttttttttgttgtttttttggggtttttttgccactgattagatcactagca

SEQ ID NO: 8578 - DNA, 193 bp, Homo sapiens
  DISO7_10000304
  Located on chromosome 5
  Distance between a terminus base of telomere on chromosomal short arm and 5'-terminus of this base sequence : 71196821
  Distance between 3'-terminus of neighbour sequence of sequence listing upward to telomere on chrosomal short arm and 5'-terminus of this base sequence : 296138
cttcaagacataatctgctatcatcattattaaattcttccctttcctctcctcccttcttccctgttccccttcctctcccttcctcccttccccttccttctttccttccttccttccttccttccttccttccttccttccttccctccttcctcccttcctctctccctccctccttctccattcccag

SEQ ID NO: 8579 - DNA, 258 bp, Homo sapiens
  D5S1999
  Located on chromosome 5
  Distance between a terminus base of telomere on chromosomal short arm and 5'-terminus of this base sequence : 71325636
  Distance between 3'-terminus of neighbour sequence of sequence listing upward to telomere on chrosomal short arm and 5'-terminus of this base sequence : 128622
tctttcactcctaactctgttttctgtgtgtgtgtgtgtgtgtgtgtgtgcgtgtgtgtgtgtgtgtgtttgcgtctctctctctctctctcttcttctctctctgtctctccacctctctctctcaccagacattggcagggcaaaggagatcactgttgccaggagattgtttgcattcccgggtctttctggcaaggccttcctctgagtggagtcgaggtaagccagccacccatctcccagtaccaggcagcc

SEQ ID NO: 8580 - DNA, 385 bp, Homo sapiens
  chr5.fa.O7frz.78580210
  Located on chromosome 5
  Distance between a terminus base of telomere on chromosomal short arm and 5'-terminus of this base sequence : 71358067
  Distance between 3'-terminus of neighbour sequence of sequence listing upward to telomere on chrosomal short arm and 5'-terminus of this base sequence : 32173
ttaagcagtcaactccagtaaccctaaaaccaacaaaagaactccatccttaatattctgttcctctagaaccactcctggtaccaaaacctgtattagggttctagaaggacagaactaacggaatatatatatatatatatatatatatataaatgggagtttgttaattattaacttacacgatcacaaggtcccacaataggctgtctgcaagctgaggagcaaggagagccagtctgagtcccaaaactgaaggacctggagtccgatgtttgagggcaggaagcatccaacatgggagaaagatgtaagctgggagactaagccagtccctcctttcatgtttttctgcctgctttatatttgctggtgctaattagat

SEQ ID NO: 8581 - DNA, 364 bp, Homo sapiens
  HUMUT1115
  Located on chromosome 5
  Distance between a terminus base of telomere on chromosomal short arm and 5'-terminus of this base sequence : 71549572
  Distance between 3'-terminus of neighbour sequence of sequence listing upward to telomere on chrosomal short arm and 5'-terminus of this base sequence : 191120
gggcgacagagtgagactctattaaaaaaaaaaatgaaaggagagagagatgaaagaaagaaagaaaagaagaaaagaaagaaagaaagagaaaagaaaagaaaggaaggaaggaaggaaaagaaagaaaagaagaagaaagaaagaaaaaagaaagagaaggaaggaaggagaagaaagaaagagaaagaaagaaagaaaagaaagaaaggaaggaaggaaggaaagaaggaaggaaggaaggaaggaaggaaaggggagggaaggggaggagaggggaggggaaaggaaaggaagggaagagaaagagaaaaagaaatagctatcatgaggcatgtcgtcacagcattaacccacgtcaagc

SEQ ID NO: 8582 - DNA, 304 bp, Homo sapiens
  chr5.fa.O7frz.77984515
  Located on chromosome 5
  Distance between a terminus base of telomere on chromosomal short arm and 5'-terminus of this base sequence : 71665782
  Distance between 3'-terminus of neighbour sequence of sequence listing upward to telomere on chrosomal short arm and 5'-terminus of this base sequence : 115846
cagtatgctcgttaagagtcatcaccagtccctaatctcaagtacccagggacacaaaaacagcggaaggccgcagggtcctctgcctaggaaaaccagcgacctttgttcacttgtttatctgctgaccttccctccactattgtcctatgaccctgccaaatccccctctgcgagaaacacccaagaatgatcaattaaaaataaataaataaataaataaataaacaactaaaaaataataataaaataaatctgaatatttaatagtattttccctaattgtaaagttaaacgtttaacc

SEQ ID NO: 8583 - DNA, 286 bp, Homo sapiens
  chr5.fa.O7frz.77885625
  Located on chromosome 5
  Distance between a terminus base of telomere on chromosomal short arm and 5'-terminus of this base sequence : 71765784
  Distance between 3'-terminus of neighbour sequence of sequence listing upward to telomere on chrosomal short arm and 5'-terminus of this base sequence : 99698
gtttcaccgtgttagcaaggatggtctcgatctcctgacctcgtgatccacccgcctcggtctcccaaagtgctgggattacaggcgtgagccaccgcgcccggcctctttttgtttttattcttttgtgtgtgtgtgtgtgtgtgtgtgtgtgtgtgtgtgtgtgtgtgtataacaatgaaagagatgaagtaattatacgctacatgagccacagaagcatctctacacgtgtttctaccaatggcagatggtccacagcttttactaggttccgaggttattc

SEQ ID NO: 8584 - DNA, 107 bp, Homo sapiens
  DISD22_0006007
  Located on chromosome 5
  Distance between a terminus base of telomere on chromosomal short arm and 5'-terminus of this base sequence : 71952637
  Distance between 3'-terminus of neighbour sequence of sequence listing upward to telomere on chrosomal short arm and 5'-terminus of this base sequence : 186567
attgctcaaagtctctggccattttaaggttttttgtgtgcatctgtgtgtgtgtgtgtgtgtgtgtgtgtgtgtgtgtgtgtgtttgggttcacatacacatgtgc

SEQ ID NO: 8585 - DNA, 283 bp, Homo sapiens
  DISD22_0006009
  Located on chromosome 5
  Distance between a terminus base of telomere on chromosomal short arm and 5'-terminus of this base sequence : 72078383
  Distance between 3'-terminus of neighbour sequence of sequence listing upward to telomere on chrosomal short arm and 5'-terminus of this base sequence : 125639
agaacagtgacctgatgatatttctttgtacatctggctcttttccaaaaagaaggattaaggggatggggggcggggtgaagagagagagagacagagagagagagagaggaaatcaaaccccttttggtcacctttattttagggcaaagtttgcttcaaatttttgtaaaaatattagataacttctcatcaacaaaaggaacaaacaacgccctccccacacaaaatctgtagttgcaatatgtctactatttctcttttgcttccctgttatcctgtg

SEQ ID NO: 8586 - DNA, 331 bp, Homo sapiens
  chr5.fa.O7frz.80629972
  Located on chromosome 5
  Distance between a terminus base of telomere on chromosomal short arm and 5'-terminus of this base sequence : 72152598
  Distance between 3'-terminus of neighbour sequence of sequence listing upward to telomere on chrosomal short arm and 5'-terminus of this base sequence : 73932
cggttcctagtacagagtctaaggacaagaagaggagcgcctaaaaaggtagttgaaaaaataagccagtccagcatcaaaccaaaagacaaaaataaaataaaataaaataaaataaaataaagcctacattgttaaatgccagcattttcacagctattgagaaggtgaaaaagaagtcttataatagagattttgctaaataggcaacagggcaaaccttattaggttttatgttatatgttaagtcatctaatgggtagggctttattttgatcctcattgatagaagacagatgtctggcatctatctacttggttctacaaccaa

SEQ ID NO: 8587 - DNA, 277 bp, Homo sapiens
  chr5.fa.O7frz.80879707
  Located on chromosome 5
  Distance between a terminus base of telomere on chromosomal short arm and 5'-terminus of this base sequence : 72263224
  Distance between 3'-terminus of neighbour sequence of sequence listing upward to telomere on chrosomal short arm and 5'-terminus of this base sequence : 110295
tttctgacagtacaaagcagtatatataatagagtaaaaaaaaatctccattccttctggatctcagcccactttcttctaaggtaatgtcttatattatggttcttcagggaaacagaatgaataggagattatatatatatatatagtcagattatatattatatattttatatatatatattatatatatatatattagccgggaagttccatgatttgccacctgcaaggtggagaaccaggaaaggtggtggtataattcagttcaagtctg

SEQ ID NO: 8588 - DNA, 415 bp, Homo sapiens
  chr5.fa.O7frz.81187259
  Located on chromosome 5
  Distance between a terminus base of telomere on chromosomal short arm and 5'-terminus of this base sequence : 72445409
  Distance between 3'-terminus of neighbour sequence of sequence listing upward to telomere on chrosomal short arm and 5'-terminus of this base sequence : 181908
tagtgactaagcagatttcatgtattccattcctaaagactcccttagtttgatatttcaataaaatgattagattataaacttcaaacaaatagaaactcttaagaaagtgacaacaaatgtacaaaacatgaaacaagtgaaaaatatgaaatatattctggaaatggtatctataaagtttgttttataaaaagttaaaataataccactaagggatttcttccccttttcttgtgttgaaacacttcagaatacccatgtatataggcatttacaaaaaaaaaaattacatttacaaagggataattggccagcaagctcgattgctctgtgtgtgtgtgtgtgtgtgtgtgtgtgtgtgtgtgtgtgtgtgttggtaggcttgttttatactgagtatccagtggctaat

SEQ ID NO: 8589 - DNA, 267 bp, Homo sapiens
  D5S1982
  Located on chromosome 5
  Distance between a terminus base of telomere on chromosomal short arm and 5'-terminus of this base sequence : 72636829
  Distance between 3'-terminus of neighbour sequence of sequence listing upward to telomere on chrosomal short arm and 5'-terminus of this base sequence : 191005
tctctgggctgctggagtgtgtgtgtgtgtgtgtgtgtgtgtgtttgtgtgtgtcaaaatttttcctgatgcaaatatttatggactttttaaccttcattctcatcttagttatgccttgcccaaactcttttaactgctttaatctttctcataaatcactctatgcctcttcctttttcactgtaatctatcaacctccttcttgtttctcaggtgcccagagtggaagtcacaattgtccagatctgcccccagattctgtct

SEQ ID NO: 8590 - DNA, 101 bp, Homo sapiens
  DISO7_10001882
  Located on chromosome 5
  Distance between a terminus base of telomere on chromosomal short arm and 5'-terminus of this base sequence : 72706376
  Distance between 3'-terminus of neighbour sequence of sequence listing upward to telomere on chrosomal short arm and 5'-terminus of this base sequence : 69280
aactttccagccataagccatctcctaataagcagaggtgtgtgtatgtgtgtgtgtgttcacacgaaaacacagaggatatcacttagtactgtgacacc

SEQ ID NO: 8591 - DNA, 287 bp, Homo sapiens
  DISO7_10001889
  Located on chromosome 5
  Distance between a terminus base of telomere on chromosomal short arm and 5'-terminus of this base sequence : 72909861
  Distance between 3'-terminus of neighbour sequence of sequence listing upward to telomere on chrosomal short arm and 5'-terminus of this base sequence : 203384
gaccagttgatcgtaaacgactgggatgtaaaggctgtttgtgtgtgtgtgtgtgtgtgtgtgtgtgtgtgtgtgtgtgtttaaagacaaggtctcacttcactctgttgcccaggctggagtgcagtggtatgatcattgcagcctcaacctcctgggctcaagtgatactcccactttggcctcccaaaacactgggattataggtgtgagtcatcatgcccagctgccatcatcattagaaagctcccctttaggttagctgaggccctggttgtgacttcatc

SEQ ID NO: 8592 - DNA, 222 bp, Homo sapiens
  DISO7_10016743
  Located on chromosome 5
  Distance between a terminus base of telomere on chromosomal short arm and 5'-terminus of this base sequence : 72981683
  Distance between 3'-terminus of neighbour sequence of sequence listing upward to telomere on chrosomal short arm and 5'-terminus of this base sequence : 71535
tccaagttctagctatctatgcctaaaatggaaaaatgaagaaatagaaatcaagaggtatagtaagttacttagagaagtagaagtaaataccgaaaatatcagctaaatgacttcaaaatggttgcttttggggtgtagaaagtgtgtttgtgtgtgtgtatgtgtgtgtgtgtgtgtgtgtatgtgtgtgtatcaggaaagtggtcacagagctgcttt

SEQ ID NO: 8593 - DNA, 174 bp, Homo sapiens
  chr5.fa.O7frz.82158698
  Located on chromosome 5
  Distance between a terminus base of telomere on chromosomal short arm and 5'-terminus of this base sequence : 73073575
  Distance between 3'-terminus of neighbour sequence of sequence listing upward to telomere on chrosomal short arm and 5'-terminus of this base sequence : 91670
tccagaagcctttctataagagtgtgtgtgtgtgtgtgtgtgtgtgtgtgtgtgtgtgtgtgtgtgtgtgtgtctaaaacattaagtctgtgtcctgaaagaaaaacctttctttttaaattctctcataatacaaatttctgcttttatgttgactatcaagctaaataagca

SEQ ID NO: 8594 - DNA, 358 bp, Homo sapiens
  chr5.fa.O7frz.82074925
  Located on chromosome 5
  Distance between a terminus base of telomere on chromosomal short arm and 5'-terminus of this base sequence : 73144835
  Distance between 3'-terminus of neighbour sequence of sequence listing upward to telomere on chrosomal short arm and 5'-terminus of this base sequence : 71086
ggatttcctttaagtagaactcagtttcaaatataagtcatgcaggccagatgttctggcttgtacccttaatcccagccctttgggagactgaggtgggaggatcccttgaggccaggagtttgagatcagtctaggcaacattggcaagatgaaagagagagagagagagagagacacacacacacacacacacacacacacacacacacacacacacacacacagagagagagaaaatgaattcatgacttctttgttgtaacaccactgtcttcaatcaaaaggtcctaaaacaatagaaaatattatttaaaaaaatatgagtcatgctgttcaggactaaaggagtaaagat

SEQ ID NO: 8595 - DNA, 384 bp, Homo sapiens
  chr5.fa.O7frz.81983208
  Located on chromosome 5
  Distance between a terminus base of telomere on chromosomal short arm and 5'-terminus of this base sequence : 73238173
  Distance between 3'-terminus of neighbour sequence of sequence listing upward to telomere on chrosomal short arm and 5'-terminus of this base sequence : 92980
gacattgaattaacgtaggtacacattcagtggcaggttggataaagaaaatgtagtatatatatatatatatatatatatacataccatggaatagcatgcagctgtacaaaagaacaaactcactcctttgcagcaacatggatgcagctggaggctattatactaagtgaattaacccaggaacataaaaacaaacactgcacgttctcacttataagcgggagctaagcactgggtactcctggacataaagatgggaacaacagacactgcagaccactagagcagggagggagtggggaagaaagggttggaaaactactgggtactatgctcagtacctgggtgatgggatcacttgtatcctaaacctcagcatca

SEQ ID NO: 8596 - DNA, 122 bp, Homo sapiens
  D5S2042
  Located on chromosome 5
  Distance between a terminus base of telomere on chromosomal short arm and 5'-terminus of this base sequence : 73450871
  Distance between 3'-terminus of neighbour sequence of sequence listing upward to telomere on chrosomal short arm and 5'-terminus of this base sequence : 212314
cattctgctttgtgttggagtttgtgtgtgtgtgtgtgtgtgtgtgtgtgtgtgtgtactacctgctacctccccttctagattgtaagttttttgaagtcccccatcacattttacattgg

SEQ ID NO: 8597 - DNA, 131 bp, Homo sapiens
  DISD22_0006013
  Located on chromosome 5
  Distance between a terminus base of telomere on chromosomal short arm and 5'-terminus of this base sequence : 73760385
  Distance between 3'-terminus of neighbour sequence of sequence listing upward to telomere on chrosomal short arm and 5'-terminus of this base sequence : 309392
gtataactgccctgcagatgctgtgcacggggctcagtttggcatggcacggcacggcatggcacggcacagcttgcgtgctgctgcccagagagagagtaatgctggggacccctgtaagggagagccag

SEQ ID NO: 8598 - DNA, 185 bp, Homo sapiens
  D5S2003
  Located on chromosome 5
  Distance between a terminus base of telomere on chromosomal short arm and 5'-terminus of this base sequence : 73838074
  Distance between 3'-terminus of neighbour sequence of sequence listing upward to telomere on chrosomal short arm and 5'-terminus of this base sequence : 77558
tgtactcactctcacagagggtgtgttataatagaaaagttaaggattagagtccttttcattgccaacttttctgatgctgagaactattagaaagttgtgtgtgtgtgtgtgtgtgtgtgtgtgtgtgtgtgtgtgtgttttgagacagtgtctcactttgtcacttaggctggagtgcaatg

SEQ ID NO: 8599 - DNA, 245 bp, Homo sapiens
  Z67270
  Located on chromosome 5
  Distance between a terminus base of telomere on chromosomal short arm and 5'-terminus of this base sequence : 73894369
  Distance between 3'-terminus of neighbour sequence of sequence listing upward to telomere on chrosomal short arm and 5'-terminus of this base sequence : 56110
ccccaaccaacagtgtgttttatcactaaacaccccagcatgaatattattagagttcaggggtgtgtgtgaatgtgtgtgtgtgtgtgtgtgtgtgtgtgtgtgttttctgaggtaacattttcatatagtgaactacaaatcttaaatatgccatttgatgaatgttgacagatacactatcccagaaagttccctcatgcctctctcagtcattcctcactctcaagatgccactactgttc

SEQ ID NO: 8600 - DNA, 440 bp, Homo sapiens
  AC021994.3_123808
  Located on chromosome 5
  Distance between a terminus base of telomere on chromosomal short arm and 5'-terminus of this base sequence : 73929579
  Distance between 3'-terminus of neighbour sequence of sequence listing upward to telomere on chrosomal short arm and 5'-terminus of this base sequence : 34965
agtcataaataccagatggtgaggatcattaggagccattttagtctgtcctccaaagtaagtttggagtggactggggaatttgcatttctaacaagtttcctccatggtgccgataccactgatttaacgaatattttctgtttcttcaccctatccgtttattttgctttgcatctcagtctgaagcttctctaatgcagttccttccttccttcctaccttccttccttccttccttccttccttccttccttccttcctttctttctctctctctctttccttccttccttccttccttccttccttccttctttctttcttttcttttcttttcttttttttgagacggagtgtatctctgttgcccaggctggagtgcagtggtgcagtcttggctcagggcaacctccaccttccaggttctaatgattctc

SEQ ID NO: 8601 - DNA, 300 bp, Homo sapiens
  AC016640.5_31623
  Located on chromosome 5
  Distance between a terminus base of telomere on chromosomal short arm and 5'-terminus of this base sequence : 74063037
  Distance between 3'-terminus of neighbour sequence of sequence listing upward to telomere on chrosomal short arm and 5'-terminus of this base sequence : 133018
gcctacatgaccatatgaatctactcatgctttcatgcaaataatcatgttccatccatgtctgcttaatatggttctttcttttaaatatatgttaatacgtttattggtaaaatgcaattttttgccagctttattgaggtatacttgacaaaattttattttattattattattattattattattattattgttttggagacagagtgtcactctgtcacccaggctggagtacagtggcaccatcttggctcacagcaacctccacctcccaggttcaagcgattcttgtgtatc

SEQ ID NO: 8602 - DNA, 350 bp, Homo sapiens
  AC016640.5_179573
  Located on chromosome 5
  Distance between a terminus base of telomere on chromosomal short arm and 5'-terminus of this base sequence : 74115963
  Distance between 3'-terminus of neighbour sequence of sequence listing upward to telomere on chrosomal short arm and 5'-terminus of this base sequence : 52626
gtagagcaagactcagtctcaaacaacaacaacaacaacaacaacaaaaattctattttgccaaatgaaatggtttttcctttaatggtaaacctttgggagaggaactaaaggaattggcataaaattttctttattaaaagggactttaaaaaaaacccttttatctcatcatgcttactaagggcaggagctacttatctgcccccttagaatagcatttcttatgttaacaactctccttgaagagttctctacccttagattcctaaattcccctctccctctctaagcactcttatggggctcctttgtaggtttccccttctctgcctatcctttaaatgttg

SEQ ID NO: 8603 - DNA, 215 bp, Homo sapiens
  chr5.fa.O7frz.82969936
  Located on chromosome 5
  Distance between a terminus base of telomere on chromosomal short arm and 5'-terminus of this base sequence : 74188920
  Distance between 3'-terminus of neighbour sequence of sequence listing upward to telomere on chrosomal short arm and 5'-terminus of this base sequence : 72607
agtggaaggattgaatgactgtactccagcctgggtgacagagtgagaccctgtctcaaaaaaaaaaaaaatttatatatacacacacacacacacacacacacacacacacacacacaagtacgtgtgtgtatatatgtatatatacatgtgtatgtgtgtgtgtatatatatagttttattcttagatcaactgtttggactttactgttgac

SEQ ID NO: 8604 - DNA, 385 bp, Homo sapiens
  chr5.fa.O7frz.83057796
  Located on chromosome 5
  Distance between a terminus base of telomere on chromosomal short arm and 5'-terminus of this base sequence : 74276975
  Distance between 3'-terminus of neighbour sequence of sequence listing upward to telomere on chrosomal short arm and 5'-terminus of this base sequence : 87840
gaatctgcatgagtctactcaggctgccacgacaaagtacagcagactggatggctcaaaccacagacaattattttctcacagttctggaggctacaagtccaacatcaagatgttggaaaagttcaattcttcttaggcctctctccttggcttatagatggccaccttctccctgccttcacctggtcttccctgtgtgtgtgtgtgtgtgtgtgtgtgtgtgtgtgtcctaatctctcttcttatagggacaccaatcattatcagattggagcccatttatatgacctcattttaccttaattacctctttaaaggccctatctccaaatatagtcaacattctgaggtacttggggttaggacttcaacataggaattt

SEQ ID NO: 8605 - DNA, 242 bp, Homo sapiens
  chr5.fa.O7frz.83234251
  Located on chromosome 5
  Distance between a terminus base of telomere on chromosomal short arm and 5'-terminus of this base sequence : 74453834
  Distance between 3'-terminus of neighbour sequence of sequence listing upward to telomere on chrosomal short arm and 5'-terminus of this base sequence : 176474
caccagattaagcgtgaatctgcctctagaaaatggtagttgggttagccatacacacacacacacacacacacacacacacacacacacacacacacacacacatttctcagattctatggaaaccaaatatggccatttgacagcattctggccaaaaatatgtgagtagaggtctgatggtgcaaattctttcctttctgccttcttcctgcctggactgtgaacatgacctagaagta

SEQ ID NO: 8606 - DNA, 198 bp, Homo sapiens
  HUMUT7783
  Located on chromosome 5
  Distance between a terminus base of telomere on chromosomal short arm and 5'-terminus of this base sequence : 74496748
  Distance between 3'-terminus of neighbour sequence of sequence listing upward to telomere on chrosomal short arm and 5'-terminus of this base sequence : 42672
agagaggtagtaatttacccactgtatcagtcagggttccatgagaagtaagagatctatctgcctatctatctatctatctatctatctatatctatctatctatctatctatctatctatcatctatctgtcatctgtctatctagcatcatcatctatctacctaaggaatagacaagaaattggcttatgtgat

SEQ ID NO: 8607 - DNA, 219 bp, Homo sapiens
  Z67304
  Located on chromosome 5
  Distance between a terminus base of telomere on chromosomal short arm and 5'-terminus of this base sequence : 74777455
  Distance between 3'-terminus of neighbour sequence of sequence listing upward to telomere on chrosomal short arm and 5'-terminus of this base sequence : 280509
acttcctgtttgccatattagtgctttcttttgctcgtgtgtgtgtgtgtgtgtgtgtgtgtgtgtcttgtcttcatgtcctgttgctgctagtgatgagttgtaacatcttcactcaggaaatgatgacatcgttaaatgccttctcagggttctctgatcacactgtacttttctgcttataagggtttccttctctctcaggataaccaaccactg

SEQ ID NO: 8608 - DNA, 213 bp, Homo sapiens
  Z66985
  Located on chromosome 5
  Distance between a terminus base of telomere on chromosomal short arm and 5'-terminus of this base sequence : 74777459
  Distance between 3'-terminus of neighbour sequence of sequence listing upward to telomere on chrosomal short arm and 5'-terminus of this base sequence : -215
cctgtttgccatattagtgctttcttttgctcgtgtgtgtgtgtgtgtgtgtgtgtgtgtgtcttgtcttcatgtcctgttgctgctagtgatgagttgtaacatcttcactcaggaaatgatgacatcgttaaatgccttctcagggttctctgatcacactgtacttttctgcttataagggtttccttctctctcaggataaccaaccac

SEQ ID NO: 8609 - DNA, 395 bp, Homo sapiens
  chr5.fa.O7frz.75171323
  Located on chromosome 5
  Distance between a terminus base of telomere on chromosomal short arm and 5'-terminus of this base sequence : 75037008
  Distance between 3'-terminus of neighbour sequence of sequence listing upward to telomere on chrosomal short arm and 5'-terminus of this base sequence : 259336
aggataaagtctacagcatgtaagaacagatgggcaagtgtcttcattcctgctgctataacaaaatatcttaggctgcgtaacttataaacaacagaaatttaatactcataattttttgaaggctgtgaagtccaaaatcaagggaccagaagatttggtgtctggtgaaggcttgctttctgcttcagagatggcaccttctagctgcaccttgtcatggcagcagggcaaggaagctccctccaaccactttattattattattattattattattattatactttaagttctagggtacatgtgcacaacatacaggtttgatacataggtatacatgtgccatgttggtgtgctgcacccattaactcgtcatttacattaggtatttc

SEQ ID NO: 8610 - DNA, 224 bp, Homo sapiens
  D5S2046
  Located on chromosome 5
  Distance between a terminus base of telomere on chromosomal short arm and 5'-terminus of this base sequence : 75159954
  Distance between 3'-terminus of neighbour sequence of sequence listing upward to telomere on chrosomal short arm and 5'-terminus of this base sequence : 122551
gggaacatcccataaaatacttagcctctcaaatctagtatttgttaatgaggctgtagagttctttgcatgtttctgcatacacaatagaaagacactgagcacacacacacacacacacacacacacacacacacacacaaagacctttataagtcaccgtcacagtattgtaagtaaaaagacacaaactcttgcttatactgggtcagaatctctgcttt

SEQ ID NO: 8611 - DNA, 427 bp, Homo sapiens
  AC008485.3_112306
  Located on chromosome 5
  Distance between a terminus base of telomere on chromosomal short arm and 5'-terminus of this base sequence : 75368474
  Distance between 3'-terminus of neighbour sequence of sequence listing upward to telomere on chrosomal short arm and 5'-terminus of this base sequence : 208296
atcttaaacactgatggctttatttttattctatttaaaaaaataatttttgaggccaggtgcagtggctcacacctgtaatcccagcattttgggaggccaaggtgggcagatcacttgaggtcaggagatcaaaaccagcatggccaatatggtgaaaccccatctctactaaaaatacaaaaattagctgggtgtgatggtgcatgcctgtaatcccagctactagggaggctgaggcaggagaatcgcttgaaactgggaggcagaggttgcagtgagccgagattgtgccactgcactttagcctgggtgacagagtgaaagtgtctcaaaataaataaataaataaataaataaataaataaataaataaataattttcaatgcttaagaattttttatcagtaaacagttcatttgaatt

SEQ ID NO: 8612 - DNA, 458 bp, Homo sapiens
  chr5.fa.O7frz.75520627
  Located on chromosome 5
  Distance between a terminus base of telomere on chromosomal short arm and 5'-terminus of this base sequence : 75494018
  Distance between 3'-terminus of neighbour sequence of sequence listing upward to telomere on chrosomal short arm and 5'-terminus of this base sequence : 125117
tctgttgatacagctcttgaagttatcagacacagacattaacataactataatacaatcaaaaatattgatgaaaagagaactagaatttacaaagaaaatcactgctgtgcatattgtaatatgactataagaggtggggagaaatagagacagggaaaaatagacatacacacacccacagagagagagagagagagagagagagagagagagagattcttcaaagcagcaggaggaagaaaaggaaatagatgcattatcttcagaggaatgacaaaaagactcacaaagtaaaccaggatataatgatatgatacttttaaaggagtaaaagggaacaactgctggtctcaaactctatacccagcaaaagtattcttcaaaaattaagatgatataaagacagttaagataaaaacttatactagaggatgaatcactagcatacctacatt

SEQ ID NO: 8613 - DNA, 482 bp, Homo sapiens
  chr5.fa.O7frz.75596997
  Located on chromosome 5
  Distance between a terminus base of telomere on chromosomal short arm and 5'-terminus of this base sequence : 75570479
  Distance between 3'-terminus of neighbour sequence of sequence listing upward to telomere on chrosomal short arm and 5'-terminus of this base sequence : 76003
ctaagaatccaaacagctgaccacatcacatgttctggcttctttctgttttaaaggaatgagggcaagtgtgtgtgtgtgtgtgtgtgtgtgtgtgtgtgtgtgtgtgtgtgtgtgtgtagaaggcatgttgggctctatagctgcagattcccttcccttgggctctctcagcttctaccagtttgaacaatcccaggaactgcacacaaaagagacagctggctatgaacatcctccccatggggagacagctcccaggtagagctgaagctgcagctgtcatcctcagaaaggagctgtctccctgccagatgtaaagcccagaccttgaccatctcacagcaacctgaatttcatttattgggttagctgggccacaacaggcaaaaagtaaggagaactggccttcctctgctttcctcctagctgtgagcagacacacaggctcccaaagcttgttggaaatgaaggtagacagt

SEQ ID NO: 8614 - DNA, 112 bp, Homo sapiens
  D5S2019
  Located on chromosome 5
  Distance between a terminus base of telomere on chromosomal short arm and 5'-terminus of this base sequence : 75641103
  Distance between 3'-terminus of neighbour sequence of sequence listing upward to telomere on chrosomal short arm and 5'-terminus of this base sequence : 70142
caatgatgggctgaatggccacagtgtatgtaagttaaaacacacacacacacacacacacacacacacacacacacacaaacaaaattctatcctgttcagttgctgtcaa

SEQ ID NO: 8615 - DNA, 144 bp, Homo sapiens
  D5S1967
  Located on chromosome 5
  Distance between a terminus base of telomere on chromosomal short arm and 5'-terminus of this base sequence : 75781646
  Distance between 3'-terminus of neighbour sequence of sequence listing upward to telomere on chrosomal short arm and 5'-terminus of this base sequence : 140431
cccaccctgtgctagatgcctctcctctgatgcacaacaccctatcacactcctcctgactaactcacacacacacacacacacacacactgtactataattgtatgcttttcttcatctgtaggctccaggtccattaggaca

SEQ ID NO: 8616 - DNA, 209 bp, Homo sapiens
  Z67720
  Located on chromosome 5
  Distance between a terminus base of telomere on chromosomal short arm and 5'-terminus of this base sequence : 75843655
  Distance between 3'-terminus of neighbour sequence of sequence listing upward to telomere on chrosomal short arm and 5'-terminus of this base sequence : 61865
ggtcactttgtgctatgacagtctctgtcccagagaaatttacagtgccattttactgaaaatcttttttcaaatatctcaagtaattgggtacacacacacacacacacacacacaccagatacccctgagaagtggcagtcctgttgtgtaagctaacacaattggccagagcattttcttatgctatccagtctttcagttcccat

SEQ ID NO: 8617 - DNA, 224 bp, Homo sapiens
  DISO7_00005250
  Located on chromosome 5
  Distance between a terminus base of telomere on chromosomal short arm and 5'-terminus of this base sequence : 75924284
  Distance between 3'-terminus of neighbour sequence of sequence listing upward to telomere on chrosomal short arm and 5'-terminus of this base sequence : 80420
agtgatgggagccagttcccatcttggtccttaaaaacatccaccaggttcttcctccatctctctctctctctctctctccctctcacacatacacactttgcaatggcagccttgccagccacatgtaccacataacctagttacaagatggaagcagcctagattcccacatcaccacttggagggaagagccaccctggaaagccatctgacccatactg

SEQ ID NO: 8618 - DNA, 241 bp, Homo sapiens
  D5S629
  Located on chromosome 5
  Distance between a terminus base of telomere on chromosomal short arm and 5'-terminus of this base sequence : 76127643
  Distance between 3'-terminus of neighbour sequence of sequence listing upward to telomere on chrosomal short arm and 5'-terminus of this base sequence : 203135
ccggtttgttcctgtgatcaggcacttagataagcatttctgatctactatctctttcagtcagccagatatccttaaatattaatgcttcttttgtgtgtgtgtgtgtgtgtgtgtgtgtgtgtgtgtgagaaagagttttgctcttgttgcccaggctggagtgcaatgacgagatctcggctcactgcaaactccgcctcccgggttcaagcgattctcctgtctcagcctcccgagt

SEQ ID NO: 8619 - DNA, 304 bp, Homo sapiens
  AC010273.3_156905
  Located on chromosome 5
  Distance between a terminus base of telomere on chromosomal short arm and 5'-terminus of this base sequence : 76205736
  Distance between 3'-terminus of neighbour sequence of sequence listing upward to telomere on chrosomal short arm and 5'-terminus of this base sequence : 77852
atctgtaggttttatgctggacataaagcctgcatttactgtcgagccgccctctttctgtgtgtgtgtgtgtgtgtgtgtgtgtgtgtgtgtgtgtgtgtgtgtgtctttctttaaccctcctgttcccttcaaaacctagcaagttctagagacttttcacttattaacacatgtataatcctcccaacaaccctacaatataaatattactattcctactttgcatataaaaaaaaaactgtggcgcagaaaggccaactaactgacccaagatcccacaattactaagtggcagagttgg

SEQ ID NO: 8620 - DNA, 199 bp, Homo sapiens
  AC022107.5_95947
  Located on chromosome 5
  Distance between a terminus base of telomere on chromosomal short arm and 5'-terminus of this base sequence : 76215272
  Distance between 3'-terminus of neighbour sequence of sequence listing upward to telomere on chrosomal short arm and 5'-terminus of this base sequence : 9232
ctaatcacttgcctaaacacaaactttgatgagatttttgcaaatttagtttttgggctatttattattattattattcactgcataatcctttcttagtacagagtcctcatgtagtgtgaacattaatttattctacttatacgaaatgctttttttttttcttttttgagacacagtctcactctgtcaccaggct

SEQ ID NO: 8621 - DNA, 205 bp, Homo sapiens
  DISD22_0006024
  Located on chromosome 5
  Distance between a terminus base of telomere on chromosomal short arm and 5'-terminus of this base sequence : 76442609
  Distance between 3'-terminus of neighbour sequence of sequence listing upward to telomere on chrosomal short arm and 5'-terminus of this base sequence : 227138
gtctaagggtgctcctggggccacaccacacactcctcctcctacgccctctcccttcctctgaccccccaccttctcccttcctctgaccccctcggcttcctgtgcagcctcaccccagccccctaaatacctgtcctctctcctctctgtctctctctgtctctctctctcacacacacacacacaccatctctagtgcctg

SEQ ID NO: 8622 - DNA, 401 bp, Homo sapiens
  chr5.fa.O7frz.83941323
  Located on chromosome 5
  Distance between a terminus base of telomere on chromosomal short arm and 5'-terminus of this base sequence : 76629398
  Distance between 3'-terminus of neighbour sequence of sequence listing upward to telomere on chrosomal short arm and 5'-terminus of this base sequence : 186584
accggtacagatacctatgttacttattaaatgaaagactgagctaacagatttcctgagatcttccaaatatgttggaagtcgatttttgtaatagacattttaatggaaattagttgggtcatatttgtttttttgataccagactatcatattttttttttcagagagaaaaaatgaatttcatattaagtcagaaaagactgaatgcaattgttttctaatcttcaaagaaagataaaaatctgtcttaccctagtatctattatgtgtgtgtgtgtgtgtgtgtgtgtgtgtgtgcgcctggccatgttccttaatgagggcaagatggcaccctgcaccccttcgagcagggccttccttacactcaagtggagaaggactcacctacaagttgt

SEQ ID NO: 8623 - DNA, 368 bp, Homo sapiens
  AC026783.2_13652
  Located on chromosome 5
  Distance between a terminus base of telomere on chromosomal short arm and 5'-terminus of this base sequence : 76747042
  Distance between 3'-terminus of neighbour sequence of sequence listing upward to telomere on chrosomal short arm and 5'-terminus of this base sequence : 117243
aggccttcaaacttatactgagccatgctactggcatcccagcatttccagcttgcagaaggcctgccatgggactcctcagcctccataattgtgtgagccgttgccttaattagtcctgtctcatatctatctatctatctatctatctatctatctatctatctatctatctatctatctgcctgtctatctattctatccattctttcctattggttctctctctctggagaatgctgaccaatatagatttcttccctcattttccttaataacttcatttctcaggtcctgtcagccactggatcccacaaaactctgcagagattttgccacctggactaaggtaactaagctcacatgac

SEQ ID NO: 8624 - DNA, 266 bp, Homo sapiens
  D5S1464
  Located on chromosome 5
  Distance between a terminus base of telomere on chromosomal short arm and 5'-terminus of this base sequence : 76947403
  Distance between 3'-terminus of neighbour sequence of sequence listing upward to telomere on chrosomal short arm and 5'-terminus of this base sequence : 199993
atcccacaacacaacagtcctctttgttgtgtcagattaaaggtcaattaggagaataaaaaagctacacttaacaatgagaaagtatggtagaaatttgttcattcaaaaacatatatatatattcaaaaacatatatatatcaaaaacatatatatatttgaatgaacaaaacagatagatagatagatagatagatagatagatagatagatagatagatagatagatagattaacagggtcttgctccattgtccaggctgg

SEQ ID NO: 8625 - DNA, 395 bp, Homo sapiens
  AC016562.4_57655
  Located on chromosome 5
  Distance between a terminus base of telomere on chromosomal short arm and 5'-terminus of this base sequence : 77190421
  Distance between 3'-terminus of neighbour sequence of sequence listing upward to telomere on chrosomal short arm and 5'-terminus of this base sequence : 242752
tcaggatgaattcataattcttaggctggctttcaagaattagtcattgcttatttctgtagcctctaccacttttccaaaaacatcctactaccctgacacacacacacacacacacacacacacacacacacacactacggcactactgaattttttgcttctagaaactatcacagcctcactggacttcttccaagcacaaaattggcgctatgccaaaagccctgtttgcttttctggcagggtttaccttgcccactgccttatacagtgcctggcacagagcaggatgctgaaaaaagtagttaatgaataaatgaataataagtgaatttaaacttttttttaatcttgtttttgagggaggtatttattggaacttggaaattgat

SEQ ID NO: 8626 - DNA, 390 bp, Homo sapiens
  AC016562.4_166552
  Located on chromosome 5
  Distance between a terminus base of telomere on chromosomal short arm and 5'-terminus of this base sequence : 77226793
  Distance between 3'-terminus of neighbour sequence of sequence listing upward to telomere on chrosomal short arm and 5'-terminus of this base sequence : 35977
gcttgaacaggagttctagaacagcctgggcaatgcagagagaccttgtctgtacaacaaatttaaaaattagctgggcatggtggcacacgcctgtagtcctagctactaggagtttgaagctgccatgtgctatgatcacaccagtgcactccagcctgggcaatagagtaagaccctgttgagagagagagagaaagagagagagagagagagagagaggtagaaggaagagagggaaggagggaagaaacaaagagaatgaaatcactatttttgtaagtcaaaggtgactgctggcaacattatatggttcaaccatgcaataatttcagtttttgcatcccatgctacagactgcttatgtgttaacacgaactaacatgtatt

SEQ ID NO: 8627 - DNA, 405 bp, Homo sapiens
  chr5.fa.O7frz.90309862
  Located on chromosome 5
  Distance between a terminus base of telomere on chromosomal short arm and 5'-terminus of this base sequence : 77270566
  Distance between 3'-terminus of neighbour sequence of sequence listing upward to telomere on chrosomal short arm and 5'-terminus of this base sequence : 43383
gttcctaaagcaagtgaggtaggaaaagatgcctccaccagaactaaagcttgtccatgtgacaggcatagaaagacctcaacccccaggtcattatgccctaacctgtcccctactattagggttttccagagaattagaaccaataaggtgcatgtgtgtgtgtgtgtgtgtgtgtgtgcatgtgtgtgtgtctgtgtgtatgtgagtggagaaagagagagagagggagaggtttagtttaaggaattggctaatgcaattatggagcttgacaagttcagtatctgttgggtaggccataaagctggagatctagggaagagcagatgttgcaggtgaaggccgcctgctggaagaattctcttgcctcagggaggtcagtctttgttctattcaagcctt

SEQ ID NO: 8628 - DNA, 397 bp, Homo sapiens
  chr5.fa.O7frz.90425290
  Located on chromosome 5
  Distance between a terminus base of telomere on chromosomal short arm and 5'-terminus of this base sequence : 77387884
  Distance between 3'-terminus of neighbour sequence of sequence listing upward to telomere on chrosomal short arm and 5'-terminus of this base sequence : 116913
ttagcaacattcaccaagtaagtgattttatttctagctcagttcctttgctcaagtggctctccttctgaaaacagctcagggcaaagatgtttatatatatatatatataaacatatatatatataaacatataaacatatatatatgtgtatatatatatatatatatatatatgcaccattcaatggtggctgcctaacttggctttgcatcagaattgctgggagaaattttttaaaacacactactgttcacctgccctagggattctaatggggtagatctgggtggggccaagtctcaggaactatttattaactccccaggtgattctgctgagcagtttcagccagtgctggacttgcagcaagtgtttggtaatttctcaggaaat

SEQ ID NO: 8629 - DNA, 128 bp, Homo sapiens
  D5S2029
  Located on chromosome 5
  Distance between a terminus base of telomere on chromosomal short arm and 5'-terminus of this base sequence : 77621547
  Distance between 3'-terminus of neighbour sequence of sequence listing upward to telomere on chrosomal short arm and 5'-terminus of this base sequence : 233266
aagaattgcacagtgatggcctaagaagagaaatagctcaatagagaagattagagaataaacacacacacacacacacacacacacacacacacacacagaggtatggtgacatttaaagtcaatgg

SEQ ID NO: 8630 - DNA, 197 bp, Homo sapiens
  G08462
  Located on chromosome 5
  Distance between a terminus base of telomere on chromosomal short arm and 5'-terminus of this base sequence : 77657561
  Distance between 3'-terminus of neighbour sequence of sequence listing upward to telomere on chrosomal short arm and 5'-terminus of this base sequence : 35886
tccaatggttaattgcatccttctctgattataccttacctctctgtcccattattttctttctttctttctttctatctatctatctatctatctatctatctatctatctatctatctatctatctctatagataaaatgatttgttcaaccaaactaagttctttttactgtatcacattcagcagttcaggtg

SEQ ID NO: 8631 - DNA, 196 bp, Homo sapiens
  D5S626
  Located on chromosome 5
  Distance between a terminus base of telomere on chromosomal short arm and 5'-terminus of this base sequence : 77786926
  Distance between 3'-terminus of neighbour sequence of sequence listing upward to telomere on chrosomal short arm and 5'-terminus of this base sequence : 129168
atcataatgctagggacccttccagggccatggaaggagcctgtataaatgtgtgtgtgtgtgtgtgtgtgtgtgtgtgcattattttttatatcaacttttattttagattcagagagtacatgtgcaggtttgttacatgggtaaattgcgtgttgtggggtttgatgtatgaatgatcccgtcacccaggtag

SEQ ID NO: 8632 - DNA, 191 bp, Homo sapiens
  D5S620
  Located on chromosome 5
  Distance between a terminus base of telomere on chromosomal short arm and 5'-terminus of this base sequence : 77837121
  Distance between 3'-terminus of neighbour sequence of sequence listing upward to telomere on chrosomal short arm and 5'-terminus of this base sequence : 49999
tttattgctttgagttttgcgtgtgtgtgtgtgtgtgtgtgtgtgtgtgtgtgtggcattagcatggtgagcagtagcaaagagaaggctcttaaggagtttatacttttctgagacagtgagggcttccttaccttgagcccacattgactctcaccttcaggagcctgaggaaaatccaggcttaatgt

SEQ ID NO: 8633 - DNA, 167 bp, Homo sapiens
  DISO7_10001899
  Located on chromosome 5
  Distance between a terminus base of telomere on chromosomal short arm and 5'-terminus of this base sequence : 77909965
  Distance between 3'-terminus of neighbour sequence of sequence listing upward to telomere on chrosomal short arm and 5'-terminus of this base sequence : 72653
ggccaagttggtttctagggagttaaaactcacctatacagttatttttatgtagttatgtgtgtgtgtgtgtgtgtgtgtgcgcgcgcgtgtgtgtgtgtgttacagttttctcacctgtaaaattgacttagtaattatctgcttcaaactctcattatctcatc

SEQ ID NO: 8634 - DNA, 212 bp, Homo sapiens
  D5S2067
  Located on chromosome 5
  Distance between a terminus base of telomere on chromosomal short arm and 5'-terminus of this base sequence : 77974670
  Distance between 3'-terminus of neighbour sequence of sequence listing upward to telomere on chrosomal short arm and 5'-terminus of this base sequence : 64538
ttggagaatgatttgccatatttgcacacacacacatatatatgtgtgtgtgtgtgtgtgtgtgtgtgtgtgtgtgtgtgtatagagagagagagagagggagagagagagagaaacaaatatatatattttccaagaagaaaaaaatataattttttccaagaagtatattttcttggaagattttccaagaaggactgtggcatgttggg

SEQ ID NO: 8635 - DNA, 477 bp, Homo sapiens
  AC026782.3_42598
  Located on chromosome 5
  Distance between a terminus base of telomere on chromosomal short arm and 5'-terminus of this base sequence : 78036523
  Distance between 3'-terminus of neighbour sequence of sequence listing upward to telomere on chrosomal short arm and 5'-terminus of this base sequence : 61641
catgttgagtggcttaaactacaaacatttatttctcacctttatggaagctgaaagtccaagattgaggtggcaacatagttgagttcttggtgagggaccttccctggtttctagatggctggttttttgctgtatcctcccatggaggggagtgggagagacagagaggggggagagagagagagagagagagagagaaagagagagagatcactttggtctttccatgctctttaagggcaccaatctcatcaaaggtgccccacctccatgacctcctctaaacccaattacctcccaaaggccccacccgtcacactggggattaggacttcaacatagcattttgggggtcacaaatattcagtccacagcactttccattggaaagtagtagagacattaaacttaatcagtttgtgaatctgagtgttactgtttctcttgtgtctcagtttcctcatctttagaata

SEQ ID NO: 8636 - DNA, 97 bp, Homo sapiens
  D5S2083
  Located on chromosome 5
  Distance between a terminus base of telomere on chromosomal short arm and 5'-terminus of this base sequence : 78050406
  Distance between 3'-terminus of neighbour sequence of sequence listing upward to telomere on chrosomal short arm and 5'-terminus of this base sequence : 13406
cagcagtttgaatacagcaaatgaaggggtgtgtgtgtgtgtgtgtgtgtgtttatcttgctgggttttctatggccatcatgtacttgcatttggt

SEQ ID NO: 8637 - DNA, 267 bp, Homo sapiens
  D5S641
  Located on chromosome 5
  Distance between a terminus base of telomere on chromosomal short arm and 5'-terminus of this base sequence : 78167135
  Distance between 3'-terminus of neighbour sequence of sequence listing upward to telomere on chrosomal short arm and 5'-terminus of this base sequence : 116632
agttgtgtattggagaatgttatcaggaataacacatttgagacacacacacacacacacacacacacacacacacacacacacacacagagcagaattgcacagagggagaggttaacctgcaaagcgatgccaatattggacttctcaaacaatgccatggagagatttgaggttgagatggcctttctgagacatcctaaatggaacaagcaggctggcctttacatacctacactgaccagtcactggaagtggactgtccct

SEQ ID NO: 8638 - DNA, 241 bp, Homo sapiens
  chr5.fa.O7frz.91580268
  Located on chromosome 5
  Distance between a terminus base of telomere on chromosomal short arm and 5'-terminus of this base sequence : 78258343
  Distance between 3'-terminus of neighbour sequence of sequence listing upward to telomere on chrosomal short arm and 5'-terminus of this base sequence : 90941
atagacagccacagtatgtaagactagatctgtgcttaagccagagaaaagaccctcctctgtttcagcagccttcctttctatagaggtagtggaatggaataaactcttcaatatctttttatctatgtttatctatctatctatctatctatctatctatctatctatctatctatctatccatccatccatccatccatagcttctcagccttttggctaagatcagtgtatttatc

SEQ ID NO: 8639 - DNA, 122 bp, Homo sapiens
  D5S424
  Located on chromosome 5
  Distance between a terminus base of telomere on chromosomal short arm and 5'-terminus of this base sequence : 78440304
  Distance between 3'-terminus of neighbour sequence of sequence listing upward to telomere on chrosomal short arm and 5'-terminus of this base sequence : 181720
gggtacatgggagttcattaggctactctacttttctatatatttgaaattctacctaataaagtttacacacacacacacacacacacacacgcacactccttatccctgccagcatgaga

SEQ ID NO: 8640 - DNA, 381 bp, Homo sapiens
  chr5.fa.O7frz.85036607
  Located on chromosome 5
  Distance between a terminus base of telomere on chromosomal short arm and 5'-terminus of this base sequence : 78763777
  Distance between 3'-terminus of neighbour sequence of sequence listing upward to telomere on chrosomal short arm and 5'-terminus of this base sequence : 323351
attcatccagtttaaatttaggactacaagccttttcttcaacctcgtcagtcttacgtttctatttcctctttcccatgacataaatcctggttcttaacatcatcatgataattcctcatttgttagatcccacatgcgcgtgcacacacacacacacacacacacacacacacaccccacgcacacatctcagaataccagtgatcaacacgacttcatgatcaatatgaacactgaaaacagtttgatttttttccagtgatttttgatattagggtctgtcccactaggggtgagcaggcaaattactgtgtttataattgtttaaatcagttcttttttatgtggctattctactaacaatggaccagttagtga

SEQ ID NO: 8641 - DNA, 420 bp, Homo sapiens
  chr5.fa.O7frz.85148160
  Located on chromosome 5
  Distance between a terminus base of telomere on chromosomal short arm and 5'-terminus of this base sequence : 78873426
  Distance between 3'-terminus of neighbour sequence of sequence listing upward to telomere on chrosomal short arm and 5'-terminus of this base sequence : 109268
ttaactttgctctgtaaatcaaacagaaagtatttcccttatgtgtatgtttatggcttcctctccttccttagctcttcccagcttccacgtaagaattgtggaggaccagaggcccagggaaagccagggagaagccaaccactccagatatgtggagccaaccactccagtgtatatgtggggtgtgtgtgtgtgtgtgtgtgtgtgtgtgtgtgagagagagaggaaggagtgaggagagggattgatttttttctctggccaacttgggtgaaggaaatctaagaaatacatctttcagcagggcctagtattctcctcctccacttatatagctaccggagaagcaaaagtatgtgactagtagtttggaatactttggaattctgcttatctttctacttaatagtttgccag

SEQ ID NO: 8642 - DNA, 226 bp, Homo sapiens
  D5S2041
  Located on chromosome 5
  Distance between a terminus base of telomere on chromosomal short arm and 5'-terminus of this base sequence : 78916005
  Distance between 3'-terminus of neighbour sequence of sequence listing upward to telomere on chrosomal short arm and 5'-terminus of this base sequence : 42159
tgggactcctcagccaccataatcatgtgagccaatttatataataaactcagctcgcttgctcgctctctccctctctctctacacacacacacacacacacacacacacacacacacacaccccctgttggttctttgtctagagaatgctaatatagcaggtgttggtcgccatttaccaatgacgaaactgagacttagtaaagctctgtaagttccccagg

SEQ ID NO: 8643 - DNA, 199 bp, Homo sapiens
  D5S1962
  Located on chromosome 5
  Distance between a terminus base of telomere on chromosomal short arm and 5'-terminus of this base sequence : 79050352
  Distance between 3'-terminus of neighbour sequence of sequence listing upward to telomere on chrosomal short arm and 5'-terminus of this base sequence : 134121
gattgtaatgtgccccacaaagttaagaaaagccatggtctgtaattacatggggtgagtgagagagagagagagagagagtgagtgtgtgtgtgtgtgtgtgtgtgtgtgtgtgtgtgtgtgtgtgtgtatgatgggggcagtcaggaagagagggtgagaaattaaaagtctttggacataaaattcgtcaggcggg

SEQ ID NO: 8644 - DNA, 197 bp, Homo sapiens
  DISD22_0006027
  Located on chromosome 5
  Distance between a terminus base of telomere on chromosomal short arm and 5'-terminus of this base sequence : 79261691
  Distance between 3'-terminus of neighbour sequence of sequence listing upward to telomere on chrosomal short arm and 5'-terminus of this base sequence : 211140
aacaaagcagtaattcttgatctcaaatagtttatagaaaagaaaaatacacacacacacacacacacacaacaaatccaagtgtttatttttaaaattccaaataagggtacagaacaaatttcactttttattttcaatatatcattttatattaaatcatttattatctttgctacaaccaaatagatgctcta

SEQ ID NO: 8645 - DNA, 169 bp, Homo sapiens
  AC022493.12_135908
  Located on chromosome 5
  Distance between a terminus base of telomere on chromosomal short arm and 5'-terminus of this base sequence : 79390212
  Distance between 3'-terminus of neighbour sequence of sequence listing upward to telomere on chrosomal short arm and 5'-terminus of this base sequence : 128324
tgaggttctgtctttggacttctttcagttgatatagtcttgtcaattttttatttacacacacacacacacacacacacacacacacacacacacacccatatgtatgtcattggttttgtcaaaaagcctgaaaatgcaaattctgcttgtaaatattggtagagga

SEQ ID NO: 8646 - DNA, 184 bp, Homo sapiens
  AC022493.12_134529
  Located on chromosome 5
  Distance between a terminus base of telomere on chromosomal short arm and 5'-terminus of this base sequence : 79391632
  Distance between 3'-terminus of neighbour sequence of sequence listing upward to telomere on chrosomal short arm and 5'-terminus of this base sequence : 1251
ttaaggctgaatagtattccagagtgtgtgtgtgtgtgtgtgtgtgtgtgtgtgtgtcacatttaaaaaatctattcatctattggtggacactttggttgtttccatatcttgataattgtgaataatgtggcagtgaacatagggagtacagatatttcttcaacatactgatttcaattcc

SEQ ID NO: 8647 - DNA, 262 bp, Homo sapiens
  DISO7_11075109
  Located on chromosome 5
  Distance between a terminus base of telomere on chromosomal short arm and 5'-terminus of this base sequence : 79607559
  Distance between 3'-terminus of neighbour sequence of sequence listing upward to telomere on chrosomal short arm and 5'-terminus of this base sequence : 215743
ccatatggatttgctcaagtcttaaattctacttttcacaggtttaaagtggctttctatttttatacctatttatttgttctacaagaaagggatatatgtttgtgtgtgtgtgtgtgtgtgtgtgtatgtgtgtgtgtggtgtttattcagtttgttacccttctactattttctaccgttgaatattaaacctttgttaggcggttatatattggagtttgcagattttgatttgtacattaacatttcaagacctgag

SEQ ID NO: 8648 - DNA, 115 bp, Homo sapiens
  D17S1288
  Located on chromosome 5
  Distance between a terminus base of telomere on chromosomal short arm and 5'-terminus of this base sequence : 79802285
  Distance between 3'-terminus of neighbour sequence of sequence listing upward to telomere on chrosomal short arm and 5'-terminus of this base sequence : 194464
gccactgcaccactgcactccagcctgggtgacagagcaagactctgtctcaaaaataataataataataataataataataataataataagtcaaccaggtatggtggcatgt

SEQ ID NO: 8649 - DNA, 333 bp, Homo sapiens
  chr5.fa.O7frz.89769452
  Located on chromosome 5
  Distance between a terminus base of telomere on chromosomal short arm and 5'-terminus of this base sequence : 79892422
  Distance between 3'-terminus of neighbour sequence of sequence listing upward to telomere on chrosomal short arm and 5'-terminus of this base sequence : 90022
tagagcatatggtctgtcaaatagctggaagaagacatccctgctgctgtttattttttatcatagcatattaacagagaaaaggcatggaattcagaaagtttagacattatgtctaaaactacccagattttcccaagcaatatgaagaaaaaagcaaagcaagaaatagaaaacacacacacacacacacacacacacacacacacacacagaaagagagagagagagacagagacaccggaaagagaggctatggctcctgcagttctcttgcccattgacccctatgttgtggctcagggtcatcctatgaagctatctaatccagct

SEQ ID NO: 8650 - DNA, 342 bp, Homo sapiens
  chr5.fa.O7frz.88992699
  Located on chromosome 5
  Distance between a terminus base of telomere on chromosomal short arm and 5'-terminus of this base sequence : 79994474
  Distance between 3'-terminus of neighbour sequence of sequence listing upward to telomere on chrosomal short arm and 5'-terminus of this base sequence : 101719
taggaatctaactgcttatctgacagcttttcacctactcctccttattttagctgtattcttcacacacacacacacacacacacacacacacacacacacacacacacacacacacacacgctgagtcagttactactggctcatctgctttctggcttccaaaatattgttgctgccatcttctcctcttccctctgtctttaattttgtctttgacaaaattctttggttttaaggattttcaggaagaagcaaaattagatgtgtgtgttctgccatattaaccctaactatctgctaaaatattttcctgaagtttggttgtaaccaagtaaataa

SEQ ID NO: 8651 - DNA, 176 bp, Homo sapiens
  HUMUT6142
  Located on chromosome 5
  Distance between a terminus base of telomere on chromosomal short arm and 5'-terminus of this base sequence : 80062086
  Distance between 3'-terminus of neighbour sequence of sequence listing upward to telomere on chrosomal short arm and 5'-terminus of this base sequence : 67270
cctccagcctgtgttacagagggagaccctgtcttaaaaaagaaagaaagaaagaaagaaagaaagaaagaaagaaagaaagaaagaaagaaagaaagaaagaaagaaaagaaagaaagaaaaagaaagaaagacagaaagaaagaaaatctgctgttagtgcagctactttcatc

SEQ ID NO: 8652 - DNA, 228 bp, Homo sapiens
  DISO7_10001894
  Located on chromosome 5
  Distance between a terminus base of telomere on chromosomal short arm and 5'-terminus of this base sequence : 80226883
  Distance between 3'-terminus of neighbour sequence of sequence listing upward to telomere on chrosomal short arm and 5'-terminus of this base sequence : 164621
tttgatgcacatgttagaagtgttaatataaccttttaaaaaatagctactcgggaggctgaggcagaagaatggcgtgaacccgggaggcagagcttgcagtaagccaagatcacgctactgcacttcagcctgggtgacagagtgagactcggtctcaaaaataaataaataaataaataaataatttttaaaaatagttttcatcaataaactcagtgttcagaa

SEQ ID NO: 8653 - DNA, 336 bp, Homo sapiens
  AC026410.2_79030
  Located on chromosome 5
  Distance between a terminus base of telomere on chromosomal short arm and 5'-terminus of this base sequence : 80305260
  Distance between 3'-terminus of neighbour sequence of sequence listing upward to telomere on chrosomal short arm and 5'-terminus of this base sequence : 78149
agatcctatttctagatcaccaagattttcctcaatgaaaacccatgtatgtatgtatgtatgtatgtatgtatgtatgtatgtatgtatgtatgcatgtatgtatttaaagatgggatctagctcttgcccaggctggattgcagtggctcaatcatagctcactgcagcctccaactcctggggtcaagcaatctttctgcttcagcctcccaagtagctgggactacaggtgcgttctaccatgcctggccagtttttaaaaatttttgtagagactgggtctggctttgctgcccaggctagtaaaactcatttctgatgtccgttatgtta

SEQ ID NO: 8654 - DNA, 257 bp, Homo sapiens
  chr5.fa.O7frz.88068864
  Located on chromosome 5
  Distance between a terminus base of telomere on chromosomal short arm and 5'-terminus of this base sequence : 80658088
  Distance between 3'-terminus of neighbour sequence of sequence listing upward to telomere on chrosomal short arm and 5'-terminus of this base sequence : 352492
gtctattcagaaatcattaagcacttccaaggaaaaaagccctatttgccaggctcaactctatatatttctgtcttttcctagatcatagaaaaataattcttaactaccttattagctctctgatattttaaagtgtgtgtatgtgtgtgtgtgtgtgtgtgtgtgtgtgtgtgtgtgtgtgtgtgtgtgtgtattttttcatccagcttttctgtttgccctcagtcaaaggcttggttcaaattacctagtcc

SEQ ID NO: 8655 - DNA, 110 bp, Homo sapiens
  DISD22_0006030
  Located on chromosome 5
  Distance between a terminus base of telomere on chromosomal short arm and 5'-terminus of this base sequence : 80731579
  Distance between 3'-terminus of neighbour sequence of sequence listing upward to telomere on chrosomal short arm and 5'-terminus of this base sequence : 73234
caagcactgtgccttacatccatacacacacacgcatgcacacacacacacacacacacacacacacatattacacacccaaagaaaacacatccagaatagaagcaatg

SEQ ID NO: 8656 - DNA, 454 bp, Homo sapiens
  chr5.fa.O7frz.86089356
  Located on chromosome 5
  Distance between a terminus base of telomere on chromosomal short arm and 5'-terminus of this base sequence : 80934727
  Distance between 3'-terminus of neighbour sequence of sequence listing upward to telomere on chrosomal short arm and 5'-terminus of this base sequence : 203038
ctgagcataggagttcaagaccagcctgggcaacatggcaaaacctcgtctccacaaaaaaagtccaaaaattagctggatgtggtggcagaggttgcattgagccaacactgtaccactgcactccagcctgggcaatgaagtgagactctgtctcaaaaataaataaataaataaataaataaataaataaataaataaataaaggtggttaaagaaaaacaccactgttactgcagaattttatatccagcaaaaatacccttcaagaatgaagacaaaataaaggggttttcaaataaacacaatggaacactaagaaatgcaataccttataaaatataatatcttgttaattgcaactgaactgattaacagtgtttatttaagatataaacttactttgctcttttaatattcccaacttttctgctacttcatttcacttcagctg

SEQ ID NO: 8657 - DNA, 436 bp, Homo sapiens
  chr5.fa.O7frz.86217963
  Located on chromosome 5
  Distance between a terminus base of telomere on chromosomal short arm and 5'-terminus of this base sequence : 81063288
  Distance between 3'-terminus of neighbour sequence of sequence listing upward to telomere on chrosomal short arm and 5'-terminus of this base sequence : 128107
aaaggatcctcatacatcctagatgccagttccaggtaccacaagttgctgaaaatttcctgatgcagggaaaggatggggaaatgggttccctgagaccataagacagacagacagacctacagacacacacacacacacacacacacacacacacacacacacacttacttatataaacattattccccttgatctgtgtgtaaatattttaaaattttcagtaaggaggtggggatggagagaacgtgatttactacataaggcctggttttcttcatggcaaaggcacctggctgcatggctgttccgggtcaagtcctgggattgagcctcactcctgcactgtggcactggccaggtcttctcaggctatacgtatttttaacatattaaacatttttcctcagaagtaagaatggttagtttccttctc

SEQ ID NO: 8658 - DNA, 332 bp, Homo sapiens
  chr5.fa.O7frz.86299547
  Located on chromosome 5
  Distance between a terminus base of telomere on chromosomal short arm and 5'-terminus of this base sequence : 81143902
  Distance between 3'-terminus of neighbour sequence of sequence listing upward to telomere on chrosomal short arm and 5'-terminus of this base sequence : 80178
agaagcttgaggttctagttctatacatcttacattaaataaataaataaataaaggcaaatgtgaatatcaacttaatcctagtggtagatatacacatatgtatttatgctattatgtacttttccataggtttgcaatatttcataactaaaaatcaaaatgagctaagaaaaacattaacttatagcacttatcactacatttaaaagatgacatactattagagtttaaaatcaaaagcatcttttattcattaacttttaaattgttattaatttgtttaattaaatcctttcttcctcaaacttcagtagactatttcaacgaac

SEQ ID NO: 8659 - DNA, 461 bp, Homo sapiens
  chr5.fa.O7frz.85860873
  Located on chromosome 5
  Distance between a terminus base of telomere on chromosomal short arm and 5'-terminus of this base sequence : 81199799
  Distance between 3'-terminus of neighbour sequence of sequence listing upward to telomere on chrosomal short arm and 5'-terminus of this base sequence : 55565
aatgctcaacactaatgatcagggaaatgcaaatcaaaaccacaatgcaataaccaccttattcctgcaagaacgatcaaaatctaaaaataaaaaaataatagatgttggtgtgcatgtggtgaacagggaacaacttctacactgctgctgggaatgtaaactagcacattcgtgtggagattccttaaagaactaaaagtaggactaccatttgatccagcaattcctattgggtatctacccagaggaaaagacgtcattatatgaaaaagatacttgcacacatttatagcagcacaattcacaactgcaaaaatgtggaaccaacccgaatgtccatcaatcaacaagtggataaactgtggcatgcatatatatatatatatatatatatatatatatatatatatatatgatggaatactactcagccacaaatagcaaagagttaatggcat

SEQ ID NO: 8660 - DNA, 192 bp, Homo sapiens
  DISD22_0006040
  Located on chromosome 5
  Distance between a terminus base of telomere on chromosomal short arm and 5'-terminus of this base sequence : 81377054
  Distance between 3'-terminus of neighbour sequence of sequence listing upward to telomere on chrosomal short arm and 5'-terminus of this base sequence : 176794
gcctgacaaacttcacctgttttgttaaagcataatcattatatatatatatgtatatgtatatatatatgtgtgtgtgtgtgtatatatatatatatatatacatatatatatatatatgtatatatatatacatatatatatatatatatgtatatatatatgtattccaccaggactttaactagattc

SEQ ID NO: 8661 - DNA, 342 bp, Homo sapiens
  chr5.fa.O7frz.108850287
  Located on chromosome 5
  Distance between a terminus base of telomere on chromosomal short arm and 5'-terminus of this base sequence : 81510347
  Distance between 3'-terminus of neighbour sequence of sequence listing upward to telomere on chrosomal short arm and 5'-terminus of this base sequence : 133101
ctaaaatcatgtagccatgattagagctgcccctgggcaaacctatgaagtacaaaatatttttcttagttaatatccattttccctttgctgctactctttcccagtccacagactggacccagcaattccagaacatatttagtctaccttctctggataagaatttaatcagcgattctcaattgaaaggctagtactcaacccctaaatatccctcacatgttcacacacacacacacacacacacacacacacacacacacatacaattttgcatataatttcaagtaacttacaaaattttccctgaagtcagtctaggttaagaactcatttcaa

SEQ ID NO: 8662 - DNA, 400 bp, Homo sapiens
  chr5.fa.O7frz.109002543
  Located on chromosome 5
  Distance between a terminus base of telomere on chromosomal short arm and 5'-terminus of this base sequence : 81567006
  Distance between 3'-terminus of neighbour sequence of sequence listing upward to telomere on chrosomal short arm and 5'-terminus of this base sequence : 56317
agctctaggagtatcacctcactacaaatggataaaatagcaatcaatcatacagtaattttttacactggcatgttaaatctgtataatagtcaaaaatatgaatatcatgtttctatataatattttattagaatattcttttctacagatcctggtaagtttttgttccaactcatactcactgttttgttttgttttgttttgttttgtgacattgccaaaatatatactgttacccatataaggtaaaatggccctgtgtataaaataccacgtggtgaatgcttgcatttcaattaaaaccagatctcatgacatctttatgcatctgagccccagccatctgagggtagccatgtcaacctcctacactcttgatcagtgtaagctcatctat

SEQ ID NO: 8663 - DNA, 222 bp, Homo sapiens
  D5S2079
  Located on chromosome 5
  Distance between a terminus base of telomere on chromosomal short arm and 5'-terminus of this base sequence : 81866127
  Distance between 3'-terminus of neighbour sequence of sequence listing upward to telomere on chrosomal short arm and 5'-terminus of this base sequence : 298721
ttggcaaatgtttgaaaaggaaggacctttgctctatgcctctagtgctatataatatctactggacagttagaattctgttctataattgagactgttatgaactataagtgcgtgcgcacgtgcgcgcgcacacacacacacacacacacacacacacagacttcggtacctaaaatataaattttaaatgtaaagtacacaaaaacatgccatattccc

SEQ ID NO: 8664 - DNA, 345 bp, Homo sapiens
  chr5.fa.O7frz.109359285
  Located on chromosome 5
  Distance between a terminus base of telomere on chromosomal short arm and 5'-terminus of this base sequence : 81957407
  Distance between 3'-terminus of neighbour sequence of sequence listing upward to telomere on chrosomal short arm and 5'-terminus of this base sequence : 91058
ctcactttaatgctataacctgaggaaactgaagatcagaagcatgaggagagacatttttatgtacttgtttctcttagttaaaagatgagttccctcaaccttggttttcccacgcaggtttgtctctgcctcagagatgaattgaagaattattctcaccagcagcaggtgtagttagtcagtttaccaacatatttgttatatcacgagaatactttggtcgtcagtaatcattttttatgatccacttactgaccaaccagagattcactaaatacacacacatgcacacacacacacacacacacacacttgcaaagctacaaatcaggttctatggtg

SEQ ID NO: 8665 - DNA, 416 bp, Homo sapiens
  AC026778.2_28536
  Located on chromosome 5
  Distance between a terminus base of telomere on chromosomal short arm and 5'-terminus of this base sequence : 81985143
  Distance between 3'-terminus of neighbour sequence of sequence listing upward to telomere on chrosomal short arm and 5'-terminus of this base sequence : 27391
ttgactgaagtaaagtctaaggaaaagaaggaatttgtaatttggagtaatttttaatttttctttcttcataaccacatccaatctattactaattcttttagactcaccttcaataaatatcccaaatccagaaacttttcaccattttgaaaccatcttaatctcctatctgggttaatagtctctctctctctctctctctctctctctctctctctctctctctctctctctctctctctctctcttttaagacagggtctcactctgtcgcccaggctggggtacagtggagcagtcttggcttacggcagcctccatctcctggactcaagagatcatccctttatttcactgtatactaaaattaactcaagatagattaaagactcttaaacgtaagacctgtaaca

SEQ ID NO: 8666 - DNA, 225 bp, Homo sapiens
  DISD22_0006045
  Located on chromosome 5
  Distance between a terminus base of telomere on chromosomal short arm and 5'-terminus of this base sequence : 82060542
  Distance between 3'-terminus of neighbour sequence of sequence listing upward to telomere on chrosomal short arm and 5'-terminus of this base sequence : 74983
aatatgaagaccgacatgagagagagaactgaattgactaaatatcttgggaaccatgtattttatcaggatatatatatatatatatatatgactcacaactccaaaatggacctaatattaagctttttattaaaaacttaactttataaaaaatatatatagacaaaagaaaattgccaaaagttctggcactattttggagccataaatcataactgtaag

SEQ ID NO: 8667 - DNA, 449 bp, Homo sapiens
  chr5.fa.O7frz.86419251
  Located on chromosome 5
  Distance between a terminus base of telomere on chromosomal short arm and 5'-terminus of this base sequence : 82443121
  Distance between 3'-terminus of neighbour sequence of sequence listing upward to telomere on chrosomal short arm and 5'-terminus of this base sequence : 382354
tttactagtgcagatggatcactagtaatttggtgaatggtttggtatcaaggctgttctttctttggatttagtagttcctgctttcttgcctcccaggatttcttgttgcgttagttgtgtatttacaatattatttaaataaaatttggtctagtattttaggtattatgtactagaaggggatctctacatatgggtgatctgctatgttttaagaagtgaaagtcttgagtggcttgttttatatttatatatatatagatagagacagagacacatatagatacacacacacacacacacacacacgcatacacgctcatctgtcccagagtgaaaagttggaaatgaactgggaaccatcatcacaataggtatttagtagtgatgaaaagaggtcgtcctccagaattctacttggcttgagttggctaatccactatgtt

SEQ ID NO: 8668 - DNA, 451 bp, Homo sapiens
  AC010252.3_175326
  Located on chromosome 5
  Distance between a terminus base of telomere on chromosomal short arm and 5'-terminus of this base sequence : 82541660
  Distance between 3'-terminus of neighbour sequence of sequence listing upward to telomere on chrosomal short arm and 5'-terminus of this base sequence : 98090
gaagcactcctacatgacaaaccaggagtctcatctacataccagcaaatcaataaagcccataataaaggcatgaaatcatcaaggatgtgcaaatacaacagagcgagggaaaactaaacagaaatcctactctctggtcaaccagggctcttcaacaggattaataattagtgtgtgctggcttcccttgagctacatgtttgactcttcaaaagccttcagtaatacttccctgcaaaagttttaagatatacacatgcatacacacacacacacacacacacacacacacacacatgcccctgaggcaccgtgtgtccaaggagaataaagcagggatatttctctgacaagaaaatgatgaatcaatcttgaaacccacctttaatatttctgggtggtgagatgccaagctgaaggggagagtcatcttcagaagtgagtcaaa

SEQ ID NO: 8669 - DNA, 310 bp, Homo sapiens
  AC010252.3_41360
  Located on chromosome 5
  Distance between a terminus base of telomere on chromosomal short arm and 5'-terminus of this base sequence : 82675720
  Distance between 3'-terminus of neighbour sequence of sequence listing upward to telomere on chrosomal short arm and 5'-terminus of this base sequence : 133609
ttctcctgatctagctgattaaagtttaggaaaatgtgcagataacacacctttttaaccgtattcaatattttgtagacatacacaaaactagtttacattctcagcaagtgaagttcatcttacattttcttaaatatatttattgtatttaagaaaatgtacagtatacacacacacacacacacacacacacacacacatatatgctcaagctgctataataaaataccatagattgggtagcttaaatgacaaacatttatttctcacagttctgaaggctgggaagtccaagattaaggtgcca

SEQ ID NO: 8670 - DNA, 192 bp, Homo sapiens
  Z67673
  Located on chromosome 5
  Distance between a terminus base of telomere on chromosomal short arm and 5'-terminus of this base sequence : 82675756
  Distance between 3'-terminus of neighbour sequence of sequence listing upward to telomere on chrosomal short arm and 5'-terminus of this base sequence : -274
tgcagataacacacctttttaaccgtattcaatattttgtagacatacacaaaactagtttacattctcagcaagtgaagttcatcttacattttcttaaatatatttattgtatttaagaaaatgtacagtatacacacacacacacacacacacacacacacacatatatgctcaagctgctataataaa

SEQ ID NO: 8671 - DNA, 279 bp, Homo sapiens
  D5S646
  Located on chromosome 5
  Distance between a terminus base of telomere on chromosomal short arm and 5'-terminus of this base sequence : 82679318
  Distance between 3'-terminus of neighbour sequence of sequence listing upward to telomere on chrosomal short arm and 5'-terminus of this base sequence : 3370
cctggcccaagggagtggctccctaggtatttgctgaatgactggataaatgaaggaacaaacaggcactctccctaaattagcagagttcttcttctcaagaagtactattgtgctaagaatgtcttcagttcacttttctcttgggcacaatcttagcaaaaactgggaattgcatcattaaccccaagatagacagacagatgcatacacacacacacacacacacacacacacacacacacacacacacacacattttttttgagatagcgtctt

SEQ ID NO: 8672 - DNA, 254 bp, Homo sapiens
  AC010252.3_10081
  Located on chromosome 5
  Distance between a terminus base of telomere on chromosomal short arm and 5'-terminus of this base sequence : 82707137
  Distance between 3'-terminus of neighbour sequence of sequence listing upward to telomere on chrosomal short arm and 5'-terminus of this base sequence : 27540
ttaaggctgcatagtattccatggtgtgtgtgtgtgtgtgtgtgtgtgtgtgtgtgtgtgtgtgtgtatgagcaaatgcattatccaaaagaaaatacatattatatttacacaacataatctttcctccctgaaaattaaaaatccctttttcaagcccttcccactgttattcagaacgtatcatagtgttctattctctctagaatcaagaaagccccttgggacaagttagatgctcagcaatgtctact

SEQ ID NO: 8673 - DNA, 475 bp, Homo sapiens
  chr5.fa.O7frz.86791523
  Located on chromosome 5
  Distance between a terminus base of telomere on chromosomal short arm and 5'-terminus of this base sequence : 82796568
  Distance between 3'-terminus of neighbour sequence of sequence listing upward to telomere on chrosomal short arm and 5'-terminus of this base sequence : 89177
agactttgatcacgttcagacatctgaacagtctcacttgcgatatgaaaaggtccagtctaggcctgggaggtggctcatgcatgtaatcccagcactttgggaggctgatacaggtggatcacctgaggtcagacgtttgagaccagcctggccaatatgatgaaaccctgtctctactaaaaataaaaaaattagctgaatgtggtggtgcatgcctataatcccagctactcgggaagctaaggcaggagaatcgcttgaactcaggaggtggaggttgcagtgagccaagatcacaccactgcactcagtgacagagcgagactctgtctcaaaaataaataaataaataaataaataaataaataaataaataaataaataaaacaaataaataaaggtccagtctaaacccaacttaaatctcatatccaatttaagtttattctctctatccagctcagtctgatgt

SEQ ID NO: 8674 - DNA, 109 bp, Homo sapiens
  D5S1501
  Located on chromosome 5
  Distance between a terminus base of telomere on chromosomal short arm and 5'-terminus of this base sequence : 82860204
  Distance between 3'-terminus of neighbour sequence of sequence listing upward to telomere on chrosomal short arm and 5'-terminus of this base sequence : 63161
ttatagagcagccttccctgcattaaaacacacacacacacacacacacacacacacacacacacacacacatagatatagatatagatatatcccactggaggctttt

SEQ ID NO: 8675 - DNA, 166 bp, Homo sapiens
  chr5.fa.O7frz.85644911
  Located on chromosome 5
  Distance between a terminus base of telomere on chromosomal short arm and 5'-terminus of this base sequence : 82961068
  Distance between 3'-terminus of neighbour sequence of sequence listing upward to telomere on chrosomal short arm and 5'-terminus of this base sequence : 100755
gtggatttccgttaatagttaacactttattaacacagattcaagtaattataccctccaccaccacacacacacacacacacacatcaacttaagaaggcacagaaactgcatggttaatttcagtgcagacaagggtacagtgtactgatactgcaaccaagaa

SEQ ID NO: 8676 - DNA, 449 bp, Homo sapiens
  chr5.fa.O7frz.87005312
  Located on chromosome 5
  Distance between a terminus base of telomere on chromosomal short arm and 5'-terminus of this base sequence : 83003091
  Distance between 3'-terminus of neighbour sequence of sequence listing upward to telomere on chrosomal short arm and 5'-terminus of this base sequence : 41857
taggtaacctaaatgagtgcagtggatctgtattggaacttgggaacaatagagattgaagatttgaagggtggatacttcatctacagaaggcagcagctatttgattctagtcagttgttggccttctggaaatgtgggtgcagtgctgtcagaccttcctatttttaaaacacttttatttggaaataatttcaaatttacaaaaagttgcaaaaataagacataacaaaagaatacttatgcaccttacctatattcttttatttaattttgcagtccatttgaattctctctgtgcacatgtacatacatacacacacacacacacacacacaatttttttctgaaccatttgagggtatgttaaatatatcatggctttttgctcctaaatactccattgtgtatttcctataactagagacctgaaacctactattcttgag

SEQ ID NO: 8677 - DNA, 357 bp, Homo sapiens
  chr5.fa.O7frz.87183574
  Located on chromosome 5
  Distance between a terminus base of telomere on chromosomal short arm and 5'-terminus of this base sequence : 83180198
  Distance between 3'-terminus of neighbour sequence of sequence listing upward to telomere on chrosomal short arm and 5'-terminus of this base sequence : 176658
tacaggtgctgatgtgagagcattgcttgagcccgtaggttgaggctgcagtgagtcatgatcacgccactgcactccagcctgggtgacagagtgaaactctgtctcaaacacacacacacacacacacacacacacacacacacacacacacacaaacacctaatatgttggatttcttcatgctgctgctcagagggaggcatctttgacttgcaaaaaaccctagaatcaacttcctaggacaactgtcttttattccaagggggccaaataacctggcttctgatgcctgattccaccttgaactcacattgcatggatccttattttgtaaaccatagcctaataccttgt

SEQ ID NO: 8678 - DNA, 437 bp, Homo sapiens
  chr5.fa.O7frz.87736860
  Located on chromosome 5
  Distance between a terminus base of telomere on chromosomal short arm and 5'-terminus of this base sequence : 83457221
  Distance between 3'-terminus of neighbour sequence of sequence listing upward to telomere on chrosomal short arm and 5'-terminus of this base sequence : 276666
atactggaatgactttacatcaacagtgtctcttacgggtaagataaaattttgttagtcaataagaatttactgggggcccaaagagtaatataacttttaatgagcacttggtattttttgagagaacagagaggggcactgtccttcaagttataccatctaaaactagaatcagcaatagacagaagtcaatataaatacacacacacacacacacacacatgcacacacacaccctatcacagttctttacatatatcatgtgctcataaaattttggtttactagaagatagtaaattctagactattaaagaaacagagtaaatccctctccctggcattttccaaatatcaaattaccctctacattctgtgattctctctcttatataattttcttcctttcttctcatgtactaatagcctcgttac

SEQ ID NO: 8679 - DNA, 172 bp, Homo sapiens
  D5S672
  Located on chromosome 5
  Distance between a terminus base of telomere on chromosomal short arm and 5'-terminus of this base sequence : 83647655
  Distance between 3'-terminus of neighbour sequence of sequence listing upward to telomere on chrosomal short arm and 5'-terminus of this base sequence : 189997
ctgccctgcatcaaagccacctcagaagcacttggtatctttttgtgtgtgtgtgtgtgtgtgtgtgtgtgtgtataatgaggcctccctgatgttatgttcacattactttgactggattttggatgcttgcaaaacttttttatttttatttcttcgagatggggtctca

SEQ ID NO: 8680 - DNA, 410 bp, Homo sapiens
  chr5.fa.O7frz.88281166
  Located on chromosome 5
  Distance between a terminus base of telomere on chromosomal short arm and 5'-terminus of this base sequence : 83739005
  Distance between 3'-terminus of neighbour sequence of sequence listing upward to telomere on chrosomal short arm and 5'-terminus of this base sequence : 91178
cattatctagacattcaagtggactttattttaatgataatttaaaatgcaagtattgaggcatgagtatcactggaaccaggagttcgaggctgcagtgggctattatcaagttgctgcacttcaagcctagacaacagagtgagagactccacctctaaaaaaaaaatgaataaaaataatggccaggtgcaatggttcacacctgtaatccaaacactttgtgaggccaaggcaggaggattgcttgaggccaggagtttaagaccagcctgggcaacgcatagcaagacatagttcacacacacacatgcacgcacatgctcacacacacacacacacacacacacacaccccacctcacctcaccccacccctgggtgtagtggtatgcacctgtgtcttagcta

SEQ ID NO: 8681 - DNA, 266 bp, Homo sapiens
  chr5.fa.O7frz.91766108
  Located on chromosome 5
  Distance between a terminus base of telomere on chromosomal short arm and 5'-terminus of this base sequence : 83910888
  Distance between 3'-terminus of neighbour sequence of sequence listing upward to telomere on chrosomal short arm and 5'-terminus of this base sequence : 171473
aaacttacggaatcctacatattcttccatgtatttaactagcatcatgtcctgtcctatcctatcctatcctgtcctgtcctgtcctgtcctgtcctgtcctgtcctttcttagtgtgaataaatgtgtcactgctgttcatgaatgtctcatcattatatggtggcttagtgtagatgtacacattgcaggtctcgcattttgtgtgtgtgtgtgtgtttttaattaactgagctattataagtgcaaccaaatactattcatc

SEQ ID NO: 8682 - DNA, 125 bp, Homo sapiens
  D5S2094
  Located on chromosome 5
  Distance between a terminus base of telomere on chromosomal short arm and 5'-terminus of this base sequence : 84016559
  Distance between 3'-terminus of neighbour sequence of sequence listing upward to telomere on chrosomal short arm and 5'-terminus of this base sequence : 105405
tcaacaattatattgagtgtaaacggattatattctcctataaaagacaaggagtaaatgaatggacacacacacacacacacacacacacacaagacctaactacatgctacctacaaggaact

SEQ ID NO: 8683 - DNA, 443 bp, Homo sapiens
  chr5.fa.O7frz.92042720
  Located on chromosome 5
  Distance between a terminus base of telomere on chromosomal short arm and 5'-terminus of this base sequence : 84168842
  Distance between 3'-terminus of neighbour sequence of sequence listing upward to telomere on chrosomal short arm and 5'-terminus of this base sequence : 152158
taagctatggctgcatactaaggccctggattttataggtatttcactttgttttatattaagattatgataaatataatagttgctgtagtctctatttgtagctcaagctttggactagaaaagtagggatcactttcacccctatctagttggtattaagtacttgtggccttaaagatttcctgcttagtctggactcctcctgcctccaaagtgagtgtgtgtgtgtgtgtgtgtgtgtgtgtgtgtgtgtgtgaatttaatagaaatctgttgggttattatagatactgtgaaacagtcttccctataagaaactctttttctttccaaatcaaggtaaaacacgatgtccctatctaaggagaaacattgttaaactatgtccactaaataacagaacctcaacaaaatatgtagtgatagaagcaccattatgt

SEQ ID NO: 8684 - DNA, 258 bp, Homo sapiens
  D5S1959
  Located on chromosome 5
  Distance between a terminus base of telomere on chromosomal short arm and 5'-terminus of this base sequence : 84251732
  Distance between 3'-terminus of neighbour sequence of sequence listing upward to telomere on chrosomal short arm and 5'-terminus of this base sequence : 82447
tcatttggaggcactatatgttacaacttttgatttggacatgatgataagagaagacaactggattctgaggcactgctcaggcagggtaaatgttgacttcagatatagttcagatggatggatggatggacagatagatgagttatatatatgtttatatttatataaatactatatatgttatatgtgtatttctgtgtgtgtgtgtgtgtgtgtgtgtgtgtgtgtgtattttatggtgtagtagaaagtgta

SEQ ID NO: 8685 - DNA, 194 bp, Homo sapiens
  chr5.fa.O7frz.92302095
  Located on chromosome 5
  Distance between a terminus base of telomere on chromosomal short arm and 5'-terminus of this base sequence : 84425043
  Distance between 3'-terminus of neighbour sequence of sequence listing upward to telomere on chrosomal short arm and 5'-terminus of this base sequence : 173053
ctgtaatgaaattctcaggtgtagagcactctcaactgatgtagtcattttacattttctctctctctctctctctctctctctctctctctctctctctatatatatatatatatatatatatatatatctgaagtaagaaaactttggactagggtaatttatagcccttctggaccttaactaccatgagt

SEQ ID NO: 8686 - DNA, 208 bp, Homo sapiens
  AC020899.3_123148
  Located on chromosome 5
  Distance between a terminus base of telomere on chromosomal short arm and 5'-terminus of this base sequence : 84564458
  Distance between 3'-terminus of neighbour sequence of sequence listing upward to telomere on chrosomal short arm and 5'-terminus of this base sequence : 139221
gccttccaactagtatttataccactggcttccctgtgtctccaggttgtagatggcagattgtgggacttagcctacttctctatctatctatctatctatctatctatctatctatctatctatctaaaattggccctgttactctaaatgaccttgactaataaagattttgttgttgttgttgttgatggagtctcattctgtc

SEQ ID NO: 8687 - DNA, 104 bp, Homo sapiens
  G09994
  Located on chromosome 5
  Distance between a terminus base of telomere on chromosomal short arm and 5'-terminus of this base sequence : 84564510
  Distance between 3'-terminus of neighbour sequence of sequence listing upward to telomere on chrosomal short arm and 5'-terminus of this base sequence : -156
atggcagattgtgggacttagcctacttctctatctatctatctatctatctatctatctatctatctatctatctaaaattggccctgttactctaaatgacc

SEQ ID NO: 8688 - DNA, 146 bp, Homo sapiens
  D5S1948
  Located on chromosome 5
  Distance between a terminus base of telomere on chromosomal short arm and 5'-terminus of this base sequence : 84576765
  Distance between 3'-terminus of neighbour sequence of sequence listing upward to telomere on chrosomal short arm and 5'-terminus of this base sequence : 12151
tcctggagtccatgaatttcaaaacttttaacgatgtgtgtgtgtgtgtgtgtgtgtgtgtgtgtgtgtattcgtgtgcacaggcagatattttctgggaaaaggatcctatctatcagcaaaatcccagatgcctctccaaagta

SEQ ID NO: 8689 - DNA, 196 bp, Homo sapiens
  Z67581
  Located on chromosome 5
  Distance between a terminus base of telomere on chromosomal short arm and 5'-terminus of this base sequence : 84615406
  Distance between 3'-terminus of neighbour sequence of sequence listing upward to telomere on chrosomal short arm and 5'-terminus of this base sequence : 38495
tgaaaattaagcaggcaccaaacatccactgaccctcacccaaaatagttttttaacaagcctatcgaaatgtataaaattctaccattctcattcactttggggtgtgtgtgtgtgtgtgtgtgtgtgtgttgaagtaatagatgccagaagtctctggctgaaattcaaagaaccctagcaaaggtatgtaaca

SEQ ID NO: 8690 - DNA, 309 bp, Homo sapiens
  chr5.fa.O7frz.92630074
  Located on chromosome 5
  Distance between a terminus base of telomere on chromosomal short arm and 5'-terminus of this base sequence : 84696881
  Distance between 3'-terminus of neighbour sequence of sequence listing upward to telomere on chrosomal short arm and 5'-terminus of this base sequence : 81279
gcacagtgctttattcaagtagaggtagaaacaaatttgttgagctgaatcatgttaaaaccgtagagtatatatgttagcatgaagaaattgggaagtgacttcaagtcagatgtccaggtttatcatatatatatatatatatatatatatagagagagagagagagagagagagagagagagagaaaatatatgtatatatatagaaaatatatatatatagaaaatatatatatatataaaatactttaagttctagggtacatgtgcacaacgtgcaggtttgttacatatggatacatgtgcc

SEQ ID NO: 8691 - DNA, 248 bp, Homo sapiens
  AC008430.3_43298
  Located on chromosome 5
  Distance between a terminus base of telomere on chromosomal short arm and 5'-terminus of this base sequence : 84820850
  Distance between 3'-terminus of neighbour sequence of sequence listing upward to telomere on chrosomal short arm and 5'-terminus of this base sequence : 123660
ttcaatgctattcctatgaaacttccatgacattcttcacagaattagaacactatgcagccataaaacaaaacaaaacaaaacaaaacaaaacaaaacaaaacaaaacataacagaatcatgtcccttgcagcaatatggttggggctggaggccattatgctatgcaaactaacacaggaacatactgtgtaacaaaccaaatactgtatgttcccacttgtaagtgcaagctaaacattgagtac

SEQ ID NO: 8692 - DNA, 225 bp, Homo sapiens
  AC008430.3_64506
  Located on chromosome 5
  Distance between a terminus base of telomere on chromosomal short arm and 5'-terminus of this base sequence : 84842049
  Distance between 3'-terminus of neighbour sequence of sequence listing upward to telomere on chrosomal short arm and 5'-terminus of this base sequence : 20951
ccttctggaaggtatagcatagttcaaagatggagatggaaatgtctagtgctttttatgggacaccatccatttttattttattttattttattttattttattttattttattttattaagtgtaaaattcttatgagatagccttgaaatgtaaatttgggaaaatagggacactttgaaggggaatctgagcatgctgatcagtgagaattgatctggtag

SEQ ID NO: 8693 - DNA, 205 bp, Homo sapiens
  G08436
  Located on chromosome 5
  Distance between a terminus base of telomere on chromosomal short arm and 5'-terminus of this base sequence : 85215897
  Distance between 3'-terminus of neighbour sequence of sequence listing upward to telomere on chrosomal short arm and 5'-terminus of this base sequence : 373623
gttggcatgcattcctttacacttagcttaaagcaagacatctgctttatatttttatggctccaggtacttgtatcacaacacataacaacatatctttctatctatctatctatctatctatctatctatctatctatctatctatctatcatctatttttctatctattatctatctccatctttctgtctgtatgtatgtc

SEQ ID NO: 8694 - DNA, 457 bp, Homo sapiens
  AC021157.3_119773
  Located on chromosome 5
  Distance between a terminus base of telomere on chromosomal short arm and 5'-terminus of this base sequence : 85215912
  Distance between 3'-terminus of neighbour sequence of sequence listing upward to telomere on chrosomal short arm and 5'-terminus of this base sequence : -190
tttacacttagcttaaagcaagacatctgctttatatttttatggctccaggtacttgtatcacaacacataacaacatatctttctatctatctatctatctatctatctatctatctatctatctatctatctatcatctatttttctatctattatctatctccatctttctgtctgtatgtatgtctgtctgtctatctatttgtctcatcatctaaacagcaacttgtttatcattgcccctccaccattcaagtaactattacttagtaaacactcaataaatatttgtttgaaaataaatgaaaactaagattttatttgtttaaaaaaagtcacttattttttccctttgattacgttaatatactatgtatttgagttgtaaaagtttatactttttactagtttaatggattactctgataacacacataggatagttatgccacag

SEQ ID NO: 8695 - DNA, 392 bp, Homo sapiens
  AC021157.3_58068
  Located on chromosome 5
  Distance between a terminus base of telomere on chromosomal short arm and 5'-terminus of this base sequence : 85222489
  Distance between 3'-terminus of neighbour sequence of sequence listing upward to telomere on chrosomal short arm and 5'-terminus of this base sequence : 6120
agtatttaatctggaatggctaagaaagtataaatatgttagatcagggaggattaaaaagtgccattgtaatttttaagataaggaatcaatgagagagtgtctaacatttttaacatgtattttaaagtttggacatggtcagatctaaattaagaagacaatcctggcagcattttgaatggggtgattgatgactgataaagatacttcagtagacttgctatcatttatatacttatcatctaactatctatctatctatctatctatctatcatctatctatctatccatttatccatccacacatatagctagctagctatccttccatttgtctatcaatttgtctatctgtccttctagtccttgagtacctattgcatggta

SEQ ID NO: 8696 - DNA, 392 bp, Homo sapiens; identical to SEQ ID NO: 8695
  AC020936.3_123217
  Located on chromosome 5
  Distance between a terminus base of telomere on chromosomal short arm and 5'-terminus of this base sequence : 85222489
  Distance between 3'-terminus of neighbour sequence of sequence listing upward to telomere on chrosomal short arm and 5'-terminus of this base sequence : -392

SEQ ID NO: 8697 - DNA, 230 bp, Homo sapiens
  DISO7_10001900
  Located on chromosome 5
  Distance between a terminus base of telomere on chromosomal short arm and 5'-terminus of this base sequence : 85358165
  Distance between 3'-terminus of neighbour sequence of sequence listing upward to telomere on chrosomal short arm and 5'-terminus of this base sequence : 135284
gctcttctacatttataggaaggctatctttgtgtgtgtgtgtgtgtgtgtgtgtgtgtgtatgtgtgtctatatatgtgcactaatgttaaacccagttactttataaattgtaaattgtcttttataatttacattattagctttttcgtttattattttgggttttctagacataaaatcatcacatctgaaaagaactttagttttacctccttacctcctcttcg

SEQ ID NO: 8698 - DNA, 140 bp, Homo sapiens
  DISD22_0006056
  Located on chromosome 5
  Distance between a terminus base of telomere on chromosomal short arm and 5'-terminus of this base sequence : 85474273
  Distance between 3'-terminus of neighbour sequence of sequence listing upward to telomere on chrosomal short arm and 5'-terminus of this base sequence : 115878
tcggtgactgaaatatctgttccagtttccatctagagagagagagagagagagagagagaaagagagagagagagaaacctttatcttctaaggtagataaataccctttactatagatcagtaactgctcctttcatc

SEQ ID NO: 8699 - DNA, 343 bp, Homo sapiens
  chr5.fa.O7frz.94095361
  Located on chromosome 5
  Distance between a terminus base of telomere on chromosomal short arm and 5'-terminus of this base sequence : 85662260
  Distance between 3'-terminus of neighbour sequence of sequence listing upward to telomere on chrosomal short arm and 5'-terminus of this base sequence : 187847
cttcatgttgaactctagaaagaggttcaagtgtataattattagatgttcagaaatgttgccaatggcattaagggcccaattatgctgttgggcagtttcttatttgctgctaacttatctaaaagttcacctattttagctctaacatgcttttatcattttgtccattgtgaggtttggggaaaaacaaacgaaaacaacgaccagaatgtgtatgcgtgcctctgtgtgtgtgtgtgtctgtatgtgtgtgtgtacatctgcattcctctgtgtgtctgtgtgtgtgtgtgtgtgtacacatctgtgtgtgcttgtacaattggttctgagtacattt

SEQ ID NO: 8700 - DNA, 371 bp, Homo sapiens
  chr5.fa.O7frz.94482138
  Located on chromosome 5
  Distance between a terminus base of telomere on chromosomal short arm and 5'-terminus of this base sequence : 85877365
  Distance between 3'-terminus of neighbour sequence of sequence listing upward to telomere on chrosomal short arm and 5'-terminus of this base sequence : 214762
tgcaattagctttgatagaataacaatgaggaaataaaatatcctctaagaacatgattagaaatatatatgcacaggcatgtgtgtgtgtgtgtgtgtgtgtgtgtgtatgtgtacatttgtcttggtttgtgtttgtcagtacagatatatttctacaatttttattcatatcgtatttagtacttagagtaaccaagaaaataatgaaagtgcactcatatgtattatagtgaacattaagattctgaaagcaaattcagactgattaatacagtcacacatacaaattcccaagatattataaacagttttaaaacattctaacaatgaaaaggccttcagaaatgtaaggttaagataatggactg

SEQ ID NO: 8701 - DNA, 105 bp, Homo sapiens
  D5S1459
  Located on chromosome 5
  Distance between a terminus base of telomere on chromosomal short arm and 5'-terminus of this base sequence : 85996419
  Distance between 3'-terminus of neighbour sequence of sequence listing upward to telomere on chrosomal short arm and 5'-terminus of this base sequence : 118683
ggttgcctaatcacgagaaatttatctatctatctatctatctatctatctatctatctatctatctatctatacacacatatatttttgcagcatagatttgca

SEQ ID NO: 8702 - DNA, 413 bp, Homo sapiens
  chr5.fa.O7frz.94674282
  Located on chromosome 5
  Distance between a terminus base of telomere on chromosomal short arm and 5'-terminus of this base sequence : 86039893
  Distance between 3'-terminus of neighbour sequence of sequence listing upward to telomere on chrosomal short arm and 5'-terminus of this base sequence : 43369
tcttagtgttcctttacaaatcacgaaaagtttgaatattactctataatgacaaactttcattaatcatagcttatattctcaacagcgttttatgaaaagaaaatttcacttaaaagttatggtttctttctctgtagttgtgttagttgtgcattatatatttataaatgtgtattttatagacatcaagtaatacatattttgaatttatacagttattaaatttttattatcttgaagagaatcaataagaatattactattttactctcagaagattaaatgtgtgtgtgtgtgtgtgtgtgtgagtatacacacatgcatgtatatataatgccagttatatgaaataattaattcactttggagagatcattgattattttacctgatatctaaaccttagctca

SEQ ID NO: 8703 - DNA, 251 bp, Homo sapiens
  D5S428
  Located on chromosome 5
  Distance between a terminus base of telomere on chromosomal short arm and 5'-terminus of this base sequence : 86236348
  Distance between 3'-terminus of neighbour sequence of sequence listing upward to telomere on chrosomal short arm and 5'-terminus of this base sequence : 196042
aacatcttagggcatcctgggcagtgtcttaagtccccttctcatacacacacacacacacacacacacacacacacacatacacacacacatacacatacatacacaaattgcttaaatataggtaatagtaatgtttttttgaagaagacattatttactaatgaacattgtttacaaataatttaaaatattatttaaaataatctgtgaatatctactaaaatgctcctaatctattttaaatcatt

SEQ ID NO: 8704 - DNA, 462 bp, Homo sapiens
  chr5.fa.O7frz.94886986
  Located on chromosome 5
  Distance between a terminus base of telomere on chromosomal short arm and 5'-terminus of this base sequence : 86307076
  Distance between 3'-terminus of neighbour sequence of sequence listing upward to telomere on chrosomal short arm and 5'-terminus of this base sequence : 70477
ctattggtgaatatcaggtgatagttgtttctctaaggtggcctcatttcagcttcacattgggagatatgtccatatgaaacaatacacccataaatggtaggaggaagctggatccaggttgagggaaagataactaagatggattttagtcaggaaagtcagtggccttgaaaggtaactggggcagatttctattttgggaattaagacagaattttaagttcatagaactaagctatcaaagaagtgtgtgtgtgtgtgtgtgtgtgtgtgtgtgcgtgcgcacatgtgtgtgtgtgtgtgtgtgtgtgtgagaagtggtttaaaatttacaaccacaacttctcggaatttgcccattgagtacagaaaactagctatgctgacagaaaaggaaattggcagctgtgattttctcactataagaaagttgtaggattccagactaaactccatttc

SEQ ID NO: 8705 - DNA, 476 bp, Homo sapiens
  AC016550.4_47241
  Located on chromosome 5
  Distance between a terminus base of telomere on chromosomal short arm and 5'-terminus of this base sequence : 86524662
  Distance between 3'-terminus of neighbour sequence of sequence listing upward to telomere on chrosomal short arm and 5'-terminus of this base sequence : 217124
tatgaaactagtgctggatcagatatcccacaacccgggccttgttattgaagtgtatttcctaaggagtgaatactcttgactaagaagtgcattagtcggggttctttagaaaaacacaactaatcagatggagatgatagatagatgatagatgatagatagataaatagatagatagatagatagatagatagatagatagatagatagatggagatttatgataaggaattagctcacactgttatggaggctgacaagttccaaggtctgcactcagcaagctagagacacaggaaagccattggggtagttatagtcaagtccaaaggcctgaaaaccaggtgtgccaatagttgtagtaacagtttgaacaccagcaggctcaagacccaggaagagctggtatttcagtgtgagtcaggaggcagaaagaatctatgccccccagcttaaagacggtcaggtaagag

SEQ ID NO: 8706 - DNA, 205 bp, Homo sapiens
  DISO7_10016963
  Located on chromosome 5
  Distance between a terminus base of telomere on chromosomal short arm and 5'-terminus of this base sequence : 86529356
  Distance between 3'-terminus of neighbour sequence of sequence listing upward to telomere on chrosomal short arm and 5'-terminus of this base sequence : 4218
gtcagttagtgtacatgcagagacaggaaggaaggaagggagggaggaagggagggaggaaggaaggaaggaaggaaggaaaggaggaaggaaggaaggaaggaaggaaggggttgggaagaagaaaaagaataaggtgggggagaaagaaggagagaacgagaaaggaagggaggaatattcctccctacattcccaggtgcca

SEQ ID NO: 8707 - DNA, 307 bp, Homo sapiens
  chr5.fa.O7frz.95111983
  Located on chromosome 5
  Distance between a terminus base of telomere on chromosomal short arm and 5'-terminus of this base sequence : 86612448
  Distance between 3'-terminus of neighbour sequence of sequence listing upward to telomere on chrosomal short arm and 5'-terminus of this base sequence : 82887
tttaacgtagtctgtggcttacattctatcctcttaacatgtttatcacagaacaaaagcttttttgttgtttaaccttttgatgaagcctattgtgtgtgtgtgtgtgtgtgtgtgtgtgtgtgtgtgtgtgtgtgtacacaattttgcttttggttccatgtctaagaattctggcaaatgcaaggtcataaaaattttgtccaatgttgtcttctaagagttttattgtattgtgttttatatttagtttatgattgactttgagttaattttgtatatagtttgagatttaaactaagctcct

SEQ ID NO: 8708 - DNA, 424 bp, Homo sapiens
  chr5.fa.O7frz.95812118
  Located on chromosome 5
  Distance between a terminus base of telomere on chromosomal short arm and 5'-terminus of this base sequence : 86784734
  Distance between 3'-terminus of neighbour sequence of sequence listing upward to telomere on chrosomal short arm and 5'-terminus of this base sequence : 171979
gaaaatctaatttcctcaagaaagcaaaatcttttcttgactgagtatttcacagaaaacaaaatactgtgtgtgtgtgtgtgtgtgtgtgtgtgtgtattttatatatatatataaaatatatatatatatatagagagagagagagagagagtgatagagagagagagtttagtaaggaaaatatactaaaaaaacctcctcagattccttagaaaaggataaattcagtactttctcagaatttacattttgttaagagtagcaactaggtttatttaaactaaatttagttagtttaaataaactcaacagtcagtgtgtaaggccttgtagccagcatccttgctgctttgcctatagcctcctggcccaccctgaaggtcagctgtggctggggtgggcagttgcagtacttgccaac

SEQ ID NO: 8709 - DNA, 402 bp, Homo sapiens
  AC008394.3_162054
  Located on chromosome 5
  Distance between a terminus base of telomere on chromosomal short arm and 5'-terminus of this base sequence : 86908701
  Distance between 3'-terminus of neighbour sequence of sequence listing upward to telomere on chrosomal short arm and 5'-terminus of this base sequence : 123543
atgtttatccttccaaagcataaccagattgcaacatggatattgtattttagtttttggctgttttaaagcatccaggtgagataataaaagatgggaaaaatgttcactataaatttactttgaaaaatataccaatataacatgtggacatttttgtatgatatatgtgtgtgtgtgtgtgtgtgtgtgtgtgtgtgcgcgcgcgtgtatgtgtgtgtgtgtagaaagagacagagagagaatattaaatatgttacgtatattgcattacctcacacaaatgcacacaattaaattcctactgcaaaatgtagagactaggccgggcaccctggctcatgactgtaatctcaacactttgggaggccaaggagggtggattactagatcaggagttca

SEQ ID NO: 8710 - DNA, 198 bp, Homo sapiens
  Z23455.1_65
  Located on chromosome 5
  Distance between a terminus base of telomere on chromosomal short arm and 5'-terminus of this base sequence : 87190571
  Distance between 3'-terminus of neighbour sequence of sequence listing upward to telomere on chrosomal short arm and 5'-terminus of this base sequence : 281468
ttatttactagattgaaggccagaaaacatgccaaacatttttgtctgttctagatttaatattgccatatcaagcattctcttttttgtttgcatttgtgtgatctctgtgtgtgtgtgtgtgtgtgtgtgtgtgtgtgtgtgtgtgtgtgtgtagcaaacaaatttcagaagatttagactgtccactaaatcacc

SEQ ID NO: 8711 - DNA, 201 bp, Homo sapiens
  D5S617
  Located on chromosome 5
  Distance between a terminus base of telomere on chromosomal short arm and 5'-terminus of this base sequence : 87190578
  Distance between 3'-terminus of neighbour sequence of sequence listing upward to telomere on chrosomal short arm and 5'-terminus of this base sequence : -191
ctagattgaaggccagaaaacatgccaaacatttttgtctgttctagatttaatattgccatatcaagcattctcttttttgtttgcatttgtgtgatctctgtgtgtgtgtgtgtgtgtgtgtgtgtgtgtgtgtgtgtgtgtgtgtagcaaacaaatttcagaagatttagactgtccactaaatcaccaagcctttgg

SEQ ID NO: 8712 - DNA, 225 bp, Homo sapiens
  AC010361.3_57334
  Located on chromosome 5
  Distance between a terminus base of telomere on chromosomal short arm and 5'-terminus of this base sequence : 87323444
  Distance between 3'-terminus of neighbour sequence of sequence listing upward to telomere on chrosomal short arm and 5'-terminus of this base sequence : 132665
acacagcttggtacatccatatagtatcctctgggccgtgtgtgtgtgtgtgtgtgtgtgtgtgtgtgtaaatgaaatgttgcaataagttgctcagctatgtctaccgctccctgcattgtttgcctctgggaaaagaaaaagttgtatcttctgacacagatgttttcccctggggtatcaggaccaggcctaggcagcagcttaaagtaagcctgttggctt

SEQ ID NO: 8713 - DNA, 436 bp, Homo sapiens
  chr5.fa.O7frz.96195976
  Located on chromosome 5
  Distance between a terminus base of telomere on chromosomal short arm and 5'-terminus of this base sequence : 87806734
  Distance between 3'-terminus of neighbour sequence of sequence listing upward to telomere on chrosomal short arm and 5'-terminus of this base sequence : 483065
tacctaatgctaaatgacgagttaatgggtgcagcacaccagcatggcacatgtatacatatgtaactaacctgcacattgtgcacatgtaccctaaaacttaaagtataataataataataataataataataaaataaagtaaagataaagtcataattgtttaaatgattattttggatattactttgcttggttttcccagcatcttttcctccttctgggattaatagactacctttagtaaagattgctaatcatagtacattgtgcccacagtgattagtccaaggagtgggcaccagacatatgtcatgccagtcagactcttccttatgaatttaagcttgagttagaggaatgagcccttctatctcagatggtaaagttgtaaggatattaatccagcattcactagtggtagtgattcaacctt

SEQ ID NO: 8714 - DNA, 435 bp, Homo sapiens
  AC025245.3_152495
  Located on chromosome 5
  Distance between a terminus base of telomere on chromosomal short arm and 5'-terminus of this base sequence : 87901527
  Distance between 3'-terminus of neighbour sequence of sequence listing upward to telomere on chrosomal short arm and 5'-terminus of this base sequence : 94357
agcaaaagttgactttaaagaatagaaaacaactataaaattaaagcaaggatgaataaaaaatattgtaagatataatacatatttacaagatattaaaatggtaaaaaaagtgtgcaattctgttgtaaaacatttgaaattctagtatgtatgtatgtatgtatgtgtctctctctttctctctaagacggatccaaacagaagtaactaataaatcagtaactacagaagatcctggaaaagtgattaagacctgccactacaaaacataccggtactaaatactccacttttagcagtggcgaatccgtatgggtctgcacagtctcaattcttgcttcctcacaagaaagaatttgactgaggcgcatagggcagaaggagccaccgaggcaagttttagagcaggagtgaaatttattacgtcagcaa

SEQ ID NO: 8715 - DNA, 315 bp, Homo sapiens
  chr5.fa.O7frz.96572203
  Located on chromosome 5
  Distance between a terminus base of telomere on chromosomal short arm and 5'-terminus of this base sequence : 88144326
  Distance between 3'-terminus of neighbour sequence of sequence listing upward to telomere on chrosomal short arm and 5'-terminus of this base sequence : 242364
catcagttaaattctcataaggagcccacaagctagatccctcgcatgtgcagttcacaatagggttcaggctcctgtgagaatctaatgccactgcttatctgacaggaggcagagctcaggtaacaatgcttacccgacagccactcacctcctgctatgcagcccagttcctaacaggccgcagactggtgcgttgggacccctactctagaggaaacagatgtgtgtatatgtgtgtgtgtgtgtgtgtgtgtgtgtgtgttccttattctttagggacttgggcttcttcaaggcaattctttatctaca

SEQ ID NO: 8716 - DNA, 404 bp, Homo sapiens
  AC008839.4_10484
  Located on chromosome 5
  Distance between a terminus base of telomere on chromosomal short arm and 5'-terminus of this base sequence : 88265741
  Distance between 3'-terminus of neighbour sequence of sequence listing upward to telomere on chrosomal short arm and 5'-terminus of this base sequence : 121100
ttggacatgttacctacagctccttcaaagatctgaagtcatcttaatgtgtttctgtggaagttaaattctcaattgcacatccttttagtgaaagttaaattaatttttaacatattctttcaccctttttcttcaccctgtgaagattttcacagatatacacaaagcatggtcttagatttctgagaacttgtctcctgctggatattctcaattccttcctgttgaaataagaaaataataataataataataataataataataataataataataataataaggctaagccattctgacagcctcactaaaaaattttcagtttgcacagtacatagcaacaagtgacctgttaaatgatgacaaatcctttagattatggctttagacctttaacc

SEQ ID NO: 8717 - DNA, 404 bp, Homo sapiens; identical to SEQ ID NO: 8716
  AC008939.3_159639
  Located on chromosome 5
  Distance between a terminus base of telomere on chromosomal short arm and 5'-terminus of this base sequence : 88265741
  Distance between 3'-terminus of neighbour sequence of sequence listing upward to telomere on chrosomal short arm and 5'-terminus of this base sequence : -404

SEQ ID NO: 8718 - DNA, 125 bp, Homo sapiens
  DISO7_10001909
  Located on chromosome 5
  Distance between a terminus base of telomere on chromosomal short arm and 5'-terminus of this base sequence : 88502414
  Distance between 3'-terminus of neighbour sequence of sequence listing upward to telomere on chrosomal short arm and 5'-terminus of this base sequence : 236269
gcatctcttaatagaacccatatgaacacacacaaacatacacacacacatgcacgtgcacacacacacacacacacacacacacacacacagtggacaccacttcccagctgctcagcgtaaga

SEQ ID NO: 8719 - DNA, 128 bp, Homo sapiens
  DISO7_10001910
  Located on chromosome 5
  Distance between a terminus base of telomere on chromosomal short arm and 5'-terminus of this base sequence : 88568232
  Distance between 3'-terminus of neighbour sequence of sequence listing upward to telomere on chrosomal short arm and 5'-terminus of this base sequence : 65693
aagctgtccgaaggtagggatgtgtgtgtgtgtgtgtgtgtgtgtgtgtgtgtgtgtgatctgtctagaatcctaaatgaactgaaagaggccatttaaagctgcaaagaagactttgctgatgcaac

SEQ ID NO: 8720 - DNA, 127 bp, Homo sapiens
  DISO7_10001911
  Located on chromosome 5
  Distance between a terminus base of telomere on chromosomal short arm and 5'-terminus of this base sequence : 88626937
  Distance between 3'-terminus of neighbour sequence of sequence listing upward to telomere on chrosomal short arm and 5'-terminus of this base sequence : 58577
aacaatcgttaagtgattccacattttaatttctttttgaatgagtatgaacacacttgaaataatttccctatcatatatatatatatatatatatatatataatttgcattactcctgacaaggc

SEQ ID NO: 8721 - DNA, 286 bp, Homo sapiens
  AC008526.5_63411
  Located on chromosome 5
  Distance between a terminus base of telomere on chromosomal short arm and 5'-terminus of this base sequence : 88967768
  Distance between 3'-terminus of neighbour sequence of sequence listing upward to telomere on chrosomal short arm and 5'-terminus of this base sequence : 340704
aaattgaccaagctatttaactgataatatgcacttaaacagtcttttatttttcttgaagaaatatatcagaagcataccaaaaatttctccatgcaaaagtcatgcaaacagaggatggtgagctgttagtctggagggtacacctggaagtttatacacacatggacacacacacacacacacacacacacacacacacagcacatgtgcagaaggcctgtatggtacaggctataaaacttagcatatatctcttcatctggaatctccagtagaaatacag

SEQ ID NO: 8722 - DNA, 451 bp, Homo sapiens
  AC012604.3_60851
  Located on chromosome 5
  Distance between a terminus base of telomere on chromosomal short arm and 5'-terminus of this base sequence : 89040139
  Distance between 3'-terminus of neighbour sequence of sequence listing upward to telomere on chrosomal short arm and 5'-terminus of this base sequence : 72085
atgcaagactataattgtgaagagtatatgtaaacatgaaaaatgtttcagtaatattagcaagttaaaaacataaaattttactaacagtgtatgtgtaccgcaatctatataccaaaatgaatacaccttttccattaaggtatcgagactgtgtgtgtgtgtgtgtgtgtgtgtgtgtgtgtgtgtgtgtgtgtgtgtgtcactgcctttacaatgaataccattaaaacagaaagtctaatccaggtttttcttcctcttctgtgaaatttttcctaacctctctcaacacagtgaatcactttcatctactagtattgtgttcttttcttgcttctattattgcaattagtactaattccaacacaactaaagtcacaaacagtgaagtaaatacattttaatatctaattcgattaaaaaggtatggattgatctttaacaccta

SEQ ID NO: 8723 - DNA, 144 bp, Homo sapiens
  Z67413
  Located on chromosome 5
  Distance between a terminus base of telomere on chromosomal short arm and 5'-terminus of this base sequence : 89109310
  Distance between 3'-terminus of neighbour sequence of sequence listing upward to telomere on chrosomal short arm and 5'-terminus of this base sequence : 68720
gacacctgtgtgcatctgcctggagataggtgtgtgtgtgttgtgtgtgtgtgtgtgtgtgtgtgtagggagaagtaggcatttcatcaaaaatacatttgaaaaatgttggttctaaaattcagtcgttatcaattcgggcca

SEQ ID NO: 8724 - DNA, 429 bp, Homo sapiens
  AC012604.3_92905
  Located on chromosome 5
  Distance between a terminus base of telomere on chromosomal short arm and 5'-terminus of this base sequence : 89109725
  Distance between 3'-terminus of neighbour sequence of sequence listing upward to telomere on chrosomal short arm and 5'-terminus of this base sequence : 271
aacaaatgagtcctgtttcaccactagggtgccgaggtggatggtggatgctggcccccgcccctggcagcgctcagcccttagaaaccagagccagctgacaacacgcgaaacacacaggcacagcgaaaacgccgagccgacgctcattccctctgccccctccctctgctctctgtaacaaggaggacacgtacacagcctttacacacttaaaagcccttgcgactccctctgaattcttagttacttatgacggccttcctcactgcacatagcccctggggtgtgtgtgtgtgtgtgtgtgtgtgtgtgtgtatgcgcgcgtgtgtgtgtgtacgcgcgcgcgcgcacgcgtgaatgtgcatgtgtgtttaaaacgcttattggtaggtcatcagcagctgatcagacatggtaatccaataa

SEQ ID NO: 8725 - DNA, 437 bp, Homo sapiens
  chr5.fa.O7frz.98494693
  Located on chromosome 5
  Distance between a terminus base of telomere on chromosomal short arm and 5'-terminus of this base sequence : 89211226
  Distance between 3'-terminus of neighbour sequence of sequence listing upward to telomere on chrosomal short arm and 5'-terminus of this base sequence : 101072
ctatgtttgacctggtttacagattacttaagcaaaacaaaatagaaaaaaaaagcattcccattgcaaaactggcatacacacacacacacacacacacacacacacacacacacacgtatttttttatgacttactcagaattccatttgttgaaactaaaagccatcctactccagaaatgctatttttcaaagtagtttctacatcattttaaagattaaaagtaaaaatctgcttgagtgaaaataataattttaagaaagagactaaatgttggcatgttaaggggatacagactgaacaagagaatttcatgtctcagggagctaaactaaaatgagtcagctgctctcttaaggtacaatgagtcacaggaataattttcttgctgtgaaactccttaaagttttgagtttaattgcaagcagtaagtg

SEQ ID NO: 8726 - DNA, 155 bp, Homo sapiens
  DISO7_10001916
  Located on chromosome 5
  Distance between a terminus base of telomere on chromosomal short arm and 5'-terminus of this base sequence : 89225847
  Distance between 3'-terminus of neighbour sequence of sequence listing upward to telomere on chrosomal short arm and 5'-terminus of this base sequence : 14184
ctctccatctccctatgtccctttccttctctctctctctctctctctcacacacacacacacacacacacacacacacacacacacacacagagagagagacacacatgttcttcctctaaaaagaaaaaccaataatcctctactgagacagt

SEQ ID NO: 8727 - DNA, 400 bp, Homo sapiens
  chr5.fa.O7frz.98719108
  Located on chromosome 5
  Distance between a terminus base of telomere on chromosomal short arm and 5'-terminus of this base sequence : 89406575
  Distance between 3'-terminus of neighbour sequence of sequence listing upward to telomere on chrosomal short arm and 5'-terminus of this base sequence : 180573
ttccactggtacttagtttacaacaggaaatgatcctggtgtatggagaatcaagcttatcatgatctagttacttgttcttatgcaatgcatatatgcagccgaggagtttacaataatcattttgtaaaaacatatatatatatacacacacacacattatatacacacacatatacatatatatatatatatatatatggagtcttgtgagggtaaacttcttgactgaagaattaatacctagaatcatgacaactttttctttcttggaatctcttcagtttgtcttccatggtaatagctatgatatgcagaaaatgaaacgttgtgtcattacagcctcttaaggaaaaattttcccagttgctccctcagctgtcttcaacctactggtaca

SEQ ID NO: 8728 - DNA, 229 bp, Homo sapiens
  G08478
  Located on chromosome 5
  Distance between a terminus base of telomere on chromosomal short arm and 5'-terminus of this base sequence : 89530342
  Distance between 3'-terminus of neighbour sequence of sequence listing upward to telomere on chrosomal short arm and 5'-terminus of this base sequence : 123367
gggcacatccaacttagtgataatgaaaagttcattaatacattttattaggcaaagttctccaaagaacagaatcaattgtatatgtatatagatatatatagaatatatctctatctatctatctatctatctatctatctatctatctatctatctatctatcatctatctacatattcctataaagaattggcttacataattatggatgctgacaagtccaaac

SEQ ID NO: 8729 - DNA, 354 bp, Homo sapiens
  chr5.fa.O7frz.98944515
  Located on chromosome 5
  Distance between a terminus base of telomere on chromosomal short arm and 5'-terminus of this base sequence : 89606805
  Distance between 3'-terminus of neighbour sequence of sequence listing upward to telomere on chrosomal short arm and 5'-terminus of this base sequence : 76234
aaaggcaactagcaatgtaataataatttagattatcttcaaatataaagtgaaatggaggaaaaaatgtttcactgaaaatattatttctgaagagatattttcaccttcaatttctggtctaaaatttgggaaaataaccatcttagatgttccaaaagcccatatgtctgtatattatttggaaataggaataaaatacagtgttataaactcttgttgggtaaaatggcatctagaatttaataaatatttattttgcaagcagtggtgtgtgtgtgtgtgtgtgtgtgtgtatgtgtgtgtgtagacagtatataatgttatttgggattcataacaaacctgtcagat

SEQ ID NO: 8730 - DNA, 428 bp, Homo sapiens
  AC010242.4_143788
  Located on chromosome 5
  Distance between a terminus base of telomere on chromosomal short arm and 5'-terminus of this base sequence : 89793202
  Distance between 3'-terminus of neighbour sequence of sequence listing upward to telomere on chrosomal short arm and 5'-terminus of this base sequence : 186043
agtaacacagcaataaatctgaacaaaaataagacagatttccttatcgatgtgtaataaagttaaaggacattgttttgtcagacaagcgctaagtagaaaataaatctcagggtctggggaaacaaaacggagcgctgctggcatgtgtgtaaatttacttttaaaagcaataaatcaatgttaaattaaacagctgggtaccctgtctaggagaaggttccgtgtttaagaagaccttgatgggagaaatgtactatttaacaagacacacacacacacacacacacacacacacacacacaaagttaaatttttattggcatccggaggcaagactgccctgggaacttttcttctgaacttcagagagggagagggaaataagagagagcatgaattgtgtctactgtccatcctcagatctt

SEQ ID NO: 8731 - DNA, 475 bp, Homo sapiens
  chr5.fa.O7frz.103642216
  Located on chromosome 5
  Distance between a terminus base of telomere on chromosomal short arm and 5'-terminus of this base sequence : 89966251
  Distance between 3'-terminus of neighbour sequence of sequence listing upward to telomere on chrosomal short arm and 5'-terminus of this base sequence : 172621
ggacagaagtttaacatcctataattaaagtgagtatgtccaaaagttctctgcaatgaccaagtacctgtgcagaactatacagatttgatatggtcatttcagagtgtgtgtgtgtgtgtgtgtgtgtgtgtgtgtgtgtgtgtgcgcgcgcgcgcgcacgtgcaggggcatgtggcatttttaccccaaaaagtatatagaaaaaagggcaaaacaagttaaatgtttgctatatgatagagcataatgaaataaaataaacatatgcaaagaaagacatacagctattatatctaaattcaatctgtctgaaatgttattttatcaaatctaactccctattctgaaatgtgttactatagtttagaagtcaagtgtcttttggtgcttttctaatacttacgtgtcccttttttcaaggcccccgtttgtccccatcccaatttttagttgagatgaacactaccaaagt

SEQ ID NO: 8732 - DNA, 476 bp, Homo sapiens
  chr5.fa.O7frz.103756553
  Located on chromosome 5
  Distance between a terminus base of telomere on chromosomal short arm and 5'-terminus of this base sequence : 90089446
  Distance between 3'-terminus of neighbour sequence of sequence listing upward to telomere on chrosomal short arm and 5'-terminus of this base sequence : 122720
agtacagtagtctgactgtcacctatgttttttctttccttcctttcaaatacttctctgccatgagttagaatttctttttaaatctgtttctgcctgtacctcccgaaacttctgataattcgttttagaaacactcattacaaagccagccaggtgaaaacacaggctaagactaagggtgaattatgcttgagaaaggaaactgttaaatattcttcactattttttattctcactttttgaaatcagtgaactaatcatatcaaatgtttactgatttaccaactcatgtgaagtcattgcttttaaaaatctgctttgtggctaggactatctgctatgtggctaggactatctgctatgtggctaggactatacacacacacacacacacacacacacacacacacagatatatagaattttcaatttaacagttgatggttgatttgttcacttgtatgttatgctcc

SEQ ID NO: 8733 - DNA, 459 bp, Homo sapiens
  chr5.fa.O7frz.104095493
  Located on chromosome 5
  Distance between a terminus base of telomere on chromosomal short arm and 5'-terminus of this base sequence : 90463926
  Distance between 3'-terminus of neighbour sequence of sequence listing upward to telomere on chrosomal short arm and 5'-terminus of this base sequence : 374004
gaagtcatttgatgtgacaaacttcattgttctcttatttaagaaattgccacagtcaccccaaccttcagcaaccaccactctgactagttagcagctgtcaacttcgagacaagactctacaccagcaaaattattatgtcttgctgaaggcccagatgctccttagtattttaaagcaatgaattatttttaaattaagtatgtacattgttttttagacataatgctattgcacacttaatagactacagtatagtgtaaacgtaagtgttatgtgcactggaaaaactttgtgtgactcagtttattgaaatattcactttattgtggtgctctgggaccaaactgacaatatctctgaagtatgcctaaataggctatatgtgtgtgtgtgtgtgtgtgtgtgtgtgtctgtgtctgtgtgtgtaagttctctatatgtataggcgatgcaga

SEQ ID NO: 8734 - DNA, 435 bp, Homo sapiens
  AC010448.4_5676
  Located on chromosome 5
  Distance between a terminus base of telomere on chromosomal short arm and 5'-terminus of this base sequence : 90610681
  Distance between 3'-terminus of neighbour sequence of sequence listing upward to telomere on chrosomal short arm and 5'-terminus of this base sequence : 146296
agacgataagcctcaaacttagctataagcacacagacgactcaaacaataaaaggaatatcataaaatatatcttatttgaaaatgtattatacttgattaaaaatccaaatttttaaagtttacaccttatagtttttactgaaactttaagtatttaaaaaccatgttaattgatccaaagcaaaatgttcatacttttgtgcaaaataaattacatgttgtttcctaggctgaaatcatattatcatttcattggattatactgctctgtgtgtgtgtgtgtgtgtgtgtgtgtgtgtgtgtgtatctttgtgtaaaataatatgctactgtggctatattaagacagtaccaacataactggctgaaaagtgaaaaattcaatcatgacagttttacttacatgttttcctgattagactagttgatttg

SEQ ID NO: 8735 - DNA, 245 bp, Homo sapiens
  chr5.fa.O7frz.104418729
  Located on chromosome 5
  Distance between a terminus base of telomere on chromosomal short arm and 5'-terminus of this base sequence : 90773507
  Distance between 3'-terminus of neighbour sequence of sequence listing upward to telomere on chrosomal short arm and 5'-terminus of this base sequence : 162391
gtgataaccagttagtggttacagcagcccttaggcaagacccagcgctgtgctggcttcaggtctgacccaaggaagttctagtggtggtggccacaggggtgcttatattaccccacccccagctccaggtggctcagcacagagagagagagagagagagagagactcagggtgtttaggagaaagtaagggaggagaacatgagtctctgtttgataatctagtgaattctcctggatcat

SEQ ID NO: 8736 - DNA, 256 bp, Homo sapiens
  D5S627
  Located on chromosome 5
  Distance between a terminus base of telomere on chromosomal short arm and 5'-terminus of this base sequence : 90966139
  Distance between 3'-terminus of neighbour sequence of sequence listing upward to telomere on chrosomal short arm and 5'-terminus of this base sequence : 192387
aagagacaggtacaaaatatcccaggcgcctttagagaccagcatatattttttccgcaacccacattctggtacattgactttacttttgtaatttccagtgtgaaatgaatacctaagtttttctttcttgttacatagtatgtattttaaattcagcacacacatgcatacctgcaaactccatatacatatgcacacacacacacacacacacacacacacacacaagactcctaaagaatagcaatgcttc

SEQ ID NO: 8737 - DNA, 418 bp, Homo sapiens
  chr5.fa.O7frz.104493727
  Located on chromosome 5
  Distance between a terminus base of telomere on chromosomal short arm and 5'-terminus of this base sequence : 91019190
  Distance between 3'-terminus of neighbour sequence of sequence listing upward to telomere on chrosomal short arm and 5'-terminus of this base sequence : 52795
tgccttgtacagtactggatagattggacatctccgtatgtcctcctaagcttctcatttttttctcaccatattcactttggggcttgttctgtttcttccttctagcgctaaatttgtcatcagagggactaattactgcttctttcccaaataatgctatggaagtaagaacagccctcaagtctcatcactggatgcttctgtcaaataattaatatttatacacacacacacacacacacacatacacacgtgcgtgtgcatctctcctatctttgaaggatggggcaggaaatagacactgtgtctttaaaaaaaaaagtctgaaggccagctgaatgatattaaaccaagggcctaatttggctcctaggcctaaaggggccagaatttctaaacgccacttgtagttaaa

SEQ ID NO: 8738 - DNA, 280 bp, Homo sapiens
  AC008534.5_165867
  Located on chromosome 5
  Distance between a terminus base of telomere on chromosomal short arm and 5'-terminus of this base sequence : 91149530
  Distance between 3'-terminus of neighbour sequence of sequence listing upward to telomere on chrosomal short arm and 5'-terminus of this base sequence : 129922
cctaatgctaaatgacgagttaatgggtgcagcacaccagcatggcacatgtatacatatgtaactaacctgcacattgtgcacatgtaccctaaaacttaaataataaaatatatatatatatatatatatatatatatatatatattcaaaatagcttcctcaggtaggtgaattatctcacccggctgaaacagtgtctgcgtgtttggcaggagagtcagggaagagcgcttgtaactggattttatccaaagtggttacctgagttctaacaatg

SEQ ID NO: 8739 - DNA, 314 bp, Homo sapiens
  AC008534.5_85366
  Located on chromosome 5
  Distance between a terminus base of telomere on chromosomal short arm and 5'-terminus of this base sequence : 91229932
  Distance between 3'-terminus of neighbour sequence of sequence listing upward to telomere on chrosomal short arm and 5'-terminus of this base sequence : 80122
ttcaaagcttcatttctacctaaggttatttttgctgggaaaatatgtctgtgatttctttgatcgacgatgtgaacatttatatctccctctataaattgttttgaaaacatgtatttggcttctttgactcatggtttccagcttatcctttgacttctctcagtcattttcacacaggttcctttctcttgctttgggctagctgaacacacacacacacacacacacacacacacacacacacttccctactccccttcagaatgacttcatgacaagtggtctggttgtgagcactaccttaaattcca

SEQ ID NO: 8740 - DNA, 264 bp, Homo sapiens
  Z66765
  Located on chromosome 5
  Distance between a terminus base of telomere on chromosomal short arm and 5'-terminus of this base sequence : 91244218
  Distance between 3'-terminus of neighbour sequence of sequence listing upward to telomere on chrosomal short arm and 5'-terminus of this base sequence : 13972
gatttgagtcaccatgcctctgccctatccaagaccaattaaaccggaatcattgaggggcagacactgcattctctgtgtgtgtctctggtatgtgtgtgtctccgtacatgtgtgtctctgtgtgtgtctgtgtgtgtgtgtgtgtgtgtgtgtgtggtcttctaaagcacccttgataattcaaatgagcatccagtagagtgaacagtggttctcaaaatatgttccatggaccagcatcagcagcatcacttgaaagct

SEQ ID NO: 8741 - DNA, 216 bp, Homo sapiens
  AC008534.5_28231
  Located on chromosome 5
  Distance between a terminus base of telomere on chromosomal short arm and 5'-terminus of this base sequence : 91287258
  Distance between 3'-terminus of neighbour sequence of sequence listing upward to telomere on chrosomal short arm and 5'-terminus of this base sequence : 42776
cttccaccctcatgaatgtacaccacacacacacacacacacacacacacacacacccctctatgtggataattgttgctatataagtagattttctgaaagaataaaaaaaacacatttaatcccataaataattatcaataaatgttgaacaataaattatggaatagatatgtctgcttcctttttcaatctcctctagccagcaaaccactc

SEQ ID NO: 8742 - DNA, 338 bp, Homo sapiens
  AC008534.5_26226
  Located on chromosome 5
  Distance between a terminus base of telomere on chromosomal short arm and 5'-terminus of this base sequence : 91289064
  Distance between 3'-terminus of neighbour sequence of sequence listing upward to telomere on chrosomal short arm and 5'-terminus of this base sequence : 1590
taatcagtccttatgtctgagaatcctttcacattggtagcctcattccacagacatattgtcttcaggtgcttcggctctgatcctctgcttcccatttggagtggtaattattgtttgaaggtttcatttccccaagtcagctgacactccataatttattgcaaatttcaacggtttaggccagtgacacatcgattataataagaagtaaaaataaataaataaataaataaataaataaataaataaatatattggtttaaaaacataacttcatcaagaggtattcatcaagaggtattcctgccttgctatttacggttattttagaaggc

SEQ ID NO: 8743 - DNA, 427 bp, Homo sapiens
  chr5.fa.O7frz.104864129
  Located on chromosome 5
  Distance between a terminus base of telomere on chromosomal short arm and 5'-terminus of this base sequence : 91389571
  Distance between 3'-terminus of neighbour sequence of sequence listing upward to telomere on chrosomal short arm and 5'-terminus of this base sequence : 100169
atacaatgagtaggctgttaacagcagtcacttggtaggacaaaaactgtggtgcatcactgtagcatacagccagaggaattcttaaaagacaaaactacaatgccgcgtgccagagcccattggaatatataatactcactaaaaataatggaaaagaaaacaaatccttgcagttctcatttgggaatattcactaacttcaccaataacgttttagttaatatgatgctaagtataataatgttgaggatgatgatgatgatgatgatgatgatgaaaacagattatcagaggacttactttatgcctttttctaaaaccttatgtgtagaatcccatctactctttagaacaagtgtaggaggcagatgcttttgttatccccattttgaagcttattcagtgacttagttctggtctgaca

SEQ ID NO: 8744 - DNA, 271 bp, Homo sapiens
  chr5.fa.O7frz.104946622
  Located on chromosome 5
  Distance between a terminus base of telomere on chromosomal short arm and 5'-terminus of this base sequence : 91469791
  Distance between 3'-terminus of neighbour sequence of sequence listing upward to telomere on chrosomal short arm and 5'-terminus of this base sequence : 79793
gtaaacaagtttagctgtgatgtacaggtttcttaactattagatttctcagattctaatatgaaacaatgccaattttcctgtgtgtgtgtgtgtgtgtgtgtgtgtgtgtgattggaggtttgttggcaaattgatgctaaagcatatttggctttggttctggaagaaccaatgtaccccacctcctatccagagagtttgacaagctgctcctgtattccagtaaaatcaggatcaagaagcattctgttggttctggagtacagta

SEQ ID NO: 8745 - DNA, 337 bp, Homo sapiens
  chr5.fa.O7frz.105400982
  Located on chromosome 5
  Distance between a terminus base of telomere on chromosomal short arm and 5'-terminus of this base sequence : 91812673
  Distance between 3'-terminus of neighbour sequence of sequence listing upward to telomere on chrosomal short arm and 5'-terminus of this base sequence : 342611
atctattgtacgacatggtgactatagttaatagcaatacattgtattgctgaaaatcactaagagagtagatattaagtgttctcaccacaaaaaatagtatgtgagttaaagcatatgtcagttagctcaatttcccatttcacaatgtatatacatatttcaaaacatctcaatatacataataaatatatacaattttcatcaagtaaaagtaaataaataaataaataaatagtaaggttcatgtgagtggtaattttgttgggtaactgatgtatcccaagctcctagaacattgcctggcacatagaagtttcaccataaatatttgctg

SEQ ID NO: 8746 - DNA, 441 bp, Homo sapiens
  AC008930.3_15236
  Located on chromosome 5
  Distance between a terminus base of telomere on chromosomal short arm and 5'-terminus of this base sequence : 91945601
  Distance between 3'-terminus of neighbour sequence of sequence listing upward to telomere on chrosomal short arm and 5'-terminus of this base sequence : 132591
ctccagatcagtaaatgttctaagttttttatagctgtacaatcttttaacttatatatgtgccataattaattcaaccatttatcttattgctgaatggattatttctagtttaggactaccacaagaaacaaaaaaagtattatgtgtatatccttagatatccttaaatactggcacttttatttctataggcaagcttgctaggttaaagagtatatatatatatatatatatatatatatgtatattttaattttataaatttcttctttaaaatgttgtagggttttacacttcgaccagcaatgtatgagaagacctttctctacattttaaccaatgatgaatgtgttctctttttaatactggccaaaggatgaaaaaagcatctgttttaatttgcattcccttttactatttgaatattctgtgaattgc

SEQ ID NO: 8747 - DNA, 350 bp, Homo sapiens
  chr5.fa.O7frz.105780606
  Located on chromosome 5
  Distance between a terminus base of telomere on chromosomal short arm and 5'-terminus of this base sequence : 92242530
  Distance between 3'-terminus of neighbour sequence of sequence listing upward to telomere on chrosomal short arm and 5'-terminus of this base sequence : 296488
agccaaaggatcctgatatctgcaacttttaaatatttcagctgtgtgtatgtgtgtgtgttgatgtgtggatgtgtgtgtgtgtgtgtgtgtgtgtgtgtctttctgtctctctagagataaggggaaaataaaaaatgttaataattgcaaaatccacgtgagggatatatgtgaagggtatatgtgtgttcattgcatcattctttcaacttttttgactgtttgaaaatatttttaatacaaagttcagggcaaataaactttaaaataaataaattatatcaactgttatcagaattttctgcatgattttgtaatagaaatagtaggatagcactttgttggat

SEQ ID NO: 8748 - DNA, 330 bp, Homo sapiens
  chr5.fa.O7frz.105896588
  Located on chromosome 5
  Distance between a terminus base of telomere on chromosomal short arm and 5'-terminus of this base sequence : 92358248
  Distance between 3'-terminus of neighbour sequence of sequence listing upward to telomere on chrosomal short arm and 5'-terminus of this base sequence : 115368
caacagatagtcatggctttagactatttgtcaaaataaacttttagagttgtcttgactttgatgccttctaggccccttgagggaagctgagaaggcaagtacaaaagtgggctaacagctacataaaaataagctaaggcccacatcaagatgtggtgtgaggctgggcatggtggctcacgcctgcaatcccaacactttgggaggctgaggccaggagttcaagaccagccttggcaacatagcgagacctgctccctcaaaaaaacaaaacaaaacaaaacaaaactgggcatggtggcacacacctgtaattccagctacttg

SEQ ID NO: 8749 - DNA, 280 bp, Homo sapiens
  AC021124.5_100239
  Located on chromosome 5
  Distance between a terminus base of telomere on chromosomal short arm and 5'-terminus of this base sequence : 92440156
  Distance between 3'-terminus of neighbour sequence of sequence listing upward to telomere on chrosomal short arm and 5'-terminus of this base sequence : 81578
accaacatctatttagcacaatccttgttttgaaagatagcttctagaaaatggtggctatctgatacatgccaagttttatttatatatatatatgtatgtatgtatgtgtatatatatatatatatatatatatatatatatatatatatatatatataaaatcttcatatatatggttgtcttaaatcttaggatttcaaatagctcttgaacatggaaggcaaaaatctaaaccaaacaaccagccaaaaagttagttactgtgaaccagccttta

SEQ ID NO: 8750 - DNA, 447 bp, Homo sapiens
  chr5.fa.O7frz.106070258
  Located on chromosome 5
  Distance between a terminus base of telomere on chromosomal short arm and 5'-terminus of this base sequence : 92522987
  Distance between 3'-terminus of neighbour sequence of sequence listing upward to telomere on chrosomal short arm and 5'-terminus of this base sequence : 82551
gtacctagcaacatcttagaacagtcttcccaaaactgtctgatccccaaagcaaaggttctgacctaaattataatctccaagggatggagctgggaatctgtatttttaacaaggaatcctaaaattcttgtgattagggaagtctagaaaatactacatctggtgaatttatctctggaaggtgtaatatggggagtgtaaagagtggaatggggggaattggggtgggatgaaggtgggaggaattaggtacctagaaaaaataaaagggaatgttgagaatttctcacttagaaattctggcattgtcactgatttagcatttccaggtccgtgtgtgtctgtgtgtttgtgtgtgtgtgtgtgtgtaaagcagggggtggagccgctaccagtctgtggatactatatttgcaattcattccgtgtaactagtatgtagga

SEQ ID NO: 8751 - DNA, 420 bp, Homo sapiens
  AC021124.5_178697
  Located on chromosome 5
  Distance between a terminus base of telomere on chromosomal short arm and 5'-terminus of this base sequence : 92549095
  Distance between 3'-terminus of neighbour sequence of sequence listing upward to telomere on chrosomal short arm and 5'-terminus of this base sequence : 25661
ttgactcacagatgaattgatctgggtacaagccaaaaatagacttggatgcactatagcccctcagaggtagagtgacgttgtaatatcctcccagtatgtagagttgttggtgtgcccttgttattcagtgtgtgtgtgtgtgtgtgtgtgcgtgtgtgtgtgtaaagagaagtagccagaagtaagaatacttatgaagtcatggactatggaaaatggtttgtcagggacatagaaagagaatatggaagatagaggataaggaggtctggggagaagaatacagatgcacacatgggagtaagcccttagtgtgaagatatttgtattacatgttaatctccaccagagagcatccattatggaaaaggcaccatgaatgtctaaccgagtggacagaatgacttagctgacatc

SEQ ID NO: 8752 - DNA, 213 bp, Homo sapiens
  D5S1440
  Located on chromosome 5
  Distance between a terminus base of telomere on chromosomal short arm and 5'-terminus of this base sequence : 92769984
  Distance between 3'-terminus of neighbour sequence of sequence listing upward to telomere on chrosomal short arm and 5'-terminus of this base sequence : 220469
ccaggagtcatagacccataggatcctccctgtaagatcttccaaagtctctgctattatgatcaatagaagactgattcccagtctgcgtgtgtgtgtgtgtgtgtgtgtgtgtgtgtgtgtgtgtgtgtggtggggaaggtgtgccgatgacagatacagaatctttctttcctgtttcttccaaatattttgtctctactctggctattt

SEQ ID NO: 8753 - DNA, 243 bp, Homo sapiens
  HUMUT794
  Located on chromosome 5
  Distance between a terminus base of telomere on chromosomal short arm and 5'-terminus of this base sequence : 92803620
  Distance between 3'-terminus of neighbour sequence of sequence listing upward to telomere on chrosomal short arm and 5'-terminus of this base sequence : 33423
cctatgcatgcttatttgcaggcatataaataaatttgggatgtaaaatcagctccaagcaatcaatcaatctttctttcttttctttcttctttctttctttctttcttttctttctttctctctttctttccttctttcttttctttcttcctttttctttcttttatttttttatttatttattttatttatttatttattttttgagacggagactcgctctgttgcccaggctggagt

SEQ ID NO: 8754 - DNA, 413 bp, Homo sapiens
  AC008951.4_79287
  Located on chromosome 5
  Distance between a terminus base of telomere on chromosomal short arm and 5'-terminus of this base sequence : 92806656
  Distance between 3'-terminus of neighbour sequence of sequence listing upward to telomere on chrosomal short arm and 5'-terminus of this base sequence : 2793
cagaagcattaacaatgaatttagcttgcttttttctctgtctttccttctctctccctctctctctctctctctctctctctctctctctctctctctctctctccttgtgacatggctatagaactgaatatccatttgctactaggtttcctttctgggcgtttgtgtacacttttcagaggagcagaaatcaaggcagattcggtgccagttattttaatggagaaaaagattgacaaaccatcagtctttctcactcgctcactgcaagaaaagatgtgacatgacctgcaatagcatttcagaccatctgacttaagacttgagttagttaggttttatctcctccaagaaaaatatttgacccttcatttccagccaagctcttctatgctctaactatcatgcca

SEQ ID NO: 8755 - DNA, 202 bp, Homo sapiens
  D5S652
  Located on chromosome 5
  Distance between a terminus base of telomere on chromosomal short arm and 5'-terminus of this base sequence : 92970125
  Distance between 3'-terminus of neighbour sequence of sequence listing upward to telomere on chrosomal short arm and 5'-terminus of this base sequence : 163056
gaatactttaagtgacacacagaaaatcattcaagatcttggtcttatttcaaacaaaaacaagatctcaattatcctgtcttttgcctgtttaattaccttttaattattaagaagttattctttcaaatggagtctgtgtgtgtgtgtgtgtgtgtgtgtgtgtgtgtgatttgcatatgcgtattggactgaataagct

SEQ ID NO: 8756 - DNA, 99 bp, Homo sapiens
  D5S644
  Located on chromosome 5
  Distance between a terminus base of telomere on chromosomal short arm and 5'-terminus of this base sequence : 92975537
  Distance between 3'-terminus of neighbour sequence of sequence listing upward to telomere on chrosomal short arm and 5'-terminus of this base sequence : 5210
actaactggtagatcaatgtgccaaaacacacacacacacacacacacacacacacacacacacacacacacaaattatcacagtcttagcaaatccaa

SEQ ID NO: 8757 - DNA, 285 bp, Homo sapiens
  chr5.fa.O7frz.106600531
  Located on chromosome 5
  Distance between a terminus base of telomere on chromosomal short arm and 5'-terminus of this base sequence : 93114805
  Distance between 3'-terminus of neighbour sequence of sequence listing upward to telomere on chrosomal short arm and 5'-terminus of this base sequence : 139169
tggtaccatcttcactttacagggaagagaacagcagcttagcaggtcagggtacttctccaaaatcatgtggctacaggatgtggagttggggtatgaacttaaaactgaggtccagggtccaatgtgtggcctcttagacaccaagcgctcgctcgctctctctctctctctctatatatatacacacacacacacacacacacacacacacacacacacatatacatatacatatacaccagaaataagacaccaagcatcttgaccactggccaagattat

SEQ ID NO: 8758 - DNA, 300 bp, Homo sapiens
  chr5.fa.O7frz.107311515
  Located on chromosome 5
  Distance between a terminus base of telomere on chromosomal short arm and 5'-terminus of this base sequence : 93164345
  Distance between 3'-terminus of neighbour sequence of sequence listing upward to telomere on chrosomal short arm and 5'-terminus of this base sequence : 49255
atctttgtggaatcctttaagtactgaaaaggttataaatgatctaactttcaaaatttaggcagaataaaatgaaataattaaaagacatgtctcagatgtgttcgtttaacagcatgccacctataaagctagtcagtgaaacgttgcaatgtatatttccacattgaatgccatcaatcctattgactttatcttctgaaaaatgtggttgtagtaaacacacacacacacacacacaccacacaactctgcagagctaaatttgaagaacatctatgagctatgtaatgatcaagc

SEQ ID NO: 8759 - DNA, 183 bp, Homo sapiens
  AC020923.5_109185
  Located on chromosome 5
  Distance between a terminus base of telomere on chromosomal short arm and 5'-terminus of this base sequence : 93282081
  Distance between 3'-terminus of neighbour sequence of sequence listing upward to telomere on chrosomal short arm and 5'-terminus of this base sequence : 117436
ttgctagtccatctaaatactgaactaatatttatttgcttttccttaatatgtatataaagatacacacacacacacacacacacacacacacacacacaatgattaacactctttttaacacaaataataattacataacttttatttcaggcttttaccttgaattgagtttccacttca

SEQ ID NO: 8760 - DNA, 403 bp, Homo sapiens
  chr5.fa.O7frz.107103650
  Located on chromosome 5
  Distance between a terminus base of telomere on chromosomal short arm and 5'-terminus of this base sequence : 93372214
  Distance between 3'-terminus of neighbour sequence of sequence listing upward to telomere on chrosomal short arm and 5'-terminus of this base sequence : 89950
tataaggaactgaccaaagctaagaagaaacaaaaagcaggctgacaggataggccttggtgatggtggatttagggaggagtggtactgccttagagccaacaaggagggtctctctgagtaagagacaattcagagaccaggatgaaatggaaaactgagacatgaattccctaagcaataaacttcccaaagcttatcccaaagaaaagagaagagaaaagaaaaaaaaaagaaggaaggaaagaaagagagagagaaagaaagaaagaaagaaagaaagaaagaaagaaagaaagaaagaaagaaagagagagagagaaagaagaaagaaaagaaaagttaggagcccattttgctgagaaactcttttaaataagctacaagtacttgaatctggctc

SEQ ID NO: 8761 - DNA, 478 bp, Homo sapiens
  chr5.fa.O7frz.107006241
  Located on chromosome 5
  Distance between a terminus base of telomere on chromosomal short arm and 5'-terminus of this base sequence : 93469411
  Distance between 3'-terminus of neighbour sequence of sequence listing upward to telomere on chrosomal short arm and 5'-terminus of this base sequence : 96794
tctaaatgaattctgtaagctgtcatttatttgaaaatgtcttttactcttgattttgaagcatattttcactgtatgtgcaaagttgagtttagaattttctttgtcttccaactctttaaaaatgctctatcatcttcaggcctccaccgttgacatgagaagttagtgtatgtactgttgttcatctgtatgtagcattgtttccaggttctcttaaaggttttctttttatctttagttttaagcagttttgaccatgatgtgcttaagacattattatttgtgtgtgtgtgtgtgtgtgtgtgtgtgtgtgtgtgtgtatttatctttttgggggtttgctgaacattttggatctggtaagtggtgtttttcatcaaacttaataatattttaactattatttcttcagatattttcttctgctgcattctcacactccttctgtggctcctgttagatacatgttagactg

SEQ ID NO: 8762 - DNA, 339 bp, Homo sapiens
  AC008865.3_94529
  Located on chromosome 5
  Distance between a terminus base of telomere on chromosomal short arm and 5'-terminus of this base sequence : 93578779
  Distance between 3'-terminus of neighbour sequence of sequence listing upward to telomere on chrosomal short arm and 5'-terminus of this base sequence : 108890
cgtagatctttggtcagatgacaggtgtggttttgaaacacttcttaaaatgtttttttttttttttttttttttgtgtgtgtgtgtgtgtgtgtgtgtgtgtgtggtggagagcatttatagaccttcaagaagaaacttacctgttaaaataacgataacaataattctaacccttaagaaaggtgacgttgtggggaaactgggccacatatgttacagtcctctaattggttttctatttttgaagaattatctagtaacatgtattaagtatttattgtgtgttaagaatttttaaatattcaaacaatttgtcaagttaattctactccagaa

SEQ ID NO: 8763 - DNA, 271 bp, Homo sapiens
  D5S484
  Located on chromosome 5
  Distance between a terminus base of telomere on chromosomal short arm and 5'-terminus of this base sequence : 93745367
  Distance between 3'-terminus of neighbour sequence of sequence listing upward to telomere on chrosomal short arm and 5'-terminus of this base sequence : 166249
atcatcaagtttccttactgggtttgagtttctatacttatttttatctttttattttactaatattcagactcagttttaccaactgtatttatttgacatacacacacacacacacacacacacacacacacacacacacacttcattggggagaaggacgatagagatgagaggggctttttattgattttttttcatcctaattttagaaagatgttcattatagaaattttagaaaaaagaagaaagaaatgccactaggaatcca

SEQ ID NO: 8764 - DNA, 256 bp, Homo sapiens
  chr5.fa.O7frz.107675376
  Located on chromosome 5
  Distance between a terminus base of telomere on chromosomal short arm and 5'-terminus of this base sequence : 93978852
  Distance between 3'-terminus of neighbour sequence of sequence listing upward to telomere on chrosomal short arm and 5'-terminus of this base sequence : 233214
tgaccttttctaggtatttctaaacacctagaacttttgctttaatattccgtgtcggtgatctctccttggtcagcaggtcaggtttggtttggtttgtttcttttttttaagagggaaaaataactaagattttttattaaatttgttgaggaaaaaatgactcaatatgaattttatacacacacacacacacacacacacacacacacgcccttatgagtaaatgttgaactaagagaattgctgattacat

SEQ ID NO: 8765 - DNA, 184 bp, Homo sapiens
  chr5.fa.O7frz.108011974
  Located on chromosome 5
  Distance between a terminus base of telomere on chromosomal short arm and 5'-terminus of this base sequence : 94260038
  Distance between 3'-terminus of neighbour sequence of sequence listing upward to telomere on chrosomal short arm and 5'-terminus of this base sequence : 280930
catgcaatgttcatataggaagatatatgtatatgtatgtgcatatatatatatatatatatattcatttacgagagaattctagttttgtttgtggcagcaacttgatttctctgcctttcaagcatgggaggtgataatcacggcaaaggtaataaatctgtccaatgagttaagagtactg

SEQ ID NO: 8766 - DNA, 292 bp, Homo sapiens
  chr5.fa.O7frz.108094916
  Located on chromosome 5
  Distance between a terminus base of telomere on chromosomal short arm and 5'-terminus of this base sequence : 94371797
  Distance between 3'-terminus of neighbour sequence of sequence listing upward to telomere on chrosomal short arm and 5'-terminus of this base sequence : 111575
gtagactggagctgttcctattcggccatcgtggctccacctccctcatgaatatcttatatagtggaatgagattggcattgaccatgtgtattttaatatatgtcatattttgtgtatgtcattggtgtttttagctcttgtaatgcatagttctgaatattttaaatatctaacagttataaagctataattttctctcacacacacacacacacacacacacacacacacacacacctcacggtgccccttttcattgtggatggtgatagaagtcaccataattctg

SEQ ID NO: 8767 - DNA, 455 bp, Homo sapiens
  AC017114.4_89081
  Located on chromosome 5
  Distance between a terminus base of telomere on chromosomal short arm and 5'-terminus of this base sequence : 94588924
  Distance between 3'-terminus of neighbour sequence of sequence listing upward to telomere on chrosomal short arm and 5'-terminus of this base sequence : 216835
atcctagaattcctgtttgaagatactggaaaaccaatcataaatttatgatatacctagatcataaaagacctagaatagtcaaaatgactttgggtttttcaactttgaaaaatattagagtatttactctacctgatttagatatctcaaataaatctccagcaataaagacaacgtggtataggcaaaattgttaatggaagacaatagagaatccaaaaacagacctacaaatgtatagtcaatttttttttataaagacaccaatataattaaatgaggaaataataatctttttaataaatggtgttggaagaattggatagctatattctaggaaggaaggaaggaaggaaagaaaggaaagtgaaggaaagggaaggaaggaaaggaaaggaaaggaaaggaaaggaacaaaggggagggagggatgtggttacagtagcttatgc

SEQ ID NO: 8768 - DNA, 185 bp, Homo sapiens
  G08480
  Located on chromosome 5
  Distance between a terminus base of telomere on chromosomal short arm and 5'-terminus of this base sequence : 94716910
  Distance between 3'-terminus of neighbour sequence of sequence listing upward to telomere on chrosomal short arm and 5'-terminus of this base sequence : 127531
ccagagaaagaaaaccaataggatagagataggtgatgattaattgatagatggaaagatagatagatagatagatagatagatagatagattattatgagggattggcttacatgattatggagactgagaagtcccattatctgccttctgtaagctagaagagcagggtagcctgaagtaca

SEQ ID NO: 8769 - DNA, 224 bp, Homo sapiens
  AC008903.4_83964
  Located on chromosome 5
  Distance between a terminus base of telomere on chromosomal short arm and 5'-terminus of this base sequence : 94866996
  Distance between 3'-terminus of neighbour sequence of sequence listing upward to telomere on chrosomal short arm and 5'-terminus of this base sequence : 149901
aagaatgtaagactccagagaaacaactggatttgatgcaaataaatgtatgaaatgaaaatgatgaaagaagaataagcattttggagactctgagttccagtgaattgaatggtatcatctacttttaaaataaataaataaataaataaataaataaataaataaataaaggcagcggagagagagagagagagagaaagtcacagcttatttgagatgaa

SEQ ID NO: 8770 - DNA, 417 bp, Homo sapiens
  chr5.fa.O7frz.100080607
  Located on chromosome 5
  Distance between a terminus base of telomere on chromosomal short arm and 5'-terminus of this base sequence : 95201762
  Distance between 3'-terminus of neighbour sequence of sequence listing upward to telomere on chrosomal short arm and 5'-terminus of this base sequence : 334542
acaaatggtacgtaagaacctccattaatctttgtttcaaggagaatgtgaacattctctgtacaatttaatattccgtgtccacccacaaaattctacagagaagtgtgtgtgtgtgtgtgtgtgtgtgtgtgtgtgtgagagagagagagagagggagagaatcggtaagtttgattttagtaggaaattagtaaaatatgcatattacaaataaagagagtacaagtccccatctgccatttatagtaagattttatatttcagagcttaataatgaacctccctggggaaaatttaataaagcaggttccctggtattgccagcagttgggtttttctgcatctcttattttcttactccccagggggaaaaaaatctcagtaagatttgtgagcctgtatcgaagataaatc

SEQ ID NO: 8771 - DNA, 169 bp, Homo sapiens
  D5S618
  Located on chromosome 5
  Distance between a terminus base of telomere on chromosomal short arm and 5'-terminus of this base sequence : 95403175
  Distance between 3'-terminus of neighbour sequence of sequence listing upward to telomere on chrosomal short arm and 5'-terminus of this base sequence : 200996
ctacctgggtggggaaaggcctggctctcatccttctaggaaactagtagaacacacacacactctttctcctgtctctcatccttctagaaaactagcgcgcgcgcacacacacacacacacacacacacacacgctttctttctcctgttttccatactgagccctt

SEQ ID NO: 8772 - DNA, 193 bp, Homo sapiens
  D5S2044
  Located on chromosome 5
  Distance between a terminus base of telomere on chromosomal short arm and 5'-terminus of this base sequence : 95447142
  Distance between 3'-terminus of neighbour sequence of sequence listing upward to telomere on chrosomal short arm and 5'-terminus of this base sequence : 43798
agtcccagctactcgggaggctgaggttggagaattatttgagctcaggaggtcaaggcttcaatgggccaagaggaggctgaggtgggaggactgcttgagcccaggaggtcgaggcttcagtgagccaagatggcaacacacacacacacacacacacgagttatgataacttaagagatttggcagacaa

SEQ ID NO: 8773 - DNA, 441 bp, Homo sapiens
  chr5.fa.O7frz.100457236
  Located on chromosome 5
  Distance between a terminus base of telomere on chromosomal short arm and 5'-terminus of this base sequence : 95571362
  Distance between 3'-terminus of neighbour sequence of sequence listing upward to telomere on chrosomal short arm and 5'-terminus of this base sequence : 124027
tctttgtagatgctttgtctaaacacatttttaaaaatctgatgggtaactgatttttatttttatgtgaaagaaaagtatagaatgtaagcaacaaattattgaatgtccactgttccttttgctttctttcaaaaccacgttgtgtttacttcctttcttacataaagagtaaaacaaaacaaccaaaataccaagcaaacaaaaaaaccaaaaagcaaaaaccaatttacaacacacacacacacacacacacacacgctcgcgcacacacacacacagagtctagatgacttatggttttaatatatgtttcagactcgatcttaagaaaaggtatttcatacgatgaaaaaatcagtaaaatgtaatgaaatgtaaattggaaattatttttttcatttttgtttttttccttaagtaaggtgtaagcattcagtg

SEQ ID NO: 8774 - DNA, 403 bp, Homo sapiens
  chr5.fa.O7frz.100583594
  Located on chromosome 5
  Distance between a terminus base of telomere on chromosomal short arm and 5'-terminus of this base sequence : 95697687
  Distance between 3'-terminus of neighbour sequence of sequence listing upward to telomere on chrosomal short arm and 5'-terminus of this base sequence : 125884
  misc_feature (1)...(403): n = A,T,G or C
tttcaccagtaactttgatcatcttcctgaggagaactggcacctgatgtccctagagagccatctgctcgaggcactgggcactgtgcactgtgctgtcactgctgaggggaatggtgactgtagtcaccctgtgtggccacacctcgagagctgtctttgattttcttttgcatagtattacttgtaaattcatgtgataatatttactatgtctgggatttttttggaaatccatatgcatgatggggggaaaaatnnnngncnnnnnncacacacacacacacacacacacacacacacacacaaactctagatatctgaaatcaaattttttttgaagtttttattgctacataattgatatacgtattttcagagtacatgtgataatttgatgcat

SEQ ID NO: 8775 - DNA, 436 bp, Homo sapiens
  chr5.fa.O7frz.100684651
  Located on chromosome 5
  Distance between a terminus base of telomere on chromosomal short arm and 5'-terminus of this base sequence : 95798584
  Distance between 3'-terminus of neighbour sequence of sequence listing upward to telomere on chrosomal short arm and 5'-terminus of this base sequence : 100494
gagttgtgaatactttgcagacaagtctgccaagaccattcattttcaaatctttattaatgaactaggactaagtagaacggcttttgtggagaaggaaagaatggaaatgtggtagtcctggacttccttttggagcagtgtggtataatgggtccgtgaatcagaaagtcaggaaaatatgctcgtccagctctactttctacttctagaaatatgtagactattataactataatttattgtgtatgtgtatatgtgtgtgtgtgtgtgtgtgtgtgtgtgtattttcttgattggaggaatatagatacaaatccaaagattattcctgctttaaaaatcaagattctgcttgaatctggagtttgtcattatagcacccttgagaatcattgactataaaatatcagtaggtggcagtagaagatttatt

SEQ ID NO: 8776 - DNA, 473 bp, Homo sapiens
  chr5.fa.O7frz.100820297
  Located on chromosome 5
  Distance between a terminus base of telomere on chromosomal short arm and 5'-terminus of this base sequence : 95908670
  Distance between 3'-terminus of neighbour sequence of sequence listing upward to telomere on chrosomal short arm and 5'-terminus of this base sequence : 109650
catcaatattccatgcatagacaaatatttataaatatttaaataagcagacatgtgttcttgtgtgtgagtgtgtatatatatatatatatacacaatgtacatatatttatatatagtgtatatatgtttacgtgtatctgtatgtgtgtgtatatgtgtgtgtgtgtgtgtgtgtgtgtatatatatatatatatatatatatatgtatatgtatatatggacatctttaagtttaccatgcatgggtatacctttttcctatgctataatatgattattacataagttatttttctggcttccagttgatgaaattacattattttttgggtattgtgttactttttgctatagtaaacaatgtgtccttgaacacccttgcactctgaatatttgtttacttgagccatatccatagaataaattcctaggaattatgcctttgctattcatgtctacatgaaacatg

SEQ ID NO: 8777 - DNA, 169 bp, Homo sapiens
  DISD22_0006946
  Located on chromosome 5
  Distance between a terminus base of telomere on chromosomal short arm and 5'-terminus of this base sequence : 96162470
  Distance between 3'-terminus of neighbour sequence of sequence listing upward to telomere on chrosomal short arm and 5'-terminus of this base sequence : 253327
taatctctttccgctgccaaatactgtatgtgtgtgtgtgtgtctgtgtctgtgtgtgtgtgtgtctgtgtgtgtgtgtgtgtgtgtgtgtgtgtgtgtgtgtgtgaattagcaaatatttattgtgcacctcctaagttctaggcacaggaagggtgaacaaggtaga

SEQ ID NO: 8778 - DNA, 442 bp, Homo sapiens
  chr5.fa.O7frz.101231124
  Located on chromosome 5
  Distance between a terminus base of telomere on chromosomal short arm and 5'-terminus of this base sequence : 96312241
  Distance between 3'-terminus of neighbour sequence of sequence listing upward to telomere on chrosomal short arm and 5'-terminus of this base sequence : 149602
cctttaggatgacttcactaaaggaaaattctgagaacatggctcattggctcactgacttccttttttcttctttccttttctgtcctgaaaatgattttttttttctgatctctctctctctctttctcaacacacacacacacacacacacacacacacacacacacacacacacacatttccagcttttgaaaaaagttggaaaatccagtaacacaagctgatgtttccagagggcaccaatcagctggagctgagtagcccctgtgtacattggacagagcccaaatcccctgttctaccccctgcacacaattcacttagacagaacctatctcgtcattgaaggcacttaagttggtgacctctgggctacatcatcccagttttaaactttttcctcatagatcttcattaatctgcagtaattagatcctct

SEQ ID NO: 8779 - DNA, 103 bp, Homo sapiens
  DISD22_0006958
  Located on chromosome 5
  Distance between a terminus base of telomere on chromosomal short arm and 5'-terminus of this base sequence : 96501984
  Distance between 3'-terminus of neighbour sequence of sequence listing upward to telomere on chrosomal short arm and 5'-terminus of this base sequence : 189301
gctgtcggaacctttatcctatatatatgtacacacacacacacacacacacacacacgacatatgcatttcatatacacacacatctttatactgaggaggc

SEQ ID NO: 8780 - DNA, 279 bp, Homo sapiens
  DISD22_0006970
  Located on chromosome 5
  Distance between a terminus base of telomere on chromosomal short arm and 5'-terminus of this base sequence : 96783315
  Distance between 3'-terminus of neighbour sequence of sequence listing upward to telomere on chrosomal short arm and 5'-terminus of this base sequence : 281228
gatcagttactgaatttagaagcactacagttacttgtagagtccctgcatttctcggggttatccagaaaaatagaaccaagagtatgtatatatatatatatatacaagccccatgcacacatatacaaaagagtgtgtgtgtatatatatagagagagagaaagagagagaggagatttattatgggaattgtctcatgagattatggagaccaagaactccaaaattaatttgggacaaataattgcaaaccaaagcttgaggttgcatgtctga

SEQ ID NO: 8781 - DNA, 137 bp, Homo sapiens
  DISO7_10001920
  Located on chromosome 5
  Distance between a terminus base of telomere on chromosomal short arm and 5'-terminus of this base sequence : 96886732
  Distance between 3'-terminus of neighbour sequence of sequence listing upward to telomere on chrosomal short arm and 5'-terminus of this base sequence : 103138
acgcattctcattattgcacacatcaaaatgaatttaggaagtttaacttctttaagatttagtgtttcgtgtgtgtgtgtgtgtgtgtgtgtgtgtgcatacatatgtataaatacacacagagacgttcctgtga

SEQ ID NO: 8782 - DNA, 107 bp, Homo sapiens
  DISO7_10001923
  Located on chromosome 5
  Distance between a terminus base of telomere on chromosomal short arm and 5'-terminus of this base sequence : 96923170
  Distance between 3'-terminus of neighbour sequence of sequence listing upward to telomere on chrosomal short arm and 5'-terminus of this base sequence : 36301
ccacaagtgtacatgggtgcacacacacacacacacacacacaccccattctcttctaagaccatctctaacctctaatatttgattcattaggatctttctgtgtc

SEQ ID NO: 8783 - DNA, 454 bp, Homo sapiens
  chr5.fa.O7frz.101981741
  Located on chromosome 5
  Distance between a terminus base of telomere on chromosomal short arm and 5'-terminus of this base sequence : 97027239
  Distance between 3'-terminus of neighbour sequence of sequence listing upward to telomere on chrosomal short arm and 5'-terminus of this base sequence : 103962
gtagaagcctctaagaaccaacgttgacctacttctggacaaggagaccaaaagtatgtgtggaggaaaaatgaaaagtccttccacagagataggtgaacacagaaggaaagaagagggaggaacaaaacttagaagtacatgcctggctcaaaagaagcctctaaatcaaaatttaaaaacatattggtaaatctatagaaaagttattataggcagtcaataactgagaagttattagctacagaaaaaaataaaaatgatggaagaaactaaaaattgaaaagtgtatgggaatctatctaaactgtgtatctgtcatccatacatctatctatctatctatctatctatctatctatctatctatctatctatctatctgcacacacattttcccccaaggaattagaaagcaatacaagtagtaaaaaagctagaatagttgacggac

SEQ ID NO: 8784 - DNA, 201 bp, Homo sapiens
  G12408
  Located on chromosome 5
  Distance between a terminus base of telomere on chromosomal short arm and 5'-terminus of this base sequence : 97027454
  Distance between 3'-terminus of neighbour sequence of sequence listing upward to telomere on chrosomal short arm and 5'-terminus of this base sequence : -239
gcagtcaataactgagaagttattagctacagaaaaaaataaaaatgatggaagaaactaaaaattgaaaagtgtatgggaatctatctaaactgtgtatctgtcatccatacatctatctatctatctatctatctatctatctatctatctatctatctatctatctgcacacacattttcccccaaggaattagaaag

SEQ ID NO: 8785 - DNA, 197 bp, Homo sapiens
  D5S401
  Located on chromosome 5
  Distance between a terminus base of telomere on chromosomal short arm and 5'-terminus of this base sequence : 97319289
  Distance between 3'-terminus of neighbour sequence of sequence listing upward to telomere on chrosomal short arm and 5'-terminus of this base sequence : 291634
ctaaacgatccccaatgtctgttctaattctaagaatcaaagtgattaagagtctttgatagcaccagagagatctaggtagtagagaacacaggtatgagagaacacatcctattaaacacacacgtgcatgggtgcatgcacacacacacacacacacacacacacacacactcaacagaaaaaccaaaatagct

SEQ ID NO: 8786 - DNA, 393 bp, Homo sapiens
  AC008931.5_91939
  Located on chromosome 5
  Distance between a terminus base of telomere on chromosomal short arm and 5'-terminus of this base sequence : 97371659
  Distance between 3'-terminus of neighbour sequence of sequence listing upward to telomere on chrosomal short arm and 5'-terminus of this base sequence : 52173
ttcagatatctgactcaaacatgaaaaattaattcaaaaacactattggatcttcatttaccattttctcagcataaaggtcatactctataaggtacagttaaccccatcaatccagaaaaattcctggctcatatttggaatgacacttgcttttattcctttttattaaaaaaatattattattattattattattattatttgagacagagtcaagctctgttgcccagactggaatgcagtggtgtgatcttggctcactgtaacctccgcctcctaggttcaagtgattctcctgccacagcctcctgagtagctgggactacaggtgctcgccaccacgcccagctatttttttgtatttttagtagagacgaggtttcaacttgt

SEQ ID NO: 8787 - DNA, 467 bp, Homo sapiens
  AC008931.5_32985
  Located on chromosome 5
  Distance between a terminus base of telomere on chromosomal short arm and 5'-terminus of this base sequence : 97479219
  Distance between 3'-terminus of neighbour sequence of sequence listing upward to telomere on chrosomal short arm and 5'-terminus of this base sequence : 107167
agaactcttcctttccatacaggtgtaaatagagctatggtttggtagcaaaggcttttgttccagggcttaagcccaaggactattctcaaaatgaagtgcaagtgggtgatctttataacaaaattatctttgtgaagatgccggggtctgacagacaagtggagcacatcctaacatgattttagccacacaaacacacacacacacacacacacacacacacaccacaaaataagtttaaaataaaaggcagaagagcacttcttttggtagtaaaatgcactggactacagcctgtaggaggctcctgctctgaaacctgcaatttttcccaggggcacttcaaagagactggctgtgaaaacattcccctgacttccctcacttacacagaaccttcactcaggcttctctttcaggtgagaggcctcacggggaaatggtagtgaacagaagcaaacaga

SEQ ID NO: 8788 - DNA, 192 bp, Homo sapiens
  D5S2103
  Located on chromosome 5
  Distance between a terminus base of telomere on chromosomal short arm and 5'-terminus of this base sequence : 97479349
  Distance between 3'-terminus of neighbour sequence of sequence listing upward to telomere on chrosomal short arm and 5'-terminus of this base sequence : -337
ctttgtgaagatgccggggtctgacagacaagtggagcacatcctaacatgattttagccacacaaacacacacacacacacacacacacacacacaccacaaaataagtttaaaataaaaggcagaagagcacttcttttggtagtaaaatgcactggactacagcctgtaggaggctcctgctctgaaac

SEQ ID NO: 8789 - DNA, 270 bp, Homo sapiens
  chr5.fa.O7frz.99357797
  Located on chromosome 5
  Distance between a terminus base of telomere on chromosomal short arm and 5'-terminus of this base sequence : 97593552
  Distance between 3'-terminus of neighbour sequence of sequence listing upward to telomere on chrosomal short arm and 5'-terminus of this base sequence : 114011
aataacattgcaagtcactaaatagtagccttcagtggcgtggcataactattccaacccaattagctatatctctgctacatccctgcctgtaagcctgaccaaaaatataagcagcttagctatggtgggcaacaacaaaaagccatttttcgtagcttataagaatgtataggcagatagatagatgatagatagatagatagatagatagatagatagatagatagatagatagatagtagctcgataatcagattccattgaggt

SEQ ID NO: 8790 - DNA, 221 bp, Homo sapiens
  D5S418
  Located on chromosome 5
  Distance between a terminus base of telomere on chromosomal short arm and 5'-terminus of this base sequence : 97721072
  Distance between 3'-terminus of neighbour sequence of sequence listing upward to telomere on chrosomal short arm and 5'-terminus of this base sequence : 127250
ggaaacaatgatgacatctccaactataattgtgtgtgtgtgtgtgtgtgtgtgtgtgtgtgtgtgcgtgtgttttagttatatcacgttttgcttcatgtattttggacttctggttattggggtacgtatacatttaggtttttaaaaattcattggcctctttataattacgaaatgcccctatgcatctctagtaacatttcctgttttgaaggcta

SEQ ID NO: 8791 - DNA, 435 bp, Homo sapiens
  AC027504.2_102575
  Located on chromosome 5
  Distance between a terminus base of telomere on chromosomal short arm and 5'-terminus of this base sequence : 97730434
  Distance between 3'-terminus of neighbour sequence of sequence listing upward to telomere on chrosomal short arm and 5'-terminus of this base sequence : 9141
atgacttcaataactcactttcagcaatggatatgtcatcctgactgaaaattagtaaggaaacattgtacacaaactacaccttatttatttatttatttatttatttatttatttatttattattatttaaaacatagttttgttctttttgcccatgctggagtgcaatggcatgatctcggctcacttcaacctctgcctccaggattcaagtgattttcctgcctcagcctcctaagtagctgggattacaggtacacctggctaattttgtatttttagtagagatggggtttcaccatgttggccaggttggtctccaactcctgacctcagatgatctgcctgccttggcctcctgaagtgctgggattacaggtggcagccactgttcccggcgggacacaaattacgctttagactaaatggaac

SEQ ID NO: 8792 - DNA, 226 bp, Homo sapiens
  D5S2022
  Located on chromosome 5
  Distance between a terminus base of telomere on chromosomal short arm and 5'-terminus of this base sequence : 97818847
  Distance between 3'-terminus of neighbour sequence of sequence listing upward to telomere on chrosomal short arm and 5'-terminus of this base sequence : 87978
ggccaataagtttatatcggtatctttttttactctctgaaagaatatctttaaaacatggattattcttctcttaaattttccataaaactctccctaatactacttattatgctgtgtgtgtgtgtgtgtgtgtgtgtgtgtgtgtgtgtgagagagagagagagagagagagagagacagagacagagtctcactctgttgcccaggctggagtgcaatgaag

SEQ ID NO: 8793 - DNA, 210 bp, Homo sapiens
  D5S501
  Located on chromosome 5
  Distance between a terminus base of telomere on chromosomal short arm and 5'-terminus of this base sequence : 97891133
  Distance between 3'-terminus of neighbour sequence of sequence listing upward to telomere on chrosomal short arm and 5'-terminus of this base sequence : 72060
caatccaggctcataaatcaaaagagttaatatttttactatgacaatactactcagagcaatctatagattcagtgcaatccgtatcaaaataccagttacattcttcacataaatagaaagaaatcttaaaatttgtatggaaccacaaaatcaccctgaaatcacacacacacacacacacacacacaaaccctgaatagccaaagt

SEQ ID NO: 8794 - DNA, 311 bp, Homo sapiens
  chr5.fa.O7frz.45679701
  Located on chromosome 5
  Distance between a terminus base of telomere on chromosomal short arm and 5'-terminus of this base sequence : 98023664
  Distance between 3'-terminus of neighbour sequence of sequence listing upward to telomere on chrosomal short arm and 5'-terminus of this base sequence : 132321
cagtagcatttctatacagcaatacactaaagccaagaaccaaatcaagaacacagccccatttataatagacacacagacacacacacacacacacacacacacacacacacacacacacacacacacacacaacctacaaatacatctaaccaaggaggcgaaagatctctacagggagacctataaaacactgctcaaagaaatcagagaaggcacagatggaaaaacagttcatggtcatggattggaagaatcaacatcattaaaatagcctgactgcccaaagctatttgcagattcactgctat

SEQ ID NO: 8795 - DNA, 449 bp, Homo sapiens
  AC022241.2_68869
  Located on chromosome 5
  Distance between a terminus base of telomere on chromosomal short arm and 5'-terminus of this base sequence : 98098298
  Distance between 3'-terminus of neighbour sequence of sequence listing upward to telomere on chrosomal short arm and 5'-terminus of this base sequence : 74323
cgacttatgctaagtctatgctagtgcttagatctcagtggtttttaactttgtggaaatatgtgcttggcttctgttaatacgaaatatcccacacctgatgtcagatagatggatgtatagatggatagatagatagatagatagatagatagatagatagatagacagatagatagaaacttcctttcaactcacagaattactatatatctacggatgtaatctatgctgttaattctcaatattcatggaattatgtttacaaaaatgctgtgagcactgaattagtaaatactgaaacattcttcctagagaaaagacaggaagaggttcctataagcctctggtcacatttttatcaacagatcaatatataactttgttttatgaatgtttctgtttaaagataccttttcttaaaggttgactcaagaactgctaagtaa

SEQ ID NO: 8796 - DNA, 361 bp, Homo sapiens
  chr5.fa.O7frz.45773631
  Located on chromosome 5
  Distance between a terminus base of telomere on chromosomal short arm and 5'-terminus of this base sequence : 98143766
  Distance between 3'-terminus of neighbour sequence of sequence listing upward to telomere on chrosomal short arm and 5'-terminus of this base sequence : 45019
cagactcataccagagctacaccattggcttttccgtgtgtgtgtgtgtgtgtctgtaacatatatatatatatagagagagagagagagacagagagacagagagacagagagagagagagacagagagagagagagagagagagaatgcaccaaaggggaaaaatacaaataagaatgaatgctgacttcatatgagaagtaatgcatcccacaagacaatgaaacagtatttttaaagagctaaaaaaaaatttttttagtcactgctaacctaaaagtctatattcagtagaatagccttcaaatatgaaggtgaagtaaaaacattttcagactaacaaagctgatagacttcatt

SEQ ID NO: 8797 - DNA, 154 bp, Homo sapiens
  DISO7_10001832
  Located on chromosome 5
  Distance between a terminus base of telomere on chromosomal short arm and 5'-terminus of this base sequence : 98238506
  Distance between 3'-terminus of neighbour sequence of sequence listing upward to telomere on chrosomal short arm and 5'-terminus of this base sequence : 94379
tgtgaatatagcaagcattcacatacacacacacacacgcacacacacacacacacacgcagcatgtctcttcctgcacatccttaaaaatcacatcaaaccctgcaaaagaaaagtcatacataataataagaatctggatttcatgtctgtg

SEQ ID NO: 8798 - DNA, 197 bp, Homo sapiens
  DISO7_10001835
  Located on chromosome 5
  Distance between a terminus base of telomere on chromosomal short arm and 5'-terminus of this base sequence : 98306631
  Distance between 3'-terminus of neighbour sequence of sequence listing upward to telomere on chrosomal short arm and 5'-terminus of this base sequence : 67971
agttcttccttctgcagtcacaaaaaaaaggaaggaaggaaagaagaaaggaaggaaggaaggaaggaaggaaggaaggaaggaaggaaggaaggaaggaggggcaaaaagtaaagattattaaaaaggagagtaaaaggaaagagaagtataagaaaacaaaatgggatttttttgaattctgtctccaaatggag

SEQ ID NO: 8799 - DNA, 389 bp, Homo sapiens
  AC008834.4_85300
  Located on chromosome 5
  Distance between a terminus base of telomere on chromosomal short arm and 5'-terminus of this base sequence : 98426762
  Distance between 3'-terminus of neighbour sequence of sequence listing upward to telomere on chrosomal short arm and 5'-terminus of this base sequence : 119934
taacagctcattgaatgctaagggtagaaacaaatgacttttctagtgtcattatgaaatgtgatctaaatttagttttccaaacttatttgctatttttgcttctcataattcattcttcagtcaatctgaaatagatagatatagatgattagatagatagatagatagatagatcctatctatcctgtgtagatcatattccttaatctcccactcagctgtaagagatcgctctttgtacctccattggttatttcttttcctactttcaagtttgagtgtttttgtttttgaatgtatgaccaaaatgtccacatgttgggagtgagtgtgtgtgtgtgtgtgtgtgtgtgtgtgtgtaaaggtaaatttctgcatctgacttg

SEQ ID NO: 8800 - DNA, 454 bp, Homo sapiens
  chr5.fa.O7frz.108209500
  Located on chromosome 5
  Distance between a terminus base of telomere on chromosomal short arm and 5'-terminus of this base sequence : 98433065
  Distance between 3'-terminus of neighbour sequence of sequence listing upward to telomere on chrosomal short arm and 5'-terminus of this base sequence : 5914
gtaaataacagccatttcaattccaatcatgaaaaatatctcttcatctatttatttactcattatatatacaaatcacccaattgtccgtttgtcatcaaatcagttctactggaatcttgtttctctctctctctctctctcagctttcattgctgatatttgagtttcaaattggaattattgcatagatgatgggaagaacaagctttcttgagagagaaaacggtatctaaatcctaaaatcctgaggagcttccgacctccaacataaaatgcttccactttttcctctttaaattttacgttttttatttttaatagtttataccttcacttggttcaaaaaccaaaataatataacaaggcaaacattgagaagtcttgtttctattcctttcccctgtaggtagctatttttatttttttggtataattgtaggcatatttgagc

SEQ ID NO: 8801 - DNA, 419 bp, Homo sapiens
  chr5.fa.O7frz.108338903
  Located on chromosome 5
  Distance between a terminus base of telomere on chromosomal short arm and 5'-terminus of this base sequence : 98493905
  Distance between 3'-terminus of neighbour sequence of sequence listing upward to telomere on chrosomal short arm and 5'-terminus of this base sequence : 60386
aaacttgcaggataaatttgaagaagagatgggttatgcaagatggaaggaagtgagaggaaagcagagatacatcctacacacacgcacacacacacacacacacacacacacacatatatgtatatatataggcacaagcatagcaagtaacccaatgaaataaaatgtcaaatcgtggaaacatgccaatatttacataggaaacttggcagaggattgagataacactaaatatagtgaaggaaataattgataatttagtaaatagaattggtaaaattaactctccataaatgtaagaaaatatagaggtgagttttgtctcaaaaaataaacaaaaatatttcctaatggattcagaccaaaatgtgaaaagtatgtttcaatactttgtatgaattattgaagaccaaatg

SEQ ID NO: 8802 - DNA, 342 bp, Homo sapiens
  DISO7_00024010
  Located on chromosome 5
  Distance between a terminus base of telomere on chromosomal short arm and 5'-terminus of this base sequence : 98649012
  Distance between 3'-terminus of neighbour sequence of sequence listing upward to telomere on chrosomal short arm and 5'-terminus of this base sequence : 154688
gttgaatggcctatggatggctgatgatttcttctgattctgatgctagtactcttatctgggccaagccctctaagtgcaagggactaacctgaacaaaaacagtttgcatgactgtgaaaacactcctttctgtgcatcatgttctgtctctctctctcccacaccacacgcacacacacacacacacacacacacagagtgtctattgtctctgtttctctgtgtgtgtgttcatccccgatctcactggttttctcacaggcagctggaattctctgcaacggctccagggtgagggatgtcatgtaaaatggagaaccctgtcctgatccagcactt

SEQ ID NO: 8803 - DNA, 419 bp, Homo sapiens
  chr5.fa.O7frz.108758492
  Located on chromosome 5
  Distance between a terminus base of telomere on chromosomal short arm and 5'-terminus of this base sequence : 98701311
  Distance between 3'-terminus of neighbour sequence of sequence listing upward to telomere on chrosomal short arm and 5'-terminus of this base sequence : 51957
gcaactataattaagctcaatgagaacaaggaaaatattcatataatgaactaatggatggaaaatagcacagaaataggcaacctaataaaaacaagtggaaatttcagaaatgaaaaaaatctaacaggtgaaaatttaaaattcagtttcatggcagaataaagatgacaagagaaggaatctgtgtacataatagatcaaaataaattatcaattctgataaacagaaaaaaattataaaataaattttaaaagtctcaagattatgtaagacaatatcaaaggggtaattggagtcccagaaggagaatagtgagacatgagttttatatatatatatatatatatatatatatatatatacacacatacatacatacacacatatatatacattatttctttgaatctttgac

SEQ ID NO: 8804 - DNA, 231 bp, Homo sapiens
  DISO7_10001948
  Located on chromosome 5
  Distance between a terminus base of telomere on chromosomal short arm and 5'-terminus of this base sequence : 98728741
  Distance between 3'-terminus of neighbour sequence of sequence listing upward to telomere on chrosomal short arm and 5'-terminus of this base sequence : 27011
tcaagaaggaaagcataatagttgaaattatgattcccaggccccacctctttctctctctctctctatatatatatatacacacacacataaaacacacgtgtgtgtgtatatatataacacgcacataaatatatatattttatatatatatatatacattgtgtgtgtgtgtgtgtgtgtgtgtgtgtgtgtgtttctttctcaacacacttctaaggtgactgatgt

SEQ ID NO: 8805 - DNA, 446 bp, Homo sapiens
  chr5.fa.O7frz.110142947
  Located on chromosome 5
  Distance between a terminus base of telomere on chromosomal short arm and 5'-terminus of this base sequence : 98947469
  Distance between 3'-terminus of neighbour sequence of sequence listing upward to telomere on chrosomal short arm and 5'-terminus of this base sequence : 218497
ctgaagcaaatatccatagtctaccatagcagctaagctgctttgtaactcttcatattacaaaatctttggaatctatagttttaaaaaaatcagtctatgttatttacttttagtagggatcataccaggatgattatttgaatttagcagatgtctcccattagaaacacacacatacacacacacacacacacacacacacatatatatatacacacatatatatacatatatgtgtgtgtgtgtgtgtgtgtgtgtatatatatatatagatagatatatgtatgtatgtatttggttatcctaggaattaattggaatgtatgactctgtgcctctgggttttttgaacaaccagggttaaagggatattaggttattgccaagtttgatacggtagtgaacacagagtcttctttccctatgctaactcttggttcctt

SEQ ID NO: 8806 - DNA, 242 bp, Homo sapiens
  Z66917
  Located on chromosome 5
  Distance between a terminus base of telomere on chromosomal short arm and 5'-terminus of this base sequence : 99093189
  Distance between 3'-terminus of neighbour sequence of sequence listing upward to telomere on chrosomal short arm and 5'-terminus of this base sequence : 145274
agcgaaaacataaaactcttacaaaatgacaacttaaatatagggatcttctgtaaaatgattagataagcacactgtgtgtgtgtgtgtgtgtgtgtgtgtttatgaatgcattgaaacaaacagatactgtatgtgaaccattttgtatgtaaaacatatgcagtaataaagcacttcatgagagttcttcacacagagatctcactgagaagagcagcactgatttaattgggactggc

SEQ ID NO: 8807 - DNA, 222 bp, Homo sapiens
  DISD22_0006988
  Located on chromosome 5
  Distance between a terminus base of telomere on chromosomal short arm and 5'-terminus of this base sequence : 99251326
  Distance between 3'-terminus of neighbour sequence of sequence listing upward to telomere on chrosomal short arm and 5'-terminus of this base sequence : 157895
gagctgcaatgtcttcagatagaagaaaacgtgtgtgtgtgcgtgtgtgtataaatatgtccatgtgtgcatgtgtgagtatgtgtgtgtgtgtgtgagagagagagagagaaagaaaatatatattatttatacagtgtgtgtgagagagaggacttagctaaatattcaaaaattggcaaccttctcttcttctagctagagtcacttcactattcattg

SEQ ID NO: 8808 - DNA, 101 bp, Homo sapiens
  DISD22_0006992
  Located on chromosome 5
  Distance between a terminus base of telomere on chromosomal short arm and 5'-terminus of this base sequence : 99476445
  Distance between 3'-terminus of neighbour sequence of sequence listing upward to telomere on chrosomal short arm and 5'-terminus of this base sequence : 224897
tggtcaggatgtgctctggttagccatgtgtgtgtgtgtgtgtgtgtgtgtgtgtgtgtgtgtgtgttcatctcaaatttgtctcctcagcttcagatcca

SEQ ID NO: 8809 - DNA, 364 bp, Homo sapiens
  chr5.fa.O7frz.110270284
  Located on chromosome 5
  Distance between a terminus base of telomere on chromosomal short arm and 5'-terminus of this base sequence : 99591120
  Distance between 3'-terminus of neighbour sequence of sequence listing upward to telomere on chrosomal short arm and 5'-terminus of this base sequence : 114574
tagttaatgacagcaaagtgactaatgtgggcaaaagtcagcattcagaagtagaaagacagaaaaccagttaggaaagtctccacaatgaagtcctgactgaaaatcatgataactgcatctaataaaacaagaggtatgtgcctaaagaaatagacagggctgaacagaaagctctatggaaaagtcatatatgaaaaagacaagttaaaaaaagtggaaaaaagagtattatgatatcaataatttgctctaaaatacttcaacatagactctctctctctgtctctctctgagtgtgtgtgtgtgtgtgtgtgtgtgtgtgtgtgtgtgtgtgtatgtgtccacagccttaattcatact

SEQ ID NO: 8810 - DNA, 373 bp, Homo sapiens
  chr5.fa.O7frz.110633754
  Located on chromosome 5
  Distance between a terminus base of telomere on chromosomal short arm and 5'-terminus of this base sequence : 99761896
  Distance between 3'-terminus of neighbour sequence of sequence listing upward to telomere on chrosomal short arm and 5'-terminus of this base sequence : 170412
tttcttattggtaggaaatgttagagttaatatacacacaagtgtgcgcactcacgtaacactcaggctcagctctctctctctctctctctctctctctctctctctatatatatatatatatatatatatatacataaaataggatatccaaacaacatattaggaacagttaaaaataattcctaaatagcaatggaattaaatgcaaataagttttttaaagtatttgacatagtttattatcttaaatatttcagcatattctttaagattttatgagaacccattgttattaacaattcattttaagcttctgctctgactctttctgttttactacaaattcctacttaagagtgcttgaatgacc

SEQ ID NO: 8811 - DNA, 426 bp, Homo sapiens
  chr5.fa.O7frz.111093315
  Located on chromosome 5
  Distance between a terminus base of telomere on chromosomal short arm and 5'-terminus of this base sequence : 99781703
  Distance between 3'-terminus of neighbour sequence of sequence listing upward to telomere on chrosomal short arm and 5'-terminus of this base sequence : 19434
gttagttggtgcagaaatatagttaattagaatgaataagatctagtatttgatagcacaacagggtaacatgatcaacaacaatttattgtatactttactattattattattattattattattattattattatttcggagacggagtctcactctgtcggccaggctggagtgcagtggtgcgatctcggctcactgcaacctctgcatctggggctcaagcacttctcctgcctcagcctcctgggtagcattttaaaatgtgtgctatgtaaattaacatagtagtacttttgaaattagcacattattcatatgtgagtcatcaggagcaatttccagaagttttttattcagtacatacactttatatactagtttaaaaaatactgttttttcatgaataccttaacattcactgtc

SEQ ID NO: 8812 - DNA, 464 bp, Homo sapiens
  AC027315.2_20726
  Located on chromosome 5
  Distance between a terminus base of telomere on chromosomal short arm and 5'-terminus of this base sequence : 99985955
  Distance between 3'-terminus of neighbour sequence of sequence listing upward to telomere on chrosomal short arm and 5'-terminus of this base sequence : 203826
agagtgctagaattaaaggtgtaagccaccccacctggcctgtttttcttacttttacttcatcaggaaaacaaaaatcctggctaaagacctctaaatttaatttataggaagcactataggacacaatatcaaaaattaaaataacagttgttgagttttttatactactgggcgttttcaaatacaaatctgtgtgtgtgtgtgtgtgtgtgtgtgtgtgtgtgtgtgtgtgtgtgtgcgcgcgcgcgcatgcgcacacacgcatatcctgtgaatgaagcaaacacaaatgcagaatgatacaaatgtatggttttagcagctctcatgctggcttttcctttggggtttttatttctgaaaaggtaaaccttttttgataaaattcaggaaataaaagtacagtaattccttaattcatatataaaagtagaacattcaatagaaactaaacctgtctg

SEQ ID NO: 8813 - DNA, 417 bp, Homo sapiens
  chr5.fa.O7frz.111311029
  Located on chromosome 5
  Distance between a terminus base of telomere on chromosomal short arm and 5'-terminus of this base sequence : 99988631
  Distance between 3'-terminus of neighbour sequence of sequence listing upward to telomere on chrosomal short arm and 5'-terminus of this base sequence : 2212
ataggctcaaacaatgttactaagatctgatttttcttcatctcttggcttgctctaccttagctatattcttaagaatgctcctctttggggggaaatattgtcgtcagcagtctagattcatgtttacctggttccagttccacacacaaacagcaccaaaaaaagaaagaataaagaataaggagagtgagagagagagggagggagggagagagagagagagagagggagggagagagagagagagggagggagagagagagagagagagaagagaggagagagagagagagacagagagagactataaaatattccttttgttcaacaataagagaaaagattctaacaatgtatgtttttgcctcttcataactcatgtattgttccctgaaccaatcactgtaactagag

SEQ ID NO: 8814 - DNA, 138 bp, Homo sapiens
  DISO7_10001953
  Located on chromosome 5
  Distance between a terminus base of telomere on chromosomal short arm and 5'-terminus of this base sequence : 99998017
  Distance between 3'-terminus of neighbour sequence of sequence listing upward to telomere on chrosomal short arm and 5'-terminus of this base sequence : 8969
ttgacctgtccattgaaatgtttataattttctcaaatttatttattatctattttatgaaatctggactttcaagtgtgtgtgtgtgtgtgtgtgtgtgtgtgtgtgtgtgtattgatattgtgggactcactctgt

SEQ ID NO: 8815 - DNA, 452 bp, Homo sapiens
  AC008856.4_88714
  Located on chromosome 5
  Distance between a terminus base of telomere on chromosomal short arm and 5'-terminus of this base sequence : 100095761
  Distance between 3'-terminus of neighbour sequence of sequence listing upward to telomere on chrosomal short arm and 5'-terminus of this base sequence : 97606
tcaagatggattacagacttaaacataagacctaaaaccataaaatccctagaagaaaacctaggcaaccaacctaccttccttccttccttccccttccttccttccttcctcttccttccttccttccttccttccttccttccttccttccttccttccgacggtctccctctgttgctgaggctggacagtactgctgtgatcttggctcgctgcaacctccctgcctcgggctcccatgattctcctgcctctgcctgccgagtgcctgggattgcaggcacgcgccgccatgcctgactggtttttgtatttttggtggagacgggatttcgctgtgttggccgggctggtctccagctcctgacctggagtgatctgcctgcctcggcctcccaaggtgccaggattgcagacagagtctcgctcacttagtgctcaatgttgcc

SEQ ID NO: 8816 - DNA, 436 bp, Homo sapiens
  chr5.fa.O7frz.111762137
  Located on chromosome 5
  Distance between a terminus base of telomere on chromosomal short arm and 5'-terminus of this base sequence : 100177203
  Distance between 3'-terminus of neighbour sequence of sequence listing upward to telomere on chrosomal short arm and 5'-terminus of this base sequence : 80990
acttcaatgaaatgttacaaagacatctttgtttattttaacacttgtaaaggacttcaagaatgccaggacctcttctaaatttcacacacacacacacacacacacacacacacacaaatacatattatatatatgtttacacacacatatacataaacttaacatttaagcctcataacaacacaatgaagtagtactacaatcatatgtactttacagatgagtaaactgaagcacaaacacagaggatgggtgaccagcccaaggtcattgatttgtaagtgctagagctggggttcaaaaccaagcagtctacatctgattctacactcaaacttttttttaatacctgggctaaataaacatacacatagatgtgaaaaatacgtcattaaacttcatgagcattgttaggaacttgctgttacactac

SEQ ID NO: 8817 - DNA, 212 bp, Homo sapiens
  AC008961.4_37839
  Located on chromosome 5
  Distance between a terminus base of telomere on chromosomal short arm and 5'-terminus of this base sequence : 100275150
  Distance between 3'-terminus of neighbour sequence of sequence listing upward to telomere on chrosomal short arm and 5'-terminus of this base sequence : 97511
ggtcaagtaatttattgcacagcatgacgtctattgtgaatgacaatatattgtatttttcaaacatgctgagtggatactgtgttctcaccacaaggcaatggaatacatatacatttcatttatattatattatattatattatattatattatattatattatattatagtgaagtcaatgtatttgttaattagccagataaccattc

SEQ ID NO: 8818 - DNA, 401 bp, Homo sapiens
  AC008961.4_67076
  Located on chromosome 5
  Distance between a terminus base of telomere on chromosomal short arm and 5'-terminus of this base sequence : 100364545
  Distance between 3'-terminus of neighbour sequence of sequence listing upward to telomere on chrosomal short arm and 5'-terminus of this base sequence : 89183
ggcaagtccttaactttagaattgtcccaccacatgaactgagtcacaatgagccaatcaaaaaagttaattgtcagagagacccagtagccacttagttttaataagaagaaggtatactagcaaaattaaaattctcaaaagactgatgaaatctatataagtaataataacattcttaaggaatttaggtgtttaggtacaaccaagaaacatccacacccatacaatgtcaaacacacacacaaacacacacaaacacacacacacacacacacacacacacacacattttctaaagctaaaacagatatttttccaatttaaaaagtcagtggataagctgaaggaggcagttctcaacatttagagtttatttattggcttgaaatatcacataa

SEQ ID NO: 8819 - DNA, 443 bp, Homo sapiens
  chr5.fa.O7frz.111580341
  Located on chromosome 5
  Distance between a terminus base of telomere on chromosomal short arm and 5'-terminus of this base sequence : 100549220
  Distance between 3'-terminus of neighbour sequence of sequence listing upward to telomere on chrosomal short arm and 5'-terminus of this base sequence : 184274
agatatttaacttcatcctggttcagtcttgggagggtgtatgtgtccaggaatttatctattttttctagattttctagtttatatacatagaagtgtttatagtattctttgttggttgtttgtgtttttttggggtcagtagtaatatcatccttatcatttctgattgtgtttatttgaatcttctctcttttcttattagtcttattagcggtctattttattaagtttttcaaaagagcagctcctagatttatttattttctaaagggtgtgtgtgtgtgtgcgtgtgtgtgtgtgtgcgtgtgtgtgcgtgtgtgtgtgtgtgtccttcagtttagctgtgatcttggttatttcttgttttctgctagctttggggttcgtttgctcttggttctctagttcttttagttgtgatgctaggttattgactacat

SEQ ID NO: 8820 - DNA, 197 bp, Homo sapiens
  chr5.fa.O7frz.112065921
  Located on chromosome 5
  Distance between a terminus base of telomere on chromosomal short arm and 5'-terminus of this base sequence : 100690918
  Distance between 3'-terminus of neighbour sequence of sequence listing upward to telomere on chrosomal short arm and 5'-terminus of this base sequence : 141255
gttgtaatgaaatgcacctaaccaattctctgcttaggcctttaacctgagtatgacacaatcacacacacacacacacacacacacacacacacacacacacacaaatattcaggcaggcagagttttcttagagttttacttgatgtagaagaaataataggactctatacagcttctgaactatgaactgttgg

SEQ ID NO: 8821 - DNA, 449 bp, Homo sapiens
  chr5.fa.O7frz.112068120
  Located on chromosome 5
  Distance between a terminus base of telomere on chromosomal short arm and 5'-terminus of this base sequence : 100693008
  Distance between 3'-terminus of neighbour sequence of sequence listing upward to telomere on chrosomal short arm and 5'-terminus of this base sequence : 1893
tatctggaacataatgaggtctagcttatatgatacaaaatttctaaaatagaaactatttttgtaaattttacaaaaagggcataaagtctaattatttactggggtttactgagtagctagggaaatggctaggatcagaaccttggtgatgattcttgttaaatatgtatctgtgtgtgtgtgtgtgtgtgtgtgtgtgtgtgacaaagagagagaagagagaaaaacagagaggaagagagaaagactcataaagcctactttaatgttttgcttttactttaaaaatgtaccttttcatagccaatgtatgatatgttcaggtgacatccagaatctttcatttcaattgccaatgagctccaattaccctatttataactagtttctaagggacattaataatagtaaatatagactgattgtaaagttgctcagcaattaaa

SEQ ID NO: 8822 - DNA, 421 bp, Homo sapiens
  chr5.fa.O7frz.111967715
  Located on chromosome 5
  Distance between a terminus base of telomere on chromosomal short arm and 5'-terminus of this base sequence : 100718095
  Distance between 3'-terminus of neighbour sequence of sequence listing upward to telomere on chrosomal short arm and 5'-terminus of this base sequence : 24638
gacaataactctgaagctacagacacacacacacacacacacacacacacacacacaccccatttgtacatgaatacatatgtacatttatatatacatgaatattttgttgtcagttttttacttgatttctttaatcatcaaccacttgtagaaaactgtgctactattgaaattatgtcttatccttattttttatggtgggtttctgtgactaagtacagtatttgagcttactttcatattgacactattaatcaatgtgttagtacatatcagtaatagtattaaaacgatacaattgtatagtatgttttccagaaaggttgacaaaaagtcacgagttttgccttaagatcttaacaaatagagaaacattattatgcaaaacaatgtagaatctaaggaaatgtggtaggac

SEQ ID NO: 8823 - DNA, 171 bp, Homo sapiens
  HUMUT2419
  Located on chromosome 5
  Distance between a terminus base of telomere on chromosomal short arm and 5'-terminus of this base sequence : 100802844
  Distance between 3'-terminus of neighbour sequence of sequence listing upward to telomere on chrosomal short arm and 5'-terminus of this base sequence : 84328
gccttcataattgtgtgagccaattcccataataaattttcttttatctatctatctatctatctatctatctatctatctatctatctacctatctatctatgtatcatttatctatctatctgtctgtctttattggttctgtttttctggacgttcctcactcatata

SEQ ID NO: 8824 - DNA, 401 bp, Homo sapiens
  chr5.fa.O7frz.112957676
  Located on chromosome 5
  Distance between a terminus base of telomere on chromosomal short arm and 5'-terminus of this base sequence : 101024185
  Distance between 3'-terminus of neighbour sequence of sequence listing upward to telomere on chrosomal short arm and 5'-terminus of this base sequence : 221170
gctacatctgcagttatagatcacttatcttccaagtcttcccagtgcagctaatttgttctttatgtgagaagtttattattattattattattattattattattattataagtatgaaacactctacttatacaaaatggcataccagccttttccctctccctttaaaaataaactacggagcactgaattatttttaataattgtgtgctgtgtataaggaggtgggtgtaatttttaacaccttgaaaaaaatcatgaaatgtaaagtagaactcccccatttttaaaatcaaattatcagtttcataaaaataagtgttttgtgaaaggaagtaatgtagtaatcatgtcagcaatcaatttatttttctcttaatacttgagcctgtatcttg

SEQ ID NO: 8825 - DNA, 439 bp, Homo sapiens
  chr5.fa.O7frz.113083105
  Located on chromosome 5
  Distance between a terminus base of telomere on chromosomal short arm and 5'-terminus of this base sequence : 101260177
  Distance between 3'-terminus of neighbour sequence of sequence listing upward to telomere on chrosomal short arm and 5'-terminus of this base sequence : 235591
gttaagattaaagcactgagacagccatgagcacccagtgttgaagggagttttttctggcttggatagtgataatctttgggatttgagaagtagatggagaattgatcagttgataaagggggattttaggaagttttacaggtactttagattattgcatgacacccttggaaaggccacataccactagctatccagcaatgcttatacgcttatttatacgcttatttatctctctctctctctctcacacacacacacacacacacacacacacagagactagaaagctgttgcagagagagactggtacagtgaagctatattgtaatatctcttaaggggatctgtgctttaaataagaaaggaaagtttgaaactgtttatcattactatggatgcccttagatataaatgactaaggcaatttctacct

SEQ ID NO: 8826 - DNA, 215 bp, Homo sapiens
  chr5.fa.O7frz.134393910
  Located on chromosome 5
  Distance between a terminus base of telomere on chromosomal short arm and 5'-terminus of this base sequence : 101403546
  Distance between 3'-terminus of neighbour sequence of sequence listing upward to telomere on chrosomal short arm and 5'-terminus of this base sequence : 142930
tatgcttatgccatagattgaggtgaggctttcatggatgtataattattttgtatactccaaactaactaagttgctaaattaaatattcatatcttttttatgtcaatcatacctcaatacagtggtttaaaacacacacacacacacacacacacacacacacacacacacacacacagagacacacaatgaatggccagttaatattagta

SEQ ID NO: 8827 - DNA, 448 bp, Homo sapiens
  chr5.fa.O7frz.134498087
  Located on chromosome 5
  Distance between a terminus base of telomere on chromosomal short arm and 5'-terminus of this base sequence : 101507640
  Distance between 3'-terminus of neighbour sequence of sequence listing upward to telomere on chrosomal short arm and 5'-terminus of this base sequence : 103879
tgattagctacaggttaagtcatctgttttgtgtgtgtgtggtgtgtgtgtgtgtgtgtgtgtgtgtgtgtgtgtgtgctacttctatagggaagaacggtaatggtagggaaaagatatttaagcctcatatatatatatatatatatatatatatatatatatatatatatagtgaagtacatatttatttcaaataagctaccaatttttatgtagtaatatttatcacaggaaaaaatagaggtttttaatatatcatgttcaattgttttaatttttagttcccacagatgagtgagaacatgagaagtttgtctctctgtgcttggcttatttaaattaacatagtatcctccaattctcatttattttttatagctgaatagtactctattgtgtatatgtatcacattttttctttatctattaatctgttgatggacac

SEQ ID NO: 8828 - DNA, 388 bp, Homo sapiens
  chr5.fa.O7frz.134636286
  Located on chromosome 5
  Distance between a terminus base of telomere on chromosomal short arm and 5'-terminus of this base sequence : 101642307
  Distance between 3'-terminus of neighbour sequence of sequence listing upward to telomere on chrosomal short arm and 5'-terminus of this base sequence : 134219
actcgtcatttagcacatgtaccctaaaacttaaagtataataataataaaataaaataaaataaaataaaataaaagaagaaaaacaaaatgtaatttgtgacatttttgataaaaatttatcttcctttgttgaaaagaaaaagctgatctccagccaagatgatgtgctctgatcataaagaaaacagggattacctaaataatttggaaaatgtccctttaaaaattgtgcagtaataaccagttttttagaagctaaatgttttatttaattacaaatcttataggggcagtggcagaggtatttgaagagattttatgataaaacaaccaagcactagttataatgttacacatatgtgtctcctaaaggtaggcaatacat

SEQ ID NO: 8829 - DNA, 394 bp, Homo sapiens
  chr5.fa.O7frz.112732782
  Located on chromosome 5
  Distance between a terminus base of telomere on chromosomal short arm and 5'-terminus of this base sequence : 101880260
  Distance between 3'-terminus of neighbour sequence of sequence listing upward to telomere on chrosomal short arm and 5'-terminus of this base sequence : 237565
ccaggttacagtgatctatgactgtaccactgaactccagcctagatgaaagaaacactatcatacatatatatatatatatatatatatatatgtgtgtgtgtgtgtgtgtgtgtgtgtgtgtaatcttatgtatataaaattcatatttcaagttacttaatctcataaggtcagtaaattctttccccaaactgttattattcttaatatttaaaagttactctcttcctacatatttttctccattcttactgctactttctctggttttcattgctacaggtctttacccttcctccctgaaattgtattaactaggctactaagtttcatggaaaatatttactagacatgatatcctcaaaaactatgcatttatgagttgtcataa

SEQ ID NO: 8830 - DNA, 256 bp, Homo sapiens
  AC015522.4_9909
  Located on chromosome 5
  Distance between a terminus base of telomere on chromosomal short arm and 5'-terminus of this base sequence : 101927747
  Distance between 3'-terminus of neighbour sequence of sequence listing upward to telomere on chrosomal short arm and 5'-terminus of this base sequence : 47093
ttggctatgtacattctttgattctatctattaattaattttattattattacaagaaacacacacacacacacacacacacacacacacacacacacagagtactgggataaattttttaaaatcccacagagctatctgtatcagccttgtgtggtgatcacttaaacctagaagaaagccactcttgcttttctctttatctttgaattcccaaaattaataggaaaataagtcaaacttcctggtaaagatt

SEQ ID NO: 8831 - DNA, 436 bp, Homo sapiens
  chr5.fa.O7frz.112635956
  Located on chromosome 5
  Distance between a terminus base of telomere on chromosomal short arm and 5'-terminus of this base sequence : 101974971
  Distance between 3'-terminus of neighbour sequence of sequence listing upward to telomere on chrosomal short arm and 5'-terminus of this base sequence : 46968
agcataatgccttctaagtttctttattttgctccaaatgacaggattttctttctttaaggctgaataatgtttcattttttgtatatatatatatatatatatatatatatatacacacacacacacacacacacacacacacacatacatatattgtatatatactgtatatacattgtgtatatatctacctatttgtctatatatgtatatatctccacattttctttgtccattcatctgtcaaggaacatttaacaacacgggaggcagtatcagtaatccaaaatcctctaagaaagaaaagtccaagacaagatggcttcattatactaaacatttaataaagaattaatatcaatacttaaaaaaattccaaaaaatggaagaggtcaaaactcacttaatgaggtcagcatcactctaataccaa

SEQ ID NO: 8832 - DNA, 253 bp, Homo sapiens
  chr5.fa.O7frz.112482125
  Located on chromosome 5
  Distance between a terminus base of telomere on chromosomal short arm and 5'-terminus of this base sequence : 102115721
  Distance between 3'-terminus of neighbour sequence of sequence listing upward to telomere on chrosomal short arm and 5'-terminus of this base sequence : 140314
ttattgcttgaggatttcatacctagacaatgggaataggaaataagtgtgtatgtgtgcgtgtgtgtgtgtgtgtgtgtgttcgtgtgtgtgtgtgtgtgtgtgctcgtgtgtgtgtgtgctgtgttttgaggctttacgtgggctttgaaggcacaggtctgtttcttgcataaaacaaaaactacataagtaaaaaaatacatttgattataaaaacatcaattttgtaaatatgattgtccatattgga

SEQ ID NO: 8833 - DNA, 464 bp, Homo sapiens
  chr5.fa.O7frz.113316238
  Located on chromosome 5
  Distance between a terminus base of telomere on chromosomal short arm and 5'-terminus of this base sequence : 102176690
  Distance between 3'-terminus of neighbour sequence of sequence listing upward to telomere on chrosomal short arm and 5'-terminus of this base sequence : 60716
gaggtcaggagttcaagattagcctggccaacatggtgaaacactgtctttactaaaaatacaaaaattagccaggtgtggtggtgcaggcctgtaatcccagctacttgggaggctgaggcaggagaatcatttgaactcggaaggtggagggtacagtgaaccgagattgtgccacttcaatccagtctgggtgaaagagtgaaactctgtctcttaataataataataataataataatacatgtctaactgtggaataaataagaaaaacacttcgaagagcttaacaccattgtgtcatggtaggtacaatttagtcattcattctttcacttaacacagacacaaaaaattcttgtgtcctaggtgccaaacattgttctaagttctgggggtacacaagtgaacaaagactggcaaatacccctacccttatggtgcttatgttttaataggaaaca

SEQ ID NO: 8834 - DNA, 457 bp, Homo sapiens
  chr5.fa.O7frz.113432329
  Located on chromosome 5
  Distance between a terminus base of telomere on chromosomal short arm and 5'-terminus of this base sequence : 102300464
  Distance between 3'-terminus of neighbour sequence of sequence listing upward to telomere on chrosomal short arm and 5'-terminus of this base sequence : 123310
tacaaatctgaattaaatgtaaccaattaggagggatggtttatgatttgattaaaagataaacacagaatagaaacaagtaaacatatttctgattttatacaacatacacatttgttttaggattaaaccagtataacaaaatatatataaatatatatatatatatatataaattatgttataacaaagatctatgaaaacattaaggagggagaaactcattttgcctgggaatataaggtgagatttgacaaagagtttttttataatagagaagagagacaatgacattttaaatagatagattagcatctaccaaaatacaggactataaaattacctaatgtgtccaggaaagaccaagtggctggaatgtggaggacagagggataaaattctaagaaaatgggataggaaaattcagttgatgctactgtgaaagatcttcaaagtc

SEQ ID NO: 8835 - DNA, 356 bp, Homo sapiens
  chr5.fa.O7frz.113552080
  Located on chromosome 5
  Distance between a terminus base of telomere on chromosomal short arm and 5'-terminus of this base sequence : 102390274
  Distance between 3'-terminus of neighbour sequence of sequence listing upward to telomere on chrosomal short arm and 5'-terminus of this base sequence : 89353
ttgctactttacaaataggcagattgttttagagatttatgatctggcagatcagggatcagaattcaggtaaggtttatgtgtgtgtgtgtgtgtgtgtgtgtgtgtgtgtgtgcgcgcgcgcatccgcatgcatatatgtaggtgggggggcagaatgaagaaaaacaagggccaaatcaatgaaattttcactactgcaatatttcctcaggatagaattctaagtatgttgttctagggagtgcaagaagatgtacaggcatctacatatttcccttagttaagattacaatttgcctttgccaatttatcttccattttttttccgtgtcatttatcaaattactgcttct

SEQ ID NO: 8836 - DNA, 380 bp, Homo sapiens
  chr5.fa.O7frz.113681876
  Located on chromosome 5
  Distance between a terminus base of telomere on chromosomal short arm and 5'-terminus of this base sequence : 102515770
  Distance between 3'-terminus of neighbour sequence of sequence listing upward to telomere on chrosomal short arm and 5'-terminus of this base sequence : 125140
cttacctggtaacaagacattaagaaggaggtgaactttttttgtattttcaaattacccactactttaaacaaattattaaatattgtcatgtatcccagccccagttttgtcaccccgtgaggctataccttttttaatagttctactgccctttataaggcagttgtaaaccaccaatgcttcagtttgatatgaataaacatgaggcaaaaagaaaaaggaggaaaagagatgaggaaagcctatgctacacacacacacacacacacacacacacgcacacatacacacacacgagatcatatcaaatactcttaatggggcagagttacacaaactactttttgtcactgcttactcattatttcaacagcaac

SEQ ID NO: 8837 - DNA, 471 bp, Homo sapiens
  chr5.fa.O7frz.113811208
  Located on chromosome 5
  Distance between a terminus base of telomere on chromosomal short arm and 5'-terminus of this base sequence : 102658209
  Distance between 3'-terminus of neighbour sequence of sequence listing upward to telomere on chrosomal short arm and 5'-terminus of this base sequence : 142059
tgacaaccagatttctgaatctcacactagggggcagtactgcatcccatgaaaaatcattgctctaaggcaggtttcttaacctcagcacctttttctttctttctctttctttctttctttctttctttctttctttctttctttctttctttctttctttctttctttctttctttctttctttctctgtctttctctctctctctctctttctttctttctcctttcatattttgggtcaggtaattctttgttgtgggggctgtcctgtgcattggaggctgtttagcagcatctctggcttctaccccctggatgtcagtgtactcctcaagttgtgataaccaaaaatgactccagatgttgccaaatgtctcctggagggtaaagttgccccaggtttaaaagcactactctgagatctctatcagctccaaaaatctgtcatgagaatgatacagtattgat

SEQ ID NO: 8838 - DNA, 110 bp, Homo sapiens
  DISD22_0007003
  Located on chromosome 5
  Distance between a terminus base of telomere on chromosomal short arm and 5'-terminus of this base sequence : 102906342
  Distance between 3'-terminus of neighbour sequence of sequence listing upward to telomere on chrosomal short arm and 5'-terminus of this base sequence : 247662
ctggtgtagtacatgtatgagacaggggcgggcgggggagagagagagagagagagagaagactagttcctataaaaaatgataatactgtaacagaatgccataacatt

SEQ ID NO: 8839 - DNA, 339 bp, Homo sapiens
  AC008475.4_59934
  Located on chromosome 5
  Distance between a terminus base of telomere on chromosomal short arm and 5'-terminus of this base sequence : 103114677
  Distance between 3'-terminus of neighbour sequence of sequence listing upward to telomere on chrosomal short arm and 5'-terminus of this base sequence : 208225
gcataattactggttaagaatgacctgtgtcatgacacatgcctggcattacaatcccagctacttgggtggctgaggcaggaggattacttgagcccaggaattcgcatctagcctaggcaatatagcgagatgctgtctctaaaaacaaacaaacaaacaaacaaacaaacaaacaaaaaaaccatgtctgtcgtctgttttgttcatttgtgaatctccagcacatgggacagggtctggccagtggtaagcactcagtattagttgctgactgaataaatgctgatagaaatagtccctgtcctcttggaacttacaaactagtggtaagaccag

SEQ ID NO: 8840 - DNA, 396 bp, Homo sapiens
  AC026795.2_76236
  Located on chromosome 5
  Distance between a terminus base of telomere on chromosomal short arm and 5'-terminus of this base sequence : 103168861
  Distance between 3'-terminus of neighbour sequence of sequence listing upward to telomere on chrosomal short arm and 5'-terminus of this base sequence : 53845
tgtcaggtagtcacttagcaacttgggaagaatcatactattttgacagatactaacaggttttttggcatcttgttgcctacagttattgctttatgacttaaaaagtaagttcatactttttttgctatctcccgaaataatataattttccctcctgtctgttaaaaaaaaaaacccacactttctcttctttctttcacttacctattctaagcagcgtgtgtgtgtgtgtgtgtgtgtgtgtgtgcgtgtgtgtgtttgtgttggggtttaagaagccttgacaccacatttcctggaaatactaaattagtcacagcatttattagatgagagtgtctacaacaacaaaaaactttctttttctgaagacttaactccatgcaagtgtca

SEQ ID NO: 8841 - DNA, 431 bp, Homo sapiens
  AC026795.2_11076
  Located on chromosome 5
  Distance between a terminus base of telomere on chromosomal short arm and 5'-terminus of this base sequence : 103188931
  Distance between 3'-terminus of neighbour sequence of sequence listing upward to telomere on chrosomal short arm and 5'-terminus of this base sequence : 19674
aaaccacatgtttagtgaggtaaaacaaatacctgtttttctaccttttaatacaacaaacaaaaacacccactaatgtatttacaactctcgttttacaggccaacatgttttcatagaaaagtatttgagtatattgtggatgagataggggaaattgattgctgcttctggaccagccactctctaggcctgcaagttgacacagtgaacatgatacacagaatctttgctctcagagtttaaatcctagtagggagaggcagacaataaaaatgtaggcaaatgaagaggatttaaggaacaaggaggtgtgatagttagcaaagaacttacatgaagcatctttttttttcttttcttttcttttcttttctgagacagggccttgctgtgtcgcccaggctggagtacagtggcatgattatagc

SEQ ID NO: 8842 - DNA, 427 bp, Homo sapiens
  AC024564.2_111182
  Located on chromosome 5
  Distance between a terminus base of telomere on chromosomal short arm and 5'-terminus of this base sequence : 103437211
  Distance between 3'-terminus of neighbour sequence of sequence listing upward to telomere on chrosomal short arm and 5'-terminus of this base sequence : 247849
cttcagagtacctttgtatttgaggaaataggacgccgcctaaaggatattgggcctgaggtggtgaagaaagtaaatgctgtatttgagtggcatataaccaaaggcggaaatattggggctaagtggagtaagttatagccctgattttataatattctaaggtaattcttagtaaataaagtatctttttaacaattaaagacctttgaaggtaggtaaatcttacctttttaggtaagttttttttcttttcccgtgggaatgaataggtttgggaatgtccaaaggggggtgtgtgtgtgtgtgtgtgtgtgtgtgtttgtgtgtgtgtgtaagagatgtagggaatcaattgaaatgaaaataacctgttttaagatttcattgtaatccttgaaagtagtttaaacagtcatcttggcta

SEQ ID NO: 8843 - DNA, 421 bp, Homo sapiens
  AC008550.3_45431
  Located on chromosome 5
  Distance between a terminus base of telomere on chromosomal short arm and 5'-terminus of this base sequence : 103605411
  Distance between 3'-terminus of neighbour sequence of sequence listing upward to telomere on chrosomal short arm and 5'-terminus of this base sequence : 167773
tagctcctatgtatcagtgagaatgtaagatgtatggttttccattcctgagttactttactcagaataatggtctccaatctcatccaggtcactgcaaatgctgttaattcattcctttttatgactgagtagtattccatcatatatatacatgagatatatatgtgatatatatgtgagagatatatattatctatctatctatctatctatctatctatctatctatctatctatctatcacagtttctttatccactcattgactgattggcatttgggttggttccacgattttgcaattgtgaattgtgctgctataaacatgtgtgtgtatatatctttttcatgtaataacttctttttccctaggtagatatctagttgtgggattgctggattcaatggtagttctact

SEQ ID NO: 8844 - DNA, 243 bp, Homo sapiens
  D5S471
  Located on chromosome 5
  Distance between a terminus base of telomere on chromosomal short arm and 5'-terminus of this base sequence : 103619258
  Distance between 3'-terminus of neighbour sequence of sequence listing upward to telomere on chrosomal short arm and 5'-terminus of this base sequence : 13426
aaaacttcatttacaaaaacaggaggcaggccatatttggcccatgggccataatttactgatcctttctttaagttataattgacatttatcaatagaaatataaaaattagttgcatataacatgatcaaatttttgttacaacaaatagcaacagcaacaacaatacaacctatatatgtgtgtgtgtgtgtgtgtgtgtgtgtgtgtgtctttgaatgtgctgggaaaatgtgtgaaaa

SEQ ID NO: 8845 - DNA, 383 bp, Homo sapiens
  AC010348.4_24478
  Located on chromosome 5
  Distance between a terminus base of telomere on chromosomal short arm and 5'-terminus of this base sequence : 103619304
  Distance between 3'-terminus of neighbour sequence of sequence listing upward to telomere on chrosomal short arm and 5'-terminus of this base sequence : -197
ggccataatttactgatcctttctttaagttataattgacatttatcaatagaaatataaaaattagttgcatataacatgatcaaatttttgttacaacaaatagcaacagcaacaacaatacaacctatatatgtgtgtgtgtgtgtgtgtgtgtgtgtgtgtgtctttgaatgtgctgggaaaatgtgtgaaaacacataccaacatgttaacatttattatcttggagatgggtagggataaagaaagattgttaatttttaaaaataaagctttttatggttttgctacatgttgttaaaggaagaacaaataaaatcttcacaaaacaactggttttcacaatcatcaggaaaagatgctataatcaccttgaattc

SEQ ID NO: 8846 - DNA, 400 bp, Homo sapiens
  AC008419.4_34199
  Located on chromosome 5
  Distance between a terminus base of telomere on chromosomal short arm and 5'-terminus of this base sequence : 103637883
  Distance between 3'-terminus of neighbour sequence of sequence listing upward to telomere on chrosomal short arm and 5'-terminus of this base sequence : 18196
gataatctagggcctgattaaatcagttgaacagccgtgagagcagggctggaggggtgagacacacacacacacacacacacacacacacacacacacacacacacagagagagagagagagagagagagagagattctgctgtggacagcagcttcagcccctgcctgtggtttccagcctgcctgtgatcttcccttcgtgacatcctgccctacagatttcagatttgtttagccagcctccacaattgtgtaattcaatttcttgtaatatctatctatctgtctgtctgtctgtctgtctgtctgtctatctatctatcatctatctatccatctatcgtctatctatctatcatcatcctcttctcctactagttacgcttctgtagttgaac

SEQ ID NO: 8847 - DNA, 388 bp, Homo sapiens
  AC008550.3_71974
  Located on chromosome 5
  Distance between a terminus base of telomere on chromosomal short arm and 5'-terminus of this base sequence : 103637895
  Distance between 3'-terminus of neighbour sequence of sequence listing upward to telomere on chrosomal short arm and 5'-terminus of this base sequence : -388
cctgattaaatcagttgaacagccgtgagagcagggctggaggggtgagacacacacacacacacacacacacacacacacacacacacacacacagagagagagagagagagagagagagagattctgctgtggacagcagcttcagcccctgcctgtggtttccagcctgcctgtgatcttcccttcgtgacatcctgccctacagatttcagatttgtttagccagcctccacaattgtgtaattcaatttcttgtaatatctatctatctgtctgtctgtctgtctgtctgtctgtctatctatctatcatctatctatccatctatcgtctatctatctatcatcatcctcttctcctactagttacgcttctgtagttgaac

SEQ ID NO: 8848 - DNA, 415 bp, Homo sapiens
  AC010348.4_77032
  Located on chromosome 5
  Distance between a terminus base of telomere on chromosomal short arm and 5'-terminus of this base sequence : 103671723
  Distance between 3'-terminus of neighbour sequence of sequence listing upward to telomere on chrosomal short arm and 5'-terminus of this base sequence : 33440
acttgagcaaaccattcatagggtgtgggtgagctacggaagtccctaaagtcctggtacagccaagggatccacagagagtacaggaagatgattcctgggagaacctaacatggtcccattgatttgggaagccagagagttcttaaggcatgtctcggagctacccagtaaagtgagtggagagcgtctcagtggatacatattgttttctgctgatatctctttttctcatttatctatttatctatctatctatctatctatctatctatctatctatctatatctatttatctatctatctatctatctatctatctatctatctaatctctctgtctgtctttacattactttgttgacaccattgatcatcagtagtgggagactctggcactaatatccataagta

SEQ ID NO: 8849 - DNA, 426 bp, Homo sapiens
  AC008584.3_247683
  Located on chromosome 5
  Distance between a terminus base of telomere on chromosomal short arm and 5'-terminus of this base sequence : 103916595
  Distance between 3'-terminus of neighbour sequence of sequence listing upward to telomere on chrosomal short arm and 5'-terminus of this base sequence : 244457
cactgtagaagtctttcaccactttggttaagtttattcctaggtcttgtattttttgtgctattatgaatggagttgctttcttaatttccttttggagagattgtttttgtgtataggaatgctactgagtgtgtatgttgattttatatcctgcaactttacttcattcattcattagttcttgttttttttttttttttggttgagtctttaagattttctacatatatgatgatatcatctgtgaacagaagtatttttacttttttccaatttgaattttttctttctttctctttctttctttctttctttctttctttctttctttctttctttctttctttttctttcttcctttcttctttctttctttttttctttcactaattgcactgggtaggactttgagtactatgtgga

SEQ ID NO: 8850 - DNA, 451 bp, Homo sapiens
  chr5.fa.O7frz.133356948
  Located on chromosome 5
  Distance between a terminus base of telomere on chromosomal short arm and 5'-terminus of this base sequence : 104000911
  Distance between 3'-terminus of neighbour sequence of sequence listing upward to telomere on chrosomal short arm and 5'-terminus of this base sequence : 83890
ttagtcttagtgaaatggctaaagtggtttgaaaatggtttacagtcttcctcaggcagtagtaatgggaagtaatactctctggttttcttttgcctttctgtgaaacgcttatttcactatcaacaacctttgcatgaaagaagtttccggtcacagctggcctcactcagcagcacaatttgcaattgcagaatccttcaaccaacccaaatgcccatcaagaaataagtggataaagaaactgtgatacacacacacacacacacacacacacacacacacacacaaaggaatactactcagccataaaaaggaatgaattaatggcatttgcagtgaccagcatgagattggagactgttattctaagtgaagtaactcaggaatggaaaaccaaatattgtatgttctcactgatatgtgggagctaagctgtcggttaacaaag

SEQ ID NO: 8851 - DNA, 348 bp, Homo sapiens
  AC008553.4_49389
  Located on chromosome 5
  Distance between a terminus base of telomere on chromosomal short arm and 5'-terminus of this base sequence : 104100028
  Distance between 3'-terminus of neighbour sequence of sequence listing upward to telomere on chrosomal short arm and 5'-terminus of this base sequence : 98666
ccagaatctataattggcatagacatacttagtagttggcagaattcccacattggctccctgactggtagggtgagagctattatggtggaaaaggccaaatggaaaccgtcagagttgcatccagctagaaaaacaaacgtgtgtgtgtgtgtgtgtgtgtgtgtgtgtgtgtgtgtgtgtattacatccctggaaggattgcagagattagtgccaccatcaaggacttgaaagatgcaggggtggcgattcccacattttcattcaattatcctatttggccatgcagaagacagatggatcttggagaataacagtggactatcataagcttaaccaagtggt

SEQ ID NO: 8852 - DNA, 286 bp, Homo sapiens
  AC010250.3_123980
  Located on chromosome 5
  Distance between a terminus base of telomere on chromosomal short arm and 5'-terminus of this base sequence : 104327302
  Distance between 3'-terminus of neighbour sequence of sequence listing upward to telomere on chrosomal short arm and 5'-terminus of this base sequence : 226926
actcacctattgaagttggaactgatattcttagaatgaaggtcagggtctcttcccaaatgtattgccctgattgtctttggattgtcaagacttccaaactataatccacttactgtcattaagctcttggcgcatatgggaaaactagcagatattattaacaacaaacaacacactctctctctctctctctctctctctgtctctctcggcttgtttccatgcctttctcacagccctgtatgtacacctgcattttgtacatttagtatgttcctggaag

SEQ ID NO: 8853 - DNA, 444 bp, Homo sapiens
  AC010250.3_97608
  Located on chromosome 5
  Distance between a terminus base of telomere on chromosomal short arm and 5'-terminus of this base sequence : 104385370
  Distance between 3'-terminus of neighbour sequence of sequence listing upward to telomere on chrosomal short arm and 5'-terminus of this base sequence : 57782
tcttagttctgtgtaacaaggaataatcaatgagtggtttattatgggggctattttatactgaatatccagaatttactcaggagatgatagattagatagatagatagatagatagatagatagatagatagatagatgagggaaaaggacagaggaacacagagtgccaggcttattgcccattcttcctatttatttaaaacatttaaaagcgttgtattaaaatgccatgtatgttgtcgtattttccaaagagagtaaagtaaaaatcttgttgagaagaaggctgtctcaaatttaccctttaatgacttgggttagctggctttacaggcatcttatcaaaaggagaagaaaacagtcctaatgcaagttcccagtcacttcatcactcagaaagctacttggaatgtgcatgtggtataatttatgtagagcacg

SEQ ID NO: 8854 - DNA, 272 bp, Homo sapiens
  AC008930.3_134448
  Located on chromosome 5
  Distance between a terminus base of telomere on chromosomal short arm and 5'-terminus of this base sequence : 104513160
  Distance between 3'-terminus of neighbour sequence of sequence listing upward to telomere on chrosomal short arm and 5'-terminus of this base sequence : 127346
attagcactgcagatcaagtaggagaaataaatgatacccaataatgtgcagggacatttggttctctatatgaagaaaaaaatatacacacacacacacacacatatcatctaggttcatgtaggtagagtctgtattcgtgcaatgctgaaactgcctaacaaagcatttctcagaatttattccattgctaagtgactcacgactacagctgcaaatagttatgcagtattttactatgataatcctcacagtacttcatgaagtaggt

SEQ ID NO: 8855 - DNA, 282 bp, Homo sapiens
  AC008930.3_82815
  Located on chromosome 5
  Distance between a terminus base of telomere on chromosomal short arm and 5'-terminus of this base sequence : 104523984
  Distance between 3'-terminus of neighbour sequence of sequence listing upward to telomere on chrosomal short arm and 5'-terminus of this base sequence : 10552
caggaagcaagtacatgtaaacaactatggtaaggaatattttgagatgctactgctcttatagttcttatttatttatttatttatttatttatttatttatttgagacagagtctttctctgttattcaagctggagtgtagaggcacagtcatagctccctgcagcctcaaactatttggctcaagccatcctcccaccttagcctcccaagtagctgggattacaggtgtgagccaatgagtccagctatgatagttctttaactgatactcatggac

SEQ ID NO: 8856 - DNA, 282 bp, Homo sapiens
  AC011362.2_107267
  Located on chromosome 5
  Distance between a terminus base of telomere on chromosomal short arm and 5'-terminus of this base sequence : 104639636
  Distance between 3'-terminus of neighbour sequence of sequence listing upward to telomere on chrosomal short arm and 5'-terminus of this base sequence : 115370
tgataaagctacgctaggttaaaggaagaaaagatgtttacactccaggaatgtagcactatctcttgtctctttgtctctctgcctgtttctctatgtctgtctttctgttttgttctgtctctctctgtctctgtctctctctctctctctcgcccagcccccccaacacacacacacacacacacacacacacacacacacacacatgcgcaaatacacaccaggtttgagttaaggaccaacctaaagcacacacagtgtgatttcaagaaccaactc

SEQ ID NO: 8857 - DNA, 298 bp, Homo sapiens
  AC011362.2_98236
  Located on chromosome 5
  Distance between a terminus base of telomere on chromosomal short arm and 5'-terminus of this base sequence : 104648600
  Distance between 3'-terminus of neighbour sequence of sequence listing upward to telomere on chrosomal short arm and 5'-terminus of this base sequence : 8682
aaatggaagttacaggactcctacagatagagcctggtctctattcccatctcatgctatgacaaggaatatcctgatgttaactgttctaggcttctgcctgaaggaaaaattcttcgattctctaaatggttctagaatcctgaattggttcggctcatggacaagggttggtgcccagtctttactgcctgcccagcttttgtagacctgagttggctaatgtctgtataggatggtgtgtgtgtgtgtgtgtgtgtgtgtgtgtgtgtgtgtttatgaattgcagaaggtaagt

SEQ ID NO: 8858 - DNA, 107 bp, Homo sapiens
  Z66595
  Located on chromosome 5
  Distance between a terminus base of telomere on chromosomal short arm and 5'-terminus of this base sequence : 104648798
  Distance between 3'-terminus of neighbour sequence of sequence listing upward to telomere on chrosomal short arm and 5'-terminus of this base sequence : -100
gcttttgtagacctgagttggctaatgtctgtataggatggtgtgtgtgtgtgtgtgtgtgtgtgtgtgtgtgtgtgtttatgaattgcagaaggtaagtttgaggg

SEQ ID NO: 8859 - DNA, 103 bp, Homo sapiens
  D5S456
  Located on chromosome 5
  Distance between a terminus base of telomere on chromosomal short arm and 5'-terminus of this base sequence : 104648808
  Distance between 3'-terminus of neighbour sequence of sequence listing upward to telomere on chrosomal short arm and 5'-terminus of this base sequence : -97
acctgagttggctaatgtctgtataggatggtgtgtgtgtgtgtgtgtgtgtgtgtgtgtgtgtgtgtttatgaattgcagaaggtaagtttgagggtgaggg

SEQ ID NO: 8860 - DNA, 214 bp, Homo sapiens
  AC011362.2_50185
  Located on chromosome 5
  Distance between a terminus base of telomere on chromosomal short arm and 5'-terminus of this base sequence : 104696743
  Distance between 3'-terminus of neighbour sequence of sequence listing upward to telomere on chrosomal short arm and 5'-terminus of this base sequence : 47832
tagactgagaaccttagcaagaagccaagaagagaggctttagaagaagctaaacctgatgacatcttgatcttggacttctaacctccagagcatttctgttgtttaagctatcctgtctataactttgtattagtctgttagaactaccacacacacacacacacacacacacacacacacaaaccccatctattggatattggcagtctca

SEQ ID NO: 8861 - DNA, 352 bp, Homo sapiens
  AC010406.5_56254
  Located on chromosome 5
  Distance between a terminus base of telomere on chromosomal short arm and 5'-terminus of this base sequence : 104711295
  Distance between 3'-terminus of neighbour sequence of sequence listing upward to telomere on chrosomal short arm and 5'-terminus of this base sequence : 14338
gtaagccatgtaaagtgacaactgaaaatattttttgggtttagatactgaaagcctttgatgactttaacaggagctatttggtaacgtgtgagtgggacgtaagaggaacagcgagtaaggaagatatctaaatggtgatgtgggggtaaaaggaagttattattattattattttaattgacagtcattgggaaggatggattaagagtgtgtgtgtgtgtgtgtgtgtgtgcgcgtgtgtgtgtgagaaagacagagagaaatttgaaaaacaagaaagagaagaaataatctattatttaaatttcctatgaaagtcagaggagatgaaattcaatgctatcataag

SEQ ID NO: 8862 - DNA, 271 bp, Homo sapiens
  Z67292
  Located on chromosome 5
  Distance between a terminus base of telomere on chromosomal short arm and 5'-terminus of this base sequence : 104722842
  Distance between 3'-terminus of neighbour sequence of sequence listing upward to telomere on chrosomal short arm and 5'-terminus of this base sequence : 11195
actagacattccccatcaaaagtaaatgtaaaatcagggttcattgtaaatcagagacagggattctgaaataaggagaaggatagaaaataaagatgatttgttgatgagtcttgtttttctgttcacattcctttcaactcatttatgagggctgcatttttgtaaaggtcttttgtaatgtgcctattctgaaatggtgtgtgtgtgtgtgtgtgtgtgtgtgtgtgtttgtttgtgtctggttggtgttgtatgtgcatgctgttta

SEQ ID NO: 8863 - DNA, 178 bp, Homo sapiens
  AC011362.2_24039
  Located on chromosome 5
  Distance between a terminus base of telomere on chromosomal short arm and 5'-terminus of this base sequence : 104722970
  Distance between 3'-terminus of neighbour sequence of sequence listing upward to telomere on chrosomal short arm and 5'-terminus of this base sequence : -143
cattcctttcaactcatttatgagggctgcatttttgtaaaggtcttttgtaatgtgcctattctgaaatggtgtgtgtgtgtgtgtgtgtgtgtgtgtgtgtttgtttgtgtctggttggtgttgtatgtgcatgctgtttattgttggtatatgttatgaactgcatatttgcatc

SEQ ID NO: 8864 - DNA, 469 bp, Homo sapiens
  AC010406.5_109030
  Located on chromosome 5
  Distance between a terminus base of telomere on chromosomal short arm and 5'-terminus of this base sequence : 104730614
  Distance between 3'-terminus of neighbour sequence of sequence listing upward to telomere on chrosomal short arm and 5'-terminus of this base sequence : 7466
ataccagtgagtcattggaatatatccagatggtgatgtagatgagaccctgggagagcggggcagagtgtaagaaaagacgacacagttaggactctgaggaacatttcaaaaaaacagagaagtggaacctcactttgagactaggaagatatgtccagataggtaggtaggtagggagagagaaagagagaaagagagagcgagagagagagagagagagagagagagagagagagagagagagagagagagagatcatggatctgagaggaaagagccaatcagaaggagggagtaggtaagtgattcgtagtgttaggtgctccccagagttcaagtgaggttaaggctaagtagttactactgggtttggtggttgtaagtattcagaaatcatggtgagaacagttttggtgaagagatgaattacagcgtaatgaggagtttacatgcaaataggacgtta

SEQ ID NO: 8865 - DNA, 453 bp, Homo sapiens
  AC010406.5_159742
  Located on chromosome 5
  Distance between a terminus base of telomere on chromosomal short arm and 5'-terminus of this base sequence : 104774885
  Distance between 3'-terminus of neighbour sequence of sequence listing upward to telomere on chrosomal short arm and 5'-terminus of this base sequence : 43802
tgctaatggtcgactagattatttggacgcattcctcctgctgaaaatgacaagaaatgctgaatataatataaaaatgtctcttttaaaacattgaggaattaaaaatacattaaggaattaccaaaccaaaatttagggaaaaataactcaaaaaagaatctgagcactgaagccatgtgctccagaggtattttataacatggtaaaaattacactttggttttggtagcctcattgggtaagggatcataatttaaggtccagagccaactcaagtagaaaaatttaataagagactaaccctgttccatacacacacacacacacacacacacacacacacacacacatacacacacatatacatacatatgtgctttatatcaataatgaagctagtcatgggctagttctacttctaagggagtgcaacttaatctattctgattg

SEQ ID NO: 8866 - DNA, 431 bp, Homo sapiens
  AC010406.5_183361
  Located on chromosome 5
  Distance between a terminus base of telomere on chromosomal short arm and 5'-terminus of this base sequence : 104789690
  Distance between 3'-terminus of neighbour sequence of sequence listing upward to telomere on chrosomal short arm and 5'-terminus of this base sequence : 14352
atcaagtctgaggtactagacagtaaacaatattgtaccccacagggtctgaggtgacctgaataagttccgcggtgcgtccaccatagcgatgacatcattacagcatatgtgtatgcccatatctatgtgtaattgtaatgtataattaatacggagctaaaattaaactcctgggtgaaaagagatgggcaggctgaagaggctgaggaatattaacctctaagatgccgcttggttgcagcagctgtaggatggcagtgctcttagcatcaatgtgcgtgtgtgtgtgtgtgtgtgtgtgtgtgtgtgtgtgtgtatgtgtctgtgttcctttttgttgttaatgtttcagccttgaggaatgagaattttgcagtttatccacacttcatcccctccaagctccctaagaagcctttgtttcattt

SEQ ID NO: 8867 - DNA, 148 bp, Homo sapiens
  D5S409
  Located on chromosome 5
  Distance between a terminus base of telomere on chromosomal short arm and 5'-terminus of this base sequence : 104789940
  Distance between 3'-terminus of neighbour sequence of sequence listing upward to telomere on chrosomal short arm and 5'-terminus of this base sequence : -181
taggatggcagtgctcttagcatcaatgtgcgtgtgtgtgtgtgtgtgtgtgtgtgtgtgtgtgtgtgtatgtgtctgtgttcctttttgttgttaatgtttcagccttgaggaatgagaattttgcagtttatccacacttcatccc

SEQ ID NO: 8868 - DNA, 236 bp, Homo sapiens
  DISO7_10000290
  Located on chromosome 5
  Distance between a terminus base of telomere on chromosomal short arm and 5'-terminus of this base sequence : 105092052
  Distance between 3'-terminus of neighbour sequence of sequence listing upward to telomere on chrosomal short arm and 5'-terminus of this base sequence : 301964
cacaacagaagagtgaatattgactaacacattagcatatatcagcagctctgattaaaagcaatcattgtgtgtgtgtgtgtgtgtgtgtgtatgtgagagagagagagagagacattgttataaatatttttctaagcattttaaaagggaaaaaatgtggaactatttgtaaagcataaagaaaaggtctcaagatataaagaagaattaatttggagcaaatggccagaatc

SEQ ID NO: 8869 - DNA, 387 bp, Homo sapiens
  chr5.fa.O7frz.117269154
  Located on chromosome 5
  Distance between a terminus base of telomere on chromosomal short arm and 5'-terminus of this base sequence : 105162724
  Distance between 3'-terminus of neighbour sequence of sequence listing upward to telomere on chrosomal short arm and 5'-terminus of this base sequence : 70436
aggtgatttcataaggatacattaaagattagaagtttatgttataagcaaaaaaataataagaatgaaatgaatttgtttccttaataacatggacagcaaacagggatagcctatgtgcttcatgctttcttgattttgtgcctttactaatctttatttatttatttatttatttatttatttatttatttattgtatttgagacagagtctcactctgccaggctggagtccagtggcaccatcttggctcattgcaacctcagcctcccaggttcaagcgattctcctgcctcagcctcccgagtagctgggattgctgtgcaacttcatgcttctagaatagtcacgcttccagaatatgtcatgatctaactgttaggac

SEQ ID NO: 8870 - DNA, 129 bp, Homo sapiens
  D5S505
  Located on chromosome 5
  Distance between a terminus base of telomere on chromosomal short arm and 5'-terminus of this base sequence : 105261436
  Distance between 3'-terminus of neighbour sequence of sequence listing upward to telomere on chrosomal short arm and 5'-terminus of this base sequence : 98325
ctctatgagtatgaagtggatgaggtgtgtgtgtgcgtgtgtgtgtgtgtgtgtgtgtgtgtgtgtgtccagtttgaaaggttcccagatgactctgatacgtttctctgtgcaacatggcttctggac

SEQ ID NO: 8871 - DNA, 377 bp, Homo sapiens
  AC010588.7_66250
  Located on chromosome 5
  Distance between a terminus base of telomere on chromosomal short arm and 5'-terminus of this base sequence : 105324655
  Distance between 3'-terminus of neighbour sequence of sequence listing upward to telomere on chrosomal short arm and 5'-terminus of this base sequence : 63090
gacaaagtgagtattccgtgattttttgaaggaataaattcacaatgcttgagatattgttagtaattcatattttttccaacctttgtggaaaaagttaagttttagttatttggaacgttcttttaaagtgcaaatgtaaatagctttaagcaacgttaagatctcctttttctgaggtgattcatcagttaattccttctctctataggaagagaccaggggataaaactggattgagaataaaggaaagaatagggtagtggtagaagttaaagtgtgtgtgtgtgtgtgtgtgtgtgtgtgtgtgtgtgtgtgtatgtgtatgtggcagaaaggaggagattttctttctctatttgactcctgccatgtag

SEQ ID NO: 8872 - DNA, 285 bp, Homo sapiens
  chr5.fa.O7frz.116880266
  Located on chromosome 5
  Distance between a terminus base of telomere on chromosomal short arm and 5'-terminus of this base sequence : 105495071
  Distance between 3'-terminus of neighbour sequence of sequence listing upward to telomere on chrosomal short arm and 5'-terminus of this base sequence : 170039
taaaccttgctcagcattatagaattttatagaattacatgaaaaattaggatttctacccttttcctatactattgtaaacttttatgaaaaagttgtcttcagtgagtaaagtgtgatgactaaacaccctatcattcttagtttttaccaaattgttatttagaatttatatcttatcaaggaaaatcgtgtgtgtgtgtgtgtgtgtgtgtgtggtgtgtgcatgttggagggaggtatacacatgtgtgtgttggggttgtagcctgaatttaaatacag

SEQ ID NO: 8873 - DNA, 371 bp, Homo sapiens
  chr2.fa.O7frz.192175458
  Located on chromosome 5
  Distance between a terminus base of telomere on chromosomal short arm and 5'-terminus of this base sequence : 105597320
  Distance between 3'-terminus of neighbour sequence of sequence listing upward to telomere on chrosomal short arm and 5'-terminus of this base sequence : 101964
attattgaacctggtatccaacaacaagaatttgtaattattagaaagtctttgagagaagtactagagattaaatagaaaaaaaaaaaacagtgatagaaaacttttgttaagtatctgatggccaagcgctttatatctgcatgcttagatttggactccaaggctcagatgagtgtgtgtgtgtgtgtgtgtgtgtgtgtgtacacagtcatgaatcacttaatggggatacttctgagaaatgcattgtttggcaattttgtcactgtgcaaatatcatagggtgtacttacacaaacctacatgggatagcctgctacacacctaggctatatggattgcacctatgctacaaacctgtacagcat

SEQ ID NO: 8874 - DNA, 319 bp, Homo sapiens
  chr5.fa.O7frz.116752287
  Located on chromosome 5
  Distance between a terminus base of telomere on chromosomal short arm and 5'-terminus of this base sequence : 105621469
  Distance between 3'-terminus of neighbour sequence of sequence listing upward to telomere on chrosomal short arm and 5'-terminus of this base sequence : 23778
tattggtcattgctcaatagaccaataatatatacttatactgatacatacttacgtcatttgaaaaagccatatacctaatatcattggggtgtctatgtgtgtgtgtgtgtgtgtatacacacatgcactggtgtataactggtatatgcatatatataaatgcattggtgtatatatgtgtgtgtgtgtgtgtgtgtgtgtgtgtgtatatatatatatatatatacatttttttttttttttttttttttttttttttttttttttcagtcagagtctcactctgccacccagcctggagtgcagtacctgtatc

SEQ ID NO: 8875 - DNA, 261 bp, Homo sapiens
  D5S654
  Located on chromosome 5
  Distance between a terminus base of telomere on chromosomal short arm and 5'-terminus of this base sequence : 105737108
  Distance between 3'-terminus of neighbour sequence of sequence listing upward to telomere on chrosomal short arm and 5'-terminus of this base sequence : 115320
ctcatactgatgcaatcatattgaacttgctactctaagtatataaaagaatttatatagtttcatgaatggttgatacaggaaatctttgttagtcatcctagaatcttaaatacacacacacacacacacacacacacacacacacacacacacacacagacacttccatatatacatataaacagaaatagaaaatttgctaagtaaaaaaaaatgttttgaacatattttcttctagtgcaggtaacatttaacgga

SEQ ID NO: 8876 - DNA, 478 bp, Homo sapiens
  AC022124.3_9269
  Located on chromosome 5
  Distance between a terminus base of telomere on chromosomal short arm and 5'-terminus of this base sequence : 105898530
  Distance between 3'-terminus of neighbour sequence of sequence listing upward to telomere on chrosomal short arm and 5'-terminus of this base sequence : 161161
gtcacctaactgagctaaggtttgttagggttctccactgtaaagttattcttgttacccctttccatactgcactccttggcaggaggccactatgtgcagcccacacataaagaatggagagtcctgctctacataatttatttgtaattctgtatggaagatatgactctaacttcaatttattgttctttaatttatttgtattagtatgcactgagaaatacacttattttatactatgggtcataatccaatgttatattattatttagcttctcaaattgttccagctttggctattgggagctatataaattgcctcctgtgtccctttcacatgtctccattattctgtgtgtgtgtgtgtgtgtgtgcatgtgctattgctgctgttttgatttttagcattttcttactttagaacaataagatgctcaaagttcatcttttatagttcttgtcttagagtcagacc

SEQ ID NO: 8877 - DNA, 453 bp, Homo sapiens
  AC022124.3_31730
  Located on chromosome 5
  Distance between a terminus base of telomere on chromosomal short arm and 5'-terminus of this base sequence : 105939313
  Distance between 3'-terminus of neighbour sequence of sequence listing upward to telomere on chrosomal short arm and 5'-terminus of this base sequence : 40305
agctttgcttggaaactaatacaaatatacttacattcatttccattcagtttatatattctgggataagtctgggtagtagtctatttttctgcattaaaatgtgcaagctattttaagtttgaatagtaaatgttgatgaataattttcatgattataaaaatcatcttagagaaaaatatcggtaaaaatgggagtaaaagtgaacacatttaaagatgcagtagtaacgcattaaatgacccagattctagagaaaacattctttttattttctttttctttccatttatttatttatttatttatttatttatttatttgagatgggttcttgctgtgtcacccaggctagagtgtagtggtgtgattatagctcactgcaaccttaaactcccgggattaagtgttcctacctcactcacctaagtagctaggactaaggcatgtac

SEQ ID NO: 8878 - DNA, 214 bp, Homo sapiens
  D5S433
  Located on chromosome 5
  Distance between a terminus base of telomere on chromosomal short arm and 5'-terminus of this base sequence : 105945771
  Distance between 3'-terminus of neighbour sequence of sequence listing upward to telomere on chrosomal short arm and 5'-terminus of this base sequence : 6005
tgtaagacatactctctatcacccattgacatcacacacacacacacacacacacacacacacacacacacacacagaggaatttactgcctcaaaaatttatgacataaaaaattatgtataacaaaaaccctggagattctaagtagaccaaataatcctaattttgataaaatcatttttaaacaaatattccacacagatggatgtctga

SEQ ID NO: 8879 - DNA, 394 bp, Homo sapiens
  chr5.fa.O7frz.116424538
  Located on chromosome 5
  Distance between a terminus base of telomere on chromosomal short arm and 5'-terminus of this base sequence : 106074634
  Distance between 3'-terminus of neighbour sequence of sequence listing upward to telomere on chrosomal short arm and 5'-terminus of this base sequence : 128649
tagcattcactacatatgagttgagtgaatggacaatggtatttccaagtactaacctgaataggttttcattccctattaaactccatcaattccctaggctactccaaataaacatattatacataaaaaattcaaaattggtttggatatgcaaactcagggaaatttctatagcctatttttccatccagattgctactcgtagacttctgctatgtagcaacaaataaataaataaataaataaataaataaataaataaataaataaataaatacgtgaaaactgtatagccagcagacaaattaaagaggattccaatgatgtcataaaatggtatagtgctctctagagccacttttaagatgattaggatttggaattcatagat

SEQ ID NO: 8880 - DNA, 443 bp, Homo sapiens
  chr5.fa.O7frz.116183629
  Located on chromosome 5
  Distance between a terminus base of telomere on chromosomal short arm and 5'-terminus of this base sequence : 106175020
  Distance between 3'-terminus of neighbour sequence of sequence listing upward to telomere on chrosomal short arm and 5'-terminus of this base sequence : 99992
gctaacatggactataaatttcagttattttgatttctgattcaatgtaatcatattcagtattgaatatttcggagtctgtacttcaaaacaattttcatttcaccaattttggtcattatttgtgtgtgtgtgtgtgtgtgtgtgcatgtgtgtgtgtgtctttctgtttgtttttaggggttttttgtttgtttctgaattttttttgcttgtatatgtgttaaaacgaaaataagaaaaatcagtattgatgagaaaatataagcttgagaacatcaagagcaaacaaaagtttattgttatcattattatagggacttgactttaaacgtcatttatcctttttgtttcctctttggaacaatatgagtaactgttttcaatttctaaggagtttccttggggtgtaaggatatttgtccacttaagatgcaaagtta

SEQ ID NO: 8881 - DNA, 427 bp, Homo sapiens
  chr5.fa.O7frz.116102511
  Located on chromosome 5
  Distance between a terminus base of telomere on chromosomal short arm and 5'-terminus of this base sequence : 106202354
  Distance between 3'-terminus of neighbour sequence of sequence listing upward to telomere on chrosomal short arm and 5'-terminus of this base sequence : 26891
attcaagagtctaaggagaatcacttgaaaccagaaagcggaggttgcagtgagccgagattgcaccactgcactctagcctggatgacagagtgagactccatctaacaacaacaacaacaacaacaacaacaacaacacactccacccctaactctcacacttccatggttaaaattcatcacctacctattatagcctacattcgtgggtgaggtgtatatgttttttagctttagaatttattggtcctttacatgtatactaatttctagcttgaacaaactattatgaagtcctcaaatattttatgctttcaatctcatatttttggtgctttaattcatggttatattcttcatagaatcacttttccttgtaaaacttactttttttgaaaaattacttgcatactttgtaaacgtgt

SEQ ID NO: 8882 - DNA, 397 bp, Homo sapiens
  AC008970.4_111413
  Located on chromosome 5
  Distance between a terminus base of telomere on chromosomal short arm and 5'-terminus of this base sequence : 106325691
  Distance between 3'-terminus of neighbour sequence of sequence listing upward to telomere on chrosomal short arm and 5'-terminus of this base sequence : 122910
aatgtcatgaaatgcagttaaatatttgtaattaagattaataagcacacatgttgataaatactatttataattatattcttttctaatatgatttcatgaagaaacactctattttataattaatcgtctcaaaagtctatttaaaaaaacagctcccatataaacaagtatatcttaaattttacataataaaaaatgcacaaattcactctgtgtgtgtgtgtgtgtgtgtgtgtgtgtgtgtgtgtgtgtgtgtacgtgtgcgtgtttcacatgtaggaaaagtttaattgcataatagtgtaatgggtgattgaggtttgtttcttttactttttgttatttttgccaaaaaataattttagatatatttatggtcctgatttcataaatc

SEQ ID NO: 8883 - DNA, 191 bp, Homo sapiens
  G08474
  Located on chromosome 5
  Distance between a terminus base of telomere on chromosomal short arm and 5'-terminus of this base sequence : 106339273
  Distance between 3'-terminus of neighbour sequence of sequence listing upward to telomere on chrosomal short arm and 5'-terminus of this base sequence : 13185
tcctgagtactcttgcccagttctatctatctatctatctatctatctatctatctatctatctatgatatatattaaatatatacatatataatttgttctattgatattgatatgttttggctgtgtccctacccatatctcatcttgaattcccacatattgtgagaggcgcccagtgggagttaact

SEQ ID NO: 8884 - DNA, 196 bp, Homo sapiens
  Z67312
  Located on chromosome 5
  Distance between a terminus base of telomere on chromosomal short arm and 5'-terminus of this base sequence : 106553336
  Distance between 3'-terminus of neighbour sequence of sequence listing upward to telomere on chrosomal short arm and 5'-terminus of this base sequence : 213872
agctgccttagttacagtagtttgtgtgtgtgtgtgtgtgtgtgtgtgtgtgtaatatttattgttgcaaatttaggacatgcagaaaaaagatacgtataaaaaatgtataccacatggaattgcaaattaaccattgtgaagccttcagtgtaatatcttgcaatacatgtgcataaaatgggcacatatcagc

SEQ ID NO: 8885 - DNA, 202 bp, Homo sapiens
  D5S1461
  Located on chromosome 5
  Distance between a terminus base of telomere on chromosomal short arm and 5'-terminus of this base sequence : 106602029
  Distance between 3'-terminus of neighbour sequence of sequence listing upward to telomere on chrosomal short arm and 5'-terminus of this base sequence : 48497
ttccagatgagatttgggtggggacacggagccaaaccatatcaggtagataggtaaataggtaggtaggtagatagactagatatagatagatagatagatagatagatagatagatagatagatagatgatacatacatacatacatgcatcatacatacatattagatagatttgtccaatagagaattgaggaaaaga

SEQ ID NO: 8886 - DNA, 263 bp, Homo sapiens
  M5_106683789
  Located on chromosome 5
  Distance between a terminus base of telomere on chromosomal short arm and 5'-terminus of this base sequence : 106683717
  Distance between 3'-terminus of neighbour sequence of sequence listing upward to telomere on chrosomal short arm and 5'-terminus of this base sequence : 81486
atattgataccagcattaagttcagtttctctcttctccctccctcaatctccttctctcattctgaaaacttgtgtgtgtgtgtgtgtgtgtgtgtgtgtgtatgtgtgtgagagagactgagacagagagagagagagagagagagattgagacagagagagacaatgtaattcaagtaattctttatgtcatgttatataaaacttttccaacattaaacagaattttaagttactgtgctatatcttactgaagtgaga

SEQ ID NO: 8887 - DNA, 380 bp, Homo sapiens
  chr5.fa.O7frz.117853503
  Located on chromosome 5
  Distance between a terminus base of telomere on chromosomal short arm and 5'-terminus of this base sequence : 106916138
  Distance between 3'-terminus of neighbour sequence of sequence listing upward to telomere on chrosomal short arm and 5'-terminus of this base sequence : 232158
gctgcaagttcttactgtgtattgctttaactatactcacacattttgatccattgtgttgtcactattttttagttcaaaatattttctgagtcggtgatttcctgttttagaagtacatgtgtgagtgtgtgtgtgtgtgtgtgtgtgcgtgtgtgtctttaagtttcaaatatttggagcatttccagatatttttgttatttatttctaaatcagatctgttgtgacctgtaaattttctatataattccaatcattttaatttttttcagacctgctcaatttattatttggaatttctgtgagttttcctgatgggcgtttaagagctctttattttggaagtagtttctcttactgaatagatgcagagtgtt

SEQ ID NO: 8888 - DNA, 340 bp, Homo sapiens
  chr5.fa.O7frz.118009794
  Located on chromosome 5
  Distance between a terminus base of telomere on chromosomal short arm and 5'-terminus of this base sequence : 106999475
  Distance between 3'-terminus of neighbour sequence of sequence listing upward to telomere on chrosomal short arm and 5'-terminus of this base sequence : 82957
gtaacaatacaggattgcagttagtccaagaggagagctggaattttttagcatttataagctattcagcaaaccaaagtaattcagtaaaaacattgcacaaacatgagagtctacacatattttcctttctcttctaagcattttgataagttttaagacagctttccatgcatttcacacaaacacacacacacacacacacacacacacacacacacacttccttttgcaatatgttagctattctcttaggattttttcttgttttgttttgctttttaaatagtgattgtcttcttttgggaaacacaagtaatgaagtagacctctaaagctc

SEQ ID NO: 8889 - DNA, 168 bp, Homo sapiens
  AC022103.4_86159
  Located on chromosome 5
  Distance between a terminus base of telomere on chromosomal short arm and 5'-terminus of this base sequence : 107054102
  Distance between 3'-terminus of neighbour sequence of sequence listing upward to telomere on chrosomal short arm and 5'-terminus of this base sequence : 54287
tctttccacatatgtccttcacttttgcactattgttttcatgcattttaaccatatatatatatatatatatatatatatatatatatatatacgcaactgcgtaaattattattcttattatctaagttagtcaatattcatctacatgaatttctcctttgaaag

SEQ ID NO: 8890 - DNA, 275 bp, Homo sapiens
  Z67017
  Located on chromosome 5
  Distance between a terminus base of telomere on chromosomal short arm and 5'-terminus of this base sequence : 107083935
  Distance between 3'-terminus of neighbour sequence of sequence listing upward to telomere on chrosomal short arm and 5'-terminus of this base sequence : 29665
tgatactctgtgacttgggttctagaaaaaagaaaaaaagaaaaaaaaagtgtgtgtgtgtgtgtgtgtgtgtgtgcgtgcgtgtgtgtatttctaaaatgagtatttcttcttcagagagtctttgggttttataattttatgacaggcgaattctacagatacaatttcttcattcaaaaacaagtatgtgatactaccaatgttacaagattgtgaccaaaatactgcctttctattgcttgctttaataaaatgcctggttccagcactaa

SEQ ID NO: 8891 - DNA, 229 bp, Homo sapiens
  AC008529.3_14483
  Located on chromosome 5
  Distance between a terminus base of telomere on chromosomal short arm and 5'-terminus of this base sequence : 107949511
  Distance between 3'-terminus of neighbour sequence of sequence listing upward to telomere on chrosomal short arm and 5'-terminus of this base sequence : 865301
acatgaagtggtcagtgaatcctccccacaaataaaataaaataaaataaaataaaataaaataaaataaaataaaataaaataaaataaaataaaataaaataaaataaaactgggcaatattttcaaaaacaaccttttaagaaacttctgaaaagtgatcaaacaacaaacagagatgcttattcgtgaagaatttctgtaactctaggtaagaatggtaggagtc

SEQ ID NO: 8892 - DNA, 141 bp, Homo sapiens
  DISO7_10001956
  Located on chromosome 5
  Distance between a terminus base of telomere on chromosomal short arm and 5'-terminus of this base sequence : 108028065
  Distance between 3'-terminus of neighbour sequence of sequence listing upward to telomere on chrosomal short arm and 5'-terminus of this base sequence : 78325
ccttaccctccaagttgggggacatatacgtgtgtgtgtgtgtgtgtgtgtgtgtgtgtgtgtctgtgtttatagcttttcacacatttatctctctagcctcttttcaacaggccacatcccctcattgcacatcaggct

SEQ ID NO: 8893 - DNA, 141 bp, Homo sapiens
  DISO7_10001959
  Located on chromosome 5
  Distance between a terminus base of telomere on chromosomal short arm and 5'-terminus of this base sequence : 108090596
  Distance between 3'-terminus of neighbour sequence of sequence listing upward to telomere on chrosomal short arm and 5'-terminus of this base sequence : 62390
gaattccttcttccatgccccttacctacaaatctacaaacttgtacatctacctatatgtactctgtgtgtgtgtgtgtgtgtgtgtgtgtaaccatagttctgctgcatatataaattcacatcctgtatgtctggaac

SEQ ID NO: 8894 - DNA, 254 bp, Homo sapiens
  AC010626.4_33166
  Located on chromosome 5
  Distance between a terminus base of telomere on chromosomal short arm and 5'-terminus of this base sequence : 108227573
  Distance between 3'-terminus of neighbour sequence of sequence listing upward to telomere on chrosomal short arm and 5'-terminus of this base sequence : 136836
gcctaacctgactaattgtctcccctgattgtgacggttttgattagaagaataatcagctctcagcagcctgtaggcaaaaatgcaaactgaaggagtgtgagtgtgtgtgtgtgtgtgtgtatgtgtgtgtgtgacagatgcatagcagaatgaatgccagatcaatattatcccactcttaaaacattaaaggggttccaatatgaacaaaagccaataattcccttcatagctaactagcatgaacgttt

SEQ ID NO: 8895 - DNA, 409 bp, Homo sapiens
  AC010626.4_134831
  Located on chromosome 5
  Distance between a terminus base of telomere on chromosomal short arm and 5'-terminus of this base sequence : 108250387
  Distance between 3'-terminus of neighbour sequence of sequence listing upward to telomere on chrosomal short arm and 5'-terminus of this base sequence : 22560
ttagctttctatgaagtccaatacctgtaattttatgtatcaggactctctgatttgaagtccctacagaaatgctttattcttagtccatttagctgcccttaaaatgtttattttttctctttctctctctctctctctctctctctcacaggaacatccaaactgtgttgtcacagtgtataaaacagaggcatattcctttcaggttatactataccctgactccttgatgaaatgatttgatgtggttcacaaatcagaatcagacagaatgaaatcattacaccttatatagcttaaaaacaaaaaagccagacataaagtggacaggaaatcagtcataatgaaaaactatttcaagtcacacatttgctgatttagtgtctatttgctgagcatttgtatc

SEQ ID NO: 8896 - DNA, 409 bp, Homo sapiens; identical to SEQ ID NO: 8895
  AC026459.2_70166
  Located on chromosome 5
  Distance between a terminus base of telomere on chromosomal short arm and 5'-terminus of this base sequence : 108250387
  Distance between 3'-terminus of neighbour sequence of sequence listing upward to telomere on chrosomal short arm and 5'-terminus of this base sequence : -409

SEQ ID NO: 8897 - DNA, 190 bp, Homo sapiens
  DISO7_10001717
  Located on chromosome 5
  Distance between a terminus base of telomere on chromosomal short arm and 5'-terminus of this base sequence : 108272956
  Distance between 3'-terminus of neighbour sequence of sequence listing upward to telomere on chrosomal short arm and 5'-terminus of this base sequence : 22160
agactacatatggtgattaccctgtaaattacctgttcatatagtttccccaggttgtgtcgttggggcctgtgcttttctttatgtatataagtatgtatgtatgtatgtatgtatgtatgtatgtatgtatgtatgtgtatcagccaaaggagtctttgatttcttttactgtgagatttccattgga

SEQ ID NO: 8898 - DNA, 291 bp, Homo sapiens
  AC010227.5_98825
  Located on chromosome 5
  Distance between a terminus base of telomere on chromosomal short arm and 5'-terminus of this base sequence : 108290080
  Distance between 3'-terminus of neighbour sequence of sequence listing upward to telomere on chrosomal short arm and 5'-terminus of this base sequence : 16934
ccttacaattcaaatgacctacagccctagacactagaattttatttcatttttgagacacagtctcacactgtcgcccacgctgaagcgcagtggtataatcatggctcactgcagcctcaagtaaccgggctcaagtgatcctcctgcctcagcctcctaagtagctaggaccaaaaatgggcaccacaatgcctggctagttttgtgtgtgtgtgtgtgtgtgtgtgtgtgtgtgtgtgtgtgtgtgtgtgttaatttttggacagacgagtttacactatgttgcct

SEQ ID NO: 8899 - DNA, 317 bp, Homo sapiens
  AC073175.3_162859
  Located on chromosome 5
  Distance between a terminus base of telomere on chromosomal short arm and 5'-terminus of this base sequence : 108320702
  Distance between 3'-terminus of neighbour sequence of sequence listing upward to telomere on chrosomal short arm and 5'-terminus of this base sequence : 30331
taggaagctagtgaagactgaaacacctcgtcaatggcttgtcagagttgaaggtttttctggtgcgtaaaacatacacacacacacacacacacacacacacacactcatccctggtgtaggaaagaatttttttttaaataaaatactgtggccatgcatcttaaatttgccatatgcctttcctgtcaaccagcagttatttttattaataactccaagaacatatcatggaattcttttttgttttgagatccggtcatgtgactccttcaacaccagggaacactgggtaaattgtaatgttctaacatgcc

SEQ ID NO: 8900 - DNA, 319 bp, Homo sapiens
  AC026459.2_9302
  Located on chromosome 5
  Distance between a terminus base of telomere on chromosomal short arm and 5'-terminus of this base sequence : 108320704
  Distance between 3'-terminus of neighbour sequence of sequence listing upward to telomere on chrosomal short arm and 5'-terminus of this base sequence : -315
ggaagctagtgaagactgaaacacctcgtcaatggcttgtcagagttgaaggtttttctggtgcgtaaaacatacacacacacacacacacacacacacacacactcatccctggtgtaggaaagaatttttttttaaataaaatactgtggccatgcatcttaaatttgccatatgcctttcctgtcaaccagcagttatttttattaataactccaagaacatatcatggaattcttttttgttttgagatccggtcatgtgactccttcaacaccagggaacactgggtaaattgtaatgttctaacatgccaatg

SEQ ID NO: 8901 - DNA, 250 bp, Homo sapiens
  D5S475
  Located on chromosome 5
  Distance between a terminus base of telomere on chromosomal short arm and 5'-terminus of this base sequence : 108391622
  Distance between 3'-terminus of neighbour sequence of sequence listing upward to telomere on chrosomal short arm and 5'-terminus of this base sequence : 70599
cagataccgctactcttatcctaccttaccataaatttaaacccataaaaaaactaaacattacacatacttacatgtgcacatacacacacacacacacacacacacacacagagagagagagagagagagagaaagagagagagagagaaccacagagtctccaaatacaggagaaaatggaactggaacagtatttcctactcacttaaccattaattctaggaacattcattcagcaccaaccaga

SEQ ID NO: 8902 - DNA, 468 bp, Homo sapiens
  AC008800.3_40167
  Located on chromosome 5
  Distance between a terminus base of telomere on chromosomal short arm and 5'-terminus of this base sequence : 108414897
  Distance between 3'-terminus of neighbour sequence of sequence listing upward to telomere on chrosomal short arm and 5'-terminus of this base sequence : 23025
cgctatacagatactttgaaagacaaatgagaatgctgccacatgcaaggtcaatcacaaacaacctgggtgtctctccttccccaggagaccaggacctagggagccagtgggtatacccaagcaggccacaccaggtcacttctcttacatttctgagtttcaattttagcaacctggtaggtaggtaggtaggcaggtagatagatagatagatagatagatagatagatagatagatagatagacagacagacagacagacagacagatagatagaatgtatggatatgattaaaaataggctgggcacggtggctcacacctgtaatcccagcactttgggaggccaaggcaggtggattgcttgaggtcaggagttcgagaccagcctgggcaacatggtgaaacccatctctactaaaaatacaaaaaattagctgggcatggtggtacgtgcctgtagtc

SEQ ID NO: 8903 - DNA, 214 bp, Homo sapiens
  HUMUT7616
  Located on chromosome 5
  Distance between a terminus base of telomere on chromosomal short arm and 5'-terminus of this base sequence : 108415013
  Distance between 3'-terminus of neighbour sequence of sequence listing upward to telomere on chrosomal short arm and 5'-terminus of this base sequence : -352
tacccaagcaggccacaccaggtcacttctcttacatttctgagtttcaattttagcaacctggtaggtaggtaggtaggcaggtagatagatagatagatagatagatagatagatagatagatagatagacagacagacagacagacagacagatagatagaatgtatggatatgattaaaaataggctgggcacggtggctcacacctgta

SEQ ID NO: 8904 - DNA, 222 bp, Homo sapiens
  DISO7_10001960
  Located on chromosome 5
  Distance between a terminus base of telomere on chromosomal short arm and 5'-terminus of this base sequence : 108551820
  Distance between 3'-terminus of neighbour sequence of sequence listing upward to telomere on chrosomal short arm and 5'-terminus of this base sequence : 136593
cttatcatttctctgatagttcaggggagaaaggaacaaacccctttctgttacatggccttttgaaactatttctctctctctctctatttatatatatataccacacacatatatgcatacacacacacacacacacacatatatatatatatatatattttttttccctcttctcaaagatattttcctttgtattttgcaagagatgagctaaggcaa

SEQ ID NO: 8905 - DNA, 367 bp, Homo sapiens
  AC011419.5_79775
  Located on chromosome 5
  Distance between a terminus base of telomere on chromosomal short arm and 5'-terminus of this base sequence : 108689372
  Distance between 3'-terminus of neighbour sequence of sequence listing upward to telomere on chrosomal short arm and 5'-terminus of this base sequence : 137330
ggctgaaacagatcacttaagccaaggagtttgaagctgcagtgagccatgatcatgtcactgcacttcagcctgggcagcagagcaagactctgtcactaatatatatatatatatatatatatatatatatatatatatatatatatatatataaaatgagattgataaaagtaataatactagaacaactttgggcatcgtgcttagaatgccttaatttaattacactcatatgtctggggttgtagcagatggggtcttaaccctattactagccaatctaataatactgagtgattaaagtaattattccatttccttattttcaaataggaaagtggtagactggtcagactttaaggta

SEQ ID NO: 8906 - DNA, 370 bp, Homo sapiens
  AC011419.5_73761
  Located on chromosome 5
  Distance between a terminus base of telomere on chromosomal short arm and 5'-terminus of this base sequence : 108695433
  Distance between 3'-terminus of neighbour sequence of sequence listing upward to telomere on chrosomal short arm and 5'-terminus of this base sequence : 5694
tttatgtggtagttggattcaggccttacttttctttgtatttttcacagtgcctaagacataggaactacatgaatggatgaatgaatgaatgaatgaatgaatgaataaaatttattctaaaaatgcattatatgtagccgtaggtaggttccggagtcagacttcctgggttcaaatgacaactctgccacttactggttttgtgaccttgaacaagttatttcatgtttctagtgtcaatttcattatctattaagtagaaataatactcttggcctacttcagaggcttgtgagactgaaatgagatgctagtcagagtggctagtatactgtttaacacattaagcactaaatgctcactgtta

SEQ ID NO: 8907 - DNA, 395 bp, Homo sapiens
  AC011419.5_119617
  Located on chromosome 5
  Distance between a terminus base of telomere on chromosomal short arm and 5'-terminus of this base sequence : 108726008
  Distance between 3'-terminus of neighbour sequence of sequence listing upward to telomere on chrosomal short arm and 5'-terminus of this base sequence : 30205
attgaaatgtaccaagcaaataaaccggtgagtttgatgagtgagcataagggggcgtgaggttgattagaaccaggcgaaggcaggtggggcacaacacaacatatgtacagaaataaaacatgtttcaataataaagtgttgcctgtgtgtgtgtgtgtgtgtgtgtgtgtgtgtgtgtgtttatagcagccctgtatgttaaataatgaccatgactcaaaacactttagttttctgtattaccaaaagtaaattgaaaatatataaggtacttctaaattattcttgactacccctctgtacacaaagtgctccttgtaccctgctagacccagggctctgtgactgataatttcacccatcagcattcctaaattaaggttaatggccag

SEQ ID NO: 8908 - DNA, 460 bp, Homo sapiens
  AC011419.5_157763
  Located on chromosome 5
  Distance between a terminus base of telomere on chromosomal short arm and 5'-terminus of this base sequence : 108746010
  Distance between 3'-terminus of neighbour sequence of sequence listing upward to telomere on chrosomal short arm and 5'-terminus of this base sequence : 19607
tgccagattgtctaatgtctatttgtttccttcacagcttcttctacatcttcatcctcatcatctggcattggttcagaagtactacttatcttcatttctgttaattgctctggtgtagtgtctattagttcttgaatttccccaagatcagatcctcatcttgaaatcctctacccctcactttctttttctttctttctttctttcttttttatcatatccacaatctcattcctgattttcttgattggccctgtcataaatcctgtgaagtcatgcacatctggacagttttctccagcagtgattgttttcacagctttttttttttaataataagaatggcatcttcaatggtgtcatgcttccagactgttacatgttgtatctgggttctctttcacagcattgataattcttttcaaaaagtaccatgtgtaatgaaccttaaaggtcc

SEQ ID NO: 8909 - DNA, 175 bp, Homo sapiens
  DISO7_10019727
  Located on chromosome 5
  Distance between a terminus base of telomere on chromosomal short arm and 5'-terminus of this base sequence : 108917817
  Distance between 3'-terminus of neighbour sequence of sequence listing upward to telomere on chrosomal short arm and 5'-terminus of this base sequence : 171347
gaagagctctttcaccgccgttcagcgcccccctagccattagagagaaaaaccaaggccggtacaatgcgagcgcagtgtaccaagggaacacacacacacacacacacacacacacacacacacacacacacacacaaaccgaatcttgaaaaactagacgttgcccagctac

SEQ ID NO: 8910 - DNA, 159 bp, Homo sapiens
  D5S467
  Located on chromosome 5
  Distance between a terminus base of telomere on chromosomal short arm and 5'-terminus of this base sequence : 109027304
  Distance between 3'-terminus of neighbour sequence of sequence listing upward to telomere on chrosomal short arm and 5'-terminus of this base sequence : 109312
gaggctgcaagttccctaagggtagagtttacgttgtatctttgaataactaacatttattaaatagtatgtggcaggaacaatcgtaaacatttatatgtgtgtgtgtgtgtgtgtgtgtgtgtataaaaattcaattttcacaactacatgaggggc

SEQ ID NO: 8911 - DNA, 463 bp, Homo sapiens
  chr5.fa.O7frz.135283688
  Located on chromosome 5
  Distance between a terminus base of telomere on chromosomal short arm and 5'-terminus of this base sequence : 109105819
  Distance between 3'-terminus of neighbour sequence of sequence listing upward to telomere on chrosomal short arm and 5'-terminus of this base sequence : 78356
gttctgtcatttagaaactgacagtcttgggcaaattacttgtcttttctgagtcagtttctttacttataaagttgaaataataatacctgcttcataatcatttgagaattaactaaaattatgtttacaaaaaatctgtgccctatctggcatataattggcattcagtaaatattacctctcttgccttatcaaaagggagatggaggggttgctggggaaagtcatggggatttctcagtattctaatctgctggaaacagaattgactctgtgtgtgtgtgtgtgtgtgtgtgtgtgcgcgcgtgagagagagagagagagagagggagggagaaagagacagagagagagaaagagaggcagagacaatttaggggaaggaggcttatttgattgcattgatttttctaatctgtcttcttaagtcatattagtgtctgcaatttcctagtatcaa

SEQ ID NO: 8912 - DNA, 455 bp, Homo sapiens
  AC008436.4_47215
  Located on chromosome 5
  Distance between a terminus base of telomere on chromosomal short arm and 5'-terminus of this base sequence : 109256390
  Distance between 3'-terminus of neighbour sequence of sequence listing upward to telomere on chrosomal short arm and 5'-terminus of this base sequence : 150108
tcatgaatcttttgcttacaagagacagaaacccagctcaaaaaagcttatgccataaaagagaaattgcgttaaattttttcatgaagattttcttttctttctttctttcttgctttctttctttctttctttctttctttctttctttctttctttctttctttttttctacctcttattgctgcttttttctatgttgctttcattctcaaccagggtgttccttcagggtagcaaagatggcaactgtggctgccctaggcttacatcaccctctgagctaacaaaagtaagagaacaagaaagactacctctttttaaataggtctaaccaatcatctgtccctgtgcaatctttatggccaagaggatgtgaaaccctgattggctagtcgtggtcatgtgcccatccctatactgagggaggcaagtgttcaaccaatctatcaatg

SEQ ID NO: 8913 - DNA, 419 bp, Homo sapiens
  chr5.fa.O7frz.131998119
  Located on chromosome 5
  Distance between a terminus base of telomere on chromosomal short arm and 5'-terminus of this base sequence : 109340860
  Distance between 3'-terminus of neighbour sequence of sequence listing upward to telomere on chrosomal short arm and 5'-terminus of this base sequence : 84015
ttaaattgatttcttgctcactactagtacttttttctgtagtttcccagtttttatgacttacggttattcacttctttagttagctagactgtgtttttaacacaaacttcaggaagatacaaagatttcattcacttcttgaactctcatatacttaagaatctttgttcttgtgacaagtgaaatacagtttggttttgtatataattcttacttaacatctttttaattttaaaactctatagaccatactcactgatgagtcagttctccagagagaaacacacacacacgtgtgtgtgtgtgtgtgtatatatatatatctatatatatctatatatatctatatatatatggttcatgtgattatggaagcttgatcaaaatttgcagagtataccaataggctgaagacc

SEQ ID NO: 8914 - DNA, 447 bp, Homo sapiens
  chr5.fa.O7frz.131873624
  Located on chromosome 5
  Distance between a terminus base of telomere on chromosomal short arm and 5'-terminus of this base sequence : 109449487
  Distance between 3'-terminus of neighbour sequence of sequence listing upward to telomere on chrosomal short arm and 5'-terminus of this base sequence : 108208
gtatgacaccatgctagcataaaacactgaagagcccatagcttactgtgggacacacacacacacacacacacacacacacacacacacatatacaactttcgacaaattaaaattttaaaattgttgcataacagatatacatagttttgggggcacatatgacaatataatacattcacataatttgtaaagatcaaaccagtgaaattgggatatctgtcactttaaatatttgtcttttctttttgctggaaccattcagtcctcctcttctagctattttgaaatgtacaataggttactgtaaacaatagttaacccactgatttatctaacactgggtcttatttcttctatcaaactacatatttgtactcattaattgacttctcttcatccttcatctccccaccattcctggcctctggtaatcacgagtctacc

SEQ ID NO: 8915 - DNA, 265 bp, Homo sapiens
  chr5.fa.O7frz.131778631
  Located on chromosome 5
  Distance between a terminus base of telomere on chromosomal short arm and 5'-terminus of this base sequence : 109544391
  Distance between 3'-terminus of neighbour sequence of sequence listing upward to telomere on chrosomal short arm and 5'-terminus of this base sequence : 94457
tcctttgacaattctgtgttacaaattttctttcagtttgtagattgtccttttacctgtctatggtatctttctgataatagcagttcttaattgctctatttaatttagtcaaatatgttgagcttttcctttatgacttgtggctgtgtttgtgtgtgtgtgtgtgtgtgtgtgtgtttctgtatgtatgtttagagaaatccatccactgccaagattatattttcctttttatggtacctattcctatccgataaggtgt

SEQ ID NO: 8916 - DNA, 431 bp, Homo sapiens
  chr5.fa.O7frz.131665126
  Located on chromosome 5
  Distance between a terminus base of telomere on chromosomal short arm and 5'-terminus of this base sequence : 109629755
  Distance between 3'-terminus of neighbour sequence of sequence listing upward to telomere on chrosomal short arm and 5'-terminus of this base sequence : 85099
aaattgctgttatgcaaagtacatgtgcacacacacaaatacacacatttaatgtggaatggaaatctttgctgaaaaatgtcatattgacatggggtgtgtgtgtgtgtgtgtgtgtgtgtgtgtgtgtgtgtgtgtgtgtatgatggtgaagctgtaccttctaaccttttgggacttttatgtaaatggagattatttatatgttgttgggatgtggaatgtgactctcttgccaagcactccagttgtttagcttatttcctgggtaatataatcagaaaagcaaagaccatagaatttaaggtgttaaacatctctttagccccgagtgagaaatcactttaagtgagacaagaatatgttcatttgtattccaagcaaagatggaaaaaatcttataaattattaatccaccaagtagcatgtat

SEQ ID NO: 8917 - DNA, 108 bp, Homo sapiens
  DISO7_10001934
  Located on chromosome 5
  Distance between a terminus base of telomere on chromosomal short arm and 5'-terminus of this base sequence : 109877275
  Distance between 3'-terminus of neighbour sequence of sequence listing upward to telomere on chrosomal short arm and 5'-terminus of this base sequence : 247089
tggaaccagtcccagaagcgggtggtgtatgtgtgtgtgtgtgtgtgtgtgtgtgtgtgtgtgtgtgtgtgtgtctgtgtgtacatctatctgtgtatacaaaggacg

SEQ ID NO: 8918 - DNA, 276 bp, Homo sapiens
  chr5.fa.O7frz.103189687
  Located on chromosome 5
  Distance between a terminus base of telomere on chromosomal short arm and 5'-terminus of this base sequence : 109927342
  Distance between 3'-terminus of neighbour sequence of sequence listing upward to telomere on chrosomal short arm and 5'-terminus of this base sequence : 49959
agctatggatgaggatagaaagatagataggtacacacagttagatagtgtatgcatgtgtatgtatatgtgtgtgtgtgtgtgtgtgtatatatatatatatatatatatacacacacacgccctctttttttcttgaagcataaataacaccatgcggacaatgcatgcatccacatacagggccaaccttccccatagaaaaaggaggaaggcaaacatattatccaaaagtggttcaaagtgtttactgagttgccttctaagcactataca

SEQ ID NO: 8919 - DNA, 281 bp, Homo sapiens
  DISO7_10001932
  Located on chromosome 5
  Distance between a terminus base of telomere on chromosomal short arm and 5'-terminus of this base sequence : 109963260
  Distance between 3'-terminus of neighbour sequence of sequence listing upward to telomere on chrosomal short arm and 5'-terminus of this base sequence : 35642
aggcacctgacagagattgtaatattatttgcataagaataaaatgtaattttataatttttgttttatgtgtaattaaatattataattaaatagaccaaaaacatttgatagcacatatatattttaagaaaagctatttccccaaagatattccacagatatgtttattttgctagagagaatgtgtatgtatatacacacacacacacacacacacacacacatatatattcctttatatcaatagtcagatctctcctgagaaataagctaatcga

SEQ ID NO: 8920 - DNA, 101 bp, Homo sapiens
  DISO7_10001936
  Located on chromosome 5
  Distance between a terminus base of telomere on chromosomal short arm and 5'-terminus of this base sequence : 110008020
  Distance between 3'-terminus of neighbour sequence of sequence listing upward to telomere on chrosomal short arm and 5'-terminus of this base sequence : 44479
gcccacaacctacctcactcctaacctctcccttatacacacacacacacacacacacacacacacacacacgctgggaaaagcagcagtaacagggagca

SEQ ID NO: 8921 - DNA, 248 bp, Homo sapiens
  DISO7_10001937
  Located on chromosome 5
  Distance between a terminus base of telomere on chromosomal short arm and 5'-terminus of this base sequence : 110012717
  Distance between 3'-terminus of neighbour sequence of sequence listing upward to telomere on chrosomal short arm and 5'-terminus of this base sequence : 4596
ccagcctagacaaattatagcactatggtgtgtgtgtgtgtgtgtgtgtgtgtgtgtgtgtgtgtgtgtgtatgcaattagaatctaagtgtcttcttaataaaaacttactgatttttctacagtaaatgtctaaactacatcagaatagacatatatatgtatatatatgtatatatatatatgtgtgtgtatatatatatatatatgctgatctctagaaagaaaaggagaggaaagttccatcc

SEQ ID NO: 8922 - DNA, 101 bp, Homo sapiens
  DISO7_10001938
  Located on chromosome 5
  Distance between a terminus base of telomere on chromosomal short arm and 5'-terminus of this base sequence : 110027553
  Distance between 3'-terminus of neighbour sequence of sequence listing upward to telomere on chrosomal short arm and 5'-terminus of this base sequence : 14588
cccattatgagagcatacatgtgtatgtgaaagagagagaaagagagagagagagaggtgaggggagagggagcgagggaggatgaatctgtctgtgactt

SEQ ID NO: 8923 - DNA, 156 bp, Homo sapiens
  DISD22_0007872
  Located on chromosome 5
  Distance between a terminus base of telomere on chromosomal short arm and 5'-terminus of this base sequence : 110182302
  Distance between 3'-terminus of neighbour sequence of sequence listing upward to telomere on chrosomal short arm and 5'-terminus of this base sequence : 154648
cccactgagcatctgttatctttatacttttattatttagatagagataaagaggtgtgtgagagagacgtccgtgtgtgtgtgtgtgtgtgtgtgtgtgtgtgtgtgtgtgtgtgtgtgtagaataaaaatcagtctattaagtccaggaaatca

SEQ ID NO: 8924 - DNA, 237 bp, Homo sapiens
  DISD22_0007873
  Located on chromosome 5
  Distance between a terminus base of telomere on chromosomal short arm and 5'-terminus of this base sequence : 110270888
  Distance between 3'-terminus of neighbour sequence of sequence listing upward to telomere on chrosomal short arm and 5'-terminus of this base sequence : 88430
agtgggaacaggaaccaggaatgaaataaagagaaccagaaatggtaagtaaaatgtaaatatctaaaaatctatctatctatctatctatctatctatctgtctgtctgtctgtctgtctgtctgtctgtctatctatctatctatatttgcccttatttcttttctcagcttccatagtagacaaaaaaataaattaatagcaatgcattatttgctttgtagcatgtatggatg

SEQ ID NO: 8925 - DNA, 271 bp, Homo sapiens
  DISD22_0007878
  Located on chromosome 5
  Distance between a terminus base of telomere on chromosomal short arm and 5'-terminus of this base sequence : 110363996
  Distance between 3'-terminus of neighbour sequence of sequence listing upward to telomere on chrosomal short arm and 5'-terminus of this base sequence : 92871
tcataaatggaggaccttctctgtgtgtgtgtgtgtgtgtatgtgtgtgtgtgtgtgtgtgtgtgtgtgtgtgcagtatacaaaaattatatagtgtgagccaccacgccctgctaattttcatatttttagtagagacggggttttaccatgttggccaggctggactcaaactcctgacctcaggtcatccacccgcctcggcctcccaaagtgctggacttacagttgtcatgaggaaaatatgtgcttacttagtgcaatttatagg

SEQ ID NO: 8926 - DNA, 168 bp, Homo sapiens
  DISD22_0007882
  Located on chromosome 5
  Distance between a terminus base of telomere on chromosomal short arm and 5'-terminus of this base sequence : 110438552
  Distance between 3'-terminus of neighbour sequence of sequence listing upward to telomere on chrosomal short arm and 5'-terminus of this base sequence : 74285
gagaaggaggacgctataattgaatttaaactcaagtagaaaattctatggaattatctagcattatgtagaacatgttagtatttgttaagaataagatagcatattcagaaaggaaaacacacacacatacacacacacacaactttaagctatcagttctgctcc

SEQ ID NO: 8927 - DNA, 269 bp, Homo sapiens
  DISD22_0007888
  Located on chromosome 5
  Distance between a terminus base of telomere on chromosomal short arm and 5'-terminus of this base sequence : 110552918
  Distance between 3'-terminus of neighbour sequence of sequence listing upward to telomere on chrosomal short arm and 5'-terminus of this base sequence : 114198
ctgaacttgatcaacttcatattgtagataattctaaaaatctatattcccaaaccaatcctttttctctgtattttccttctagagacatgttttatggcggctgcgctttcctgtctaaaaagtacaaaaccaaagtgaaacaaaataaaacacaaatgcaaacacaaaaccaccaaaagcatttacctattcttattttcagcagagtgtgtatgtgtgtgtatatatatatatatatataacattcagataggtcacctctattt

SEQ ID NO: 8928 - DNA, 283 bp, Homo sapiens
  DISD22_0007897
  Located on chromosome 5
  Distance between a terminus base of telomere on chromosomal short arm and 5'-terminus of this base sequence : 110773731
  Distance between 3'-terminus of neighbour sequence of sequence listing upward to telomere on chrosomal short arm and 5'-terminus of this base sequence : 220544
gattgctgtatctgatgtttcccttcccaggagtagaaataacaaaattgttatttgatgattttaaaaaatttaatgggaaagtttattgctatatgtatatttctgggcatatatatatatacacacacacacacacacacacacacacacatacacacacacatacacacataaatttttgtgtgtctatgtgtatgtacatcacatacatatacacaaatacacacacagatatacaagtaatgtagaaaatagctctctcttaagggaagagctgttg

SEQ ID NO: 8929 - DNA, 357 bp, Homo sapiens
  chr5.fa.O7frz.119608203
  Located on chromosome 5
  Distance between a terminus base of telomere on chromosomal short arm and 5'-terminus of this base sequence : 111046576
  Distance between 3'-terminus of neighbour sequence of sequence listing upward to telomere on chrosomal short arm and 5'-terminus of this base sequence : 272562
agcagtattgctgaaatgttatagaattaatgcattattttgctgttgtccatgactgaagaggggaagatataagaaaactgaaaaattataacccccaaataatcaatatttaagaaggtgtaaaatagtaaaaatatttaatgtgaaaaatatctacctaatacaaggaaaataaagcaagaaacaatccatctccatggcttctccctcaccctcacctcagaacacacacacacacacacacacacacacacacagagagagagatagacagatatattaagacagcagcttcttttatcatgcacagaggaataaaatattttccattccttccttagctccatgtaaact

SEQ ID NO: 8930 - DNA, 448 bp, Homo sapiens
  chr5.fa.O7frz.119686490
  Located on chromosome 5
  Distance between a terminus base of telomere on chromosomal short arm and 5'-terminus of this base sequence : 111124674
  Distance between 3'-terminus of neighbour sequence of sequence listing upward to telomere on chrosomal short arm and 5'-terminus of this base sequence : 77741
aaatggtagcctgttaagagagtcccgggagaaaaaactgtggcatgttgggaataattaatcaacaaatagatacatacatacatacatacatacatacatacataccccagcccagcgcagtggctcacacctgtaatcccagcactttgggaggcccaggtgggcggactgcctgagctcaggagttcgacaccagcctcggcaacacagtgaaaccccgtctctactaaaatacaaaaaaaaattagccaagcgtagcagtgtgtgcctgtagtcccagctactcgggaggctgaggcaggagaattgcttgaacccgggaggcggaggttgcagcgagctgagatcgtgccactgcactccagcctgggcgacagcggaagactctgtctcaaacaaacaaacaaaaaaacccacacaaactcaaccagtaagttgattcttt

SEQ ID NO: 8931 - DNA, 194 bp, Homo sapiens
  AC044794.5_33529
  Located on chromosome 5
  Distance between a terminus base of telomere on chromosomal short arm and 5'-terminus of this base sequence : 111222222
  Distance between 3'-terminus of neighbour sequence of sequence listing upward to telomere on chrosomal short arm and 5'-terminus of this base sequence : 97100
gtggctacaactaagatgcaagagaagaagggttgggaaaaaaaagtatcgaaacagtatggacttatctggcttttaaatttcttggctattaaaatctggatgatatagtcaacaacaacaacaacaaaaagaatccaccccaaaactcacatgatgaatacatccttctactgcctgtcaggtaactttat

SEQ ID NO: 8932 - DNA, 373 bp, Homo sapiens
  AC044794.4_115110
  Located on chromosome 5
  Distance between a terminus base of telomere on chromosomal short arm and 5'-terminus of this base sequence : 111274076
  Distance between 3'-terminus of neighbour sequence of sequence listing upward to telomere on chrosomal short arm and 5'-terminus of this base sequence : 51660
tagtatgctgtccttgctaacttcttttctttcaaaactgctttatatcttcatttaagtcttactttggaagagagcgagagagagagagagagagagagagagtgtgtgtgtgtgtgtgtgtgtgtgtgtgtgtatgtcttggggaggatactaaggcaggaactcttccaaattcccattgttttgccaatgattttccctggcaaatcaatatatttcctgcctgttgtcttcaacatttgtaaaaattgacatctctaaactttaatgcattgagtccagtttgaataatttgaatctttattgcactacaaatcaaagatgttcactgctgaattatcagtaggtaacataactgcagattagtggt

SEQ ID NO: 8933 - DNA, 200 bp, Homo sapiens
  Z67623
  Located on chromosome 5
  Distance between a terminus base of telomere on chromosomal short arm and 5'-terminus of this base sequence : 111274126
  Distance between 3'-terminus of neighbour sequence of sequence listing upward to telomere on chrosomal short arm and 5'-terminus of this base sequence : -323
tcatttaagtcttactttggaagagagcgagagagagagagagagagagagagagtgtgtgtgtgtgtgtgtgtgtgtgtgtgtgtatgtcttggggaggatactaaggcaggaactcttccaaattcccattgttttgccaatgattttccctggcaaatcaatatatttcctgcctgttgtcttcaacatttgtaaaa

SEQ ID NO: 8934 - DNA, 433 bp, Homo sapiens
  chr5.fa.O7frz.120010974
  Located on chromosome 5
  Distance between a terminus base of telomere on chromosomal short arm and 5'-terminus of this base sequence : 111369486
  Distance between 3'-terminus of neighbour sequence of sequence listing upward to telomere on chrosomal short arm and 5'-terminus of this base sequence : 95160
tactagaccttagaaggttgtcagttttttgtgggttagtagttaatatagaaaaacaacaaagtatgactgctatatcaggattatattcagccttgaagcaatttctatttttatatgttcacttagaccagtttgtatgctgcgaaatcaatgagaagagaattgtgttggcaagaaatgtgcctggtgaatgaatgaaagaaagaaagaaaaaaagaaagaaagaaggaaagaaagaaagaaagaaagaaagaaagaaagaaagaaagaaagaaagaaagaaaggaaggaaggagggagggcgggagggagggagggaagaaacaaagagatgttttcttaaactacatatgcctttaaacatttttatttagaattttttatttccctgcaaatatgtgattataacattacaaggaagacattgtag

SEQ ID NO: 8935 - DNA, 292 bp, Homo sapiens
  AC044794.5_79234
  Located on chromosome 5
  Distance between a terminus base of telomere on chromosomal short arm and 5'-terminus of this base sequence : 111440656
  Distance between 3'-terminus of neighbour sequence of sequence listing upward to telomere on chrosomal short arm and 5'-terminus of this base sequence : 70737
taacctgcacattgtgcacatgtaccctaaaacttaaagtataataataataaaaataataataataataaaaggaaaatgaacaaaaaagtctctctggcctcaatgccactgaggcctattactggaaagtatacataaaagtttaaagaacaaaacaaatgcagaaaaaaaatgcaatatttattatgaataactcttggataaatgagggagaaactattcagttactatgcagctaccataaaaattctttttatcaaaatttgtacaatatttccaaagctatgct

SEQ ID NO: 8936 - DNA, 324 bp, Homo sapiens
  chr5.fa.O7frz.120225636
  Located on chromosome 5
  Distance between a terminus base of telomere on chromosomal short arm and 5'-terminus of this base sequence : 111657359
  Distance between 3'-terminus of neighbour sequence of sequence listing upward to telomere on chrosomal short arm and 5'-terminus of this base sequence : 216411
catccagaagttccttatcatatatatatacacacacatatgtgtatatacatatatatgatatatatatatacatatatatatgatttgtaaatattttctcccattctgtaggttgtcttttcactttcttgatggtgtcctttgaagcatggaagttttaaattttgatgaaatccaactaatgtgtttttattttgtcatttgtgcttttgttgttgtatctaagaaaccattgcctaagccaaggttacaaagattacttgtatgttttattctgagaattttatagttttagctctgatacttaggtatgtcatccat

SEQ ID NO: 8937 - DNA, 395 bp, Homo sapiens
  AC011421.2_41465
  Located on chromosome 5
  Distance between a terminus base of telomere on chromosomal short arm and 5'-terminus of this base sequence : 112018651
  Distance between 3'-terminus of neighbour sequence of sequence listing upward to telomere on chrosomal short arm and 5'-terminus of this base sequence : 360968
ccaagtaatactgccatacctattcaccagcctaggcagttctaagtggaaaaggatttgcatggagatagcaaagtaagtggtatcttatcttaactaattatctctacacctaggagaatttttatgttcgtttataataattgttatcttatcctcaagttattcaacctaaaattatgtaaatagttcaagttatttttagacatctctgtaagtaagtttcctgctagtaagtttccagacagattttgtgcagtttttgtttgtttgtttgtttgtttgtttgtttggcacgactcctctgttctttcagaaaaatcagaattttcagcttccaattgttttgtggtttttggtatttttatttataaacttggtagttagatgctttc

SEQ ID NO: 8938 - DNA, 186 bp, Homo sapiens
  chr5.fa.O7frz.121003336
  Located on chromosome 5
  Distance between a terminus base of telomere on chromosomal short arm and 5'-terminus of this base sequence : 112521340
  Distance between 3'-terminus of neighbour sequence of sequence listing upward to telomere on chrosomal short arm and 5'-terminus of this base sequence : 502294
gcaaactaatccatagtgacagaaagcagattagtgattgactaggattctgcctgagaccgtgataggaaggaaggaaggaaggaaggaaggaaggaaggaaggaaggaaggaaggaaggatggattacaaacgggcatgataaaattttgggaggtgatggacttgacaggttcattaacttga

SEQ ID NO: 8939 - DNA, 296 bp, Homo sapiens
  D5S1466
  Located on chromosome 5
  Distance between a terminus base of telomere on chromosomal short arm and 5'-terminus of this base sequence : 112594530
  Distance between 3'-terminus of neighbour sequence of sequence listing upward to telomere on chrosomal short arm and 5'-terminus of this base sequence : 73004
ggcacctaggtttgttctgaaggtcctggggaaaccagaatgtctgtctgtctgtctatctatctatctatctatctatctatctatctatctatctatcatctatctatctttctatctgtcatctatgtcatctcatctatttatccatcctatgtatttatcatctaatttatctgtatatctctatcatcaatttatcaattatctatcaatctattttccagctttattgaggtattattggtaaataaaaattgtatatatttatggtgtacaacatgaagttctgatac

SEQ ID NO: 8940 - DNA, 196 bp, Homo sapiens
  AC008417.3_59031
  Located on chromosome 5
  Distance between a terminus base of telomere on chromosomal short arm and 5'-terminus of this base sequence : 112619168
  Distance between 3'-terminus of neighbour sequence of sequence listing upward to telomere on chrosomal short arm and 5'-terminus of this base sequence : 24342
agaaagacagaactgataggacacacacacacacacacacacacacacacacacacatgagaagggagttattaggagaattggcttatttgattatggagactgagaagttccactattggccatctgcatctgcatgctggagaaccagagaagctggtagcaggacttagtctaagtctgaaggccttagaac

SEQ ID NO: 8941 - DNA, 453 bp, Homo sapiens
  AC008417.3_110484
  Located on chromosome 5
  Distance between a terminus base of telomere on chromosomal short arm and 5'-terminus of this base sequence : 112670335
  Distance between 3'-terminus of neighbour sequence of sequence listing upward to telomere on chrosomal short arm and 5'-terminus of this base sequence : 50971
cagcttatgtgaactttgaaagagttttccaaagtggtggtgctattttatattccaccaacaacgaattagagttctgattgttccacatttttgccagtgtttgctgtgtgagtcttttttcttagaaccatgctagtgggtatatagtgatatttcactgttattttaacatgcatttctatgatgactaatgatgctgagtatgttttgttgtgcttattggccagtggtataccctattttcaagtttctaagtcttttacccattctttttatttgaattgttgctatatatatatatatatagatagatagatagatagatagatagatagatagatagatactttaagttctgggatacatgtgcagaacatgcaggtttgttacataggtttacaacatgccatagtggtttgctgcacccatcaacctgtcatctatgttagg

SEQ ID NO: 8942 - DNA, 201 bp, Homo sapiens
  AC008417.3_131032
  Located on chromosome 5
  Distance between a terminus base of telomere on chromosomal short arm and 5'-terminus of this base sequence : 112691152
  Distance between 3'-terminus of neighbour sequence of sequence listing upward to telomere on chrosomal short arm and 5'-terminus of this base sequence : 20364
gctattgctaccttgaatcaaaatgacttgcaatatctgtgtgtgtgtgtgtgtgtgtgtgtgtgtgtgtgtgtgtatgtgtgtaggaaacaacaaaatccgcatctttcttttaaaaggaacacattccctgttaaataatctgtttatttttgacaggactgccttttaatatctgtttacaagatttggtatcgtgtt

SEQ ID NO: 8943 - DNA, 288 bp, Homo sapiens
  chr5.fa.O7frz.121288037
  Located on chromosome 5
  Distance between a terminus base of telomere on chromosomal short arm and 5'-terminus of this base sequence : 112804515
  Distance between 3'-terminus of neighbour sequence of sequence listing upward to telomere on chrosomal short arm and 5'-terminus of this base sequence : 113162
agtttaaaccacctaaatgcttacctaccacagaatggttaaaattaagctaaattaatatatatgcacttgtttaataaatgaaataaatcaacatgtgttttactaggaaaaggtgtacaatacacacaacccttcatcacacacacacacacacacacacacacacgtatatctatgtgttaacccctcttaacacacagacgtatatcccttggatatcttaggccagacctgtgctttaacaactatagctttctacaggttcaagaaagttatgctatcagt

SEQ ID NO: 8944 - DNA, 398 bp, Homo sapiens
  chr5.fa.O7frz.121394636
  Located on chromosome 5
  Distance between a terminus base of telomere on chromosomal short arm and 5'-terminus of this base sequence : 112911247
  Distance between 3'-terminus of neighbour sequence of sequence listing upward to telomere on chrosomal short arm and 5'-terminus of this base sequence : 106444
tttgaataactgctacaaggagaatcagcaaaaaggaaagttagtgatggacttaatgtgtgtgtgtgtgtgtgtgtgtgtgtgtgtgtgtgtgtgtgtgtgtgtgaaagagagagagagaaatcaattctataaattgtttgttgaaaggtaagttgtagcccatgtagtaaaatccttattgaacaggagtgtctctagctacactctggaacagagaaagtcttgagtattcaccctatcatctctctagttgcatcagtatgttcaggttggccctatgagagaagtagatgcttcggtagcatctcactctttgtctcccggaccacaggagatattcaaaggttattactcagcagctatacaaaataaggaacagaattgcttcctaaatc

SEQ ID NO: 8945 - DNA, 237 bp, Homo sapiens
  DISO7_10001965
  Located on chromosome 5
  Distance between a terminus base of telomere on chromosomal short arm and 5'-terminus of this base sequence : 112972256
  Distance between 3'-terminus of neighbour sequence of sequence listing upward to telomere on chrosomal short arm and 5'-terminus of this base sequence : 60611
acacagatatttggctagacattactcatacattatttctatccagagtatttgcttttgaacacaaaaattttcaaagagatagcaaaaatattccctatttcctagtgggaaaataataaatataattaccaaagttagggattgggaatctctctctcttcttctctgtcatccctctctctctctctctctctgatctatctaatttttagtataggtggcaatttctgccta

SEQ ID NO: 8946 - DNA, 235 bp, Homo sapiens
  DISO7_10001967
  Located on chromosome 5
  Distance between a terminus base of telomere on chromosomal short arm and 5'-terminus of this base sequence : 112997021
  Distance between 3'-terminus of neighbour sequence of sequence listing upward to telomere on chrosomal short arm and 5'-terminus of this base sequence : 24528
catcaggtgggtagatattaacccctggagaaaactaaatgactgagtatttccaaatgtatattttatatatatatatatatatataagtatatatatatataaatatatatacttatatatatatatacttatatatataagtatttctatttccaaatatatatatacatatatatatatgtatatatatgaagaatcagtgaagagagagaggtaattcatggtgttaatg

SEQ ID NO: 8947 - DNA, 142 bp, Homo sapiens
  DISO7_10001964
  Located on chromosome 5
  Distance between a terminus base of telomere on chromosomal short arm and 5'-terminus of this base sequence : 113019420
  Distance between 3'-terminus of neighbour sequence of sequence listing upward to telomere on chrosomal short arm and 5'-terminus of this base sequence : 22164
aagaacaacagaaacttctctgggagagggggagagtgagagagagagagagagagagagagagagagagcgagagagagagggagagagagagagagagagagagagagagagagaattaagcacattctttaatccagca

SEQ ID NO: 8948 - DNA, 416 bp, Homo sapiens
  chr5.fa.O7frz.122197817
  Located on chromosome 5
  Distance between a terminus base of telomere on chromosomal short arm and 5'-terminus of this base sequence : 113216686
  Distance between 3'-terminus of neighbour sequence of sequence listing upward to telomere on chrosomal short arm and 5'-terminus of this base sequence : 197124
taagctgtatctgtttcaggagcaccccaagcccagcaacactgtggttcttgcagaggtactgccttgatagtcttggacaagatccagaagaattatctggattaccaggcagagattcttttaatcttcccttactttcccccaaacatatagagtctctctctctctctctctctctctctctctcttctctctcctctctcctctctcctcatctctcctctctctcctctctctcctctctctcttcagaggcatctaaagctgggggtggagtgacacaagcacccctgtggccataatcactatgactgagctagatcagacctgaaaccagtacagaacaggatctcacccaagaccagttcctggctgctgcctatgttcctggatactgcctatgttcactcaag

SEQ ID NO: 8949 - DNA, 106 bp, Homo sapiens
  Z66841
  Located on chromosome 5
  Distance between a terminus base of telomere on chromosomal short arm and 5'-terminus of this base sequence : 113334053
  Distance between 3'-terminus of neighbour sequence of sequence listing upward to telomere on chrosomal short arm and 5'-terminus of this base sequence : 116951
gccctagacagaccaaagtagttatttatgcgtgcgtgtgtgtgtgtgtgtgtgtgtgtgtgtgtatgtgtatgtgtgtatgtgatgttggcaaactgctatttca

SEQ ID NO: 8950 - DNA, 354 bp, Homo sapiens
  chr5.fa.O7frz.122292141
  Located on chromosome 5
  Distance between a terminus base of telomere on chromosomal short arm and 5'-terminus of this base sequence : 113569642
  Distance between 3'-terminus of neighbour sequence of sequence listing upward to telomere on chrosomal short arm and 5'-terminus of this base sequence : 235483
gttggtaggaatgtacgttagtacagccataatgaataacactatggaggttcctcaaaaaactaaaaatagaactgccatataatccagcaatcccattactggatatatatccaaagaaaatataatcagtatgtgaaagagacatctgcacatccatgtttattgtagcactattcacagtagccaagatacagaatcaacctatatgtgcatctaatgatgaatggatatctatctgagtgtgtgtgtgtgtgtgtgtgtgtagtagaatactataaagccataaaacagaatgaaatcctgtcatttgcagtaacatgaatgaacctggataacactatgttaaagcac

SEQ ID NO: 8951 - DNA, 395 bp, Homo sapiens
  chr5.fa.O7frz.122371996
  Located on chromosome 5
  Distance between a terminus base of telomere on chromosomal short arm and 5'-terminus of this base sequence : 113613052
  Distance between 3'-terminus of neighbour sequence of sequence listing upward to telomere on chrosomal short arm and 5'-terminus of this base sequence : 43056
ggaacctcagaaacatctaaatgtgtctgttattattgcaaggaaccaggacatctgaagaaagattgcaaaaagttgaaatgggcacagaaattaacaagaataaatataaaagaaagaagaggtatgggaggctctgaggaaataaagagggcctttcccttgcttttaagtcataatctgggggaagtgaagatagataaataggtagataggtaggtaggtaggtaggtagatagatagataggtagatagatagatagatagatagatagatagatagatagatataatagagaacaaattaaagcattaattgacacaagagctaccttttctatcctcaaccccacctttcctaaagagccttcttcctcagagtaatcaaactattc

SEQ ID NO: 8952 - DNA, 280 bp, Homo sapiens
  AC016608.4_77493
  Located on chromosome 5
  Distance between a terminus base of telomere on chromosomal short arm and 5'-terminus of this base sequence : 113720711
  Distance between 3'-terminus of neighbour sequence of sequence listing upward to telomere on chrosomal short arm and 5'-terminus of this base sequence : 107264
gataaagaattacgtgagcttcagctgctggtggcagctacaggaagatggcttgtctgagagtgtgtatgcatgcatgcgtgtgtgtgtgtgcctgtgggtgcgtaagagaaagagagaattctgaaagtaatatttgagtgcttggacttagacttcttgtccacctctacccacgaacttctctatgtgattaaataacattattattattattattattattattattattattattaatgcaatctaggctgaattaggtttctgcaacttgtaa

SEQ ID NO: 8953 - DNA, 280 bp, Homo sapiens; identical to SEQ ID NO: 8952
  AC008782.4_31348
  Located on chromosome 5
  Distance between a terminus base of telomere on chromosomal short arm and 5'-terminus of this base sequence : 113720711
  Distance between 3'-terminus of neighbour sequence of sequence listing upward to telomere on chrosomal short arm and 5'-terminus of this base sequence : -280

SEQ ID NO: 8954 - DNA, 334 bp, Homo sapiens
  HUMUT6886
  Located on chromosome 5
  Distance between a terminus base of telomere on chromosomal short arm and 5'-terminus of this base sequence : 113736527
  Distance between 3'-terminus of neighbour sequence of sequence listing upward to telomere on chrosomal short arm and 5'-terminus of this base sequence : 15536
tgagaacagatggcacactgagtctctgttagccaattaagaatgaatggcatggctgcagaggaggctgccacccaccccctagtcactctcaggggttgggaatgtcagtcttgttccaatccagtccgtccgtccttccttccttccttccttccttccttccttccttccttccttcctttcttccttccttccttccttccttccttcctttctttctctctctctctctttctctctccctctctctctctccccacccccccctttctttctttccttctttctttctgttgttgacaagatctcattctgttgcccaggctggagt

SEQ ID NO: 8955 - DNA, 316 bp, Homo sapiens
  chr5.fa.O7frz.122746589
  Located on chromosome 5
  Distance between a terminus base of telomere on chromosomal short arm and 5'-terminus of this base sequence : 113929405
  Distance between 3'-terminus of neighbour sequence of sequence listing upward to telomere on chrosomal short arm and 5'-terminus of this base sequence : 192544
caacgtgacctgtaaactctagccaacttctcttcgggcacttaaacacacacacacacacacacacacacacacgcacacaattttttttttcctgctagactgcaatatttgttgctcttggcttcctggcatccaaatgctctcccaccccttgtttgaatcctgatctccctttgggtggaatttccccatgagtaagtttctcatgggagagcatttcctatctcttgttgctcatggtttatcccaccaaaaagaaaaaaaaaaaaacctatctttgtctgcttcctggtacaattaagcagtggacaac

SEQ ID NO: 8956 - DNA, 287 bp, Homo sapiens
  AC012606.4_170551
  Located on chromosome 5
  Distance between a terminus base of telomere on chromosomal short arm and 5'-terminus of this base sequence : 114057856
  Distance between 3'-terminus of neighbour sequence of sequence listing upward to telomere on chrosomal short arm and 5'-terminus of this base sequence : 128135
gaaatagacttggtgatagttgagaggtggataataaagtcaactcctgggtttctatttgtagtactggatggatgattgtgtgattgttattcaccacgataagaaattgtgtgtgtgtgtgtgtgtgtgtaagagagaaagagagaggtgtgcacatgcaaatgcaaggaggtaattgaggatgaagtgagggtagttgagtttgaagtgacttggtggtttctaaatagatgttcccactccccagattgcacttttcctacttctgcactagacatcaagac

SEQ ID NO: 8957 - DNA, 452 bp, Homo sapiens
  chr5.fa.O7frz.122977136
  Located on chromosome 5
  Distance between a terminus base of telomere on chromosomal short arm and 5'-terminus of this base sequence : 114178727
  Distance between 3'-terminus of neighbour sequence of sequence listing upward to telomere on chrosomal short arm and 5'-terminus of this base sequence : 120584
gagatgacagcctagataggacagaataagggtttgaaaagtagaatagaaggtttcctaaataaatatattcacacacacacacacacacacacacacacacacacagaaagagagagagagagacgtttgcccatgagaacatttcccttattatatttattctgaactacagttgcttccctcttcaacccagcccttttcactttcacattcatgaattctttctttatataagctacactttggggaatagattttttgctttttggtgtattttactattctcaggtatttaaaagcatttttaagatatctatgaattctcaaaatgcccacatttctggcacagttgaaatagcgagacttgagtttagacaccagtggtctccttattatgaattactgtcctgctatttattagtctttctcaatagattgacatagttggc

SEQ ID NO: 8958 - DNA, 348 bp, Homo sapiens
  chr5.fa.O7frz.123068646
  Located on chromosome 5
  Distance between a terminus base of telomere on chromosomal short arm and 5'-terminus of this base sequence : 114265101
  Distance between 3'-terminus of neighbour sequence of sequence listing upward to telomere on chrosomal short arm and 5'-terminus of this base sequence : 85922
gactgaatcatttataatgagcacaaatttactggttcagttctggaggaggctgagaagtccaaaatcaaggggccagcatgtggtgaggggcttcttcctgtgtcaactcatggcagaatagcagagagagagagagagagagagagagggagagggagggagggaaggggagagggggaaagagagagaaagaaagagggtaccaaactcatgcttttataagggaactactcttgcaataagagcattaatccattcatgggaatggtgcaccatcatccaaacacctccctttaggccccacctttcaacaccacagcattgaggatcaaatttccaatacat

SEQ ID NO: 8959 - DNA, 464 bp, Homo sapiens
  AC011340.4_60729
  Located on chromosome 5
  Distance between a terminus base of telomere on chromosomal short arm and 5'-terminus of this base sequence : 114320388
  Distance between 3'-terminus of neighbour sequence of sequence listing upward to telomere on chrosomal short arm and 5'-terminus of this base sequence : 54939
tagtttatgtgcaatagcctctacctactgcaggccacaagagaagggcttaagaaagaatgactaggctgggcatggtggtttatgcctgtaatctcagcaccttgggaggctgaggtgggcagatcacttgaggtcaggagtttgaaaccagcctggccaacatggtgaaccctcatctctgctaaaaatacaaaattagccaggcatggtcccagctactcaggaggctgaggcaggagaatcgcttgaacctgggagccagaggttgtagtgagccaagatcacgccactgcactccagccttggcaacaaagtgagactccatcaaagaaagaaagagagagagagagagagagagaaagactctgtgggaaatatcaatgtctcatgacttaaaggtgaacagtgatcctttctttttataagtgtttccctctaaggatggtgtattagtctgttct

SEQ ID NO: 8960 - DNA, 157 bp, Homo sapiens
  AC011422.2_58343
  Located on chromosome 5
  Distance between a terminus base of telomere on chromosomal short arm and 5'-terminus of this base sequence : 114380521
  Distance between 3'-terminus of neighbour sequence of sequence listing upward to telomere on chrosomal short arm and 5'-terminus of this base sequence : 59669
cagtgagttcgtaaagaaattgtcacacacacacacacacacacacacacacaccatggaatactactcagccataaaaaggagtgaaataatgacatttgcagcaacctggatggagttagagaccattattgtaagtgaagtaactcaggaatgg

SEQ ID NO: 8961 - DNA, 403 bp, Homo sapiens
  AC011340.4_172447
  Located on chromosome 5
  Distance between a terminus base of telomere on chromosomal short arm and 5'-terminus of this base sequence : 114398801
  Distance between 3'-terminus of neighbour sequence of sequence listing upward to telomere on chrosomal short arm and 5'-terminus of this base sequence : 18123
tagtttaagaatctgacaggtcactgatatggagcccctgaagaagcacatcatctgggctcagaagattattttttgttttgttttatttgtactatctagtagagagcacttttcttattccctctttccttccttcctcatttaattattccctctcagaattcccatgttgtccattataaggggctcgctatttttaacctttaagaatgtcttctttgttaagcattaagatttccatttaagaggatcaatttcctgttgtactttttaccatgagactgaaacacacacacacacacacacacacacacacacacatgtgttggaagagcaaagagagggaagggggtctttttagaaagtggcacttggcgcttagctgaaagatcagaacaca

SEQ ID NO: 8962 - DNA, 183 bp, Homo sapiens
  AC011422.2_39772
  Located on chromosome 5
  Distance between a terminus base of telomere on chromosomal short arm and 5'-terminus of this base sequence : 114399022
  Distance between 3'-terminus of neighbour sequence of sequence listing upward to telomere on chrosomal short arm and 5'-terminus of this base sequence : -182
ttgttaagcattaagatttccatttaagaggatcaatttcctgttgtactttttaccatgagactgaaacacacacacacacacacacacacacacacacacatgtgttggaagagcaaagagagggaagggggtctttttagaaagtggcacttggcgcttagctgaaagatcagaacacat

SEQ ID NO: 8963 - DNA, 264 bp, Homo sapiens
  D5S2051
  Located on chromosome 5
  Distance between a terminus base of telomere on chromosomal short arm and 5'-terminus of this base sequence : 114586150
  Distance between 3'-terminus of neighbour sequence of sequence listing upward to telomere on chrosomal short arm and 5'-terminus of this base sequence : 186945
aatccttcagggggtaaaagagggcccaggaaaaaacatggagagtgggtggagtaacataattgaaaacagcttggaaaagtgggcctaattttttttgaactaaaaatgagtaaaatgtcttttcaagaactgaatataaaaatgaaaccaagagataaagaaaactcactatatttagttgttcacacacacacacacacacacagagacagcgagagagagagcgagagagagtgctaatacagtagccacgcaatacat

SEQ ID NO: 8964 - DNA, 402 bp, Homo sapiens
  AC026229.2_90049
  Located on chromosome 5
  Distance between a terminus base of telomere on chromosomal short arm and 5'-terminus of this base sequence : 114676165
  Distance between 3'-terminus of neighbour sequence of sequence listing upward to telomere on chrosomal short arm and 5'-terminus of this base sequence : 89751
gatttatccagattatcctaccacgcaaaacagaccatatgaaacacattttaaaattatcctccttcttgccttaaaactgatctgcatcatggtacaaaactgtaaaaataatactggtagttaatgctgttctaaaacaagaaaaagaaattattttaaaatcccagtacgtctgtatgtgtgtgtgtgtgtgtgtgtttgtgtgtgcgcgcacgcgcatgcttatttgtgttaacgaatttgcattaacaaagtagaatgtttgttccccctggaagaattttttgaattttacaattataaatgggtattttctgtaacactggggaaatgcagaaacatgctctaagaagctgataacatatatactgtctggttatagacaaggtagtgcttgtc

SEQ ID NO: 8965 - DNA, 120 bp, Homo sapiens
  Z67460
  Located on chromosome 5
  Distance between a terminus base of telomere on chromosomal short arm and 5'-terminus of this base sequence : 114689915
  Distance between 3'-terminus of neighbour sequence of sequence listing upward to telomere on chrosomal short arm and 5'-terminus of this base sequence : 13348
tttgctacagtgtgtggtgtgggtgtgtgtgtgagtgtgtgtgtgtgtgtgtgtgttttaagtacgtatttattatgagaatctaacagtagttgtctctggagaggaaaccgggtagct

SEQ ID NO: 8966 - DNA, 179 bp, Homo sapiens
  chr5.fa.O7frz.123876268
  Located on chromosome 5
  Distance between a terminus base of telomere on chromosomal short arm and 5'-terminus of this base sequence : 114868457
  Distance between 3'-terminus of neighbour sequence of sequence listing upward to telomere on chrosomal short arm and 5'-terminus of this base sequence : 178422
aactaatgtagatgacaggttgatgggtgcagcaaaccaccatggcatgtgtatacccatgtaacaaacctgcacattctgcacatgtatcccagaacttgaagagagagaaagaaagaaagaaagaaagaaagaaagaaagaaagaaagaaagaaagatctgaactgtccattatgta

SEQ ID NO: 8967 - DNA, 373 bp, Homo sapiens
  AC073129.1_29648
  Located on chromosome 5
  Distance between a terminus base of telomere on chromosomal short arm and 5'-terminus of this base sequence : 115250264
  Distance between 3'-terminus of neighbour sequence of sequence listing upward to telomere on chrosomal short arm and 5'-terminus of this base sequence : 381628
ccacttacgagtgagaacatacaatatttgtttttccattcctgagttacttcacttagaataatagtctccagtatcatcaaggttgctgtgaatgccattaattcattccattttatggctgagtagtattccatcacatacatatatacatacatacacacacacacacacacacacacacaccacagtttatccactcgttgactgatgggcatttgggttggttccacatttttgcaattgtgaactgtgctgctataaacatgggtgtgcaagtatctttttcgtatgacttcttttcctccgggtggatacccagtagtgggattgctggatcaaatgggagttatactttgagttccttaaggaa

SEQ ID NO: 8968 - DNA, 453 bp, Homo sapiens
  chr5.fa.O7frz.124443422
  Located on chromosome 5
  Distance between a terminus base of telomere on chromosomal short arm and 5'-terminus of this base sequence : 115343272
  Distance between 3'-terminus of neighbour sequence of sequence listing upward to telomere on chrosomal short arm and 5'-terminus of this base sequence : 92635
gtgagtatcaattcaccatcaccacagaatgttacctaatgcccttttacagggagggcatgtgtgtgtacgtgtgtgtgtttatgtgtgcacacgcatgcacgtgttgtaggatgtgcacaatgctacaggatgcatatatatatatacatatatatatatacacacacacacacacacacacacacacacacacacacacacgcacacataaagccccagcaacctgggatgatttttattttcttgttatactactacattttccaaattttccaatataaacacctatgtattttataatttaggtagttttgatattttttaatttttaaaatagtgagttgaaatgggatatagttaattgatttcactgacaaggacaaggcagatcaatgcattaatgtaatagtcttagattactagaaagactaagaacaagactgttagcca

SEQ ID NO: 8969 - DNA, 366 bp, Homo sapiens
  chr5.fa.O7frz.125112597
  Located on chromosome 5
  Distance between a terminus base of telomere on chromosomal short arm and 5'-terminus of this base sequence : 115680210
  Distance between 3'-terminus of neighbour sequence of sequence listing upward to telomere on chrosomal short arm and 5'-terminus of this base sequence : 336485
ctgattgaactccgaactaacaccaatgccaaaatgcaaacatacacagctacacctgctcctaagccccctgaagataaacacacacacacacacacactttgaaatagggcagaagagacttaggagactcatgtgagctcagctttactaacaaaagatattttccaaaaggaagtgaaaagcacctaagaaggcagagtgaaacttagaccacacacacacacacacacacacacaaaaaaaaaaagaaactgcccagccctcttcaggaacatagagataggcactaagttgccatccatggagacataaatgaagagctactcactcactgctttgcactttataaggatgttggaaggt

SEQ ID NO: 8970 - DNA, 160 bp, Homo sapiens
  D70814.1_86
  Located on chromosome 5
  Distance between a terminus base of telomere on chromosomal short arm and 5'-terminus of this base sequence : 115807824
  Distance between 3'-terminus of neighbour sequence of sequence listing upward to telomere on chrosomal short arm and 5'-terminus of this base sequence : 127248
ttatttcattcctgtagccaagaaccaaaagcagtaagtatgtaaggtaagaccttcctttcacctgataagaactgacacacacacacacacacacacacacacacacacgtgcactacaagtagatgattctactgtatcagcctattgatgtgaaga

SEQ ID NO: 8971 - DNA, 358 bp, Homo sapiens
  chr5.fa.O7frz.125283472
  Located on chromosome 5
  Distance between a terminus base of telomere on chromosomal short arm and 5'-terminus of this base sequence : 115987974
  Distance between 3'-terminus of neighbour sequence of sequence listing upward to telomere on chrosomal short arm and 5'-terminus of this base sequence : 179990
gtgcaattactggtctcgaacacctgggctcaagtgatcctccctctgtggcctcccaaagtactgagattgcaggtgtgagccactgtgcccagtcctatttttttgaagtgcaattacttgtctaatacacacacacacacacacacacacacccacacaccctacctgagtttttaatatattcttgatcttaatggtgtctttgaagacagttgcacatattgataggtaaacttttaagtaaaccagccttaattgttaaaattataaatccaagccatcgagattaatttattaatcaaaaacattattaagctctatctcaagcagtagattagaccttagtttcgaagga

SEQ ID NO: 8972 - DNA, 324 bp, Homo sapiens
  AC067893.3_43705
  Located on chromosome 5
  Distance between a terminus base of telomere on chromosomal short arm and 5'-terminus of this base sequence : 116146128
  Distance between 3'-terminus of neighbour sequence of sequence listing upward to telomere on chrosomal short arm and 5'-terminus of this base sequence : 157796
aactcctgacctcgtgatctgcctgcctcggcctcccaaagtgctgggattacaggcgtgagccaccgcacccagctctctctctctctctctctctctctctaaacaattgattggacaccacactgtctgtggatccagaaacagaagggtgagctgatatggaagaaaacagagtccctgttgtttactctataaaaaccattctccttgaaagatgccaatcacaacagtatcaagatctgctcagaaccaaataaaacacagaaagctcagggggtcagcagagggatgaggacagtgagacttaccaactttactgag

SEQ ID NO: 8973 - DNA, 248 bp, Homo sapiens
  Z67698
  Located on chromosome 5
  Distance between a terminus base of telomere on chromosomal short arm and 5'-terminus of this base sequence : 116163111
  Distance between 3'-terminus of neighbour sequence of sequence listing upward to telomere on chrosomal short arm and 5'-terminus of this base sequence : 16659
tcacagtatggggcagtctcaggcatttgaatttcaactttcattaaaatcctaggtcttatgccaaatgctaggaaaaactgttgttctttttatagttcccctaaaaaataactatattattttggtcctggctggagtcaacctctaccttcaatctacatttcttttgtgcttgcttccccttcaccccttctacacacacacacacacacacacacaaaaccattatcaccagcaattctgaa

SEQ ID NO: 8974 - DNA, 444 bp, Homo sapiens
  AC067893.3_124342
  Located on chromosome 5
  Distance between a terminus base of telomere on chromosomal short arm and 5'-terminus of this base sequence : 116236355
  Distance between 3'-terminus of neighbour sequence of sequence listing upward to telomere on chrosomal short arm and 5'-terminus of this base sequence : 72996
tagacaaaatttgcaaagacaggagagagagtaatcatataccccacaaatagtttttcctacttattaacatcttacattattttggtatactagtcataataaactgatgttgacacactattattaactaaagtccatattttatctaggcttccttagtgtgtgtgtgtgtgtgtgtgtgtgtgtgtgcgtgcatgtgtgttttactgtaatgtcctttttttctgatccaggatcccattgaggatatgcattccatttagttgtcgtattttcttaggcttctcttagctggacagtttctctttattagactttccttgtttttgataaccttgacagttttgaggagttttggttacgtattttgtagactgtcatttaattgggatttttctgatgattgtattttaattattgttgccatatttacaattgcta

SEQ ID NO: 8975 - DNA, 187 bp, Homo sapiens
  D5S656
  Located on chromosome 5
  Distance between a terminus base of telomere on chromosomal short arm and 5'-terminus of this base sequence : 116236452
  Distance between 3'-terminus of neighbour sequence of sequence listing upward to telomere on chrosomal short arm and 5'-terminus of this base sequence : -347
cataataaactgatgttgacacactattattaactaaagtccatattttatctaggcttccttagtgtgtgtgtgtgtgtgtgtgtgtgtgtgtgcgtgcatgtgtgttttactgtaatgtcctttttttctgatccaggatcccattgaggatatgcattccatttagttgtcgtattttcttagg

SEQ ID NO: 8976 - DNA, 395 bp, Homo sapiens
  AC025185.5_120920
  Located on chromosome 5
  Distance between a terminus base of telomere on chromosomal short arm and 5'-terminus of this base sequence : 116243490
  Distance between 3'-terminus of neighbour sequence of sequence listing upward to telomere on chrosomal short arm and 5'-terminus of this base sequence : 6851
aggtcagaagttcaagaccagcctggacaacatggtgaaaccccatctctactaaaaatacaaaaaaaattagccaggcgtagtggtgggcacctgtaatcccagctacttgggaggctgagcaggagaattgcttgaacctgggaggtggaagtcgcagcgagccaagatcatgccattgtactccagcctgggcaacaagagtgaaactctgtctaaaaaaacaaacaaacaacaacaacaacaacaacaaaaaaaacaacaaaaagtttattgaaagggataatatcagagaacttctcaaacctagagaaagatatcaacattcaagtataagaaggttatagaacaccaagcagatttaacccaaagaagactacctcaaggcatctaat

SEQ ID NO: 8977 - DNA, 317 bp, Homo sapiens
  AC025185.5_52622
  Located on chromosome 5
  Distance between a terminus base of telomere on chromosomal short arm and 5'-terminus of this base sequence : 116251642
  Distance between 3'-terminus of neighbour sequence of sequence listing upward to telomere on chrosomal short arm and 5'-terminus of this base sequence : 7757
agcgattgtcctgtttcagcctccggagtacctgggattacaggcatgcaccaccacacccagctaatttttgtatttttaggagagacggggtttcaccatgttgaccaggctggtcttgaactcctgacctcaggtgatctgcccgcctcggcctcccaaatgctgggattacaggcatgagccaccgtgcccggcccctttttcttttagactttttattgtactatgatcaaccatataccctgtattattattattattattattattcaacatccagaattaatggccttattaagaccttattcttggcc

SEQ ID NO: 8978 - DNA, 263 bp, Homo sapiens
  D5S2001
  Located on chromosome 5
  Distance between a terminus base of telomere on chromosomal short arm and 5'-terminus of this base sequence : 116356208
  Distance between 3'-terminus of neighbour sequence of sequence listing upward to telomere on chrosomal short arm and 5'-terminus of this base sequence : 104249
tctgaacaggtgatggcaacaatgaggtctctggggaggagtaaggatatgtgtgtgtgtgtgtgtgtgtgtgtgtgtgtgtgtgtgtgtgtgtgaagtgggtgggggggggagagagagaatatgaatgaagactctggaaaaatataccttttgaaaaagccacaggccaggtgcggtggctcacacctgtaatcccagcactttgggagggaggccgaggcgggtggatcacgaggtcaggagatcgagaccatcttggc

SEQ ID NO: 8979 - DNA, 423 bp, Homo sapiens
  AC010431.4_90251
  Located on chromosome 5
  Distance between a terminus base of telomere on chromosomal short arm and 5'-terminus of this base sequence : 116356750
  Distance between 3'-terminus of neighbour sequence of sequence listing upward to telomere on chrosomal short arm and 5'-terminus of this base sequence : 279
tcctgatggaaggacctacaggaccagaaggagccatattcatgtgccacctcagaaacctctgtcgctgctcgcccattctacctttagctctccaatgtgatcactgacttaaaagtcaaagggcagacaaatgcttcaaataaaactagataacagatatcccttgcaaaaaggagtcctagaatcgctatggaaaacacacacacacacacacacacacacacacacaggcatgcatacatatgtgcacaccttagttgtattctgtggatatttagatagatatttaatagatacttaaagaaaggacaagtaaacatcctagggcaaggaatcaagctggaaacttgcttcatccacatgacattcagtgaaagctgagaaaaagggaaaataaactgaagcaacatgaagtaaaga

SEQ ID NO: 8980 - DNA, 170 bp, Homo sapiens
  D5S421
  Located on chromosome 5
  Distance between a terminus base of telomere on chromosomal short arm and 5'-terminus of this base sequence : 116415642
  Distance between 3'-terminus of neighbour sequence of sequence listing upward to telomere on chrosomal short arm and 5'-terminus of this base sequence : 58469
tctatcgttaactttattgattcagtaagttagttttcgtgtgtgtgtgtgtgtgtgtgtgtgtgtgtgtgtgtgtgtgtgtatctgtaggtgtctgatattatagtttcttagtacctatttgagaggccacctggtgtaaagtgcagaaagcctggattctatttcca

SEQ ID NO: 8981 - DNA, 367 bp, Homo sapiens
  chr5.fa.O7frz.126009099
  Located on chromosome 5
  Distance between a terminus base of telomere on chromosomal short arm and 5'-terminus of this base sequence : 116566568
  Distance between 3'-terminus of neighbour sequence of sequence listing upward to telomere on chrosomal short arm and 5'-terminus of this base sequence : 150756
ctatcatttgatccagcaatcccactgctgggcatctacccagaggaaaagaagccattctatgaaaatgacatttgcatgtgcatatttatagcagcacaatttgcaattgcaaaaatatggaaccagcctaaatgtccatcaactaaaaagtagataaaggaaatgtacacacacacacacacacacacacacacacacacacacacgcaccatggaatactactcagccataaaaaggaatgaagtaatgtcatacacaccaacctggatggagttggagaccattattctaagtgaagtaactcaggaatggaaaactaaacagcttatgttctcacttataagcgatagttaagctatgaga

SEQ ID NO: 8982 - DNA, 276 bp, Homo sapiens
  chr5.fa.O7frz.126173618
  Located on chromosome 5
  Distance between a terminus base of telomere on chromosomal short arm and 5'-terminus of this base sequence : 116684683
  Distance between 3'-terminus of neighbour sequence of sequence listing upward to telomere on chrosomal short arm and 5'-terminus of this base sequence : 117748
gttcaaataggactgtattcaaattatgcctcaataaatggaacaagtcaaaatccatttgtcccacatggctcaagccctcactgagccccagtggaaacaaggtaacaatctatacctcaaagcaaagagagagagagagagagacagagacagagagagagagagagagagagagagaggagagagagagagagagagagagaatatgaatctattatcctttaagaaggagtttgggctgcactagaggaagactgcaaatggataccaaag

SEQ ID NO: 8983 - DNA, 338 bp, Homo sapiens
  chr5.fa.O7frz.126300461
  Located on chromosome 5
  Distance between a terminus base of telomere on chromosomal short arm and 5'-terminus of this base sequence : 116860866
  Distance between 3'-terminus of neighbour sequence of sequence listing upward to telomere on chrosomal short arm and 5'-terminus of this base sequence : 175907
gttggtacagatataagaccttgtattcatcagggttctccagaaagacagaatcaattggatgcgtgtgtgtgtgtgtgtgtgtgtgtgtatatgatgtatattgattctgtcagttagattatatatatacacacacacacatatatacatatacacatttatatatgtgaatgagaggggattacatatatatatatatatatatatatatgaatgagaagggaatttatatatataatttgaatgaggggggattacatatatgtatgaatgagagaggatttattaaaagaattggctcacgcgataagggagtctgaattctaagtgccacg

SEQ ID NO: 8984 - DNA, 310 bp, Homo sapiens
  chr5.fa.O7frz.126407042
  Located on chromosome 5
  Distance between a terminus base of telomere on chromosomal short arm and 5'-terminus of this base sequence : 116950088
  Distance between 3'-terminus of neighbour sequence of sequence listing upward to telomere on chrosomal short arm and 5'-terminus of this base sequence : 88884
gaatacctaatgtagatgacaggttgatgggctcagcaaaccaccatggcacgtgtatacctgtgtaacaaaactacaggttctgcacatgtaccccagaacttaaagtataacaataataataataataataataataataaatatatgtatatatataggcaaaatagaaagaaaaactttctatatctttaacttaatttttaaagaagtatttataacaacacttaaaggtgaattatttaatgttttacttatgagaatgggaaacaaataaagatatccactacctcttccattaaacattgta

SEQ ID NO: 8985 - DNA, 184 bp, Homo sapiens
  D5S489
  Located on chromosome 5
  Distance between a terminus base of telomere on chromosomal short arm and 5'-terminus of this base sequence : 117082030
  Distance between 3'-terminus of neighbour sequence of sequence listing upward to telomere on chrosomal short arm and 5'-terminus of this base sequence : 131632
ttcacttgttgatgggcttttgtgttgtttctagtttttttaagttttaaatatatgtagcattatatatgtgtgtatatagatatataatcatatatatgtggatatatatacacacacacacacacacacacacacaacatctaggtagtatgataaatacacacacatatacaagtctggt

SEQ ID NO: 8986 - DNA, 328 bp, Homo sapiens
  chr5.fa.O7frz.126590841
  Located on chromosome 5
  Distance between a terminus base of telomere on chromosomal short arm and 5'-terminus of this base sequence : 117285307
  Distance between 3'-terminus of neighbour sequence of sequence listing upward to telomere on chrosomal short arm and 5'-terminus of this base sequence : 203093
gttctgtttaactgttgaacctaggcttggtaggaactgcttccattttctcctttctctcttgtcaatctctgtctctctctctctctctccccgcccctccatctctgtgtgtgtgtgtgtgtgtgtttatgtgtgcatttctgtgtatgatatcctagtcagattttgcagcaaaggtacttctagctttaagattaaataatttttaagcatatactatgacctgaagcaggtaaaattttaaaataagataataaattatgtccttgaaggcttgagtcaaatttaaagtatctggatctggtgtctatggtcaaggttgtaa

SEQ ID NO: 8987 - DNA, 129 bp, Homo sapiens
  D5S2065
  Located on chromosome 5
  Distance between a terminus base of telomere on chromosomal short arm and 5'-terminus of this base sequence : 117389261
  Distance between 3'-terminus of neighbour sequence of sequence listing upward to telomere on chrosomal short arm and 5'-terminus of this base sequence : 103626
cagcctcattgtttattgacagcatacacacatgcgcgcacacacacacacacacacacacacacacacacacacattattggaatcatgttgatttgtttggagagctagagccaaaactatgccatt

SEQ ID NO: 8988 - DNA, 306 bp, Homo sapiens
  chr5.fa.O7frz.126793106
  Located on chromosome 5
  Distance between a terminus base of telomere on chromosomal short arm and 5'-terminus of this base sequence : 117487615
  Distance between 3'-terminus of neighbour sequence of sequence listing upward to telomere on chrosomal short arm and 5'-terminus of this base sequence : 98225
agactttgattacggttgattactagtgaggcagagcaaatgttcttatttttcaactgtgtgtgtgtgtgtgtgtgtgtgtgtgtgtaaagatgttcctgttaacaaagatccttccccccactttacttattttttgataaacagaaaatgacttttatttcataggtcttttggcctgtttattggccatagaattattatacctactaaatgtttgatggacatcggtaaatcctctcataccacttatcacagtatctagcatgtagtagagattcagtacgtaggttgaatttgtaagtg

SEQ ID NO: 8989 - DNA, 222 bp, Homo sapiens
  DISO7_10001926
  Located on chromosome 5
  Distance between a terminus base of telomere on chromosomal short arm and 5'-terminus of this base sequence : 117588605
  Distance between 3'-terminus of neighbour sequence of sequence listing upward to telomere on chrosomal short arm and 5'-terminus of this base sequence : 100684
ttgagtaagcaggctaaagatgttaaaacaattgacacacatttatatatatatatatatatatatatatatatatatatatataaatatttatgaaatttaaaaaatggactgtgatttcttttatcataaacatttatttttaggaatttactatatgttttaattatatgtatattttgtcaaatataaatatagaaccaacatcaatttataatcaac

SEQ ID NO: 8990 - DNA, 267 bp, Homo sapiens
  D5S2100
  Located on chromosome 5
  Distance between a terminus base of telomere on chromosomal short arm and 5'-terminus of this base sequence : 117701663
  Distance between 3'-terminus of neighbour sequence of sequence listing upward to telomere on chrosomal short arm and 5'-terminus of this base sequence : 112836
ttaattgagaagcaatagtgataattcacattaagtgtaccagatattctaaaatttggtctctacattttctcttcttttcttggtaatatcatcttaacaaacaccagaaattgaaaatcacacacacacacacacacacacacacacacacacacacaccccatagtgaaatgttaacatcaaattaaaaatttctaaagtttggagagatttaagtaataagaaatattttatggaaatcaaatctatatatgacttcccagc

SEQ ID NO: 8991 - DNA, 394 bp, Homo sapiens
  chr5.fa.O7frz.102409463
  Located on chromosome 5
  Distance between a terminus base of telomere on chromosomal short arm and 5'-terminus of this base sequence : 117766081
  Distance between 3'-terminus of neighbour sequence of sequence listing upward to telomere on chrosomal short arm and 5'-terminus of this base sequence : 64151
ttggttattcgcataaattaaaacattctcgttatttacaagtatgtaaaaaatgaaacactagaaaaataattaattattgtatacctgtacaatagtgtattatagttcatcaaaaatggcgatgtagcactatgctaaagtagaaaatgtccattgtatatgctcaataaatatgcatgtttgtgtgtgtgtgtgtgtgtgtgtgtgtagtaaaccagcatatgtattatgggcctttatattcattagagaaggctgagaaagttttatatcaacatatatattcttaaccactttatcgggtatttatatcataaaatttactgatttcaaatatacaatgcaatggtttcagtaactttaccaggtagtggtaaagccatcagtatac

SEQ ID NO: 8992 - DNA, 248 bp, Homo sapiens
  G08463
  Located on chromosome 5
  Distance between a terminus base of telomere on chromosomal short arm and 5'-terminus of this base sequence : 117857112
  Distance between 3'-terminus of neighbour sequence of sequence listing upward to telomere on chrosomal short arm and 5'-terminus of this base sequence : 90637
aatgctatgctgtgtttaagacacttattagtgagacagattagatagatagacagtaacatgatagatagatagatagatagatagatagatagatagatagatagacagacagacagacagatagttagatagatatccctgttacttgtagtaaattctaccatgggactgcctttctttgcactggtgtttacttataaggtctaaattaagactagatcttgtgtcttgcagatctgcgtttt

SEQ ID NO: 8993 - DNA, 268 bp, Homo sapiens
  DISO7_10001930
  Located on chromosome 5
  Distance between a terminus base of telomere on chromosomal short arm and 5'-terminus of this base sequence : 117908694
  Distance between 3'-terminus of neighbour sequence of sequence listing upward to telomere on chrosomal short arm and 5'-terminus of this base sequence : 51334
accatgaaaccatgactatattgaaaattttctcatttctgtttccttgaactcctagcctcgagcaatcctcctgcatcagcctcccaaaagtcctgggattacaagcatgaaccactgcacctggctgcattagtgtttcctaaaagctttattagtttctgactcaatctcttttccttttgtcatctcctgtgtgtgtgtgtgtgtgtgtgtgtgatttgaagtcagaagatatgatgttttctgccaataattctgtgtaagc

SEQ ID NO: 8994 - DNA, 147 bp, Homo sapiens
  DISO7_10000381
  Located on chromosome 5
  Distance between a terminus base of telomere on chromosomal short arm and 5'-terminus of this base sequence : 118410831
  Distance between 3'-terminus of neighbour sequence of sequence listing upward to telomere on chrosomal short arm and 5'-terminus of this base sequence : 501869
tccttgttactcatatccaaatgatattccaaatacccatcctaaaacatgacatgcccctaccccaacttctctctctctctctctctctctctcacacacacacacacacacacagtctaacacactatctcattcacatgactc

SEQ ID NO: 8995 - DNA, 381 bp, Homo sapiens
  chrX.fa.O7frz.47420800
  Located on chromosome 5
  Distance between a terminus base of telomere on chromosomal short arm and 5'-terminus of this base sequence : 118483899
  Distance between 3'-terminus of neighbour sequence of sequence listing upward to telomere on chrosomal short arm and 5'-terminus of this base sequence : 72921
agtcagcaagatagtccaattcagatcatccagtctgaggaacagaaattttacacacacacacacacacacacacacacacacacacacaggtttctgagactgtgtgtgtctgtgcatatatatatatgtatatatacatatatgtacgtatatatacgtatatatatgtgtatatatacatacgtgtatatatgtatgtgtatatatatatatacagacacacacacacacacacacacacacacagagacaatataaacacagcctcagaaacttgtaagaaatcatctagcaaccaaaatacatataatgggaatcagagaagaaaatagaaaagaggaagaagatatttgaacaaattacagctgaaagcatcac

SEQ ID NO: 8996 - DNA, 332 bp, Homo sapiens
  AC010230.4_121832
  Located on chromosome 5
  Distance between a terminus base of telomere on chromosomal short arm and 5'-terminus of this base sequence : 118628127
  Distance between 3'-terminus of neighbour sequence of sequence listing upward to telomere on chrosomal short arm and 5'-terminus of this base sequence : 143847
tacctatgtaacaaacctgcatgttctgcacaggtatcccagaacttaaagtcaaaaaaaaaattgaagaggaggaagtcctccctaatgcattctgtgtggccagcatcatcctgataccaaaacctggcaagcacacacacacacacacatacacacgtgcatgtgcatacacacacacacacacacacacacacacacacacacacacacacacacacaacttcaggtcaatatcctcaatgaacatcaatgcaaaaatcatcaaggaaatactggcaaaccaaacctaacagcatatcaaaaacttgtctaccatgatcaaataggct

SEQ ID NO: 8997 - DNA, 211 bp, Homo sapiens
  D5S659
  Located on chromosome 5
  Distance between a terminus base of telomere on chromosomal short arm and 5'-terminus of this base sequence : 118859427
  Distance between 3'-terminus of neighbour sequence of sequence listing upward to telomere on chrosomal short arm and 5'-terminus of this base sequence : 230968
cagggatgctgggaggtctagtgaggcctcagcatatagatatacatacttgtattttaatggtctggttgctttacacacacacacacacacacacacacacactttttaatacacttacaaaatacaaatgaacctaaaacctcattggatcagaaattcgaagggtacatgaaagttgaaagtgacataggcaagttgcccacctccc

SEQ ID NO: 8998 - DNA, 183 bp, Homo sapiens
  Z24277.1_99
  Located on chromosome 5
  Distance between a terminus base of telomere on chromosomal short arm and 5'-terminus of this base sequence : 118859443
  Distance between 3'-terminus of neighbour sequence of sequence listing upward to telomere on chrosomal short arm and 5'-terminus of this base sequence : -195
tctagtgaggcctcagcatatagatatacatacttgtattttaatggtctggttgctttacacacacacacacacacacacacacacactttttaatacacttacaaaatacaaatgaacctaaaacctcattggatcagaaattcgaagggtacatgaaagttgaaagtgacataggcaagt

SEQ ID NO: 8999 - DNA, 161 bp, Homo sapiens
  HUMUT5264
  Located on chromosome 5
  Distance between a terminus base of telomere on chromosomal short arm and 5'-terminus of this base sequence : 119045211
  Distance between 3'-terminus of neighbour sequence of sequence listing upward to telomere on chrosomal short arm and 5'-terminus of this base sequence : 185585
cagcctgtgtgcaacagagtgagactccttctccaaaaataaataaataaataaataaataaataaataaataaatataccttgagtgctttttcctacgaatattggccatgtgtatgtattcttttcaaaagtatctgttcatgtcctttgttcacctt

SEQ ID NO: 9000 - DNA, 300 bp, Homo sapiens
  chr5.fa.O7frz.127810640
  Located on chromosome 5
  Distance between a terminus base of telomere on chromosomal short arm and 5'-terminus of this base sequence : 119210201
  Distance between 3'-terminus of neighbour sequence of sequence listing upward to telomere on chrosomal short arm and 5'-terminus of this base sequence : 164829
cttcactctattaaatcttgcaactgcaaataaaataaaataaaataaaataaagtaaaattcatatggaaccaaaaagagcccaaatagccaaaggaatcctaggcaaaaataacaaagccagaggcatcattttacctgacctcttactatactataaatcttcagtaaccaaaacagcatggtactggtacaaaactagacacataggccaatggaacagaatagagaagccagaaataaagccacacacctacagccatctgatctttgacagagtttacagaaatgatcaatgag

SEQ ID NO: 9001 - DNA, 307 bp, Homo sapiens
  chr5.fa.O7frz.128068361
  Located on chromosome 5
  Distance between a terminus base of telomere on chromosomal short arm and 5'-terminus of this base sequence : 119464291
  Distance between 3'-terminus of neighbour sequence of sequence listing upward to telomere on chrosomal short arm and 5'-terminus of this base sequence : 253790
ttgaacatggattgctagatagtagtattgttacattgttaaatttcctgcatgataattatattgtggctatgcaggtgaatatccttgttcttagaataaaaatgtgtcaatatccttttcttagaaaaaaatgtgtcaacatataagggtggagtgaaattacatttgcaactaattatcaaaagattcaaaaatatagatgtgcgtgtgtgtgtgtgtgtgtgtgtgtgtgtgtataggcacataaatatataaagagatataaaacaaatgcgagaaaatgttaatgacagtgaatctaggt

SEQ ID NO: 9002 - DNA, 369 bp, Homo sapiens
  chr5.fa.O7frz.128240830
  Located on chromosome 5
  Distance between a terminus base of telomere on chromosomal short arm and 5'-terminus of this base sequence : 119595264
  Distance between 3'-terminus of neighbour sequence of sequence listing upward to telomere on chrosomal short arm and 5'-terminus of this base sequence : 130666
ctgaggaacgcattgttatcacaggagacgacagctccatgcatgatactgccctgaagacttcaaagcaacaagatgtggaagaggaagatggtgattttgttgatcctgaccccatgcaggcctaggctagtgtgtgtgtgtgtgtgtgtgtgtgtgtgtgtgtgtgtgtgtcttagtttttaacaaaaaagttttcaaaatttaaaaaagttttaaatagaaaatggcttatagaataaggatataaagaaagaacacattatagagtggtatagtatgtttgtgttttaagttgtattattaaatgagtcaaaaagtttaaaaaattaagaagtttataaagtaagctacagtaagctaaggcta

SEQ ID NO: 9003 - DNA, 360 bp, Homo sapiens
  chr5.fa.O7frz.128385354
  Located on chromosome 5
  Distance between a terminus base of telomere on chromosomal short arm and 5'-terminus of this base sequence : 119741802
  Distance between 3'-terminus of neighbour sequence of sequence listing upward to telomere on chrosomal short arm and 5'-terminus of this base sequence : 146169
taacaataacagatattggtcgacttatagagccacaaaacctcttatacactgctagtgaaaaagtaaattggttaatcaagttggaaaacaatgtgccattatctaataaagtagaatatatgtatacacacacagaacacacacacctatatacagtgtgtgtgtgtgtgtgtgtatatatgtatatatatatatatatatatagcctggaatatgtagccacagcctggaaattccattttacatatatttatggagtatatgctttagagcagtggttctcaagtgttgctctgaagtccccagaagcctcctgaaaccctttcagagggtatgtaatgatctgtatgaagctgg

SEQ ID NO: 9004 - DNA, 391 bp, Homo sapiens
  AC010472.4_83345
  Located on chromosome 5
  Distance between a terminus base of telomere on chromosomal short arm and 5'-terminus of this base sequence : 119817875
  Distance between 3'-terminus of neighbour sequence of sequence listing upward to telomere on chrosomal short arm and 5'-terminus of this base sequence : 75713
catttacctgccatttaatcttgggtaagttgtctaacttttgtgaatctatgtacccttatgttaataaaactactaatctcattgttttttgtttgttcttaaagtgagactatatatatatatatatatatatatatatatatatatatatatatatatatatataatttgactcataaagtggccttcttatttaacattttaacccttaaatatggcctagctttgtgtgttttttgtttttctccatgacacttatcatttgcttactttgcttattttccatttcttcaattggatttaatataaaatcgtgcaggcactttggaaaacagtttggcatgtccacaaatagttaaacatagagttatcttatgaccgagcaata

SEQ ID NO: 9005 - DNA, 264 bp, Homo sapiens
  AC010472.4_87064
  Located on chromosome 5
  Distance between a terminus base of telomere on chromosomal short arm and 5'-terminus of this base sequence : 119821573
  Distance between 3'-terminus of neighbour sequence of sequence listing upward to telomere on chrosomal short arm and 5'-terminus of this base sequence : 3307
ggagtcaagactacatgtatcaactcctgtctgtttctagcctgcttgctttgtttgccctacaaatttcagacttgccaggcctaacaattgcatgaatcaatttttaagataaactcctttatatctacatctatatctatgtcaaatctctatctatctatctatctatctatctattttattggtttttatttcattggagaaccatcactgatatagaaatgaatttgcatagaagttggctaaggttaggagtatagt

SEQ ID NO: 9006 - DNA, 420 bp, Homo sapiens
  AC010472.4_110077
  Located on chromosome 5
  Distance between a terminus base of telomere on chromosomal short arm and 5'-terminus of this base sequence : 119867175
  Distance between 3'-terminus of neighbour sequence of sequence listing upward to telomere on chrosomal short arm and 5'-terminus of this base sequence : 45338
aagtaggccttcgatgtctcttgtttccctcctggtatccatgtgttctcgttgtgtagctcccacttataagtgagaacatgcagcatttgattttctgttcctgtgttagtttgcttaggataatcgcctccagctgcatccatattgctgcaaagtacatgatctcattctttttatgcctacatagtattccatagggtgtgtgggtgcctgtgtgtgtgtgtgtgtgtgtgtgtatacacacaccacattttctttatccagtctatcattgatgagtatttaggttgattccatgtctttgctattgtgaatagtgctgccgtgaacatacacattcatgtgtctttatggtagaactattcatattcctttgggtatgtagccaatagtggaattgctaggtcaaatggtaat

SEQ ID NO: 9007 - DNA, 375 bp, Homo sapiens
  AC026449.2_54336
  Located on chromosome 5
  Distance between a terminus base of telomere on chromosomal short arm and 5'-terminus of this base sequence : 119908197
  Distance between 3'-terminus of neighbour sequence of sequence listing upward to telomere on chrosomal short arm and 5'-terminus of this base sequence : 40602
tcacaactttccaaactagtaaagccttcttaaatgaatgagacacagaagtatgtgagccttggccaccttaagactttccatctccctacaataccctgtccttcaggtctacatgtaaagatccaacccatcctttaggcagaaaagctccccattctcaggtcccatagtcctcagttcatatctctttcatgacatttatcattattctttttggtttggtacttatcgtgtgtgtgtgtgtgtgtgtgtgtgtgtgtgtgtgtgttatactccttttcaggatggaggcttgttctttttagatttgctacaactccttgcacaaggtctagcacctcagagggactaacagatgtctgtggaataaat

SEQ ID NO: 9008 - DNA, 213 bp, Homo sapiens
  D5S2055
  Located on chromosome 5
  Distance between a terminus base of telomere on chromosomal short arm and 5'-terminus of this base sequence : 120075834
  Distance between 3'-terminus of neighbour sequence of sequence listing upward to telomere on chrosomal short arm and 5'-terminus of this base sequence : 167262
gtctaccccatctctgaacccaggcgaaagggtttcctcattgcaagtgagatacagccaaagcagtagtaaagcgaacaccgttttatagctgctatggaaaaattattatattttcgctgtaacacacacacacacacacacacacacacacacacacgcgcgcgagtctcaagacgggatagtttaaaatcttcagcctgcagtgggatc

SEQ ID NO: 9009 - DNA, 366 bp, Homo sapiens
  chr5.fa.O7frz.128887940
  Located on chromosome 5
  Distance between a terminus base of telomere on chromosomal short arm and 5'-terminus of this base sequence : 120160102
  Distance between 3'-terminus of neighbour sequence of sequence listing upward to telomere on chrosomal short arm and 5'-terminus of this base sequence : 84055
tttgaatgtataatccaacagatccatagtacaaataaggtgtagtagagaggcccttttagatgctgatctgtcagtgacccagacaggccgtttaagggagttggttttaaagtgatgccagatggtagcattcgtggcattagcaatagcaactatgtggtggcattgtgttccacagatgatgaaattctctgctgagtgcactttcaaattattttaaatatactgtatgtattttcacattgtttcatatagacccacagaagtgtgtgtgtgtgtgtgtgtgtgtgtgtgtgtgtgtgtacgaaaatacaactacaaaagtatggctaggaatctgtggatactgtagataaagttgct

SEQ ID NO: 9010 - DNA, 394 bp, Homo sapiens
  chr5.fa.O7frz.128985574
  Located on chromosome 5
  Distance between a terminus base of telomere on chromosomal short arm and 5'-terminus of this base sequence : 120254786
  Distance between 3'-terminus of neighbour sequence of sequence listing upward to telomere on chrosomal short arm and 5'-terminus of this base sequence : 94318
acgtctggcttatttcacttaccataatgtcctccagattcatccatgttgttgcaaatggcactatatcctttttcaaggctgactcatactactatgtgtgtgtgtgtgtgtgtgtgtgtatgtgtctgtctgtatatatgtctatgcgtatatatatgtacacatatggacacatacacataccacaatttatccattgatagatagttacgttgtttccatatcttggctgttatgaataatgctgcaacaaacatgggggtgcagatatctctttaacatactggattcatcttctttgaatatataccaagcaggagattcctggtagttctaatttgaatttttggaggaaccttcaaactgttgtccttaatggctataccaattt

SEQ ID NO: 9011 - DNA, 441 bp, Homo sapiens
  AC018752.4_88494
  Located on chromosome 5
  Distance between a terminus base of telomere on chromosomal short arm and 5'-terminus of this base sequence : 120454575
  Distance between 3'-terminus of neighbour sequence of sequence listing upward to telomere on chrosomal short arm and 5'-terminus of this base sequence : 199395
tctacgctagtaagcagtgttaaagggagctcttttggctgaagtgaaatggtttctgatggaaatttgaaaccacacacatactacacacacacacacacacacacacacacacacactctctctctctctctctctctctctctctctctccctctccctctctccccctgccaaaataatgaaaagaactggaaatagcaaaacgtttgggtaaatattttaaaaatgctgtaatttttactgtcatggaaatgtaactattttaaacaaaaataataatagtgttttgtagagcttatagtataggttatagtaaatgtgtggaaataatagcacaaaagatgggaggagggaaatggaagtatactacttttataaatctttacaatataatatgacagtaggctgtgataagttgtagctatgcatgttaaacct

SEQ ID NO: 9012 - DNA, 260 bp, Homo sapiens
  AC008524.6_95837
  Located on chromosome 5
  Distance between a terminus base of telomere on chromosomal short arm and 5'-terminus of this base sequence : 120849479
  Distance between 3'-terminus of neighbour sequence of sequence listing upward to telomere on chrosomal short arm and 5'-terminus of this base sequence : 394463
tgagcctactggtatagtggacattttatagacacagtaccaaccatctttacatgtttcacgtattttctgatttgatccaaatctacacccctatttttctacagacaccactattgcaagtaatataaatatgatgaaaatagctcattaacatcagctaactaagctgttaataaagcgtgcacgcatgcacacacacacacacacacacacacacacacatcttaaaacctgtttccttgcaaataaagctataa

SEQ ID NO: 9013 - DNA, 314 bp, Homo sapiens
  AC010233.5_53140
  Located on chromosome 5
  Distance between a terminus base of telomere on chromosomal short arm and 5'-terminus of this base sequence : 120859825
  Distance between 3'-terminus of neighbour sequence of sequence listing upward to telomere on chrosomal short arm and 5'-terminus of this base sequence : 10086
aaggcagtaagtgcaccacaaacaacatagggtcttgccctcagttggctcacacttcagtgtggaggcaaatataagaataatgacaaaaataaggagaattgcttgaacaaggaggcggaggttgcagcgagtagagatggctcattgcactccagcctgggtgacagagcgagactccgtctcaggaaaaaaaaaataataataataataacaaaaatcataacaacaacatcttcaggacggtctggtaagagcagagtatgaaagaagtatgcacaaggtcccataggaggtgactagctgacatttga

SEQ ID NO: 9014 - DNA, 441 bp, Homo sapiens
  chr5.fa.O7frz.129536196
  Located on chromosome 5
  Distance between a terminus base of telomere on chromosomal short arm and 5'-terminus of this base sequence : 120926216
  Distance between 3'-terminus of neighbour sequence of sequence listing upward to telomere on chrosomal short arm and 5'-terminus of this base sequence : 66077
gcatcacttagatgaggtacacatacaggtcatgaccaaatagaacatgggtgaaataatctgaaggggaaaagcagaggaagcgagtgacatgcaggggctttgagagtaggggaggtgtcaaaatggataacgtaggcaataacagccaaatatgcccgtgttacaagtgtagaatcaattctgcatgatagtcttagcatacacacacacacacacacacacacacacacacacattctctttgcagctcatcctctatcagcagaagatttacctttacaaagcagaagatttggggggaaatataaaaataggaaacacttatctagtgcttatgatgtaatgggaactcaagggaatgtatacatatggactaatttaatcctcacagcaaccctataaggcagatgctattactactccatcttacaaaggagg

SEQ ID NO: 9015 - DNA, 315 bp, Homo sapiens
  D5S1468
  Located on chromosome 5
  Distance between a terminus base of telomere on chromosomal short arm and 5'-terminus of this base sequence : 121018768
  Distance between 3'-terminus of neighbour sequence of sequence listing upward to telomere on chrosomal short arm and 5'-terminus of this base sequence : 92111
gcagagttaccagtacacattttatataaaactaacaatactatttacatggtcacataaaaagctttgtaggatatctatctatatctatcatctatctatctatctatctatctatctatctatctatctatctatcatctgcctattatctatccatctatctaaacaacaggaacatattaatgcattgttaggcaatttcatcattttgagcagtggtcccccacatttttggcaccaggcattggttttgtggaaggcaatttttccatggactggggcaggggagggggatggttttgggatgattca

SEQ ID NO: 9016 - DNA, 457 bp, Homo sapiens
  chr5.fa.O7frz.129743190
  Located on chromosome 5
  Distance between a terminus base of telomere on chromosomal short arm and 5'-terminus of this base sequence : 121119056
  Distance between 3'-terminus of neighbour sequence of sequence listing upward to telomere on chrosomal short arm and 5'-terminus of this base sequence : 99973
aatttgacgaaactaatagttgacaaagcatctcagagaatgtgagtttataactggttgctgacacatacataacatcaatggtgtgaagtatggatataatgcatgtacacttaaaaataactttgtatagtgagccaagatcgtgccactgccctccagcctggacaacagcgagactctgtctcaaaaaacaaacaaacaaacaaacaaaaaaaatgctttgtatacccagatactttctgtaagttttagtatatgagatttagacttacctagtctttactctttcaaagttgttagatttttttttctcttgaattgtcttcagttggctgtaattttatgcaagtataaatatgcaaacagcctacctatactgaaagtaccttagtttaactcatttgatggactttaactgtttgggactccagtgttcaatagtgctttgtacagc

SEQ ID NO: 9017 - DNA, 236 bp, Homo sapiens
  AC008484.3_164960
  Located on chromosome 5
  Distance between a terminus base of telomere on chromosomal short arm and 5'-terminus of this base sequence : 121281251
  Distance between 3'-terminus of neighbour sequence of sequence listing upward to telomere on chrosomal short arm and 5'-terminus of this base sequence : 161738
tctactgaaaactgacagatttcactcctttttcttatcagagaaaaataaaagcaaagtagatttgtttctttaggaagatttgtaatttttattctgggaaatcagaatgcagtcttgcaaaataataataataataataataataataataataataataataataacaacagtcagttgactctactctgcctgcaaaaaattaaaatataaattacctggctctgtatttg

SEQ ID NO: 9018 - DNA, 351 bp, Homo sapiens
  AC008484.3_104130
  Located on chromosome 5
  Distance between a terminus base of telomere on chromosomal short arm and 5'-terminus of this base sequence : 121319694
  Distance between 3'-terminus of neighbour sequence of sequence listing upward to telomere on chrosomal short arm and 5'-terminus of this base sequence : 38207
ttgcttaaacctaggagcttaggaccagcctgggcaacatagaaagaccctgttttcaccccccggaaccaaaaataagataagataagataagataagataagatagctgggtgtgtgtagtcacagctactccagaggctgaggcaggaggattacttgaggccagacactcaaggttgcagtgagctgtgattttgccacagcactccagcctgggtgacagagtaagaccttgtctcttaaaaaattaaagtatctttagatttaccacaatcaacaaagacttatttaactttttcttttagtttttgaagcaatttacataatgctgttgattacaattaaactt

SEQ ID NO: 9019 - DNA, 442 bp, Homo sapiens
  chr5.fa.O7frz.130034704
  Located on chromosome 5
  Distance between a terminus base of telomere on chromosomal short arm and 5'-terminus of this base sequence : 121406469
  Distance between 3'-terminus of neighbour sequence of sequence listing upward to telomere on chrosomal short arm and 5'-terminus of this base sequence : 86424
tacctaggctaccgtgctatgtgaaaaaacagtgaaaaagcagtgtacagcatacaatatttgtttaaaataatataacctctgtatgtacaggcagtgtgtgtgtgtgtatgtgtgtatagtcttattctctaggaatacagtaagtaactgatagcaggtgttgctctgatgagagtgggaatgaggatagaagataaatgtattattctttgtttagctttttatattgtttgatttcttttgccatataaaatattatttaaaaaagtgaaccaaataaccaaagaaaagcacgtatgttctgcctttattaccttagacatataagcaaacaatattcagataaatacaccttaatttttgaaatcttgtctttcattgactttttgtaaatggcgatgtctatgtttttatgtgtggaagtcatattaccttcatc

SEQ ID NO: 9020 - DNA, 140 bp, Homo sapiens
  DISD22_0007955
  Located on chromosome 5
  Distance between a terminus base of telomere on chromosomal short arm and 5'-terminus of this base sequence : 121608846
  Distance between 3'-terminus of neighbour sequence of sequence listing upward to telomere on chrosomal short arm and 5'-terminus of this base sequence : 201935
ctctcctttctcttaatagccatagtttttttaattgatatgaaccttatttgtgtgtgtgtgtatatatatatgtgtatatatatatatatatatttatatatgtctctatttaaaatgtctctgtcatgcaggactaa

SEQ ID NO: 9021 - DNA, 410 bp, Homo sapiens
  chr5.fa.O7frz.130237404
  Located on chromosome 5
  Distance between a terminus base of telomere on chromosomal short arm and 5'-terminus of this base sequence : 121744530
  Distance between 3'-terminus of neighbour sequence of sequence listing upward to telomere on chrosomal short arm and 5'-terminus of this base sequence : 135544
gaatttgtgcatagaatctagaactctccctctctgaacccctcctttctgagactcctcctgtatttccagctattgtggttgcctcaaacttggtccttctattctttagtccagagatactgcaggtttgtaaatgacaattctacatgctccgaatagaatggaaagagaactatctccaatcgagaagccatgaaaatgaaaaataccttttatccacacattttctttatccaactactgactgtctccaaaatcttctttcactttgcctccaacgccttcgggtagttttgttgttgttgttgttgttgttgttgttgttattttgtctagggtacgcatctgttatctatgcaagtgttactgaatagaaacttacttggtcatacaggaagtgtatcacg

SEQ ID NO: 9022 - DNA, 179 bp, Homo sapiens
  Z16664.1_125
  Located on chromosome 5
  Distance between a terminus base of telomere on chromosomal short arm and 5'-terminus of this base sequence : 121990012
  Distance between 3'-terminus of neighbour sequence of sequence listing upward to telomere on chrosomal short arm and 5'-terminus of this base sequence : 245072
atttctggagatgtaatgctgtgcatggtgacaatagttaaaaatactgtattgtatacttgaaatttgttaagaggatgcatcttaaattaagtctcaccacacacacacacacacacacacacacacacaaatggtaactatgcagagatgataggtatgttaattaggtggaatgt

SEQ ID NO: 9023 - DNA, 182 bp, Homo sapiens
  D5S404
  Located on chromosome 5
  Distance between a terminus base of telomere on chromosomal short arm and 5'-terminus of this base sequence : 121990016
  Distance between 3'-terminus of neighbour sequence of sequence listing upward to telomere on chrosomal short arm and 5'-terminus of this base sequence : -175
ctggagatgtaatgctgtgcatggtgacaatagttaaaaatactgtattgtatacttgaaatttgttaagaggatgcatcttaaattaagtctcaccacacacacacacacacacacacacacacacaaatggtaactatgcagagatgataggtatgttaattaggtggaatgtggtgatc

SEQ ID NO: 9024 - DNA, 116 bp, Homo sapiens
  D5S494
  Located on chromosome 5
  Distance between a terminus base of telomere on chromosomal short arm and 5'-terminus of this base sequence : 122130542
  Distance between 3'-terminus of neighbour sequence of sequence listing upward to telomere on chrosomal short arm and 5'-terminus of this base sequence : 140344
ccaggctaggcagattacagattatttttgttctgtaggcagttgagagatactatttgtgtgtgtgtgtgtgtgtgtgtgtgtgtgtttaaagcaatatctaccttcgtgaaagc

SEQ ID NO: 9025 - DNA, 116 bp, Homo sapiens
  D5S1435
  Located on chromosome 5
  Distance between a terminus base of telomere on chromosomal short arm and 5'-terminus of this base sequence : 122131963
  Distance between 3'-terminus of neighbour sequence of sequence listing upward to telomere on chrosomal short arm and 5'-terminus of this base sequence : 1305
atggcctaaaggttgttgtgcttcaagcacatttgcttaacactccatagaattaaaaaatgtgtgtgtgtgtgtgtgtgtgtgtgtgtagttcacatcaaagaatgggaggtgtt

SEQ ID NO: 9026 - DNA, 453 bp, Homo sapiens
  AC073538.1_139240
  Located on chromosome 5
  Distance between a terminus base of telomere on chromosomal short arm and 5'-terminus of this base sequence : 122150789
  Distance between 3'-terminus of neighbour sequence of sequence listing upward to telomere on chrosomal short arm and 5'-terminus of this base sequence : 18710
gcaattagatggcattaaattaaggccagaatatcaaaatacatatacatatatatatatatatatatgtgtgtgtgtgtgtgtgtgtgtgtgtgtgtgtgtgtgtgtgtgtgagatggagttacgctctgtcacccaggcaggagtgcagtggagagatctcggctcacggtaacctctgcatgctgggttcaagcgattctcctgcctcagcctccaaagtagcttggattgcagaaatatacatacattttctaaggacttccagttaaacacagaaaactgatcattcattttcactagaaatcctacttgaaacagcactaaaatatcagttaaagaattttttataggtaaaaaccagaaagaataaagaaaacagaggagggaaatacagcaacgcaattttaaaaaccagaaaacactaggatgaatggttgctgacctataagt

SEQ ID NO: 9027 - DNA, 360 bp, Homo sapiens
  chr5.fa.O7frz.131244236
  Located on chromosome 5
  Distance between a terminus base of telomere on chromosomal short arm and 5'-terminus of this base sequence : 122388498
  Distance between 3'-terminus of neighbour sequence of sequence listing upward to telomere on chrosomal short arm and 5'-terminus of this base sequence : 237256
ttactgagctgcctttataattaaataaaatctcaattagtgaatatttaaattacaacgactcctcttatataaggttatgtttttctttacatgaacaaaaaatgccctaattattaacaatattgaagactgctgactacttggttctgacactatttagtgtttaattttcaggtattttagaaatagcagtgatttgtgtgtgtgtgtgtgtgtgtgtgtgtgtgtgtgtgtgtgtgtttaaagaaaataatccctaaggggtccctattcaaaagatttcctgcagatgcatcatgagtggtccttcatcattccctgagacgaactcctctctacgaaatgctaataggtaga

SEQ ID NO: 9028 - DNA, 191 bp, Homo sapiens
  chr5.fa.O7frz.131117590
  Located on chromosome 5
  Distance between a terminus base of telomere on chromosomal short arm and 5'-terminus of this base sequence : 122488932
  Distance between 3'-terminus of neighbour sequence of sequence listing upward to telomere on chrosomal short arm and 5'-terminus of this base sequence : 100074
ttaccacataaatatttgccatatatgtatatatacagaatatggtaaatatgtgtgtgtgtgtgtgtgtgtgtgtgtgtatgagacacatgtatcatatatacggtaaatttttttcaaaaattgtgtcaaggagttcaacgaaaagcattatttttaataactggtgctgaaacaattggatattcatg

SEQ ID NO: 9029 - DNA, 128 bp, Homo sapiens
  D5S639
  Located on chromosome 5
  Distance between a terminus base of telomere on chromosomal short arm and 5'-terminus of this base sequence : 122654400
  Distance between 3'-terminus of neighbour sequence of sequence listing upward to telomere on chrosomal short arm and 5'-terminus of this base sequence : 165277
tgcactagcaacaaatgcagttatttctcttgcctgaactatcctacgcaaagtatggggaaacacacacacacacacacacacacacacacacacacacacacagtttatcaggtcatgggaactcc

SEQ ID NO: 9030 - DNA, 283 bp, Homo sapiens
  AC027313.2_42571
  Located on chromosome 5
  Distance between a terminus base of telomere on chromosomal short arm and 5'-terminus of this base sequence : 122764247
  Distance between 3'-terminus of neighbour sequence of sequence listing upward to telomere on chrosomal short arm and 5'-terminus of this base sequence : 109719
ataagatgaccacaatagtctgacaggtaaccaagtttcccacatcatgtggccatttatacttgtaattgggagatagatgatacatagacagatagatagattagatagatagatagatagatagatagatagatagatagatagatacttttttttaattttattattgttatactttaagttttagggtacatgtgcacaacgtgcaggtttgttacatatgtatacatgtgccatgctggtgtgctgcacccattaactcgtcatttagcattaggta

SEQ ID NO: 9031 - DNA, 459 bp, Homo sapiens
  AC027313.2_71287
  Located on chromosome 5
  Distance between a terminus base of telomere on chromosomal short arm and 5'-terminus of this base sequence : 122820815
  Distance between 3'-terminus of neighbour sequence of sequence listing upward to telomere on chrosomal short arm and 5'-terminus of this base sequence : 56285
caagtcgtaatggaaattgtaaggagttttaaaaatagggtttggtttttgcaaatagaagattttgattaaagcaaagtcaaatatagagtcaaacaagtttaatttgttttcttgagacagggtcttgctttatttcccaagctggagtgcagtggtgcaatcacagctcactgaacccctgacctcccgggcctcaagcaatcctcctacctcagctttccaagtagctgggaatggcttctttttatttatttatttatttatttatttatttatttatttatttatttatttattttgcgatggggtctcattggttgctcaggctggtctcaacctcctgggctcaagcagccctcctgccttggcttccaaagtgctgggattacaggcatgagccaccacatatggccatgtttaatttgttgatggctgagaacagttagctcagaatac

SEQ ID NO: 9032 - DNA, 267 bp, Homo sapiens
  D5S485
  Located on chromosome 5
  Distance between a terminus base of telomere on chromosomal short arm and 5'-terminus of this base sequence : 122826974
  Distance between 3'-terminus of neighbour sequence of sequence listing upward to telomere on chrosomal short arm and 5'-terminus of this base sequence : 5700
gacacagcatacagaatgaaagtctaaggtgggagtaaatattgtaaaactattattttaatgaagaaatttatatatttgttcccaaggtgtgtgtgtgtgtgtgtgtgtgtgtgtgtgtgtattatacaatataatatatatatatattaaaagaagaaaaagattaggcttattcacatgcaatgtaggaatcatttcaaacaagaagtattaattttgctcctagaagccagagcatgacatagtcattggattgattggatc

SEQ ID NO: 9033 - DNA, 130 bp, Homo sapiens
  D5S460
  Located on chromosome 5
  Distance between a terminus base of telomere on chromosomal short arm and 5'-terminus of this base sequence : 122942459
  Distance between 3'-terminus of neighbour sequence of sequence listing upward to telomere on chrosomal short arm and 5'-terminus of this base sequence : 115218
ctattagcctgccagaatgttacagatacataaacacacacacacacacacacactcccaaacacacagactaatacatacatatataaaagaacaaaagattttgatttctgagtcaaaaacagaccac

SEQ ID NO: 9034 - DNA, 160 bp, Homo sapiens
  D5S657
  Located on chromosome 5
  Distance between a terminus base of telomere on chromosomal short arm and 5'-terminus of this base sequence : 123235699
  Distance between 3'-terminus of neighbour sequence of sequence listing upward to telomere on chrosomal short arm and 5'-terminus of this base sequence : 293110
agctgtgtgctcacatggtagaagggatgaaagagcaaaactgggaactagaatgcttccatatacatacacacacacacacacacacacacacacacacacacacacatatatatctcacaagagtcttcatgctctttgaagcataggtaagaatcta

SEQ ID NO: 9035 - DNA, 279 bp, Homo sapiens
  chr5.fa.O7frz.135053631
  Located on chromosome 5
  Distance between a terminus base of telomere on chromosomal short arm and 5'-terminus of this base sequence : 123317332
  Distance between 3'-terminus of neighbour sequence of sequence listing upward to telomere on chrosomal short arm and 5'-terminus of this base sequence : 81473
taaacggattatcaactgacagtggggagggagaggagatttggagatttgaggagaaaagagaatctgtaaaataattatctaggagagcagctattgaaagtttttgacagaaacacagaataagaaatatcactatccaggatgtaaattcacaacacacacacacacacacacacacactctctctctctcttgctcacacactcacacacctgaaacaagagcttcaggaaataatacccttacttcacctactgtcgcttcaattctactcta

SEQ ID NO: 9036 - DNA, 429 bp, Homo sapiens
  chr5.fa.O7frz.134846172
  Located on chromosome 5
  Distance between a terminus base of telomere on chromosomal short arm and 5'-terminus of this base sequence : 123513852
  Distance between 3'-terminus of neighbour sequence of sequence listing upward to telomere on chrosomal short arm and 5'-terminus of this base sequence : 196241
agaagtctttctatccatggacatgacatttctctttctttattaaaatactctttaatttctctagtaaagttttatatattccttgtacaaaagctttgttagatctcttctttagcactttgtttttgatgctatttaaaatgctattgttttaaaagttttattctgttgatgatgtaaataaataatgtgttatatatttcaaagtaagagaacaaatttcaaatgtcatgcctaaaaaatgataggtaagcaaggtgatggttatttaataagcttgatttaatcatgccactatatatatatatatatatatatatatatacatatatatacatatgtgtatatatatatatatatatacacacacatatatatatatagtggatctaattccactggatctaattccaagctggatctaat

SEQ ID NO: 9037 - DNA, 352 bp, Homo sapiens
  chr5.fa.O7frz.135697157
  Located on chromosome 5
  Distance between a terminus base of telomere on chromosomal short arm and 5'-terminus of this base sequence : 123603410
  Distance between 3'-terminus of neighbour sequence of sequence listing upward to telomere on chrosomal short arm and 5'-terminus of this base sequence : 89129
tcctgtaacataactagacaggaggctgtgtgggtgtgtggaagccattccaggcagaggaataatacctgtaaatgtgcagaagggaatgagaacacagtgagggagtggacagtgacaagataggattccctggaatgggtggctaggagaataccatagtggcctgcaagggcggggggggggagagagggagagagagagagagagagagagagagagagagtgtgtgtgtgtgtgtgtgtgtgtgtgtgtgtgtgaaggggaacaactgagccttacctaatcatatataaaaccatgtggcttgttgccacaagtgtattatagatctaatctctgttgacaatgt

SEQ ID NO: 9038 - DNA, 465 bp, Homo sapiens
  chr5.fa.O7frz.135618109
  Located on chromosome 5
  Distance between a terminus base of telomere on chromosomal short arm and 5'-terminus of this base sequence : 123682251
  Distance between 3'-terminus of neighbour sequence of sequence listing upward to telomere on chrosomal short arm and 5'-terminus of this base sequence : 78489
gtatacacctgaccattccttaggccagtggttgcaaatcaaagctcacaaaggccaggaaagtgacaaatgattgtgaaaatgctggcaagctagagggcacaagccccttctacagaaatcagccaccacttggttctagccacatgggtacatgcacctagcattgccaaatctttctgatttttcaacagaaacccaaacactgtatctgtatagaaaatttaaaaatttatcaattttgaaaatattaacaacaaattcaaaacttaaaaaacctgcaagtcaaacaaaatcacacacacacacacacacacaaaactcacgctacatttatttttacatgaggcctagattgcagctgctataggttgatgatcccagtctcaagagatgtaaactgaaaatgccaacaggatttagagatgggcgattttggggttagatgaaagagtcataggagac

SEQ ID NO: 9039 - DNA, 456 bp, Homo sapiens
  chr5.fa.O7frz.135472700
  Located on chromosome 5
  Distance between a terminus base of telomere on chromosomal short arm and 5'-terminus of this base sequence : 123830373
  Distance between 3'-terminus of neighbour sequence of sequence listing upward to telomere on chrosomal short arm and 5'-terminus of this base sequence : 147657
ctattgctccatttaccagtatactatgaggcctggtaattaaaagtaagttggatttgtcaaaataaatgagcagagtacattcggtgatgaggtaacttcaaaggatttgcattacaacttatttctttaccttttaatataccagctcttagaaaaacacagccgctccctgcacccctacacacacacacacacacacacacacacacacacacacatacgtgcgcacacgcatgcctgccaaatttgtactgggaaaaattttcaatttgaaagcctgaacatcgatattgggcttactttcttcaatataaaaacttaaaatgatcacaaaataagtactggaaggtctgggtagaaatgttgtccccagttggctcagtagcttggctggcaaggaagcaactcattccaaatgttggatttggtttctttcactctttgattcaacag

SEQ ID NO: 9040 - DNA, 367 bp, Homo sapiens
  chr5.fa.O7frz.135813439
  Located on chromosome 5
  Distance between a terminus base of telomere on chromosomal short arm and 5'-terminus of this base sequence : 123925091
  Distance between 3'-terminus of neighbour sequence of sequence listing upward to telomere on chrosomal short arm and 5'-terminus of this base sequence : 94262
gagattagaagttcgaaaccagcctggccaacacggtgaaaccctgactctactaaaaataaaaaaaattagccatgtgtggtggcaagagcctgtaatcccagctacccaggaggctgaggcaagagaatcacttgaacccaggaggcggaggttgcagtgagccgagaccatgccactgcactccagcttgggtgacagagtgagattgcgtctcaaataaataaataaataaataaataaataaataaataaataaataaataagaaaaagagagaagtgggggaagaaggaaggaagggaggggaggaggaagagagaaaaggggaagtaacatattcagtatatacggattgctttctgtaa

SEQ ID NO: 9041 - DNA, 252 bp, Homo sapiens
  D5S1975
  Located on chromosome 5
  Distance between a terminus base of telomere on chromosomal short arm and 5'-terminus of this base sequence : 124017229
  Distance between 3'-terminus of neighbour sequence of sequence listing upward to telomere on chrosomal short arm and 5'-terminus of this base sequence : 91771
gctgtgctgtttggctacacatgtgctgctcagggttgaccctgagatttgcacacattcattcacagaattaggggatccccttctccagttttttctctgggattttccccacattcttcagtttacaagaccgccccaccttccccaccacacacacacatacacacacacacacacacacagacacacacggacacacacacacacacacacacacacacactcttcctctagcccgaaagatgaggt

SEQ ID NO: 9042 - DNA, 187 bp, Homo sapiens
  Z67521
  Located on chromosome 5
  Distance between a terminus base of telomere on chromosomal short arm and 5'-terminus of this base sequence : 124184185
  Distance between 3'-terminus of neighbour sequence of sequence listing upward to telomere on chrosomal short arm and 5'-terminus of this base sequence : 166704
cctgggagcagtgaacagtgtcccaggcctgatttggaacacagtctctgcagggaaggcttagttgtccatctgctgtaatttgtaaaaataaaacctttaaaacacttgggaaaaaaaaaatatatacacacacacacacacacacacacacacacacacacacatacacagccaccatattttt

SEQ ID NO: 9043 - DNA, 442 bp, Homo sapiens
  AC010396.3_193844
  Located on chromosome 5
  Distance between a terminus base of telomere on chromosomal short arm and 5'-terminus of this base sequence : 124394194
  Distance between 3'-terminus of neighbour sequence of sequence listing upward to telomere on chrosomal short arm and 5'-terminus of this base sequence : 209822
tatcttatggcaattaaacctaaataaagatgttgaattttttaaaaataccagtactaaaataacagctgccaacccacccttggttgtctttttgtatgtatgtatgtatgtatgtatgtatgtatgtatgtatgtatgtatgtatgcatgtatttttttgagacagagtctcactctgttgcccaggctggagtgcagcggtgtgatctcggctcactgcaagctccacctcccaggttcacgccattctcctgcctctggagtagctgggactataggcacctgccaccacgcccagcatgtacttttccacataagtagattttccagataactgaggcttagtatttactccattggaaactgcttattttaaccattttaaaagtaaacctttaaaaaatgtatcacagcctcctttgaatgttgaatcaaagac

SEQ ID NO: 9044 - DNA, 195 bp, Homo sapiens
  D5S622
  Located on chromosome 5
  Distance between a terminus base of telomere on chromosomal short arm and 5'-terminus of this base sequence : 124534252
  Distance between 3'-terminus of neighbour sequence of sequence listing upward to telomere on chrosomal short arm and 5'-terminus of this base sequence : 139616
ctttgaaattctcttattacagaggttaaaaataaaacaattattaatatttcttgtatgtgtgtgtgtgttgtgtgtatgtgtgtgtgtgtgtgtgtgtgtgtgtgtgtgtgtgctacctgagagcagggaaaactggaagaaagaccctgtaagattactctttattgcatgagaagtttgggattaaatgtt

SEQ ID NO: 9045 - DNA, 473 bp, Homo sapiens
  AC041047.3_125637
  Located on chromosome 5
  Distance between a terminus base of telomere on chromosomal short arm and 5'-terminus of this base sequence : 124884692
  Distance between 3'-terminus of neighbour sequence of sequence listing upward to telomere on chrosomal short arm and 5'-terminus of this base sequence : 350245
gtaagttacagtcagccatgatcgtggaggattgcttgaacccaggaggtagaggttgcagtgagccgtgattgtgccactgcactccagtctgggcaacagagcgagaccgtctcaaaacaaacaaacaaacaaacaaacaaacaagctgggcgcggtggctcaccgagcctgtaatcccagcactttgggaggccaaggcggttggatcacgaggtcagtagttgaccatcctggccaacacggtgaaaccccgtctctactaaaaatacaaaaaaattagctgggcatggtggcgggtgcctgtagtcccagttactcgggaggctgaggcaggtgaatggcgtgaacccaggaggcggagcttgcagtgagccgagatcgcgctactgcactccagcctgggccacagagcgagactctgtctcaaaacaaacaaacaaacaaaaaaactccaactcattgatttattg

SEQ ID NO: 9046 - DNA, 425 bp, Homo sapiens
  AC041047.3_126265
  Located on chromosome 5
  Distance between a terminus base of telomere on chromosomal short arm and 5'-terminus of this base sequence : 124885159
  Distance between 3'-terminus of neighbour sequence of sequence listing upward to telomere on chrosomal short arm and 5'-terminus of this base sequence : -6
ttattgctattgtctgatggagacatgggtgtaaccttaagaattttttttcatgattcattcagcctgggaaattggtaggaagaaagagaggatacccatgcatgtgagttttagagattatagaagcatcagttattatttttttcttcttggaagagacatgatattttacataggatgaaaaaagagaagttgtgtgtgtctgtgtgtgtgattttttttccttcctggaaaacacatgatacattttacataggatgaaaaaagaagtgtgtgtgtgtgtgtgtgtgtgtgtgtgtgcgtgtgcttgtaacatttagcaaaatagtcattatctgagttttctgtgcagaagatgtaggaataataagtcatgggccttgccctcaaagggtttacagtctcttgaggtagctaagcat

SEQ ID NO: 9047 - DNA, 229 bp, Homo sapiens
  AC005221.1_82655
  Located on chromosome 5
  Distance between a terminus base of telomere on chromosomal short arm and 5'-terminus of this base sequence : 125125911
  Distance between 3'-terminus of neighbour sequence of sequence listing upward to telomere on chrosomal short arm and 5'-terminus of this base sequence : 240327
gccaggtaggactataggcttatctgccctcccaaaaccaggaaagagaacaacccacagaagtggtcccagaggtcagagagggagagggactcgtgtaagtaggggtgtgtgtgtgtgtgtgtgtgtgtgtgtgtgtgtgtctgtgtgtgtgtggtggaggggagggggcactgaggacctctaacaccgctgtttttattaactcagtaattggaaccatctaaga

SEQ ID NO: 9048 - DNA, 314 bp, Homo sapiens
  AC005221.1_20515
  Located on chromosome 5
  Distance between a terminus base of telomere on chromosomal short arm and 5'-terminus of this base sequence : 125188018
  Distance between 3'-terminus of neighbour sequence of sequence listing upward to telomere on chrosomal short arm and 5'-terminus of this base sequence : 61878
aatcagtggtaaccaagtcatatggcaggcaacgggccagacaacctggtccagtgaccgaaccctattttaagagtctgaaaggacagttataaacattcaggagacgttatctctttaaaaaatttatttatttatttatttatttatttatttatttatttatttatttatttttaaccttgcagcttcagctcaaaggatgagagaggaggtgttatttttatagcagcaggatctggttacctataagcaaaatctttttaaggtactaagttacaataacataggtaggttttcaaataaaggaagac

SEQ ID NO: 9049 - DNA, 172 bp, Homo sapiens
  AC005915.1_83816
  Located on chromosome 5
  Distance between a terminus base of telomere on chromosomal short arm and 5'-terminus of this base sequence : 125309554
  Distance between 3'-terminus of neighbour sequence of sequence listing upward to telomere on chrosomal short arm and 5'-terminus of this base sequence : 121222
actgtcctcatgatcgtgatagagttctcacaagatctgattgtttataagtgtatagcaccttctctctctctctctctctctctctctctctctgtctctctgtcttgttgctccagccatgtgacatgccttctcccccttcaccttctgccatgattatgtttcctaa

SEQ ID NO: 9050 - DNA, 228 bp, Homo sapiens
  AC005915.1_113787
  Located on chromosome 5
  Distance between a terminus base of telomere on chromosomal short arm and 5'-terminus of this base sequence : 125339532
  Distance between 3'-terminus of neighbour sequence of sequence listing upward to telomere on chrosomal short arm and 5'-terminus of this base sequence : 29806
ctgagtactccaaacaaccaagatggcggtccatccccattcccctcccaaacatgcacacacacacacacacacacacacacacacacaccatctcagtgagagatcagagctctgtttatggaatacaggcggggtggctggagtccctggctaggaggttgggcccagtgaggaagaatggatcagggtcctgcttcaagaagcagtctggccacattctgttaa

SEQ ID NO: 9051 - DNA, 388 bp, Homo sapiens
  chr5.fa.O7frz.140476483
  Located on chromosome 5
  Distance between a terminus base of telomere on chromosomal short arm and 5'-terminus of this base sequence : 125418500
  Distance between 3'-terminus of neighbour sequence of sequence listing upward to telomere on chrosomal short arm and 5'-terminus of this base sequence : 78740
ctatacaggatgttattggaacacatgggaaattttgaatttggactgtaaattagataatgttaaagttcctgagcaataattatatgctggttgtataagagaatgcctttgctcttaggggatagatgatggaagacacacacacacacacacacacacacacacacacacacacgggagagagagaataaacacagtatatatatatattatatataaaatatatatatatataatatatatacacacacacacacagttttacatgtatatactttatatatatataaagttaacaaaatgttaacaatggatctaaatgaatgttaaatggatgattgttgtagtactctcatgacttttctgaaggtttgaaatgttcata

SEQ ID NO: 9052 - DNA, 329 bp, Homo sapiens
  AC008566.3_68865
  Located on chromosome 5
  Distance between a terminus base of telomere on chromosomal short arm and 5'-terminus of this base sequence : 125489111
  Distance between 3'-terminus of neighbour sequence of sequence listing upward to telomere on chrosomal short arm and 5'-terminus of this base sequence : 70223
ttgaggaatcaccatactgtttttctacagtggctgctccattttacatttccgtcagcaatgcacaagagttccaatttttccacatccttgccaactctttctttctttctttctttctttctttctttctttctttctttctttccttccttccttcctttctttttttctttctttctttccttctttctttatttctttctttctttctttctctctttctttctttctttgtttcggagggggtgataatagcaatcctaatcagtgtgaagttatcgcattgtggtttgatttacatttccctaatgattagtgatacggcc

SEQ ID NO: 9053 - DNA, 165 bp, Homo sapiens
  AC005611.1_15625
  Located on chromosome 5
  Distance between a terminus base of telomere on chromosomal short arm and 5'-terminus of this base sequence : 125686270
  Distance between 3'-terminus of neighbour sequence of sequence listing upward to telomere on chrosomal short arm and 5'-terminus of this base sequence : 196830
ctgacagaatttgctaaaggactggatgtggagtgagagggaaagtgaggagtcaaggaggtctccaaggtgtgtgtgtgtgtgtgtgtgtgtgtgtgtttaaaataaacttacttttagaacaccttcagattcacagaaaaattgaaaggatagtgcagtttg

SEQ ID NO: 9054 - DNA, 94 bp, Homo sapiens
  D5S490
  Located on chromosome 5
  Distance between a terminus base of telomere on chromosomal short arm and 5'-terminus of this base sequence : 125686311
  Distance between 3'-terminus of neighbour sequence of sequence listing upward to telomere on chrosomal short arm and 5'-terminus of this base sequence : -124
aaagtgaggagtcaaggaggtctccaaggtgtgtgtgtgtgtgtgtgtgtgtgtgtgtttaaaataaacttacttttagaacaccttcagattc

SEQ ID NO: 9055 - DNA, 176 bp, Homo sapiens
  DISO7_10002019
  Located on chromosome 5
  Distance between a terminus base of telomere on chromosomal short arm and 5'-terminus of this base sequence : 125809976
  Distance between 3'-terminus of neighbour sequence of sequence listing upward to telomere on chrosomal short arm and 5'-terminus of this base sequence : 123571
gatgcactctactctggtagatatctatagtatatatctggtatctatagatcagatagatagatgatagatagatagatagatagatagatagatagatagatagagtacatacttggtagatatctgtagtaagtacactaacaataataagaatacgtacttagagcagacgg

SEQ ID NO: 9056 - DNA, 108 bp, Homo sapiens
  DISO7_10002022
  Located on chromosome 5
  Distance between a terminus base of telomere on chromosomal short arm and 5'-terminus of this base sequence : 125880519
  Distance between 3'-terminus of neighbour sequence of sequence listing upward to telomere on chrosomal short arm and 5'-terminus of this base sequence : 70367
cttcaggaagggttccagaaacctcttaaattccttttcatttgtgcaaacaccacacacatgcacacacacacacacacacacatattcagtgcttagtggagtgcc

SEQ ID NO: 9057 - DNA, 473 bp, Homo sapiens
  AC026422.2_27575
  Located on chromosome 5
  Distance between a terminus base of telomere on chromosomal short arm and 5'-terminus of this base sequence : 126022124
  Distance between 3'-terminus of neighbour sequence of sequence listing upward to telomere on chrosomal short arm and 5'-terminus of this base sequence : 141497
cagaatttagtgaaaggcaattaggggagtcacagaactgacggaagctggaagacctggtctaggcagaatccaaaatgctccagaggctggcaagtaagatcatagccattattctgtgtcagaaactgtgtggtcaggttgccactcttgggatggagtccctcccattccaaccatttttagtcttcacgttcctcacctcataattcaaacctaggtgtactccagcctgggtgacagaatgagaccctgtctcaataataataataataataataataattcaaatctagggagagagaatccaattgatattgtttcagcaacatgttccccgttactcctcctcccttactccacacctacaggaaggcacagcctctgatcactgaacagagtgagacagaaaaagattcatcaaagggaaatctgagtgctactaggaaaaggtaaatagatgctggacagcc

SEQ ID NO: 9058 - DNA, 274 bp, Homo sapiens
  AC026422.2_47945
  Located on chromosome 5
  Distance between a terminus base of telomere on chromosomal short arm and 5'-terminus of this base sequence : 126042616
  Distance between 3'-terminus of neighbour sequence of sequence listing upward to telomere on chrosomal short arm and 5'-terminus of this base sequence : 20019
gcagaatgcatttgagaatcatctatattgtagcgagtgtcagtggtttctttttactgctgagcaatattccattgtatggatgtacctcaccacatttatctatttgcccattaagaaatgtttcattcatgtacagattgtgtgtgtgtgtgtgtgtgtgtgtgtgtgtgtgtgtgtgtatgaacataatttttttttccttgagtatgatcctaaagttgggattgttgggtcatatggcaagtgtgtgtttaactttgtaagaaactgc

SEQ ID NO: 9059 - DNA, 186 bp, Homo sapiens
  D5S2020
  Located on chromosome 5
  Distance between a terminus base of telomere on chromosomal short arm and 5'-terminus of this base sequence : 126287618
  Distance between 3'-terminus of neighbour sequence of sequence listing upward to telomere on chrosomal short arm and 5'-terminus of this base sequence : 244728
ctgggattacaggcataagccactgtgcccggtcagtttctagtattttttgaatatttttacatctatgttcatcaggggtattggcctgtagttgtgtgtgtgtgtgtgtgtgtgtgtgtgtgtgtgtctgtctttgtctagttttggtatcagagtgacactggccttgtagaatgagtttgg

SEQ ID NO: 9060 - DNA, 456 bp, Homo sapiens
  AC008512.4_79138
  Located on chromosome 5
  Distance between a terminus base of telomere on chromosomal short arm and 5'-terminus of this base sequence : 126300527
  Distance between 3'-terminus of neighbour sequence of sequence listing upward to telomere on chrosomal short arm and 5'-terminus of this base sequence : 12723
atgttatctacaacgcctgtatagtcatgtccctctgtgtagcctggctatgtgccacattgtgaggttctctccctctagctacttcttccagtttcctctttcaggatcccaattcctttctcaaagcactggtgaataactccaaatactccatcatttcattatacagagtaatataagtcttctttttctaaacctctcccatctggatagtggacctcatatttcagatgctaataggctgttgaggtagtttcctaagcaaaaaagtaattgtctctctcagaggaatgctttagtgctttttagccaagtgattccaatcatagccacagtttacaacatttgtatctttatctgtatccttatttatacctctatctatctatctatctatctatctatctatctatctatctatcttcaaaatattacataaggataccaaagagg

SEQ ID NO: 9061 - DNA, 149 bp, Homo sapiens
  G08446
  Located on chromosome 5
  Distance between a terminus base of telomere on chromosomal short arm and 5'-terminus of this base sequence : 126300844
  Distance between 3'-terminus of neighbour sequence of sequence listing upward to telomere on chrosomal short arm and 5'-terminus of this base sequence : -139
tgattccaatcatagccacagtttacaacatttgtatctttatctgtatccttatttatacctctatctatctatctatctatctatctatctatctatctatctatcttcaaaatattacataaggataccaaagaggaaaatcaccc

SEQ ID NO: 9062 - DNA, 412 bp, Homo sapiens
  AC021080.2_36212
  Located on chromosome 5
  Distance between a terminus base of telomere on chromosomal short arm and 5'-terminus of this base sequence : 126329177
  Distance between 3'-terminus of neighbour sequence of sequence listing upward to telomere on chrosomal short arm and 5'-terminus of this base sequence : 28184
tggtacaaatgagcattcttatctggccaaagagtatttgtcattgctgctgggggtcatgatgatggcagagggatacataggctgctgagaccacaaatgcaggctaagccagaaagctgcacgtgtgtgtgtgtgtgtgtgtgtgtgtgtgtgtgtgtgtgtatttcaaaaatgggtctaactaaggatagatctttggaaactgatcttgatctttgaaaaaaattctaatgtgggaaaacatttgagtctaatttgctttagctgtttgaggctaccaagtgcaatattagattccctgctaaaatttaataatacatttgatggaaaattacaaaaggaaaatttcacttaaatatttaataactagggtagtagttcacaaaaactcaagttcagtgattctgag

SEQ ID NO: 9063 - DNA, 442 bp, Homo sapiens
  AC008693.6_186814
  Located on chromosome 5
  Distance between a terminus base of telomere on chromosomal short arm and 5'-terminus of this base sequence : 126520381
  Distance between 3'-terminus of neighbour sequence of sequence listing upward to telomere on chrosomal short arm and 5'-terminus of this base sequence : 190792
gactaggtgcattgtcaacgagtagtaatattttgaaagcaatctcttttctgagcagtagttctcatcagcaggcttaaaatattcagtaaaccatgctgttaacagatgtgctgtcatacaggctttgctattccatttatagagcccaggcagagtagatttagcataattcttaagggccttagcatttttggaatggtaaatgagcattggcttcaacttaaagtcaccagctgcattggcccttaacaaaggagtcaacctgtcctttgaagctttgaaataagttattgactattactactactactactactactactactactactactactacttcttcttcttcttctttcttctttcttctttcttctttcttctagctaggaaggtcctagttggcatctttttcaaatagatggctgtttgaaatctg

SEQ ID NO: 9064 - DNA, 323 bp, Homo sapiens
  chr5.fa.O7frz.137406697
  Located on chromosome 5
  Distance between a terminus base of telomere on chromosomal short arm and 5'-terminus of this base sequence : 126520465
  Distance between 3'-terminus of neighbour sequence of sequence listing upward to telomere on chrosomal short arm and 5'-terminus of this base sequence : -358
ttcagtaaaccatgctgttaacagatgtgctgtcatacaggctttgctattccatttatagagcccaggcagagtagatttagcataattcttaagggccttagcatttttggaatggtaaatgagcattggcttcaacttaaagtcaccagctgcattggcccttaacaaaggagtcaacctgtcctttgaagctttgaaataagttattgactattactactactactactactactactactactactactactacttcttcttcttcttctttcttctttcttctttcttctttcttctagctaggaaggtcctagttg

SEQ ID NO: 9065 - DNA, 128 bp, Homo sapiens
  D5S2039
  Located on chromosome 5
  Distance between a terminus base of telomere on chromosomal short arm and 5'-terminus of this base sequence : 126564020
  Distance between 3'-terminus of neighbour sequence of sequence listing upward to telomere on chrosomal short arm and 5'-terminus of this base sequence : 43232
ctagcatcctcagggctctagtttggccaacatgcagatgcagggaccaacactgtgtgtgtgtgtgtgtgtgtgtgtgtgtgtgtgtgtgtgtgtgtgtgtgtggtgggagtggagagcagtctaaa

SEQ ID NO: 9066 - DNA, 113 bp, Homo sapiens
  DISD22_0007975
  Located on chromosome 5
  Distance between a terminus base of telomere on chromosomal short arm and 5'-terminus of this base sequence : 126669555
  Distance between 3'-terminus of neighbour sequence of sequence listing upward to telomere on chrosomal short arm and 5'-terminus of this base sequence : 105407
catatgcagacagaggcgcacacacacacacacacacacacacacacacacaccaagtcagtacaccagctgttcagcattatttacaatatattggaatcaccgctgaccta

SEQ ID NO: 9067 - DNA, 388 bp, Homo sapiens
  AC040974.2_179835
  Located on chromosome 5
  Distance between a terminus base of telomere on chromosomal short arm and 5'-terminus of this base sequence : 126890785
  Distance between 3'-terminus of neighbour sequence of sequence listing upward to telomere on chrosomal short arm and 5'-terminus of this base sequence : 221117
atgctaaatgacgagttaacaggtgcagcacaccaacatggaacatgtatacatatgtaacaaacctgcacattgtgcacatgtaccctaaatcttaaagtataataaaataaaataaaataaaataaaataaaataaaaagaccctcaggtgaaaggtaccctccttataccccaatgaaaagaatgttcttacctctgaagacaaagggtcacagagaagaatctgaaccaacaagccctgctgagttttctccagtttattaccattagatcataccccctttatccaatcatatttctccatgactttctactctttctcaaacctaagcacaaaaataaacaagtttatctatttctttgggtcttcattttcttatgaaggc

SEQ ID NO: 9068 - DNA, 123 bp, Homo sapiens
  Z66916
  Located on chromosome 5
  Distance between a terminus base of telomere on chromosomal short arm and 5'-terminus of this base sequence : 126971106
  Distance between 3'-terminus of neighbour sequence of sequence listing upward to telomere on chrosomal short arm and 5'-terminus of this base sequence : 79933
agatgggccctaatttgtttatccaaataatacacatacacacacacacacacacacacacacacacacacacacacacacacacagcccaccttctgtggaggcctcagtcgctatgacaag

SEQ ID NO: 9069 - DNA, 193 bp, Homo sapiens
  D5S2098
  Located on chromosome 5
  Distance between a terminus base of telomere on chromosomal short arm and 5'-terminus of this base sequence : 126978086
  Distance between 3'-terminus of neighbour sequence of sequence listing upward to telomere on chrosomal short arm and 5'-terminus of this base sequence : 6857
gctaagggtaatcttaaactgcctgactggatcctttcaccttgaggcctctccataaataaagccatgcatttcatttcaggcccaaataataattacatggtgtgtgtgtgtgtgtgtgtgtgtgtgtgtgtgtgtgtgtgtgtgtgtgttgggggaatccacctcttctaccctatgatgcagaatacag

SEQ ID NO: 9070 - DNA, 433 bp, Homo sapiens
  chr5.fa.O7frz.27538434
  Located on chromosome 5
  Distance between a terminus base of telomere on chromosomal short arm and 5'-terminus of this base sequence : 127137308
  Distance between 3'-terminus of neighbour sequence of sequence listing upward to telomere on chrosomal short arm and 5'-terminus of this base sequence : 159029
aaagctttaatcctgattaaattcaactaacttgctattcctttgctatcatccattcagctgaaagtggttggagaaaacacacacacacacacacacacacacacacacacacacacacacacacgagagaaactggtctcatattcaatttatgactatgtccacaagagggctcacttctttttttggcttgtaaactaaatttctatctatttgaagctatgtcacacctatctacccatttgtaactgaaaatagtaataaaaagaaaacagacaatttgagtgttcttcattccgtgaatatctcaattttgtaagctctttttaaaattcactttcctgtaatgtgtctgctcactgtgtattttatagattgttgatttcccattagaatgataaatttggtctctgttcacagtgattggtat

SEQ ID NO: 9071 - DNA, 442 bp, Homo sapiens
  chr5.fa.O7frz.138363779
  Located on chromosome 5
  Distance between a terminus base of telomere on chromosomal short arm and 5'-terminus of this base sequence : 127391716
  Distance between 3'-terminus of neighbour sequence of sequence listing upward to telomere on chrosomal short arm and 5'-terminus of this base sequence : 253975
aaccagtctaggcagtctagagggaaactgtgtaaatgacttgtaactaagaggatatgaccctctgcataattcataatcattagtctaagtgacacttctgcaatcactctgccagggcactctaatatggtggggctggaacccaaacagtccactcagcagcagtccctatatgatcagatttctctgaaagacaactccctggaaggctatatttgggctgcaggacatatatatatatatatatatatatatatattttttttttttttttaacagaagatgctggctcagcttcatcatgtgtgcaatttaagggttgctcaagtgattctttaaaactgcataaaagcaattctgctgtgcctgggagacagtgttgctacaatgttctgtgcatacatctgcatgatttctcagagctaattcaaatttaatg

SEQ ID NO: 9072 - DNA, 417 bp, Homo sapiens
  chr5.fa.O7frz.138476778
  Located on chromosome 5
  Distance between a terminus base of telomere on chromosomal short arm and 5'-terminus of this base sequence : 127504741
  Distance between 3'-terminus of neighbour sequence of sequence listing upward to telomere on chrosomal short arm and 5'-terminus of this base sequence : 112583
taaattaaagcatgtcactcctctgttttcaaacctccattggcttccttcctccctccctccctcccttccttccttcctttcttccttccttcctctctttccttctttccttccttccctccttcctctctctttccttccttccttcctctctgtctttccttccttccttcctttcttccttccttcctctctgtctttccttcctttcttcccttcttccttccttcctttcttccttcctatccttcattcgttccttcattctttcttctttcttttttttgagatggaatcttgctctgtcacccaggctggagtgcagtggcacagtcttggctcactgcaacctccacctcccaggttcaagcagttctgcctcagcctcctgaatagctggaattataggcaagt

SEQ ID NO: 9073 - DNA, 285 bp, Homo sapiens
  chr5.fa.O7frz.138598260
  Located on chromosome 5
  Distance between a terminus base of telomere on chromosomal short arm and 5'-terminus of this base sequence : 127626066
  Distance between 3'-terminus of neighbour sequence of sequence listing upward to telomere on chrosomal short arm and 5'-terminus of this base sequence : 120908
ttgtcacctaaggagatacataacaaattaggttatttctgaaaatgtctacacacacacacacacacacacacacacacaattgatttaaaaagaaaaagccctataggagaagtgggcagaatgacaagggaaccaggctttctgccagcatttcctagacaggaaaaatacctcttgaaatattcatgaaacactttttatccaagcaattggaaaagattataatacatgttttagaacaagagtctttcaaaatgaacctttactccacagaatgaggat

SEQ ID NO: 9074 - DNA, 192 bp, Homo sapiens
  D5S2059
  Located on chromosome 5
  Distance between a terminus base of telomere on chromosomal short arm and 5'-terminus of this base sequence : 127712932
  Distance between 3'-terminus of neighbour sequence of sequence listing upward to telomere on chrosomal short arm and 5'-terminus of this base sequence : 86581
gctacccacggggtttattatttttggcttaaatgcaaacctctaattattagtataagcataagttctccttgctgacagtttaagataaagtaaattggaagtgacataaaagggtgtgtgtgtgtgtgtgtgtgtgtgtgtgtgaatgtgtgtcaccaagattctttcttgcatcctgaaaagtcccct

SEQ ID NO: 9075 - DNA, 238 bp, Homo sapiens
  D5S804
  Located on chromosome 5
  Distance between a terminus base of telomere on chromosomal short arm and 5'-terminus of this base sequence : 127921655
  Distance between 3'-terminus of neighbour sequence of sequence listing upward to telomere on chrosomal short arm and 5'-terminus of this base sequence : 208531
gagggaagggtgactgaattacagataactttaccagttatcttagactggaagccctgaatattcttttcctaactgggaactactacactgagagtaaaaatggaggattcatgtttccctgacagtgggcatattattcacatatagatagatagatagatagatagatagatagataggtagatagatagatagacagatcatatagtaaattttaaaaagggatgtggcatgt

SEQ ID NO: 9076 - DNA, 456 bp, Homo sapiens
  AC010372.4_99862
  Located on chromosome 5
  Distance between a terminus base of telomere on chromosomal short arm and 5'-terminus of this base sequence : 127925629
  Distance between 3'-terminus of neighbour sequence of sequence listing upward to telomere on chrosomal short arm and 5'-terminus of this base sequence : 3736
cagactttgtaatttgagtcattcaatatttaaaatatattggggtagtatattattttttaaagtaatcggctgggcgcggtggctcacgcctgtaatcccagcactttgggaggccgaggcgggtggatcacgaggtcaggagatcgagaccatcctggctaacacagtgaaaccccgcctctactaaaaatacaaaaaattatccgggcgtggtggcgggcgcctgtagtcccagctactcgggaggctgaggcaggagaatggcgtgaacccaggaggcagagcttgcagtgagccgagatggggccactgcactctagcctgggcaacagagtaagactccatctcaaaaaataaataaataaataaataaataaataaataaataaacaaataaataaataaagtaatccttttgtgaaattatttatgttaacgcataagcatatttca

SEQ ID NO: 9077 - DNA, 307 bp, Homo sapiens
  AC010587.3_171042
  Located on chromosome 5
  Distance between a terminus base of telomere on chromosomal short arm and 5'-terminus of this base sequence : 127992033
  Distance between 3'-terminus of neighbour sequence of sequence listing upward to telomere on chrosomal short arm and 5'-terminus of this base sequence : 65948
aattataagcctagctgcctatacaattctacatatttacagtgactttaaaaggatgtgtctgattttaaagctctggcctttaaacaaaaaggtctttttcattatgccaaacagagaggtgatgctgttgaataaatttatgctgttcttttacgtgtgcgtgtgtgtgtgtgtgtgtgtatgtgtgtgtgtagatacatacacttatatataacatggaggactgcaataaaaatgactatacaattgggagaaaggtaaaatgttacacaaatactgtgtatattccttgtctatccaaggt

SEQ ID NO: 9078 - DNA, 347 bp, Homo sapiens
  HUMUT2422
  Located on chromosome 5
  Distance between a terminus base of telomere on chromosomal short arm and 5'-terminus of this base sequence : 127999937
  Distance between 3'-terminus of neighbour sequence of sequence listing upward to telomere on chrosomal short arm and 5'-terminus of this base sequence : 7597
aaccctcaagcagtctagggagaagaggttgtatcagagtcagggttttacagagaaagagaaccaaaaggatgtatcgatatagatacagagataggtaggtaggtaggtagatagatagatatataggatagatagatagatagatagatagataaatagatatacagatagattcatagatacatagacaaatgaaaaggcttataataagaaactggttcttaccactgtggagtctaacaagtcctaaagtctgctgtcagcaagctggagaccaggagagctgattatgtaagtttcagtctaagtctgaaggtctgagaaccaggagagatgatggtgta

SEQ ID NO: 9079 - DNA, 387 bp, Homo sapiens
  AC010587.3_104056
  Located on chromosome 5
  Distance between a terminus base of telomere on chromosomal short arm and 5'-terminus of this base sequence : 128185581
  Distance between 3'-terminus of neighbour sequence of sequence listing upward to telomere on chrosomal short arm and 5'-terminus of this base sequence : 185297
cactcgactagatcattactatcagcatacagtcattctaaaatctctcaactgcatattatcctacagactctatctcgtttctccactcccccacattaggacattgttctaggaatttacctctctctctctctctctctctctctctctctctctctctcacacacacacacactcactcacatacacaccaatttttccaataagcttataaacattctattatttcttccactgctaaaagaagaaaaactcataatcccacaacagctccagctactgtcctatgtcattccttctcctggaagaaaactcctaggaacagtatttaatataatgtctccaatttctctttttccactttccttagaatccttagacttc

SEQ ID NO: 9080 - DNA, 387 bp, Homo sapiens
  D5S1495
  Located on chromosome 5
  Distance between a terminus base of telomere on chromosomal short arm and 5'-terminus of this base sequence : 128186639
  Distance between 3'-terminus of neighbour sequence of sequence listing upward to telomere on chrosomal short arm and 5'-terminus of this base sequence : 671
tccaaaaaatgatttgaggcagatgatatgtatatggtattgctatttataccctgcgtgcagaatatgctgtcacttacgaaggagataaatgctaatttctttcataaaatgtaagagtaaccattcgaaaactgaggagggggaacaggctaaaaagcatttatttaagtaataactgaccagaaatttgtatagatagatagatagatagatagatagatagatagatagataatttttaaaaataccagagggcaatgtcaagattagggtatatttgaggtaagagaaaacaagaagattcttgatttgaagagtgaagatgtcaaatgagcctacactctctttttacacacacacacgcaaaaagagagacatctttta

SEQ ID NO: 9081 - DNA, 399 bp, Homo sapiens
  chr5.fa.O7frz.139538206
  Located on chromosome 5
  Distance between a terminus base of telomere on chromosomal short arm and 5'-terminus of this base sequence : 128437212
  Distance between 3'-terminus of neighbour sequence of sequence listing upward to telomere on chrosomal short arm and 5'-terminus of this base sequence : 250186
ccttcatctggtgtatctcagcttttcctatatggctaccttcacagtgagaaaataattgaaatatatatatatatatacacacacatacacacacacacacacacgtacacacacacacacacacacaaattcagagatttatgcctgaaaattcatcacaaatgtgtggttttttttttttaagttagatgagtagtttgggttttttgagggtggcccactgttttcttcaaaatttatcagaaaggaaatttaagtaaaggaagaataagcaaaggtaaacagagaggaaggaaaagtaattctgccagaaaagatgacccattttattgggtaagatttcacccagaacaaaagaaaaagacattgtaggggtaggtccaaagtggtaaagac

SEQ ID NO: 9082 - DNA, 121 bp, Homo sapiens
  DISO7_10002016
  Located on chromosome 5
  Distance between a terminus base of telomere on chromosomal short arm and 5'-terminus of this base sequence : 128539738
  Distance between 3'-terminus of neighbour sequence of sequence listing upward to telomere on chrosomal short arm and 5'-terminus of this base sequence : 102127
caatatccaaatcctacacctgtaaaaactggaggaggaggaggaggaggaggaggaggaggaggaggaagtagaggaaaaggagggagaggaggaaaaggggaatatacaggcatgaatt

SEQ ID NO: 9083 - DNA, 284 bp, Homo sapiens
  DISD22_0008826
  Located on chromosome 5
  Distance between a terminus base of telomere on chromosomal short arm and 5'-terminus of this base sequence : 128803684
  Distance between 3'-terminus of neighbour sequence of sequence listing upward to telomere on chrosomal short arm and 5'-terminus of this base sequence : 263825
attggcttagagggattcacaaatctatttgaggtaggactgaatcatcccacaaatccttaaatgtcttctgtgttcaaggcaccatgctagtgcacactgtaggataccaggaaaaattaaaactaatttatgccttcagagacttcacaacttagaagagaaatgaatatgctcagaattaactgtaaaaaaaaaaaaaaagaaagaaagaaagaaggaaggatagaaagaaagaaagaaagaaaagaaaaaaaaagcaaagctataatgcccaagtgaca

SEQ ID NO: 9084 - DNA, 381 bp, Homo sapiens
  HUMUT2042
  Located on chromosome 5
  Distance between a terminus base of telomere on chromosomal short arm and 5'-terminus of this base sequence : 128988586
  Distance between 3'-terminus of neighbour sequence of sequence listing upward to telomere on chrosomal short arm and 5'-terminus of this base sequence : 184618
cacctgtagtcccagctacctgggaggctgaggaaggtgaggctgcagtgagtcatgcttgtaccactacactccagcctgggcatcagagtgagagtctgttggaaaggaaaggaggaaggaggaaggaggaagcaggaaaggaggaaaggaaaagaaaggaaaggaaaggaaaggaaaggagaaaggagaggaaaggacaggagaaaggagaggaaaggaaaggagaaaagaaaagaaaagaaaagaaggaaggaaagagagagagaaagaaagagagtagtggaggaaggaagggaagaaagggaaagaaggaagggtaggaaggtaagaaaagaaaaggaaggaaaggaaaaaagactgacaaggtagttaagtagt

SEQ ID NO: 9085 - DNA, 253 bp, Homo sapiens
  AC005353.1_80479
  Located on chromosome 5
  Distance between a terminus base of telomere on chromosomal short arm and 5'-terminus of this base sequence : 129022377
  Distance between 3'-terminus of neighbour sequence of sequence listing upward to telomere on chrosomal short arm and 5'-terminus of this base sequence : 33410
attaaggaacctggtttaatcatttgagatctcaagaatagaaatctccaggcatatatatatatatatatatatatatatatatatatatatatatatttatatagacagacagaggaaatttattttaaggaatttactgatatggttgcagaggttggcaaacccaaaatctgtaaggtaggccagcatattacagacccagggaagagttgatgttgcagtttgtgtccaaaggtagtctgttgataga

SEQ ID NO: 9086 - DNA, 173 bp, Homo sapiens
  D5S649
  Located on chromosome 5
  Distance between a terminus base of telomere on chromosomal short arm and 5'-terminus of this base sequence : 129028448
  Distance between 3'-terminus of neighbour sequence of sequence listing upward to telomere on chrosomal short arm and 5'-terminus of this base sequence : 5818
atgcccacaacacacacacacacacacacacacacacacatatacacacacacacatatatatatatatatagaaagagagagagattgagagaattacttaacaagcagtgatgaaaacttaagacatgtttgttgtatgaatgaaccttacttagtgaaaacttgaaaggg

SEQ ID NO: 9087 - DNA, 153 bp, Homo sapiens
  AC005352.1_54961
  Located on chromosome 5
  Distance between a terminus base of telomere on chromosomal short arm and 5'-terminus of this base sequence : 129070153
  Distance between 3'-terminus of neighbour sequence of sequence listing upward to telomere on chrosomal short arm and 5'-terminus of this base sequence : 41532
aggtgatcatagtatttcaaccagactaaaaaaataaacataaaaatcagagacacatatatatatatatatatatatatatatatatatatatatatatatacacatcctggtcctatgttatgtgacaactggataagatgaccaattctg

SEQ ID NO: 9088 - DNA, 365 bp, Homo sapiens
  AC005352.1_50474
  Located on chromosome 5
  Distance between a terminus base of telomere on chromosomal short arm and 5'-terminus of this base sequence : 129074484
  Distance between 3'-terminus of neighbour sequence of sequence listing upward to telomere on chrosomal short arm and 5'-terminus of this base sequence : 4178
gaatcgcctaagaacttgttagaaatataaattctgggccccattccagacgtattaaataaaaaatgttgagtatggggcctagcaatctgtgttttaacaagtcttccaggtaatcctgatgcacactaaactttgagaatcaagaccaatctcaaatgctgccatctaaaattcttttattctttctttctttctttcttttctttctttctttctttctttctttctttctttctttctttctttctttctttctctcgctctctctctctttcttgtttttttgttttgttttgagacagggtctcgctctggctctgtcacctaggctggagtacagtagtaccatctcagcttactgc

SEQ ID NO: 9089 - DNA, 439 bp, Homo sapiens
  AC011332.4_127561
  Located on chromosome 5
  Distance between a terminus base of telomere on chromosomal short arm and 5'-terminus of this base sequence : 129156700
  Distance between 3'-terminus of neighbour sequence of sequence listing upward to telomere on chrosomal short arm and 5'-terminus of this base sequence : 81851
agactcaagtgattactgtggtctggttgagagatagtaaaggttggtggcacaaaggattggatgtgggagtgagaaagaagctgacttgtagattttgaacttgagaaacttaatagatgttggtactgttgcttgagatgagaaatactggaggaggaatagatttggtggttgggagaagtttgtatttgaggctattctgtttcagtagcctataaagacaaagacaacttattccaagagtcgtggaggaggctctgtgtgtgtgtgtgtgtgtgtgtgtgtgtgtgtctgtatataaacatatgtaaatatatatatttacatataaagatttggttgcttaaggtcatggactaaattacttagggagagtggtagataagagaacagaaaatagggtctggcattggacttggagattgtttaaaggtct

SEQ ID NO: 9090 - DNA, 109 bp, Homo sapiens
  Z66570
  Located on chromosome 5
  Distance between a terminus base of telomere on chromosomal short arm and 5'-terminus of this base sequence : 129229819
  Distance between 3'-terminus of neighbour sequence of sequence listing upward to telomere on chrosomal short arm and 5'-terminus of this base sequence : 72680
tacagtggcaaagtcaaggggtgtgtgtttgtgtgtgtgtgtgtgtgtgtgtgagagtgcgtgtatgtagggtggtagaaggatacttggagacactgaccccacttgg

SEQ ID NO: 9091 - DNA, 303 bp, Homo sapiens
  chr5.fa.O7frz.141795626
  Located on chromosome 5
  Distance between a terminus base of telomere on chromosomal short arm and 5'-terminus of this base sequence : 129431652
  Distance between 3'-terminus of neighbour sequence of sequence listing upward to telomere on chrosomal short arm and 5'-terminus of this base sequence : 201724
cttagatgactgaacaaagcataggtgattctctaaatccccatttatgcaaaacttagaaataaagaaaatatcccaaatatgcatttatataacacagatacatctttcttcaaaagaaaaaaatccccatattaaaaaatataaagcatcaaaagaaattattctaaagtggcaaaaaataatttccttggcacatatatatatatatatatatattttttttttttttattgcaattcgcattcttcaattggaatttctttaaagcctgcttttgtcctatgtcacttaggctaagtt

SEQ ID NO: 9092 - DNA, 443 bp, Homo sapiens
  chr5.fa.O7frz.141923008
  Located on chromosome 5
  Distance between a terminus base of telomere on chromosomal short arm and 5'-terminus of this base sequence : 129558948
  Distance between 3'-terminus of neighbour sequence of sequence listing upward to telomere on chrosomal short arm and 5'-terminus of this base sequence : 126993
agattcctatacaaagtgatggttatatgggggcctcataaccaccatgggtagatgcaggttattgtcatggtcctagcttttggttttggtggcttcatgggtgcttattacattgtaatagcaaagcaaaagtaggtcatggatcaataataataagaatcatgaatcaaatactatgattaatacaatattatgcacctgaaagagaaaaggggagcaccacatatagagagagtagtctagatagataaatagatagataaatagtatgtatgtatagatagatagatagatagatagatagatagatagatagacagacagacagacagaaagacaggagaaatgctgaaataaataaatgaaagcatcataaaaaagaaaaagaaattgatctgtttttctgttttgaaagtcttaatttcagtaggccatgtagt

SEQ ID NO: 9093 - DNA, 209 bp, Homo sapiens
  DISO7_10002024
  Located on chromosome 5
  Distance between a terminus base of telomere on chromosomal short arm and 5'-terminus of this base sequence : 129624624
  Distance between 3'-terminus of neighbour sequence of sequence listing upward to telomere on chrosomal short arm and 5'-terminus of this base sequence : 65233
  misc_feature (1)...(209): n = A,T,G or C
cagcagtccaagtaccagagaacagacacacacacacacactctcacacacacactcacactctcacacacacacactcatacacactctcacgcacacactcacacgcacactcacacacacacacacacacacccctgtttccatgtgtaaataaatgagtggtaagataaatatactatttctgtcttggagctntataatcagct

SEQ ID NO: 9094 - DNA, 229 bp, Homo sapiens
  DISO7_10002028
  Located on chromosome 5
  Distance between a terminus base of telomere on chromosomal short arm and 5'-terminus of this base sequence : 129759766
  Distance between 3'-terminus of neighbour sequence of sequence listing upward to telomere on chrosomal short arm and 5'-terminus of this base sequence : 134933
aaatgccaagaacatctgtgaaaaacaatgtccctgtttaagtcctttgcaagcattaaatttttacaaaataatttatttcttttgtaaattatatttctagttgcaatggtagttttactaaacatagacacacacacacacacacacacacacacacactaaattatcttctttagaagtaaagttgtataaaaaaatgaaaattgttcgttatcgtcatgaattg

SEQ ID NO: 9095 - DNA, 112 bp, Homo sapiens
  DISO7_10002029
  Located on chromosome 5
  Distance between a terminus base of telomere on chromosomal short arm and 5'-terminus of this base sequence : 129764714
  Distance between 3'-terminus of neighbour sequence of sequence listing upward to telomere on chrosomal short arm and 5'-terminus of this base sequence : 4719
ccttggtatgaacatacatatgtgtatgtgtgtgtgtgtgtctgtgtgtgtgtgtgtatatatatatatatggaacatttttgctgttttgcttaggatggtagaacctgtt

SEQ ID NO: 9096 - DNA, 134 bp, Homo sapiens
  AC004748_97069
  Located on chromosome 5
  Distance between a terminus base of telomere on chromosomal short arm and 5'-terminus of this base sequence : 129830789
  Distance between 3'-terminus of neighbour sequence of sequence listing upward to telomere on chrosomal short arm and 5'-terminus of this base sequence : 65963
aactaacctgcacgttgtgcacatgtaccctaaaacttaaagtataataataataataataataaaagaaatgatagctttgatagtttctcagtagctaggtattatagttcattttgagtaaaaactaaatg

SEQ ID NO: 9097 - DNA, 450 bp, Homo sapiens
  AC008588.4_202408
  Located on chromosome 5
  Distance between a terminus base of telomere on chromosomal short arm and 5'-terminus of this base sequence : 130057982
  Distance between 3'-terminus of neighbour sequence of sequence listing upward to telomere on chrosomal short arm and 5'-terminus of this base sequence : 227059
atgtatggtggctaaatgtcagccctgcaccacaagagaaatgaagtgacatgatttctatagtagtttttttgaagagtcttaaattttatacccattgaaaaatcaaaagaagttccagttttataaagagaaaaaattatggtccacttctccattccctaacttacttcactgccccccaaccccccaaaaaatcttacaatgtgccttttatactctctgtcttcttcttcttcttcttaaatagggtctcactctgttgcccgggctggagtgcagtggtacaatcacagctcactgaagcctcaatctcccagcctcaaactatcctcccacctgaacctcctgagtagctagaaatacaggtgtgcaccaccagacttgaataatttttaaatttttatttgtatttttttttttgtagacattagttctcactatgttgcc

SEQ ID NO: 9098 - DNA, 450 bp, Homo sapiens; identical to SEQ ID NO: 9097
  AC008437.5_168973
  Located on chromosome 5
  Distance between a terminus base of telomere on chromosomal short arm and 5'-terminus of this base sequence : 130057982
  Distance between 3'-terminus of neighbour sequence of sequence listing upward to telomere on chrosomal short arm and 5'-terminus of this base sequence : -450

SEQ ID NO: 9099 - DNA, 213 bp, Homo sapiens
  AC005723.1_99610
  Located on chromosome 5
  Distance between a terminus base of telomere on chromosomal short arm and 5'-terminus of this base sequence : 130090954
  Distance between 3'-terminus of neighbour sequence of sequence listing upward to telomere on chrosomal short arm and 5'-terminus of this base sequence : 32522
cactgaaggacctcagtgatacagtgagttaagaaaaatacaagaaaaatgcaagttacataccataaaaaagtgtgtgtgtatcagaaatgtggatattttatatataaatatatatatatatatatatatatatatatatatatatatatgtatatataaaggggagtttcctaagtattaacttacactatcagaaggttccacaatagg

SEQ ID NO: 9100 - DNA, 199 bp, Homo sapiens
  D5S2078
  Located on chromosome 5
  Distance between a terminus base of telomere on chromosomal short arm and 5'-terminus of this base sequence : 130133861
  Distance between 3'-terminus of neighbour sequence of sequence listing upward to telomere on chrosomal short arm and 5'-terminus of this base sequence : 42694
aatcaaaaaatgccattcaaagaaagtttaagcaattggctagcaggaaaagtggttaccttctcccttcccccgtgtgtgtgtgtgtgtgtgtgtgtgtttgtgtgtatgtaaacttacaaattctttcccctggttaaaataaaacacacacacaaaacaatgatgacaactgtaattacatcctggcaacattgaa

SEQ ID NO: 9101 - DNA, 191 bp, Homo sapiens
  D5S642
  Located on chromosome 5
  Distance between a terminus base of telomere on chromosomal short arm and 5'-terminus of this base sequence : 130161729
  Distance between 3'-terminus of neighbour sequence of sequence listing upward to telomere on chrosomal short arm and 5'-terminus of this base sequence : 27669
ctagaccatagataaccctgtgatcattctaagaagtttgcatttttttggtcaagatctgagtcgttgaaggttctggtgtgactgtgtgtgtgtgtgtgtgtgtgtgtgtgtgtatacatgcaatgtttttgttaaaatcaaataaaaacacatacatgatttttttgtaagtccagaagtaaagagct

SEQ ID NO: 9102 - DNA, 468 bp, Homo sapiens
  AC004636.1_5098
  Located on chromosome 5
  Distance between a terminus base of telomere on chromosomal short arm and 5'-terminus of this base sequence : 130223267
  Distance between 3'-terminus of neighbour sequence of sequence listing upward to telomere on chrosomal short arm and 5'-terminus of this base sequence : 61347
tagacttaccatagtggaagcatcttctttagaaagtgagccatctctaagcatgcagctttaacagggcatctggcatggaggtagaaagcattctgtaaacaaaataaagggttatagaaattctcaatgtccttttacgctatgattctcttattcatgagactatcctctgggggaaaatgatgactggaacttggagcactcaggaatatttgccaaacattgcagaacatttcaaggggtcaagatttatttagctgaagccctaaatgaatatattgattatgaataagtgtgtgtgtgtgtgtgtgtgtgtgtgtgtgtgtgtgtgtgtttatggtttggaaagtgcattagggctactgtaacattttcacaaacttggtggtttaaaaccatagaaatttattatcttacagtcctgatggccagagtccaaaatcaagatgctagaaggacctcact

SEQ ID NO: 9103 - DNA, 426 bp, Homo sapiens
  AC006959.1_17504
  Located on chromosome 5
  Distance between a terminus base of telomere on chromosomal short arm and 5'-terminus of this base sequence : 130379495
  Distance between 3'-terminus of neighbour sequence of sequence listing upward to telomere on chrosomal short arm and 5'-terminus of this base sequence : 155760
gaatgaagtaccaggtagcctcctgatcctgctcattgggaaggcttacagaaaaaactctgaactggcagtttgcagcagtttttaacttcctgaactggtctcctgctgcttcccaccttatcatggttgtctttttctgctatactaacgtgtgtgtatgtgtgtgtgtgtgtgtgtgtgtgtgtgtgtgtgtgtgtgtattggaagttaatttgtctttttttgttgttgataagtctgcatatcaaaagtagccacatccaaacttgaggcagagactgatgaattgaacacagtggtccacaatactgagctatgactgtgattttggggttgccttcttggggtgggaatagatatattctgtgtatggaacagagtgtgaaccaattgaaccaatatctggtaatcagaatagtggcc

SEQ ID NO: 9104 - DNA, 151 bp, Homo sapiens
  D5S2120
  Located on chromosome 5
  Distance between a terminus base of telomere on chromosomal short arm and 5'-terminus of this base sequence : 130379632
  Distance between 3'-terminus of neighbour sequence of sequence listing upward to telomere on chrosomal short arm and 5'-terminus of this base sequence : -289
ttctgctatactaacgtgtgtgtatgtgtgtgtgtgtgtgtgtgtgtgtgtgtgtgtgtgtgtgtattggaagttaatttgtctttttttgttgttgataagtctgcatatcaaaagtagccacatccaaacttgaggcagagactgatga

SEQ ID NO: 9105 - DNA, 272 bp, Homo sapiens
  DISO7_10002026
  Located on chromosome 5
  Distance between a terminus base of telomere on chromosomal short arm and 5'-terminus of this base sequence : 130584157
  Distance between 3'-terminus of neighbour sequence of sequence listing upward to telomere on chrosomal short arm and 5'-terminus of this base sequence : 204374
ttaataggtttacatactgcaggtcaaaaatctttaagtatataaatgcaatgctgaatttttttccagcattactgagaaataattgacaaacactgcaaatatttagggtgtgtgctgttttgatatatgatatatactgtaaaataattgccacagcaaagctaattaacatatccatcatctcacaggtgtgtgtgtgtgtgtgtgtgtgtgtgtgtgtgtgtgcatgaacatttaagaactactctcttaccgtatatcaaggagcc

SEQ ID NO: 9106 - DNA, 327 bp, Homo sapiens
  AC025177.3_86910
  Located on chromosome 5
  Distance between a terminus base of telomere on chromosomal short arm and 5'-terminus of this base sequence : 130786087
  Distance between 3'-terminus of neighbour sequence of sequence listing upward to telomere on chrosomal short arm and 5'-terminus of this base sequence : 201658
cattcacagatttccacttagagaacctcctctacagtgtattttccagacccaattgttttatttttaaatccacaaacttttattatttcattgtaactaattctgaccatcatatcatagacttttcctcccttaaaacacacacacacacacacacacacacacacacacacacacacacacctgggtttcctcaaaaatctaagcctgtccatggaaggaacatcatcatcctgccagtgacaatggatacaaggcagaaaaggactctgcaagctggtgggagggcagagagaggggatggtggaatcaggacaagatatg

SEQ ID NO: 9107 - DNA, 430 bp, Homo sapiens
  L81683.1_871
  Located on chromosome 5
  Distance between a terminus base of telomere on chromosomal short arm and 5'-terminus of this base sequence : 130834230
  Distance between 3'-terminus of neighbour sequence of sequence listing upward to telomere on chrosomal short arm and 5'-terminus of this base sequence : 47816
gctgtaacatgaagttgctaagggccaggcacggtggctcacgcctgtaatcccagaactttgggaggccgagacgggtggataacttgaggtcaggagttggagaccaccctggctaacacggtgaaaccccatctctactaaaaatacaaaaattagttgagtgtagtggcaggtgcctgtaatcccagctactcaggaggctgaggcaggagaatcgcttgaacccaggaggcagaggttgcagtgagccgagatcacaccactgcactccagcctgggtgacagagggaaactcagtctcaaaaaaagaaaagaaaagaaaagaaaagaaaagaaaaagaagttgctaggaccccactagaacccacactcaagagtaaagctagagccctggcaacccctcccaggataacgtcagagcaagctg

SEQ ID NO: 9108 - DNA, 310 bp, Homo sapiens
  AC025177.3_26053
  Located on chromosome 5
  Distance between a terminus base of telomere on chromosomal short arm and 5'-terminus of this base sequence : 130879616
  Distance between 3'-terminus of neighbour sequence of sequence listing upward to telomere on chrosomal short arm and 5'-terminus of this base sequence : 44956
acagtccgtttccagactttgaagagggagggaagagcctggccacatcaccttccgaggtggtgtggtgtgcaggaaggatgagagaccagccagccctagagctgtgtgtgtatgtgtgtgtgtgtgtgtgtgtgtgtgtgtgtgtgtatgtgtgacgccttctgagacaggacaattggtgaatgcattagcattggcatgcacattaatctttgagggaactgcagcccagccatggcttattggaaagattatagccccgaggaaagacacacattggttagtaatgacctgaagtttatgagtc

SEQ ID NO: 9109 - DNA, 475 bp, Homo sapiens
  L81414.1_1889
  Located on chromosome 5
  Distance between a terminus base of telomere on chromosomal short arm and 5'-terminus of this base sequence : 130889223
  Distance between 3'-terminus of neighbour sequence of sequence listing upward to telomere on chrosomal short arm and 5'-terminus of this base sequence : 9297
gcattggtgctaatgttctgggttttggccattcaaataggtgtgtggtatctcattgattcaatttggaatttccttccttccttccttccttccttccttccttccttccttccttccttccttcctttcacagggtctagctctgtcacctaggctggggtgcagtggcacaatcagggctcactgtagccttggcctcctgggcttaaatgatgcttttgcctcagtcctctgagtagatgggactacaggctacttaaaaaaaaatctttttttgagatgaggtttcaccatgttacccaggcaggtgttgaactcctggtttcaaatgatcctcctgccttggcctcccaaagtgctgtgattacaggcaagagccaagtaataacagtgcttggccaaatttgtaattttttttaatgacatataatgtagggcacctttttatatgcttatttggcatagctttgat

SEQ ID NO: 9110 - DNA, 162 bp, Homo sapiens
  DISO7_10002032
  Located on chromosome 5
  Distance between a terminus base of telomere on chromosomal short arm and 5'-terminus of this base sequence : 131097952
  Distance between 3'-terminus of neighbour sequence of sequence listing upward to telomere on chrosomal short arm and 5'-terminus of this base sequence : 208254
tctgtatgccattatgcatagagaaaaggtttctagaaaattctgaattatataggttaataaaggataaatacagagttcatgtttggcaaatgttgtgcataaagtttctgagatatatatatatatatatatatagtaggcatgattgttacatgtaaa

SEQ ID NO: 9111 - DNA, 414 bp, Homo sapiens
  chr5.fa.O7frz.143506275
  Located on chromosome 5
  Distance between a terminus base of telomere on chromosomal short arm and 5'-terminus of this base sequence : 131148866
  Distance between 3'-terminus of neighbour sequence of sequence listing upward to telomere on chrosomal short arm and 5'-terminus of this base sequence : 50752
gcataggatgaactttcacactctattatattaatatctattggtatatcttacactttaaatggatcttttaaccctgcatgactttttagtatcaattatctattgattggaatatattagttcactgagtcaggcagatcttctaaatgttgacacatttcaccctactatctatctatctatctatctatctatctatctatctatctatctaatctatctgttaatatcaccatctatattatcagaaaagtatttaagttttgagaagctgtcaagctcatggtgacagatgaaagttttccaatattctaatttttcacttgaaaacttgaattttattcttggcaagaaaaatagtcataataccatcagttggttttcatagagtgacaagttcactttgttcat

SEQ ID NO: 9112 - DNA, 176 bp, Homo sapiens
  AC005179.1_10798
  Located on chromosome 5
  Distance between a terminus base of telomere on chromosomal short arm and 5'-terminus of this base sequence : 131373101
  Distance between 3'-terminus of neighbour sequence of sequence listing upward to telomere on chrosomal short arm and 5'-terminus of this base sequence : 223821
gagcatttgaatttctggattagggatacccaaactgtgtgtgtgtgtgtgtgtgtgtgtgtgtgtgtgtgtgtgtgtgtgtatcctcatccttttcaactcttggaaaatattccagagtataaataagccaccttttctttcattgtaccctaactttggaaactcagtctgtt

SEQ ID NO: 9113 - DNA, 423 bp, Homo sapiens
  AC005179.1_4177
  Located on chromosome 5
  Distance between a terminus base of telomere on chromosomal short arm and 5'-terminus of this base sequence : 131379569
  Distance between 3'-terminus of neighbour sequence of sequence listing upward to telomere on chrosomal short arm and 5'-terminus of this base sequence : 6292
ataggcattatgtctgcaacttactctcagaaagttcaggaaaaaaaaatgagggaaacacaataaggcaaatatggtaaaatgttagcatttgtagaatctgggtaaaggaaattctcatacccttcaacttttgcactttttttgtaaatctgaattatttcaaaataaaaaggttttaaaaatatatatatttacacacacacacacacacacacacacacacacacacacagtggccagatgcagcggctcatgcctgtaattctggcactttgggaagctgaggtgggaagattgcttgaggccaggagtttgagaccagcttgggaaacacagcgagactctgtctctacaaaaaattgtttaaaaattagctaggcatggtggtgcacacctgtattcctagctactcaagaggct

SEQ ID NO: 9114 - DNA, 248 bp, Homo sapiens
  D5S666
  Located on chromosome 5
  Distance between a terminus base of telomere on chromosomal short arm and 5'-terminus of this base sequence : 131385470
  Distance between 3'-terminus of neighbour sequence of sequence listing upward to telomere on chrosomal short arm and 5'-terminus of this base sequence : 5478
gtgcctggcttatttcacttaacataatgtcttccaggttcatgtatgttgtcacaaatgacaagatttccttgtttttatggctgaataatattgcattgtgtgtgtgtgtgtgtgtgtgtgtgtgtgtgtgtgtgtgtgtgtgtgtatgcaccacattttttttaatcaactgtcactggattcttaggttgattccgtatcttggttattgtgaatagtgccaagataaacatgagaatgcagct

SEQ ID NO: 9115 - DNA, 217 bp, Homo sapiens
  AC008633.3_107701
  Located on chromosome 5
  Distance between a terminus base of telomere on chromosomal short arm and 5'-terminus of this base sequence : 131430481
  Distance between 3'-terminus of neighbour sequence of sequence listing upward to telomere on chrosomal short arm and 5'-terminus of this base sequence : 44763
ccgaagagatcctaaatggtactttgggaccatccttagaactttaaaaagaaaaattgccaggcaaaactagcaccttctcttattattattattattattactattattattattatttttgagacagaggctcactctgtcgcccaggctggagtgcagtggcatgaccttggctcattgcagcctccacctctcaggttcaagtgattcttgt

SEQ ID NO: 9116 - DNA, 328 bp, Homo sapiens
  chr5.fa.O7frz.145258620
  Located on chromosome 5
  Distance between a terminus base of telomere on chromosomal short arm and 5'-terminus of this base sequence : 131604632
  Distance between 3'-terminus of neighbour sequence of sequence listing upward to telomere on chrosomal short arm and 5'-terminus of this base sequence : 173934
cttctgccatgactgtaagttttctgaggcctcaccagaatcagatactgtcgccatgcttcttgtatagcttgcagaaccatgaaccaaataaatctcttttctttctttctttctttctttctcttttcttttcttttgcctgcctgcctgccttccttcctgctttccttccttcttccttccttccttccttccttccttccttccttccttccttccttccgtccttccttccttccttctttccttccttcctcctttcctttcctttctcttttcttttgtcttttcttttctttctgtttcttagatggagtttcactct

SEQ ID NO: 9117 - DNA, 268 bp, Homo sapiens
  D5S2110
  Located on chromosome 5
  Distance between a terminus base of telomere on chromosomal short arm and 5'-terminus of this base sequence : 131902092
  Distance between 3'-terminus of neighbour sequence of sequence listing upward to telomere on chrosomal short arm and 5'-terminus of this base sequence : 297132
ctgaacagttttcaaaagccattactaatgatatttcagaggaaaaacttggcccttctatcctcccaaataaaaatatcagacctgtccatttaagggtaggaatgttaccctacacacacacacacacacacacacacacacacacacacacacacacacacactctctctctctctcacacacacactcactctccctccctccctcctaataaaaaatggtgactgatacaagaataaaacagcaatatcttggaatcaagttc

SEQ ID NO: 9118 - DNA, 193 bp, Homo sapiens
  AC004227.1_62603
  Located on chromosome 5
  Distance between a terminus base of telomere on chromosomal short arm and 5'-terminus of this base sequence : 131913434
  Distance between 3'-terminus of neighbour sequence of sequence listing upward to telomere on chrosomal short arm and 5'-terminus of this base sequence : 11074
aaggatgacatcacctgtacagaaagcctccagaaactgcattagatcaattggctactgtatctgcagatgtagccccaagagcaatttattgaaaacatacacacacacacacacacacacacacacacacacacacacacaccccatcctcctttccatgagacacgtcagcaagctaaattctttaaga

SEQ ID NO: 9119 - DNA, 116 bp, Homo sapiens
  D5S2057
  Located on chromosome 5
  Distance between a terminus base of telomere on chromosomal short arm and 5'-terminus of this base sequence : 131913492
  Distance between 3'-terminus of neighbour sequence of sequence listing upward to telomere on chrosomal short arm and 5'-terminus of this base sequence : -135
tgtatctgcagatgtagccccaagagcaatttattgaaaacatacacacacacacacacacacacacacacacacacacacacacaccccatcctcctttccatgagacacgtcag

SEQ ID NO: 9120 - DNA, 284 bp, Homo sapiens
  AC005576.1_942
  Located on chromosome 5
  Distance between a terminus base of telomere on chromosomal short arm and 5'-terminus of this base sequence : 131965575
  Distance between 3'-terminus of neighbour sequence of sequence listing upward to telomere on chrosomal short arm and 5'-terminus of this base sequence : 51967
actcaattccaggtagactacagatttaactgtgaaaggaaaacaagaaaagttctagaaaataagaaaaaaaaaaaactatacatacatacatacatacatacatacatacatacatacatacatatatatctccatggccttgtgaaagcaaagtatcttgagcctcccaaatcactaagctaaagggaaaagtcaagctggaaactgcttagggcaaagctgcctcccattctattcaaagtcacccctctgctcactgagataaatgcatacctgattgc

SEQ ID NO: 9121 - DNA, 267 bp, Homo sapiens
  AC004621.1_5198
  Located on chromosome 5
  Distance between a terminus base of telomere on chromosomal short arm and 5'-terminus of this base sequence : 132047641
  Distance between 3'-terminus of neighbour sequence of sequence listing upward to telomere on chrosomal short arm and 5'-terminus of this base sequence : 81782
atgaagatcacaagttctgataagtttttctcacaaattgtttttatctatatttgccataatttctctactatacaataaaacaccaaactttacaacttaggtaactttctacagacacagaaggtttaaaccttattggctaacaattgactgttgctcactaagccacattttctcatccataatttcccacttggctttcttcacttctgtttttttgtttgtttgtttgtttgtttgtttgttttgaaatggttgtcttgc

SEQ ID NO: 9122 - DNA, 247 bp, Homo sapiens
  AC004620.1_22775
  Located on chromosome 5
  Distance between a terminus base of telomere on chromosomal short arm and 5'-terminus of this base sequence : 132075296
  Distance between 3'-terminus of neighbour sequence of sequence listing upward to telomere on chrosomal short arm and 5'-terminus of this base sequence : 27388
gaggcacataatcacttgaaccctgggaggcagaggctgcagtgagttgagatcgtgctactgcactccagcctgggccacagagtgagacactgtctcaaataaataaataaataaataaataaataaataaataaataaataaagcattaactgggaaaactgtaggttggggaagagggctatatgaaaaaactgctatttgctcaatttttctgtaaatctgaaactgttcaaattaagtctc

SEQ ID NO: 9123 - DNA, 271 bp, Homo sapiens
  AC005178.1_25751
  Located on chromosome 5
  Distance between a terminus base of telomere on chromosomal short arm and 5'-terminus of this base sequence : 132244283
  Distance between 3'-terminus of neighbour sequence of sequence listing upward to telomere on chrosomal short arm and 5'-terminus of this base sequence : 168740
gtctggaaacctattagcagttgttggtgggggtgtcttctattcattctagttatgccaacccattctcttttttgcctggttacccttgctctcttttcctctcctttggtgtttcatatgcttgcaatatacccacctgcccatcaattcattcatccattcaccctcccatccatccatccatccatccatccatccatccatccatccatccagaggctgacttcaaactctcccataaaaggaaagattaggattcagattctgc

SEQ ID NO: 9124 - DNA, 249 bp, Homo sapiens
  Z23761
  Located on chromosome 5
  Distance between a terminus base of telomere on chromosomal short arm and 5'-terminus of this base sequence : 132256094
  Distance between 3'-terminus of neighbour sequence of sequence listing upward to telomere on chrosomal short arm and 5'-terminus of this base sequence : 11540
attggtcaagccaggattcaaaccttgacaatctgcctccaaagcccttcagttatatggctgcctggacaggggtatgagtgtgtgtgtgtgtgtgtgtgtgtgtgtgtgtgttttcataaatctacatatgcaggaattcatgtgccaggcaaccaaggggtcgtatgtgatggggttcttttatttccttgataagaggacccctcttgcctttcaggaacctttccccacctaattccagaaatt

SEQ ID NO: 9125 - DNA, 216 bp, Homo sapiens
  D5S2117
  Located on chromosome 5
  Distance between a terminus base of telomere on chromosomal short arm and 5'-terminus of this base sequence : 132283782
  Distance between 3'-terminus of neighbour sequence of sequence listing upward to telomere on chrosomal short arm and 5'-terminus of this base sequence : 27439
aatcagaaggtgtgtgcggaagaactaagaaccagcgatgaacagtaacagattattgtgcagtactgaactgtgtcctccaaccatggtcacctgcattcctcagcaatgccattcagggaacctgaggctggcctgtggggtgtgtgtgtgtgtgtgtgtgtgtgtgtgtgtgtgtgtgtgtttctgtgtctttctgactaggttctcacctgg

SEQ ID NO: 9126 - DNA, 190 bp, Homo sapiens
  AC005571.1_14757
  Located on chromosome 5
  Distance between a terminus base of telomere on chromosomal short arm and 5'-terminus of this base sequence : 132283804
  Distance between 3'-terminus of neighbour sequence of sequence listing upward to telomere on chrosomal short arm and 5'-terminus of this base sequence : -194
aactaagaaccagcgatgaacagtaacagattattgtgcagtactgaactgtgtcctccaaccatggtcacctgcattcctcagcaatgccattcagggaacctgaggctggcctgtggggtgtgtgtgtgtgtgtgtgtgtgtgtgtgtgtgtgtgtgtgtttctgtgtctttctgactaggttctcac

SEQ ID NO: 9127 - DNA, 205 bp, Homo sapiens
  DISD22_0008842
  Located on chromosome 5
  Distance between a terminus base of telomere on chromosomal short arm and 5'-terminus of this base sequence : 132485721
  Distance between 3'-terminus of neighbour sequence of sequence listing upward to telomere on chrosomal short arm and 5'-terminus of this base sequence : 201727
gggaacatattaagaggagagtgaaaagaggggccaatttcctttctttgaaagggacaacataatttttatcatgaccctgttttccaactcaccatatagaatcataaataatgtgaaaatctaaatctatctatctatctatctatctatctatctatctatctatctatctaattttaaagatgaactgctaccttaggga

SEQ ID NO: 9128 - DNA, 443 bp, Homo sapiens
  chr5.fa.O7frz.148869374
  Located on chromosome 5
  Distance between a terminus base of telomere on chromosomal short arm and 5'-terminus of this base sequence : 132690677
  Distance between 3'-terminus of neighbour sequence of sequence listing upward to telomere on chrosomal short arm and 5'-terminus of this base sequence : 204751
gctttgatatgaatagcagaatagtgaataaggatgaagcatccaacccttctccaaggtcactggagtgaaaaatatcttattgggcgccccagatatgtccagtcagtcagcaacagagcctagcttgtaacttccgtagaatttctttgctaattcggagggtttgtttgtttgtttgtttgtttgtttagggagtaaaaatcaaatttgcattcatcccaggatgtttcaaggacagatttacagcaacaaacattggtgaactaaaactgggagattgcactgtagagttaggatatggaacagaaaaatgtttaaagctccagtaaactacctagaaatgtaattaagtcccttgcaagaggccaaaatgccaaaaatgtgacagtcaccctgttcttgaagaaccacttctggaggtaatcagtctgttatgacag

SEQ ID NO: 9129 - DNA, 428 bp, Homo sapiens
  AC008500.4_130852
  Located on chromosome 5
  Distance between a terminus base of telomere on chromosomal short arm and 5'-terminus of this base sequence : 132779977
  Distance between 3'-terminus of neighbour sequence of sequence listing upward to telomere on chrosomal short arm and 5'-terminus of this base sequence : 88857
aggtaaacactgagctcagttatgtgttctctccttggtgtcacgtgcttagggggattctgacacacaggtgacctccagggggcaaagactaggatcacacacagtctaaaaactttattccacaggacaataaattttaaaaaatagatagatagatagatacatacatacatacatacatacatagatacatagatacatagatacatagatagataattcccctgccagtcctcaaatctcagcatgaagcattatctccctggcgggagaaacatgaaaactgtctccaaagctgatggccctttacctggaagtttgatgaggtgtgtttggcagccccagcaggcacatgttcggcctgtgggtgggtgacagggaggccaatttcaaatgccctgcttgtcagtgtcatggatttcaat

SEQ ID NO: 9130 - DNA, 112 bp, Homo sapiens
  DISO7_10002038
  Located on chromosome 5
  Distance between a terminus base of telomere on chromosomal short arm and 5'-terminus of this base sequence : 132869112
  Distance between 3'-terminus of neighbour sequence of sequence listing upward to telomere on chrosomal short arm and 5'-terminus of this base sequence : 88707
agccttggagaacactgccacacacacacacacagacacacacacacacacacacacacgctaggcttaaaggcccagaggaccccaggaagcgcagcacacctttaggatg

SEQ ID NO: 9131 - DNA, 134 bp, Homo sapiens
  DISO7_10002036
  Located on chromosome 5
  Distance between a terminus base of telomere on chromosomal short arm and 5'-terminus of this base sequence : 132946919
  Distance between 3'-terminus of neighbour sequence of sequence listing upward to telomere on chrosomal short arm and 5'-terminus of this base sequence : 77695
atccaggaatattatgcaaggataatttattttaaaaagggagtttcacaggagagacgcatgtgtataaacaaacactacacacacacacacacacacacgcaaagaaaaagacatagaatccaggaatgtgt

SEQ ID NO: 9132 - DNA, 322 bp, Homo sapiens
  chr5.fa.O7frz.187735980
  Located on chromosome 5
  Distance between a terminus base of telomere on chromosomal short arm and 5'-terminus of this base sequence : 133119329
  Distance between 3'-terminus of neighbour sequence of sequence listing upward to telomere on chrosomal short arm and 5'-terminus of this base sequence : 172276
atagtatgtacatggcaatgactcccaaatctgtatctcgtatatcagacctgtctcatatattcagctaactgatcagcattttcacttatatgtcaaacacccaaagtaaactcaacatctcgaagactgaaattctgatctgcacacacacacacacacacacacacacacacacacacacacacacacaccctgctgtttttacagcctaccccatctcaatagatagtaactctctcttagttttcaatccaaaaatgatgtcacttctaacccctctgtttctaccacaccctgcgtgtaatccatcagcaaattt

SEQ ID NO: 9133 - DNA, 283 bp, Homo sapiens
  AC008642.3_25564
  Located on chromosome 5
  Distance between a terminus base of telomere on chromosomal short arm and 5'-terminus of this base sequence : 133193590
  Distance between 3'-terminus of neighbour sequence of sequence listing upward to telomere on chrosomal short arm and 5'-terminus of this base sequence : 73939
tctgcttccttaattaggaaacaaagtataaatattgttaacttctttgaaagatttaaaataatactcagagtgtaggagttggctcctgaaacaatgtgaaatcaaaatcaatgccctactgaaaaaaaaaatgtctgtctatctatctatctatctatctatctatctatctatctatctatctatctatctatgtatcttttggaaaggatgtgctgaggcctagcaatgctatatgtcagggatcaacaaacatcttctgtaaagatccagacagtaa

SEQ ID NO: 9134 - DNA, 158 bp, Homo sapiens
  DISD22_0008856
  Located on chromosome 5
  Distance between a terminus base of telomere on chromosomal short arm and 5'-terminus of this base sequence : 133302235
  Distance between 3'-terminus of neighbour sequence of sequence listing upward to telomere on chrosomal short arm and 5'-terminus of this base sequence : 108362
gtggaatcatcccattgcaaaagcagcacaaacaacccccttggaattcattctctctgtttttttttctctctctctctgtttctctctctcacacacacacacacacacacacacacacacagatccacttcccacacatacacaacagacccact

SEQ ID NO: 9135 - DNA, 113 bp, Homo sapiens
  DISO7_10004993
  Located on chromosome 5
  Distance between a terminus base of telomere on chromosomal short arm and 5'-terminus of this base sequence : 133808169
  Distance between 3'-terminus of neighbour sequence of sequence listing upward to telomere on chrosomal short arm and 5'-terminus of this base sequence : 505776
aagctcagaggctgatgcaccacccccgacacccacgcgcgcgcgcgcgcgcacacacacacacacacacacacacaccagcttcactgacaatggctgcagtgcaagaacac

SEQ ID NO: 9136 - DNA, 333 bp, Homo sapiens
  AC023861.3_149147
  Located on chromosome 5
  Distance between a terminus base of telomere on chromosomal short arm and 5'-terminus of this base sequence : 133868219
  Distance between 3'-terminus of neighbour sequence of sequence listing upward to telomere on chrosomal short arm and 5'-terminus of this base sequence : 59937
tcaatctgatgtaggatctgacaccccatgcctggtcctcattaaggactctactggtgagaaatgcagacacacctcatcaattgggcaattggttacctactggtacacacgtacacacacacacacacacacacacacacctgaaaacatgtatgaattctcaggaaaggtataatccaaacccttacagagaaagagaaacattttcctaacaaacatattctgcacagttgccctgtgccacacctgagatagcagattatacagagtggtgttatttttccctttgtccttccctgtactttcaaactatttcaaactatgctcaga

SEQ ID NO: 9137 - DNA, 430 bp, Homo sapiens
  chr5.fa.O7frz.146892752
  Located on chromosome 5
  Distance between a terminus base of telomere on chromosomal short arm and 5'-terminus of this base sequence : 133944915
  Distance between 3'-terminus of neighbour sequence of sequence listing upward to telomere on chrosomal short arm and 5'-terminus of this base sequence : 76363
ccaatgacttatgttaccataaagttagaaactactcagttgttcagcaattagggattggttaagtgattttcctactttcatatgatggaatactagcattatgaaaaactgtatttaatacatggaggattatatactgttatataaaactggttataaaagtatatacagtattgtaattttgttaaaaatgaagtatgagtgtgtgtgtgtgtgtgtgtgtgtgtgtgtgtgtgcgcgcgcctgtgccgaaatcaatggggaaaaaagactggaagaaaatatttccaaatgggttatctctggatcattggactacaggagttgtttgtgttttccagtaatagacatgtcacttttgtcaccagaaaaatatatctatttttaaattaacatgctcctacactgacaggactacctggtattt

SEQ ID NO: 9138 - DNA, 365 bp, Homo sapiens
  chr5.fa.O7frz.147777267
  Located on chromosome 5
  Distance between a terminus base of telomere on chromosomal short arm and 5'-terminus of this base sequence : 134027628
  Distance between 3'-terminus of neighbour sequence of sequence listing upward to telomere on chrosomal short arm and 5'-terminus of this base sequence : 82283
  misc_feature (1)...(365): n = A,T,G or C
tagaaatggtagatgtagctcaagctaataaatacccacaggaatgtgtctttgtggtctggactcagcaaatgctgagttattggtatatttatggaaggaaagcagggcagagacaggagaacaggtgtccctgtgggtgctcggccctgttcactgttgtagcctcaggagccagcctcagctgagcagagagcaggtgccccatgaaccagtgtgacatggttggatggatggatggatggatggatggatggnatggacgaacagacagatggatagataggaatatggatggtggattcagatggcctcagcagcatgcacattttccccacgatggtctttgcaataagacaatttcc

SEQ ID NO: 9139 - DNA, 470 bp, Homo sapiens
  chr5.fa.O7frz.148146755
  Located on chromosome 5
  Distance between a terminus base of telomere on chromosomal short arm and 5'-terminus of this base sequence : 134088663
  Distance between 3'-terminus of neighbour sequence of sequence listing upward to telomere on chrosomal short arm and 5'-terminus of this base sequence : 60670
acttaaagtgcatgaacactttagtagttatgtaattttcttacattagattgctttcagtttttcattaaaatgtaccatgataagccaggcttgggggtgtgtgccaatactcccagatagctctagaggctgagatgggaggattgcttcagcccaggagttcaaggctagcctggacaatatagtgagacccactgtctagaaaaaaaagtatcatgataaaaatctttgtgtatgaatcattgtttgaattatggtgtttatactattcgtatgtgtaaaggacatagaatttggtctataggtttgtttttgcacatatagaagtgaaacaacaatacacacacacacacacacacacacacatatatatatagtttattcgtttttagtggggtcatgtgcctctctagccgctccctgaccccagttccactatgttttcgttacgtattcttccaagcttt

SEQ ID NO: 9140 - DNA, 406 bp, Homo sapiens
  chr5.fa.O7frz.148030876
  Located on chromosome 5
  Distance between a terminus base of telomere on chromosomal short arm and 5'-terminus of this base sequence : 134204561
  Distance between 3'-terminus of neighbour sequence of sequence listing upward to telomere on chrosomal short arm and 5'-terminus of this base sequence : 115428
gtgcgatttcagctcatagcagcctccacctcccaggctcaagctatcttcctacctcagcctcccaagtagccgggacgacaggtgtgcaccaccacgcctggctaatttttgtatttttttgtagagatggagtcttgccattttgcccaggcttgtctcgaacttctgggctcaagcaatccgtccacctcggcctctcaaagtgctgggattagccactgcacctgggcaacagtttatgtgtgtgtgtgtgtgtgtgtgtgtgtgtatatatgtgtgtgtgtatatatatgtgtgtatgtatatatgtgtatgtatatgtgtgtgtgtgtgtgtgtgtgtgtgtataaaatctccaagtccatccaaccgagatggctcctactagaagccaagagtccac

SEQ ID NO: 9141 - DNA, 125 bp, Homo sapiens
  AC004500_61390
  Located on chromosome 5
  Distance between a terminus base of telomere on chromosomal short arm and 5'-terminus of this base sequence : 134371357
  Distance between 3'-terminus of neighbour sequence of sequence listing upward to telomere on chrosomal short arm and 5'-terminus of this base sequence : 166390
gtgagccaagatctcaccattgcactccagcctgggcaacaagagtgaaactccgtctcaataataataataataataataataataataataataataataataaagccaaactgcaactctct

SEQ ID NO: 9142 - DNA, 337 bp, Homo sapiens
  AC004500.1_58292
  Located on chromosome 5
  Distance between a terminus base of telomere on chromosomal short arm and 5'-terminus of this base sequence : 134374306
  Distance between 3'-terminus of neighbour sequence of sequence listing upward to telomere on chrosomal short arm and 5'-terminus of this base sequence : 2824
agctgcagtttatcttataccattcatgattccaccatgcttaggcagttcagtaatgggaaagaagtatatttgggttcgagaccagaaagctatttgggcatggtggcatgtgcctgttaggcccagctactaaggagcccaaggcagaaggatcacttgagcccaggactttaagaccaggctggacaacacaagaagattctctttctctttaaaaagagagacagacagacagacagacagacagagagagagacagagaaagccactgcataggaggaggaaatatattaaataataggctgggcacagtggctcatgcctataatcgcag

SEQ ID NO: 9143 - DNA, 125 bp, Homo sapiens
  DISO7_10002035
  Located on chromosome 5
  Distance between a terminus base of telomere on chromosomal short arm and 5'-terminus of this base sequence : 134441731
  Distance between 3'-terminus of neighbour sequence of sequence listing upward to telomere on chrosomal short arm and 5'-terminus of this base sequence : 67088
aatgacaatagggtcttatacagcagaaaaggatggtataaaatcacttgaagatagaggctgacacacacacaacacacacacacacacacacacacacacaaaagggctgatgagacagagaa

SEQ ID NO: 9144 - DNA, 382 bp, Homo sapiens
  AC009175.3_176459
  Located on chromosome 5
  Distance between a terminus base of telomere on chromosomal short arm and 5'-terminus of this base sequence : 134656649
  Distance between 3'-terminus of neighbour sequence of sequence listing upward to telomere on chrosomal short arm and 5'-terminus of this base sequence : 214793
aattgtcaaatttcatactttcataatttcttccgtaggtttttgcaattacaagtactttctcattctaaaattagggaaacacatttttgtattgttgtcttatattctctgtgtgtgtgtgtgtgtgtgtgtgtgtgtgtctttcactgtttaacactttaagccatctagaatttactttattatgcatagtaaatttctctccactaagttcgtattttgcattaactgctcagtaaatgatcttactactcaagtgtggtctgtgatgagatagggatctatgccagaatataggacactgcttccctcattgaaagagtcttgacgtgaaaaaaaaaagctgaagtaaactgtgtgcttagtgatgtagctgatt

SEQ ID NO: 9145 - DNA, 425 bp, Homo sapiens
  AC011350.4_72200
  Located on chromosome 5
  Distance between a terminus base of telomere on chromosomal short arm and 5'-terminus of this base sequence : 134773977
  Distance between 3'-terminus of neighbour sequence of sequence listing upward to telomere on chrosomal short arm and 5'-terminus of this base sequence : 116946
acggagacttcatcttagaaataaataaataaaattaaatatttatctttttttcttttgagctttttgtgccaatcagtaagagcttctaacatatactttaattttaggacagtatgtgtgtatgtatatatatatatatatatatatttattttttttttttttggagacaaagtcttgctctgtcacccaggctggagtgcagtggtgtgatcttggctcactgcaacctccgcctccagggttcaagcgattcttgttcctcagcctcccgagtagctaggattaaaggtgtccgccaccacgcccggctgatttttctattttagtagaaacagggtttcaccacgttggccagtctggtctcaaactcttgacctcacccaccttggcctcccaaaatgctggaattacagttatgag

SEQ ID NO: 9146 - DNA, 402 bp, Homo sapiens
  AC011360.2_41176
  Located on chromosome 5
  Distance between a terminus base of telomere on chromosomal short arm and 5'-terminus of this base sequence : 134919631
  Distance between 3'-terminus of neighbour sequence of sequence listing upward to telomere on chrosomal short arm and 5'-terminus of this base sequence : 145229
aacgctgaaatgtttgactacttagataatcaatttattttagacaataaaaagggtaatcttttccacaaatggttcatgaataattggtaataataataaaggaaggaaggaaggaagggtgggagggagggagaaaagagatggagggaggcagagagagagagaggtagtaatacagagaaagagaatgagagagagagagagagagagacactaagggaagaaggaggaaaggaaagaaggaaaagaaaaaaacagaacctcaaccctttccttaccctgtatacaaaaagtaacttaacagggatcaatgacctaaatgtaaagtaaaaaccacaaactttctagaaaaataaagcagaaaatcttagtgatgtggacatagcaaatatttcttaa

SEQ ID NO: 9147 - DNA, 472 bp, Homo sapiens
  HUMUT446B
  Located on chromosome 5
  Distance between a terminus base of telomere on chromosomal short arm and 5'-terminus of this base sequence : 135044255
  Distance between 3'-terminus of neighbour sequence of sequence listing upward to telomere on chrosomal short arm and 5'-terminus of this base sequence : 124222
tcagggcactctgatgtgtttcaagtcaagcagctgggaagcatcaggaatggggctgaagtggtgtgagtgagtgagtgtgtgtgtgtgtgtgtgtgtgtgtgtcctgctgtctagtctgtggcctttttacctgtcaatcatccatactgtaattgaatttagaaagtatatttacctcctggtcatacagaaattgaatataaagcaatgtgtatttgtgaagatggataagtaatatattaacaaacccaaatttttattttatagaacgtaactacactgtctggttgtattaatgctagaaatattattccagtagcatttttatcagagtttgatgacttcaatcaaattctatccatttatatagtagtagattgtacttatattcaattatttcttagttaatttttcactttattcattcatttggcaataatttgttgaataccttccctaggttagaatc

SEQ ID NO: 9148 - DNA, 283 bp, Homo sapiens
  AC005373.1_79121
  Located on chromosome 5
  Distance between a terminus base of telomere on chromosomal short arm and 5'-terminus of this base sequence : 135125360
  Distance between 3'-terminus of neighbour sequence of sequence listing upward to telomere on chrosomal short arm and 5'-terminus of this base sequence : 80633
tgaacagtttggacagtttaaataaatgagtgaaaagactcatatctgtgggagaaaacaaaacagtttattttgcctcataaaactgcgcaaaatatagctgagtaaaaagatgacattatagtagttcattgtgtgtgtgtgtgtgtgtgtgtgtgtgtgtgtgtgtttgtatacacatatcacattctctttatctatttaccccttgatggacagttagatttcttacatatattggctattgtgaataatgctgaaatgaacatggaagttcagatag

SEQ ID NO: 9149 - DNA, 420 bp, Homo sapiens
  AC004219.1_52089
  Located on chromosome 5
  Distance between a terminus base of telomere on chromosomal short arm and 5'-terminus of this base sequence : 135207820
  Distance between 3'-terminus of neighbour sequence of sequence listing upward to telomere on chrosomal short arm and 5'-terminus of this base sequence : 82177
taggaaattgcacataccatagaaatttggatttctggctgtttttgtttgtttgtttgtttgtttgtttgagacagagtctcacactgttgcccaggctggatgcaatgccacaatcttggctcactgcaacctccacctctcagtttcaagtgattctccagcctcagccttctgagtagctgggactacaggtgcacgccaccacacccagctaattttcatacttttagtagagacagggtttcatcatattggtcaggctggtcttgaactcctgacctcaggtgatccacccacctcagcctcccaaagtgctgggattacaggcatgagccaccgcgtctggccctggctgtttttaaaaatcacaagatatgctaacatcagtcccagtagacaagaatttaaggaatagct

SEQ ID NO: 9150 - DNA, 370 bp, Homo sapiens
  chr5.fa.O7frz.144271606
  Located on chromosome 5
  Distance between a terminus base of telomere on chromosomal short arm and 5'-terminus of this base sequence : 135288719
  Distance between 3'-terminus of neighbour sequence of sequence listing upward to telomere on chrosomal short arm and 5'-terminus of this base sequence : 80479
ctagacgtaccatctgtatcagtttcctggggctgctataacaaggtgctgcaaactaggtggcttaaaacaacagaaatttattgtctcataattctaggggctacaggtccgaagtcaaggtgttggcagggtcatcttccctctgaaatttgtagaaaaatcattctttgccttttcctagcttcttgtggttttctggcaatcttaggcattccttggtttgcagctgcataattccaatctcagccttcaccctcacatgacatttttcctctgtgtgtgtgtgtgtgtgtgtgtgtgcatgtgtgtctgtacatgtgtatgtgtgtctatgtctatatgaacatcttataagatcaccagtcat

SEQ ID NO: 9151 - DNA, 480 bp, Homo sapiens
  AC005196.1_68593
  Located on chromosome 5
  Distance between a terminus base of telomere on chromosomal short arm and 5'-terminus of this base sequence : 135426624
  Distance between 3'-terminus of neighbour sequence of sequence listing upward to telomere on chrosomal short arm and 5'-terminus of this base sequence : 137535
ctcacagttctgcaggtttaacaggaagcatggctaggaggcctcaggaaacttacaatcatggtggaaggggaagcaggcaccttcttaacaaggcggcaggagtgtcagcgagaaccagaaagtgcctcatttaaaaccatcagctcttgtgagaactccctcactatcatgagaacagcatggggaaaactgccccccagtccaatcatatatatatccaatatatatgattggatcatatatgtgtgtgtgtgtgtgtgtgtgtgtgtgtgtgtgtgtgtatggagagagagagagacatagatcagaagggatttattaggggaattggttcatttgattatagaggctgagaagtcccatgataggccatacgcaagcttgagaaccagaaaagccagccagcagtgtgactcagttcaagttcaaaggcctcaggaccaaggaagttgatggtgaatctcagtctaaagccaa

SEQ ID NO: 9152 - DNA, 299 bp, Homo sapiens
  AC004226.1_93734
  Located on chromosome 5
  Distance between a terminus base of telomere on chromosomal short arm and 5'-terminus of this base sequence : 135519544
  Distance between 3'-terminus of neighbour sequence of sequence listing upward to telomere on chrosomal short arm and 5'-terminus of this base sequence : 92440
actcaattagtcttgtctgcaatcatttttaatttgaacatctgggaacagaaagcaaaaggaagcttctggctgcatttctattttgatatacatacatgaattaatgaatagcttttaaaattgcctggaagaattattctcagggctcactataaagtaggaagaatcacagtagccacagagagagagagagagagagagagagagagagaagagagagagagagattgatgccagacccatgaggaacaacctatgatataacattttagaagcaagaataggcatgtagtcta

SEQ ID NO: 9153 - DNA, 465 bp, Homo sapiens
  AC005741.1_11885
  Located on chromosome 5
  Distance between a terminus base of telomere on chromosomal short arm and 5'-terminus of this base sequence : 135545341
  Distance between 3'-terminus of neighbour sequence of sequence listing upward to telomere on chrosomal short arm and 5'-terminus of this base sequence : 25498
aaatgtcagacataatctgcacaataaaccaaatgggcctaatagatatttacaaagcatttcatctgacagtggcagaatatagatttttctcctcacctcataagtcattctccaagacagaaccatgtatttatttatttatttatttatttatttattcatttatttacttatttatttaacttcagacagggtcttgctcttttacccaggctggagtgcagtggcatgattacagctcactgcagcatcaacttcccaagttccaacaatcctcccaccttagcctcccaagaagctgagcaactgggaccacaggcacacaccaccatgcccagctaatttttgtatttttggtagtcatggtttcaccatgttgccagactggtttcaaactcctgagtgcaagcaatccacctgccttagccacccaaagtactgtaattataggcatgagctatc

SEQ ID NO: 9154 - DNA, 339 bp, Homo sapiens
  AC005613.1_57743
  Located on chromosome 5
  Distance between a terminus base of telomere on chromosomal short arm and 5'-terminus of this base sequence : 135656921
  Distance between 3'-terminus of neighbour sequence of sequence listing upward to telomere on chrosomal short arm and 5'-terminus of this base sequence : 111115
tttagacctgatttaactcagcaccctagaaaaaggaaaaacatttttctggcttctggcattatccatgaaattaagaagttggaaatgtatttccccgtgcattttatccaagatcagtttagatcagaggggtgtgtgctcgagtatacgtgtgtttgtgtgtgagtgtatgtgtgtgtgtctttgcagaggggtatgtgtgagcatgtgtgtgtgtgtgtgtgtgtgtgtgtgtgtgtgtgtgtgtatgtgtgtctttgcaggaggactgaccttcccctgatgtagatcaaaccaccactgaggaagcatctgtagccttctgtagctcatgaa

SEQ ID NO: 9155 - DNA, 245 bp, Homo sapiens
  AC005613.1_47785
  Located on chromosome 5
  Distance between a terminus base of telomere on chromosomal short arm and 5'-terminus of this base sequence : 135666968
  Distance between 3'-terminus of neighbour sequence of sequence listing upward to telomere on chrosomal short arm and 5'-terminus of this base sequence : 9708
gaaatacctaatgtagatgacgagttgatggatgcaggaaaccaccatggcacatgtatacctatgtaacaaacctgcacgttctgcacatgtaccccagaacttaaagtataacaaataaatacatacatacatacatacatacatacatacatacatacgataaaacaaaaagttctcactccagtttaaagaaacttaatttctgattaaagggtatagtaaatgtatggatgttagtcagc

SEQ ID NO: 9156 - DNA, 314 bp, Homo sapiens
  AC004043.1_60367
  Located on chromosome 5
  Distance between a terminus base of telomere on chromosomal short arm and 5'-terminus of this base sequence : 135730399
  Distance between 3'-terminus of neighbour sequence of sequence listing upward to telomere on chrosomal short arm and 5'-terminus of this base sequence : 63186
actaactcaaattgataagccaagaactagtgatactatatttatattacttaggggtacagaagcaagtgcatgcacacacacacacacacacacacacacacacacacacacatacccaaactaaaaaaaggaatgagagtagtcacctctagaggactacagctcagaaaaggtataaagcagaatattgtaagtataaaataggtggatctattattttataaaaatcttttaattgtttaaacacataaagacaaaggaaatccattataagagatttggaagacaagttgcatacctaaactttgctg

SEQ ID NO: 9157 - DNA, 281 bp, Homo sapiens
  chr5.fa.O7frz.151859639
  Located on chromosome 5
  Distance between a terminus base of telomere on chromosomal short arm and 5'-terminus of this base sequence : 135927071
  Distance between 3'-terminus of neighbour sequence of sequence listing upward to telomere on chrosomal short arm and 5'-terminus of this base sequence : 196358
gatgctgttagctaattgtcagacaacagacaaacacactgcagccagaaaaatccccactgagtttgggcagctgatttctctggcatcaaatgaaagctttagctattgcccctgaggcctggctgagcaagccctgcacccgagccctccctctgtgtgcccccccttccccaccactatgggccggagcgggtgttaagtgtgtgtgtgtgtgtgtgttggggggatgggggttgagaagaatgcaggcaccctagctcacaatcttaggcagctac

SEQ ID NO: 9158 - DNA, 334 bp, Homo sapiens
  chr16.fa.O7frz.23880546
  Located on chromosome 5
  Distance between a terminus base of telomere on chromosomal short arm and 5'-terminus of this base sequence : 136119259
  Distance between 3'-terminus of neighbour sequence of sequence listing upward to telomere on chrosomal short arm and 5'-terminus of this base sequence : 191907
ctacttggtgtggcttcagtgtcatcctgcccagtcataaggccctgggccatataacctctccacaagcctcaaaaggtatataaacatgctgcatttttcagggattatggaacaggcttcttttttgtttgtttgtttgtttgtttgtttgtttgtttgttttttgaggtggagtctcgctcagtcacccaggctggagtgcagtggcgcgatctcggctcactgcaagctccgcctcccgggttcacgccattctcctgcctcagcctcccaagtagctgggattacaggcgcccaccaccatgcccagctatggaacaggcatctttac

SEQ ID NO: 9159 - DNA, 247 bp, Homo sapiens
  chr5.fa.O7frz.149913374
  Located on chromosome 5
  Distance between a terminus base of telomere on chromosomal short arm and 5'-terminus of this base sequence : 136395732
  Distance between 3'-terminus of neighbour sequence of sequence listing upward to telomere on chrosomal short arm and 5'-terminus of this base sequence : 276139
tctatagttgcttatcaggaaagaatgtttgcgtcaaggcgtgctggctcatgcttgtaatcccaaaactttgggaggccaaggtgaaaggactgcttgaggtcaggagttcaagaccagcctgggcagcagaacaagaccctgtctctacacacacacacacacacacacacacacacacacgcacgcacacacacggatctctattcattcagaggtgtagtagtctaggttgtaaatcaggatt

SEQ ID NO: 9160 - DNA, 481 bp, Homo sapiens
  AC011426.4_83703
  Located on chromosome 5
  Distance between a terminus base of telomere on chromosomal short arm and 5'-terminus of this base sequence : 136515239
  Distance between 3'-terminus of neighbour sequence of sequence listing upward to telomere on chrosomal short arm and 5'-terminus of this base sequence : 119260
gactaaagttaaacctggctacttagaaaaacataagttttatttgaaggaagttgcaacacacaattcaaaaatgctatagaagtatggcctctatataggcttcttccacatagctaactgctaatgattagtaagatggcggcactggtttcaagaagataatttcatgcctgaggactcttctctgtagactcacactgtgcaatgacagtgtcaagaatgaacatcccagggcaggggctctgtacattttttaggtataagacccctttaggatgtttcagaaagacccttcctaacacacacacacacacacacacacacacacacacacacacacacacacttcacactggtctatagataatgtttgggacgtgccaaacctccttagtctcctactggggtctgcagcccaatgtcattaggtgttctgatctctaatacccaacatgactggaaagagttcagatacctt

SEQ ID NO: 9161 - DNA, 298 bp, Homo sapiens
  chr5.fa.O7frz.150131197
  Located on chromosome 5
  Distance between a terminus base of telomere on chromosomal short arm and 5'-terminus of this base sequence : 136632343
  Distance between 3'-terminus of neighbour sequence of sequence listing upward to telomere on chrosomal short arm and 5'-terminus of this base sequence : 116623
agcatctagtgcatcaaataacgaatcctaaagttaaatggaaattatttttaggttgtctgggcaaatagcacagaaggtggggggaatccagagatatgacctcagatgtgacacatgcagacacacgacacaccacacatacacacacacacacacacacacacacacgcatatgggtacacacaaatgcaccttctctcttccttctgcccccacactagcagctccttcctggcttcctccgcccctcactcacacaaagggccaaagcaaatacttcagcactgagtcatgt

SEQ ID NO: 9162 - DNA, 248 bp, Homo sapiens
  chr5.fa.O7frz.150324969
  Located on chromosome 5
  Distance between a terminus base of telomere on chromosomal short arm and 5'-terminus of this base sequence : 136734518
  Distance between 3'-terminus of neighbour sequence of sequence listing upward to telomere on chrosomal short arm and 5'-terminus of this base sequence : 101877
aactgagaggcttgttaaagagtcagattcctgcctcccacttccacccccagatctagtgaatcacaatctctggtaggaatttttttaagcgtgtgtgtgtgtgtgtgtgtgtgtgtgtgtgttttaaagctctccaggagattctgtgcatactagagaaacttaatatagataaaatggttgtcttatttttcacatttcaactgagtcgacattgtgtactacttcagtttgtccataagttg

SEQ ID NO: 9163 - DNA, 388 bp, Homo sapiens
  AL162728.12_36705
  Located on chromosome 5
  Distance between a terminus base of telomere on chromosomal short arm and 5'-terminus of this base sequence : 136863728
  Distance between 3'-terminus of neighbour sequence of sequence listing upward to telomere on chrosomal short arm and 5'-terminus of this base sequence : 128962
ttgaattgtctgtaaagtgcttggctttatttctgcattctctgtcctgttatatgtgtctatgtgtctgtttttacaccagtaccagtttggttttggttactattgctttgtattacaatttgacatcagtagtgtgctgcctccagttttgttttttgttttgttgttgttgttgttgttgttgttcaggactgcattagctattcaggatcttttgtggtcccatacaaatgttagtatttttctttaatttctgtgaagaatgtcattggtattttgcattgaatctgtagattgcttgcccagtatagatattttaacaatagaatgtttcatttcactggcttacaaaagttattcttccctgtttcaagtaccaacgcac

SEQ ID NO: 9164 - DNA, 271 bp, Homo sapiens
  D5S2115
  Located on chromosome 5
  Distance between a terminus base of telomere on chromosomal short arm and 5'-terminus of this base sequence : 137069226
  Distance between 3'-terminus of neighbour sequence of sequence listing upward to telomere on chrosomal short arm and 5'-terminus of this base sequence : 205110
ggcactcatgctgcactggggcttatgccacagcatttgctgtgttctgcaaagcccttccctcaccctgttttcctaaaattaaaacacacacacacacacacacacacacacacacacacacacacacaccacaccacatcacacaggaaagggacaattaagaattttatcttaattcttaaagaattcttaaagaattttatctgaattcttaaattaaaattaagaattttatcttaatcacacgggaaaggagccaggggcttac

SEQ ID NO: 9165 - DNA, 124 bp, Homo sapiens
  D5S396
  Located on chromosome 5
  Distance between a terminus base of telomere on chromosomal short arm and 5'-terminus of this base sequence : 137393415
  Distance between 3'-terminus of neighbour sequence of sequence listing upward to telomere on chrosomal short arm and 5'-terminus of this base sequence : 323918
acatggtgactggcaccttagaatgaatacatgaatgaatgaatgagtaaatgaattagtgaataccccttacacacacacacacacacacacacacacacgcagagtacagccccaaatcact

SEQ ID NO: 9166 - DNA, 192 bp, Homo sapiens
  D5S2056
  Located on chromosome 5
  Distance between a terminus base of telomere on chromosomal short arm and 5'-terminus of this base sequence : 137491248
  Distance between 3'-terminus of neighbour sequence of sequence listing upward to telomere on chrosomal short arm and 5'-terminus of this base sequence : 97709
gagcctgagaagtcaagactacagtgagccatggtcgcaccactacactactgcctgggcaacagaatgagaccccgtgtcaaacacacacacacacacacacacacacacacacacaaactgttatactggctgggggcaatggctcacacctgtaatccttggactttgggaggcagaggtgggaggctt

SEQ ID NO: 9167 - DNA, 357 bp, Homo sapiens
  AC004764.1_516
  Located on chromosome 5
  Distance between a terminus base of telomere on chromosomal short arm and 5'-terminus of this base sequence : 137491258
  Distance between 3'-terminus of neighbour sequence of sequence listing upward to telomere on chrosomal short arm and 5'-terminus of this base sequence : -182
agtcaagactacagtgagccatggtcgcaccactacactactgcctgggcaacagaatgagaccccgtgtcaaacacacacacacacacacacacacacacacacacaaactgttatactggctgggggcaatggctcacacctgtaatccttggactttgggaggcagaggtgggaggcttgcttgagcccaagagttcaaggccagcctgggcaagatgggagaccccatctctacaaaaaatttaaaaattagtcaggcgtggtggcacttgcctatagtcccagctactctggaggctgaggagggagaactgcttgagcccaggaggttaaggctgcaataaaccgtgatcc

SEQ ID NO: 9168 - DNA, 265 bp, Homo sapiens
  AC006077.1_23803
  Located on chromosome 5
  Distance between a terminus base of telomere on chromosomal short arm and 5'-terminus of this base sequence : 137596551
  Distance between 3'-terminus of neighbour sequence of sequence listing upward to telomere on chrosomal short arm and 5'-terminus of this base sequence : 104936
agatggattcctatatgcttcttaatatttgggttctgatggtcgggaaactgcattctgtttataccagttttacagtctaccattcaatttgtgtcctttggtagatatcaacctgaaaacacagtaagtgctaatgcaatgggacaatttctgagaaaaactaaaaacgttccaaataaatgagcaacatcaataaatggttttatttatttatttatttatttatttatttatttatttatttgagacggagtcttactct

SEQ ID NO: 9169 - DNA, 451 bp, Homo sapiens
  AC006077.1_18157
  Located on chromosome 5
  Distance between a terminus base of telomere on chromosomal short arm and 5'-terminus of this base sequence : 137602134
  Distance between 3'-terminus of neighbour sequence of sequence listing upward to telomere on chrosomal short arm and 5'-terminus of this base sequence : 5318
ctttcttactgcaaagtcaaatagatttggtttccaaatggaagaaaagcaaatgccagaattagtaaagacaaccaggatggccacgatggctcacgcctacaatcccagcactgtgagaggccaaggcgggaaaatcacctaaggtcaggagttcaagaccagcttggccaaaatggcaaaaccctgtttctactaaaaatacaaaaatttacaaaaattttgtgggggaaaaaaaaaagttctgtgacttaccaggagggtaacaaaaataaataaataaataaataaataaataaataaataaatatatgtatttctgtatgtataaaatatgtatgtgtgtgtagtgtgtgtgtgtgtgtgtatatatatatatatatatgaacattcataatctatcagagaactcaggatatacagtctcagcttacattatgttaggctttta

SEQ ID NO: 9170 - DNA, 478 bp, Homo sapiens
  AC010301.4_22681
  Located on chromosome 5
  Distance between a terminus base of telomere on chromosomal short arm and 5'-terminus of this base sequence : 137771754
  Distance between 3'-terminus of neighbour sequence of sequence listing upward to telomere on chrosomal short arm and 5'-terminus of this base sequence : 169169
tgcactctaaaggttaagctatagttcaggaaatagcctggtttgcagatgaaaggggcttcaacttttattataatttcattttgtatattaaagcacctacacataaaaattttaaaggtaactaaatacttcatgtacattttcagaattgttacagtgcaagagaaagttcttagcctatccttacttttctatactcaaaacacacacacacacacacacacacacacacacacaaacaataaaactgtttttttgttttgttttatttgtttgtttgagatggagttttgctcttgttgccaaggctggagtgcaatggtgcaatctcggttcactgcaacctccgcctcccgggttcaagcgattctcctgcctcagcctcccgagtagctgggattacaggtgcccgccaccacacccagctaatttttttatatttttagtaaagatggggtttcactacattggccag

SEQ ID NO: 9171 - DNA, 284 bp, Homo sapiens
  D5S458
  Located on chromosome 5
  Distance between a terminus base of telomere on chromosomal short arm and 5'-terminus of this base sequence : 137771776
  Distance between 3'-terminus of neighbour sequence of sequence listing upward to telomere on chrosomal short arm and 5'-terminus of this base sequence : -456
agttcaggaaatagcctggtttgcagatgaaaggggcttcaacttttattataatttcattttgtatattaaagcacctacacataaaaattttaaaggtaactaaatacttcatgtacattttcagaattgttacagtgcaagagaaagttcttagcctatccttacttttctatactcaaaacacacacacacacacacacacacacacacacacaaacaataaaactgtttttttgttttgttttatttgtttgtttgagatggagttttgctcttgttgc

SEQ ID NO: 9172 - DNA, 380 bp, Homo sapiens
  chr5.fa.O7frz.152268042
  Located on chromosome 5
  Distance between a terminus base of telomere on chromosomal short arm and 5'-terminus of this base sequence : 137975327
  Distance between 3'-terminus of neighbour sequence of sequence listing upward to telomere on chrosomal short arm and 5'-terminus of this base sequence : 203267
caagattacttggacttaagacagtgatccatgcaggggagagtttcccaggtttgttctctctgttcctctctctctctctctctctctctctctctctctctctctctctctctctctctctctctctccctctgtttctgtttctttctctctcagctttgcccagaaggcacattctaattacacaacagcaatgcagtggtggcaaaaggatggctactctagaagaaatccagtatttctggtcaaatgaaccaggacagagaccctggaaggaaacaaagcatgaggacatccaggagggaaggtagccagaaaagcagtcctctaattctgtgaataaatgcctacaagtctcagcctaactcctgagttat

SEQ ID NO: 9173 - DNA, 373 bp, Homo sapiens
  AC002428.1_127157
  Located on chromosome 5
  Distance between a terminus base of telomere on chromosomal short arm and 5'-terminus of this base sequence : 138049815
  Distance between 3'-terminus of neighbour sequence of sequence listing upward to telomere on chrosomal short arm and 5'-terminus of this base sequence : 74108
aaggacagagtgactcaaatgatgtagagccaagcagccccagaagcctacctgccaagagccagagtcggtggtgaggattgtggggatgggaagggaagtggcttgagacacagagcaaataggtgggcaggtccaggctagctcatgtggtgtaaagacagcataggtggttgacctcaaattggatttcaggggtctttacacacacacacacacacacacacacacacacacacacacacacacccctattaagtggccctaaatctctgcattagagaaagccttttctggggactctttgaggcctaaaattgtatcattatccttttaggttgtctttccaaggtcatttgacagtacaatggct

SEQ ID NO: 9174 - DNA, 123 bp, Homo sapiens
  HUMUT819
  Located on chromosome 5
  Distance between a terminus base of telomere on chromosomal short arm and 5'-terminus of this base sequence : 138076583
  Distance between 3'-terminus of neighbour sequence of sequence listing upward to telomere on chrosomal short arm and 5'-terminus of this base sequence : 26395
gggtcaatgaagtatttgcacatcactaccactatttgataaagacaacatacatacatacatacatatacatatatacacacacacacacacacacacatatatgtaggaggtagcagaaga

SEQ ID NO: 9175 - DNA, 243 bp, Homo sapiens
  G08438
  Located on chromosome 5
  Distance between a terminus base of telomere on chromosomal short arm and 5'-terminus of this base sequence : 138123105
  Distance between 3'-terminus of neighbour sequence of sequence listing upward to telomere on chrosomal short arm and 5'-terminus of this base sequence : 46399
tctacttggcatccctgatggaggttaatttaccttaatccagagtcttgacccttggtttttttcagtgtcccagactcagacttagggagagtagttcaagttcatcaagttactggggaccaaataaatgaatacagtgataaatgaatagatgatagatagatagatagatagatagatagatagatagatagatgatagatagacaagatagaagatggatatgattttcagtggcaa

SEQ ID NO: 9176 - DNA, 450 bp, Homo sapiens
  AC004627.1_14374
  Located on chromosome 5
  Distance between a terminus base of telomere on chromosomal short arm and 5'-terminus of this base sequence : 138123126
  Distance between 3'-terminus of neighbour sequence of sequence listing upward to telomere on chrosomal short arm and 5'-terminus of this base sequence : -222
aggttaatttaccttaatccagagtcttgacccttggtttttttcagtgtcccagactcagacttagggagagtagttcaagttcatcaagttactggggaccaaataaatgaatacagtgataaatgaatagatgatagatagatagatagatagatagatagatagatagatagatgatagatagacaagatagaagatggatatgattttcagtggcaatagctcttctataatggggggaaatgctctcttcctgttgttataatccttgggattatgaatatgaaatgacggcaaaaaaaaaaaggtgaagaattttaagggcttttccaactaactgtgtggtctaatctgaaatatatttactttcccatgaaaaaaatggagtagaaagtgtttctcccgggcatcacctaagggacctgagaacctctgactctttgattt

SEQ ID NO: 9177 - DNA, 222 bp, Homo sapiens
  AC005219.1_22994
  Located on chromosome 5
  Distance between a terminus base of telomere on chromosomal short arm and 5'-terminus of this base sequence : 138264715
  Distance between 3'-terminus of neighbour sequence of sequence listing upward to telomere on chrosomal short arm and 5'-terminus of this base sequence : 141139
aaactaatgcatacctcacgagattgatgagggaatttgataaaatagtgtgtgtgtgtgtgtgtgtgtgtgtgtgtgtgtgtgtgtataaacatacaaacaaagcatttggaaaggtaaacactgatgtttagcacatatggtaagccctgaataaatgttaactaatattgattatgggttattattttcaggacagcctcagcttgtaatgactaagcc

SEQ ID NO: 9178 - DNA, 414 bp, Homo sapiens
  AC009014.2_77523
  Located on chromosome 5
  Distance between a terminus base of telomere on chromosomal short arm and 5'-terminus of this base sequence : 138296185
  Distance between 3'-terminus of neighbour sequence of sequence listing upward to telomere on chrosomal short arm and 5'-terminus of this base sequence : 31248
tttgtacaggtttgaattagaatacaatgggttgtgacccattatgggcatttattttcatgggatgatgtgctcaggagattttgttttggccaatagtgttgaggaaaatgtggggattggtttgcttgcctttttatttcagattgcagcagtcatagagatgttggagcacaaagtgaaagagttgtttctgtgaattcactttagaaatctagctgtgagctctgtgtgtgtgtgtgtgtgtgtgtgtgtgtgtctttctgtatgtttttctgtatgtatgtgtgtctcggggtgggtattgaagtcagtttgtgtgtgtgtttattatgaaagttggtcaggatgtagtacttccataaccttaggtaagaacaggacctttgggttattgattcaacatgaattcat

SEQ ID NO: 9179 - DNA, 172 bp, Homo sapiens
  D5S393
  Located on chromosome 5
  Distance between a terminus base of telomere on chromosomal short arm and 5'-terminus of this base sequence : 138498139
  Distance between 3'-terminus of neighbour sequence of sequence listing upward to telomere on chrosomal short arm and 5'-terminus of this base sequence : 201540
ttctacctgccctttcctctgccccagaatagtacatcacacacacacacacacacacacacacacacacacacacacacacacacacctcgttatataaggcagcatgttctgacttctgaggcagaatattcattggtttaaacaaatgaggaatgaggaatgaggaatg

SEQ ID NO: 9180 - DNA, 359 bp, Homo sapiens
  HUMUT1171
  Located on chromosome 5
  Distance between a terminus base of telomere on chromosomal short arm and 5'-terminus of this base sequence : 138691934
  Distance between 3'-terminus of neighbour sequence of sequence listing upward to telomere on chrosomal short arm and 5'-terminus of this base sequence : 193623
ccctccagaaaacttcctctctcacccctgatacacacatgtgcacgcacacatgcacacacacacgcactctcccacccctgacacacaaatgtgcatgcgcacacgcgcatacacacacacacacacacacacacacacacgagtccagttttgatgaccctcccacaagttcctaaccctccctggtccaggctctgtagcacccaccacattttattgtgtttggtgttctgtctctctctcctctaagtggtgaatggcttgaaggcagagatgtgtcacatcttatctctgtaaacccaccatgcttaaggcaccaaaggtgctcagtaaatattagctgcaagacctatgag

SEQ ID NO: 9181 - DNA, 150 bp, Homo sapiens
  Z67108
  Located on chromosome 5
  Distance between a terminus base of telomere on chromosomal short arm and 5'-terminus of this base sequence : 138740763
  Distance between 3'-terminus of neighbour sequence of sequence listing upward to telomere on chrosomal short arm and 5'-terminus of this base sequence : 48470
atccagtagactgtcacacacgctcaccccccaacttagagaaacatagagaaacaccatggtctacacacacacacacacacacacacactccagggtctgtattgtccctgtagaaacaccaaaacaaagcccaaaggtgctgcctgg

SEQ ID NO: 9182 - DNA, 114 bp, Homo sapiens
  D5S1983
  Located on chromosome 5
  Distance between a terminus base of telomere on chromosomal short arm and 5'-terminus of this base sequence : 138781246
  Distance between 3'-terminus of neighbour sequence of sequence listing upward to telomere on chrosomal short arm and 5'-terminus of this base sequence : 40333
ttgctggcctcagagagtgatcacacacacactctacacacacacacacacacacacacacacacacacacacacaaggacaaacctgctatcccaaatgtagaatcatcatgg

SEQ ID NO: 9183 - DNA, 382 bp, Homo sapiens
  AC004021.1_163087
  Located on chromosome 5
  Distance between a terminus base of telomere on chromosomal short arm and 5'-terminus of this base sequence : 138810406
  Distance between 3'-terminus of neighbour sequence of sequence listing upward to telomere on chrosomal short arm and 5'-terminus of this base sequence : 29046
aatgcagattctaattcattaggtctaggatgggatctgagagcctgcatttctaataagaactcaagtgatgcttgcagttgctggtccacaaaccacactttgagtaacaaaactctacacacacacacacacacacacacacacacacacacacacaatggttctcatactgggctgcacactggtattaccttaagagttttaaaactactgatgtctaggtcttgccctaaaagaatctaactcaataggtatggagtgtggcctggacattaagatgttttttaaagctccccaggtgcttctaatgtacagccacgtttgagagccactgtcccacaaccttcagtgtactgtcctcattcagaaaggtacttaa

SEQ ID NO: 9184 - DNA, 282 bp, Homo sapiens
  AC006084.1_4136
  Located on chromosome 5
  Distance between a terminus base of telomere on chromosomal short arm and 5'-terminus of this base sequence : 138934890
  Distance between 3'-terminus of neighbour sequence of sequence listing upward to telomere on chrosomal short arm and 5'-terminus of this base sequence : 124102
atcatgaggtcagaagtttgagaacagcctgaccaacatggtgaaaccccgtctgtactaaaaatacgaaaattagccgagccaagtgtcatggcacacgcctgtaatcccagctattcaggaggctgaggcaggagaatcacttgaacccgggaggcggaggttgcagtgagctgagattgcgccactgcactccaacctgggcaacagagcaagacactgtctcaaacacacacacacacacacacacacacacacacacaaatagtgagcctaggtcag

SEQ ID NO: 9185 - DNA, 247 bp, Homo sapiens
  AC011435.1_108051
  Located on chromosome 5
  Distance between a terminus base of telomere on chromosomal short arm and 5'-terminus of this base sequence : 138968199
  Distance between 3'-terminus of neighbour sequence of sequence listing upward to telomere on chrosomal short arm and 5'-terminus of this base sequence : 33027
tcttgaacaacctgtcttgaactcccaggattaatcattgctgggtttttttttttaacttgtttcttctttgtatgagtttgtagtgttcctgaggacttgtatgattcttataaatcgaatacattcataagtatgatgatacattattatattattattattattattattattattattattattattattgagacagggtcttgctctgttgcccaagctggagttcagtgaatatcatagc

SEQ ID NO: 9186 - DNA, 247 bp, Homo sapiens; identical to SEQ ID NO: 9185
  AC011367.6_32946
  Located on chromosome 5
  Distance between a terminus base of telomere on chromosomal short arm and 5'-terminus of this base sequence : 138968199
  Distance between 3'-terminus of neighbour sequence of sequence listing upward to telomere on chrosomal short arm and 5'-terminus of this base sequence : -247

SEQ ID NO: 9187 - DNA, 265 bp, Homo sapiens
  AC011435.1_58388
  Located on chromosome 5
  Distance between a terminus base of telomere on chromosomal short arm and 5'-terminus of this base sequence : 139032415
  Distance between 3'-terminus of neighbour sequence of sequence listing upward to telomere on chrosomal short arm and 5'-terminus of this base sequence : 63969
gcaaatggtaggatgagtaattactaccttagcagcctaaaagacctaatcacctacatttgagaagcatgaatgttaaacatacaaaatgtaatccacctaaccaaggtactctggatctaaaaaccagtttgctaacttatacacagttgaagttgaagaggagagagctttttccaaaaacaacaacaacaacaacaacaacaacagaagagtcctcactaaatgggtccttattgttctaccaaatccagatgtcactatt

SEQ ID NO: 9188 - DNA, 206 bp, Homo sapiens
  D5S414
  Located on chromosome 5
  Distance between a terminus base of telomere on chromosomal short arm and 5'-terminus of this base sequence : 139266349
  Distance between 3'-terminus of neighbour sequence of sequence listing upward to telomere on chrosomal short arm and 5'-terminus of this base sequence : 233669
tggttccagcatatagagcgcgcgcgtgtgtgtgtgtgtgtgtgtgtgtgtgtgtgtgtgtgtgtgtgtgtaagagataaatgatcctttaaattacacaaaatttgggactcctgtgtttgaattggcaagagaccaagcccactgcctctgctttctctgctgcccaagtaattagaaaacctggccacttgactgaactggcc

SEQ ID NO: 9189 - DNA, 253 bp, Homo sapiens
  AC004826.2_47977
  Located on chromosome 5
  Distance between a terminus base of telomere on chromosomal short arm and 5'-terminus of this base sequence : 139334853
  Distance between 3'-terminus of neighbour sequence of sequence listing upward to telomere on chrosomal short arm and 5'-terminus of this base sequence : 68298
catttagagcataagacatggtatttttgaaatatatatacatttgtgaaactatccacaattaaggtaattattatagtatccattaacagatgaatgggtaaagaaaaaatatatatgtatacacacacacacacacacacacacacaatggaatactgttgagccataaaaaagaattaaatcctccatttgtgattccatggttgagcctggaggatagtatgtaaagtgaaataagccagacacataa

SEQ ID NO: 9190 - DNA, 461 bp, Homo sapiens
  AC021854.3_112171
  Located on chromosome 5
  Distance between a terminus base of telomere on chromosomal short arm and 5'-terminus of this base sequence : 139425499
  Distance between 3'-terminus of neighbour sequence of sequence listing upward to telomere on chrosomal short arm and 5'-terminus of this base sequence : 90393
gttactaggacttcagctccttaggtgggaatctgtcttttattttattttatttatttatttatttatttatttatttatttatttatttattttgagatggagtctcactctgtcgccaggctggagtgcagtggcatgatctcggctcactgcaacctccacttcctgggatcgagcaattctcctgcctcagcctccggagtagctgggattacaggtgtgcgccaccatgcccagctaatttttgtatttttagtagagacgggtttcaccatgttggccgggatggtctcgatctcttaatctcgtgatccacctgcctcggcctcccaaagtgctgggattacaggcgtgagccaccatacccagccttattttattttattttttgaggcagagtttcactcttgtcacccgggctggagtgcaagtgtgccatctcaacttactgcaacctc

SEQ ID NO: 9191 - DNA, 447 bp, Homo sapiens
  chr5.fa.O7frz.154676902
  Located on chromosome 5
  Distance between a terminus base of telomere on chromosomal short arm and 5'-terminus of this base sequence : 139446117
  Distance between 3'-terminus of neighbour sequence of sequence listing upward to telomere on chrosomal short arm and 5'-terminus of this base sequence : 20157
ggcaactgtcacttgtatttaaaataattttgctgtttggggctgggagtggtggctcatgcctgtaatgccgaggtgtgcagatcacctgaggtcaggagttcgataccagcctggccaacgtggtgaaactccatctctaccaaaaaatacaaaaaaattagccgtgcatggtggcacgtgcctatgatctctactactcaggaggctgaggcacgagaatcgcttgagcccaggagacagaggttgcagtgagctgagatcatgccactgcactctagcctgggtgacagagtaagactctgtctcaaaaaaaaaacaaacaaaaaaaacaaactcaaaaaactctctctctctctctttctctctctctctctctctctctgtgtgtgtgtgtgtgtgtataaattttgctgtttagatttataacagtatgcttgtggacat

SEQ ID NO: 9192 - DNA, 101 bp, Homo sapiens
  DISO7_10002042
  Located on chromosome 5
  Distance between a terminus base of telomere on chromosomal short arm and 5'-terminus of this base sequence : 139559199
  Distance between 3'-terminus of neighbour sequence of sequence listing upward to telomere on chrosomal short arm and 5'-terminus of this base sequence : 112635
ggctcatacctacctatgggtctcttctctctctctctctctctctgtgtgtgtgtgtgtgtgtgtgtgtgtgtgtgtccctttctcttgtctgtatctgg

SEQ ID NO: 9193 - DNA, 476 bp, Homo sapiens
  AC011385.3_122594
  Located on chromosome 5
  Distance between a terminus base of telomere on chromosomal short arm and 5'-terminus of this base sequence : 139893269
  Distance between 3'-terminus of neighbour sequence of sequence listing upward to telomere on chrosomal short arm and 5'-terminus of this base sequence : 333969
gaatgtgttgattcagaaacagtttttaaattaataagcacgtggtgattcaggctgtttgttcagggcaacgtgctgcctaaattggaatgtgccaaactccgttctcccactttcccccacctcctccgcctctccaggtcctggctgttccccatgtcattctggtagtcagaattccggttcctccataccctcaggcaaggcaactattagtctgcaaagcccaacttgccaactgagcagcttccctgggctctgaggtctctcctgggtgtgtgtgtgtgtatgtgtgtgtgtgtgtgtgtgtgtaaagtactttttcttcttaaattgaaaagtgattaatccatcggttctcctctcttctggaacgtgtcctaggaggacaggtactactcagtttcatatctgctgtcaggaggtcggcatgagcagctcctccttgaggcaagaactacaggttggactgtctt

SEQ ID NO: 9194 - DNA, 167 bp, Homo sapiens
  D5S476
  Located on chromosome 5
  Distance between a terminus base of telomere on chromosomal short arm and 5'-terminus of this base sequence : 139893527
  Distance between 3'-terminus of neighbour sequence of sequence listing upward to telomere on chrosomal short arm and 5'-terminus of this base sequence : -218
ctgaggtctctcctgggtgtgtgtgtgtgtatgtgtgtgtgtgtgtgtgtgtgtaaagtactttttcttcttaaattgaaaagtgattaatccatcggttctcctctcttctggaacgtgtcctaggaggacaggtactactcagtttcatatctgctgtcaggagg

SEQ ID NO: 9195 - DNA, 436 bp, Homo sapiens
  chr5.fa.O7frz.156860048
  Located on chromosome 5
  Distance between a terminus base of telomere on chromosomal short arm and 5'-terminus of this base sequence : 140077127
  Distance between 3'-terminus of neighbour sequence of sequence listing upward to telomere on chrosomal short arm and 5'-terminus of this base sequence : 183433
gtctgatctgcttttggtactatgtatacttcctaatacttttgttcccctacttgctatagaagtagaagtagttttactggaatacctacgattttcctgtcctgtctctctcattcacttagttattttctgccttggctctggttgccaaaattctaaacttctgttttgtgttttgtgtgtgtgtgtgtgtgtgtgtgtgtgtgtgtgttttgacagggtcttgctctgttgtccaggctagactgcagtggcacaatcacggctcactgcagccttgaccctctgggcttaagtgatcctcccacctcagcctttccagtagctgggacagcaggtgtgtgctaccatacctggctttttaaaaaaatttttgtagagatagggtcttgctgtgtggcccaggctgctctcaaactcctgtattcaagtg

SEQ ID NO: 9196 - DNA, 342 bp, Homo sapiens
  AC026291.2_80379
  Located on chromosome 5
  Distance between a terminus base of telomere on chromosomal short arm and 5'-terminus of this base sequence : 140185536
  Distance between 3'-terminus of neighbour sequence of sequence listing upward to telomere on chrosomal short arm and 5'-terminus of this base sequence : 107973
atttagagccagctctagacacagaacggtgggggtttgagaggctgggtgcacacactgggctggagagaagtccagcctccaggtagcccctgcgtggacgtgtgtgtgtgtgtgtgtgtgtgtgtgtgtgtgtgtgtgatgctttaagggcctgacaattgtgtgaggctttgtgcagtaatgtggctatgtgtgacatcgggtgtgatatgcaaatgggtttgtgacagtgtattggagactgagatgtgaatgggttagtgtatgtcagtggccacactttggaatgttctgtgacattgcgtgtgtactcttgtgacattgtacagttctgtaaca

SEQ ID NO: 9197 - DNA, 421 bp, Homo sapiens
  AC026291.2_198981
  Located on chromosome 5
  Distance between a terminus base of telomere on chromosomal short arm and 5'-terminus of this base sequence : 140266107
  Distance between 3'-terminus of neighbour sequence of sequence listing upward to telomere on chrosomal short arm and 5'-terminus of this base sequence : 80229
catcaggatagtaaggtgataaagagcactgactggcctgggtttgagtctgggcaagtcccttccttctctctctttctttctttctttctttctttctttctttctttctttctttctttctttctttctttccttctttccctctttccctccctttctttctttctttctttctttctttctttctttctttctttctttctttctttctttctttccttctttctttctttctcagagtctcgctctgtcacccaggctggagtgcagtggcacaatctcggctcgctgcaagctctgcctcccaggttcacaccattctactgcctcagcctcccgagtagctgggactacaggcacccgccaccttgcccagctaattttttttgtatttttagtagagacagatttcaccgtg

SEQ ID NO: 9198 - DNA, 471 bp, Homo sapiens
  chr5.fa.O7frz.157338357
  Located on chromosome 5
  Distance between a terminus base of telomere on chromosomal short arm and 5'-terminus of this base sequence : 140364396
  Distance between 3'-terminus of neighbour sequence of sequence listing upward to telomere on chrosomal short arm and 5'-terminus of this base sequence : 97868
accatcctgtagccacataaatatctctggtattcatggaaatcattgccctgggtcctgctctcccttaattccccttccttccctctaccccatttccaaaccctcaaaacaaacaaactctggccagactggaaaatgggctttctgagaactttttttctctctcaaacacgtcggcacacacacacacacacacacactcactgccagaccctttggtaccctcaggcagccttcggagcaggggagggctctgcaaatgcttcctcccattctggccaggctgcccgaccccagaagttgggaggaggcctgggtgtggccctggctgctgcagagagaacttggcattactgtgcccaggaggtacagcccacatgtggaggtgggggtgccgggggtgtttccgtctcctctaaggagcgcaggacaccctctacatctccccctagtcttgctaagcaaggc

SEQ ID NO: 9199 - DNA, 413 bp, Homo sapiens
  AC011379.4_118029
  Located on chromosome 5
  Distance between a terminus base of telomere on chromosomal short arm and 5'-terminus of this base sequence : 140506663
  Distance between 3'-terminus of neighbour sequence of sequence listing upward to telomere on chrosomal short arm and 5'-terminus of this base sequence : 141796
gctgagcactgtacaacctcatcttttaaaaatctgatctctaagaaaggtggggggcttcttgggagccaacagagagccagagcctgtcagggccagaggctgctccataaaaaaggttttttttgttttgttttgttttgtttccaaggctgatgcttgcaagaggcagaagagtttgctgcactggagccagcatctgatttaaaacacacacacacacacacacacacacaggtccataatccattagcctatcaatgagggtccagggagttttcaacacccagcttttaaccttgaaggatgtggagctcaggaatgccagtgagctcttggggaattttataccgcactgggctccacaggaaactggtccaaggatgagtgacttaggctaggactgctattct

SEQ ID NO: 9200 - DNA, 241 bp, Homo sapiens
  AC011379.4_33240
  Located on chromosome 5
  Distance between a terminus base of telomere on chromosomal short arm and 5'-terminus of this base sequence : 140625850
  Distance between 3'-terminus of neighbour sequence of sequence listing upward to telomere on chrosomal short arm and 5'-terminus of this base sequence : 118774
caaagatacagtaccaggacctagagaggctgagatttagagcctcatggtgcaaactcaattgtagggtcctagccaggactacttgcctgtatcttctaagaatctcacaacagtgccacatgcctcagctttatccaagcaacagaaggaggtggtggaggtggtgatggcagcagcagcagcagcagcagcagtggcagcaaatctgtccccagtgcactacagtactgttttgcta

SEQ ID NO: 9201 - DNA, 278 bp, Homo sapiens
  AC005575_43324
  Located on chromosome 5
  Distance between a terminus base of telomere on chromosomal short arm and 5'-terminus of this base sequence : 140625922
  Distance between 3'-terminus of neighbour sequence of sequence listing upward to telomere on chrosomal short arm and 5'-terminus of this base sequence : -169
tagccaggactacttgcctgtatcttctaagaatctcacaacagtgccacatgcctcagctttatccaagcaacagaaggaggtggtggaggtggtgatggcagcagcagcagcagcagcagcagtggcagcaaatctgtccccagtgcactacagtactgttttgctatgatgaaatacacatggcatatggctacaaagttactatcttgagagtggatagaaatgggatttttcatgtgccagatttcacttccctttctgaaacaattcttgta

SEQ ID NO: 9202 - DNA, 387 bp, Homo sapiens
  AC011380.5_2382
  Located on chromosome 5
  Distance between a terminus base of telomere on chromosomal short arm and 5'-terminus of this base sequence : 140629419
  Distance between 3'-terminus of neighbour sequence of sequence listing upward to telomere on chrosomal short arm and 5'-terminus of this base sequence : 3219
ttaagctgatttgaatagtgcttcagcacttgcagtggagaaattcctgacaagcaaattggaatttgaaaacatagatcagaaaaagagccagaagggccgggtgcagtggcttatgcttgtaatcccagcactttgagaggctgaggtgggtagatcacttgagcccagagttcaagaccagcctgggcaacatggtgaaacctgtctctacaaaaaaaacaaaacaaaacacacacacacacacacacacacacacacacacacacacacacacacacaaattagctggctgcggtggtgtgcacctgtagtcccagctactcgggggagaaattgaaatgaaccagaggccaagtctcagtgaacttctccagtgctttaaac

SEQ ID NO: 9203 - DNA, 285 bp, Homo sapiens
  AC011380.5_47554
  Located on chromosome 5
  Distance between a terminus base of telomere on chromosomal short arm and 5'-terminus of this base sequence : 140774437
  Distance between 3'-terminus of neighbour sequence of sequence listing upward to telomere on chrosomal short arm and 5'-terminus of this base sequence : 144631
atacatcttgtgacgctatcactacagacttttttcttttcttaggaactttgtctccagctctccttctctaaattagttttttttttctttctttctttctttcctgtttatcctgccttggggtattgaaaagagttttctcctctctgtccctctattttcccatttgtaagatgaggatttgggcaataccagtgcatccctccacccccaccccactcccatttctactttagccacacgacactttcttcacatgaactcttgccttaaagactaaac

SEQ ID NO: 9204 - DNA, 474 bp, Homo sapiens
  AC021081.2_19753
  Located on chromosome 5
  Distance between a terminus base of telomere on chromosomal short arm and 5'-terminus of this base sequence : 140993894
  Distance between 3'-terminus of neighbour sequence of sequence listing upward to telomere on chrosomal short arm and 5'-terminus of this base sequence : 219172
tccaacttagagtaggtgcttaattagaatttttttttaaaataagtgactgaataaacaacctctttctttctggagggcagacaggaaaattgcaaaatggcccccaaggcctctctaacttcctatgtcaccccattcttttctttatggctgtggcagattagtgacaatgtggtttggtttgtttttctctcagttctttcttctttgcctccctcctcctcctcctcctcctcctccttctcccccttcttttccctctctctctctctctctggcttcccaggagaaaacatattctattcttcctggctcatcctcaagacccagttgcatatgatgaatagtaagttcagggtcagggtcctagaatgcagcctttacctcagagtttctaaggagaaaccaagtcccagagccatggaatattagaggagtgaggaacagaagtgcattgtattcactcagtga

SEQ ID NO: 9205 - DNA, 327 bp, Homo sapiens
  DISO7_00024490
  Located on chromosome 5
  Distance between a terminus base of telomere on chromosomal short arm and 5'-terminus of this base sequence : 141011591
  Distance between 3'-terminus of neighbour sequence of sequence listing upward to telomere on chrosomal short arm and 5'-terminus of this base sequence : 17223
ctagcacttagaacctcatgttgcagcctgtctgtctgtcttttcaaaagactgtgagcttcacaagggcagggagggctgtctgtccctcaccactgagtctccagagtcagggcaggccccactacagaatcgatcaatgaatgagtgaatgagtgaatgaatgaatgaatgaatgaatgaatttttcataactgctgctccaaaccattcctcagcttaggttccaagcacaaccagaatatgacctccagagcccttctagacgctctgaatctcgctgtacttaagcatcagaggcccctcccagctcaagactgggagctc

SEQ ID NO: 9206 - DNA, 418 bp, Homo sapiens
  chr5.fa.O7frz.157967179
  Located on chromosome 5
  Distance between a terminus base of telomere on chromosomal short arm and 5'-terminus of this base sequence : 141057378
  Distance between 3'-terminus of neighbour sequence of sequence listing upward to telomere on chrosomal short arm and 5'-terminus of this base sequence : 45460
atagtaaggctcaggccatccgttatttcttccccatggcacttggggcacttggcgcattattgtagcttctgagcttaagccgggtgtgtgtgtgtgtgtgtgtgtgtgtgtgtgtgtgtgtatgtatgtatgtgtgacgcttgagcccggagaagccacagggtcctaagtgaggccgacagctccaaactccgtccccagtcctcactcctactccaagtgatgatgggcggcttttgtgcgtggatcgctttcccccagtcctgtccccatacttaatcctgggttgcgcgtatttatcttttacgtagtattttagacgtgatcttccggaagtcttctctgatcctccagcgcaggattagggtcctctgctttgtgctcccacagcttcttgtagtttcctatttcagca

SEQ ID NO: 9207 - DNA, 464 bp, Homo sapiens
  chr5.fa.O7frz.158327124
  Located on chromosome 5
  Distance between a terminus base of telomere on chromosomal short arm and 5'-terminus of this base sequence : 141269385
  Distance between 3'-terminus of neighbour sequence of sequence listing upward to telomere on chrosomal short arm and 5'-terminus of this base sequence : 211589
ctcaggtatacaagtgcattaatctctccatcaatactaacttaaggccaggcatggtggctcacacctgtaatcccagcattttgagaggccaaggtgggaggatggtttgaggccaggagttcaagaccaacctgggcgacatagggatatcttgtactgtgtgtgtgtgtatatatatgtatatatgtgtatatatatatgtatatatatatgatgggctctccttacatatatatatatatatgtacttatgtatatataagccaggcatggtggtacatgcctttagtccctactgtagtgctacttgggagggtgaggtgggaggacggcttgagcctgggaagttgaggctgcagtgacccatgattgtgccactgcactccagcctggatgacaaagtgagaccctatttcaaaaattgaaaaaagcaaaagcaatagtaacaccattatcctgca

SEQ ID NO: 9208 - DNA, 253 bp, Homo sapiens
  AC005752.1_52126
  Located on chromosome 5
  Distance between a terminus base of telomere on chromosomal short arm and 5'-terminus of this base sequence : 141647032
  Distance between 3'-terminus of neighbour sequence of sequence listing upward to telomere on chrosomal short arm and 5'-terminus of this base sequence : 377183
cactagtgtgatgcttattccattgcaggccttcttttcttacatacacacacacacacacacacacacacacacacacaccgtttgtttttttcgttttttaagagatgaggtcttgccatgtcacacgggctagtcttgaactcctggcctccagtgatcgtaccgcatcagcttcccaagttgttgggattacaggcatgagccctgatcattttttattggtcctgtgatagattcctgatttaagctg

SEQ ID NO: 9209 - DNA, 396 bp, Homo sapiens
  AC005618.1_58650
  Located on chromosome 5
  Distance between a terminus base of telomere on chromosomal short arm and 5'-terminus of this base sequence : 141756299
  Distance between 3'-terminus of neighbour sequence of sequence listing upward to telomere on chrosomal short arm and 5'-terminus of this base sequence : 109014
tttgtcattccaacctgtatagcttatcctgatacatacaagtaaaaatacatatgaataaaagatattttatgcccatgaaattaaatgatgtttgactccttccaagacaggtgacactctttttttctttctccttccttccttcctctctctttcctccttccttccttcctctctctctttcctccttccttccttccttcctctctctctttcctccttccttccttcctctctctctttcctccttccttccttcctctgtttctctctttctttctttctttctttctttctttctttctttctttcttgacagggtcttactctgtctggagtgcagtggcatgatcacggctcactgcagccttgacctcgcagactcaagtgatc

SEQ ID NO: 9210 - DNA, 265 bp, Homo sapiens
  D5S2119
  Located on chromosome 5
  Distance between a terminus base of telomere on chromosomal short arm and 5'-terminus of this base sequence : 141838462
  Distance between 3'-terminus of neighbour sequence of sequence listing upward to telomere on chrosomal short arm and 5'-terminus of this base sequence : 81767
gcatttttagtacagacggggtttcaccgtgttagccaggatggtctcgatttcctgacctcgtgatctgcccgcctcggcctcccaaagtgctgggattataggcgtgagccactgcacccggcccggagacattgtttatacacacacacacacacacacacacacacacacacacgtgtgaaaagtgggtattatgatactgctgtcattgagatattttaattgaggaataaatttttttcctgtgatgtttcttgggaca

SEQ ID NO: 9211 - DNA, 302 bp, Homo sapiens
  AC005618.1_144871
  Located on chromosome 5
  Distance between a terminus base of telomere on chromosomal short arm and 5'-terminus of this base sequence : 141842576
  Distance between 3'-terminus of neighbour sequence of sequence listing upward to telomere on chrosomal short arm and 5'-terminus of this base sequence : 3849
ggtgattcggtattttctaaagacagtcatgggttaattgaggtgagtttatatcaaatcttctttcttttttttttttaattgctctgtctcccaagctggaatgcagcggtacgatcatagctcactgcagcctcaaactcctaggctcaagcaattatcccacctttgcctccggtgtaacagggactacaggtgcaagccacctactgtctgcctatctatctatctatctatctatctatctatctatctatctatctattactttcttgtacagacaggagtctcactatgttgag

SEQ ID NO: 9212 - DNA, 252 bp, Homo sapiens
  AC005366.1_30722
  Located on chromosome 5
  Distance between a terminus base of telomere on chromosomal short arm and 5'-terminus of this base sequence : 141909421
  Distance between 3'-terminus of neighbour sequence of sequence listing upward to telomere on chrosomal short arm and 5'-terminus of this base sequence : 66543
tgattctttcataaggtccacattttatatttgagtgagtgtctcttaagtatcttaatgctcttttaatgtaaaagacttcccctccatcttccatttttgcaatttatttgttgaatccctgccttttcatatatatctttctaaacttttctttgtgtaatcaaagaacatgcatgagcttcatttttatttttatttatttatttatttatttatttatttatttatttattgatacgtagccttgct

SEQ ID NO: 9213 - DNA, 173 bp, Homo sapiens
  D5S1979
  Located on chromosome 5
  Distance between a terminus base of telomere on chromosomal short arm and 5'-terminus of this base sequence : 142154631
  Distance between 3'-terminus of neighbour sequence of sequence listing upward to telomere on chrosomal short arm and 5'-terminus of this base sequence : 244958
attatttccagcccaggtgccacttcattttacacacacacacacacacacacacacacacacacacacacacacaattcggactacttgtaggggaactgccaagttcaaaggaagggttaaacctgctggaaagagttttcccaccctacccaggacccttgagagtgagg

SEQ ID NO: 9214 - DNA, 152 bp, Homo sapiens
  D5S2011
  Located on chromosome 5
  Distance between a terminus base of telomere on chromosomal short arm and 5'-terminus of this base sequence : 142252122
  Distance between 3'-terminus of neighbour sequence of sequence listing upward to telomere on chrosomal short arm and 5'-terminus of this base sequence : 97318
tcagcctcacccagagaagtagagagaagaggggcagccgaggagtagagagaacccagaagtagagttctgcaaaaccgtgtgtgtgtgtgtgtgtgtgtgtgtgtgtgtgtgtgtgtgtgtgtgtgtgtctccactcttgtgttccaagc

SEQ ID NO: 9215 - DNA, 147 bp, Homo sapiens
  DISD22_0008883
  Located on chromosome 5
  Distance between a terminus base of telomere on chromosomal short arm and 5'-terminus of this base sequence : 142464450
  Distance between 3'-terminus of neighbour sequence of sequence listing upward to telomere on chrosomal short arm and 5'-terminus of this base sequence : 212176
ttctcagggaggttggtgtggcatcatgcccagcatagtgcctggcaccaagaaggcacacaatactcatctgtttttgattgctgaatgaatgaatgaatgaatgaatgatagaaagaatgagatatttgtgctaaggaagagttg

SEQ ID NO: 9216 - DNA, 198 bp, Homo sapiens
  AC005592.1_81870
  Located on chromosome 5
  Distance between a terminus base of telomere on chromosomal short arm and 5'-terminus of this base sequence : 142869275
  Distance between 3'-terminus of neighbour sequence of sequence listing upward to telomere on chrosomal short arm and 5'-terminus of this base sequence : 404678
ctttctagactctgactcaacgacaccacactgctgctggatttcatgaaatcttacaccccatcctatccagtacattgtatcatgtctttaagaaatttaaaggagcagaaacaagttttaaaaagctaagattgtgtgtgtgtgtgtgtgtgtgtgtgtgtgtgtgtgtgtgtattacatgctccttagaccatt

SEQ ID NO: 9217 - DNA, 354 bp, Homo sapiens
  AC005370.1_33802
  Located on chromosome 5
  Distance between a terminus base of telomere on chromosomal short arm and 5'-terminus of this base sequence : 142910242
  Distance between 3'-terminus of neighbour sequence of sequence listing upward to telomere on chrosomal short arm and 5'-terminus of this base sequence : 40769
ctaagcacttaaaagaattcctgacctccaactgaatgatgctctatgagggggagtgttttgtggatgaataagccagactgcagggaaaaaacatacagaatcaagggaagaaataaaggatactacaggacacgtgtgtgtgtgtgtgtgtgtgtgtgtgtgtccgcttgtagttctctctcttcgttatgaagtgtgcaagctggggctgggactgagctgtttggtgacacagctggattagataacagccccacttcctgccagttacactagatgcaagcatctatgtccctcttatctgaaacatggcttgatgagtctggtgtggctagactgtaaactccttaa

SEQ ID NO: 9218 - DNA, 349 bp, Homo sapiens
  AC016560.6_172920
  Located on chromosome 5
  Distance between a terminus base of telomere on chromosomal short arm and 5'-terminus of this base sequence : 142910245
  Distance between 3'-terminus of neighbour sequence of sequence listing upward to telomere on chrosomal short arm and 5'-terminus of this base sequence : -351
agcacttaaaagaattcctgacctccaactgaatgatgctctatgagggggagtgttttgtggatgaataagccagactgcagggaaaaaacatacagaatcaagggaagaaataaaggatactacaggacacgtgtgtgtgtgtgtgtgtgtgtgtgtgtgtccgcttgtagttctctctcttcgttatgaagtgtgcaagctggggctgggactgagctgtttggtgacacagctggattagataacagccccacttcctgccagttacactagatgcaagcatctatgtccctcttatctgaaacatggcttgatgagtctggtgtggctagactgtaaactcctt

SEQ ID NO: 9219 - DNA, 336 bp, Homo sapiens
  AC004752.1_9016
  Located on chromosome 5
  Distance between a terminus base of telomere on chromosomal short arm and 5'-terminus of this base sequence : 143279165
  Distance between 3'-terminus of neighbour sequence of sequence listing upward to telomere on chrosomal short arm and 5'-terminus of this base sequence : 368571
atagcgatgtatagcacctctagcctgattggctagagccactccatttctttcttgaattaggtatttatttatttatttatttatttatttatttatttatttacttacttatttattgagatggagtctcactttgtcgcccaggctggagtgcagtggcgccatcttggttcactgcaacctccatctcccgggttcaagtgattttcctgcctcagcctcccgagtagctggaactacaggcacatgccaccacgcccggctaatttttgtatttttagtggagatggggtttcaccatgttggccaggctggtctccaactcctgacctc

SEQ ID NO: 9220 - DNA, 248 bp, Homo sapiens
  chr5.fa.O7frz.159528702
  Located on chromosome 5
  Distance between a terminus base of telomere on chromosomal short arm and 5'-terminus of this base sequence : 143353597
  Distance between 3'-terminus of neighbour sequence of sequence listing upward to telomere on chrosomal short arm and 5'-terminus of this base sequence : 74096
ataatgttgtccactagatgtcaggatccccttatctattacagcaattctcatcgtctcaacttgaaactttgtctactattattattattattattattattaacagacagggtcttgctctgttgcccaggctggagtgcagcggtatgatcacagcctctgcagcctctgcaagcttgaattcctgggcccagatgatcctcctgcctctgcttcccaagtagctaagataacaggttcatgcc

SEQ ID NO: 9221 - DNA, 366 bp, Homo sapiens
  AC011401.7_162077
  Located on chromosome 5
  Distance between a terminus base of telomere on chromosomal short arm and 5'-terminus of this base sequence : 143381458
  Distance between 3'-terminus of neighbour sequence of sequence listing upward to telomere on chrosomal short arm and 5'-terminus of this base sequence : 27613
gaagtcaggagttcgagactagcctggccaacatggtgaaaccccacctctactaaaaatacaaaaattagccgggcctgctggcgggcacctgtagtcccagctactccagaggctgaggcaggagaatggcttcaaactggaaggcaggggttgcagtgtgccaagattgcgccactgcactccagcctggggaacagagcaagactctgttgaaagaaagaaagaaagagagagagagagagagagaaagaaggaaggaaggaaggaaggaaggaaataaataaataaatatacatatgaagggaactgcattaataagaaaatatttcactaggaatgctcttaaacttgatcagtgctagt

SEQ ID NO: 9222 - DNA, 253 bp, Homo sapiens
  AC005214.1_4107
  Located on chromosome 5
  Distance between a terminus base of telomere on chromosomal short arm and 5'-terminus of this base sequence : 143429449
  Distance between 3'-terminus of neighbour sequence of sequence listing upward to telomere on chrosomal short arm and 5'-terminus of this base sequence : 47625
acagcttaggcagtttactgtaactgattgtcctgatgtccttatccataaactaaaaaatccccacagaagcttctgtaagtataatgtgaaataagtctataaacacaacagcaacaacaacaagaatgtaaaccaaatgcccagttatgggaaactggtgaagaaatttactggtaaacccactgtaatggtgtgtgtgtgtgtgtgtgtgtgtgtgtgtgtgtgtgtgtacatgtcaacttggctcagt

SEQ ID NO: 9223 - DNA, 285 bp, Homo sapiens
  D5S2116
  Located on chromosome 5
  Distance between a terminus base of telomere on chromosomal short arm and 5'-terminus of this base sequence : 143518674
  Distance between 3'-terminus of neighbour sequence of sequence listing upward to telomere on chrosomal short arm and 5'-terminus of this base sequence : 88972
gggctctcatggaggtgatacattcaccagccatctttaggaaggtaaatgattaattgcactgttttcccactgctgcaaggacaatgaaagggaaagtaaacttgtgcacctcatttcatatctagttgtaattttccacacaacaataaacagaaacatatacttcaaggttatcaggcctttttttctgtgtgtgtgtgtgtgtgtgtgtgtgtgtgtgtgtgtgtgtgtggtgtggtgtggttgtgtgctttcattaagaaagttaatgcaaaaatccca

SEQ ID NO: 9224 - DNA, 429 bp, Homo sapiens
  AC011399.2_67442
  Located on chromosome 5
  Distance between a terminus base of telomere on chromosomal short arm and 5'-terminus of this base sequence : 143531119
  Distance between 3'-terminus of neighbour sequence of sequence listing upward to telomere on chrosomal short arm and 5'-terminus of this base sequence : 12160
tatttggataatccaacagataagaaactacattagtatggccaccctttgcagcttcaatgagcattgttgaaccatcctgaaaaagaattgccatgataattaattctttatagtttcttagcagctcatataaaatcaaaactcatttaaacagtattaaatactaagcactaagatagatcaaacatatttttataactatacacatattatttatatatatatacacatacatacgtgtgtgtgtgtgtgtgtgtgtgtgtgtgttttaatagagatggggtctccttatgttgcctagactagtctcaaactcctgggctcaagtgatccacccgcctcagctttctaaagtgctgggatcatagacatgagccaccgcacacagcctgtttacttatttttaagtagactaccttgagtcga

SEQ ID NO: 9225 - DNA, 195 bp, Homo sapiens
  DID22N_0026277
  Located on chromosome 5
  Distance between a terminus base of telomere on chromosomal short arm and 5'-terminus of this base sequence : 143881137
  Distance between 3'-terminus of neighbour sequence of sequence listing upward to telomere on chrosomal short arm and 5'-terminus of this base sequence : 349589
tcatcttctatcccaggaccctgcctctgcttctttggtaattaaaattatatggagagagagagagagagagagagagagagttcagactaacatctgtgattttaagtattaatttaaaacagctgtaaaaaatattcaaatattcactttaggtaatatgttggctttttccagaaagaatgctgtcttcct

SEQ ID NO: 9226 - DNA, 405 bp, Homo sapiens
  AC006525.1_60158
  Located on chromosome 5
  Distance between a terminus base of telomere on chromosomal short arm and 5'-terminus of this base sequence : 143925581
  Distance between 3'-terminus of neighbour sequence of sequence listing upward to telomere on chrosomal short arm and 5'-terminus of this base sequence : 44249
atcatgaggttaggagatcaagatcatcccggctaacacggtgaaaccccttctctactaaaaatacaaaaaattagctgggcatggtggcacgtgcttgtaatcccagctactggggaggctgaggcaggagaatagcttgaacctaggaggtggattttgcagtgagccgagattatgccactgcactccagcctgggtgacagaacgagactccatctcaacaaataaataaataaataaataaataaataaatagaattatgtaactatctgtgtagatctcaggctgctaggacttagtgctccagaataaagctgtgttcctttaggctttcaaagggcctgcctgctgacagccaaaactctgaatctagtgttctaatggacacttaaatggttaga

SEQ ID NO: 9227 - DNA, 406 bp, Homo sapiens
  AC001156_3226
  Located on chromosome 5
  Distance between a terminus base of telomere on chromosomal short arm and 5'-terminus of this base sequence : 143935068
  Distance between 3'-terminus of neighbour sequence of sequence listing upward to telomere on chrosomal short arm and 5'-terminus of this base sequence : 9082
ttgtttcatgaaactttaaaggttttatttgtccatttgcttgcactttgaatgtttcctcaattgagttagcagattctgactaaagtagatctctagattagaacatctgaattggtcctaccagttccttcagatcttatcagaaggcaagaaattaaactctccattgttgtaaataataataataataataataataataataataataataaaataatgccaggtaaaataaaaataatgttcaacatagggcatgttcttttcaaagattgtttgactatttttgctttatataattctatttaaagcttagaattatcatgtatacaaaattaccacctaggagaattgacacatttaccatgttgaagtttctgatacatggtcattcacagtcttc

SEQ ID NO: 9228 - DNA, 406 bp, Homo sapiens; identical to SEQ ID NO: 9227
  AC001164_2712
  Located on chromosome 5
  Distance between a terminus base of telomere on chromosomal short arm and 5'-terminus of this base sequence : 143935068
  Distance between 3'-terminus of neighbour sequence of sequence listing upward to telomere on chrosomal short arm and 5'-terminus of this base sequence : -406

SEQ ID NO: 9229 - DNA, 272 bp, Homo sapiens
  chr5.fa.O7frz.138011975
  Located on chromosome 5
  Distance between a terminus base of telomere on chromosomal short arm and 5'-terminus of this base sequence : 144257560
  Distance between 3'-terminus of neighbour sequence of sequence listing upward to telomere on chrosomal short arm and 5'-terminus of this base sequence : 322086
ataatcagcaagttagcagtgatggtcctctggggctgtctttatgtaagccgcccaccccctattccaacacacacacacacacacacacacacacactgtgcaagccactaattttcagttctgtgttttgcacagacaaatgtaatttctaaccgaaatagaatatggtatcacagctgatgagaactgtgggaagaggttcttcaagtaatggaatataaaatgtctcatttccacaatggaagaggtggaatagtgaaggcagttat

SEQ ID NO: 9230 - DNA, 379 bp, Homo sapiens
  AC016598.3_22186
  Located on chromosome 5
  Distance between a terminus base of telomere on chromosomal short arm and 5'-terminus of this base sequence : 144484269
  Distance between 3'-terminus of neighbour sequence of sequence listing upward to telomere on chrosomal short arm and 5'-terminus of this base sequence : 226437
caccttagtaaacattatcctcaatctcattttaaaaggtagcatagtatttcactgtctaaatgaatgatggaggaatataatagaataatgggggatgattctatctccaaaagctaaacatttaacaggcactaaaagaaagactccacctatgtcagacatgtgttgatcgaagaggggttcttttgtgtgtgtgtgtgtgtgtttgtgtgtgtgtgtgtgtgtgtgtgtgtgtgttgggggtggatttcttcttctttttgtaaaaccccgaagacctgctagacaaattcaaaaagagcagtaacgctgaggagaattcttgataactattaagtagtgaggaaaacaagagctactggataatctttcaact

SEQ ID NO: 9231 - DNA, 403 bp, Homo sapiens
  AC016598.3_92979
  Located on chromosome 5
  Distance between a terminus base of telomere on chromosomal short arm and 5'-terminus of this base sequence : 144537696
  Distance between 3'-terminus of neighbour sequence of sequence listing upward to telomere on chrosomal short arm and 5'-terminus of this base sequence : 53048
aggatggactatagttcctaagagggcataatcttctgctttttctgtgggattctagcccccttttctgggcagggatggcatgagcccagctactaaggagatatctgtccacatgacatttattagtttagaagtggtagcctcttcatcaggaatttaagtaatttttaaagagttacctgatgagtgcatacatgtatgtgtacgtgcatgtgtacgcgcgtgtgtgtgtgtgtgtgtgtgtgtgtgtgttttctggaatccctgtaagtcatctttctggtcactcatgtagccagtgctatgacctcatataattggaactctaattctactgcctactaaacagtcaataatattgagcactattaaacatctcatgaaagaatagcattagaat

SEQ ID NO: 9232 - DNA, 387 bp, Homo sapiens
  chr5.fa.O7frz.161950120
  Located on chromosome 5
  Distance between a terminus base of telomere on chromosomal short arm and 5'-terminus of this base sequence : 144566667
  Distance between 3'-terminus of neighbour sequence of sequence listing upward to telomere on chrosomal short arm and 5'-terminus of this base sequence : 28568
ggctgttaaatgtttacagagtaggggcaggagtggcatgtcaaagggcaaattcaacttgtgtggttacttgaggggttgtgagtggctgtgtaggaattctgggcagggtgagaaagagacaagaagatggggcattagatctgccagctaattattccatatggcacgtgtcatagtggaaatacgtctctagctggaaggaatttttaaaaatcttatgatgagagaggggacaagagagaatgagagagagagagagaatgagagagagagagaaagagagagagaaaatgagagagagagaatgagagaaagaaaatcagctatgggaggtatagagaaaaaagtaggattaaaaaatagttccggttaagactaaacaat

SEQ ID NO: 9233 - DNA, 479 bp, Homo sapiens
  chr5.fa.O7frz.162069082
  Located on chromosome 5
  Distance between a terminus base of telomere on chromosomal short arm and 5'-terminus of this base sequence : 144685779
  Distance between 3'-terminus of neighbour sequence of sequence listing upward to telomere on chrosomal short arm and 5'-terminus of this base sequence : 118725
ggcttcaggtcatagtttattctaacctaattaaattaactcatggatgagaccactgagtttaaatcattctcccaaggctatagaacttgttagatggcccatccaggaccaggacacaggcatccaaggacgcaggactccaagcctggtgctctttctttccccttttcatttctgacttcaaaaaacagcacatgtttagaatagaatgttaaagaacaaagaaaattcctcctaaattcaactacctagagacaaccaacatcagcattttggcaaatatcccttctaatgtgtgtgtgtgtgtgtgtgtgcgcatgtatacaattttacacatgtaactagctattaaatggggttctttgagttgtttcagagtgttagctgaggccccaaatctcaggacaatggaagacaagtactcacacattctagagagaggagctggagcattcttactgaaagatgtccaactg

SEQ ID NO: 9234 - DNA, 435 bp, Homo sapiens
  chr5.fa.O7frz.162157056
  Located on chromosome 5
  Distance between a terminus base of telomere on chromosomal short arm and 5'-terminus of this base sequence : 144773704
  Distance between 3'-terminus of neighbour sequence of sequence listing upward to telomere on chrosomal short arm and 5'-terminus of this base sequence : 87446
agcaaaggttagccttaactactatttttaatcattaagaaattaagagatttgtattttttacttgaaaccccaaattacttcattcattctttcatttattcataaaatatgaatccatttggtaggatttatagactgttacatgccacacattttgctaggagctggagacatgtctgagaatagggcagatacaatcctgccctcaagagtaaatcttttgaatgagcactgtaaccaatttactccatgtgtccaaacgtaatgcactgtgaagaccttagtccatacagctatgcatttgatgtagaagcaaaactctctttctcctttaaaatgaaaaaaaccaaccaaccaaccaaccaacctgtctagattctgatgaagtagatctgtgctaattttcttagcttcagtaattgcttgtgacat

SEQ ID NO: 9235 - DNA, 479 bp, Homo sapiens
  chr5.fa.O7frz.162283500
  Located on chromosome 5
  Distance between a terminus base of telomere on chromosomal short arm and 5'-terminus of this base sequence : 144897854
  Distance between 3'-terminus of neighbour sequence of sequence listing upward to telomere on chrosomal short arm and 5'-terminus of this base sequence : 123715
cctatctcatgaagttcttgtaagaataagaaagagtgccttgttcattcattatccatccatcagcaaatttaccaattgtctactacataacaggtattgttgtaatcacaaatccctacccttgagggatgggtagggtagggatttttgttggctctacacacacacacacacacacacacattttgcacgcgtgcaaaaaaaaattaacaaatcaaggtctattcaggaaatagatggctcagtcaagcagggtaattgattgaagagagcttaattaaggaactaattataaatgtgctacaggattataggaacccagaagggtgtggtgaaataccttgtggctagcaatagcagagaactgttaccactctagacctcaagggttaggggaagagaacaatcacctgaactaagttagaaagatctatagctatgggaaggcactgtcctgtaagagttgtagccatgag

SEQ ID NO: 9236 - DNA, 274 bp, Homo sapiens
  chr5.fa.O7frz.162411573
  Located on chromosome 5
  Distance between a terminus base of telomere on chromosomal short arm and 5'-terminus of this base sequence : 145026180
  Distance between 3'-terminus of neighbour sequence of sequence listing upward to telomere on chrosomal short arm and 5'-terminus of this base sequence : 127847
tcttaaatctccatcctcacttggcttctgtgacatcactctttcccgctgttacttttccattttctccagctgttttgctatctcctccttctctacctcacatctaaccaccacattgacacagagtttggtcatgagctctttcttttccctcttcttctccttcttctgtttcttcttctccctcttcttcttcttcttcttcttcttcttcttcctcttcttcttcttcttttttttttgagttgaattctcactctgtcaccatgct

SEQ ID NO: 9237 - DNA, 352 bp, Homo sapiens
  chr5.fa.O7frz.162525440
  Located on chromosome 5
  Distance between a terminus base of telomere on chromosomal short arm and 5'-terminus of this base sequence : 145151613
  Distance between 3'-terminus of neighbour sequence of sequence listing upward to telomere on chrosomal short arm and 5'-terminus of this base sequence : 125159
ttatttaattagaagctgccaactgtgcctatataagcattaattcatcaagctgttgtgctcgggttaatgggacgaaaccatgggagatgctctaaagaagggagttggctgcatgcaaagatgcttttcacaaaggaactcaacttcctcctgggcttagggggaaatatatatatatatatatttatatgtgtgtatatatataaatatatatatatttatatgtgtatatatatacacatatatatgtgtgtatgtatgtatatatatgtgtgtgtatatatatgtatatatatatatatacaagctccttagatctaaggaattaacaatttaagcaatcagtctt

SEQ ID NO: 9238 - DNA, 472 bp, Homo sapiens
  chr5.fa.O7frz.162610232
  Located on chromosome 5
  Distance between a terminus base of telomere on chromosomal short arm and 5'-terminus of this base sequence : 145235754
  Distance between 3'-terminus of neighbour sequence of sequence listing upward to telomere on chrosomal short arm and 5'-terminus of this base sequence : 83789
tgtaattaaatgagaagccagttacattttgcatataatgttgaatgctttttagaaaattatctagtattttaactagaatataaaccatgcatccccttaaattaaaaccgcaggggctgggtgcggtggctcacgcctgtaatcccagcactttgggaggccaaggcaggtggatcacaaggtcaggagatagagaccattccgggacagcatggtgaaaccccatgtctactaaaaatacaaaaactagccaggtgtggtggcacacacctgtaatcccagctactcaggaggctgaggcaggagaatcacttgaatctgggaggcagaggttgcagtgagccgaggttgccccactacactccagcctgaatgacagagtgagactctgtcaaacaaacaaacaaacaaaaaacacagcaacaaaaaaccacagcgttttttgaataaatgccaataaatcatatct

SEQ ID NO: 9239 - DNA, 463 bp, Homo sapiens
  chr5.fa.O7frz.162713193
  Located on chromosome 5
  Distance between a terminus base of telomere on chromosomal short arm and 5'-terminus of this base sequence : 145338600
  Distance between 3'-terminus of neighbour sequence of sequence listing upward to telomere on chrosomal short arm and 5'-terminus of this base sequence : 102374
acagaagctttgtaagatttacacgtgacatattcacataatacattttaatcacctctcaagtccacatcaggcctctgatcaaacctaaaatgtaacattgcaaatcaaaacacccaagaattgctctgtttcctaaaacaggctcaaaataagtctcatgcttatcaatgctctaatgtctcatagaaaaatcagtctgctttccagtccccgagatataaactgacttgtggcatcttccagtcaagttccttgtttattatttatgtattgttttagcattgctgaattcactttatttattatatatatatatatatatattttattatactttaagttctagggtacatgtgcacaacatgcaggtttgttacatatgtatacatgtgccatgtttgtgtgctgcacccattaactcgtcatttacattaggtatatctcctaatgctatcactcc

SEQ ID NO: 9240 - DNA, 481 bp, Homo sapiens
  AC034243.3_95216
  Located on chromosome 5
  Distance between a terminus base of telomere on chromosomal short arm and 5'-terminus of this base sequence : 145838995
  Distance between 3'-terminus of neighbour sequence of sequence listing upward to telomere on chrosomal short arm and 5'-terminus of this base sequence : 499932
gaactacacttacagcgtgaatgcgtatctttattgaaagatcgaaatgtattatataatagttagaaagtgttttttttcatggttcctttgtaatacaataagaatcagtgttaagcctgttgctagccaattatttttaacttggctctttgaggtttgaagatcaggaaaaagcagaagaaagaggtttaaacccctttgtcaaggcatctttgatcatgatagttgagagagagagcgcgagagtgtgtgtgtgtgtgtgtgtgtgtgtgtgtgcttttaaattggagggagcatgtcaggattgttaaattgactcagtttgtcttgtttatctccaaaatatcttctaaatcttttttcacatattaatgtaaacataggatttagtacattaattagtacaatgacagtttaatgctagtttaaaacagttgtctaaatgccacaaaaatcatgtccattataagtcaaacga

SEQ ID NO: 9241 - DNA, 379 bp, Homo sapiens
  AC034243.4_47169
  Located on chromosome 5
  Distance between a terminus base of telomere on chromosomal short arm and 5'-terminus of this base sequence : 145848833
  Distance between 3'-terminus of neighbour sequence of sequence listing upward to telomere on chrosomal short arm and 5'-terminus of this base sequence : 9357
caagatcttcatctcttgctttattgaaggtccctactgtatggatgacagccccagttctcttttttattgtcttgggtagaagaagcttcaatgctgattcttatttggtcttgtaaaatgccataattcattgtttgttgttgttgttgttgaattttctaatggctgaggaggtattttatctaactagatcttcctgttaaactaatcagacctcctgtttgttacctttttaaacagtccttaaatgttaagggttaaaacactgtatttcaccctcctctacccacctcaggcttactctagattaaaatgaggatagaaagcagaggtttatttgaagtcttatattctaactagtgacaaggaagcagag

SEQ ID NO: 9242 - DNA, 297 bp, Homo sapiens
  HUMUT520B
  Located on chromosome 5
  Distance between a terminus base of telomere on chromosomal short arm and 5'-terminus of this base sequence : 146129937
  Distance between 3'-terminus of neighbour sequence of sequence listing upward to telomere on chrosomal short arm and 5'-terminus of this base sequence : 280725
tttggggaccctggctgaggtaccattacatgacacagattcacaaatgacagtcacagtggggtgggagagcctaactgtgcattttacccatcccaatcacatttccacaatcacacacacacacacacacacacacacacacacacacacacacaaaagttatagcctggaggagtagaagagatggagcctaacatattacctacaaccctagccagaagacagctgtgaaaacttccgaaagaaaacactcctttgaagaactgcagaaacaacacaggggccaggaaacag

SEQ ID NO: 9243 - DNA, 441 bp, Homo sapiens
  AC011404.4_51638
  Located on chromosome 5
  Distance between a terminus base of telomere on chromosomal short arm and 5'-terminus of this base sequence : 146197089
  Distance between 3'-terminus of neighbour sequence of sequence listing upward to telomere on chrosomal short arm and 5'-terminus of this base sequence : 66855
agaattgctagaagcagaagttgcagtgagctgagattgcgccattgtactccaactgggtgacagagtgaaactccatctcataaataaataaataaataaataaataaataaataaatatacagaaattagctgggcatggtggcgggcacctgtaatcccagctactcaggaggctaaggcaggagaatagcttgaacccgggaggcaaaggttgcagtgagccaagattgcaccattgcactctagcctgagcgacaagagcagaaaaaaacatagaaatactatagagaatcaacaaaatttttttgacaagctcagtcaagaaaaaggcatagataaacaatatcaaaacatttaaaagggctgggcgcggtggctcatgcctgtaatcccagcattttggaaggctgaatgaagcaggcagactacctgaggtt

SEQ ID NO: 9244 - DNA, 192 bp, Homo sapiens
  chr5.fa.O7frz.166986620
  Located on chromosome 5
  Distance between a terminus base of telomere on chromosomal short arm and 5'-terminus of this base sequence : 146538547
  Distance between 3'-terminus of neighbour sequence of sequence listing upward to telomere on chrosomal short arm and 5'-terminus of this base sequence : 341017
tggttaagtcagatttaccttaactattttcattactaatgaaattattattttattttttccttattaggaattgttttaagaggggtaattctctctctctctctctctctctctctctctctctctctgtcacacacacacacaattcactcctcaccatttaaagaatagcacatttatgcttagcta

SEQ ID NO: 9245 - DNA, 254 bp, Homo sapiens
  D5S434
  Located on chromosome 5
  Distance between a terminus base of telomere on chromosomal short arm and 5'-terminus of this base sequence : 146578607
  Distance between 3'-terminus of neighbour sequence of sequence listing upward to telomere on chrosomal short arm and 5'-terminus of this base sequence : 39868
cttgaaatgttcccaacacacacacacactctctctctctctctctctcacacacacacacacacacacacacacacacagttttctccctataaaatatgatttccaggcccaatcctctcacaagcatcctagagcagtaaagatttcacatagtgacatcagacttgagtttgattccacctttactattcattcaccatgagactggacaaattagttaacctcagagtctcagtttcctcatctgtgca

SEQ ID NO: 9246 - DNA, 406 bp, Homo sapiens
  AC011352.3_48285
  Located on chromosome 5
  Distance between a terminus base of telomere on chromosomal short arm and 5'-terminus of this base sequence : 146603106
  Distance between 3'-terminus of neighbour sequence of sequence listing upward to telomere on chrosomal short arm and 5'-terminus of this base sequence : 24245
tgtatctaattcagcacctgaccagaggaggcagcctattattattattattagtggtggtggtggtggtggtggtggtggtcctaaaatgtctctctccctcctctaagacaactcaatgtagaatagaatagaatagaatagaatagaatagaatagaatagaatagaatagaatagaatagaatagaatagacaagtttattatttatttttcacttagtatttgcaaggcactgtgctagttttacaaattttcttatctaatctttataacaacaccaagaggtatcattattcctattttatggacactggatccaaagcacagagaaattaaaaatatcttaaggttacagtgtcacacagctcgtaaggggcaaatctgaaattcaaactcagttctg

SEQ ID NO: 9247 - DNA, 194 bp, Homo sapiens
  D5S2090
  Located on chromosome 5
  Distance between a terminus base of telomere on chromosomal short arm and 5'-terminus of this base sequence : 146659387
  Distance between 3'-terminus of neighbour sequence of sequence listing upward to telomere on chrosomal short arm and 5'-terminus of this base sequence : 55875
catgggcatgtttcaaaatctcaatgcatgttcttgcacacacacacacacacacacacacacacacacaatttttaacaatctttataaatataaggattgtaaatctactgttcatttttctctaataggagtaattctttgcattctggaaatggtcctggttcgaagcccagagttactaaggaggtact

SEQ ID NO: 9248 - DNA, 182 bp, Homo sapiens
  D5S463
  Located on chromosome 5
  Distance between a terminus base of telomere on chromosomal short arm and 5'-terminus of this base sequence : 146759358
  Distance between 3'-terminus of neighbour sequence of sequence listing upward to telomere on chrosomal short arm and 5'-terminus of this base sequence : 99777
gatcggggttaaggcttcaacgtataaattttgggaaaacacagtgcagttcataatagaaaccttcaaatgctgcaatttcatgtaatataggtttcttttgtgtgtgtgtgtgtgtgtgtgtgtgtgtgtgtattttctggcaccatgagtgatatcttccttgggaaatgggtgtgctt

SEQ ID NO: 9249 - DNA, 418 bp, Homo sapiens
  AC011370.3_64864
  Located on chromosome 5
  Distance between a terminus base of telomere on chromosomal short arm and 5'-terminus of this base sequence : 146819209
  Distance between 3'-terminus of neighbour sequence of sequence listing upward to telomere on chrosomal short arm and 5'-terminus of this base sequence : 59669
cagagttgtggtcaaggttaggtttatccagcagagggccacacagtatgcgtcatgcaatagccacgaagcactggagaaggagctacacactcacctgagacacattccccagagggtttgcaatgaaccatgtgaggcatccaggaagactttttgatccctcagtgagatggaccctgttacctcatatatctttccaaaatgtttttatgcatgtatgtacctataggtccacatagatgtgtgtgcatatgtgcatatatatatatatatatatatatatatatatatatatatatataatctctttagttttttacatgaatgacattatactttggacttcattcgtcatcttgctctttaaatgttttgaggtgcaactagcctcattggttcatgtagatcttcctat

SEQ ID NO: 9250 - DNA, 427 bp, Homo sapiens
  AC011370.3_90019
  Located on chromosome 5
  Distance between a terminus base of telomere on chromosomal short arm and 5'-terminus of this base sequence : 146837365
  Distance between 3'-terminus of neighbour sequence of sequence listing upward to telomere on chrosomal short arm and 5'-terminus of this base sequence : 17738
gtggaaagacagtttactgtttatacttctgaaacaattcatgcctattttttaaaaaactcttatcagattatggatggtgacgtagatagatagatcgttgatagatagatagatagatagataaattttttcccattggaaggctgacttatttttctatttccaaattctatacctagcacagcatatggaaagagctctaacaatattgactgattgaatgaatgaatgaatatatgagtgactcagttaatccggtgattcatttatagttattccccacttctcacagtttagctattacatgtaatcctgtctctatacattggcttttcttaaagttgggtctctctgccttttgaggtcatcacataggtgacttcctttaacgaccatgttccttatgtttggagtatcagtgagt

SEQ ID NO: 9251 - DNA, 453 bp, Homo sapiens
  AC011367.6_15915
  Located on chromosome 5
  Distance between a terminus base of telomere on chromosomal short arm and 5'-terminus of this base sequence : 146938354
  Distance between 3'-terminus of neighbour sequence of sequence listing upward to telomere on chrosomal short arm and 5'-terminus of this base sequence : 100562
tgctcaggtttagtgctattagcttcttccatttctctggtatttaaatattacctgcagtgtctttctgtaacagtggtttttaaacttattgtgcataggaatcatccggagagtttattttaaaaaggcatactttcagatgtattttccagaatttctgatcccataagtctggggcagttggattcaggtgaaattcaaaagccaaatcaagaaacacgtctccaaagagagagggagagggagagagaaggaatgagagagagagagagaatctgtgtgtgtgtgtgtgtgtgtgtgtgtgtgtgtgagagagagagagagagggagtgtgtgtgtgtgtgtgttgcaggcatgctttccctcaagtgatatacctgatgtattagaagggatggtttttgtatttacctgatgttaattggcacggtttgtcactagtttatttaa

SEQ ID NO: 9252 - DNA, 387 bp, Homo sapiens
  AC011371.4_40807
  Located on chromosome 5
  Distance between a terminus base of telomere on chromosomal short arm and 5'-terminus of this base sequence : 146947615
  Distance between 3'-terminus of neighbour sequence of sequence listing upward to telomere on chrosomal short arm and 5'-terminus of this base sequence : 8808
gtgtccactggacatttctaggtggttatttgttcctcagtgggacaggatctgttctcagcactgcctttaaggctggccctgtcatttctccttgagtcttagctgttgtttaaattagctgcttggtcaaggtgttctctgatatagttgattgccacctagtggccacaggtaagaccgtgtgtcacggaaacgagaaaaatgctatggagaattttgtttcattctaagatttgcacagggtgtgtgtgtgtgtgtgtgtgtgtgtgtgtgtgtgtgtgttttgtttgtttttgctagtacaatgccaggagtctgggctgcagaatggtatttacaagggactgtaacttgcttttcttataatgaagcacatcgaactag

SEQ ID NO: 9253 - DNA, 312 bp, Homo sapiens
  AC011367.6_175183
  Located on chromosome 5
  Distance between a terminus base of telomere on chromosomal short arm and 5'-terminus of this base sequence : 146986900
  Distance between 3'-terminus of neighbour sequence of sequence listing upward to telomere on chrosomal short arm and 5'-terminus of this base sequence : 38898
agaaacggaatctcactatgttgctcaggctggtcttgaacttttgggctcaagcaatcctcctgcctgggattacagtgctgggattacaggcctgagccattgtgctggccatgacaactttttaattcagtgatgttaatatatgttttttaacggttgtacatggcataataagttataggcaatgaaatgtgtgtgtgtgtgtgtgtgtgtgtgtgtgtttagtttaagttggttgttgaaattcccaaatctggggactacttctccaaagaaagttttgggaaggcattagttaacatctttgta

SEQ ID NO: 9254 - DNA, 238 bp, Homo sapiens
  chr5.fa.O7frz.161315596
  Located on chromosome 5
  Distance between a terminus base of telomere on chromosomal short arm and 5'-terminus of this base sequence : 147129203
  Distance between 3'-terminus of neighbour sequence of sequence listing upward to telomere on chrosomal short arm and 5'-terminus of this base sequence : 141991
gcgttagtttgctaaggataacgacctccagctccatccatcttcccacaaagggcataatctcattcttttttatggctgtgtagtattccatgatatatatatatatgtatatatatatgtgtgtgtgtgtgtgtgtgtgtgtgtgtgtgtaccacattttctttaacctgtcattgatgggcatttagattgattccgtgactttgctattgataatagtgctgcagtgaacata

SEQ ID NO: 9255 - DNA, 315 bp, Homo sapiens
  AC004782.1_79224
  Located on chromosome 5
  Distance between a terminus base of telomere on chromosomal short arm and 5'-terminus of this base sequence : 147388322
  Distance between 3'-terminus of neighbour sequence of sequence listing upward to telomere on chrosomal short arm and 5'-terminus of this base sequence : 258881
tgcactgagtacatagttgatactgggcaggtgggtgggtggatggatggaaggaaggaaggaaggaaggaaggatggaaggatggatacatgtatggatggaccaggacaactgttgccctctaacaagagtaggaatctgtcacttctttgtagtttaaaccaggagcttcagaaaatccgtgaaacccctaaaattgtacacaaaattttgtatgtctgtgtctgtttcctttttcattgtaaagaaagttcaggacagctttcatcagaaggcttatattccacaaaaggttcagaacctttggtttaaac

SEQ ID NO: 9256 - DNA, 271 bp, Homo sapiens
  AC004782.1_78890
  Located on chromosome 5
  Distance between a terminus base of telomere on chromosomal short arm and 5'-terminus of this base sequence : 147388665
  Distance between 3'-terminus of neighbour sequence of sequence listing upward to telomere on chrosomal short arm and 5'-terminus of this base sequence : 28
ttgtactcattgtccaagcttccttcatacacacacacacacacacacacacacacacacacacaccccacacacacatctgccgcctgctctatctgtaatgccatctcttctcgctttctctccccttcctgtacagttcacccatctcaggagcctggctggttggaggggactctgaacggaaagactggcctcatccctgagaattacgtggagttcctctaaccgtgggccccagcagaactgctgagctttacatggtatccat

SEQ ID NO: 9257 - DNA, 168 bp, Homo sapiens
  AC004782.1_44375
  Located on chromosome 5
  Distance between a terminus base of telomere on chromosomal short arm and 5'-terminus of this base sequence : 147423186
  Distance between 3'-terminus of neighbour sequence of sequence listing upward to telomere on chrosomal short arm and 5'-terminus of this base sequence : 34250
tccttccagatacttagtgcatgtgtacgtgtgtgtgtgtgtgtgtgtgtgtgtgtgtgtatgaagacattataacatggtggttaaaatcatgggctctggatccagtctttttgggtttgaatcacaattttgccacttaccaggtttgcgatcttaggaaagttc

SEQ ID NO: 9258 - DNA, 301 bp, Homo sapiens
  chr5.fa.O7frz.161721258
  Located on chromosome 5
  Distance between a terminus base of telomere on chromosomal short arm and 5'-terminus of this base sequence : 147534837
  Distance between 3'-terminus of neighbour sequence of sequence listing upward to telomere on chrosomal short arm and 5'-terminus of this base sequence : 111483
aaacttgtgagtcaaatgacactatcaagaagtgaaaagatggccttttaaatgggagaaattgtcctcaaattatatatttcataagggtctagtgtttagaatatatctgcatatatacatacacatatattctagatacacacacacacacacacacacacacacacaccgacaactcaacaataaaaagacaacctaattttaaaatgggcaaagaatgttaaagacatttcttcaaagaaaatacacaaatgtccaaaaagcagatgaaaagatgttcaacatcgttagtcatttg

SEQ ID NO: 9259 - DNA, 135 bp, Homo sapiens
  DISO7_10002049
  Located on chromosome 5
  Distance between a terminus base of telomere on chromosomal short arm and 5'-terminus of this base sequence : 147772769
  Distance between 3'-terminus of neighbour sequence of sequence listing upward to telomere on chrosomal short arm and 5'-terminus of this base sequence : 237631
tccctgctgagaccactacatatatatgtgtgtgcgtgtgtgtgtgtgtgtgtgtgtgtgtgtgtgtaatataaaataagattttatgggactccaattttgtgatattagcagctattattgattatcaatagc

SEQ ID NO: 9260 - DNA, 136 bp, Homo sapiens
  DISO7_10002051
  Located on chromosome 5
  Distance between a terminus base of telomere on chromosomal short arm and 5'-terminus of this base sequence : 147788678
  Distance between 3'-terminus of neighbour sequence of sequence listing upward to telomere on chrosomal short arm and 5'-terminus of this base sequence : 15774
gatgtcctagtttgcttgctctttcagggtgtgtgtgtgtgtgtgtgtgtgtgtgtgtgtgtgtgtgtagcaatcatgccagttggatctttttatctgaaatagcccatcctcacacatatccaccaagtgtcat

SEQ ID NO: 9261 - DNA, 396 bp, Homo sapiens
  AC008700.3_30379
  Located on chromosome 5
  Distance between a terminus base of telomere on chromosomal short arm and 5'-terminus of this base sequence : 147920168
  Distance between 3'-terminus of neighbour sequence of sequence listing upward to telomere on chrosomal short arm and 5'-terminus of this base sequence : 131354
atcacctgagatcaggagttagagaccagcctggccaacatagtgaaacctcgtctctactagaaatacaaaattagctaggcatggtggtgcatgcctgtagtaatcccagctacttgggaggctgagaaaagagaatcacttgaacctgggaggtggaggttgcagtgagctgagatcccagcattgcactccagcctgggcaacaagagcgaaactccatctcaaaataaataaataaataaataaataaataaataaaaatttaaaaataaaaagaaaatcagagaccacattttttgatatagtcctgacacagttaatttcagatgcttgttggttatataggcctggagccaaaaggagagatctctgtcttcattgagttttcagtac

SEQ ID NO: 9262 - DNA, 178 bp, Homo sapiens
  DISO7_10002054
  Located on chromosome 5
  Distance between a terminus base of telomere on chromosomal short arm and 5'-terminus of this base sequence : 147975411
  Distance between 3'-terminus of neighbour sequence of sequence listing upward to telomere on chrosomal short arm and 5'-terminus of this base sequence : 54847
cattgatgaggtatgcatctgatttttgaaaagacctggggaaatttaattttcccttttggtctctcttgtgtgtgagtgagagtgacttactctctctctctctctctctctctctgtgtgtgtgtgtgtgtgtgtgtgtgtgtgtgtgtgtagtttagaatgaagtgaaacggcc

SEQ ID NO: 9263 - DNA, 133 bp, Homo sapiens
  DISO7_10002052
  Located on chromosome 5
  Distance between a terminus base of telomere on chromosomal short arm and 5'-terminus of this base sequence : 147995899
  Distance between 3'-terminus of neighbour sequence of sequence listing upward to telomere on chrosomal short arm and 5'-terminus of this base sequence : 20310
ttcaacttcaacaatgtggagaaaaaagattgattaatagataatctttacattttttaatctatctatctatctatctatctatctatctatctatctgtctatgcaaaagtaactccagcctaaatccttg

SEQ ID NO: 9264 - DNA, 283 bp, Homo sapiens
  AC011355.3_93296
  Located on chromosome 5
  Distance between a terminus base of telomere on chromosomal short arm and 5'-terminus of this base sequence : 148052665
  Distance between 3'-terminus of neighbour sequence of sequence listing upward to telomere on chrosomal short arm and 5'-terminus of this base sequence : 56633
cactaatagcagtagcctctacatttagatcatgcatacaataaaaggaagccttcagaattcctctctccctctcccccttccctttcctccccttctcttacacacacacacacacacacacacacacacacacgagttatcccatccactctgacataaataccttccgtctaagcagttttcaccccttagatttaagcctatttaaaatgatttgctcatgtaaaactatatcctggtgacactaatctttcctgtctttattctggattagtcagaa

SEQ ID NO: 9265 - DNA, 360 bp, Homo sapiens
  AC011359.3_152377
  Located on chromosome 5
  Distance between a terminus base of telomere on chromosomal short arm and 5'-terminus of this base sequence : 148076719
  Distance between 3'-terminus of neighbour sequence of sequence listing upward to telomere on chrosomal short arm and 5'-terminus of this base sequence : 23771
aggaagtcttatccatgacatcacaaagtgctgagcagaaggcaaaagcagcaggcaggctgaggggagaaagaagaaaggcccctcactttgcaaacttgagctttaagttttccgaaccctaggaagtgaaatacaaaactctgactgtgggtctccacccacagcaggcgtgtgtgtgtgtgtgtgtgtgtgtgtgtgtgtgtgtgtgatattgatttattaatggatttttcagggaaaggggttcatcattttaacacattcttaaagatatctgtgacccaaaaagacactagattagaacacaggctctctgagggcaggaatactgtctatttcagttactcctgtatctcc

SEQ ID NO: 9266 - DNA, 234 bp, Homo sapiens
  D5S436
  Located on chromosome 5
  Distance between a terminus base of telomere on chromosomal short arm and 5'-terminus of this base sequence : 148076872
  Distance between 3'-terminus of neighbour sequence of sequence listing upward to telomere on chrosomal short arm and 5'-terminus of this base sequence : -207
gtctccacccacagcaggcgtgtgtgtgtgtgtgtgtgtgtgtgtgtgtgtgtgtgtgatattgatttattaatggatttttcagggaaaggggttcatcattttaacacattcttaaagatatctgtgacccaaaaagacactagattagaacacaggctctctgagggcaggaatactgtctatttcagttactcctgtatctccaacagccagcgtaatgcctggcacata

SEQ ID NO: 9267 - DNA, 338 bp, Homo sapiens
  AC011359.3_35182
  Located on chromosome 5
  Distance between a terminus base of telomere on chromosomal short arm and 5'-terminus of this base sequence : 148181587
  Distance between 3'-terminus of neighbour sequence of sequence listing upward to telomere on chrosomal short arm and 5'-terminus of this base sequence : 104481
tattaattgtgaatgatccttcacatcattaaatatgcatctccttatcatttttaatagttgtataatattcccccctatatatatatatatatatatatatcaccatttatttacccactcccctatttttggacatcaggctgtttaacttttcacttttataagtaatgctataaggaacacacttggatacatatctgttatgttacataaatttatagaagtggtattttaggatcaaaaggtgagaagtgagaccatatttttaagactttagacttaaacttttttttacttttcattttgaaataattacagactcataagacattgca

SEQ ID NO: 9268 - DNA, 240 bp, Homo sapiens
  D5S2099
  Located on chromosome 5
  Distance between a terminus base of telomere on chromosomal short arm and 5'-terminus of this base sequence : 148205517
  Distance between 3'-terminus of neighbour sequence of sequence listing upward to telomere on chrosomal short arm and 5'-terminus of this base sequence : 23592
attgcacagaaatggtaaaggctctgaagaaatataggcagaacaccaacagtctctctctctctctctctgtcacacacacacacacacacacacaaataataaaaataattgcaaattgcaatgtgtctgctatataaactaaatatagacaagggtatgaaatggaggataaaaggaaagatattttattagggtggtcaaaaaaagacctctctaagggaggcatttatgctgata

SEQ ID NO: 9269 - DNA, 380 bp, Homo sapiens
  AC005351.1_28962
  Located on chromosome 5
  Distance between a terminus base of telomere on chromosomal short arm and 5'-terminus of this base sequence : 148238152
  Distance between 3'-terminus of neighbour sequence of sequence listing upward to telomere on chrosomal short arm and 5'-terminus of this base sequence : 32395
aagatacttctggagctttcattattcacctttaaaaagctctgggtctggtacagtggctcatgcctataatcccagtactttgggaggctgaagagggagcccaggcatttgagaccagcctgagcaatatagcaagaccccatctctacaaaacaaaaataaaaattagctgggcatggtggagtgtgcctgtagtcctggctattttggaggctgaggcaggaggatctcttgagcccaggagtttgaggcttcagtgagcaatgattgcactgctgcactccagcctgggcaacagagcaagacttgtctcaaataaataaataaataaataaataaataaataaataaataaatgtctgttatcgttagagttg

SEQ ID NO: 9270 - DNA, 464 bp, Homo sapiens
  AC011359.3_75447
  Located on chromosome 5
  Distance between a terminus base of telomere on chromosomal short arm and 5'-terminus of this base sequence : 148238152
  Distance between 3'-terminus of neighbour sequence of sequence listing upward to telomere on chrosomal short arm and 5'-terminus of this base sequence : -380
aagatacttctggagctttcattattcacctttaaaaagctctgggtctggtacagtggctcatgcctataatcccagtactttgggaggctgaagagggagcccaggcatttgagaccagcctgagcaatatagcaagaccccatctctacaaaacaaaaataaaaattagctgggcatggtggagtgtgcctgtagtcctggctattttggaggctgaggcaggaggatctcttgagcccaggagtttgaggcttcagtgagcaatgattgcactgctgcactccagcctgggcaacagagcaagacttgtctcaaataaataaataaataaataaataaataaataaataaataaatgtctgttatcgttagagttgggaagaatggtaaaaatcatcttcttcactttgcagttgaggaaacaggcccagagaggttcagtacctcattcaaggacacag

SEQ ID NO: 9271 - DNA, 454 bp, Homo sapiens
  AC005216.1_12575
  Located on chromosome 5
  Distance between a terminus base of telomere on chromosomal short arm and 5'-terminus of this base sequence : 148268659
  Distance between 3'-terminus of neighbour sequence of sequence listing upward to telomere on chrosomal short arm and 5'-terminus of this base sequence : 30043
gtaaatcttccagccaataaacatctgttgaatgcttgcaatgtgctagtaaccatagtgagtactggagattctactaccaaaacaagaagagtaatataacctcaaactttactgaaactaatatgagacggatggatctataggtaggtaggtaagtagatggatggatggatggatggatggatggatggatggatggatggatagatgattgatacatagataaatagatagatagataaatagatacagtgatatcctctgatagaaaagtctccttttactctcagtctcctaagcctcccctccattctaaaactgtaataagaacctttgtaggggaggtattatcaacactttatagcaaggtaattaaggccccaaaagaaaaatgattaagccaagttcatgtaatttagtaaagagtctggattgaatttagaattgtcta

SEQ ID NO: 9272 - DNA, 324 bp, Homo sapiens
  AC005216.1_19089
  Located on chromosome 5
  Distance between a terminus base of telomere on chromosomal short arm and 5'-terminus of this base sequence : 148275111
  Distance between 3'-terminus of neighbour sequence of sequence listing upward to telomere on chrosomal short arm and 5'-terminus of this base sequence : 5998
tacttgaggtcaggagttcaagaccagcctggccaacatggagaaaccccgtctctactaaaaatacaaaaattagccaggtgtggtggcgcatgcctgtagtcccagctacttgggaagctgaggcaggagaatggcttgaaccaggaggcagaggttgcagtgagccgagatcttgccggtgcactgcagcctgagtgacacagagcaaggctccatctaaacacacacacacacacacacacacacacacacacaattccttaaaaacattaaatattcagtgttcaaatttttatatttgccttatgaatgttcttagtg

SEQ ID NO: 9273 - DNA, 449 bp, Homo sapiens
  AC005216.1_86714
  Located on chromosome 5
  Distance between a terminus base of telomere on chromosomal short arm and 5'-terminus of this base sequence : 148342636
  Distance between 3'-terminus of neighbour sequence of sequence listing upward to telomere on chrosomal short arm and 5'-terminus of this base sequence : 67201
caggccaaggataagtatctagaatatataaagaactcttggccgggcacagtggctcatgcctgtaatcccaacactttgagaggccgaggcgggtggatcatttgaggtcaggagtttgagaccagcctggccaacatgatgaaaccccatctccacaaaaaatacaaaaattagccaggtggtagtggcgtgtgcctgtaatcccagctactcaggaggttgaggtggaagaatcccttgagcttgagaggtggaggttgccatgagccgagatcgggccactgcactccaggctgggcaaaggaatgagaccgtctcaaaaaacaaaacaaaacaaaacaaaacaaaacaaaacaaaactcctgcaaatcaacatatagaagattaaacaaaagaagaaaatgggcataggatatgggcaggtaatccacttaagagcaaataca

SEQ ID NO: 9274 - DNA, 320 bp, Homo sapiens
  chr5.fa.O7frz.164848590
  Located on chromosome 5
  Distance between a terminus base of telomere on chromosomal short arm and 5'-terminus of this base sequence : 148403019
  Distance between 3'-terminus of neighbour sequence of sequence listing upward to telomere on chrosomal short arm and 5'-terminus of this base sequence : 59934
gtctgaccaatatggtgaaatcctcgtgtctactaaaaatacaaaaattagctggtcatggtggcacgtgcctgtagtcccagctactcaggagtctgaggcaggagaatcgcttgaacccggaagttggaggctgcagtgagctgagattgagccaccgcactccagcctgtgagacagagcaagactccgtcagatagacacacacacacacacacacacacacacacacacacacacacacacacacaaatgtaaatcccagagccaggctacctagtttgaattccagttcccactggctaactatctggctaatc

SEQ ID NO: 9275 - DNA, 480 bp, Homo sapiens
  chr5.fa.O7frz.165046307
  Located on chromosome 5
  Distance between a terminus base of telomere on chromosomal short arm and 5'-terminus of this base sequence : 148615575
  Distance between 3'-terminus of neighbour sequence of sequence listing upward to telomere on chrosomal short arm and 5'-terminus of this base sequence : 212236
cagaagcaaccatagacaatacagaaataagtgggcaaatgggcatcgctgtggtcctgtaacactttatttataaaaacaggcagcaggccagctttggttgtcaggtcatagtttgcagacccttgatctagatgtcttccaggggtctcccaggttttctgggtcttttctatcccaaatctttcctggtcttagatggttcttagatctaaggcttctaaaggcatcctgaatgctttgcctcttgttccttgagtcatatatgcccacttgggtgatctttgggagagaacttagccctggatggtgtggaggtggaatcttgatttccttgtctttctgacttttctcttaaacaaaacaaaacaaaacaaaacaaaacaaaacaaaacaaaacacatctgtggcctacagaccttccctcagcaagctgtgtcccttctggtttttaaaagccccttcaaatggagatcagca

SEQ ID NO: 9276 - DNA, 349 bp, Homo sapiens
  AC011355.3_40054
  Located on chromosome 5
  Distance between a terminus base of telomere on chromosomal short arm and 5'-terminus of this base sequence : 148640373
  Distance between 3'-terminus of neighbour sequence of sequence listing upward to telomere on chrosomal short arm and 5'-terminus of this base sequence : 24318
gactcaatcatatgctattaacaagaaactcacatgaaatataatcacacaggcaggttgaaagtaaaaagatttaagtatatatatcatacaaacactcataaaggaagtaggagtggctatattaatacagttaaagtagatttagtgcaaagaaaagtactagggatagagtcattatataataatgacaggatttatcaaatatatatatatatatatatatatatatatatatatatatatatatatatatataaatcctaaatgtgtatgcaccatacaacagagctgcaaaatatgtgcagcaaaaatttatagaactgaaaggagaaatacagaaatcatt

SEQ ID NO: 9277 - DNA, 136 bp, Homo sapiens
  DISO7_10002057
  Located on chromosome 5
  Distance between a terminus base of telomere on chromosomal short arm and 5'-terminus of this base sequence : 148646763
  Distance between 3'-terminus of neighbour sequence of sequence listing upward to telomere on chrosomal short arm and 5'-terminus of this base sequence : 6041
taccttgctactgggtcaaggcatggtgtcccccatcacacctgtgagatacatatatatatatatatatatttttttttttttttccccccctgagagaagctcatgcctttttggatgcacttactgttcatca

SEQ ID NO: 9278 - DNA, 286 bp, Homo sapiens
  chr5.fa.O7frz.164172010
  Located on chromosome 5
  Distance between a terminus base of telomere on chromosomal short arm and 5'-terminus of this base sequence : 148680886
  Distance between 3'-terminus of neighbour sequence of sequence listing upward to telomere on chrosomal short arm and 5'-terminus of this base sequence : 33987
gaggtcaggagtttgagactagcctggccaaaatggtgaaaccccatctctactaaaagtacaaaaactagccagatgtggtggtgcatgcctgtaatttcagctacttgggaggctgaggcaggagaatcacttgaacctaggaggcagagcttgtagtgagctgagatcacaccactgcaccccagccttggtgacagagtgagaccctgtttcaaaaccaaaccaaaccaaaccaaaccaaaccaaaccaaaccaaaccatcagatctcatgataactcactg

SEQ ID NO: 9279 - DNA, 145 bp, Homo sapiens
  DISO7_10002058
  Located on chromosome 5
  Distance between a terminus base of telomere on chromosomal short arm and 5'-terminus of this base sequence : 148774555
  Distance between 3'-terminus of neighbour sequence of sequence listing upward to telomere on chrosomal short arm and 5'-terminus of this base sequence : 93383
tgtttgcttgttgttatattgtgtgaaaatgactgaatagattttaaccaaattaaaaaaaatattttagtctatatatatatatatatatatatatatatatatatatatatatatgtatatatgtgcgattcgatatgctcaa

SEQ ID NO: 9280 - DNA, 442 bp, Homo sapiens
  AC011375.4_14014
  Located on chromosome 5
  Distance between a terminus base of telomere on chromosomal short arm and 5'-terminus of this base sequence : 148925777
  Distance between 3'-terminus of neighbour sequence of sequence listing upward to telomere on chrosomal short arm and 5'-terminus of this base sequence : 151077
catgtaagatggtgaacctaattgataaacgtgtgtgatctaactgttccaccgaccggctgttccccatctctcttcctctcctcgggtgtccattttccctgagacacaacaatattgaaattaggccaattagtagccctataatgccctcaaagtgttcaagtgaaaggaagagtcacatacctctcactttgtgtgtgtgtgtgtgtgtgtgtgtgttttgagacggagtcttgctctgtcgcccaggctggagtgcagtggtgcgatcttggttcactgcaacttccgcctcctgggttcaagcgattcttctgtctcagcttcccaaatagctgggattatagttacacgccaccacgcctggctaattttttgcatttttagtagagatggggtttcaccgtattagccaggatggtctcgatctcctgacctc

SEQ ID NO: 9281 - DNA, 289 bp, Homo sapiens
  AC011375.4_132018
  Located on chromosome 5
  Distance between a terminus base of telomere on chromosomal short arm and 5'-terminus of this base sequence : 148967492
  Distance between 3'-terminus of neighbour sequence of sequence listing upward to telomere on chrosomal short arm and 5'-terminus of this base sequence : 41273
aagctaaggctgtagccacagagcagctgccaaccccaaatgcgtcagctgtgtcactttcctgacacacacaccactcatagtgatgttgccaggaggttggctctggacattgagaagcagtcatcaaacaactgaacatctgagctgtaggcatatatatatatatatatatatatatatatatatatatatatatatatgtacacacacacacacacacacacacacacacacacaattctgctttatatgtaagttacaggggacctcattcagcttaatcttc

SEQ ID NO: 9282 - DNA, 221 bp, Homo sapiens
  D5S2033
  Located on chromosome 5
  Distance between a terminus base of telomere on chromosomal short arm and 5'-terminus of this base sequence : 149027581
  Distance between 3'-terminus of neighbour sequence of sequence listing upward to telomere on chrosomal short arm and 5'-terminus of this base sequence : 59800
ttccagtttgggtccttatgcagctgggaagcatcctccatttctacaaggataatgaattccgagatgattccctgagaggaaagaagcctgttaatgggacactgaggctgtgtgtgtgtgtgtgtgtgtgtgtgtgtgtgtgagagagagagagagagagagagagagaggtcacattaggaagaatttattgaatgctagataacatggaaaagcta

SEQ ID NO: 9283 - DNA, 347 bp, Homo sapiens
  chr5.fa.O7frz.165355271
  Located on chromosome 5
  Distance between a terminus base of telomere on chromosomal short arm and 5'-terminus of this base sequence : 149117291
  Distance between 3'-terminus of neighbour sequence of sequence listing upward to telomere on chrosomal short arm and 5'-terminus of this base sequence : 89489
cagaatcacctgagagttcttaaagagcaatagaaaatacagacttcgagatgaactcagttggtctgaggtgaggcttaggtatcctgatttttttttaaagctctccaaataattgagggaaaattagaatagtgttttctaaaactcagtccttttagtaccccttcagattttcttatctgttttatgtgtactattatttatttatttatttatttatttatttatttattgagacagaatcttgctctgtgacccaggttgcagtgcagtggcgcaatgtcggctcactgcaacctccgcctcccgagttcaaacaattctcttgttttagccttctgagt

SEQ ID NO: 9284 - DNA, 222 bp, Homo sapiens
  Z67160
  Located on chromosome 5
  Distance between a terminus base of telomere on chromosomal short arm and 5'-terminus of this base sequence : 149245191
  Distance between 3'-terminus of neighbour sequence of sequence listing upward to telomere on chrosomal short arm and 5'-terminus of this base sequence : 127553
gatccacattctcatgctcattgcaacaccattcccaatagccagatatggaagcaacctaaatgtctgtcaacagatgaatggatgaagaaaatgtggggtatgtgtacatacacacacacacacacacacacacacacatatacacacatgtatatatatgtgtgtatacactgggatatcattcagcctttaaaaggaaggaaatcctggcatttacaa

SEQ ID NO: 9285 - DNA, 307 bp, Homo sapiens
  AF152102.1_625
  Located on chromosome 5
  Distance between a terminus base of telomere on chromosomal short arm and 5'-terminus of this base sequence : 149325140
  Distance between 3'-terminus of neighbour sequence of sequence listing upward to telomere on chrosomal short arm and 5'-terminus of this base sequence : 79727
atgcagtatggatacttctggtagatagaaaatgacatcttcctcatctccagaaattgactgcatatccctgggagaaaagagcagaaatgttccttgacatagttattttgtgtgtgtgtgtgtgtgtgtgtgtgtgtgtgtgtgtgtgtgtgtggtggggggagttcagttcaactttcaatagattctattttattttcatctagtgcttaagacttatacacttgtttgttcaaaatccacatttaaaattttagtaacaggtgaagacgggtacaagttgatttaatccacttcagtacaa

SEQ ID NO: 9286 - DNA, 288 bp, Homo sapiens
  AC011386.4_138477
  Located on chromosome 5
  Distance between a terminus base of telomere on chromosomal short arm and 5'-terminus of this base sequence : 149345470
  Distance between 3'-terminus of neighbour sequence of sequence listing upward to telomere on chrosomal short arm and 5'-terminus of this base sequence : 20023
gttagactgttgccatatgtaaaggaacattatgtcattgttgctaccttggcaaatttcaaaggttattgttccagcttcccttccttttctttcctttctcctttcctttctccctttctttctcctttcctttcctttctttttccttcctttcttccttccttccttccttccttccttccttccttctttccttcttttctttcttttctttctctcttaaattttattttaagctccgggctacaggatgtgtgcaggatgtgcaggtttgttacttaggta

SEQ ID NO: 9287 - DNA, 288 bp, Homo sapiens; identical to SEQ ID NO: 9286
  AC021201.3_28087
  Located on chromosome 5
  Distance between a terminus base of telomere on chromosomal short arm and 5'-terminus of this base sequence : 149345470
  Distance between 3'-terminus of neighbour sequence of sequence listing upward to telomere on chrosomal short arm and 5'-terminus of this base sequence : -288

SEQ ID NO: 9288 - DNA, 137 bp, Homo sapiens
  D5S638
  Located on chromosome 5
  Distance between a terminus base of telomere on chromosomal short arm and 5'-terminus of this base sequence : 149399764
  Distance between 3'-terminus of neighbour sequence of sequence listing upward to telomere on chrosomal short arm and 5'-terminus of this base sequence : 54006
tttagagaaacacacgcaccagtacatatgtgtatgtatacatatatgaatatgtgtatatatgtgtgtgtgtgtgtgtgtgtgtgtgtgtgtgttgagttgagggtatagtggcaatgatactactgagtgtttcc

SEQ ID NO: 9289 - DNA, 226 bp, Homo sapiens
  AC022527.4_6812
  Located on chromosome 5
  Distance between a terminus base of telomere on chromosomal short arm and 5'-terminus of this base sequence : 149431497
  Distance between 3'-terminus of neighbour sequence of sequence listing upward to telomere on chrosomal short arm and 5'-terminus of this base sequence : 31596
gttcagtactatctgtggtttcaggcatttactgggggtcttggaacgtatcccctgtggataaagagggactagcgtgtgtgtgtgtgtgtgtgtgtgtgtgtgtgtgtgtgtgtttcaaggtgggaagattcaatattggttcattggttcatttaagttttatttattgagcatctattgagcatctactatgtggcaggtactactgtaggcactgaggata

SEQ ID NO: 9290 - DNA, 383 bp, Homo sapiens
  chr5.fa.O7frz.165990193
  Located on chromosome 5
  Distance between a terminus base of telomere on chromosomal short arm and 5'-terminus of this base sequence : 149674450
  Distance between 3'-terminus of neighbour sequence of sequence listing upward to telomere on chrosomal short arm and 5'-terminus of this base sequence : 242727
ccacttcagcttctcaagtagcagggaccacaagtacatgccatgatggatggatggatggatggatggatggatggatggatggatgggtggatgggtggacgggtggctggttgggtggctggtttgtatgtttgtttgtttgtttgtttgagatggtgtctcactatgatgtccaggctgcactcaaactcgtgggctcaagcaatcttcctaccttggcttctcaaagtgctgggattacaggcatgagccacggtacccaggcaggaacagagttttcaatagaaattttaaacaagtgggatcaagatgttgaagcatttccccagagaattgtaccaggagatgaaacatggctttgtcagtatgattctgaagac

SEQ ID NO: 9291 - DNA, 248 bp, Homo sapiens
  chr5.fa.O7frz.166102716
  Located on chromosome 5
  Distance between a terminus base of telomere on chromosomal short arm and 5'-terminus of this base sequence : 149786887
  Distance between 3'-terminus of neighbour sequence of sequence listing upward to telomere on chrosomal short arm and 5'-terminus of this base sequence : 112054
tatgaatcgtggttatctttagatggttttgtttttcttctttatactttgctgtattttttatactgatagcatattcgttttatatatatgtgtgtatatatatatatcttacaattatatatacaattttatatatttttatatatatttatatatatactcttcattgtaaacaagaaattgaagctcagaaaagtcagataaatttcctaatttcaaatatcttgtaaatggtacagctagga

SEQ ID NO: 9292 - DNA, 346 bp, Homo sapiens
  AC009189.4_49567
  Located on chromosome 5
  Distance between a terminus base of telomere on chromosomal short arm and 5'-terminus of this base sequence : 149875777
  Distance between 3'-terminus of neighbour sequence of sequence listing upward to telomere on chrosomal short arm and 5'-terminus of this base sequence : 88642
tgtttcagctagatatggtcagagtaattcaaaggtaaaatatttcaacttgaaatcaaggacaagagcaatgccattttcttttaatatttcattctcttcccccatgtaactagagagagagagagagagaggaaaagagaaccccctacatgcagagccacctcactttccaacagaaatcttctatgagaaaaaaaaatgagccttattttctatgatatttgaacaactgcaaatttcatggctttcaattaccagtggggggaataaatctcttttgtcacttctaaaataatggacatatataattcagcctattttctgcctaaaacctatggtactc

SEQ ID NO: 9293 - DNA, 382 bp, Homo sapiens
  AC009189.4_37537
  Located on chromosome 5
  Distance between a terminus base of telomere on chromosomal short arm and 5'-terminus of this base sequence : 149887667
  Distance between 3'-terminus of neighbour sequence of sequence listing upward to telomere on chrosomal short arm and 5'-terminus of this base sequence : 11544
cagacaaacgactatctgttattcttcaaacatgcctaggattgtatttaactatcacctatctaaaagaggtattctcgcctgcctggaaagaattttgctaagaaaattgtttctcttcttcccatattattttacctctatgctagttccctgtgatttgatatgtcaactttgacaaattcatttttctaaagcacagatatgaccttttttgttaagaaaaagaaactactgttgctccccagtgctacacacacacacacacacacatacacatacacacccttcacaagccttatctgcacccccgcccactccccacaacaaacttcagatgtcttagcttggcattcttcggaattaggtcaacgtttcagat

SEQ ID NO: 9294 - DNA, 294 bp, Homo sapiens
  AC011373.2_49271
  Located on chromosome 5
  Distance between a terminus base of telomere on chromosomal short arm and 5'-terminus of this base sequence : 150002550
  Distance between 3'-terminus of neighbour sequence of sequence listing upward to telomere on chrosomal short arm and 5'-terminus of this base sequence : 114501
atgaaccaatttcttagtgcacacatcatgaatatatatatattattattattattattattattattattattatgagaaggagtttctctcttgttacccatgctggagtgcaatggcgcgatctcagctcactgcaacctccacctcccgggtttaagcgattcttctgccttagactcctgagtagctgggattacaggcatgtgccactacgcccggctcattttgtatttttagtagagacagggtttctccatgttggtcaggctggtctcaaattctcgacctcag

SEQ ID NO: 9295 - DNA, 300 bp, Homo sapiens
  AC011373.2_147347
  Located on chromosome 5
  Distance between a terminus base of telomere on chromosomal short arm and 5'-terminus of this base sequence : 150024105
  Distance between 3'-terminus of neighbour sequence of sequence listing upward to telomere on chrosomal short arm and 5'-terminus of this base sequence : 21261
ctcatgaccaaatcagtatcattaccttggggcttaggatttcaacctatgaaattgggggtacacaaaccttcagaccacgctaaatgataaaaaataatttaaacacagaaatactgcatctcctcacttttgggaaaaaaatgcatgtcacagatacacacacacacacacacacacacatatacacacagatgggaagaaaatacactcctaggttaatggcagttttctccagaagatgatgaggaaacgatgtttatgttttcttactgctgatctctttggtacatcttaatt

SEQ ID NO: 9296 - DNA, 351 bp, Homo sapiens
  chr5.fa.O7frz.163611913
  Located on chromosome 5
  Distance between a terminus base of telomere on chromosomal short arm and 5'-terminus of this base sequence : 150164821
  Distance between 3'-terminus of neighbour sequence of sequence listing upward to telomere on chrosomal short arm and 5'-terminus of this base sequence : 140416
tagcatcaaatatgtagattgctttgggcagcatgaccattttaatgatgttcattcttccaatccataagcatgggatgtttttctatttatttgttccttctctgatttattttaaccctattttgtaattctctttacagagatctttaacatcctttaacagctagccgtattcctaggggtgtgtgtgtgtgtgtgtgtgtgtgtgtctactgtaaatgagattacattcttaacttggcactcagcttcaatatttttgatgtataaatatgctactgttcatattctttgcccactttttgatggggttgtttttttcttgtaaatttgtttaaggtccttgta

SEQ ID NO: 9297 - DNA, 477 bp, Homo sapiens
  AC008608.4_3966
  Located on chromosome 5
  Distance between a terminus base of telomere on chromosomal short arm and 5'-terminus of this base sequence : 150239472
  Distance between 3'-terminus of neighbour sequence of sequence listing upward to telomere on chrosomal short arm and 5'-terminus of this base sequence : 74300
cataatgaggaataatctgttcatttctttcttttaggaaaaatgaacaataaacaataatcagctcatttatttcttttagaaacaattcttgtattgtattgtattgtattgtattgtattgtattgtattgtattgtattgtattgtactgtattgtattgtattttttgagacagggtcttgctctgtcacccaggctggagtgcagcggtgagatgttagctctctgcaaccttcacctcgggggttcaagcagttcttgtgcctcagtcacccaagtagccaggattacaggcatgattgccaccaagctcagctaatttttgtatttttaatagagacggtgttttgtgatgtaattcatgtattttaaatggaaaaaacaagctttctgaaaaaactcatattttctttcttacattgtttagaacagtggaaactttttctctggttagcaatagtctgctgaagtac

SEQ ID NO: 9298 - DNA, 376 bp, Homo sapiens
  chr5.fa.O7frz.167539953
  Located on chromosome 5
  Distance between a terminus base of telomere on chromosomal short arm and 5'-terminus of this base sequence : 150271519
  Distance between 3'-terminus of neighbour sequence of sequence listing upward to telomere on chrosomal short arm and 5'-terminus of this base sequence : 31570
agaccagttagacaatctttgatgattacctctctctctctctctctctctctctctctctctctatatatatatatatatatatatatatacacatacatacatacatatatataaaattaggcccagtggaaataagaaggaagggacagatgcaaatgacagagtggaaatagagtccccaggaactggcaaatgtttgagtagaaagtggggagaaggggaacagaggtggaggtgtcaaagatgattcaggctctgagcatccatgagtgaggataatggctttatttaagtgaggtgtttggtttagggaaggggagtagtggcaaattcaagtttagatcttattgtcattaaagaaacaatctacagc

SEQ ID NO: 9299 - DNA, 176 bp, Homo sapiens
  DISO7_10002067
  Located on chromosome 5
  Distance between a terminus base of telomere on chromosomal short arm and 5'-terminus of this base sequence : 150313664
  Distance between 3'-terminus of neighbour sequence of sequence listing upward to telomere on chrosomal short arm and 5'-terminus of this base sequence : 41769
ttcccaatgaattacacttactgtaatgtcaattaggtaactttacacacacacacacacacacacacacacgaaacccagaattgtaaaattatgagccagaaaagaacttattgatctcaactttttattcttataatttctaaccgtattatctaacaactcagttcgccttt

SEQ ID NO: 9300 - DNA, 154 bp, Homo sapiens
  DISO7_10002065
  Located on chromosome 5
  Distance between a terminus base of telomere on chromosomal short arm and 5'-terminus of this base sequence : 150352171
  Distance between 3'-terminus of neighbour sequence of sequence listing upward to telomere on chrosomal short arm and 5'-terminus of this base sequence : 38331
tgactctccagaaagtatgagagagagagagagagtgtgtgtgtgtgtgtgtgtgtgtgacaaagtataacctaagatttcctttgctattgtctctatcattattaataacaataatcacttatttatcatactttatcattcacagtccatt

SEQ ID NO: 9301 - DNA, 420 bp, Homo sapiens
  AC011334.3_34122
  Located on chromosome 5
  Distance between a terminus base of telomere on chromosomal short arm and 5'-terminus of this base sequence : 150501647
  Distance between 3'-terminus of neighbour sequence of sequence listing upward to telomere on chrosomal short arm and 5'-terminus of this base sequence : 149322
tcgaattcttactgagctacagtaagcagagcaatggagatgctatcagtaggctgtgtgaataataaatttaggggacagttagagtacactgcaggaaggactaagagagaggtttgctagtagaggcagacccagagttagcaggggtggaaagtgttggagagagggagtgatagtgatagacaggcaggaaacaagatggattgtattggttgaatataaataatagaatggagagttgagcgactgagaaggggggaaatggcaaagtatagtgctttggaggaactacagagagagagagagagagagagagagagagagagagagaaacagacagagagttactcagccttcttaacttcaaatggccacaggagccaggcaggttatatgaatgagtgaagtaggctgaat

SEQ ID NO: 9302 - DNA, 385 bp, Homo sapiens
  AC011334.3_80000
  Located on chromosome 5
  Distance between a terminus base of telomere on chromosomal short arm and 5'-terminus of this base sequence : 150566736
  Distance between 3'-terminus of neighbour sequence of sequence listing upward to telomere on chrosomal short arm and 5'-terminus of this base sequence : 64669
caccaaatatgaagcttacaacttgctggtgctgtttcctgggatttactccctgctctggagtatctctaaacctttggaggtgctgccacatgccccaccctcaccccaggttttgatgaccaccccatcttttaggagttccccttatttttatatcctcatcctttctctatccatgctcagtcatggtcaatgtgaaatctgtgctgtggctttcctggcttggctcttcatagataaacctataaagccaagatttgagaaatctttctctctctctctctctctctctctctcaataaagttggtgttcttttttttttctttagcaaattggcaacatttcctatcagattatgtattgttcacaggctatacaaac

SEQ ID NO: 9303 - DNA, 151 bp, Homo sapiens
  DISD22_0009771
  Located on chromosome 5
  Distance between a terminus base of telomere on chromosomal short arm and 5'-terminus of this base sequence : 150644556
  Distance between 3'-terminus of neighbour sequence of sequence listing upward to telomere on chrosomal short arm and 5'-terminus of this base sequence : 77435
gccaaatcttcctgtcctcttgttttttttgttttgttttgttttgttttgttttgttttctgagaagcctaaaatccagatttttaaaatgttggctctaaatattttaaaatcccatgccaaacaaaacatgactgcagagcacatatt

SEQ ID NO: 9304 - DNA, 113 bp, Homo sapiens
  DISD22_0009775
  Located on chromosome 5
  Distance between a terminus base of telomere on chromosomal short arm and 5'-terminus of this base sequence : 150727228
  Distance between 3'-terminus of neighbour sequence of sequence listing upward to telomere on chrosomal short arm and 5'-terminus of this base sequence : 82521
ccaagaacaagagtcagggttctctctctctctctctctctctctcactctctctctctctctttctctctctttcccccaactctatccccagctgatccacattctggctt

SEQ ID NO: 9305 - DNA, 350 bp, Homo sapiens
  chr5.fa.O7frz.167108761
  Located on chromosome 5
  Distance between a terminus base of telomere on chromosomal short arm and 5'-terminus of this base sequence : 150890871
  Distance between 3'-terminus of neighbour sequence of sequence listing upward to telomere on chrosomal short arm and 5'-terminus of this base sequence : 163530
tatgtcaatgattaggcttgagtgaaaggggttctctggagccttcctgtctgtttatgacaatgtgaaggtttttttaagcaaaatacacacacatacacacacacacacacacacagaaaagttaaaaagggtacaacatggggaaaaaaggtcagagaaaaaataactaagataaacattgaaataactcgttactatatgtcaactaacccattcactgagtttaaatttactgaatttaaatttaagatacttagtatcaatcccattttctaaactatatactacataattatgataaattgagtgacatgaatgtagatgttgaattggacagattagtctta

SEQ ID NO: 9306 - DNA, 234 bp, Homo sapiens
  DISO7_10002062
  Located on chromosome 5
  Distance between a terminus base of telomere on chromosomal short arm and 5'-terminus of this base sequence : 151043032
  Distance between 3'-terminus of neighbour sequence of sequence listing upward to telomere on chrosomal short arm and 5'-terminus of this base sequence : 151811
ggctatttgtaagccaggagtttacaaatcaagttctctctccatttatctatctatctatctatctatctatctatctatctatctatctatctatcgggtctcactctgttacccaggctggagttcagtggcatgatcttggctcactgcaacctcaacctgttgggctcattctctctcctttcaaaaaattattatataatatagagattataatatgcaactaggccg

SEQ ID NO: 9307 - DNA, 274 bp, Homo sapiens
  D5S413
  Located on chromosome 5
  Distance between a terminus base of telomere on chromosomal short arm and 5'-terminus of this base sequence : 151171593
  Distance between 3'-terminus of neighbour sequence of sequence listing upward to telomere on chrosomal short arm and 5'-terminus of this base sequence : 128327
aggcctcattcaaaatctgtgtgtgtgtgtgtgtgtgtgtgtgtgtgtgtgtgtgtgtgtgtgtgttctttagatcatgaaacttctcatctgaaaatctccactctgtggcccagagtaagcttacatagtgagtgcacctaaaggtgagccatctccactttggccacttctccagatacccacaaggaagtgccgagaatgctgttgcacctcctctggccaaggacagagagtcatatcatctgcccacttggagacagagaaggtgact

SEQ ID NO: 9308 - DNA, 350 bp, Homo sapiens
  AC011364.2_13766
  Located on chromosome 5
  Distance between a terminus base of telomere on chromosomal short arm and 5'-terminus of this base sequence : 151203720
  Distance between 3'-terminus of neighbour sequence of sequence listing upward to telomere on chrosomal short arm and 5'-terminus of this base sequence : 31853
tactgtttgatctgtttggaagttccctggaagcctctgctcacagggcttgttttcctttaacctcactcagagctcactcagcgcagaacagccttttccctgaggcatatgtcaaaaataattagtagcaattgtttaatatgatcactgccttaggtggtgaaaacatgtggagcaaacaagaaaaggtcaaacacacacacacacacacacacacacacactaggaaaagttgggaaatgagatgtccataaaaagttttaaaagttctgacatattcctgggaatctagaagaccacatgcatgtacagggctgtgagcatgatcaggaaactgctaagatttt

SEQ ID NO: 9309 - DNA, 374 bp, Homo sapiens
  AC012613.5_99583
  Located on chromosome 5
  Distance between a terminus base of telomere on chromosomal short arm and 5'-terminus of this base sequence : 151394757
  Distance between 3'-terminus of neighbour sequence of sequence listing upward to telomere on chrosomal short arm and 5'-terminus of this base sequence : 190687
tacatgaccttgagcagataaccttgctgagatctctgggaaaccccaaaatgagaaggtagacaaaattcttcctggttcaaaaaatgctgtgctgggaaaatcagttgtatctttgattcggacccagacagatttctaaagagtgacattaggattttcctcccagccctgccggagaaaggaagtcttttttatttatttatttatttatttatttaattatttattttgtttgtttgtttgttttagtatttggtaatgtgctgatttaagagccagcttgtctagcagcttgctccctaagcccttctttggtgggtccatcaccatggcaacgcctctccccagcctttgatgtatgactccttctg

SEQ ID NO: 9310 - DNA, 217 bp, Homo sapiens
  AC012613.5_111615
  Located on chromosome 5
  Distance between a terminus base of telomere on chromosomal short arm and 5'-terminus of this base sequence : 151432566
  Distance between 3'-terminus of neighbour sequence of sequence listing upward to telomere on chrosomal short arm and 5'-terminus of this base sequence : 37435
cctcctgaggtagtgagtctaccatgatttgaacttatacaagcaggggctttattcaaatacttcttgaaaatctcattgcaagctcctcctattcctggacacacacacacacacacacacacacacacacacacacactctgtctgcctcctccttttcttactcctgtgagatgcagtcctgccaggaaatctcatctcggatcaatacatta

SEQ ID NO: 9311 - DNA, 404 bp, Homo sapiens
  AC012613.5_58125
  Located on chromosome 5
  Distance between a terminus base of telomere on chromosomal short arm and 5'-terminus of this base sequence : 151459122
  Distance between 3'-terminus of neighbour sequence of sequence listing upward to telomere on chrosomal short arm and 5'-terminus of this base sequence : 26339
aagtctaagatcaaggtgcagtcagggttagtgtcgggtgggacctctcttcctggcttgtagggacactttttgccatgtcccttcgtggcctcttctctgtgcatccagagaaagatctctggtgtttcttcttcttcttcttcctcttcctcttcttcttcttctttcttccttctttcctctttcttcattttttaattttttttgagacagagtctcactctgtcacccaggctggagtgcagtggtgggatctcggctcactgcaagctccgcctccttggttcatgccattctcctgcctcagcctcccgagtagctgggactacaggcgtgcaccaccatgcccagctaatttttttgtatttttagtagagatgaggtttcaccacgttagccag

SEQ ID NO: 9312 - DNA, 306 bp, Homo sapiens
  chr5.fa.O7frz.168454859
  Located on chromosome 5
  Distance between a terminus base of telomere on chromosomal short arm and 5'-terminus of this base sequence : 151742318
  Distance between 3'-terminus of neighbour sequence of sequence listing upward to telomere on chrosomal short arm and 5'-terminus of this base sequence : 282792
tgttctgactggtcttgaatacctgggctcaagtgatcctccctcctcggcctcctaaagtgctgggattacaggcgtgagccactgtgcccaaccagacaacccaatgatctttaaaaaaccatatatatatgtgtgtgtgtgtgtgtgtgtgtgtgtgtgtgtgtgtgtgtgtgtgtatatatatttttatatgtataaaatatttactgttcctttccttataaatgtgacattgaaaaatttctaaaattcagataaatcggaaaaaaacaaaaatctcttagaggtaatcaccaaatgtta

SEQ ID NO: 9313 - DNA, 384 bp, Homo sapiens
  chr5.fa.O7frz.168752429
  Located on chromosome 5
  Distance between a terminus base of telomere on chromosomal short arm and 5'-terminus of this base sequence : 151928419
  Distance between 3'-terminus of neighbour sequence of sequence listing upward to telomere on chrosomal short arm and 5'-terminus of this base sequence : 185795
tgtcatccactcagtgtatgtctctgggagcctactatgtaccagcaaactgagcttgatgctgaatgtaaataataataataataataataatggaatcctcatttgtgtacttgtccatttattcaacagcttttcactgagtaccaaccacgtagtagacatggtgccaggctctggggatgaagtgtgaacaagacagacatggactctgcctttatgaagctgactcagtgggagagaccctcaagtaaaacagtaaaacagcaacctcaacagagagggagaaggacctgagtagaaggctatacagaaagagcacctgaaccaagcaaagaggacttcctggaggaagcgacatgtcactgagatttgaaggatagt

SEQ ID NO: 9314 - DNA, 202 bp, Homo sapiens
  Z67370
  Located on chromosome 5
  Distance between a terminus base of telomere on chromosomal short arm and 5'-terminus of this base sequence : 152015022
  Distance between 3'-terminus of neighbour sequence of sequence listing upward to telomere on chrosomal short arm and 5'-terminus of this base sequence : 86219
tgctgttgattgcacacacacatgcatacgctcatgtatgtgagcgtgcacacacacacacacacacacacacacacattcaagcaaaattccctaagcagtaaaatggcaaagatgtgtttgcctctaaagggcagttgcttattttgtcttttctgtgcctgttgcctttgaggcaggagaagggtgggcaaggattcct

SEQ ID NO: 9315 - DNA, 351 bp, Homo sapiens
  chr5.fa.O7frz.169024134
  Located on chromosome 5
  Distance between a terminus base of telomere on chromosomal short arm and 5'-terminus of this base sequence : 152141278
  Distance between 3'-terminus of neighbour sequence of sequence listing upward to telomere on chrosomal short arm and 5'-terminus of this base sequence : 126054
attcaggtatttatggaaagactttgatttttaagggttagccgccaatttcccagcactttgggaggccaaggtaggaggatcacttgagcactaggaagtcaagaccagcctaggcaacatacaaagaccctatctgagagagaaagagagagacagagagagagagagagagaagaaaagaaagaaagaagaaagagagaaagagagaaaaagaaagaaagaaagaaagaaagaaagaaagaaagaaagaaagaaagaaagaaaaagaaagaaaatagaaaacctacgtagccaagcaagtgtatctgtcagctggaattggctttctggctaccaatttgtacatta

SEQ ID NO: 9316 - DNA, 345 bp, Homo sapiens
  AC011406.2_129322
  Located on chromosome 5
  Distance between a terminus base of telomere on chromosomal short arm and 5'-terminus of this base sequence : 152211976
  Distance between 3'-terminus of neighbour sequence of sequence listing upward to telomere on chrosomal short arm and 5'-terminus of this base sequence : 70347
ggtatagtatgttggcctacagagaggattagtcaactggagcagaagtggggttgccactcaagtgaggttggagtgaccaaagaggcacggagaagccacagaaagcctgacgagggataatatcaacctcttttagcttaacaaagtaccaaaaacccctgatatccaatagaatcgaagtgttagccagtgtaaactgaactaaaaaattttctttttcggatgatttccatcttccgatggaagtccaggatctaaatcatgatatattaagtaaatcaagaatgttaaatttgttattattattattattattattttagatggtgtttcactctgtca

SEQ ID NO: 9317 - DNA, 393 bp, Homo sapiens
  AC011382.2_28240
  Located on chromosome 5
  Distance between a terminus base of telomere on chromosomal short arm and 5'-terminus of this base sequence : 152316003
  Distance between 3'-terminus of neighbour sequence of sequence listing upward to telomere on chrosomal short arm and 5'-terminus of this base sequence : 103682
gactgagccttctcagatactatctcctggtgcacacttggacagcatttcctgtgtcagaccctgttctaagtacttcctatctatctatctatctatctatctatctatctatctatctatctatctatctaatctatctatcttctatctatgaaggcagttactgttaatatcttcattttacaggtaggaaaactgagacacagggtggttagcaacctgctagtccttggcagactcaggttggaacactgccctggagtgtgtgctcctgaccaccacgaagtgcctcctctgtacaatctgaccccatcactctcctctttacaatgacctcccaataggttaagatgcagttattctttctcactttaagacacctttacctcc

SEQ ID NO: 9318 - DNA, 414 bp, Homo sapiens
  AC005895.1_66450
  Located on chromosome 5
  Distance between a terminus base of telomere on chromosomal short arm and 5'-terminus of this base sequence : 152437534
  Distance between 3'-terminus of neighbour sequence of sequence listing upward to telomere on chrosomal short arm and 5'-terminus of this base sequence : 121138
cataggtaaagcacttagcataaggccaggacgtacatagtaaggaccatctcagactcctctaatagagataggactataatagagtaagggactgtcatcagaattaaacaacataatgcaggtgaaaccattatcacggtgctgggcacacagtgggtcctgggaatggtgggtgtcggaaggacgttgcactcatcagcctatcccaatgccccattttatggtcaataaaacaaagccttgtcactgcattctgcctttaaaagaagaaagagaaagaaagaaagaaagaaagaaagaaagaaagaaagaaagaaagaaagaaagaaagaaagaaagagaaagaaagaaagaaagaaagaaagcaaagcccagaggcttgctcagtattgctcagtaattagtgacaga

SEQ ID NO: 9319 - DNA, 173 bp, Homo sapiens
  D5S2015
  Located on chromosome 5
  Distance between a terminus base of telomere on chromosomal short arm and 5'-terminus of this base sequence : 152438534
  Distance between 3'-terminus of neighbour sequence of sequence listing upward to telomere on chrosomal short arm and 5'-terminus of this base sequence : 586
gctacctaaagaacacagtcatggccaggccctggatggtgtgtgtgtgtgtgtgtgtgtgtgtgtgtgtgtgtgtgtgtgtgtgtgtgtggtgtacacatgtatatgcaaatacccagacccctcattcctcccctcactacagtctcccactgttgcctcccattagccaa

SEQ ID NO: 9320 - DNA, 154 bp, Homo sapiens
  D5S2013
  Located on chromosome 5
  Distance between a terminus base of telomere on chromosomal short arm and 5'-terminus of this base sequence : 152443534
  Distance between 3'-terminus of neighbour sequence of sequence listing upward to telomere on chrosomal short arm and 5'-terminus of this base sequence : 4827
agccaggtgagtctcgtctgtggcagcaggcaccccgtgtgtgtgtggtgtgtgtgtgtgtgtgtgtgtgtgtgtgtgtgtgtgtgtgtgttggggatagaattctgacccccagcccctcctctctcctcagtttgcttttctggagaccatt

SEQ ID NO: 9321 - DNA, 167 bp, Homo sapiens
  chr5.fa.O7frz.180128401
  Located on chromosome 5
  Distance between a terminus base of telomere on chromosomal short arm and 5'-terminus of this base sequence : 152513130
  Distance between 3'-terminus of neighbour sequence of sequence listing upward to telomere on chrosomal short arm and 5'-terminus of this base sequence : 69442
actcactagatttcaagttccaccaacaacaaaaaaagtgtgtgcatgtatgtgtgtgtgcacgtgtgtgcgtgtgtgtgtgtgtgtgtgtatgtgtgtgtatttagctcaaaatcatcagcacctagaacattgctaaggatttctggacatttgacataactttg

SEQ ID NO: 9322 - DNA, 278 bp, Homo sapiens
  HUMUT1066B
  Located on chromosome 5
  Distance between a terminus base of telomere on chromosomal short arm and 5'-terminus of this base sequence : 152783647
  Distance between 3'-terminus of neighbour sequence of sequence listing upward to telomere on chrosomal short arm and 5'-terminus of this base sequence : 270350
accctgtcaggaaggaaggaaggaagaaagaaaagaaaagaaaaaaagaaaagaaaagaaagaatggaagaaagaaataaaagaaggaagggaaggagggagggaggaaggaaggaaggaaggaagaaaggaaggaaggaaggaaggaaggaaggaaggaaggaaggaaggaaggaaggaaagaaggaaaggcaactagtggaagaactgggttgagatatcttagaggatttggttgggaaagattctgagattaagtctgggctcagtgggaaaga

SEQ ID NO: 9323 - DNA, 397 bp, Homo sapiens
  AC011343.2_14278
  Located on chromosome 5
  Distance between a terminus base of telomere on chromosomal short arm and 5'-terminus of this base sequence : 152792221
  Distance between 3'-terminus of neighbour sequence of sequence listing upward to telomere on chrosomal short arm and 5'-terminus of this base sequence : 8296
acaactccatgtggtaaatactattaaaatccccattttacagataaacagatagaagcttaaataaataaagtaacttgcccaaggtcacaaagccaggaagtggcaggagctagaattttatctgtctggatgaagccagtttggtgtttaataagctacttccttagggctaactggcgtttctcatgctgtctttgtctttggcatctatagctgtttgttctctctctctctctctctgtcacacacacacacacacacacacacacacagagttggttgccatcatgggaccaataatttttgccctccttaaagacaattattgaatcaggtctcccacccttcttggaagagttaaggcaggatcctgacataaactcacttaaggttc

SEQ ID NO: 9324 - DNA, 417 bp, Homo sapiens
  AC011353.3_108755
  Located on chromosome 5
  Distance between a terminus base of telomere on chromosomal short arm and 5'-terminus of this base sequence : 152828847
  Distance between 3'-terminus of neighbour sequence of sequence listing upward to telomere on chrosomal short arm and 5'-terminus of this base sequence : 36229
acatggatgaagctggaatccatcattctcagcaaactatcgcaaggacaaaaaaccaaacaccatatgttctcactcataggtgggaatagaacaatgagaacacatggacacaggaaggggaacatcacacaccagggcctgttgtggggtagggggagaggggagggatagcattaggagatatacctaatgttaaatgacgagttaatgtgtgcagcacaccaacatggcacatgtatacatatgtaacaaacctgcatgttgtgcacatgtaccctaaaacttaaagtataataataataataataataaaagaaatgtttattgaaatctttcagtattgaatgttggggttagcactcaaaagaaggaatgtgactggagggagaactggagcatagtctttgattacat

SEQ ID NO: 9325 - DNA, 253 bp, Homo sapiens
  AC005371.1_83094
  Located on chromosome 5
  Distance between a terminus base of telomere on chromosomal short arm and 5'-terminus of this base sequence : 152908278
  Distance between 3'-terminus of neighbour sequence of sequence listing upward to telomere on chrosomal short arm and 5'-terminus of this base sequence : 79014
atcctgtcattcagcactttacaaataaagcctctaaaaacattaatttgtgtgtgtgtgtgtgtgtgtgtgtgtgtgtgtgtgtgtgtgaatgtaagttttcatttgtcttgggtaaatctcaagaatagggcattttactttatttatttatttatttatttatttatttatttatttatttatttatttattgaggcagggtctcactcttcacccaggctggagtctagtgttggatctatagccttga

SEQ ID NO: 9326 - DNA, 398 bp, Homo sapiens
  chr5.fa.O7frz.162914815
  Located on chromosome 5
  Distance between a terminus base of telomere on chromosomal short arm and 5'-terminus of this base sequence : 153101802
  Distance between 3'-terminus of neighbour sequence of sequence listing upward to telomere on chrosomal short arm and 5'-terminus of this base sequence : 193271
ctgaattctaccagatgtttaaagcagaattggtaccaattctactgaaactattccaaaagattgagaaagacagaatccttcctaactcattttatgaggccagtatcaccctcatatcaaaatcaggagcagacataacaaaaagataaaaccgtgaaccaatatccctgatgcacatagataagaaaatcctctctctctctctctctctctctctctctctctctctctctctctctctctatatatatatatatatatatatatatatatatgctagctagccaaatccaacaacacatcaaaaagataatacatgatgatcaagtgagttttatcttagggaagcagggataatttaacttacacaagtcaataaatgtgatacttcacat

SEQ ID NO: 9327 - DNA, 167 bp, Homo sapiens
  D5S402
  Located on chromosome 5
  Distance between a terminus base of telomere on chromosomal short arm and 5'-terminus of this base sequence : 153271003
  Distance between 3'-terminus of neighbour sequence of sequence listing upward to telomere on chrosomal short arm and 5'-terminus of this base sequence : 168803
ttaaagaaggttcacagggaatctacaagcagggagatgtactctcaggctataatattcatttccttaacatatgcacacatacacatgcatttgtgcacacacacacacacacatgcacacacacacgcacacacacttactattccaccatcttaacttcctga

SEQ ID NO: 9328 - DNA, 420 bp, Homo sapiens
  AC011353.3_72323
  Located on chromosome 5
  Distance between a terminus base of telomere on chromosomal short arm and 5'-terminus of this base sequence : 153449262
  Distance between 3'-terminus of neighbour sequence of sequence listing upward to telomere on chrosomal short arm and 5'-terminus of this base sequence : 178092
gatcatattagtggttgccattggttaggaatgggagggcaagcatgggtgagaggtagacacggtcgtgaggagtaatatggggaatctttgtggtgatggaactgttccaaatcttgactgtgatgggggaaaccaacaggtggtaaaattgcatagaaccaaacacacacacacacacacacacacacacacacacacacccgagtacaagtaaaaatagggaaatcctgagtaacattgattaactgtatcaatgacaatatcctagttgtgatattgtagcatagttttgcaaatgtcaccttttgaaggaaatgggtaaagattacattggatcactttgcgcatttcttacaaatgcatgtgaatttgtaaatttcaataaaaagtacactggtaactaagtttgcaaactaa

SEQ ID NO: 9329 - DNA, 155 bp, Homo sapiens
  HUMUT2211
  Located on chromosome 5
  Distance between a terminus base of telomere on chromosomal short arm and 5'-terminus of this base sequence : 153450894
  Distance between 3'-terminus of neighbour sequence of sequence listing upward to telomere on chrosomal short arm and 5'-terminus of this base sequence : 1212
gcctggaaagaacagtggcctgaggtaaggatggatggatggatagatggatggatggatagatagatagatagatagatagatagatagatagatagatagatagacagacagatagatagatagagtcccaagggaaatgacaaatggcctgg

SEQ ID NO: 9330 - DNA, 461 bp, Homo sapiens
  AC011353.3_77742
  Located on chromosome 5
  Distance between a terminus base of telomere on chromosomal short arm and 5'-terminus of this base sequence : 153454578
  Distance between 3'-terminus of neighbour sequence of sequence listing upward to telomere on chrosomal short arm and 5'-terminus of this base sequence : 3529
aagtaatgcctatcaactgtagaatagacaaaatacaattttgtcaatacacagaaatattatataccagtgaaaattaatgaaatatggcttcattcatagatctacaagaataaaactcaaaaataaaagtacatcaaaatgttagtaaactacatacactattatataaagttcaaagtagaaacaatgaataatatagtgattaggtatactaatatataatcaacatattaaaggggataatatagatagaaatgtaggtaggagatagatagatagatagatagagggatagatagactataatacataattgatatattagaggcaaaaccataaaggaaagaaaagaaatatataacattaggttattcattgcctctgaggagggaggtgagctatataattagagaggggcacagagagaatatatactggtatgctttcatatgtaatct

SEQ ID NO: 9331 - DNA, 168 bp, Homo sapiens
  Z67584
  Located on chromosome 5
  Distance between a terminus base of telomere on chromosomal short arm and 5'-terminus of this base sequence : 153565544
  Distance between 3'-terminus of neighbour sequence of sequence listing upward to telomere on chrosomal short arm and 5'-terminus of this base sequence : 110505
agctacagttttaacacccctaacttcacacacacacacacacacacacacacacacgcacgcaccagtatacatcttacaatcaaaccataaaagaattctgaatatgtgaacacctatctaggggcttctttactttcttcatctgggcttcaatgagctgtagac

SEQ ID NO: 9332 - DNA, 372 bp, Homo sapiens
  chr5.fa.O7frz.172083184
  Located on chromosome 5
  Distance between a terminus base of telomere on chromosomal short arm and 5'-terminus of this base sequence : 153635953
  Distance between 3'-terminus of neighbour sequence of sequence listing upward to telomere on chrosomal short arm and 5'-terminus of this base sequence : 70241
tcctaccttaatttctgcctaggctggttcattctctctctagctcactatttctgtctctatctctgtgtttgtctcttgtctttctctcctttctctctctcctccctccctctctctttctcaatctgtcacacacacaaacacacacacacacacacacacacacagccgaaattaaacaacctgctttttaaattgatctggtgcctgtccttagggccaaacaacaaaagcaaggagaggggagaatataatattgcagaaggagtcttttcagtggtagcaaagcaggctgcaagagtaacgtgaacaggagctgaagtcagagggaatataaactaagaagtcagaaggaacataaactaagaa

SEQ ID NO: 9333 - DNA, 148 bp, Homo sapiens
  DISD22_0009784
  Located on chromosome 5
  Distance between a terminus base of telomere on chromosomal short arm and 5'-terminus of this base sequence : 153765580
  Distance between 3'-terminus of neighbour sequence of sequence listing upward to telomere on chrosomal short arm and 5'-terminus of this base sequence : 129255
gcctccatagcctcttatactgttttatccctgctcaccgtgctgtctgttttatcagcctctttgtgttcacacaacacacacacacacacacacacacacacacacacacacacacacacacacccctcactgtaaggatttcctg

SEQ ID NO: 9334 - DNA, 222 bp, Homo sapiens
  DISD22_0009792
  Located on chromosome 5
  Distance between a terminus base of telomere on chromosomal short arm and 5'-terminus of this base sequence : 154004925
  Distance between 3'-terminus of neighbour sequence of sequence listing upward to telomere on chrosomal short arm and 5'-terminus of this base sequence : 239197
ctaaggatgtcacttgaacccctggattcagctgtgacttttcagccacctgaaataatttcccttgttggtttaaatacactgaaaagagagagagagagagagagagagagagagagagagagagagagagagagtatactattatatataatatatatgcactattatatatttatttacttacagctgaaagatgcccaaatcaagtgactctcaatg

SEQ ID NO: 9335 - DNA, 236 bp, Homo sapiens
  DISD22_0009794
  Located on chromosome 5
  Distance between a terminus base of telomere on chromosomal short arm and 5'-terminus of this base sequence : 154095514
  Distance between 3'-terminus of neighbour sequence of sequence listing upward to telomere on chrosomal short arm and 5'-terminus of this base sequence : 90367
gcagaatgaagccagaattagatttctatcacctattagctgtgtcatcttaggaccatttctcaaactccttaaggatcagttttctcaaatataaagtaacgataatggcacttgactattttttaagaatttgtgaaaattagagaataaatgaatacacacacacacacacacacacacacacacacacccctagtatagctttgagaaccgggaggtattcgacacaggga

SEQ ID NO: 9336 - DNA, 475 bp, Homo sapiens
  chr5.fa.O7frz.172390475
  Located on chromosome 5
  Distance between a terminus base of telomere on chromosomal short arm and 5'-terminus of this base sequence : 154236558
  Distance between 3'-terminus of neighbour sequence of sequence listing upward to telomere on chrosomal short arm and 5'-terminus of this base sequence : 140808
cctttatggaaggttccaccctctactctttgtctggcttcaagagacttgggtttttagaaaaacctttctaggccgggcgcggtggctcacgtctgaaatcccagcactttgggaggcccaggcgggcggatcaccatatcaggagatggagaccatcctagctaacacggtgaaaccccgtctctactaaaaaatacaaaaagttagccgggcgtggtggcgggcgcctgtagtcccagctacccgggatgctgaggcaggagaacggcgtgaacccaggaggtggagcttgcagtgagcacagatcgcaccactgcactccagttttggcgacagagcgagactccgtctcaaaaaaataaaataaaataaaataaaataagaaaaagaaaaacctttctagatctcatgatgtaattcaggaccacactttccttttttccattgtaccttacattctgccttcatatca

SEQ ID NO: 9337 - DNA, 423 bp, Homo sapiens
  chr5.fa.O7frz.172613972
  Located on chromosome 5
  Distance between a terminus base of telomere on chromosomal short arm and 5'-terminus of this base sequence : 154405172
  Distance between 3'-terminus of neighbour sequence of sequence listing upward to telomere on chrosomal short arm and 5'-terminus of this base sequence : 168139
tttcatctttatggtactttcaacaccattctttcatttttatatgaagcagctatttttatacacacacacacacacacagagagagagagagagagagagagagagagagagagataggcctatcattgagagatgtgagatgcctaacccaaggtcacataggtaactgacacagacagcactggaacacataacttttattcttcaagtccattattgttttttctaccaccccacgtgacagatttctaccacccaatagaaatctgtcaccgcttgggttttctgggaagcagactctgaaacagtttaatgtacaggatattttactgaggagtgcccttagaattaacaactatgaaagacaagggaaggaatcaggattaacagagagataagttaagctatgaagcagatttg

SEQ ID NO: 9338 - DNA, 253 bp, Homo sapiens
  Z66763
  Located on chromosome 5
  Distance between a terminus base of telomere on chromosomal short arm and 5'-terminus of this base sequence : 154515503
  Distance between 3'-terminus of neighbour sequence of sequence listing upward to telomere on chrosomal short arm and 5'-terminus of this base sequence : 109908
cctgggtgacaagatgtaacaaatacatgtgtgtgtgtgtgtgtgtgtgtgtgtgtgtgtatatactcaaaatatatattatatatatactcaaaatatatattatgtatataaatttatatataatatctgtctcaaatatatatatattttatataatattactaaaattaattttacctgctatttatacttttataaaggtggctactgaaaaattttaaattacctatgtggcttacatttgtggatt

SEQ ID NO: 9339 - DNA, 355 bp, Homo sapiens
  AC022099.6_162256
  Located on chromosome 5
  Distance between a terminus base of telomere on chromosomal short arm and 5'-terminus of this base sequence : 154567611
  Distance between 3'-terminus of neighbour sequence of sequence listing upward to telomere on chrosomal short arm and 5'-terminus of this base sequence : 51855
ggagcctcactgtagttcttagaggtaactatggatggttttgtctctctttttagagataatagaacagaagccccaagaaagaaaatgtcttttccaacatcataaatctagtccatgtcagaagtaaaactaggcaatatatcattcacatcttttatagtagtaataaaactgtattgatgattagtagtcaggattaagctagtgtgtgtgtgtgtgtgtgtgtgtgtgtgtgtgtgtattcatttaatgcactcaatagttaattagatggcattatcactattttacagataaagaaaatgggactgctgactggttaaaatttgtgcaactaatcatttctaattgt

SEQ ID NO: 9340 - DNA, 197 bp, Homo sapiens
  D5S2007
  Located on chromosome 5
  Distance between a terminus base of telomere on chromosomal short arm and 5'-terminus of this base sequence : 154650368
  Distance between 3'-terminus of neighbour sequence of sequence listing upward to telomere on chrosomal short arm and 5'-terminus of this base sequence : 82402
gcattaggcattgattttcctcttaaggggctcaggttcttataaaggaaataggcataaaccaaatctgcctctctttctctctctctctctctctctctctctccccctcttacatacacacacacacacacacacacacacacacacacacacacacacattcagaggaaggaaggaaaacctttagttggagg

SEQ ID NO: 9341 - DNA, 280 bp, Homo sapiens
  D5S1978
  Located on chromosome 5
  Distance between a terminus base of telomere on chromosomal short arm and 5'-terminus of this base sequence : 154656039
  Distance between 3'-terminus of neighbour sequence of sequence listing upward to telomere on chrosomal short arm and 5'-terminus of this base sequence : 5474
tggtctcaggcattggaagccactgagcatagcaaggcagagagggggaggtatgctagggcattcctaaccatgaggtgatggaattggctatacttcttggcttggctccagaatactcaagagttgttgcttattaggatggcaagaagggtgtgtgtgtgtgtgtgtgtgtgtgtgtgtgtgtgtgtgtgtgttcatacatatattcattctttcacagaggaggaaaatgaactagatggcttctagatccctttccaagtgtgtgattataaaa

SEQ ID NO: 9342 - DNA, 446 bp, Homo sapiens
  chr5.fa.O7frz.173161722
  Located on chromosome 5
  Distance between a terminus base of telomere on chromosomal short arm and 5'-terminus of this base sequence : 154779839
  Distance between 3'-terminus of neighbour sequence of sequence listing upward to telomere on chrosomal short arm and 5'-terminus of this base sequence : 123520
gacatgttgcaaggtagtttagcaaagtgataaggactcatgtggaatcagacatacaggggtttgaattgtagctccactattatcagttctgtgacccctgcctacctatgttttagtccctcttttgttaaatggcaataataataaagtacaccctcttaagctgttacagagattaaaagaattgatgaaagtaaaatgtgtagtctattttctagcattaaagtgctcagtatatgcaagcacctattagtaattaatgttagaaataataatgataattatcatcatcatcatcatcatcatcatcatttgttgccactgtggctgtgccaggttctccagatcctcaatgatcccctttcttttcttagatatgtgagggagataagcaaaggaatatattgaagagaaaaagcccaatgtttattactgcgtggctg

SEQ ID NO: 9343 - DNA, 109 bp, Homo sapiens
  DISD22_0009798
  Located on chromosome 5
  Distance between a terminus base of telomere on chromosomal short arm and 5'-terminus of this base sequence : 154855358
  Distance between 3'-terminus of neighbour sequence of sequence listing upward to telomere on chrosomal short arm and 5'-terminus of this base sequence : 75073
agtcagctcttctcaatccctttgcctaatgctatggttttgtttgtttgtttgtttgtttgttttttaaatactgaaaagtaaagagatgaattatttcagaccactg

SEQ ID NO: 9344 - DNA, 298 bp, Homo sapiens
  DISD22_0009801
  Located on chromosome 5
  Distance between a terminus base of telomere on chromosomal short arm and 5'-terminus of this base sequence : 154947791
  Distance between 3'-terminus of neighbour sequence of sequence listing upward to telomere on chrosomal short arm and 5'-terminus of this base sequence : 92324
agaagcatgtccaggagctggcatggtggcttatgcctgtaatcccagcactttgggaggctgtgatgggaggatcactggagcccaggagttcaagaccagcttgggcaacatagtgagaccttatctctattttaaaaagtatatatatatgtgtgtgtgtgtgtgtgtgtgtgtgtaaataatacatataaatttcacatagattatatatgtatatataaattacacacacacacacgaatatatgaactgtgtccagggcacctggggagagaaactagcctgggatagcgag

SEQ ID NO: 9345 - DNA, 113 bp, Homo sapiens
  DISO7_10002078
  Located on chromosome 5
  Distance between a terminus base of telomere on chromosomal short arm and 5'-terminus of this base sequence : 155429557
  Distance between 3'-terminus of neighbour sequence of sequence listing upward to telomere on chrosomal short arm and 5'-terminus of this base sequence : 481468
aattcacactcctggtttctcttaaaaattgcaagatctataaaaattacacacacacacacacacacacacacacacacacacacacacactgcaagatctggcaacactag

SEQ ID NO: 9346 - DNA, 283 bp, Homo sapiens
  DISO7_10002079
  Located on chromosome 5
  Distance between a terminus base of telomere on chromosomal short arm and 5'-terminus of this base sequence : 155517136
  Distance between 3'-terminus of neighbour sequence of sequence listing upward to telomere on chrosomal short arm and 5'-terminus of this base sequence : 87466
ttcctgttccaggataaagactaaactccacccctggccccctacccacactgtgccctcacccacctctgccctccaacgactctgatctccaacaagccatgtgtccttctgcaacagagccttggcacatgtcactctcattacatggagcactcttccagttacctaccgtgcacacaagtgcatgcacacaggcacacatgcacttgcatgcacacacacatgcatacacacacacacacacacacacacacacagttttgcttggctaattctgcct

SEQ ID NO: 9347 - DNA, 139 bp, Homo sapiens
  DISO7_10002080
  Located on chromosome 5
  Distance between a terminus base of telomere on chromosomal short arm and 5'-terminus of this base sequence : 155526762
  Distance between 3'-terminus of neighbour sequence of sequence listing upward to telomere on chrosomal short arm and 5'-terminus of this base sequence : 9343
gaattctgtaagatctcaaacactctctcgcgctctctctctctctctctctctctctcacacacacacacacacacacacacacaccacagagagagagggagagagatttcatttatgagatgacatgaacacccaa

SEQ ID NO: 9348 - DNA, 329 bp, Homo sapiens
  AC010367.3_23832
  Located on chromosome 5
  Distance between a terminus base of telomere on chromosomal short arm and 5'-terminus of this base sequence : 155585993
  Distance between 3'-terminus of neighbour sequence of sequence listing upward to telomere on chrosomal short arm and 5'-terminus of this base sequence : 59092
gcctaggaatgtctgtttgagtccctgctttcagttcttttagatacatacctaaaatggaattgttggatcatatggtagttctacatttaaccttttggaaaccacaaaagtttttaacagcagctgcaccattttgcatgtttactagcagtgcacaaaggtttcaatttctccacccacatcctcactaacacttgttgttttccactttttaaattatagctagcctagcaggtgtaaaatgatatttaatgctagtttttgttgttgttgttgttgttgttgttttgttttttttttttttttgagatggagctttgctcttg

SEQ ID NO: 9349 - DNA, 234 bp, Homo sapiens
  Z67218
  Located on chromosome 5
  Distance between a terminus base of telomere on chromosomal short arm and 5'-terminus of this base sequence : 155594853
  Distance between 3'-terminus of neighbour sequence of sequence listing upward to telomere on chrosomal short arm and 5'-terminus of this base sequence : 8531
cttgaagaaattgctttgctgtgtgtgtgtgtgtgtgtgtgtgagagagagagagagagtgtgcatgtgtgtgcatgtgtgtgtgtgtgagagagagagagagagaagtttattaatctacttggtagataaacagatgtttgaaatgatatagttatttaaacctcaaagcaaaatcatttcattgcctttgtagggttctttgagaggaaggtggaggggagccatcctaaa

SEQ ID NO: 9350 - DNA, 181 bp, Homo sapiens
  AC018757.5_62055
  Located on chromosome 5
  Distance between a terminus base of telomere on chromosomal short arm and 5'-terminus of this base sequence : 155595264
  Distance between 3'-terminus of neighbour sequence of sequence listing upward to telomere on chrosomal short arm and 5'-terminus of this base sequence : 177
tatgcactttaacaaatcttccttcttgagcagaatgtagttggcttgcttcaccaccattctttcctacctccaaaggctgccaggcctgctaaatagtgattaaacaaagattaaaattccatttgtgtgtgtgtgtgtgtgtgtgtgtgtgtgtgtgtttgaacactaatcgattctt

SEQ ID NO: 9351 - DNA, 250 bp, Homo sapiens
  AC018757.5_68623
  Located on chromosome 5
  Distance between a terminus base of telomere on chromosomal short arm and 5'-terminus of this base sequence : 155601850
  Distance between 3'-terminus of neighbour sequence of sequence listing upward to telomere on chrosomal short arm and 5'-terminus of this base sequence : 6405
gaaggactggcatgacaaggaggccatccggagggacgctcagcgcgtaggtacggagggcaggattggccatgggtgggctctgtgaagggcatatgcacatatgcttgtgtgtgtgtgtgtgtgtgtgtgtgtgtgtgttcatgtgtgtgtttagcaggggtgtctggacctcctgttggctccctccctgtcagccaccatcccttcccctgattcccagatgcccctcttcaccagttagctgacc

SEQ ID NO: 9352 - DNA, 400 bp, Homo sapiens
  AC010367.3_68377
  Located on chromosome 5
  Distance between a terminus base of telomere on chromosomal short arm and 5'-terminus of this base sequence : 155637798
  Distance between 3'-terminus of neighbour sequence of sequence listing upward to telomere on chrosomal short arm and 5'-terminus of this base sequence : 35698
cagctgacagtttcaggagcggctcacctgcccatcgccccgttttaataccgcactcttaattacatgcgtttagtacagaggcctcagagagacagagagggtgtgtgtgtgtgtgtgtgtgtgtgtgtgtttgtgtgtgtgtagacatttaactcagttcttacccggtctataaagtcttccctaactcttgacatacactcattctcgtgctaccctttacgtttccttccttttccttaccacttatcacaggtggaattaaaatacatatttgtgtgaacattggtgtgttgtgtgcctcccctactagactgtctattttgattgcagggactaccacattggtcctgttcaccactgatcccagctccttaggcatacagtaggtgcttac

SEQ ID NO: 9353 - DNA, 207 bp, Homo sapiens
  D5S497
  Located on chromosome 5
  Distance between a terminus base of telomere on chromosomal short arm and 5'-terminus of this base sequence : 155637818
  Distance between 3'-terminus of neighbour sequence of sequence listing upward to telomere on chrosomal short arm and 5'-terminus of this base sequence : -380
ggctcacctgcccatcgccccgttttaataccgcactcttaattacatgcgtttagtacagaggcctcagagagacagagagggtgtgtgtgtgtgtgtgtgtgtgtgtgtgtttgtgtgtgtgtagacatttaactcagttcttacccggtctataaagtcttccctaactcttgacatacactcattctcgtgctaccctttacg

SEQ ID NO: 9354 - DNA, 194 bp, Homo sapiens
  AC018757.5_104555
  Located on chromosome 5
  Distance between a terminus base of telomere on chromosomal short arm and 5'-terminus of this base sequence : 155637867
  Distance between 3'-terminus of neighbour sequence of sequence listing upward to telomere on chrosomal short arm and 5'-terminus of this base sequence : -158
cgtttagtacagaggcctcagagagacagagagggtgtgtgtgtgtgtgtgtgtgtgtgtgtgtttgtgtgtgtgtagacatttaactcagttcttacccggtctataaagtcttccctaactcttgacatacactcattctcgtgctaccctttacgtttccttccttttccttaccacttatcacaggtgga

SEQ ID NO: 9355 - DNA, 455 bp, Homo sapiens
  chr5.fa.O7frz.174038708
  Located on chromosome 5
  Distance between a terminus base of telomere on chromosomal short arm and 5'-terminus of this base sequence : 155723077
  Distance between 3'-terminus of neighbour sequence of sequence listing upward to telomere on chrosomal short arm and 5'-terminus of this base sequence : 85016
gaaatctagacttcactgtgaaatcctcaagtcttaaatgttggcaactgattccatttaaaaagaaaagtgcagccgggcacagtggctcatgcctgtaatcccagcactttgggaggctgaggtgggtggatcacctgaggtcaggagttcgagactagcctggccaacatggtgaaaccccgtctctatacaaaaatcagccagacatggtggctcatgcctgtactcccagctactcgggaggccgaggcaggagaagcacttgaacctgagaggcagaggttgcagtgagccaagattgtgccactacactccagcctgggtgacagagtgagaacctgtctcaaaaaaattaaaaaaattaaaaaaataaaagataaaaggaaagcacatacacacacacacacacacacacacacacacacacacacgataaggaccagtgaggtctg

SEQ ID NO: 9356 - DNA, 113 bp, Homo sapiens
  D5S2026
  Located on chromosome 5
  Distance between a terminus base of telomere on chromosomal short arm and 5'-terminus of this base sequence : 155795041
  Distance between 3'-terminus of neighbour sequence of sequence listing upward to telomere on chrosomal short arm and 5'-terminus of this base sequence : 71509
tcaaacccaagtctccctgactttaaagtccttgctttcaaccactacaattaaaggggtgtgtgtgtgtgtgtgtgtgtgtgtgtgtgtaaagtgggggtaagtaaaatgct

SEQ ID NO: 9357 - DNA, 262 bp, Homo sapiens
  DISD22_0009824
  Located on chromosome 5
  Distance between a terminus base of telomere on chromosomal short arm and 5'-terminus of this base sequence : 155943266
  Distance between 3'-terminus of neighbour sequence of sequence listing upward to telomere on chrosomal short arm and 5'-terminus of this base sequence : 148112
cctgtccatctacttgtatacctgtccatccatccatttattcatccatctactcatctaactgttcatccatccatccatccacccatctatccagccatcatccatccattcatccatccatccactcacctcttcatccaaccatcccccatccatccatccaaccatccatccatccatccatccatccatccatccatccatccatgtatccatccatccatccaacatgtactggggatctgttatgattcagtca

SEQ ID NO: 9358 - DNA, 228 bp, Homo sapiens
  DISD22_0009826
  Located on chromosome 5
  Distance between a terminus base of telomere on chromosomal short arm and 5'-terminus of this base sequence : 156033276
  Distance between 3'-terminus of neighbour sequence of sequence listing upward to telomere on chrosomal short arm and 5'-terminus of this base sequence : 89748
ccaacaggaaagagaatagagtggagagacagacagacagacagagagaaacagagacagcagagaaacagaaagagagaaagagaaagagacagagaaacagagagaaacagagccagacagaaaagggcagacagacaaagagagacagagaaagagagactaagagagagagagagagagagagaaagacaaagatagagacagagacacagaaagatactcatg

SEQ ID NO: 9359 - DNA, 321 bp, Homo sapiens
  AC011372.4_156895
  Located on chromosome 5
  Distance between a terminus base of telomere on chromosomal short arm and 5'-terminus of this base sequence : 156251609
  Distance between 3'-terminus of neighbour sequence of sequence listing upward to telomere on chrosomal short arm and 5'-terminus of this base sequence : 218105
atatgcacatctacgtgaagactggggtcatgcacacaggatgatgtacgtgtgtgtgcacacgcatgtgtgtgcatgtgtgaggcctgggctcacagggttatgtgggagtatgggtgttataggcatgtgtgagctcatgctggtgtctgcatatgtgtgggaggtggccctgtgactgtatacaggaaggctgcttgcacacacacacacacacacacacacacacacacacacacagaggctatcctacaggcatgcaccacctcccttgagcacatatacccccatgtgtacgtgtgttcactcttatctgcagac

SEQ ID NO: 9360 - DNA, 352 bp, Homo sapiens
  AC011372.4_66613
  Located on chromosome 5
  Distance between a terminus base of telomere on chromosomal short arm and 5'-terminus of this base sequence : 156308314
  Distance between 3'-terminus of neighbour sequence of sequence listing upward to telomere on chrosomal short arm and 5'-terminus of this base sequence : 56384
atggtagttggtgcttcattaccatcactattattattattattattattattattattattattatttctgtgtccccttctgccttacagtgcggaaacaggaaattataaaagtgacagagcagctgattgaagccataagcaatggagattttgagtcctacacgtgagtcagctgggctcattctgcatgtcctgcctggattgttgttcagggggtaccaatggctaactttgggggtccttgtctccgatcctcatccactcactttgcatgtgctgtgaatcgggctgaactcatatttctattttgcatccggacttgatgcttctattgagctttctgttcg

SEQ ID NO: 9361 - DNA, 406 bp, Homo sapiens
  AC011372.4_26465
  Located on chromosome 5
  Distance between a terminus base of telomere on chromosomal short arm and 5'-terminus of this base sequence : 156314623
  Distance between 3'-terminus of neighbour sequence of sequence listing upward to telomere on chrosomal short arm and 5'-terminus of this base sequence : 5957
tctagattgttctaatgcagtctcacttggaaactgacttttttttttttaattttatctatccattgtctctctctctctctctcactttctctctctctctctctctctctctctctctccctacctaccaggttatgagactggctatttttttgtattttttgtagagactgggtttcacctttttgcccaggctggtctcaaactcctgggctcacgcagtccacctgcctcagtctcctaaactgttggaattacaggagtgagtcactgctcccggccaaaactgacttttagattccactgcgtttttttcaggaattagcccagcttgggacgagtcagattgcttctctggacctgagtttgcatatctgtggaatggatatgttggtcttgtatg

SEQ ID NO: 9362 - DNA, 450 bp, Homo sapiens
  chr5.fa.O7frz.169611869
  Located on chromosome 5
  Distance between a terminus base of telomere on chromosomal short arm and 5'-terminus of this base sequence : 156418018
  Distance between 3'-terminus of neighbour sequence of sequence listing upward to telomere on chrosomal short arm and 5'-terminus of this base sequence : 102989
cctgattctttagactatgtgaatttacaacttcaatacaaggtaaaactaaatttatagttttttttgttttggggtgtgtgtgtgtgtgtgtgtgtgtgtgtgtgtgtgtgacggagtctcactgtgtcaccaggctggagtgcagtggcgtgatctcagctccctgcaacctctgcctcctgagttcaagcgattctcttgcctcagcctcctgagtaggtgggattacaggtgcctaccaccatgcccggctaatttttgtattttcatagagacggggtttcacgatgttggtcaggctggtctccaactcctgacctcaaatgacctgcccacctcggcctctcaaagtgctgcgattataggcgtgagccaccgcgcccagcctaaatttaaaataaagggaataatgcatcacagtcactagattctaaaccaatggtgata

SEQ ID NO: 9363 - DNA, 279 bp, Homo sapiens
  chr5.fa.O7frz.169692085
  Located on chromosome 5
  Distance between a terminus base of telomere on chromosomal short arm and 5'-terminus of this base sequence : 156472892
  Distance between 3'-terminus of neighbour sequence of sequence listing upward to telomere on chrosomal short arm and 5'-terminus of this base sequence : 54424
atcagtcttcggtttctacattttatatccattgtatggctgaagcagggatagccttcccattttacagattttctctgctgtttgtttaacagatatcaaggtctgccaggaggaaaacagtcctagcacttgaaaagttcagtgtgtgtgtgtgtgtgtgtgtgtgtgtgtgtgtgtgtgtgtgttgggggagggagggcgcagtggggggcggagggaaagagagaggaaactgttacagcatgtggtcaatgctgtaattatggtgaccatgtt

SEQ ID NO: 9364 - DNA, 144 bp, Homo sapiens
  D5S636
  Located on chromosome 5
  Distance between a terminus base of telomere on chromosomal short arm and 5'-terminus of this base sequence : 156512554
  Distance between 3'-terminus of neighbour sequence of sequence listing upward to telomere on chrosomal short arm and 5'-terminus of this base sequence : 39383
ccacaccattatgacattttctagtgtgtgtgtgtgtgtgtgtgtgtgtgtgtgtgtgtgtgtgtatggctttattgtttagatttttagttttacattcacagcaaaattgaaaggaagatacagatatttcccatatgcctt

SEQ ID NO: 9365 - DNA, 345 bp, Homo sapiens
  AC011383.4_13198
  Located on chromosome 5
  Distance between a terminus base of telomere on chromosomal short arm and 5'-terminus of this base sequence : 156579805
  Distance between 3'-terminus of neighbour sequence of sequence listing upward to telomere on chrosomal short arm and 5'-terminus of this base sequence : 67107
gagctgtgactgctcagagaaggctggagtagaatggacttgggggtgacctctcaaggcttcctggaacctgagaatcccaactgcatggaactagcacctttcttgacatttgcatgcagatgctcatttaactttgcacataaagtcagctactaccagcagcattctctaccctacacacacacacacacacacacacacacacacacacacacacacacacacactctccctctctaactaaagactgcaccttcattgcctcacactgcagatcacattcggacacacaataataataatgtagtaataattttaataacacctattgagcgtttacta

SEQ ID NO: 9366 - DNA, 160 bp, Homo sapiens
  D5S2014
  Located on chromosome 5
  Distance between a terminus base of telomere on chromosomal short arm and 5'-terminus of this base sequence : 156579955
  Distance between 3'-terminus of neighbour sequence of sequence listing upward to telomere on chrosomal short arm and 5'-terminus of this base sequence : -195
agctactaccagcagcattctctaccctacacacacacacacacacacacacacacacacacacacacacacacacacactctccctctctaactaaagactgcaccttcattgcctcacactgcagatcacattcggacacacaataataataatgtag

SEQ ID NO: 9367 - DNA, 442 bp, Homo sapiens
  AC011383.4_37669
  Located on chromosome 5
  Distance between a terminus base of telomere on chromosomal short arm and 5'-terminus of this base sequence : 156598280
  Distance between 3'-terminus of neighbour sequence of sequence listing upward to telomere on chrosomal short arm and 5'-terminus of this base sequence : 18165
gcatgatcataactcttccagctgttttttcttttattttttgtagagacagggtctcactatgttgctcaggctggtctcaaacacctggccacaagcgatccttccctcatggcttcccagcgcgctgggattacagacatgagccaccacgtgtagccgctttcatcattttaaatgttcctaagagcgttggttttgactgtctagggcctgaaggtgtgatctgctatgtaggccatcttttggcccccacaaactagcaaccgccctgtaattctgtgattacagagtggaaagcccagttgccaccttagggtgtgtgtgtgtgtgtgtgtgtgtgtgtgtgtgtgtgtgtgtgtggtgtatgctgtgagtgctatgtgggaaggggcaggggatggaatgcgcagagctggggaaaagatcagccatcctgagt

SEQ ID NO: 9368 - DNA, 89 bp, Homo sapiens
  D5S640
  Located on chromosome 5
  Distance between a terminus base of telomere on chromosomal short arm and 5'-terminus of this base sequence : 156598579
  Distance between 3'-terminus of neighbour sequence of sequence listing upward to telomere on chrosomal short arm and 5'-terminus of this base sequence : -143
gcccagttgccaccttagggtgtgtgtgtgtgtgtgtgtgtgtgtgtgtgtgtgtgtgtgtgtggtgtatgctgtgagtgctatgtggg

SEQ ID NO: 9369 - DNA, 240 bp, Homo sapiens
  D5S470
  Located on chromosome 5
  Distance between a terminus base of telomere on chromosomal short arm and 5'-terminus of this base sequence : 156652945
  Distance between 3'-terminus of neighbour sequence of sequence listing upward to telomere on chrosomal short arm and 5'-terminus of this base sequence : 54277
gcaatccacaaacgtcaaaattccccttcccatcagtacacacaccgatgcacacacactctctctttctctctctctctctctctctcacacacacacacacacacacacacacacacacacactagttagtgccttggatgaggcggggcagtgtgtatatggacccctggacttgctaccttcagggttccatactcgtccctcccctcctggctctgctgtctggagtctggcaag

SEQ ID NO: 9370 - DNA, 187 bp, Homo sapiens
  DISO7_10002071
  Located on chromosome 5
  Distance between a terminus base of telomere on chromosomal short arm and 5'-terminus of this base sequence : 156807636
  Distance between 3'-terminus of neighbour sequence of sequence listing upward to telomere on chrosomal short arm and 5'-terminus of this base sequence : 154451
ggcagagtatggactgaggagaaaaataaatgatatccctaaatatgttttaatttcagggagttactttgtcttctcatattttactcagatcgctttgtgtgtgtgtgcgtgcgtgtgtgtgtgtgtgtgtgtgtgatgaaatacatattttaattaaatattttacctcagaaacagcctctca

SEQ ID NO: 9371 - DNA, 200 bp, Homo sapiens
  AC022106.3_74285
  Located on chromosome 5
  Distance between a terminus base of telomere on chromosomal short arm and 5'-terminus of this base sequence : 156975606
  Distance between 3'-terminus of neighbour sequence of sequence listing upward to telomere on chrosomal short arm and 5'-terminus of this base sequence : 167783
gagcagtagcattcacctttagttccagctacttggaagggtaaggtgggatgattgcttgagcccaggagtttgagtccagcctggacaacatagtaagacctcatctctactgattaataacaataataataataataatgcagctagtataaatgtattcagataattcaataaaatcacgattaaacaagtgaagg

SEQ ID NO: 9372 - DNA, 463 bp, Homo sapiens
  chr5.fa.O7frz.170676421
  Located on chromosome 5
  Distance between a terminus base of telomere on chromosomal short arm and 5'-terminus of this base sequence : 157144578
  Distance between 3'-terminus of neighbour sequence of sequence listing upward to telomere on chrosomal short arm and 5'-terminus of this base sequence : 168772
agactctaatttgaaacctcactccatcccctgccagcccacggccaaacccaccacacctgctgccctggagaccaaccctgctcccttcccatcccccataccgagtcccttcatggctttccgcagcgctttggcatctgcgtcagggttgaagtcattggctgggcgcacagttcccttcagctgtgagaagcagaaagagactcagcaggtgtctgaaggcccccctggggaccaggctgaaagacagcatgcgagggtgggaagctcaccccatgagcccaaaccaagcggcgtgggtggggaaagaggcagaggtgaagccacagcagacagaccctgcacgagagctgagagagagagagagagagagagagaaagagacagaaagatatagagagagggagagagggactcagggctgggagcagggcaagtcctgatcaagagaaattggcta

SEQ ID NO: 9373 - DNA, 469 bp, Homo sapiens
  AC008385.4_5820
  Located on chromosome 5
  Distance between a terminus base of telomere on chromosomal short arm and 5'-terminus of this base sequence : 157255709
  Distance between 3'-terminus of neighbour sequence of sequence listing upward to telomere on chrosomal short arm and 5'-terminus of this base sequence : 110668
ttggaaagctacgagtggtaggcagaggcacccaggaatgtagagtccagctcctcgaaagaaaggaagaccaggccgggcatggtggctcacacctgtaatcccagaactttgggaggctgaggcgggtggatcacaagatcaggagttcaagaccagcctggccaagatggcgaaaccccgtctccactaaaactacaaaaattagctgggtgcggtggcaggtgcctgtaatcctgactactcaggaggttgaggcaggagaattgcttgaacctgggtggcagaggttgcagtgagctgagatcacgccactgcacactagcctgggtgacagagcaagactctgaaaaaggaaggcaggcaggcaggcaggcaggcaggccttccaactggtcaaagattcaggggtctggcttgacagggagtgagtgccccattgcgggaggtgttcaagcagaagctaacg

SEQ ID NO: 9374 - DNA, 395 bp, Homo sapiens
  AC011337.3_40041
  Located on chromosome 5
  Distance between a terminus base of telomere on chromosomal short arm and 5'-terminus of this base sequence : 157553692
  Distance between 3'-terminus of neighbour sequence of sequence listing upward to telomere on chrosomal short arm and 5'-terminus of this base sequence : 297514
ccattagatggagacgtaaataagatggcttatgggtcactccagctctgatgtattccagatctctcctatcaaacccatttctgtatctcaagcaagtctattccacttgcacttgttatctccaacacacacacacacacacacacacacacacacacacacacacacgctttccaggtccagccaccctgcctttgtgttgactgtttgccctccctagaacccctacatccctcgaatatctcacctccttcaatgccaagctaaaactcactttctctaggaaatcttaattttaccctgctggtgtcaaacagagcagggtgttttgatcccacttttatcatcatcattttcctgtgttgacctggctattctgatgctgagagcat

SEQ ID NO: 9375 - DNA, 253 bp, Homo sapiens
  chr5.fa.O7frz.171144076
  Located on chromosome 5
  Distance between a terminus base of telomere on chromosomal short arm and 5'-terminus of this base sequence : 157555270
  Distance between 3'-terminus of neighbour sequence of sequence listing upward to telomere on chrosomal short arm and 5'-terminus of this base sequence : 1183
acattgccagtttaagatcatcatcaacaagctaaaaataggtatattcttaatggccaattaggcaatttctaacaatatataaaatgcatttatcctttggttcgtaattccacttctaggaaaatatatatatatatatatatatatatgtatacattttctatagaaaaatcaacccaaagataaaaatctatgtataaggatattctctgcagcactgtttataatagcaactattgaaatcatccta

SEQ ID NO: 9376 - DNA, 157 bp, Homo sapiens
  D5S403
  Located on chromosome 5
  Distance between a terminus base of telomere on chromosomal short arm and 5'-terminus of this base sequence : 157714011
  Distance between 3'-terminus of neighbour sequence of sequence listing upward to telomere on chrosomal short arm and 5'-terminus of this base sequence : 158488
cacttagagcacatttagggttgtttccaatgtgtgtgtgtgtgtgtgtgtgtgtgtgtgcaagtgcacattctttctgacggtgctgccatgaacatctttattcataatattaatagtaggtcttccctattgctctccaagactctgcctcagt

SEQ ID NO: 9377 - DNA, 385 bp, Homo sapiens
  chr5.fa.O7frz.180686619
  Located on chromosome 5
  Distance between a terminus base of telomere on chromosomal short arm and 5'-terminus of this base sequence : 157950615
  Distance between 3'-terminus of neighbour sequence of sequence listing upward to telomere on chrosomal short arm and 5'-terminus of this base sequence : 236447
ctctgaaggttgataacaatttagttttagtttagtgaaaatgactccactctaatttttagtctagtctgttggggcctagctttgtccaaaacaatggcctcctgtaatttttatttaataccacaaaagagagagggtgcagtgagcacattacagagggatgggaccttgtgtcccaagaggtggggcttgaactgagatcagggaatgagtgagaggtggctggatggagtactactgtgtgtatatatgcgtgagtgagtgtgtgtgtgtgtgtgtgtgtgtgtgtgtgtatgtgctgtgtttctgaaagtaagcatcctaggaagacaaagccatagttgcaagtcttctgtggctacagtaaacatgttgacttcaa

SEQ ID NO: 9378 - DNA, 290 bp, Homo sapiens
  chr5.fa.O7frz.171521151
  Located on chromosome 5
  Distance between a terminus base of telomere on chromosomal short arm and 5'-terminus of this base sequence : 158152610
  Distance between 3'-terminus of neighbour sequence of sequence listing upward to telomere on chrosomal short arm and 5'-terminus of this base sequence : 201610
aagtagaactgtatgcttcaacaggtaaggcttcccaagacatgttaatatgtgaacaaaacaaatagtaaattacatagaaaatatgattccatgaaatgattgtatatttcaatggttatatacatgtgtgtatgtaatgtatatgtaatacatatatatatatatatatatgaataaaaaattatcaaaaaggataacagttgaaagggacctagaggtcattatcaaaggggatctcaggctttggtgtagtattataattccttaaagaggtaatgtatgcagac

SEQ ID NO: 9379 - DNA, 95 bp, Homo sapiens
  D5S2077
  Located on chromosome 5
  Distance between a terminus base of telomere on chromosomal short arm and 5'-terminus of this base sequence : 158192734
  Distance between 3'-terminus of neighbour sequence of sequence listing upward to telomere on chrosomal short arm and 5'-terminus of this base sequence : 39834
tcacaggtaatctaacacagaggaggtgcacacacacacacacacacacacactcataacacacacatacacacttgtgtgtatccagaaagatg

SEQ ID NO: 9380 - DNA, 323 bp, Homo sapiens
  chr5.fa.O7frz.171687253
  Located on chromosome 5
  Distance between a terminus base of telomere on chromosomal short arm and 5'-terminus of this base sequence : 158279044
  Distance between 3'-terminus of neighbour sequence of sequence listing upward to telomere on chrosomal short arm and 5'-terminus of this base sequence : 86215
actgaggtaccattgtacaattaggccctgtgaattctatgtatttatctgtaatagataatacatttatttataagtgtactttctgagacatcaaattccagcatatctctaaaggtataattggagtttatcaattccttctctctctctctctacacacacacacacacacgcacacacacacacacagataaattacttatttgaaagtttcaatagcaacactatcaaatatgatagggcccatatttatgccccttcacccccgaccatattgtaaagctggtggtaaaatttaggagtacaaatgttccttagat

SEQ ID NO: 9381 - DNA, 465 bp, Homo sapiens
  AC010610.4_61726
  Located on chromosome 5
  Distance between a terminus base of telomere on chromosomal short arm and 5'-terminus of this base sequence : 158347338
  Distance between 3'-terminus of neighbour sequence of sequence listing upward to telomere on chrosomal short arm and 5'-terminus of this base sequence : 67971
tttccttgtaccatgaaatgttgtttgatagaatttttaccaacagtagaacttctttcaaaactggagtcaatcctcttgaacccagccacttacttgtcaactacatatgtatatatatatatatatatatatatatatatatatatatatatatatactcttctaaaccctttgttgtcatttcaacaatgttttacatcatcttcactaggattaggttccggctgaagaaaatattttctttgctcatccataaagagcagctctttatttgttcaagttttatcataaattgcagcaattcagccacattttcaggctccacttctaattcttgttcttttgctatttctaccacatccacagtcacttcctccactgaagtcttaaacccctcaaagtcatccataagggttggaatcagtttcttccaagctcttgttaatgttgctatttggacct

SEQ ID NO: 9382 - DNA, 330 bp, Homo sapiens
  chr5.fa.O7frz.172002946
  Located on chromosome 5
  Distance between a terminus base of telomere on chromosomal short arm and 5'-terminus of this base sequence : 158527030
  Distance between 3'-terminus of neighbour sequence of sequence listing upward to telomere on chrosomal short arm and 5'-terminus of this base sequence : 179227
tgctggattatttgacaactacttgcaacatgttggcatttagcaattagctggcagctaaaatggagtaaagtagaaatattttagctgatatctcaaaaatgtccactatctgttaaaacagagtgaaccatgctagacttttgtttagtggtgtgtgtgtgtgtgtgtgtgtgtgtgtgtataaaggtagacaccagtgaaaagttagggggtaattatgtaacaatttaggggcaggagtgacgaatagttggcataatgccattatcccagtgggcgtttctgatgcccaagggcagacattgctaatcgatcatgtcactcatt

SEQ ID NO: 9383 - DNA, 412 bp, Homo sapiens
  AC011374.4_173044
  Located on chromosome 5
  Distance between a terminus base of telomere on chromosomal short arm and 5'-terminus of this base sequence : 158597185
  Distance between 3'-terminus of neighbour sequence of sequence listing upward to telomere on chrosomal short arm and 5'-terminus of this base sequence : 69825
ctcttatctacttctaacctggaagccctcacttctcaagttgtcttgccttagcgaactcaaccaatgcacaatttagacatgttgattgaagtctcgtgtctccctaaaatgtatgaaagcaaactgtactcccgaccaccttggacacatgtctcagaacttcctgaggctgtgtcacaggcacattcttaaccttggcaaagtaaactttctaaattgactgagatctatgttcacaagagggtgtcaagcctccacccctgccagccacacccaagcatctcccctttcctctgtgtgtgtgtgtgtgtgtgtgtgtgtgtgtgtgtgtgtgtgcttgtttgtttgtttgtttttgagatggagtctcatgctgtcgcccagggtagagtacagtggcgagatcttg

SEQ ID NO: 9384 - DNA, 248 bp, Homo sapiens
  AC011374.4_135822
  Located on chromosome 5
  Distance between a terminus base of telomere on chromosomal short arm and 5'-terminus of this base sequence : 158609504
  Distance between 3'-terminus of neighbour sequence of sequence listing upward to telomere on chrosomal short arm and 5'-terminus of this base sequence : 11907
acatttgttaccagtcctcactccatccccacgtcatgccctctaatccatttgagaatatcttaaagctgaaagctgtgaccacccatattcatcctctctctctctctctctccctctctctctcacacacacacacacacacacacacacacacacacagtgcatacaatttttaggggcttagagatggcttgaggcccattcaaagaccactccatagaccctggttaagaaatcttcctttg

SEQ ID NO: 9385 - DNA, 336 bp, Homo sapiens
  chr5.fa.O7frz.171234119
  Located on chromosome 5
  Distance between a terminus base of telomere on chromosomal short arm and 5'-terminus of this base sequence : 158670598
  Distance between 3'-terminus of neighbour sequence of sequence listing upward to telomere on chrosomal short arm and 5'-terminus of this base sequence : 60846
gataaacctggaccaagattatctgtctctttgcttgcccatcaatttgttcatcatccatccatccatccatccatccatccatccatccatccatccatccgtccatccatccgtccatccatccttgtgcccacgaatccgcacatctgcttatatctgtcatctatttaatacattcatctatttctgtgtattcatttattatgacttggtctctataaaaatctgcctattcaatttggcaaacgtttacccagagcctgccatgtgccatgcactctctctacttgtacctcctggccccacgctccatctagctcatctttcctgact

SEQ ID NO: 9386 - DNA, 219 bp, Homo sapiens
  chr5.fa.O7frz.181434684
  Located on chromosome 5
  Distance between a terminus base of telomere on chromosomal short arm and 5'-terminus of this base sequence : 159051332
  Distance between 3'-terminus of neighbour sequence of sequence listing upward to telomere on chrosomal short arm and 5'-terminus of this base sequence : 380398
tccttggttaagtttattcctaactattttttaatatactactgtaattgcaatgtcttcttaatttccttttcatattttttgttagtatatagaaatgcaactgatttttatgtcgattttgcatcctgcaactttattgtattatttttagttctaacaggtgtgtgtgtgtgtgtgtgtgtgtgtgtgtgtgtacgcttagtctttaggattttc

SEQ ID NO: 9387 - DNA, 256 bp, Homo sapiens
  D5S2047
  Located on chromosome 5
  Distance between a terminus base of telomere on chromosomal short arm and 5'-terminus of this base sequence : 159167287
  Distance between 3'-terminus of neighbour sequence of sequence listing upward to telomere on chrosomal short arm and 5'-terminus of this base sequence : 115736
tatataggtagggccaggggtgtgtgtttgtgtgtgtgtgtgtgtgtgtgtgtgtattttgtgtgtatatgtttgttgaatgaataaatatatacatgaatgaataactaatgaatatgaacataaaattgaatcaactcatttttcttcagaaaagcagattactcttcaggatgctatttattaagtcgtttccttcctttagatatttggctggaaaaaaatctctaagatgcctttagttcaataattttcc

SEQ ID NO: 9388 - DNA, 358 bp, Homo sapiens
  HUMUT1377
  Located on chromosome 5
  Distance between a terminus base of telomere on chromosomal short arm and 5'-terminus of this base sequence : 159284335
  Distance between 3'-terminus of neighbour sequence of sequence listing upward to telomere on chrosomal short arm and 5'-terminus of this base sequence : 116792
cataagaatggtcaaagacgaaaaaaataaagagcagtgaaaaggtaaaaaatgtgggcaattataaataaacattgatagtgcaacataatgttaataatattttgttgagtttaaaatacatgtataattgaaatatgttaaaattatataaattaagaacaaggtacaccaaataaaaacattctgaggtctttaagacgataaatagttattaatgttagagtttaataagttaaaaatacatgcaaatctttagagacaatactatctatctatctatctatctatctatctatctatctatctacagtgaaagactacatatccttcaagataggagaggaagtaaaatccc

SEQ ID NO: 9389 - DNA, 261 bp, Homo sapiens
  D5S2118
  Located on chromosome 5
  Distance between a terminus base of telomere on chromosomal short arm and 5'-terminus of this base sequence : 159382231
  Distance between 3'-terminus of neighbour sequence of sequence listing upward to telomere on chrosomal short arm and 5'-terminus of this base sequence : 97538
caagaacagtgggtgaaatcaatcaaaagcaaattccattaggacacacacacacacacacacacacacacacacacacacacacaaactagaagaatgcaagggaaaataggaaagactctcctagcattagaataaagatcatgtttaaactactccaaaggacacttgggaaaaaatattcagtagacctcatgttggtttaaagtttatttttaaaatcttagtactttactacttaacttggcacatgaagacaac

SEQ ID NO: 9390 - DNA, 480 bp, Homo sapiens
  chr5.fa.O7frz.182108179
  Located on chromosome 5
  Distance between a terminus base of telomere on chromosomal short arm and 5'-terminus of this base sequence : 159701076
  Distance between 3'-terminus of neighbour sequence of sequence listing upward to telomere on chrosomal short arm and 5'-terminus of this base sequence : 318584
tgcctttatgttctcatagtttagctcctacttataagtgagaacatctgatgattggttttccattcctgagttatttcacttagaataacggtctccagccaggcgtggtggctcatgcctataatctcagcactttgggaggcctaggtgggcggaccacttgaggtccagagttccagaccagcctgaccaacatggagaaaccccatctctactaaaaatatgcaaatatatatatatatatagctgggcgtgatggtgcatgcctgtaattccagctacttgggaggctgaggcaggagaatcacttgaacctgggaggtgggagttgtggtgagccaagatcatgccattgcactccagcctgggcaacaagagtgaaattctgtctcaaaataataataataataataataataataataataataataataatactctctaactccatccaggttgtagcgaatgccatta

SEQ ID NO: 9391 - DNA, 101 bp, Homo sapiens
  DISD22_0009835
  Located on chromosome 5
  Distance between a terminus base of telomere on chromosomal short arm and 5'-terminus of this base sequence : 159816625
  Distance between 3'-terminus of neighbour sequence of sequence listing upward to telomere on chrosomal short arm and 5'-terminus of this base sequence : 115069
acactctcacactgttatgcatacattttacacatatctatctgtgtgtgtgtgtgtgtgtgtgtacggtttaaaaaaatttggtttaggatccatcctgg

SEQ ID NO: 9392 - DNA, 379 bp, Homo sapiens
  AC008464.5_36224
  Located on chromosome 5
  Distance between a terminus base of telomere on chromosomal short arm and 5'-terminus of this base sequence : 160017566
  Distance between 3'-terminus of neighbour sequence of sequence listing upward to telomere on chrosomal short arm and 5'-terminus of this base sequence : 200840
aaggaccaatttattgaacaagaaagcctctttggattctccttaagtggcaccttttggttcacataaataaacttgtcttcccctcttctacctcctctgaaagaaggttgtgtgaattgaaactgcagaatcatattccaaagatcgttgtgcgttatcctgaggacaggaagggcacagcatcagagaatcttccttttggattggaccacagaagtcatttcaattgattgattgattgattgattggaaatgggatctcattctgtcacacaggctggagtgtagtggtgtgatcaaggctcactgcagtctcaacctcctgggctcaagccatcctcccacctcagcttcccaagtggctacgagtatgcac

SEQ ID NO: 9393 - DNA, 216 bp, Homo sapiens
  G10138
  Located on chromosome 5
  Distance between a terminus base of telomere on chromosomal short arm and 5'-terminus of this base sequence : 160070129
  Distance between 3'-terminus of neighbour sequence of sequence listing upward to telomere on chrosomal short arm and 5'-terminus of this base sequence : 52184
tcttctactcaccctggaaagaaggaaggaaggaaggaaggaaggaaggaaggaaggaaggaaggaaggaaggaaggaaggaaggaaggagggaaggaaggaaggaagggagggagggagggagggaggcagggaggacggaaaacttagaaaagactgaattaaacaaagcttaagaaaaacagagtcgtaaaacttctcagggcctttaacatg

SEQ ID NO: 9394 - DNA, 184 bp, Homo sapiens
  D5S1458
  Located on chromosome 5
  Distance between a terminus base of telomere on chromosomal short arm and 5'-terminus of this base sequence : 160314173
  Distance between 3'-terminus of neighbour sequence of sequence listing upward to telomere on chrosomal short arm and 5'-terminus of this base sequence : 243828
actgttttgtgaccgcatcttcacaggatttagacagatttttggtaaggaatgtttgacagattaataaataaatataaatatatatgatagatagatagatagatagatagatagatagatagatagatagattgatagatagcacaagctttttaagcatgtctgagtgtcccattcgggt

SEQ ID NO: 9395 - DNA, 350 bp, Homo sapiens
  AC025764.3_50454
  Located on chromosome 5
  Distance between a terminus base of telomere on chromosomal short arm and 5'-terminus of this base sequence : 160360883
  Distance between 3'-terminus of neighbour sequence of sequence listing upward to telomere on chrosomal short arm and 5'-terminus of this base sequence : 46526
aaagccagcttacctagtacagctcacagccacctcgtttttttaatgtcaggtcaatgcacgtgtgtgtgtgtgtgtgtgtgtgtgtgtgtgtgtgtgtgtgtgtgtgtgtgtgtgtgtgttggggtgggggcaggttctagaaaaagaagggaaggtagctcttagaaacgaactcctgttttaaatcaaaggcagtgcagggtgacaggaatccacatgacatagtgtcctgtggtgatccccttctgctttcatctgtggctttaggagttgtgttgttttcgctactgtttggagggggtggcgtgtaatcagagaagtctaattaaatacatttagcagtcacc

SEQ ID NO: 9396 - DNA, 387 bp, Homo sapiens
  AC025764.3_16386
  Located on chromosome 5
  Distance between a terminus base of telomere on chromosomal short arm and 5'-terminus of this base sequence : 160417711
  Distance between 3'-terminus of neighbour sequence of sequence listing upward to telomere on chrosomal short arm and 5'-terminus of this base sequence : 56478
cgtaagtatcgagatgactgtaacccagttcctgacctccagaggctcatctggtgagagacatattcaaataaccaacgataatgcaaagtagaattaagtctttgctaccatataggtgtctgttcagttgtttatcaaaacgcatttataaagtggcactgtgctaagttctggggattcaatggtgaataagacaaataccgttctctcaaggtgtgtgtgtgtgtgtgtgtgtgtgtgtgcagattaattcagattttcaagattggcataatacagaagggctcatgtcaaaatgggcctgaagaattcatgggaccttggccggcagaagtgagctcaaggctgaaggaaggctatgaacaaatgtcataaggacatagg

SEQ ID NO: 9397 - DNA, 199 bp, Homo sapiens
  D5S671
  Located on chromosome 5
  Distance between a terminus base of telomere on chromosomal short arm and 5'-terminus of this base sequence : 160463857
  Distance between 3'-terminus of neighbour sequence of sequence listing upward to telomere on chrosomal short arm and 5'-terminus of this base sequence : 45759
aacttattccggggggtggtgggttggggagaaaaaattctgccaaggtagttatatccctgcaattaattaatgctgtgagacaaaaaattgcactaaaaatttctactccgtgtgtgtgtgtgtgtgtgtgtgtgtgtgtgtgtgtttatttgccttggatttttccttacctgaatcatggagatgcccacccatt

SEQ ID NO: 9398 - DNA, 189 bp, Homo sapiens
  D5S1974
  Located on chromosome 5
  Distance between a terminus base of telomere on chromosomal short arm and 5'-terminus of this base sequence : 160525906
  Distance between 3'-terminus of neighbour sequence of sequence listing upward to telomere on chrosomal short arm and 5'-terminus of this base sequence : 61850
accatctggagtggcaacctgccttctgtgtgtgtgtgtgtgtgtgtgtgtgtgtgtgtgtgtgtgtgtgtgcgcgcgcgcacgcatgcacgtgcgtgcatgccagggtattgtgttccctttctgtgcttgagaggctgaatgaacaagagaagagcaaaggcaaagaggacaatgcccagaagtcat

SEQ ID NO: 9399 - DNA, 282 bp, Homo sapiens
  chr5.fa.O7frz.189414803
  Located on chromosome 5
  Distance between a terminus base of telomere on chromosomal short arm and 5'-terminus of this base sequence : 160860832
  Distance between 3'-terminus of neighbour sequence of sequence listing upward to telomere on chrosomal short arm and 5'-terminus of this base sequence : 334737
gctgtacatttagtgctcaaaggggttaaatacttgggatgagttaaaaaaaaaaattcgtccacaaatcaaattgtctcagataataaattgtactgctggctttaaaataatagtctccattatcctgaaaaaacatcagtgcttctctgggctccttcttgttgccttgactttattcttctttgcaaggatatcatcatgccccttcattcattcattcattcagggtttcagctgttccctaaaaacgggagtctctttgttctgcaagtcacttat

SEQ ID NO: 9400 - DNA, 411 bp, Homo sapiens
  AC011365.3_93395
  Located on chromosome 5
  Distance between a terminus base of telomere on chromosomal short arm and 5'-terminus of this base sequence : 160952194
  Distance between 3'-terminus of neighbour sequence of sequence listing upward to telomere on chrosomal short arm and 5'-terminus of this base sequence : 91080
tgttccttgaggaaatgactagttctctctgagccttgtttttaccacttatgaaatggaaataatatgaactaccctatggggaattagttaatggttatatatgtaagacacctagcatgtaatggcagctccataaataatagcgatgatgatgatgatgatgatgatgatgatgatgatgatgcttggggtctgaggcagggctgaatgtgagtgactaaaatactttttcaggtctttggttggtgccaagtagttccagaggtgcatatatgagagtggtggtggccaacacatggaccgtgaagggcaggacaaagaaccttgagaaggtcaaggcaagacctctctagcccctgcctgggttagcccctggctctggggaactggtaagtaccagtgactcca

SEQ ID NO: 9401 - DNA, 412 bp, Homo sapiens
  AC011365.3_92831
  Located on chromosome 5
  Distance between a terminus base of telomere on chromosomal short arm and 5'-terminus of this base sequence : 160952787
  Distance between 3'-terminus of neighbour sequence of sequence listing upward to telomere on chrosomal short arm and 5'-terminus of this base sequence : 182
ggttaattagcctgattcaattctcttcagcctcattttgctcaaatctaccagatttgtggtgctccttggtcctccaccacactttctacccctcatcccactttgtgtgtgtgtgtgtgtgtgtgtgtgtgtgtgtgtgtgtgtgtgtgtgtgtgtaggacatggccaggaatcctgactggcttcctttaaaacaggtgtccccaacccctgggacatggactggtaccggtccccgttaggaaccaggctgcacagcaggaggtgagcagatggggcgggagcattaccacctgagctccgcctcctttcaggtcagccgtggcgttagattctcataggagcacacaccctactgtgaactgtgcatgcgagggatctaggttgcacgctccttatgagaatctaa

SEQ ID NO: 9402 - DNA, 368 bp, Homo sapiens
  AC011365.3_3933
  Located on chromosome 5
  Distance between a terminus base of telomere on chromosomal short arm and 5'-terminus of this base sequence : 160977704
  Distance between 3'-terminus of neighbour sequence of sequence listing upward to telomere on chrosomal short arm and 5'-terminus of this base sequence : 24505
gtcactgaggatgtgattatagagaccactgatcctatgccctgccgaggaattcatacaaagatcacactaccacaggcactcaaaatcaaacccaaagtatcttaatcaacaacatatatatatatatatatatatatcctcagagaaaattctcccctacaaaagcaatttcaaacaattagaacaagtgactgctacaccagatgttcagaaatccaagtaatgacacaggaaacatgaaacagcagggaaatatgatgctaccaaaggaccacaattgtccagcaacagatcccaatcaaaaagaattccttgaaatgccaggtaaagaattgaaaatgttattcttaaagaagctcaatgag

SEQ ID NO: 9403 - DNA, 399 bp, Homo sapiens
  chr5.fa.O7frz.174488547
  Located on chromosome 5
  Distance between a terminus base of telomere on chromosomal short arm and 5'-terminus of this base sequence : 161184532
  Distance between 3'-terminus of neighbour sequence of sequence listing upward to telomere on chrosomal short arm and 5'-terminus of this base sequence : 206460
ttacagtctagattcctcagtgacctctgagaaatttcttcatcttaacatgtgagatgaaatcatcttattttaattttagttctatgagtaaacaattcaaaaagtacagaagaagcagaaagttcctttaccctccaatctttccttcccccaacaaggagacaatcatttgtgttgagtataacctactagactattttttaatctctgtgtatgtgtacgtgtgtgtatgtgtgtgtgtgtgtgtgtatctctacagatagatagcctatctgacagatattattattttgctagttattttcaaacattaattacatctactgtaaatatttttctttttctacatagaaataagttttgaactcttaatatgtcactgcatacagatatttc

SEQ ID NO: 9404 - DNA, 467 bp, Homo sapiens
  chr5.fa.O7frz.174607731
  Located on chromosome 5
  Distance between a terminus base of telomere on chromosomal short arm and 5'-terminus of this base sequence : 161303633
  Distance between 3'-terminus of neighbour sequence of sequence listing upward to telomere on chrosomal short arm and 5'-terminus of this base sequence : 118702
taaaggtactgaggcatagtgtggctataatacttgcccaaatcccagtggctggttagtagcacagcagagatttaaatatgggttaatcttcaaagtcttacatcttagcctctctgtaataccacatgtcacaaagaaattatatttatgtattagtggaaagatggcactcttaacacacaggttgtaaagaacatacataattcattcatttaacagaaaagaaaaatatcactgggccagtttttaaatctgccactgctagccgtgtggcccttagcaattaacttctttgagttttctttctctctctctctctctctctctctctctctctctctctttagaggcagagtctcaccatgatgccaagactggacttagacttcaacacttgggctcaagttatccttcagtctcagcttcctaagtggctgagactaaagatacatagcactgagacc

SEQ ID NO: 9405 - DNA, 175 bp, Homo sapiens
  DISD22_0009846
  Located on chromosome 5
  Distance between a terminus base of telomere on chromosomal short arm and 5'-terminus of this base sequence : 161405242
  Distance between 3'-terminus of neighbour sequence of sequence listing upward to telomere on chrosomal short arm and 5'-terminus of this base sequence : 101142
ataacctagctatctttccatggttttccttctctttctatctcttcaccttacacacacacacacacacacacacacacacacacacacacacacacacatagtcttttaaggcaaaaccaacagaaatagggccctacagaaaatgaattcagaaccatgaccacataatcaa

SEQ ID NO: 9406 - DNA, 298 bp, Homo sapiens
  DISD22_0009851
  Located on chromosome 5
  Distance between a terminus base of telomere on chromosomal short arm and 5'-terminus of this base sequence : 161489058
  Distance between 3'-terminus of neighbour sequence of sequence listing upward to telomere on chrosomal short arm and 5'-terminus of this base sequence : 83641
gcaagattagttattggagccaaaagtagcatggaaaaacttaatatttattaggaaagttattgaataccttgtaatttatctttcaattgtatattttatgatcatcaaaaattatattttcaaagaattgcaatgacataaaaatgatcttgatataattgtatgtgaataatgacaaaagtattcaacttcattttcattatttgtaattaaacagtatatgtgtatgtgtgtgtgtgtgtgtgtgtgtgtgtttgaatgtctataagaaaatacaccacaaggttagcagtct

SEQ ID NO: 9407 - DNA, 253 bp, Homo sapiens
  DISD22_0009854
  Located on chromosome 5
  Distance between a terminus base of telomere on chromosomal short arm and 5'-terminus of this base sequence : 161583015
  Distance between 3'-terminus of neighbour sequence of sequence listing upward to telomere on chrosomal short arm and 5'-terminus of this base sequence : 93659
agggcataaggatggatggatcgatccccctccctctctctctctctctctctctctctctctctctctctccacccaccaccccccccacccccaccagtaaaatgggcataacaaagcctacctgccagcatgggtaaaaagattgagataatgtgtgaaaatattcttatcaagagtatctggcatttagcaagcactctataaatattaacaaataaagaggaaaataacagaattcaagctaacccaa

SEQ ID NO: 9408 - DNA, 383 bp, Homo sapiens
  AC010476.4_11220
  Located on chromosome 5
  Distance between a terminus base of telomere on chromosomal short arm and 5'-terminus of this base sequence : 161836876
  Distance between 3'-terminus of neighbour sequence of sequence listing upward to telomere on chrosomal short arm and 5'-terminus of this base sequence : 253608
aatttggcagtagctatcaaaattgtaaatgtatataacttaggagccagcagatgcaaaagtaaaacaaagcaaccttaaaaaaagtagatattaaaacaaagcataaagttatgggtaaaaaaaaattcattgcaacatcatttataatagcaacaagaaaaatagcaggaaggaagggaaggaaggaaggaaggaaggaaggaaggaaggaaggaaggaaggaaggaaggaaggggaaagaggtattaaaagacgcagtttatttgagcatttaaccattcataaactgggcagcaccagaccataagcagttcatgcctccaccaagggggtgggagagaaaatttttattaggtgtttgaggaaataagacaaagata

SEQ ID NO: 9409 - DNA, 382 bp, Homo sapiens
  chr5.fa.O7frz.194393197
  Located on chromosome 5
  Distance between a terminus base of telomere on chromosomal short arm and 5'-terminus of this base sequence : 162371170
  Distance between 3'-terminus of neighbour sequence of sequence listing upward to telomere on chrosomal short arm and 5'-terminus of this base sequence : 533911
ggtctaaagattgaaagcaaagagagagagagagagagagagagagagagagagaggctgggaatggagcaagtcccgaatggaccacagagggcaggggcaatgctgggaaggaggcatggccagtgcttgtcttgggttcggtggaagatctctctcaaatgacttcaagccttttctcatagtctatggagtactggcctcaaccaacacttattgggtggccactgtgtcccaggctcacaggtgcatagggtaagagcttaggaccctaaaaggaagaccctctggggatggtgagaaatccaggtggctgcgtgaataatggcaggagagctctgggtgcctttaggctacactaactaggtgagtttcagctaga

SEQ ID NO: 9410 - DNA, 145 bp, Homo sapiens
  DISO7_10002100
  Located on chromosome 5
  Distance between a terminus base of telomere on chromosomal short arm and 5'-terminus of this base sequence : 162391043
  Distance between 3'-terminus of neighbour sequence of sequence listing upward to telomere on chrosomal short arm and 5'-terminus of this base sequence : 19491
tgagcttagtttgcacgtgtatatatatatatatatatatatatatatatatatatatatatatatatatataggctaagccatatatatgtgcgtatgtatatattttctccctaagatcttaaaacctcgagaaaggcagaag

SEQ ID NO: 9411 - DNA, 108 bp, Homo sapiens
  DISO7_10002098
  Located on chromosome 5
  Distance between a terminus base of telomere on chromosomal short arm and 5'-terminus of this base sequence : 162467325
  Distance between 3'-terminus of neighbour sequence of sequence listing upward to telomere on chrosomal short arm and 5'-terminus of this base sequence : 76137
tggtcaccttatctgtgcactgtgtgtgtgtgtgtgtgtgtgtgtgcgcgtgtgtgtgtgtgcatgcgtgcatgtgtggcactttcccaaggaacatcagggctgtgt

SEQ ID NO: 9412 - DNA, 108 bp, Homo sapiens
  DISO7_10002097
  Located on chromosome 5
  Distance between a terminus base of telomere on chromosomal short arm and 5'-terminus of this base sequence : 162519836
  Distance between 3'-terminus of neighbour sequence of sequence listing upward to telomere on chrosomal short arm and 5'-terminus of this base sequence : 52403
gacacattcttcatctccctgggccttagtttcttgatgatgttgatgatgatgatgatgatgatgatcctaatgatgacagtgatgatgaagaatatctaccacagt

SEQ ID NO: 9413 - DNA, 132 bp, Homo sapiens
  DISO7_10002096
  Located on chromosome 5
  Distance between a terminus base of telomere on chromosomal short arm and 5'-terminus of this base sequence : 162522230
  Distance between 3'-terminus of neighbour sequence of sequence listing upward to telomere on chrosomal short arm and 5'-terminus of this base sequence : 2286
aacaggtcaatggactaaagggacacagacacatacacacacagacacacacagacacacacacacacacacacacacacacacacacacacacacacacacttgtctctcttaaccttgtaatccaaagaa

SEQ ID NO: 9414 - DNA, 349 bp, Homo sapiens
  chr5.fa.O7frz.194503622
  Located on chromosome 5
  Distance between a terminus base of telomere on chromosomal short arm and 5'-terminus of this base sequence : 162606175
  Distance between 3'-terminus of neighbour sequence of sequence listing upward to telomere on chrosomal short arm and 5'-terminus of this base sequence : 83813
tattactgatcagtccagaggtagggcttacttcaggtataggttgatctagcatccgaaaccaacaatctccttttctttctctctttctttctctctctctctctttctttctttctccctttctttctttctttccttctttctttttctttctttctttctctttctttctttcttctttcttctttctttctttcttttctttctttctttctttctttctttctttctttctttctttctttctttctttctttctttcttttcttttcttttctttctttctgtaactctcttcatccctcagtgtagtagtcagttttgtgttgctatcatgtaataccgg

SEQ ID NO: 9415 - DNA, 305 bp, Homo sapiens
  D5S2069
  Located on chromosome 5
  Distance between a terminus base of telomere on chromosomal short arm and 5'-terminus of this base sequence : 162763733
  Distance between 3'-terminus of neighbour sequence of sequence listing upward to telomere on chrosomal short arm and 5'-terminus of this base sequence : 157209
ggaagccatatgtttggaattgcttgtgtgtgtgtgtgtgtgtgtgtgtgtgcgcgtgtggtttttatttctattttttttttctttaaacactgtgtgggccaaacaaaccatgtctgtaggcctattgggaccagagaggatcttctaataacatataataagagtgacatagaaggcatcccaggggctaatggaagccctaagtggggcatttaacccagccaagggtggagttgggagtatcttcccagtgcaggtgaactgaatcttggataatgttagcctaaatcatggcctggtaa

SEQ ID NO: 9416 - DNA, 222 bp, Homo sapiens
  D5S677
  Located on chromosome 5
  Distance between a terminus base of telomere on chromosomal short arm and 5'-terminus of this base sequence : 162808775
  Distance between 3'-terminus of neighbour sequence of sequence listing upward to telomere on chrosomal short arm and 5'-terminus of this base sequence : 44737
ctgtgactgtgtaaactgtgtggctttgtgtacatgtatatagaggtggctgggtgcagtgattgctctgtgtgtgtgtgtgtgtgtgtgtgtgtgtgtgtgtgatagagagagagagagagagagagagagagacagagagagagactccaggctcttaccaacacagaagctggaaaaacactgctctccatgtgttctttcagcctccaagaatgtcag

SEQ ID NO: 9417 - DNA, 385 bp, Homo sapiens
  AC017043.3_72030
  Located on chromosome 5
  Distance between a terminus base of telomere on chromosomal short arm and 5'-terminus of this base sequence : 162904609
  Distance between 3'-terminus of neighbour sequence of sequence listing upward to telomere on chrosomal short arm and 5'-terminus of this base sequence : 95612
agagcctttacagaggtaattaagttaaaatgaggttgttagggtaggccctaatccactttgactggtgttcttataagaagaggaaatttagacacagagaagcaccaggaatgctcacacacagaggacaggccataagaggggacagcgagaaggtggccatctgcaaaccaaggagagaggcctcaaaacgaaccaaccctgactacatcttgatcttgggcctctggcttccagagctgcaagaaataaatgttatttaagcccactcctccaccacacacacacacacacacacacacacacacacacacacgcacacactaaaatttttttagtaaaagagtaattgacctgcctaatctcctattgtccttgtctt

SEQ ID NO: 9418 - DNA, 448 bp, Homo sapiens
  AC017043.3_143654
  Located on chromosome 5
  Distance between a terminus base of telomere on chromosomal short arm and 5'-terminus of this base sequence : 162947049
  Distance between 3'-terminus of neighbour sequence of sequence listing upward to telomere on chrosomal short arm and 5'-terminus of this base sequence : 42055
taaactgaaagttgtcgttacttccaaggtgaactagagcatctccctatgttgcccaggctcatctcgaactcctgggctcagtccatcctcccgcctctgcttcccaaagtgttgggattacaggcatgagccaccacgtccagcccgtatgatttctccaatcccttcatgtgagtcaaacctgtcggctgtttcaattctgtgagcctcaatttaccaatctgcagattgaggcactcagccattttcctcagagggtgtgtgtgtgtgtgtgtgtgtgtgtgtgtgtgtgtttcttagaagatcatgcaagggctgatataaaggccataaaaacactaaagcagcctttcctctaagtccaggttcaagggcccatctaagtccagcattttaaaatttgaccccttacaaacacacagcttcatccttaacaagatgctta

SEQ ID NO: 9419 - DNA, 253 bp, Homo sapiens
  AC017043.3_159096
  Located on chromosome 5
  Distance between a terminus base of telomere on chromosomal short arm and 5'-terminus of this base sequence : 162962623
  Distance between 3'-terminus of neighbour sequence of sequence listing upward to telomere on chrosomal short arm and 5'-terminus of this base sequence : 15126
tgctgatggaaccagttacacccgctttgttagtgggaagaaaaagcatgggggtaggggcggagagtggtggttggaaggggttatcacacacacacacacagacacacacacacacacacacacacacacacacgctcccagaggcccaactccattaataagagattccaccataatctagtgattcttgtatcttactctattgcgcccatcatccatgtgcagcttgtctaccatgcaaataagtcct

SEQ ID NO: 9420 - DNA, 253 bp, Homo sapiens; identical to SEQ ID NO: 9419
  AC027609.2_74909
  Located on chromosome 5
  Distance between a terminus base of telomere on chromosomal short arm and 5'-terminus of this base sequence : 162962623
  Distance between 3'-terminus of neighbour sequence of sequence listing upward to telomere on chrosomal short arm and 5'-terminus of this base sequence : -253

SEQ ID NO: 9421 - DNA, 409 bp, Homo sapiens
  AC027609.2_15253
  Located on chromosome 5
  Distance between a terminus base of telomere on chromosomal short arm and 5'-terminus of this base sequence : 163060940
  Distance between 3'-terminus of neighbour sequence of sequence listing upward to telomere on chrosomal short arm and 5'-terminus of this base sequence : 98064
atgaggctggaatctgttttctagaatttgccttagtcccagggaaaaaattccatccgggagtttgctcattcattcatctatttatttcttcaacaaatatttgttattcttaggccccgaggatgctgtggggacaagacaggtaaaggctctgtcctcttggcatttatgttctggagacaaaggcctgggtttgagccctgggatgtatgtgtgtgtgtgtgtgtgtgtgtgtgtgtgtgtgtgtgtgttgctgtgtcggattttggtgagtcacttcagcttcagcagtgcagccttagtgaaatgtgatgggcgtcattgggaagatctcgggaaagaatgccgtgaaaagataaggcactactgttatgcacagaaccactaatctgaatttgcgacttta

SEQ ID NO: 9422 - DNA, 479 bp, Homo sapiens
  AC011333.5_62189
  Located on chromosome 5
  Distance between a terminus base of telomere on chromosomal short arm and 5'-terminus of this base sequence : 163239395
  Distance between 3'-terminus of neighbour sequence of sequence listing upward to telomere on chrosomal short arm and 5'-terminus of this base sequence : 178046
ctgagtggctaaggttatcagctgtcctctgctcacctgttgtcagggaacactgaggaccaccatcactcagagtgtcaggagtgaagggtggggggtcccagtgtgtgtgtgtgtgtgtgtgtgtgtgtgtgtgtgtgtgtgttgtaggcagcaggcatagggactgtgcaggaccttgaaggctttggtaaggagtatgggtttcaaactgtgggcaggtggagccagcatagggattcaagcaaaggagtgacgaggtcagaggcaacctctagacagggctgcagggtggagagaggtgagcagctgaggctgggcaccaggtggtgggtccaggacaccatggccaggtctggtcctgagaatggagaggaggcctatggagaagactgttgctgggatttggggtcaaattggccttgaggtagacgaggaagagaagcatccagggtgacacctgcttcattaggtgcaag

SEQ ID NO: 9423 - DNA, 178 bp, Homo sapiens
  D5S2108
  Located on chromosome 5
  Distance between a terminus base of telomere on chromosomal short arm and 5'-terminus of this base sequence : 163239463
  Distance between 3'-terminus of neighbour sequence of sequence listing upward to telomere on chrosomal short arm and 5'-terminus of this base sequence : -411
ctcagagtgtcaggagtgaagggtggggggtcccagtgtgtgtgtgtgtgtgtgtgtgtgtgtgtgtgtgtgtgtgttgtaggcagcaggcatagggactgtgcaggaccttgaaggctttggtaaggagtatgggtttcaaactgtgggcaggtggagccagcatagggattcaagc

SEQ ID NO: 9424 - DNA, 453 bp, Homo sapiens
  chr5.fa.O7frz.195136582
  Located on chromosome 5
  Distance between a terminus base of telomere on chromosomal short arm and 5'-terminus of this base sequence : 163260820
  Distance between 3'-terminus of neighbour sequence of sequence listing upward to telomere on chrosomal short arm and 5'-terminus of this base sequence : 21179
tcaaacgcaatgttagtgactcagaaaatgtctctaacaatgtcagttctaaatgccaaaaaacatgtgtctgaagtgacttcacatgtacactagagatgaatgaataagtaaatatattgtaaataatagagacatatttcccactgtcagagaaagaaattacaagcaagtgaagagggaatcctagaaaaaaccttatggttttgcattagagtaagagggattaaaatactcatgtttgtgagacatagatagatagatagatagatagatagatagattgatagatagatagctagatagatagatagatagatagattgattgatagatagattgatagatagatagatagatagatagattgatagattgatagatagatagcagacagacaaatagacagatgtatacacaggctagtatacatccataacttcctagctctgt

SEQ ID NO: 9425 - DNA, 250 bp, Homo sapiens
  D5S2058
  Located on chromosome 5
  Distance between a terminus base of telomere on chromosomal short arm and 5'-terminus of this base sequence : 163309427
  Distance between 3'-terminus of neighbour sequence of sequence listing upward to telomere on chrosomal short arm and 5'-terminus of this base sequence : 48154
ccttctaagttgaggtgaaatcatttacagaatgggcatgacaataacatattttttataaagcaaaatatcagaagctatccaaatttgatttaagaatttcatactccaaaaccacatatacacgtgcacacacacacacacacacacacacacacaaacacacacacacacgcacacacacaaacacacacacgcacacacacacacacacaggaccatgcaaagatattcaccgaatctttgtctt

SEQ ID NO: 9426 - DNA, 292 bp, Homo sapiens
  AC011333.5_111313
  Located on chromosome 5
  Distance between a terminus base of telomere on chromosomal short arm and 5'-terminus of this base sequence : 163309431
  Distance between 3'-terminus of neighbour sequence of sequence listing upward to telomere on chrosomal short arm and 5'-terminus of this base sequence : -246
ctaagttgaggtgaaatcatttacagaatgggcatgacaataacatattttttataaagcaaaatatcagaagctatccaaatttgatttaagaatttcatactccaaaaccacatatacacgtgcacacacacacacacacacacacacacacaaacacacacacacacgcacacacacaaacacacacacgcacacacacacacacacaggaccatgcaaagatattcaccgaatctttgtcttataatggcaaggaatggaaaaaaatgtaatgttcaccaatagacgg

SEQ ID NO: 9427 - DNA, 425 bp, Homo sapiens
  AC026408.2_76101
  Located on chromosome 5
  Distance between a terminus base of telomere on chromosomal short arm and 5'-terminus of this base sequence : 163346175
  Distance between 3'-terminus of neighbour sequence of sequence listing upward to telomere on chrosomal short arm and 5'-terminus of this base sequence : 36452
caggttagtcatttatgaccatgatgggaaagtctgcagagaaggaagccacagtgaagagaacaaggcaaataaatggagagaaaaagtcatcctggtcatgtgattttagccctggctcaaaccttgcctgaagccagtggtctattcagttttgtgagctgataaattatcattatttcagtgtgcacaggaagggtttttctgtcatttgcatccaaaagagctctcgctgagtacacattagtccaaaacaaagtagtgttatagtaggctttcaacagaaacacacacacacacacacactgtggttcaactgaaaaaccactggggaaaaatagagtagtttggcttccttcagggaagcaatgcacctcccctgatgggttggacaagggttgtgtctcctaccgtttcagtgtaag

SEQ ID NO: 9428 - DNA, 467 bp, Homo sapiens
  AC026408.2_14599
  Located on chromosome 5
  Distance between a terminus base of telomere on chromosomal short arm and 5'-terminus of this base sequence : 163393579
  Distance between 3'-terminus of neighbour sequence of sequence listing upward to telomere on chrosomal short arm and 5'-terminus of this base sequence : 46979
cgactgtcacttaactgtcatctaaaacttgtattcccaaggccaccttcactgtctatttttaacgtgtggccattatctatatagaagaagcagatgatggttcagatggatcagctacagcctgttcatccatccatccatccatccatccatccatccatccatccatccatccatccatctgtccatccatccaccaatcctctgtaaccactcctcattcaaaaagtttatccatctatttgtccattcatccacctattcatctataaatcaactcataaacttattaatgcataatacactcattgacagaaaaagccattcatcatctatcaatttgcctactcatctatcaactcattcacttataaatgcatacatacactcgctgattgaaaaattcatccatccatccatccatccatccttgcactcatctatgaatcaacttgtttacttcc

SEQ ID NO: 9429 - DNA, 297 bp, Homo sapiens
  AC010257.4_193049
  Located on chromosome 5
  Distance between a terminus base of telomere on chromosomal short arm and 5'-terminus of this base sequence : 163452121
  Distance between 3'-terminus of neighbour sequence of sequence listing upward to telomere on chrosomal short arm and 5'-terminus of this base sequence : 58075
catgagcttactgattcagtctttcatttgctagctatttagggagcaccgccaagtattctaagccctagatgagacacaaagggattgtattagtcaggtttcttcagaaaaacagaaccaataggagaaatgtatagatagatagatagatagatagatagatagatagatagatagatgagggttttttttaaaataggaattactcacgaggctatggaggtcaagaaatcccactaatccgcaagtggagaatcaagaaagcttgtggggtcattcagactgagtctgaaa

SEQ ID NO: 9430 - DNA, 134 bp, Homo sapiens
  Z66689
  Located on chromosome 5
  Distance between a terminus base of telomere on chromosomal short arm and 5'-terminus of this base sequence : 163490847
  Distance between 3'-terminus of neighbour sequence of sequence listing upward to telomere on chrosomal short arm and 5'-terminus of this base sequence : 38429
ttcctggggaaacacactaatgaaataatctctctctctctctctgtacacacacacacacacacacacacacattcactcactgcaaagatgatggtaagaacttataagtgaactgtcgatctagttggcaa

SEQ ID NO: 9431 - DNA, 428 bp, Homo sapiens
  AC010257.4_345828
  Located on chromosome 5
  Distance between a terminus base of telomere on chromosomal short arm and 5'-terminus of this base sequence : 163557294
  Distance between 3'-terminus of neighbour sequence of sequence listing upward to telomere on chrosomal short arm and 5'-terminus of this base sequence : 66313
gacggttctaatctttgctaagagcccttgacagatagtgtcaggaggcagtaaagcatccatctgagctgccgaggtagacacatcctatccattttaaagacgaatacatggaggtccaaggagactaagtcattggcacaaacacaacaacggatgccagaaagagaaggatgccagaaagagaagatggaacattaattcactcactcgctcactcgctcgctcactcactcactcactcactcactcactcactcacatatttagtggctatgtcgttatctatagagcagcttttgtgtcacaaactgcatattcaacaaaaagcctggggcaatgattattcttttatcctcccatgatgcttcacccaggggttcaattataaatagctataatcactgacatttattcagctcactatt

SEQ ID NO: 9432 - DNA, 289 bp, Homo sapiens
  AC026552.3_69647
  Located on chromosome 5
  Distance between a terminus base of telomere on chromosomal short arm and 5'-terminus of this base sequence : 163681176
  Distance between 3'-terminus of neighbour sequence of sequence listing upward to telomere on chrosomal short arm and 5'-terminus of this base sequence : 123454
aatgatctggtcgatagattgatttccgaattcgctttttaagactctagctttctttatttgttttctcattggaaccaagatgtttttctaaaggacaacaattctggagatgtgcctggtacaaacctagaataaaggcagagaaagagccaatggcaagaagattcattacacagcaacagaacaagcaaacaaagcagcagcagcaacaacaacaacaaaaccatggagtttgttggcaaaagctgatgtggctcaggttctgaggttctcaggttctgaaatc

SEQ ID NO: 9433 - DNA, 466 bp, Homo sapiens
  AC026552.3_167592
  Located on chromosome 5
  Distance between a terminus base of telomere on chromosomal short arm and 5'-terminus of this base sequence : 163732021
  Distance between 3'-terminus of neighbour sequence of sequence listing upward to telomere on chrosomal short arm and 5'-terminus of this base sequence : 50556
atcttacgtatcctcaccttaaagcagggaaagaaggaagaaaggaaggaaggagggaaagaaagaaggaaggaaagaaggaagggaaggaagggaagagagggaagggaggaagggaggaagaaaggaaaaaagaaaaagggaattagtgaggtgatgggtgtgttaattgtggtgattgtggtgattatttccctgtgtgtgtgtgtgtgtgtgtgtgtgtgtatataaaaacatcagtttgtacacattaaacatatataacttttttaattaaaccttaaaaactgttaaatataaaataaatcaaaatattaaaataaaatattaaaataaacactgccctctttctttcgctgatgaggaacttggcttttgatgggagcaaaaattcagagaagaaagccaaatgccactaaggaaaaagttgttgagaaattattcattaagatttgctatatttgct

SEQ ID NO: 9434 - DNA, 135 bp, Homo sapiens
  Z67400
  Located on chromosome 5
  Distance between a terminus base of telomere on chromosomal short arm and 5'-terminus of this base sequence : 163931911
  Distance between 3'-terminus of neighbour sequence of sequence listing upward to telomere on chrosomal short arm and 5'-terminus of this base sequence : 199424
ccagtgcaactaaggaatagtctcagatgatttctgcaccacactgctgtgtgtgtgtgtgtgtgtgtgtgtgtgtgtgtgtttaggccagtttgacatagcatcacaatagggaagacactgatgtgcctttgc

SEQ ID NO: 9435 - DNA, 395 bp, Homo sapiens
  chr5.fa.O7frz.178188527
  Located on chromosome 5
  Distance between a terminus base of telomere on chromosomal short arm and 5'-terminus of this base sequence : 163990608
  Distance between 3'-terminus of neighbour sequence of sequence listing upward to telomere on chrosomal short arm and 5'-terminus of this base sequence : 58562
aattaaactcatctgtaaatgcatgaaaatataagggaatgcactttacaactgtgctattttactatagtatcaggagatcaaacttttatataactatagaaaatgctttctagaaaacaactgtatttaaaatattttaaagataattctccttcagccacattcaacaattttttctttcctttttctttaatagtgaaaaagattttaaaaactaaacagtaaaagcctgggtttttcatatgctaggaatgaaaatatcagccctagtctgttctctagtaacaagtcattgggtttttttctgatgtaagtaggagagagagagagagagagagagagagcgaaagagagagaaagagagaaatgttacttgaaacatgttccattac

SEQ ID NO: 9436 - DNA, 269 bp, Homo sapiens
  D5S1507
  Located on chromosome 5
  Distance between a terminus base of telomere on chromosomal short arm and 5'-terminus of this base sequence : 164188283
  Distance between 3'-terminus of neighbour sequence of sequence listing upward to telomere on chrosomal short arm and 5'-terminus of this base sequence : 197280
agagttcttcagagacaaagaaccaatacaggatatttacatatccttgtctctgtctgtatctctctctctctccatatatacacatctctatttctatatctctatatctctatatctatctatctatctatctatctatctatctatctatctatctatctatctatctatctggctagctatctagctacctagctagctatctaaaaggagatttattatgaggaatatgttcttgtgatgacagaagctgagatattccacat

SEQ ID NO: 9437 - DNA, 93 bp, Homo sapiens
  D5S662
  Located on chromosome 5
  Distance between a terminus base of telomere on chromosomal short arm and 5'-terminus of this base sequence : 164209767
  Distance between 3'-terminus of neighbour sequence of sequence listing upward to telomere on chrosomal short arm and 5'-terminus of this base sequence : 21215
attgccgccagagggtgttgctaaggctttgtgtgtgtgtgtgtgtgtgtgtgtgtgtgtgtgttataaacaaggcagtttatcacgttacaa

SEQ ID NO: 9438 - DNA, 145 bp, Homo sapiens
  HUMUT2159
  Located on chromosome 5
  Distance between a terminus base of telomere on chromosomal short arm and 5'-terminus of this base sequence : 164256282
  Distance between 3'-terminus of neighbour sequence of sequence listing upward to telomere on chrosomal short arm and 5'-terminus of this base sequence : 46422
cagcctgggtgacagtgataccctgtttctaaatagataggtaggtaagtagatagacagatgatagatagatagatagatagatagatagatagatagatagacagatagataggagaaccaggctcagaaaaggaaaggacac

SEQ ID NO: 9439 - DNA, 334 bp, Homo sapiens
  chr5.fa.O7frz.176043693
  Located on chromosome 5
  Distance between a terminus base of telomere on chromosomal short arm and 5'-terminus of this base sequence : 164464103
  Distance between 3'-terminus of neighbour sequence of sequence listing upward to telomere on chrosomal short arm and 5'-terminus of this base sequence : 207676
agttgatgcctatttgcttagaagcacatacaattctgtggattctctgcaatgctggtgctttgtctagaaaaatagattatttgttctatctctctttcataatacaattatagtttatatagagtattacacatgcttttaaatagcattttattttggaattaaatgagagcctatggttgtgtgtatgtgtatatatatatatatatatttatttatgttgcatgtgtatacacacacacacacacacacacacattctctttcacaatctcctcttataaagtttgtacttcaaaagaggcaaaaccatgttggattacatagtattt

SEQ ID NO: 9440 - DNA, 255 bp, Homo sapiens
  D5S487
  Located on chromosome 5
  Distance between a terminus base of telomere on chromosomal short arm and 5'-terminus of this base sequence : 164606925
  Distance between 3'-terminus of neighbour sequence of sequence listing upward to telomere on chrosomal short arm and 5'-terminus of this base sequence : 142488
ctggccttggaaattagaccaaaacgtgtgtgtgtgtgtgtgtgtgtgtgtgtgtgtgtgtgcatgtatgtgcataatctttagttagaaccagttgaaagtttggaaaatagtcattcagaaaattgatttctagtgaataaatttaattccagtattagagaatgctttgtggacaagttaagttagatcacaaatttctctcctgatgactttggcatggcaagtgaatgactcattgtgggcttaccaaga

SEQ ID NO: 9441 - DNA, 254 bp, Homo sapiens
  D5S1439
  Located on chromosome 5
  Distance between a terminus base of telomere on chromosomal short arm and 5'-terminus of this base sequence : 164685746
  Distance between 3'-terminus of neighbour sequence of sequence listing upward to telomere on chrosomal short arm and 5'-terminus of this base sequence : 78566
agcaactactatgtgccagccactgtgctagttgtggatttgctcaattatgtctctttcacatatctaataaaccccttataaagataaatcatttgaaatgtataatgatgaattatttgtctttgacagcctttgatatgtgtgtgtgtgtgtgtgtgtgtgtgtgtgtgtgtgtacaattgttgggttttagggttggattttgaggcttggtctttagtattaaccagcactcctcattcaagaagttt

SEQ ID NO: 9442 - DNA, 437 bp, Homo sapiens
  chr5.fa.O7frz.176351105
  Located on chromosome 5
  Distance between a terminus base of telomere on chromosomal short arm and 5'-terminus of this base sequence : 164771534
  Distance between 3'-terminus of neighbour sequence of sequence listing upward to telomere on chrosomal short arm and 5'-terminus of this base sequence : 85534
aagctaaggtttaaggaagttaagttacctgctgtattagggttttctagagggacagaactaataggagattttatatatatatatatatatatatatatatacacacacacacacacacacacatatatatgtgtatatatattagtttattaagtattaacttacataatcacaaggtcccacaataggctgtctgcaagcttgaggagtgaggagagccagtcctagtctcaaaactgaagaacttagagtccgatgttcaaaggcaggaagcatccagcacgagagaaagatgtaggctgggaggctaggccagtcttgctttttcacgtttttctgcctgctttatattcactggaagcttattagatggtgcccaccagattaagggtgggtctgccttccccagcccactgactcaaatgttaatctcg

SEQ ID NO: 9443 - DNA, 334 bp, Homo sapiens
  chr5.fa.O7frz.176479788
  Located on chromosome 5
  Distance between a terminus base of telomere on chromosomal short arm and 5'-terminus of this base sequence : 164900957
  Distance between 3'-terminus of neighbour sequence of sequence listing upward to telomere on chrosomal short arm and 5'-terminus of this base sequence : 128986
tatcagattggattcactgaagcctgttctcactgggcttgaggttagaaggtagcagccacacacacacacacacacacacacacacacacacacacacacacacaggtatatatatattttcacaggtcccctttcctccattcccttgacccttatatcttgaaactagcgagggtgttctttgatacttcctctatcaaatcttcatattttatctggtgccttacgttggagttctatatcaattttatcttcatgcccagttgaaaccacatttttaacatcctcctaaatgtgccctgtgattctctgactttcatagtaaagctgt

SEQ ID NO: 9444 - DNA, 199 bp, Homo sapiens
  G08470
  Located on chromosome 5
  Distance between a terminus base of telomere on chromosomal short arm and 5'-terminus of this base sequence : 165108335
  Distance between 3'-terminus of neighbour sequence of sequence listing upward to telomere on chrosomal short arm and 5'-terminus of this base sequence : 207044
attgcatggcaactcttctccagtcctgctgagtttggacttgccagcctccataattgcataagccaactccttaaaataaatcaacctctctcgatagatagatagatagatagatagatagatggatagatagatagatagatagatagatagatagatagatagatatcctactggttctgtttccctgaagaac

SEQ ID NO: 9445 - DNA, 444 bp, Homo sapiens
  AC026734.3_68909
  Located on chromosome 5
  Distance between a terminus base of telomere on chromosomal short arm and 5'-terminus of this base sequence : 165111506
  Distance between 3'-terminus of neighbour sequence of sequence listing upward to telomere on chrosomal short arm and 5'-terminus of this base sequence : 2972
tctagcaatgattatgccttactgcaggagacaactgatttccctgttggaggatgacttggaaagtttgcttcagagaagcagagtcttaaagtgcacagctctggagacataccagccctggagtcctggttctgctcctaacccattgtgtgtccttgggcaaggtacttagcctaggtaagcctcatttctctgtctgtacaagagaagtcagtaatatccggcttattatattttgaaaactaaattaaaatacacacacacacacacacacacacacacacacacacacacacagcatttagtatgttgcctggaacataggaaatatccaaaaagtagtagcttaaaaattaaacaaaccaaagagttctaaaaacattgctaagattgacatgacatttgcagacagaggttaagaacagaataagctccagctac

SEQ ID NO: 9446 - DNA, 138 bp, Homo sapiens
  chr5.fa.O7frz.176758842
  Located on chromosome 5
  Distance between a terminus base of telomere on chromosomal short arm and 5'-terminus of this base sequence : 165209120
  Distance between 3'-terminus of neighbour sequence of sequence listing upward to telomere on chrosomal short arm and 5'-terminus of this base sequence : 97170
cctcagctatcctcttaggaggaaagaggaagaaagaaaagaaaaatagaggaagagacaaggagaatgagagagagagagagagagagagagagagagagaaaatggaaagagcagaccagatcagctaccataatt

SEQ ID NO: 9447 - DNA, 399 bp, Homo sapiens
  chr5.fa.O7frz.176888091
  Located on chromosome 5
  Distance between a terminus base of telomere on chromosomal short arm and 5'-terminus of this base sequence : 165209120
  Distance between 3'-terminus of neighbour sequence of sequence listing upward to telomere on chrosomal short arm and 5'-terminus of this base sequence : -138
cctcagctatcctcttaggaggaaagaggaagaaagaaaagaaaaatagaggaagagacaaggagaatgagagagagagagagagagagagagagagagagaaaatggaaagagcagaccagatcagctaccataattcaaatgctcccccaaaatcatttgctacatttgtaatacagaagcagcagcacacttcagtgcaaagacacttcatttaaaattaataagagaatgaagacatcatatggaagttaagaaatgaattttaagtcagtttcaatcagggtgtttgtgatagggagggtcaatatcttgagtctgtttcctcatgtgcaaaatgaaactataataatcacaaagtgaacatcaactgttcctggtctatccagcattactgac

SEQ ID NO: 9448 - DNA, 387 bp, Homo sapiens
  AC011414.2_23872
  Located on chromosome 5
  Distance between a terminus base of telomere on chromosomal short arm and 5'-terminus of this base sequence : 165261107
  Distance between 3'-terminus of neighbour sequence of sequence listing upward to telomere on chrosomal short arm and 5'-terminus of this base sequence : 51588
ctgagctgaacaatttattagaagttctcaacagcagaaaggatcaagcagagcaaagaatcggtgagctcaaggacaggttatttgaaaatacagagttagggccaggcacagtggctcatgcccgtaatccctgcactttgggaggctgaagctggtggatcacttgagtccaggagcttgagaccaacctgggcaacatggcaaaactctatctttacaaacacacacatacacacacacacacacacacacacacacacacacacacacacacacacacacattatacatgtgtggctggtgcctgtagtcccagccactcaggaggctgagctgggaggatcacttgagcctgggaggaagaggtagcaataagtccagatc

SEQ ID NO: 9449 - DNA, 459 bp, Homo sapiens
  AC011414.2_12410
  Located on chromosome 5
  Distance between a terminus base of telomere on chromosomal short arm and 5'-terminus of this base sequence : 165273118
  Distance between 3'-terminus of neighbour sequence of sequence listing upward to telomere on chrosomal short arm and 5'-terminus of this base sequence : 11624
gttcctaaaataagccttagatcttgggtatcccagcactgggtcctagaaatagaaatgaaggggtctgaaattgcttaggatcacaggtggtagatttggaagccaatgcatgaatgtgaaagtgtgtgtttgtgtgtgtgtgtgtgtgtgtgaaagagagagagacagagagagagagagagagagtgtgtgtgtgtgtgtgtgtgtgtctgtgttgggaaaggtgacttcatggttaagtctgaaaaaaaacaaaccagaaaaatgaaatagaggtaaaatgaatcatagagaaagggataggcatggaagagaagcaaagactcaataaacctataatgagagtccctgaagagaaaaaacaattatcacttttaaatatggaatagaattcaaagctgtaagtctcctcccccacaaaattttccagatattagaccagacttgaatctacaa

SEQ ID NO: 9450 - DNA, 281 bp, Homo sapiens
  AC011377.4_90108
  Located on chromosome 5
  Distance between a terminus base of telomere on chromosomal short arm and 5'-terminus of this base sequence : 165419518
  Distance between 3'-terminus of neighbour sequence of sequence listing upward to telomere on chrosomal short arm and 5'-terminus of this base sequence : 145941
ataattataggccaggctcacacctataatcccagcactttgggaagctgagatgggaggatcacttgagaccaggagttagggaccagcctaataatattgagaccccatttatacaaaacacacacacacacacacacacacacacacacacacatataattataagcatttttaaaacaatgaatttaaggaagttaaatcttccatttattcaatatacatttacaaattgattcaatacacattactcctgcaataacaggagtcctatatgcaag

SEQ ID NO: 9451 - DNA, 401 bp, Homo sapiens
  AC009185.4_71677
  Located on chromosome 5
  Distance between a terminus base of telomere on chromosomal short arm and 5'-terminus of this base sequence : 165578390
  Distance between 3'-terminus of neighbour sequence of sequence listing upward to telomere on chrosomal short arm and 5'-terminus of this base sequence : 158591
aagatctgcaggtaatcgtatacacattaaagtttaagaagcactgtcgcgaggatatactgtctaagccagttttgaagataaatttatgagttataaggtaagtaagtgggcagaagtaagagacatactttccaggtagagagagaacaggaagtattgggaagctattgtcagttcactattgctggagcatgcgcgcatgcgcgtgcgcgctgtgtgtgtgtgtgtgtgtgtgtgtgtgtgtgtgtgtgtgtgtgtgtgtctattttctcagcaagggtaaggatgatagaagaggtgggtaaattgaaactgaatctataaatctatgaaagaactatactttaaaagaccaagaagttggaatttcaccctataggtagaaaagatgtcattgc

SEQ ID NO: 9452 - DNA, 306 bp, Homo sapiens
  D5S2112
  Located on chromosome 5
  Distance between a terminus base of telomere on chromosomal short arm and 5'-terminus of this base sequence : 165578555
  Distance between 3'-terminus of neighbour sequence of sequence listing upward to telomere on chrosomal short arm and 5'-terminus of this base sequence : -236
agctattgtcagttcactattgctggagcatgcgcgcatgcgcgtgcgcgctgtgtgtgtgtgtgtgtgtgtgtgtgtgtgtgtgtgtgtgtgtgtgtgtctattttctcagcaagggtaaggatgatagaagaggtgggtaaattgaaactgaatctataaatctatgaaagaactatactttaaaagaccaagaagttggaatttcaccctataggtagaaaagatgtcattgcacaggaagagaaggtcaaatttgcgatgtgtttaagaatatattctggcagcagcatagtgaatggattt

SEQ ID NO: 9453 - DNA, 333 bp, Homo sapiens
  AC009185.4_32138
  Located on chromosome 5
  Distance between a terminus base of telomere on chromosomal short arm and 5'-terminus of this base sequence : 165609181
  Distance between 3'-terminus of neighbour sequence of sequence listing upward to telomere on chrosomal short arm and 5'-terminus of this base sequence : 30320
ttccatgacaataccacaatactaccacattaggcttagccacctcatggtacttaaaagtccatttatggatatgctattttatgtatatatatatatatatatatatatatttagcctttcactgttgatggatatgtaggttgtttacagtttgttttaatcacaaaaaacagccacagtaattattcttgtacctatatatccacacccttgggtgagtatttctggaactgccgaatcaaagcaatgcacatcttaacttttagcagctatttgggcttgtggagtttaagcatctgcttctgaagctcagatgagtgaacctgatta

SEQ ID NO: 9454 - DNA, 466 bp, Homo sapiens
  AC009185.4_25650
  Located on chromosome 5
  Distance between a terminus base of telomere on chromosomal short arm and 5'-terminus of this base sequence : 165615631
  Distance between 3'-terminus of neighbour sequence of sequence listing upward to telomere on chrosomal short arm and 5'-terminus of this base sequence : 6117
gatttaacagatgactaagtggagaattttaggataagtgatttacaatagactaaagggctaataagtgatgaagctgggatttgagcccagatatgtatgtatgtatgtatgtatgtatgtatgtatgtatgtatgtatgtatgtatgtgtgtttgagatggagtcttgctctgtcgcccaggctggaatgcaatggcgcaatctaagctcattgcagcctctgccccccgagttcatgcaattctcctgcctcagcctccagagtagctgagattgcaggcacccgccaccacacctggctaatttttgtatttttagtagagacggggttttgccattttggccaggctcatcttgaactcctgacctcagatgatccaccggcttcagcctttcaaagtgctaggattacaggtgtgaaccactgcgcccagccttgagcccaggtattcggaccttgagt

SEQ ID NO: 9455 - DNA, 392 bp, Homo sapiens
  chr5.fa.O7frz.177607732
  Located on chromosome 5
  Distance between a terminus base of telomere on chromosomal short arm and 5'-terminus of this base sequence : 165848585
  Distance between 3'-terminus of neighbour sequence of sequence listing upward to telomere on chrosomal short arm and 5'-terminus of this base sequence : 232488
accacggttaaggtgtaattacagtgagagtgagccctatgttttcgaaggcagggctgctgtaatataagggtgatccatcaaatagaccactatggatgatttattgcatacctctgaaagactttctatataatgaaacgtgccagacattagtacaaacgatattatgcaaccattaaaagaatgagatagatctatgtatacctaaaacataatgcttaagttggaaaaaaaatacaaaactgtatgcatagggtgatctcatttggattaaatatgttcatatatacatatatatatatatacacacacacacacacacacacacacacaattatgtatttcaataaaggatacctccaacagtaattaaggatacctccaacagt

SEQ ID NO: 9456 - DNA, 212 bp, Homo sapiens
  AC008694.3_3840
  Located on chromosome 5
  Distance between a terminus base of telomere on chromosomal short arm and 5'-terminus of this base sequence : 166016229
  Distance between 3'-terminus of neighbour sequence of sequence listing upward to telomere on chrosomal short arm and 5'-terminus of this base sequence : 167252
tagataccttggaaactgacttcttagaatcttaggcattttcagtgttgttgttgttgttgttttttaatgtatcattttagcaattgatagcaacaagctacattccagatgtctagactcaagagagagatgcagaaagctgatcctatagccctgttctgtcctagcacaggcaggcactctcagtcttcactgtttggtagtgactt

SEQ ID NO: 9457 - DNA, 325 bp, Homo sapiens
  chr5.fa.O7frz.178470500
  Located on chromosome 5
  Distance between a terminus base of telomere on chromosomal short arm and 5'-terminus of this base sequence : 166261277
  Distance between 3'-terminus of neighbour sequence of sequence listing upward to telomere on chrosomal short arm and 5'-terminus of this base sequence : 244836
agttagagtggactgtcttcctaggaaaccagattgctatattataatgacaatgacaatgatattattagtacttgctgaattcttcttaaattcattattaatcttttaaatgaaactcagatataacgaatgctgcttctctgccaagatctgggccaagccttttatctgtttgatcttttctgatcctctcaatgaccccgttatgtggatattatgctcccccaccccccaacacacacacacacacacacacacacacacacacacacacacactttttttggacaaggaaacagattcagtatggttacatgaccta

SEQ ID NO: 9458 - DNA, 359 bp, Homo sapiens
  chr5.fa.O7frz.178543856
  Located on chromosome 5
  Distance between a terminus base of telomere on chromosomal short arm and 5'-terminus of this base sequence : 166334670
  Distance between 3'-terminus of neighbour sequence of sequence listing upward to telomere on chrosomal short arm and 5'-terminus of this base sequence : 73068
ctggcctgaatgtcagtagtggtgaggctgagcaaccctgcagttgatgctgctcttttcctcctttgcaaatgaggaaaccaaggccccagagaggttaggagatttctgtggtgtcacacagccagtcagtggtagatccatcggaaccggagctctttatttatttatttatttatttatttatttatttttccatgtctttttttgttgttgtggttgtattttagaacttttttttaaaattatactttaagttttagggtacatgtgcacaatgtgcaggtttgttacatatgtatacatgtgccatgttggtatgctgcacccattaactcgtcatttacatgaggtatatc

SEQ ID NO: 9459 - DNA, 93 bp, Homo sapiens
  D5S2049
  Located on chromosome 5
  Distance between a terminus base of telomere on chromosomal short arm and 5'-terminus of this base sequence : 166399364
  Distance between 3'-terminus of neighbour sequence of sequence listing upward to telomere on chrosomal short arm and 5'-terminus of this base sequence : 64335
gctgacaacggctcctacattgagtgtgtgtgtgtgtgtgtgtgtgtgtgtgtgtgtaaaaaaaagggataggccaagccaaagtttccccag

SEQ ID NO: 9460 - DNA, 421 bp, Homo sapiens
  chr5.fa.O7frz.178740155
  Located on chromosome 5
  Distance between a terminus base of telomere on chromosomal short arm and 5'-terminus of this base sequence : 166636473
  Distance between 3'-terminus of neighbour sequence of sequence listing upward to telomere on chrosomal short arm and 5'-terminus of this base sequence : 237016
tcatgtgaggtagttaatccagatcagctgtggggatgccatgacatagatttctccctgcaagaaaaattgttctggacctctgaaatttttttcaactctaaaagttatacacacacacacccacacacacacacacacacacgtttcatatgtacacattttaaattaaatgtgtaatttgaatattttgcacagtcataactgcaaattttgcatacaagcccatcccacttggatgacgaattttataaattactatttctgttgttaatttttcctccttttcttcaattaaaaattaagtgtactatatatttcatcacattagacctcttaaactaactcatttctaaagctctttacaattctgcataacaaagttgtcccttttgtcaactacatgctgtccaagagttac

SEQ ID NO: 9461 - DNA, 337 bp, Homo sapiens
  DISO7_00005161
  Located on chromosome 5
  Distance between a terminus base of telomere on chromosomal short arm and 5'-terminus of this base sequence : 166657121
  Distance between 3'-terminus of neighbour sequence of sequence listing upward to telomere on chrosomal short arm and 5'-terminus of this base sequence : 20227
attgggtcagatgaggctggccagcaaagcccagcttttcaggggactgggaggcaaggcaaccccaagtctctggctcaaatgggagacttcctaagcttctcaaaaggcctctccttgaaaacccatgcatctactcctcctaaaaagctgcagggaatgctggcagggcatctaaatagggaaatggaatcaaaggatcaaaggagaaatggcacagggtagaagggaaatacacacacatacacgcgcacacacacacacacacacacacagagacacacatacattccacaaagtaaggagtctctcctggaacactggcctggaaatgaag

SEQ ID NO: 9462 - DNA, 266 bp, Homo sapiens
  chr5.fa.O7frz.178942017
  Located on chromosome 5
  Distance between a terminus base of telomere on chromosomal short arm and 5'-terminus of this base sequence : 166733383
  Distance between 3'-terminus of neighbour sequence of sequence listing upward to telomere on chrosomal short arm and 5'-terminus of this base sequence : 75925
aataagcacatcagtctaactgaggctgaagcaagattctatgttcaaaatttagttctaaaggaaacaaagacttgaacaaggcttcattcattcattcattcattcatgtattcactcatttaacaaagaggtattgagggtctctgatgtgtcaggcaccatgctgggctctggggatcatgaggtgaacaaggaagacatagtcatgcattcccagaactaatatagtaccacaggaaaaagattaggaaagattaagcgtc

SEQ ID NO: 9463 - DNA, 178 bp, Homo sapiens
  D5S412
  Located on chromosome 5
  Distance between a terminus base of telomere on chromosomal short arm and 5'-terminus of this base sequence : 166883082
  Distance between 3'-terminus of neighbour sequence of sequence listing upward to telomere on chrosomal short arm and 5'-terminus of this base sequence : 149433
gctggggaatgttacagtatcagaagtttcaattggtccttttcctgcagccccataatgagacttgtaaaacacacacacacacacacacacacacacatgcacacagacacacacacacacacacacacacacacacacacacacacacacactgctatgtggaagttctcatggg

SEQ ID NO: 9464 - DNA, 302 bp, Homo sapiens
  chr5.fa.O7frz.179802015
  Located on chromosome 5
  Distance between a terminus base of telomere on chromosomal short arm and 5'-terminus of this base sequence : 166985550
  Distance between 3'-terminus of neighbour sequence of sequence listing upward to telomere on chrosomal short arm and 5'-terminus of this base sequence : 102290
ggaagactaagctctactggactgcttcataagagtgtaagatagctaaaaataataataataataataataatgcagagagaatgaaaatctccactggtgatttaaaacagagggaacgaaatccttaaatatccatggaaaattgttaagagagtttctctgtacagttggctgactcctcagtctataagtaacgataactaacaccgaatttactgtgtggcagacactgtgctaagtactttacgtgctttttttttttttcatttaatcctcagtcaaatgtaaggcagatactg

SEQ ID NO: 9465 - DNA, 315 bp, Homo sapiens
  AC011376.2_147332
  Located on chromosome 5
  Distance between a terminus base of telomere on chromosomal short arm and 5'-terminus of this base sequence : 167068436
  Distance between 3'-terminus of neighbour sequence of sequence listing upward to telomere on chrosomal short arm and 5'-terminus of this base sequence : 82584
atgtatgaacaagttcatggaaacattactcataatagcaaaacactggaaatgtccccaaatgtccatgaataatacagtggacaaatactgggtttgtgcaaaagtaattatagtatttgccattactttcaataataataataataataataataataataaaaaattggtgtatgtgcctacaatgcaataccatacagcactaaaaatgaaaaatctatagccacacgtgacaaaacaaatccttccaaaacacctaattttgagtaaataaccagattgtagaagaactcataaagcaagattccatgt

SEQ ID NO: 9466 - DNA, 301 bp, Homo sapiens
  AC011376.2_146041
  Located on chromosome 5
  Distance between a terminus base of telomere on chromosomal short arm and 5'-terminus of this base sequence : 167069793
  Distance between 3'-terminus of neighbour sequence of sequence listing upward to telomere on chrosomal short arm and 5'-terminus of this base sequence : 1042
acattcacaataagttgcttaaaggggactacaaaagagtatgtatatatatactgttggccattttttgcaacttatatatgtgtgtgtgtgtgtgtgtgtgtgtgtgttataaatgcataggaaaaagtctgaaagtatatcaacatatttacagtggtagaatttcaggtaatttacattttcctctctttgcttctccatattttcttaagagatgtagtttaaaaattagcctgtgagggttccttgttttccctctccccattgccccttttaagattgactgagtagattcaca

SEQ ID NO: 9467 - DNA, 227 bp, Homo sapiens
  Z67033
  Located on chromosome 5
  Distance between a terminus base of telomere on chromosomal short arm and 5'-terminus of this base sequence : 167069816
  Distance between 3'-terminus of neighbour sequence of sequence listing upward to telomere on chrosomal short arm and 5'-terminus of this base sequence : -278
ggggactacaaaagagtatgtatatatatactgttggccattttttgcaacttatatatgtgtgtgtgtgtgtgtgtgtgtgtgtgttataaatgcataggaaaaagtctgaaagtatatcaacatatttacagtggtagaatttcaggtaatttacattttcctctctttgcttctccatattttcttaagagatgtagtttaaaaattagcctgtgagggttcct

SEQ ID NO: 9468 - DNA, 220 bp, Homo sapiens
  AC007200_2224
  Located on chromosome 5
  Distance between a terminus base of telomere on chromosomal short arm and 5'-terminus of this base sequence : 167424210
  Distance between 3'-terminus of neighbour sequence of sequence listing upward to telomere on chrosomal short arm and 5'-terminus of this base sequence : 354167
ctgtaatcctagctgctcgggaggctgaggtgggaggattgccaaactggggaggtcaaggctgcagtggctgtgatcatgccactgcactccagccagggtgacagagcgagaccctgtctcaaaataatagtaataataataataataataataataataataataacgaaaaaaaggaaaagaaatgcttgccaccaaagtgtacttgttatttcaa

SEQ ID NO: 9469 - DNA, 324 bp, Homo sapiens
  AC007200.1_26571
  Located on chromosome 5
  Distance between a terminus base of telomere on chromosomal short arm and 5'-terminus of this base sequence : 167448547
  Distance between 3'-terminus of neighbour sequence of sequence listing upward to telomere on chrosomal short arm and 5'-terminus of this base sequence : 24117
accattcttaacctgaactctaagctgtcaagggcaattcctaggcatccaggctttaaaatgtaaacaaagataaaaactgatcaaagtcaacagtggccacacgctttatagatttagcccaggcaagttactaagttaaaaaacaaacaaacaaacaaacaaacaaacaactctaggaggaaaaaatcacaatccagagtggctgcagtattagctaagatgttcaatattcaatataaaattacaaggcatataaagaaaccaaaaggatgaccaaactgagtctactgaaactgtctctgagtgtttccagataatgaa

SEQ ID NO: 9470 - DNA, 354 bp, Homo sapiens
  AC007200.1_36545
  Located on chromosome 5
  Distance between a terminus base of telomere on chromosomal short arm and 5'-terminus of this base sequence : 167458384
  Distance between 3'-terminus of neighbour sequence of sequence listing upward to telomere on chrosomal short arm and 5'-terminus of this base sequence : 9513
gattctcattgaaatcctagcttaatttgaggaggtctcctaaaaatttcccaccttggatggctttgagtcctgacctttgctgcctctccccatacagcccctgagcagagcccaagtgaacgataaccagaaatgctttcaggcctaattggtttcgtgtctgatattccagtcctttttctggttacaaatctgtcccctcaaattgtcctgggaatttccgactgttgtttttttcttttcagtccttttcaggagagttcaaacttattttgacgtgtgtgtgtgtgtgtgtgtgtgtgtgtgtgtgtgtatgttggtagtagagggttgatttgaatgacctagctg

SEQ ID NO: 9471 - DNA, 245 bp, Homo sapiens
  D5S1971
  Located on chromosome 5
  Distance between a terminus base of telomere on chromosomal short arm and 5'-terminus of this base sequence : 167458492
  Distance between 3'-terminus of neighbour sequence of sequence listing upward to telomere on chrosomal short arm and 5'-terminus of this base sequence : -246
cagagcccaagtgaacgataaccagaaatgctttcaggcctaattggtttcgtgtctgatattccagtcctttttctggttacaaatctgtcccctcaaattgtcctgggaatttccgactgttgtttttttcttttcagtccttttcaggagagttcaaacttattttgacgtgtgtgtgtgtgtgtgtgtgtgtgtgtgtgtgtgtatgttggtagtagagggttgatttgaatgacctagct

SEQ ID NO: 9472 - DNA, 304 bp, Homo sapiens
  AC007200.1_91098
  Located on chromosome 5
  Distance between a terminus base of telomere on chromosomal short arm and 5'-terminus of this base sequence : 167513057
  Distance between 3'-terminus of neighbour sequence of sequence listing upward to telomere on chrosomal short arm and 5'-terminus of this base sequence : 54320
gtctttccagtgttcacaagatcaagtagtgaatatgtcatgcatgattccaagtcactggcctggatgaaaaggcagagtgaagtgaaaaggggatggggagaccttggatttgggtaggtcccaaaagatcaaaacaaaacaaaacaaacaacaaaacgtgtgtgtgtgtgtgtgtgtgtgtgtgtgtgtgtgtttattaggatctgggccaattagggaaaaaaaagagaacactactaatataggaaaacagaatgtttggagaagaggaaataggagggtctcaaggatttcatgcaat

SEQ ID NO: 9473 - DNA, 342 bp, Homo sapiens
  AC011376.2_79673
  Located on chromosome 5
  Distance between a terminus base of telomere on chromosomal short arm and 5'-terminus of this base sequence : 167652921
  Distance between 3'-terminus of neighbour sequence of sequence listing upward to telomere on chrosomal short arm and 5'-terminus of this base sequence : 139560
ggaaactgagtgattctcctagtgcttgttctttcccaaaagagaactgtggactctctctctctgtgtgtgtgtgtgtgtgtgtgtgtgtgtgtgtgtgtgtatgtgtgtgtgtgtgtgtatcttcaattcttttaccttcaagaaacccccaaagaaaaatcaaacaatagtctttccttaatcaagcctattaagcagctttgccctcatatgtttttagacttaaaagtcttatatctaaattctttccagataatgtaaaaaaaaaaaatgatgtcactgtttatgttggcagcggcaaggtgctctatttatttcatactattcaaatagtttcca

SEQ ID NO: 9474 - DNA, 333 bp, Homo sapiens
  DISO7_00024761
  Located on chromosome 5
  Distance between a terminus base of telomere on chromosomal short arm and 5'-terminus of this base sequence : 167775083
  Distance between 3'-terminus of neighbour sequence of sequence listing upward to telomere on chrosomal short arm and 5'-terminus of this base sequence : 121820
ggtggaaatgccaagaatttcattttacagataagaaaactgaagccatgtgagaagcgattagtccaaggtccctcagcaaggggcagtgtccccagcccctccagtcttcttccactgtgatctggaataaacatagaactcagagctactggttttcatttgagaaggaagagggaaacaaagagtgctggattctcagaggctcctttctttgaaggagagagagagagagagagagagagagtgtgtgtgtgtgtgtgtgtgtgtgtgtgtgtgtgtgtgtgtgtgcgcgcgcgcgcgcacacaatgcactgaggatagttcagccca

SEQ ID NO: 9475 - DNA, 262 bp, Homo sapiens
  chr5.fa.O7frz.180842999
  Located on chromosome 5
  Distance between a terminus base of telomere on chromosomal short arm and 5'-terminus of this base sequence : 167882313
  Distance between 3'-terminus of neighbour sequence of sequence listing upward to telomere on chrosomal short arm and 5'-terminus of this base sequence : 106897
gttagacatggtcattatggatacatgcattgtattcataggcaaattacatttatatcaatatggtttgtttgtattgagagcccccgacatcccccaccctccacacacacacacacacacacacacacacacacacacacacacacacacacacatacacactctctctctctctctctctctctctctctctccccctcccctctctcaatctctcaattcataaaccttggcaaagaacttagcttatttctgaggt

SEQ ID NO: 9476 - DNA, 255 bp, Homo sapiens
  AC008609.4_24152
  Located on chromosome 5
  Distance between a terminus base of telomere on chromosomal short arm and 5'-terminus of this base sequence : 167984317
  Distance between 3'-terminus of neighbour sequence of sequence listing upward to telomere on chrosomal short arm and 5'-terminus of this base sequence : 101742
tattctgtgagcaaattaggttacatctttctttctttctttctttctttctttctttctttctttctttctttctttctttctttctttctctttctttctttctttttctttctctttctttctctctctctcttcttttcttccttccttccttctttcttctttttctcgctttctctctttctttcctagtttatttagagacaagttcttactatattgcccaggctggtctcgtacttctggactcaa

SEQ ID NO: 9477 - DNA, 318 bp, Homo sapiens
  AC008609.4_97564
  Located on chromosome 5
  Distance between a terminus base of telomere on chromosomal short arm and 5'-terminus of this base sequence : 168076432
  Distance between 3'-terminus of neighbour sequence of sequence listing upward to telomere on chrosomal short arm and 5'-terminus of this base sequence : 91860
tgctatgagttatgattacatcactgcacttcagcctgggtgacagaatgagaccctgtaataaaaattataagagagaagaaggaaagaaagaaagaaagaaagaaagaaagaaagaaagaaagaaagaaagaaagaaagaaagaaagaaagagaaaggcaggcaaaacctacttgagctagcttaggttaaaaaataaaaaaggtgatttataaagttgaaccatcagcatgtataactgctgatatttgacctttttgacctataaaaacaacaatttcagatggtgcaacctaatattctaacaatgcagaagg

SEQ ID NO: 9478 - DNA, 174 bp, Homo sapiens
  DISD22_0010536
  Located on chromosome 5
  Distance between a terminus base of telomere on chromosomal short arm and 5'-terminus of this base sequence : 168189500
  Distance between 3'-terminus of neighbour sequence of sequence listing upward to telomere on chrosomal short arm and 5'-terminus of this base sequence : 112750
tgcgactctgctgttctctctttttctttttgagttattacacacacacacacacacacacacacacacacacacacacacacacagacacacagaggatttgtttaagaaatggcaaaaatgaatacaagcaaacagaagaaagtaaaattcccctcacaatcctaccacttg

SEQ ID NO: 9479 - DNA, 262 bp, Homo sapiens
  D5S1465
  Located on chromosome 5
  Distance between a terminus base of telomere on chromosomal short arm and 5'-terminus of this base sequence : 168417151
  Distance between 3'-terminus of neighbour sequence of sequence listing upward to telomere on chrosomal short arm and 5'-terminus of this base sequence : 227477
ctaaatttggaccctgcagatagatggatagataaatgcatagatagatagatagatagatagatagatagatagatagatagatagacatcagcatagataaggattaatctgcaatctatactttacaaatcgcagaaacaaattttaaatatattcatcaagcaaagtggggagtaggagagaaggattgatactggaatttgcagggtaagcactaaattcagaaatagcttaatccatgttcaaacaatattgtggg

SEQ ID NO: 9480 - DNA, 288 bp, Homo sapiens
  AF165124.1_107315
  Located on chromosome 5
  Distance between a terminus base of telomere on chromosomal short arm and 5'-terminus of this base sequence : 168546338
  Distance between 3'-terminus of neighbour sequence of sequence listing upward to telomere on chrosomal short arm and 5'-terminus of this base sequence : 128925
gaatagacactcatctttcctgactgacagtctgattccaattatgaattaaacaccaaggggtgtgcgtgcatgtgtgtgtgtgtgtgtgtgtgtgtgtgtgtgtgtgtttccagaaaggattactcttggccctatttctttatctagtgtgtaatttatgttcctgttattgttttggcatctatccatctaccaatctatctatctatctaatctatcctttatctatttatcttaagctgattgcatataagtatggtagagtcagtctgtattggtcagctt

SEQ ID NO: 9481 - DNA, 461 bp, Homo sapiens
  AF165124.1_105226
  Located on chromosome 5
  Distance between a terminus base of telomere on chromosomal short arm and 5'-terminus of this base sequence : 168548264
  Distance between 3'-terminus of neighbour sequence of sequence listing upward to telomere on chrosomal short arm and 5'-terminus of this base sequence : 1638
cactagaactgtaaacttgcgacaaatttttgcaggtttttgaattatggattcaaatcctgagccagtatttgattttagactcagccccagaatttttgttgagtcttatttgtaggtagtggtgatttggtatagcagttttgtttattttttctcctcaactctttttctgccatccatggtagttttatcaaggaaaaaaaaacccaaactattgctgttcatagaggttctgatggtgtgtgtgtgtgtgtgtgtgtgtgtgtgtgtctgtaataaacataataaaaacacgtattttcaaggtactcatgccaattatatactgtaacagcctgataggttttattgtttgcagttaatggcaagagttttgataattaactctaacctaatatgtctagttttctttttatagaaacaagagtgaggtggtaacaggtgtatcttgatcaagg

SEQ ID NO: 9482 - DNA, 225 bp, Homo sapiens
  AF165124.1_98469
  Located on chromosome 5
  Distance between a terminus base of telomere on chromosomal short arm and 5'-terminus of this base sequence : 168555158
  Distance between 3'-terminus of neighbour sequence of sequence listing upward to telomere on chrosomal short arm and 5'-terminus of this base sequence : 6433
gaatctcataagtcaccaagaaagggcattacctacacataagagcagtctcaaaataaataagatgcagtttttgctgttctttctggtataaagagatgtgtgtgtgtgtgtgtgtgtgtgtgtgtgtgtgtgtatttgcaactaagcatatcaaaaacagaatagaatgaaaggtttctcagcttagatgatgtctctttgaccatacctcaactgtcttca

SEQ ID NO: 9483 - DNA, 176 bp, Homo sapiens
  DISD22_0010550
  Located on chromosome 5
  Distance between a terminus base of telomere on chromosomal short arm and 5'-terminus of this base sequence : 168721646
  Distance between 3'-terminus of neighbour sequence of sequence listing upward to telomere on chrosomal short arm and 5'-terminus of this base sequence : 166263
aacaattctcagtcattactgtttcaaatattacttctgtctctctctctctctctctctctgtctctctctctctctctctctgtctctctctctctctctctgtctctctctcttctccttgttttcccattgtgtgtttataccttttgtagttgcctaacattgttgaatat

SEQ ID NO: 9484 - DNA, 358 bp, Homo sapiens
  AC023335.2_124533
  Located on chromosome 5
  Distance between a terminus base of telomere on chromosomal short arm and 5'-terminus of this base sequence : 168928501
  Distance between 3'-terminus of neighbour sequence of sequence listing upward to telomere on chrosomal short arm and 5'-terminus of this base sequence : 206679
tccaaagcattacataaagaaggcataccttggagaaactgaacaaaaacacaagaatcctaagcattgggctaaagaacacattggtttagtttgaaaatggtttaatttgaaacctgaatattatcagtagatagaaatgataattcacaatcaagccagaagaaacttgctttttttgtcaattttctttaaagattttaaatgtcacattcaaacatacaactctaacaacaactctctctctctctttctctctctctctctctctctatatatatgtatatatacacgagttcaaaattaacacattgtattaccacatctaatatgccttcgttcttgataaaatgtaaga

SEQ ID NO: 9485 - DNA, 337 bp, Homo sapiens
  AC023335.2_148116
  Located on chromosome 5
  Distance between a terminus base of telomere on chromosomal short arm and 5'-terminus of this base sequence : 169117289
  Distance between 3'-terminus of neighbour sequence of sequence listing upward to telomere on chrosomal short arm and 5'-terminus of this base sequence : 188430
gttacgtatggtttgtacaggaaaataagtgaagcaatagtcccaaattgtataactttaacattcttataagtttctatggaaataccatacaaaaccttatctctttccatttttctatctatctatctatctatctatctatctatctatctatctatctatctattcccatgtatttttttgtgtttcagatgaaaggtttaattctgtaatttctgtgtattttataagcgtacttgtgtttatttagtaaatctgtattctgtatattttttcaaattacgtggaaatatatatttagttaaataaagactataggaatgaaaccttcacc

SEQ ID NO: 9486 - DNA, 406 bp, Homo sapiens
  AC020920.3_80395
  Located on chromosome 5
  Distance between a terminus base of telomere on chromosomal short arm and 5'-terminus of this base sequence : 169125561
  Distance between 3'-terminus of neighbour sequence of sequence listing upward to telomere on chrosomal short arm and 5'-terminus of this base sequence : 7935
atgtaggttcctggtaaacatccatcttttaagaatatcagcaaaattttctgtcagagaaatatcaattctgtgtgtgtgtgtgtgtgtgtgtgtgtgtgtgtttatgttcggaagtacaaattatattttatatgttgatcagaatttgttaacctgcaagaggatttacagaacaagtatattcttgtaaaaaatcattggtttaaacactttgacacaagtagacttgtaaaatagttggtaacttaaaaccaagccctaaaatggtaatcattcacatttgtttcatctatgattcctttgtgacaaccatattgtaaaatacctaaatattggtgctattatcagattttgttttgcttcccaaatagccaccagcatgatgctgaggaattcactaatt

SEQ ID NO: 9487 - DNA, 101 bp, Homo sapiens
  DISO7_10002083
  Located on chromosome 5
  Distance between a terminus base of telomere on chromosomal short arm and 5'-terminus of this base sequence : 169180793
  Distance between 3'-terminus of neighbour sequence of sequence listing upward to telomere on chrosomal short arm and 5'-terminus of this base sequence : 54826
acgagctcaaaagagtcacgtacacggtgtgtgtgtgtgtgtgtgtgtgtgtgtgtgattttcaataaaagagtaaagagatggcataatagtctttcaga

SEQ ID NO: 9488 - DNA, 346 bp, Homo sapiens
  AC020920.3_93825
  Located on chromosome 5
  Distance between a terminus base of telomere on chromosomal short arm and 5'-terminus of this base sequence : 169204055
  Distance between 3'-terminus of neighbour sequence of sequence listing upward to telomere on chrosomal short arm and 5'-terminus of this base sequence : 23161
atattctggaactttctttgtaagctgtgactagctctaacaaacctttattagcaagtcattacaggtaactgtattgttacactaggttcatttaatcttacctgactcaaatgctataaatttaaaaagcattttttgagcactagagtgtatttgtataaaagagagagagagagacagtgtgtgtgtgtgtgtgtgtgtgtgtgtgtgtgaagcattcaacacctttcctccttggagggcaattcttcattgcaaatataattggaattggtgggttactgaacatcacatccctctatagaagctaggcagacaagagctatagaatcctattctgccc

SEQ ID NO: 9489 - DNA, 165 bp, Homo sapiens
  DISO7_10002085
  Located on chromosome 5
  Distance between a terminus base of telomere on chromosomal short arm and 5'-terminus of this base sequence : 169319235
  Distance between 3'-terminus of neighbour sequence of sequence listing upward to telomere on chrosomal short arm and 5'-terminus of this base sequence : 114834
aggacacaaagtaccaagtgagtaaatatatatattatatatatatgctctatatatagagagaacaaagagaacaaatatgtatttgagtgtgtgtgtgtgtgtgtgtgtgtgtgtgtgtgtgtgtggataaaaagcctggaaagaaaccatctgaactgctga

SEQ ID NO: 9490 - DNA, 261 bp, Homo sapiens
  chr5.fa.O7frz.183307264
  Located on chromosome 5
  Distance between a terminus base of telomere on chromosomal short arm and 5'-terminus of this base sequence : 169504734
  Distance between 3'-terminus of neighbour sequence of sequence listing upward to telomere on chrosomal short arm and 5'-terminus of this base sequence : 185334
gttaagtccttgagtgatgtttactcttttcctcatattccataacttaaatattatgaggtaaaaatgaataattgctaattaatgatataaattcaattttgaaattttgtttgtttggagggctgaagggtaatacaatcagtattgtattaccaggtgctatggaaatagccatggaccttacattaaataatgatgctcttttatttatttatttatttatttatttatttatttatttatgagacggagtttcac

SEQ ID NO: 9491 - DNA, 475 bp, Homo sapiens
  chr5.fa.O7frz.183490927
  Located on chromosome 5
  Distance between a terminus base of telomere on chromosomal short arm and 5'-terminus of this base sequence : 169759647
  Distance between 3'-terminus of neighbour sequence of sequence listing upward to telomere on chrosomal short arm and 5'-terminus of this base sequence : 254652
ggtacaaagtatggatgcatacaagttctttatcatttcagaagaaataggatctcttaggcattttcctcacggtgaacaattattataggcatctcaactttattgaccttggcttttccacttgcccaaacataacaaatttactaccctaaaagaattagctttgaccatgcctgtccccaagtatctaatgaaaatattggtgtaggtacaaaataaatgctcttgttctttcctctcttccacctcctctctctcactctgtctctctctctctctctccctctctctgtctcatacacatacacacacacacacacacacagtgtcttagtgcaagtagaaccatcaatgagattaaaatgtttcactagatggaaacaagagaaaaaatacaaactctaaagaaagatgctgcattgctatctttctaatgatagaagaatacctcataatgacaaactgttaagct

SEQ ID NO: 9492 - DNA, 122 bp, Homo sapiens
  D5S2093
  Located on chromosome 5
  Distance between a terminus base of telomere on chromosomal short arm and 5'-terminus of this base sequence : 169894517
  Distance between 3'-terminus of neighbour sequence of sequence listing upward to telomere on chrosomal short arm and 5'-terminus of this base sequence : 134395
ttgcagtgagtcaagttcgtgctactgcactccagcctgggcaacagagcaaaactctgtctcaaacacacacacacacacacacacacacacacacaaaggtgcctctatatgatgccgag

SEQ ID NO: 9493 - DNA, 431 bp, Homo sapiens
  AC010291.5_16577
  Located on chromosome 5
  Distance between a terminus base of telomere on chromosomal short arm and 5'-terminus of this base sequence : 170064863
  Distance between 3'-terminus of neighbour sequence of sequence listing upward to telomere on chrosomal short arm and 5'-terminus of this base sequence : 170224
gacaaatttagagcaatgaacatcacgtgagaagatagaatggatccaattaccataaaaaggatatattaactacattcaaaattatgtggaagtacaatgataaagatgcttacaatataaaaaggttatgttgtaacatagtatcccattagataaagaaaaatggtaggtaatatttcaatatgaatttaaaaagaagaatgttttgtgtgagggagtgtgtgtgtgtgtgtgtgtgtgtgtgtgtgtgtgatgggctttattagtcaggatgcaattaagcaaaaagaaaccatataaaaatctcaatgtgaggaatctaacatggagaaatgcttacaaggttagattgctgaaaaagcaagaagggaatactgaggtatcacagagacagtaactgtgggacacagctacttcacctaagatcg

SEQ ID NO: 9494 - DNA, 391 bp, Homo sapiens
  AC010291.5_82643
  Located on chromosome 5
  Distance between a terminus base of telomere on chromosomal short arm and 5'-terminus of this base sequence : 170130970
  Distance between 3'-terminus of neighbour sequence of sequence listing upward to telomere on chrosomal short arm and 5'-terminus of this base sequence : 65676
ttgagtcaaggacctgagtaaggaggggaaggctcatttatcatcagagaagggcaagacaactgtcatcactccatttgactccagctgtgaagtgaacagcttattttgttttgatgatgatttgagagactcatcaataaaatcaccaatactcttttcagtgctgcaatctgtcagtgtgtgtgtgtgtgtgtgtgtgtgtgtgtgtgtacatgtacatacacgtgcttatttcaaggaaaaagggagaaagcaggaaacagatttacctttacatatatatgtatatttacacacgatttcccattctccattcactgatggtagggacgcatctcagaatctccagctggtccatcattgtccctgatggttagcatattgagct

SEQ ID NO: 9495 - DNA, 249 bp, Homo sapiens
  D5S2066
  Located on chromosome 5
  Distance between a terminus base of telomere on chromosomal short arm and 5'-terminus of this base sequence : 170434722
  Distance between 3'-terminus of neighbour sequence of sequence listing upward to telomere on chrosomal short arm and 5'-terminus of this base sequence : 303361
tcgaggcattgagtgtgggaagaggatataacagcaattttgtattccctttttccttccatgattatgttttcagtatacacaaaatagttaaggtagccattttaattctcaggaactaatatctaacttatccatattcatgtgtgtgtgcatgtacacacacacacacacacacacacacacacagtagaatcttgaattcatctccagcatcatcttctgtttctaccacttgtcctctatcag

SEQ ID NO: 9496 - DNA, 439 bp, Homo sapiens
  chr5.fa.O7frz.184310248
  Located on chromosome 5
  Distance between a terminus base of telomere on chromosomal short arm and 5'-terminus of this base sequence : 170530651
  Distance between 3'-terminus of neighbour sequence of sequence listing upward to telomere on chrosomal short arm and 5'-terminus of this base sequence : 95680
gagttatctaaggccatcaaagtggcttttcctgtgtgtgacaatggacacataattagccacacacccagatctcccaactctcaacacgtcattttagaaagcagcattcaaggtgcaattttaaagttaaaatattaaaatactaacaaactgtatttctattgcgctcatttcattcttctaataaaatgtgtctagttattttcattataaccatcatgcaagggcaaagtcctttataaataaatatacacaaatatatgcacatatataaaaatgtatattcataatacacacacacacacacacacacacacacacacacacacacacaccccagagctcaaaaaggtaaagtcaaagaaagactttcgttacttgggtagtaacacatttttggtctctagaacaaaactgtttcctgaagcttacttct

SEQ ID NO: 9497 - DNA, 340 bp, Homo sapiens
  chr5.fa.O7frz.184432508
  Located on chromosome 5
  Distance between a terminus base of telomere on chromosomal short arm and 5'-terminus of this base sequence : 170753233
  Distance between 3'-terminus of neighbour sequence of sequence listing upward to telomere on chrosomal short arm and 5'-terminus of this base sequence : 222143
attgtctttcaaagcactagtactttgcagggctgctgggtgcccagtgcatgagacctgacctcgatcaaaaattcctgacactcttcttagtcaaggtttccagcacaaattcccccaccttcctaaaaagtcttattttggatattctcgtatgtatgtatgtgtgtgtgtgtgtgtgtgtgtgtgtgtgtgtgtgtgtgtgtgtgtgtgtgtatacacatatatatactatctcttcttaggaaacaagctctgtatactaaggatatgagacactattttttaatccactgcggcaaataagggcctatttttctgcacttacaaagttaagtgg

SEQ ID NO: 9498 - DNA, 221 bp, Homo sapiens
  DISD22_0010558
  Located on chromosome 5
  Distance between a terminus base of telomere on chromosomal short arm and 5'-terminus of this base sequence : 170919461
  Distance between 3'-terminus of neighbour sequence of sequence listing upward to telomere on chrosomal short arm and 5'-terminus of this base sequence : 165888
accgtgctgatttcttacttatagaatatcttagagagcaatgatataatctcttagtctctcgatatgtatatgcatacacacacacacacacacacacacacacacacacaccatttgtaaaaccaaacattttaggctgtctttacatacactaaatatacatttttggaaacaggagtgattctactagtgtctatgagagtagagtaatgggagtg

SEQ ID NO: 9499 - DNA, 416 bp, Homo sapiens
  chr5.fa.O7frz.184605338
  Located on chromosome 5
  Distance between a terminus base of telomere on chromosomal short arm and 5'-terminus of this base sequence : 171040042
  Distance between 3'-terminus of neighbour sequence of sequence listing upward to telomere on chrosomal short arm and 5'-terminus of this base sequence : 120360
ttgctaagaactttataaagcaacgacagagcagcatcaaagcatctgcaaatgctttctctttccaaattaatactctatcagtataaaggaggccactcaccactggctatattttcatttttataaagtatttttatgactgtttagggaaagcctgtatacagccattccctccattttgtgtgtgtagttttcttgctctgagccaacattccatcaccttggccaaagtaacatatatatatatatatatatacacacacacacatatatatgtataatttataaacgtatttaatttttatatgtatttaatttatatatttaaggtatggcttgacatacattttggaagatgcctggagtataagttatgggtgactgcagaatcctgatctggtaggctctagatc

SEQ ID NO: 9500 - DNA, 217 bp, Homo sapiens
  D5S621
  Located on chromosome 5
  Distance between a terminus base of telomere on chromosomal short arm and 5'-terminus of this base sequence : 171109504
  Distance between 3'-terminus of neighbour sequence of sequence listing upward to telomere on chrosomal short arm and 5'-terminus of this base sequence : 69046
atttcaggtgtattaatgtagtctttttaacgttaccattgtatatatacatatatatatatatagtgtactttgtgtttgtgtgtgtgtgtgtgtgtgtgtgtgtgtgtgtgtgtatcccaagcacaatactcccctacaaaaagaaagaaaaaatgtgaaaaaaattgccaagttgcatattgtaaataaagttaaatatggaacaatggcaggg

SEQ ID NO: 9501 - DNA, 369 bp, Homo sapiens
  chr5.fa.O7frz.184681618
  Located on chromosome 5
  Distance between a terminus base of telomere on chromosomal short arm and 5'-terminus of this base sequence : 171116419
  Distance between 3'-terminus of neighbour sequence of sequence listing upward to telomere on chrosomal short arm and 5'-terminus of this base sequence : 6698
aaagtgcattatgataaagcagctatgaagtaatatgtttgaatgaagttgtatttaaaatttaagataagaaaaagttacattatgcttaagattcattacttactttgtttaagctacacagaatgttagaatctctatgaattcatttaaccctctgggtaactccacacacacacacacacacacacacacacacacacacccctcaattcttctggcctctgcttcaggaacaaatgggagaatcattgtagactatagattgaaccattgcagaaactagccttctcctttagaaatctctctagtgtcctcctttaagagaaatcttcattgcggccactaaatagctgtaaatggtgaagt

SEQ ID NO: 9502 - DNA, 192 bp, Homo sapiens
  DISD22_0010562
  Located on chromosome 5
  Distance between a terminus base of telomere on chromosomal short arm and 5'-terminus of this base sequence : 171243990
  Distance between 3'-terminus of neighbour sequence of sequence listing upward to telomere on chrosomal short arm and 5'-terminus of this base sequence : 127202
gcagtgtttatgtagtctaagcatctagaagaaaaccgatccctaaagttttatttatttatttatttatttatttatttaggctgtatacttaggttttaaggatatcataacatcccaaaaatgtgtttttaaatagttgcatgccccagttgcccctgtttatttaagattggtatgcagtctctgaga

SEQ ID NO: 9503 - DNA, 140 bp, Homo sapiens
  DISD22_0010564
  Located on chromosome 5
  Distance between a terminus base of telomere on chromosomal short arm and 5'-terminus of this base sequence : 171337915
  Distance between 3'-terminus of neighbour sequence of sequence listing upward to telomere on chrosomal short arm and 5'-terminus of this base sequence : 93733
ttgtacatttggcatgttcctttctctctatcatcaccacacacacacacacacacacacacacacacacactacacacatgttccccagggttgaaaacagtgtatattgaagacagacaatatttcttagttggtcat

SEQ ID NO: 9504 - DNA, 105 bp, Homo sapiens
  DISD22_0010569
  Located on chromosome 5
  Distance between a terminus base of telomere on chromosomal short arm and 5'-terminus of this base sequence : 171446080
  Distance between 3'-terminus of neighbour sequence of sequence listing upward to telomere on chrosomal short arm and 5'-terminus of this base sequence : 108025
tcaataggctatgctgaagcaaacaacaacaacaacaacaacaacaacaacaacagaaaacgatctggagtcatggattttggaatggagtctgggctccatgtt

SEQ ID NO: 9505 - DNA, 405 bp, Homo sapiens
  chr5.fa.O7frz.185171838
  Located on chromosome 5
  Distance between a terminus base of telomere on chromosomal short arm and 5'-terminus of this base sequence : 171624071
  Distance between 3'-terminus of neighbour sequence of sequence listing upward to telomere on chrosomal short arm and 5'-terminus of this base sequence : 177886
gaaacttaatcctcaatgtaacagtgttggttgggaacttttggaaggtgtttaggtcatgaagtcccttctgtcatgaatggattaatgctgctattagaaagatttgcagaagtgtgctcttgcgctctcttgtgcactagctctcgctgtctctgtctctttctctctctctctcacacacacacacacacacacacacacacacccttctgccctcctttatgtgaggattcagtaagaaggcctgcatctgatgctggagttttgatcttgcactttacacactccagaatagtaagaaataaatttctgttttttataaattacctagtctcaggcattctgttatagcactaaaataacgtgtctcagtttctagcctcctggtagaataagcctaaa

SEQ ID NO: 9506 - DNA, 460 bp, Homo sapiens
  chr5.fa.O7frz.185058599
  Located on chromosome 5
  Distance between a terminus base of telomere on chromosomal short arm and 5'-terminus of this base sequence : 171878215
  Distance between 3'-terminus of neighbour sequence of sequence listing upward to telomere on chrosomal short arm and 5'-terminus of this base sequence : 253739
gcaagtttcaatatcaggcatattaaagtaattctgcctacgtcatttgagatttttggtgtcaatataaagatacacattttcttgatcttatctttattctcacttttgcattttggccattctttctaaggaacattctgtacccttttgcatcgctagcctttgtatgcactgctccctccgtgaaatgctcttccctcatcttcaaaaagctggctcctgcacatcactgaaatcttcatgcacatgccatccatgcacacagacttccctgaccagatcacttttgcaaaattagcaccaacatccttcgctttctgtcccattagcttaatgtgtgtggtgtgtgtgtgtgtgtgtgtgtgtgtgtgtgtgattatccctttatacaactgggttatttatatatttgtttatgagcttatctgtcacccataccagaagttagaacgacaac

SEQ ID NO: 9507 - DNA, 440 bp, Homo sapiens
  chr5.fa.O7frz.185398715
  Located on chromosome 5
  Distance between a terminus base of telomere on chromosomal short arm and 5'-terminus of this base sequence : 171992028
  Distance between 3'-terminus of neighbour sequence of sequence listing upward to telomere on chrosomal short arm and 5'-terminus of this base sequence : 113353
gcctactcaacaggaagataacaaggatgaagacctttatgatgatccatttaatgagtagtaaatatattttctctttcttatgatctatctagcttattttattttaaaaatatagtacataatatatataacaagtacattatttatatatatatatatatgtatatataacagtacataatatatatgccaagtatgcattaattgactatggcagcagtctccaacctttttggcaccaaggactgattttgtggaagaaaatttttccatggacaaccagtaggggatggtttcagggtaattcaagtgcattacatttattgtgcattttatttctattattacattggaatataaaatgaaataataatacaactcaccataatgtcaaatgagtaggagccccgagcttgttatcctacaactagatggtc

SEQ ID NO: 9508 - DNA, 189 bp, Homo sapiens
  D5S423
  Located on chromosome 5
  Distance between a terminus base of telomere on chromosomal short arm and 5'-terminus of this base sequence : 172064347
  Distance between 3'-terminus of neighbour sequence of sequence listing upward to telomere on chrosomal short arm and 5'-terminus of this base sequence : 71879
ctgggcaacaagagtgaaattccatcacacacacacacgcgcgcgcgcgcgcgcacacacacacacacacacacacacacacacacagagagaaaaaaggaaaacggtgaacttaatataaagagggccaaattaaacagtatggttattcatgctactatgcaattcattacggctttgtggaatttg

SEQ ID NO: 9509 - DNA, 123 bp, Homo sapiens
  Z66737
  Located on chromosome 5
  Distance between a terminus base of telomere on chromosomal short arm and 5'-terminus of this base sequence : 172064357
  Distance between 3'-terminus of neighbour sequence of sequence listing upward to telomere on chrosomal short arm and 5'-terminus of this base sequence : -179
agagtgaaattccatcacacacacacacgcgcgcgcgcgcgcgcacacacacacacacacacacacacacacacacagagagaaaaaaggaaaacggtgaacttaatataaagagggccaaat

SEQ ID NO: 9510 - DNA, 125 bp, Homo sapiens
  D5S2032
  Located on chromosome 5
  Distance between a terminus base of telomere on chromosomal short arm and 5'-terminus of this base sequence : 172077618
  Distance between 3'-terminus of neighbour sequence of sequence listing upward to telomere on chrosomal short arm and 5'-terminus of this base sequence : 13138
atgttgccagctcttttgatgctttctaggtctacaggggaagcatgtgcacacacacacacacacacacacacacgcacacactaaacataaagcccttttcctaaatgacataattcaggcag

SEQ ID NO: 9511 - DNA, 223 bp, Homo sapiens
  AC008415.4_119254
  Located on chromosome 5
  Distance between a terminus base of telomere on chromosomal short arm and 5'-terminus of this base sequence : 172152169
  Distance between 3'-terminus of neighbour sequence of sequence listing upward to telomere on chrosomal short arm and 5'-terminus of this base sequence : 74426
ctaaaataacatgagtgctttcacttgcaattaaaatgtgtactttaaggaaggcagggaggcgggcaaagaaataatgtcattctaggaccctctgcaaaagaaaggaaagagggaaaagagagaaagaaaggagggagcgagggaggagggaaggaaggaaggaaggaaggaaggcaggcaggcaggcaaagaaataacgttgtcattctagaaccatctg

SEQ ID NO: 9512 - DNA, 238 bp, Homo sapiens
  D5S2040
  Located on chromosome 5
  Distance between a terminus base of telomere on chromosomal short arm and 5'-terminus of this base sequence : 172202136
  Distance between 3'-terminus of neighbour sequence of sequence listing upward to telomere on chrosomal short arm and 5'-terminus of this base sequence : 49744
ttgtatttcataactcagtcttgtcaattaatttagataggctttttcccaattaactgagtcatacttaactctctcaagaggtatttatacacacacacacacacacacacacacacacacacacacacaaacgaacagattccatagagatacaattgcaattgcttctcatgtttttatctttcttctggctacatgccccatccttccatttgaaaactgtgaaactgcaaca

SEQ ID NO: 9513 - DNA, 115 bp, Homo sapiens
  D5S415
  Located on chromosome 5
  Distance between a terminus base of telomere on chromosomal short arm and 5'-terminus of this base sequence : 172323443
  Distance between 3'-terminus of neighbour sequence of sequence listing upward to telomere on chrosomal short arm and 5'-terminus of this base sequence : 121069
agcagaatatatgatttatcatcaaaacacacacacacacacacacacacacacacacagagagagagagagagagagagagagagagagaaaatccccaaactattttagacat

SEQ ID NO: 9514 - DNA, 202 bp, Homo sapiens
  chr5.fa.O7frz.186058101
  Located on chromosome 5
  Distance between a terminus base of telomere on chromosomal short arm and 5'-terminus of this base sequence : 172429670
  Distance between 3'-terminus of neighbour sequence of sequence listing upward to telomere on chrosomal short arm and 5'-terminus of this base sequence : 106112
gcaaactatttatggatcatttagtttcccaaagaaaatgtggggtatatctcctatgtagtccttctggaggctggtgtgtgtgtgtgtgtgtgtgtgtgtgtgtgtgtgtgtgtgtgtgtacagctgtgtgtataactgtggtaatgtacataacgtatttgaaatgataagaaagctgttattgcaaattgtagcctaa

SEQ ID NO: 9515 - DNA, 431 bp, Homo sapiens
  chr5.fa.O7frz.186166808
  Located on chromosome 5
  Distance between a terminus base of telomere on chromosomal short arm and 5'-terminus of this base sequence : 172536818
  Distance between 3'-terminus of neighbour sequence of sequence listing upward to telomere on chrosomal short arm and 5'-terminus of this base sequence : 106946
aaattaaacttgctagaacatgacaatagagattgctgcttacaaatcactagcctaaaatacctcactgtgcattgttacttgcttttgtgcgcgtttgtgtgtgtgtgtgtgtgtgtgctaatatctatgaattgctgtgtttccagtactaaattaacagctggatattttagattctatctgatgaaatattttcatatgggtttttaaatgtcttttcattttcagtaattatctcataagttcctagaagcatggacctcagtaattttgaatctttgatggctattcatagagatcatcaaatagctattctaaagctttgaaacatgtgcttcccagttctctaagggtaaacttgacagtttttcttagggcaatgcttctcctttgttcttgtaagggtcacttcagtgaattaccttaga

SEQ ID NO: 9516 - DNA, 411 bp, Homo sapiens
  chr5.fa.O7frz.186256967
  Located on chromosome 5
  Distance between a terminus base of telomere on chromosomal short arm and 5'-terminus of this base sequence : 172601782
  Distance between 3'-terminus of neighbour sequence of sequence listing upward to telomere on chrosomal short arm and 5'-terminus of this base sequence : 64533
attaagtttgaggtaggactgatcacaaatctgatagggaaaggaatgtgtgaagaagattataagaaagacttatgaagaatactcatgtaatagtgttccttgaaaccatccatctaacagcaatggcaagaaggtagctggaaaaaaacagagagagagagagagagagagagagagagagaaagaacaatcgttatcatggcagaaaactcccatttactccttatgacaacagtaggaatagagcacttttattactcccattttaccaattataagattcacagttattgaggaatttgtccatgaccacacaactgtaggttgtgatgggagaaatgtaacacaagctgatgccactttaaagctagtactctaaccactatactaagttggaatactggactg

SEQ ID NO: 9517 - DNA, 469 bp, Homo sapiens
  chr5.fa.O7frz.186379329
  Located on chromosome 5
  Distance between a terminus base of telomere on chromosomal short arm and 5'-terminus of this base sequence : 172693717
  Distance between 3'-terminus of neighbour sequence of sequence listing upward to telomere on chrosomal short arm and 5'-terminus of this base sequence : 91524
catttgaactccattcatgtacatgtggagaacagctagtgttttacaaagggcagaggtggttacattgaaagtccttggcattatcacaaatccctatgtttgtattcttttttatgggatccacaagattttatctattgcattcttttttacctaatgcctttgttgtcagggttggaacattgttgaattccggcaaacaatgggaatgaattggttttatacaaacaactttgtgtgtgtgtgtgtgtgtgtgtgtgtgtgtgtgtgtgtgcgcgcatgcatgcatgtttcccaaagaccagaaaagcaaaggagactattaaaatcttaaagcaaatctgtgggttactaggcctacctgggtctttatttactgtgttccactggattactgactagaaacacctgttgtaagaggaggagtacacgtggctggtgcatgaaccttggtaagtcatagtaa

SEQ ID NO: 9518 - DNA, 310 bp, Homo sapiens
  chr5.fa.O7frz.187086402
  Located on chromosome 5
  Distance between a terminus base of telomere on chromosomal short arm and 5'-terminus of this base sequence : 172827180
  Distance between 3'-terminus of neighbour sequence of sequence listing upward to telomere on chrosomal short arm and 5'-terminus of this base sequence : 132994
cagtgagctatgattgtaccactgctctccagcctgggcaacaaaataaaactccatcctttggggaaaacaacaacaacaacaacaacaacaactatcttagaagtagaaggaatcattatctgttttgtgtagttatctgtgatatgtatcaaattatcccaaatctttatgacaaaaaataataagcatttaatactgggtgtttctgtgggccaagagtccagaagctctgaccagggtcctctggtttcccgtcctagaagagctgcaatcaaatagttgactgaggcttcagtcatctaaagac

SEQ ID NO: 9519 - DNA, 277 bp, Homo sapiens
  chr5.fa.O7frz.187234048
  Located on chromosome 5
  Distance between a terminus base of telomere on chromosomal short arm and 5'-terminus of this base sequence : 172954068
  Distance between 3'-terminus of neighbour sequence of sequence listing upward to telomere on chrosomal short arm and 5'-terminus of this base sequence : 126578
tactggaattacaggcttgagctaccacacccagccagaatctaaccactcttcatcatgtatatttccagtattataacaatagctttctaccaagtttccctgcttctatttgtgtgtgtgtgtgtgtgtgtgtgtgtgtgtgtgtgtggaggtagaattgattttttggtatataacaatctgtgcataattaatgtatacaacttggtcaatctggagatgagtgtacacccatgaagccaccaccactatctgtgtcatagacctattcatc

SEQ ID NO: 9520 - DNA, 470 bp, Homo sapiens
  chr5.fa.O7frz.187343877
  Located on chromosome 5
  Distance between a terminus base of telomere on chromosomal short arm and 5'-terminus of this base sequence : 173078054
  Distance between 3'-terminus of neighbour sequence of sequence listing upward to telomere on chrosomal short arm and 5'-terminus of this base sequence : 123709
tagtctagctaaagatattggcagtgggaagacagtgaagggtttatgcagatgtaaagcattatctgatttgtattttagaaatactgttctaagccgggcgcggtggctcacgcctgtaatcccagcactttgggaggccgaggcgtgatccgaggcgggcggatcacaaggtcaagtgatcgagaccatcctggccaacatggtgaaaccgtctctactaaaaatacaaaaattagctgggtatggtggcacacacctgtagtcccagctactcgggaggctgaggcaggagaatcgcttgaacccaggaggtggaggttgcagtgagccgagatcgcgccactgcactccagcctggtgacagagcgagactccatctcaaataaataggaaggaaggaaggaaggaaggaaggaaggaaggaaggaaggaaggaaggaaagactgttctaaggacagtgaagacg

SEQ ID NO: 9521 - DNA, 201 bp, Homo sapiens
  D5S2050
  Located on chromosome 5
  Distance between a terminus base of telomere on chromosomal short arm and 5'-terminus of this base sequence : 173123675
  Distance between 3'-terminus of neighbour sequence of sequence listing upward to telomere on chrosomal short arm and 5'-terminus of this base sequence : 45151
gacactaaaaaataaccaggaacattaattaaaaaaccaacatagtaatcataatcccttatcagggactataaagctttttatcagtgtttttcaatgttggctgtgttttaatatcctctaggaaactctaacacacacacgcacacacacacacacacacacacacacacacacacacacagtgcctgggctctacct

SEQ ID NO: 9522 - DNA, 245 bp, Homo sapiens
  DISD22_0010572
  Located on chromosome 5
  Distance between a terminus base of telomere on chromosomal short arm and 5'-terminus of this base sequence : 173295623
  Distance between 3'-terminus of neighbour sequence of sequence listing upward to telomere on chrosomal short arm and 5'-terminus of this base sequence : 171747
ttatgactagcatttgcatgacaaatatgatgttaaaaaatttttcagttaatctaatcaaaaattatgacaaaactacattgaaaggctggtagaaaggtgtgcgtgtgtgtgtgtgtgtgtgtgtgtgtgtgtgtgtgtgtgttttgagtggatattaaaaagggtgcatcctttttttccaaagtagggagtgatcagaaaatatctaaaactgaaaaatcatgaatacaaccacaatgtgt

SEQ ID NO: 9523 - DNA, 101 bp, Homo sapiens
  DISD22_0010577
  Located on chromosome 5
  Distance between a terminus base of telomere on chromosomal short arm and 5'-terminus of this base sequence : 173378988
  Distance between 3'-terminus of neighbour sequence of sequence listing upward to telomere on chrosomal short arm and 5'-terminus of this base sequence : 83120
acacatttctaagagccaagtatcctattttctttttcaggaaaaggagagagagagagagagagagagagagagagagagagcaagtcacgttcagccat

SEQ ID NO: 9524 - DNA, 114 bp, Homo sapiens
  DISO7_10002092
  Located on chromosome 5
  Distance between a terminus base of telomere on chromosomal short arm and 5'-terminus of this base sequence : 173516584
  Distance between 3'-terminus of neighbour sequence of sequence listing upward to telomere on chrosomal short arm and 5'-terminus of this base sequence : 137495
aacttggatggttagtaggatttagaaactcagaggctgtatagaaactttaagaattagttgtctttcacacacaaacacacacacacgcaccaataatcagtgtacatattc

SEQ ID NO: 9525 - DNA, 142 bp, Homo sapiens
  DISO7_10002094
  Located on chromosome 5
  Distance between a terminus base of telomere on chromosomal short arm and 5'-terminus of this base sequence : 173559510
  Distance between 3'-terminus of neighbour sequence of sequence listing upward to telomere on chrosomal short arm and 5'-terminus of this base sequence : 42812
aagctttacttcaatctctactgcatatatattatatatatatatatatatatatatatatatatatagagagagagagagagagagagagagagcacatagcatataaatcaaaaattatgaggcaagtgaagaaacaaga

SEQ ID NO: 9526 - DNA, 154 bp, Homo sapiens
  D5S1475
  Located on chromosome 5
  Distance between a terminus base of telomere on chromosomal short arm and 5'-terminus of this base sequence : 173606433
  Distance between 3'-terminus of neighbour sequence of sequence listing upward to telomere on chrosomal short arm and 5'-terminus of this base sequence : 46781
actcaagctaagggcctcatagagctcagctccataaaggatggatggatggatggatggatggatggatggatggatggatggatggataaatatataggtaaagggcacccttatgatagaatgagcaaacacaatttttgacccaaaatgc

SEQ ID NO: 9527 - DNA, 113 bp, Homo sapiens
  DISD22_0010586
  Located on chromosome 5
  Distance between a terminus base of telomere on chromosomal short arm and 5'-terminus of this base sequence : 173685552
  Distance between 3'-terminus of neighbour sequence of sequence listing upward to telomere on chrosomal short arm and 5'-terminus of this base sequence : 78965
acttgcaataatctctttgccttgtgtggccctttcggatacacacatgcacacacacacacacacacacacacacacacacacacataatcagagctaagtcacaaaggccg

SEQ ID NO: 9528 - DNA, 344 bp, Homo sapiens
  AC011384.2_375
  Located on chromosome 5
  Distance between a terminus base of telomere on chromosomal short arm and 5'-terminus of this base sequence : 173821107
  Distance between 3'-terminus of neighbour sequence of sequence listing upward to telomere on chrosomal short arm and 5'-terminus of this base sequence : 135442
aggttaccttctggactgtaacaatggctgagctatgtttgtggcagagtgtgcataccctaaagatatgcagatagatagatgatagatagatagatagatagatagatagatagatagatagatagataaagacagtttttaaaataattgtagtcttttatagtttggtgctttctaatttcacatgtatactgagtgaaaacagaattttataatgaaaagaaaagaaatggggccaggtgcagtggctcatgcctgtaatcccagcactttgggaggccaaggtgggtggatcacctaaggccaggagttcaagaccagtctcaccaatacagtgaagc

SEQ ID NO: 9529 - DNA, 156 bp, Homo sapiens
  G08461
  Located on chromosome 5
  Distance between a terminus base of telomere on chromosomal short arm and 5'-terminus of this base sequence : 173821145
  Distance between 3'-terminus of neighbour sequence of sequence listing upward to telomere on chrosomal short arm and 5'-terminus of this base sequence : -306
ttgtggcagagtgtgcataccctaaagatatgcagatagatagatgatagatagatagatagatagatagatagatagatagatagatagataaagacagtttttaaaataattgtagtcttttatagtttggtgctttctaatttcacatgtata

SEQ ID NO: 9530 - DNA, 463 bp, Homo sapiens
  AC011384.2_48566
  Located on chromosome 5
  Distance between a terminus base of telomere on chromosomal short arm and 5'-terminus of this base sequence : 173825973
  Distance between 3'-terminus of neighbour sequence of sequence listing upward to telomere on chrosomal short arm and 5'-terminus of this base sequence : 4672
gctgtactagtcaggatgtttactgtttaaaatgagaagaacagcagctcaaatgatcataggcatgaaagggaatttgttggcttatgtaattaagaagatcaaggggtcaatatggatggcttcaggcatggcttaaaacagagttaaaaaaataatggcactagaaataactgtgtgtgtgtgtgtgtgtgcatgtgcacacgtgtgtatgtgtctgtatttctcatctctgtgtgtgtgcatgcacacccacacatatttatgtgtgtgtctgtatttctttgtgtgtatgtgtgcacatgcatgtgtatgtgtgtgtatctgtatttctgtctttctctctctcctcgccctgccccatctctttcccatccactcaaccgttggttctattttcctctatattaccttttcttccaggttgacctttctcaggagctttggctaacagttacatcag

SEQ ID NO: 9531 - DNA, 249 bp, Homo sapiens
  D5S619
  Located on chromosome 5
  Distance between a terminus base of telomere on chromosomal short arm and 5'-terminus of this base sequence : 173826092
  Distance between 3'-terminus of neighbour sequence of sequence listing upward to telomere on chrosomal short arm and 5'-terminus of this base sequence : -344
tggcttcaggcatggcttaaaacagagttaaaaaaataatggcactagaaataactgtgtgtgtgtgtgtgtgtgcatgtgcacacgtgtgtatgtgtctgtatttctcatctctgtgtgtgtgcatgcacacccacacatatttatgtgtgtgtctgtatttctttgtgtgtatgtgtgcacatgcatgtgtatgtgtgtgtatctgtatttctgtctttctctctctcctcgccctgccccatctct

SEQ ID NO: 9532 - DNA, 407 bp, Homo sapiens
  AC011384.2_43105
  Located on chromosome 5
  Distance between a terminus base of telomere on chromosomal short arm and 5'-terminus of this base sequence : 173831436
  Distance between 3'-terminus of neighbour sequence of sequence listing upward to telomere on chrosomal short arm and 5'-terminus of this base sequence : 5095
aatcagccatgtaaactgtaatacacacattgaaaacataaccaatgtgacccataagtaaatttcctaaatatttgcttacttcttatttacagtttgcaaatctctcataaactagataggtcctcagaccattctgcatttccttgtatataaagataaacacacacacacacacacacacacacacacgcacacacacacacaacacacactcaaacgcatatatatatacaaacatcaaataaacttttgtgtcttttatgaaaaatacgacacattgagtggaaggatcatatatttcctcttccatttctaaagcatttcaattttgaaagagcaatagagatacaccctctcacatctgagtttagaatactgaggtccagataggttaagtaattggt

SEQ ID NO: 9533 - DNA, 188 bp, Homo sapiens
  D5S496
  Located on chromosome 5
  Distance between a terminus base of telomere on chromosomal short arm and 5'-terminus of this base sequence : 173940335
  Distance between 3'-terminus of neighbour sequence of sequence listing upward to telomere on chrosomal short arm and 5'-terminus of this base sequence : 108492
tgcacagacaggcagagaccatggtgtgtgtgtgtgtgtgtgtgtgtgtgtgtgtgtgtataaaaatatatatttcaaataaaagcatttattcaacttgttgaaaattcaacaatattgttcatcaccatgtacacagaaaaacatcacataggttgatggaattttttatgttgttccagattgtt

SEQ ID NO: 9534 - DNA, 255 bp, Homo sapiens
  DISD22_0010598
  Located on chromosome 5
  Distance between a terminus base of telomere on chromosomal short arm and 5'-terminus of this base sequence : 174069114
  Distance between 3'-terminus of neighbour sequence of sequence listing upward to telomere on chrosomal short arm and 5'-terminus of this base sequence : 128591
cctccttgcaacttaagtgtctttaaaataaaaacattttgtcaccgcttaaaaggaaataccagtataaacaagtaaaattacacacacgcaatcacacacacatacatgtttgtatatatgtatgtacgtatatattcgtatatatgtatatatttgtatatatatccgtatatgcgagtgtgtgtgtgtgtgtgtgtgtgtgtgtgtgtgtgtgtgtgtgtagagagagagaggaatataagcaatgaaatg

SEQ ID NO: 9535 - DNA, 415 bp, Homo sapiens
  AC011389.5_104174
  Located on chromosome 5
  Distance between a terminus base of telomere on chromosomal short arm and 5'-terminus of this base sequence : 174157173
  Distance between 3'-terminus of neighbour sequence of sequence listing upward to telomere on chrosomal short arm and 5'-terminus of this base sequence : 87804
ctgctaagtttgcttctggtagaagactggtgagaaggttccaatggggggaaataaaccaaatagactaattctccagtcctgataatcagtcttttggtattcacagcaacaaatcagctcccctcagagaggcagttataaaatatcaaagcctctgactctcctctgtggggctaatccagaaaatcttactttagaaataacaataataataataataataataataataatacctcattcatctttacttatcatgtgctagtatgtttctaagccttttggcatagccttcaatgtccctttctgaatatagaaaaaactcccagacttcactgcaaaatgctaattccagctctggggacaagaatgacgtcaggaaggtgaactgctatggagatcatacatttct

SEQ ID NO: 9536 - DNA, 121 bp, Homo sapiens
  D5S2052
  Located on chromosome 5
  Distance between a terminus base of telomere on chromosomal short arm and 5'-terminus of this base sequence : 174214722
  Distance between 3'-terminus of neighbour sequence of sequence listing upward to telomere on chrosomal short arm and 5'-terminus of this base sequence : 57134
gagcaatactatactatttcaggcatgcatgcacgcatgtgtgtgtgtgtgtgtgtgtgtgtgtatgtgtgaaagacagagaattggtcaaagctgtgctttgaaaagaccactctgggta

SEQ ID NO: 9537 - DNA, 395 bp, Homo sapiens
  AC011389.5_221310
  Located on chromosome 5
  Distance between a terminus base of telomere on chromosomal short arm and 5'-terminus of this base sequence : 174259422
  Distance between 3'-terminus of neighbour sequence of sequence listing upward to telomere on chrosomal short arm and 5'-terminus of this base sequence : 44579
gttaaatcttccattgcagaccaattaaaatttaaagattttctctctctttccccctcttctctctctctctctctctctctctctcacacacacacacacacacacacacaactctccaagcacaaagagctgacaacaacctagtgtttactattagaaacaggatttgaaaattcaaagaaagaaaagttaattcttcacctccatttgtcttttcctccccaaagttccctaaatgagagactgctttaccaggaagcctgagtgcctcccacccaaccgttcctgttgctggacatgagagtcgagccccttggcctttttgcagagtgtctggatacacatacatggtgcctgaggcatgccctgggcacttggtaagccaggctact

SEQ ID NO: 9538 - DNA, 372 bp, Homo sapiens
  AC011389.5_211955
  Located on chromosome 5
  Distance between a terminus base of telomere on chromosomal short arm and 5'-terminus of this base sequence : 174268749
  Distance between 3'-terminus of neighbour sequence of sequence listing upward to telomere on chrosomal short arm and 5'-terminus of this base sequence : 8932
attgtttgaggctgtagtgagctatgatcatgccactgcactccagcctggctgatagaatgagattctgactcagaaaaatataaacacacacacacacacacacacacacacacacacacacacacacacacacacacaactttctgtctgcccccttgctcttcctgtcccatctctgcctttcttctttcctctctttgtcaaatctccttcgtctgcctcacaaaggccagtgagccccagccgcagaccagggaagccagcaaattaggaattttcttcacaaagttttgagtagctatttttcccacgtgcttctcaggctgtgagataaatccccaagtctcctgttgagtgctgagtaagaaa

SEQ ID NO: 9539 - DNA, 232 bp, Homo sapiens
  D5S400
  Located on chromosome 5
  Distance between a terminus base of telomere on chromosomal short arm and 5'-terminus of this base sequence : 174268794
  Distance between 3'-terminus of neighbour sequence of sequence listing upward to telomere on chrosomal short arm and 5'-terminus of this base sequence : -327
gcctggctgatagaatgagattctgactcagaaaaatataaacacacacacacacacacacacacacacacacacacacacacacacacacacacaactttctgtctgcccccttgctcttcctgtcccatctctgcctttcttctttcctctctttgtcaaatctccttcgtctgcctcacaaaggccagtgagccccagccgcagaccagggaagccagcaaattaggaa

SEQ ID NO: 9540 - DNA, 271 bp, Homo sapiens
  D5S2043
  Located on chromosome 5
  Distance between a terminus base of telomere on chromosomal short arm and 5'-terminus of this base sequence : 174389906
  Distance between 3'-terminus of neighbour sequence of sequence listing upward to telomere on chrosomal short arm and 5'-terminus of this base sequence : 120880
cttagattcagaccatcaggcctttcaaaagcacaggaacctactttacctcgcccaactctacggatgggataggaacttacaaggacatttcctcattggattccaatgttcattctccccttctctctctcaattaatctccccctcttctctttctatctacatacacacacacacacacacacacacacacacagagagagagagagagagagaaacagtttgcttcacagcgggaagcaggggaagggtatctatttccggcaag

SEQ ID NO: 9541 - DNA, 140 bp, Homo sapiens
  Z67278
  Located on chromosome 5
  Distance between a terminus base of telomere on chromosomal short arm and 5'-terminus of this base sequence : 174403242
  Distance between 3'-terminus of neighbour sequence of sequence listing upward to telomere on chrosomal short arm and 5'-terminus of this base sequence : 13065
ggatcgaggaacaatttcccatcccattctatttcactcacatacacacacacacacacacacacacacacccttacctcacatagggatgtacaaactttgaatggagtaatggagcagtaatgtctgttttaatcgcc

SEQ ID NO: 9542 - DNA, 234 bp, Homo sapiens
  D5S2075
  Located on chromosome 5
  Distance between a terminus base of telomere on chromosomal short arm and 5'-terminus of this base sequence : 174460214
  Distance between 3'-terminus of neighbour sequence of sequence listing upward to telomere on chrosomal short arm and 5'-terminus of this base sequence : 56832
ggtgtgttggcctctggaccactatctttctctgttttacatacacatacatacacacacacacacacacacacacacacacacacacacacacacatcggcaccaagtccatcctgaaaagaattcaacgtcatctccaagttagagccagtataggatgaacagaggtagttacctaacacaaataacatattttcaattgtggatgaaggcaaagggctccacattcacac

SEQ ID NO: 9543 - DNA, 193 bp, Homo sapiens
  DISD22_0010603
  Located on chromosome 5
  Distance between a terminus base of telomere on chromosomal short arm and 5'-terminus of this base sequence : 174624189
  Distance between 3'-terminus of neighbour sequence of sequence listing upward to telomere on chrosomal short arm and 5'-terminus of this base sequence : 163741
cctaagagacagacccggggccaggcacctggctgatgggtgaggttcagggggcagtagattggccccagggagactgtgtgtgtgtatgtgtgtgtgtgtgtgtgtgtgtgtgtgtgtgtgtgtgtgatgtgcgtgcgtgcgtgtgtgtgtgtgtgtgtccctgtgtgtggtgcattgtgatttcattcga

SEQ ID NO: 9544 - DNA, 259 bp, Homo sapiens
  HUMUT7277
  Located on chromosome 5
  Distance between a terminus base of telomere on chromosomal short arm and 5'-terminus of this base sequence : 174760493
  Distance between 3'-terminus of neighbour sequence of sequence listing upward to telomere on chrosomal short arm and 5'-terminus of this base sequence : 136111
tcctcccatcctccatcaatccatccatttgttaggcccctactctatgccaggtcttgtgctgggtgctgcacattctttctttctttctttctttcctttctttcctttctttctttctttcctttctttctttctttctttctttctttctttctttctttctttctttctttctttctttctttctttctttctttttctttccttctttccttctttcttctttttttttgagacggagttttgctcttgttgc

SEQ ID NO: 9545 - DNA, 421 bp, Homo sapiens
  AC008660.3_145335
  Located on chromosome 5
  Distance between a terminus base of telomere on chromosomal short arm and 5'-terminus of this base sequence : 174905871
  Distance between 3'-terminus of neighbour sequence of sequence listing upward to telomere on chrosomal short arm and 5'-terminus of this base sequence : 145119
ccatagtcaaagccagcacaaagccagcaaatgccaggagcccgccacagtattgcaagtcccccaagggccattcctccaccaaggccaggccccatccttgttgggtcacaagcaccctcttaacatttccaggcttatattttatcatagtcaatttattattattattattattattattattatatatttttgcgatggggtctcactcacacccagactggagtgcagtggagtcatcatggcccactgaagtctcagcctcctgggttcaagtgatcctcccacctcagcctcccgagtaactgggaccacaggtgcgcaccaccaagcccagctaatttttttagttttaaaatttttatagagatgaggtcttcccatgttgcccaggctggtcaatttgtttcttttaatg

SEQ ID NO: 9546 - DNA, 398 bp, Homo sapiens
  AC008660.3_201720
  Located on chromosome 5
  Distance between a terminus base of telomere on chromosomal short arm and 5'-terminus of this base sequence : 174923957
  Distance between 3'-terminus of neighbour sequence of sequence listing upward to telomere on chrosomal short arm and 5'-terminus of this base sequence : 17665
gtgccttagacagaattaggagtgctagaccaaagtctgcagggatgggggctgaagtgctaaggtcttaggaatttcttctggggataaataggtgcaaagattaatgacttgtaggaaattgtatccatccaaccatccatccatccatacatcaatccatccatccacccacccactcatgcatccatccatccatccatccatccatccatccatccatctatccattcaatgttctccaagcacattcgctataccagggactgtgccaagtgccaagggagccactgacacctggttcctgccctcagaactcagtctacagaaagccagacaagtaaagagaaaaaggcaacacatgggtaagtgtcccatactgtaagaacgcacatgat

SEQ ID NO: 9547 - DNA, 290 bp, Homo sapiens
  Z16542.1_201
  Located on chromosome 5
  Distance between a terminus base of telomere on chromosomal short arm and 5'-terminus of this base sequence : 174998156
  Distance between 3'-terminus of neighbour sequence of sequence listing upward to telomere on chrosomal short arm and 5'-terminus of this base sequence : 73801
aaccttaggcaagatgttcataaaccctttaatctctagtgcccttgttcataaaaagaagtgaatcggatccctgcaggactgtttttgtattcagtgcacaggtgtgtgtgaagacacccagcatgttgccaggcacacagagatgtctaccttgatacttttctctcctcctccccgcaaatacacacacacacacacacacacacacacacacacactcacacactcttattttgatctcggcctgaggctgacaagccccagattagtgatcagtgacaatttcg

SEQ ID NO: 9548 - DNA, 338 bp, Homo sapiens
  AC008479.3_142624
  Located on chromosome 5
  Distance between a terminus base of telomere on chromosomal short arm and 5'-terminus of this base sequence : 175060395
  Distance between 3'-terminus of neighbour sequence of sequence listing upward to telomere on chrosomal short arm and 5'-terminus of this base sequence : 61949
gacaaactattctggatgagaacagaggagggacatgggcaaatttttgtttttgttcctgaatgggaggaggactggtgagtgagggggaaagaatggagacaggactgagaagaaccagaaattaaaataatagtagtaatagcctaacatgtacacgtatatgagatctatctatctatctatctatctatctatctatctatctatctatctatctatcatctatatatctatcatccatcatgtatctatctatttgcatatataagctataatatctggctctgttctaattgttttacttacattaactcattcaatcttcatatgaatct

SEQ ID NO: 9549 - DNA, 474 bp, Homo sapiens
  AC010218.4_218451
  Located on chromosome 5
  Distance between a terminus base of telomere on chromosomal short arm and 5'-terminus of this base sequence : 175150686
  Distance between 3'-terminus of neighbour sequence of sequence listing upward to telomere on chrosomal short arm and 5'-terminus of this base sequence : 89953
ctgagtaagtggtcaataggatagcagatcccaagaaaagaggcatttgtatttctctaagaatacaaagcacttggatgacgggagggagagcatcaggaaaaatagctaagggatgctgggcttaatacctaggtgatgggatgatctgtgcggatctgtgagcaagccactatggcacacatttacttacgtaataaatctgcacatcctgcacatgtaccattgaacttaaaagttgaaaaaatagaatacaaagctcttcctgactgctcaaagctcaaggtgttgcctttttcaaatgggatgcaatagcctactcattttccaagattaaagctagagagaagaatgaatgaataaataaataaataaataaataaataaatgagcaaagttaatattagctggaaaaaatagggtacaggtggaaggaatgaacccatattgagagtccactatgtgtcaaattcc

SEQ ID NO: 9550 - DNA, 369 bp, Homo sapiens
  AC010218.4_240690
  Located on chromosome 5
  Distance between a terminus base of telomere on chromosomal short arm and 5'-terminus of this base sequence : 175191470
  Distance between 3'-terminus of neighbour sequence of sequence listing upward to telomere on chrosomal short arm and 5'-terminus of this base sequence : 40310
aatgcatacaggaatcatacacacaggtaatataaatgtcttcttatatctggcccttttgagaaaagccgatgataaagtgacaggccttggtgaactggaaaaagcatacccagtataagatccaaggaactggtggattgttgacatgaggagtatggacacaaaatagccaaatctgatttttcaaaatacactggaaatccacattgtgtgtgtgtgtatgtgtgtgtgtgtgtgtgtgtgtgtgtgtgtgtgtgtaaattcccaagtttccagctttaaatcaaatattttttttttcttctgcactgtgtgtgggccaaacagcacaatggtgggccactaatttgcaaacctacaacttat

SEQ ID NO: 9551 - DNA, 194 bp, Homo sapiens
  D5S1456
  Located on chromosome 5
  Distance between a terminus base of telomere on chromosomal short arm and 5'-terminus of this base sequence : 175223995
  Distance between 3'-terminus of neighbour sequence of sequence listing upward to telomere on chrosomal short arm and 5'-terminus of this base sequence : 32156
tatcgaattgtaaccccgttgtaggtcaaggagcatctgcatatatacatacatagatgatagatagatagatagatagatagatagatagatagatttaattctaaactttccaaatactctttcatttaaatgattatagttttacaacaatttcatatattctataggtaggagaattagggttttccaga

SEQ ID NO: 9552 - DNA, 341 bp, Homo sapiens
  AC008680.3_163625
  Located on chromosome 5
  Distance between a terminus base of telomere on chromosomal short arm and 5'-terminus of this base sequence : 175277436
  Distance between 3'-terminus of neighbour sequence of sequence listing upward to telomere on chrosomal short arm and 5'-terminus of this base sequence : 53247
tttgcttccaatctacaagactgcattattattattattattattattattattattattattattattattattattgagatgggggtttctctttgttgcccagtctggtctccaactccagggcccaagcagtcctcctgcctcagccttccaagtacctgggattacagatgcatgccaccttgccgggctttcaatagttttaaaatcttccccaccacccccaataaagaagtgaaaagagcactggcttttgaattagaaagttattccctgcttctgctacccactagtggagtcatcttgggtatgtaagctttaggtttctcatctgttaa

SEQ ID NO: 9553 - DNA, 293 bp, Homo sapiens
  AC008680.3_19103
  Located on chromosome 5
  Distance between a terminus base of telomere on chromosomal short arm and 5'-terminus of this base sequence : 175383197
  Distance between 3'-terminus of neighbour sequence of sequence listing upward to telomere on chrosomal short arm and 5'-terminus of this base sequence : 105420
ccttaacgtttgatagttgcacacaaccctcaactacatggttttcctcagggtccgagagacacaggacctaatgaataaaagggccttggttggtacatgctctccattctgactttgaacgtgtttgttgttgttgttgttgttgttgttgttttcaatttttattgccctagaatgtttttgtaaaggggccatgttacatatgcctggaagaagtagaggtcaaggtgaaatatttgtgatttctcacttcattgtttgtgttactacaggctccaacatagttacat

SEQ ID NO: 9554 - DNA, 181 bp, Homo sapiens
  D5S504
  Located on chromosome 5
  Distance between a terminus base of telomere on chromosomal short arm and 5'-terminus of this base sequence : 175398746
  Distance between 3'-terminus of neighbour sequence of sequence listing upward to telomere on chrosomal short arm and 5'-terminus of this base sequence : 15256
atttgtaagttttaaggctcccccaacccaataaatgtgtgtgtgtgtgtgtgtgtgtgtgtgtgtgtgtgtgtgtgtgttgaatcgttctaacacaccttccaaaatgcatgggaaagttgtcaacttcttttctcatggtgtgttaaaagaatttggcatccaataaagtacctctggg

SEQ ID NO: 9555 - DNA, 176 bp, Homo sapiens
  D5S1961
  Located on chromosome 5
  Distance between a terminus base of telomere on chromosomal short arm and 5'-terminus of this base sequence : 175429379
  Distance between 3'-terminus of neighbour sequence of sequence listing upward to telomere on chrosomal short arm and 5'-terminus of this base sequence : 30452
cccatgaatgatttgtctaatgcgttgaatatgcacgtgtggttttgggtgcatgtatgtttacacacacacacacagactctctctctctctcacacacacacacacacacacacacacacacacactcatgcctctcctttgaagaggatcagatatggacagcaaagggcatt

SEQ ID NO: 9556 - DNA, 460 bp, Homo sapiens
  chr5.fa.O7frz.190502940
  Located on chromosome 5
  Distance between a terminus base of telomere on chromosomal short arm and 5'-terminus of this base sequence : 175541906
  Distance between 3'-terminus of neighbour sequence of sequence listing upward to telomere on chrosomal short arm and 5'-terminus of this base sequence : 112351
ttagcaacctatttgttagcagcacatgcgtgcgtgtgcatgcacgtgggcacacacacacacacacacacacacacactctttgcaggggaattttgagccagaaatttatctgtaggcccatattcattcctttttgcacatttctattgtgaccttgggcacgtctctatccctctttgagccactgttttctcatctgataaaagaaggataatattgcttcaaagaaggttaataggactaagtaaggcactgaatatgcatgtattttataagttttaaagtgccttaaaaatgtgagtaactgtgtttaggtaaaaacatatatggcatgtttcttaaagtttctcttctctgttatttgcatagatgttatgcaacttgtgttgtagatagtttgccaaggagaattttatcctgcaggcctcagccagtcagtatatgagctaagatggaa

SEQ ID NO: 9557 - DNA, 440 bp, Homo sapiens
  AC026695.3_105356
  Located on chromosome 5
  Distance between a terminus base of telomere on chromosomal short arm and 5'-terminus of this base sequence : 175663844
  Distance between 3'-terminus of neighbour sequence of sequence listing upward to telomere on chrosomal short arm and 5'-terminus of this base sequence : 121478
cttacagagtcagaatgttaggagaggattgatagcttttggtggggggaaggtatagtgatcttgttaaaaacagctgagctgttaactgttttcactgtttgtaagataatacacaaatacacacacatgtgcttgcaccaagagacacctaatacctgccccgcgtgtacctccacatagatgtttgccaatgcctatgcccaagacacacacacatacacacacacacacacacacaggatacattcaagcacacactaatgtatgtgcacttgcctgcacagagtccacatcacacaggcccccgtctagatccacatatatcttccagattgtatcaaatggaagatgccatcgatcatacaccattctttttattgtgccatgtcatgattccttcagggccaactgcagttataagatgccattaggtgtaa

SEQ ID NO: 9558 - DNA, 259 bp, Homo sapiens
  D5S1973
  Located on chromosome 5
  Distance between a terminus base of telomere on chromosomal short arm and 5'-terminus of this base sequence : 175679341
  Distance between 3'-terminus of neighbour sequence of sequence listing upward to telomere on chrosomal short arm and 5'-terminus of this base sequence : 15057
cagggtgtgcatgtgtggatgcatgtatatgtgtatctatgtgtgtatgtatatgagtgtgtgtgtgtgtgtgtgtgtgtgtgtgagagagagagagagagagacagagagagtgagtcagtcaattcccagggccttctcactgtagagatcagtcatcttcagaaacatccagactcagggtaagggagtaaggaggctataatttcacagaaatggttttaaaagatgaccaagaagacaattagcaacatagcag

SEQ ID NO: 9559 - DNA, 329 bp, Homo sapiens
  HUMUT886B
  Located on chromosome 5
  Distance between a terminus base of telomere on chromosomal short arm and 5'-terminus of this base sequence : 175725232
  Distance between 3'-terminus of neighbour sequence of sequence listing upward to telomere on chrosomal short arm and 5'-terminus of this base sequence : 45632
atgtgtatcgtgtgttattgctgcttgcatggtgcctgacacatagttggcactcaatcaatgttagcttctcctcctcctcctctcttctttctttctttcttttctctttctatctttcttttctttctttttctttctctttcttttctttctttctttctttctttgctttctttctttctttctttctttctttctttctctttctttctttcttctttctttttttctaccattaggagaataatgtcatcttggtctacaaatacagagttgccaaaaatgtagatgcttactactagaaaggattgtcctaattaaatcca

SEQ ID NO: 9560 - DNA, 446 bp, Homo sapiens
  AC027312.3_1106
  Located on chromosome 5
  Distance between a terminus base of telomere on chromosomal short arm and 5'-terminus of this base sequence : 175861987
  Distance between 3'-terminus of neighbour sequence of sequence listing upward to telomere on chrosomal short arm and 5'-terminus of this base sequence : 136426
aggtgcttaaattgtttctgtttggtttggtgtggtgtgatgtggtgtggtgtggtgtggtgtggtgtggtgtggtgtggtgtggtgtggtgtggtgtggtgtgatgtgatgtggtgtgcggtgcggtgcggtgcggtgcggtgcggtgtggtgtggtatgggttgaggctggccttaggagcctgttggccttccaggccagtcctgaagcccagcccagagcaccagactctgcagtcagtcagtggagggcccacatctcagccaatgcatggctttgggtggtgacttcatctcccctagtgttcctttccccctctgcaaaatgggaatggggatggctcagaactcccagcgggagttaggaggaataatgtataggaagtatgagcagagtgcctggcctggagcatagcgcatggccgatcataggtaagtgctggtg

SEQ ID NO: 9561 - DNA, 222 bp, Homo sapiens
  AC027312.3_10203
  Located on chromosome 5
  Distance between a terminus base of telomere on chromosomal short arm and 5'-terminus of this base sequence : 175871126
  Distance between 3'-terminus of neighbour sequence of sequence listing upward to telomere on chrosomal short arm and 5'-terminus of this base sequence : 8693
caggatactgaatgcaaacaggccctgaggccatctgatgtgctcgttcccatagccccgctgtgtgtgtgcgcgtgtgtgtgtgtgtgtgtgtgtgtgtgtgtgtgtgtgtgtgtgtgtttggtggggtgggaggggaggcagaagaggaagagagggcagagagccaaagactgaggccccggcccataagtaaggcagtttgcagatctcaatatcctg

SEQ ID NO: 9562 - DNA, 232 bp, Homo sapiens
  D5S625
  Located on chromosome 5
  Distance between a terminus base of telomere on chromosomal short arm and 5'-terminus of this base sequence : 176015305
  Distance between 3'-terminus of neighbour sequence of sequence listing upward to telomere on chrosomal short arm and 5'-terminus of this base sequence : 143957
atgattctggggatgtgtctgtctgtccatctgtctctctccacacacacacacacacacacacacacacacacacacacacacacatcctgttagttctgtttacctggagaaccttgactaacatacccattaaaaccaaaatatgtccttcagggtgttaatgtttggttgaagaaacacagaagtttaacaattgtatcaggctgggcacggcctataatcccagcat

SEQ ID NO: 9563 - DNA, 469 bp, Homo sapiens
  AC008815.3_63369
  Located on chromosome 5
  Distance between a terminus base of telomere on chromosomal short arm and 5'-terminus of this base sequence : 176095400
  Distance between 3'-terminus of neighbour sequence of sequence listing upward to telomere on chrosomal short arm and 5'-terminus of this base sequence : 79863
accatgatcatgccagtacactccagcctcggtgaaaggcctgtctcaaaataaaaaagaaaaagaaaaataacaagaaacaaaatttgggaggaaatatttttcaaaattatagattgaagaaatattatttaagaaagtaactctttcttaaaatataattaatgagacataaaatatatgaaaggaaaatctagtcttaagtgttttgttttgttttgttttgttttgttttgttttgttttgtttgagaaagagtatcgctctgtcgcccaggcttgagtgcagtggcacgatctcagctcactgcaacctccacctcccttagttcaaacaattcccctgcctcagcctcctgagtagctaggattacaggcgcctgccaccacgtctggctaattttttttgtatttttactagaaacagggtttcaccatgttggccagactagtcttgaactcctgacctc

SEQ ID NO: 9564 - DNA, 133 bp, Homo sapiens
  D5S653
  Located on chromosome 5
  Distance between a terminus base of telomere on chromosomal short arm and 5'-terminus of this base sequence : 176311380
  Distance between 3'-terminus of neighbour sequence of sequence listing upward to telomere on chrosomal short arm and 5'-terminus of this base sequence : 215511
ggccatgttgaacttgtagaaccaaatgattgctaattacttggggcgatactagtgatatattatcttacatacacacacacaaaacacacacacacacacacacacacacacggcttgagtccagcatggc

SEQ ID NO: 9565 - DNA, 326 bp, Homo sapiens
  chr5.fa.O7frz.191860390
  Located on chromosome 5
  Distance between a terminus base of telomere on chromosomal short arm and 5'-terminus of this base sequence : 176405858
  Distance between 3'-terminus of neighbour sequence of sequence listing upward to telomere on chrosomal short arm and 5'-terminus of this base sequence : 94345
attctttactcaaatttgtagcagttaacatgctccacttgggtttcagaaaggaaatttcattctctatcaggccctctgttggtggttggcctttattacataatcatcaaacatgagaaaactaaaaatatctagagtgtgtgtgtgtgtgtgtgtgtgtgtgtgtgtgtgtgtgtgtattttgaggtcctttttttaaatatactttaagttctgggatacatgtgcagaacgtggaggtttgttacataggtacacgcgtgccatggtggtttgctgcacccatcaacccatcatctacatcaggtatttctcctaatgct

SEQ ID NO: 9566 - DNA, 432 bp, Homo sapiens
  chr5.fa.O7frz.192080124
  Located on chromosome 5
  Distance between a terminus base of telomere on chromosomal short arm and 5'-terminus of this base sequence : 176505256
  Distance between 3'-terminus of neighbour sequence of sequence listing upward to telomere on chrosomal short arm and 5'-terminus of this base sequence : 99072
gatgaagtgaaactgacctaatacttttcaaactttctttttcttcaaaatagccaggtttgtttgagataaaaataaagtttagtttgatcaagtgtgtgtgtgtgtgtgtgtgtgtgtgtgtgtgtgtgtgcgcgcgcgcgcgcgtgcgcaaaatctaactactgaggatcaaaataaaataagaggtctgggactggacaaaagtatctaggtaacaaccaggtaataaaagtccaaaagagagtaaacctcttaagaatgaaaaatttgtgaccattgcctcaagagatccgtttagaaagttaatgcttataatttaaaaatagagaaacactagtttttttaatattaagatgacattttacctatgatgttatgaaagtacttatctatcttttcaagaatgatctagtccagatcctttgttat

SEQ ID NO: 9567 - DNA, 193 bp, Homo sapiens
  chr5.fa.O7frz.192286353
  Located on chromosome 5
  Distance between a terminus base of telomere on chromosomal short arm and 5'-terminus of this base sequence : 176815340
  Distance between 3'-terminus of neighbour sequence of sequence listing upward to telomere on chrosomal short arm and 5'-terminus of this base sequence : 309652
taagatcatttgtccatgttattctctacctgttggttccttcctcattgaaaattggtgtatagatggtagatagatagatgatagatagataggtagatagatagatagatagatagatagatagatagatagatagatagatagatttttatttttggtctatctcctttactaaacagtaagctccatg

SEQ ID NO: 9568 - DNA, 135 bp, Homo sapiens
  D5S462
  Located on chromosome 5
  Distance between a terminus base of telomere on chromosomal short arm and 5'-terminus of this base sequence : 177002975
  Distance between 3'-terminus of neighbour sequence of sequence listing upward to telomere on chrosomal short arm and 5'-terminus of this base sequence : 187442
ttcattcatccactcaaacagatacacacacacacacacacacacacacacacacccttttcaccccttggtagtgtacagtctctgagttgtaaaaaatagtcattcctttctgcttgaaagactgtattagct

SEQ ID NO: 9569 - DNA, 174 bp, Homo sapiens
  D5S429
  Located on chromosome 5
  Distance between a terminus base of telomere on chromosomal short arm and 5'-terminus of this base sequence : 177144174
  Distance between 3'-terminus of neighbour sequence of sequence listing upward to telomere on chrosomal short arm and 5'-terminus of this base sequence : 141064
tgtgtaccagcatggttgataaaccaccaaatcgtgaaactttgcttgctccccaaacccccaaccacacacacatacacacacacacacacacacacacacacacacacacacacacacacacacacacacaacctgggaaattgggaagaaaactggcaaaccttaaactag

SEQ ID NO: 9570 - DNA, 238 bp, Homo sapiens
  D5S425
  Located on chromosome 5
  Distance between a terminus base of telomere on chromosomal short arm and 5'-terminus of this base sequence : 177353925
  Distance between 3'-terminus of neighbour sequence of sequence listing upward to telomere on chrosomal short arm and 5'-terminus of this base sequence : 209577
ctccagcctgctgacctgtcctgcagatttcagacttaccagcccccacaatcgtgtaagccaattccttaaaataactaaatcaatttccctctccctctccctacacacacacacacacacacacacacacacacacacacacacacacacacacatcctctctctatcttggttctgtttctctagagaatccagactaatacggcccagagcggggaagatggcttgcccaaga

SEQ ID NO: 9571 - DNA, 266 bp, Homo sapiens
  D5S1960
  Located on chromosome 5
  Distance between a terminus base of telomere on chromosomal short arm and 5'-terminus of this base sequence : 177392690
  Distance between 3'-terminus of neighbour sequence of sequence listing upward to telomere on chrosomal short arm and 5'-terminus of this base sequence : 38527
ggtttcatctgccaaagcaacctgtgccctagcctcccgacccacacagatgacaccagtgtgtgtgtgtgtgtgtgtgtgtgtgtgtgtgtgtgtgtgtgtgtggtgtatgcagatacactagtgaaaagtctgtttttcctccctctgtctcctagagggagaagagatccacaacatctaaaactacttttatttggttttggcttatttatttatttatttatttatttatttacttttgagacagaatctcaccctgtcgc

SEQ ID NO: 9572 - DNA, 210 bp, Homo sapiens
  HUMUT1158
  Located on chromosome 5
  Distance between a terminus base of telomere on chromosomal short arm and 5'-terminus of this base sequence : 177455032
  Distance between 3'-terminus of neighbour sequence of sequence listing upward to telomere on chrosomal short arm and 5'-terminus of this base sequence : 62076
gtgtctgtcccctctgtaaaatgggcatgtcgatacagtaataatacacccacctccagggctgcaaagcctgtgcagactttaaagtgctttacaaagtgctcgtgtgtgtgtgtgtgtgtgtgtgtgtctgtgtgtgtgtgtgtgtgtgtcccaacaaccgggtgccccaatccagagagagggcaggggttggtgagtgccagggag

SEQ ID NO: 9573 - DNA, 291 bp, Homo sapiens
  AC024561.4_64541
  Located on chromosome 5
  Distance between a terminus base of telomere on chromosomal short arm and 5'-terminus of this base sequence : 177500614
  Distance between 3'-terminus of neighbour sequence of sequence listing upward to telomere on chrosomal short arm and 5'-terminus of this base sequence : 45372
tgacacatcgtaaggacttaataagtgtttgttattattgtaattattattcttgggagctgagccccactcaggcattaactctggagacccctcagcaagatttatctgtcatgtgggaagtttgaatctgatgagctgcaggatcccttctacttattggtacttgtgaatgaccaaaaataaataaataaataaataaataaataaaaataaataaataaataaataaatataaaagctgcagatctcagccatgcttgttgagttcacaaactaatagaagtccaa

SEQ ID NO: 9574 - DNA, 151 bp, Homo sapiens
  HUMUT6535
  Located on chromosome 5
  Distance between a terminus base of telomere on chromosomal short arm and 5'-terminus of this base sequence : 177630409
  Distance between 3'-terminus of neighbour sequence of sequence listing upward to telomere on chrosomal short arm and 5'-terminus of this base sequence : 129504
ccccaccttagctttctgtattttcacaatctccagctgttccatgattgtcagactgatcatcatcatcatcatcatcatcatcattggtttgcacgaccagcaagtgcttgttaaatacctagctggaggactgcactcagaccctgtg

SEQ ID NO: 9575 - DNA, 224 bp, Homo sapiens
  AC011407.4_183169
  Located on chromosome 5
  Distance between a terminus base of telomere on chromosomal short arm and 5'-terminus of this base sequence : 177651164
  Distance between 3'-terminus of neighbour sequence of sequence listing upward to telomere on chrosomal short arm and 5'-terminus of this base sequence : 20604
gctgtaggaaccaaagctcagagaggcaaagctacttgctcaaggtcacacagacaggaagtaaaaagaaggacttactcccaggtccccaggtcctgcccttctctctctctctctctctctctctgtctctctctctctctgtgtctctgtagaaacagggtctcattctgtcacccaggctggagtgcagtggcatgatcatagctcactataaccttgaa

SEQ ID NO: 9576 - DNA, 387 bp, Homo sapiens
  chr5.fa.O7frz.192977059
  Located on chromosome 5
  Distance between a terminus base of telomere on chromosomal short arm and 5'-terminus of this base sequence : 177667166
  Distance between 3'-terminus of neighbour sequence of sequence listing upward to telomere on chrosomal short arm and 5'-terminus of this base sequence : 15778
tgacttcaaatttcattagctaaggagaaaagaatcaggtccgacgtcatatgttagtgatatatttgtgccaaatgagtgttgaatgcaccacgatatgctgctttaacaaaggttttcccagtatttccattagagaaaaatgagtcatcacaatactcagaatatataggcagattgattccaaaaaatctactccaatgcggttgcctccatcctgtccgtgtgagtggagatataatttcagcaaagctgaaaaaaatcagtatatgtatgtgtgtgtatatgtgtgtgtgtgtgtgtgtgtgtgtgtgtgtgtgtatgaattaaaaataaaaagcgccatcaggtctcctgttaatgttaaggtaaactctgtcagctttg

SEQ ID NO: 9577 - DNA, 454 bp, Homo sapiens
  AC011407.4_212424
  Located on chromosome 5
  Distance between a terminus base of telomere on chromosomal short arm and 5'-terminus of this base sequence : 177726061
  Distance between 3'-terminus of neighbour sequence of sequence listing upward to telomere on chrosomal short arm and 5'-terminus of this base sequence : 58508
gcaagataattgtttgaacctgggaggcggaggttgcagtgagctgagatcgcgccactgcactccagactgggtgacagagcgagactgtctcaaacacacacacatacaaacacaaaagcaaacccaaaaagcaaaggaaggagacgggtgttaggaatgccatataccaccagtggctctcagactcgggaaggcaccagaatcacttggagggcttattaaaacacagatcgtggagccccacccgagtttctgatccagtagttctgcggagggggctgaggatgtgcatttctaaaaaagtttcctggtgatgctgctggtttggagaacaacacacacacacacacacacacacacacaatgtatgatatacacgcatatattataggcatatttgttcaagtaatatgtccatatttaggcaaaatcagaccatactgtacatgct

SEQ ID NO: 9578 - DNA, 474 bp, Homo sapiens
  AC034210.2_213639
  Located on chromosome 5
  Distance between a terminus base of telomere on chromosomal short arm and 5'-terminus of this base sequence : 177857405
  Distance between 3'-terminus of neighbour sequence of sequence listing upward to telomere on chrosomal short arm and 5'-terminus of this base sequence : 130890
tatgcattctatctgttgcattaggcccagtgcagtggctcatgcctgtaatccaaatgctttgggaggccaaggtgggaggatcacttgagcccaggagttcaaggccagcttgagaaacatggtgagacctcatctctacaaaaaataaaaaataattagctggttgtgatgcacgtacctgtgatcccagctacttgggaggctgaggtaagaggattgcttgagcccaggaggttgaagctacagtgagccatgatcgtgtcactacatgccagcctgggtgacagagcaagatcttctctcaataaataaataaataaataaataaataaataaataaataaggcccctgttattgcccccaaccaaatggattcatttagatttgttcacagccttgatcttttcctcgaaaggacatttgttcattcacatcccttgctgctgctgaatgacttgacatgagcattt

SEQ ID NO: 9579 - DNA, 442 bp, Homo sapiens
  AC034210.2_296291
  Located on chromosome 5
  Distance between a terminus base of telomere on chromosomal short arm and 5'-terminus of this base sequence : 177921736
  Distance between 3'-terminus of neighbour sequence of sequence listing upward to telomere on chrosomal short arm and 5'-terminus of this base sequence : 63857
ccggtactatcattcacttaatagatttttaaaaattggttcacctaaaaaatactcagaaaactatagattattattaagaggaagcaaaaaatgctaaaataaatgaatagatatatcatattcatggtgggaccactcaatattttaaataagtcaattctctgcaaactgacttatagattcaacacatacacctctaatcaaaatcctaacaggggtgtgtgtgtgtgtgtgtgtgtgtgtgtgtgtgtgtgtttaacttggaaaacaaattctagttttcaaaaaaatgtatgtagaaacccaaagggtaaaggataaccaatttttgaaaaggaagaacttttagccagaagagttgatagctcttctggctatcaaaacctattataaagcgatggtaaataagtgcagtgttggtacaaggatagacaaatag

SEQ ID NO: 9580 - DNA, 442 bp, Homo sapiens; identical to SEQ ID NO: 9579
  AC027309.2_197655
  Located on chromosome 5
  Distance between a terminus base of telomere on chromosomal short arm and 5'-terminus of this base sequence : 177921736
  Distance between 3'-terminus of neighbour sequence of sequence listing upward to telomere on chrosomal short arm and 5'-terminus of this base sequence : -442

SEQ ID NO: 9581 - DNA, 396 bp, Homo sapiens
  AC027309.2_193457
  Located on chromosome 5
  Distance between a terminus base of telomere on chromosomal short arm and 5'-terminus of this base sequence : 177926108
  Distance between 3'-terminus of neighbour sequence of sequence listing upward to telomere on chrosomal short arm and 5'-terminus of this base sequence : 3930
gaacagttgctgaatattagtgagtgaatgaatgcatgaaaggagtaactgaatgaatgaatgaatgaatgaatgaatgaatgatggagtaactgaatgaatgcaagggatgcccaggcagacagctagcgtggagagtgcaggctggcagatggctcagcggggaaggtcagagggggacgaaggccggggccaggctcagccaggccaccttcagcctcgcctcccaggcctctgtgccatctgtaaaatggactcatctaggactctccgagcagcaagcgcctcaccctcctcctggctctgttctggccactggccaaaggcagtcaggctctgaagaccctgcccccactagaaccagggaagaccctgggatgagcggatctgctaata

SEQ ID NO: 9582 - DNA, 472 bp, Homo sapiens
  AC027309.2_176756
  Located on chromosome 5
  Distance between a terminus base of telomere on chromosomal short arm and 5'-terminus of this base sequence : 177942498
  Distance between 3'-terminus of neighbour sequence of sequence listing upward to telomere on chrosomal short arm and 5'-terminus of this base sequence : 15994
aatccttcaagcttcctctagcccctctgctctggaccaggcaggtcaccacggaccttgcacatccagctccaaagccagtctcctctgggatgaactggaccccttttggattctttggccccagtgccttcatttgaccaaacacaacaacttttctgagaacagatctaaagtcttcttccaggagcttcctctatcagggtcttttttgactttgcagggttgggacaaacagtgtcctgatggggctcctgcctcctgttccctccccagtcaatcttccctccctgagatggtttcatgagtgtcccagcacacaacctgccatgctatccatccatccatccacccatccatccatccatccatccatccatccatccatccatccactcatccttccaacaaattgattactcatcttatccttagctgtacaatacggaattactgaaatccatgcacttac

SEQ ID NO: 9583 - DNA, 454 bp, Homo sapiens
  AC034210.2_317173
  Located on chromosome 5
  Distance between a terminus base of telomere on chromosomal short arm and 5'-terminus of this base sequence : 177942498
  Distance between 3'-terminus of neighbour sequence of sequence listing upward to telomere on chrosomal short arm and 5'-terminus of this base sequence : -472
aatccttcaagcttcctctagcccctctgctctggaccaggcaggtcaccacggaccttgcacatccagctccaaagccagtctcctctgggatgaactggaccccttttggattctttggccccagtgccttcatttgaccaaacacaacaacttttctgagaacagatctaaagtcttcttccaggagcttcctctatcagggtcttttttgactttgcagggttgggacaaacagtgtcctgatggggctcctgcctcctgttccctccccagtcaatcttccctccctgagatggtttcatgagtgtcccagcacacaacctgccatgctatccatccatccatccacccatccatccatccatccatccatccatccatccatccatccactcatccttccaacaaattgattactcatcttatccttagctgtacaatacggaattac

SEQ ID NO: 9584 - DNA, 454 bp, Homo sapiens
  chr5.fa.O7frz.193468187
  Located on chromosome 5
  Distance between a terminus base of telomere on chromosomal short arm and 5'-terminus of this base sequence : 178052632
  Distance between 3'-terminus of neighbour sequence of sequence listing upward to telomere on chrosomal short arm and 5'-terminus of this base sequence : 109680
cttcatagccttcatccttatcttattttgtgattatcttatttctataacccacccatatatagtgccatgagacggcaagtgacaaagtaaaattacttttgctgtttagcgaaaatagcaaaagtaattttagctacttataagtaggaattttgtcttgcaccaaagtatcccctgagactatacttatcaatatttgttgaacacatgaatgaatgaatgaatgaacgaatgagtgaatgaatgcgtgggcctcctgcctagctttaaaagccacattcaaggaaaaggtggctatgagcttatcttccttggcagagcagttttgtccactgtggcgctagcagagagcacaccctttgttctccacggggtggaagacacctcctcggtgggcagaggggagcagggctgctggtctgcacctacaggctgttctcaaacaggctca

SEQ ID NO: 9585 - DNA, 429 bp, Homo sapiens
  AC021159.4_176618
  Located on chromosome 5
  Distance between a terminus base of telomere on chromosomal short arm and 5'-terminus of this base sequence : 178260125
  Distance between 3'-terminus of neighbour sequence of sequence listing upward to telomere on chrosomal short arm and 5'-terminus of this base sequence : 207039
agatactcataggtagtctgcctcagggttcccccttagccttcaggcttgcagtcactcaccctgtgactgagccagttgcatagcagtttccatgccccagggcctcagtttcccctcaggcgatgtgctttcctgtgtacctcaatacacacattgtctccctctggtctgggccagccccatgaaaggagagttgagactgggtgccaggtgtctgtgagtcataagcatttgggttccaaattgtgtgtagatgaatacagatgtgttttgtgtgtgtgtgtgtgtgtgtgtgtgtgtgtgtgtggttattttttattttttgcttcattgcacgtaagtcacattttcctatcttctgatccaagctctaaaagcgttttgtggtataaaatctcccatcatctgatccactctaccgaaata

SEQ ID NO: 9586 - DNA, 409 bp, Homo sapiens
  chr5.fa.O7frz.193641361
  Located on chromosome 5
  Distance between a terminus base of telomere on chromosomal short arm and 5'-terminus of this base sequence : 178293822
  Distance between 3'-terminus of neighbour sequence of sequence listing upward to telomere on chrosomal short arm and 5'-terminus of this base sequence : 33268
gagccattgtcatgctactgcactccagcctgggcaacagagtgagattccatcaaaaaaagaaaaaagaaagaaagaaagagagaggaaggaaggaaggaaggaaggaaggaaggaaggaaggaaggaaggagaaagtagaaatgaacttctttctctaattttgttctgacctcatcccttcttagctactcaattcagttgcacagttatttattgagcacattctatgtataaagtcctcccggaaacaaagatcagtgaaacagtgcctattctcaaggagttggccctctagtagagggttggtcaagatacatatacaacaaggccaaagagatgcgctaacaggatgaaatgggtcttggagaaggcggtgtttgggctagaacttaaggaccataggatt

SEQ ID NO: 9587 - DNA, 300 bp, Homo sapiens
  chr5.fa.O7frz.193888832
  Located on chromosome 5
  Distance between a terminus base of telomere on chromosomal short arm and 5'-terminus of this base sequence : 178452903
  Distance between 3'-terminus of neighbour sequence of sequence listing upward to telomere on chrosomal short arm and 5'-terminus of this base sequence : 158672
cctcatgactaaatgcagttagattttctggtaagaatacatcatacaaccttttcattccatcagtcaagaggcacataatatcagattgtctcattatttgtcatgctaagtttgatcacatggttaagcttgtatatatgtatacacacacacacacacacacacacacacacacacacttttttttgtttgtttttggagacggagtcttgctctgtcaccctggctggagtgcagtagtgcaatctcagctcactgcaacctctgcctcctaggttcaagtggttctcctatctc

SEQ ID NO: 9588 - DNA, 349 bp, Homo sapiens
  AC010257.4_118337
  Located on chromosome 5
  Distance between a terminus base of telomere on chromosomal short arm and 5'-terminus of this base sequence : 178487223
  Distance between 3'-terminus of neighbour sequence of sequence listing upward to telomere on chrosomal short arm and 5'-terminus of this base sequence : 34020
agagttaaggcctcagttataaagtggcagatcatcatgggaccaagttataaaaaactagctgcacatctcagaccagcttaatgagtggattccaagttaaagtgtggatctaagtatagatccacactgtgtacacacacacacacacacacacacacacacacataattttgtaggctgtatatcatccttaaacaattcctggccccaaaagacactcggtgcagattgtgcacacatgtgtcttatttatagtcaaattaaagctgagaataaagcacagatgggaaattcccactcagattccagctgtaagtgcagcagatggatgttatcaagttcagat

SEQ ID NO: 9589 - DNA, 147 bp, Homo sapiens
  D5S394
  Located on chromosome 5
  Distance between a terminus base of telomere on chromosomal short arm and 5'-terminus of this base sequence : 178487310
  Distance between 3'-terminus of neighbour sequence of sequence listing upward to telomere on chrosomal short arm and 5'-terminus of this base sequence : -262
gtggattccaagttaaagtgtggatctaagtatagatccacactgtgtacacacacacacacacacacacacacacacacataattttgtaggctgtatatcatccttaaacaattcctggccccaaaagacactcggtgcagattg

SEQ ID NO: 9590 - DNA, 395 bp, Homo sapiens
  chr5.fa.O7frz.194102934
  Located on chromosome 5
  Distance between a terminus base of telomere on chromosomal short arm and 5'-terminus of this base sequence : 178543857
  Distance between 3'-terminus of neighbour sequence of sequence listing upward to telomere on chrosomal short arm and 5'-terminus of this base sequence : 56400
cagagcactggaaatactaactctctattgcctagctgggttttggcttccttccctcaccccccacccctccccagccccctgctagccagctaggacagacagaaagtctccaagctgctttaagagctgtccatggaaacttgctcagccataggaagggcctagagcccacagaaggaaagagcagatccacatggctagtggatactgtgcgtatgtgtgtgtgtgtgtgtgtgtgtgtggctgtgaggggagaggctaaaagagtggaccgtagctttcacccagctgccaagtgactccacagcttggtcactgttggattcttgtgcctgattttctccatcccttcacctacattgagtgggtgcccactatgtaccaggtgctgg

SEQ ID NO: 9591 - DNA, 214 bp, Homo sapiens
  chr5.fa.O7frz.196041947
  Located on chromosome 5
  Distance between a terminus base of telomere on chromosomal short arm and 5'-terminus of this base sequence : 178762774
  Distance between 3'-terminus of neighbour sequence of sequence listing upward to telomere on chrosomal short arm and 5'-terminus of this base sequence : 218522
tctcatactcacttaccaatgttctctcagcaagtatttatcaaacctgtgtcttctaagcacagagcttatagtggtgccaaacacagacagtgttctcctcctcttggagcataccttccagaaaggaaggaagacaaaaaatagacaaacaagtgtgtgtgtgtgtgtgtgtgtgtgtgtgtgcatatagtaatttcagttgagctcagtg

SEQ ID NO: 9592 - DNA, 218 bp, Homo sapiens
  chr5.fa.O7frz.196136973
  Located on chromosome 5
  Distance between a terminus base of telomere on chromosomal short arm and 5'-terminus of this base sequence : 178858816
  Distance between 3'-terminus of neighbour sequence of sequence listing upward to telomere on chrosomal short arm and 5'-terminus of this base sequence : 95828
atcggatgctttcctaaagacaaaaacaaacaaacaagaaaaccaaagagactactgtagttaagtgtatgttttaggaagatgtctccagctgctgcagagcaggcagacagaccagagagagagagaaagagagagagagagagagagagagagagacaggaggcaaggagatcattcaagctgcaactgaacttcattatgagttctcattgaag

SEQ ID NO: 9593 - DNA, 446 bp, Homo sapiens
  AC025713.6_88694
  Located on chromosome 5
  Distance between a terminus base of telomere on chromosomal short arm and 5'-terminus of this base sequence : 179137172
  Distance between 3'-terminus of neighbour sequence of sequence listing upward to telomere on chrosomal short arm and 5'-terminus of this base sequence : 278138
accagccttgatttctagactttctattgtgtttccacttatctacatattctgatgccaatacccaccattttaacttgacagtcaattttaatcttgggtagagcaaccgtcccacacgctattcttctttttctttttctaagatgccttatactaatttattctcccagataaaccttagaattattattattattattattattattattattattgtgatggagttgcactcttgtcgcccaggctggaatgcaatggcgtgatcttggctcactgcaacctccgcctcctgggttcaagcaatgctcctgccccggcctcctgggtaactgggattacaggcacccgccaccacattcagcttttttttttgtatttttagtagagatggggtttcaccatgttggccaggctggtcttgaactcttaacctcaggtga

SEQ ID NO: 9594 - DNA, 481 bp, Homo sapiens
  AC025713.5_161247
  Located on chromosome 5
  Distance between a terminus base of telomere on chromosomal short arm and 5'-terminus of this base sequence : 179191378
  Distance between 3'-terminus of neighbour sequence of sequence listing upward to telomere on chrosomal short arm and 5'-terminus of this base sequence : 53760
tccagacaatatggaataacagggattagatttgccctcccaccagatacaaccaataatatgaacaaaatacatgtttctccagatattggatgtcaggaaacaaaggacagcgatccccgaaagatggggaaaaatgaggtaagacttactgtcacccagcttactgcctcaaaagatggtccaagccatggcgcagggagggggaatacaggtggagtccgggagactccctgagttgggtgaacagaactaagggtccagggagatcaagacaaccagaggtcacagaacagagtactgcaaaggagagacctgcagagaaagagacagagagagagagagagagagagagagagaggagagagacagaaaggactccagagatcttcagagagtcccctttgagcgttcagcagaggactaaccagtacatgagtgtgcagaaatataagtgtggaaattataaggaacagtatct

SEQ ID NO: 9595 - DNA, 423 bp, Homo sapiens
  chr5.fa.O7frz.196429268
  Located on chromosome 5
  Distance between a terminus base of telomere on chromosomal short arm and 5'-terminus of this base sequence : 179257652
  Distance between 3'-terminus of neighbour sequence of sequence listing upward to telomere on chrosomal short arm and 5'-terminus of this base sequence : 65793
acatgtctaggtgatatcattcagcagcatagcatggagtctctgtgtcacagaactctaaagggtcatagtagtttggggtcttgtaactgcaagcctctagcttataaatagtcagctgatatggggtaaaattttgcctgatatgtaaaccagagaagctttaaatagctaaaattctgcctgttgggcagactcactttccttctttccttccttccttccttccttccttccttccttccttccttccttccttcctctctccttccctccccctcttcctttcctttcccttcccttcccttcctccttccttccttccttctttcctttcttcctttcttcctttcctttctttccttctttctttcttttcacaaatggatgtgtaaacatttgaccttggtgctagaaggcttt

SEQ ID NO: 9596 - DNA, 390 bp, Homo sapiens
  HUMUT6397
  Located on chromosome 5
  Distance between a terminus base of telomere on chromosomal short arm and 5'-terminus of this base sequence : 179430322
  Distance between 3'-terminus of neighbour sequence of sequence listing upward to telomere on chrosomal short arm and 5'-terminus of this base sequence : 172247
gcaaatggtcagagactatcacatcctcgggctcggtctgccactagggttaagcctcactctgtgcttggtgtcaagactgagtgtgtggccagggttgggggtacagtgtgagtcggcgtcactctatggctgaggtggagactcagtctagacctgaggtaagggaccagaatctgtccagcagtaggcagggcagatgccataagctggtatatgggggactcaggtgtcattcaaaagccactttggccacacatgacttcttaagcacttattattattattattattattattattattatgagatggagtcttgctctgtcacccaggctggagtgcagtggctcagtctcagctcacttgaagcaattctcctgccttagc

SEQ ID NO: 9597 - DNA, 382 bp, Homo sapiens
  AC010241.3_30658
  Located on chromosome 5
  Distance between a terminus base of telomere on chromosomal short arm and 5'-terminus of this base sequence : 179430322
  Distance between 3'-terminus of neighbour sequence of sequence listing upward to telomere on chrosomal short arm and 5'-terminus of this base sequence : -390
gcaaatggtcagagactatcacatcctcgggctcggtctgccactagggttaagcctcactctgtgcttggtgtcaagactgagtgtgtggccagggttgggggtacagtgtgagtcggcgtcactctatggctgaggtggagactcagtctagacctgaggtaagggaccagaatctgtccagcagtaggcagggcagatgccataagctggtatatgggggactcaggtgtcattcaaaagccactttggccacacatgacttcttaagcacttattattattattattattattattattattatgagatggagtcttgctctgtcacccaggctggagtgcagtggctcagtctcagctcacttgaagcaattctcct

SEQ ID NO: 9598 - DNA, 333 bp, Homo sapiens
  AC018760.4_22173
  Located on chromosome 5
  Distance between a terminus base of telomere on chromosomal short arm and 5'-terminus of this base sequence : 179596659
  Distance between 3'-terminus of neighbour sequence of sequence listing upward to telomere on chrosomal short arm and 5'-terminus of this base sequence : 165955
tggaactgtgagtccattaaacctctttttctttataaattatccagtctttggtatttcttcatcgcagtatgaaaatggacatatatatatatatatatatatatatatatatatatatgacattttctttatccatttatctgttgatagactcaaacaactcaatagcaaaaagcccaaagtatttgtctaaaaatgggcaaaatatttgaataagcatttctcaaaagaatacatacaaataaccaacaggtatatgaaaaaatgctcaatgtctatcatcagggaaatccacattggaactgaggagagtggaaatcacctggtgac

SEQ ID NO: 9599 - DNA, 489 bp, Homo sapiens
  AC010219.3_10762
  Located on chromosome 5
  Distance between a terminus base of telomere on chromosomal short arm and 5'-terminus of this base sequence : 179608454
  Distance between 3'-terminus of neighbour sequence of sequence listing upward to telomere on chrosomal short arm and 5'-terminus of this base sequence : 11462
tcaggagaagtctgagtatttcttctacctaccttttctgtcctgcactggaagtagggcatctctaggaggactagaaggactagaaggcacaggtgggatgttgaggctgtaaagagacaatttcttcccagtgttgctggtgggagtgtgaacatgctttgcctctctggagggctgttaggcagcatgtatactccacatccagaaaaacacttgcaggtacacttatgctaaacacacacacacacacacacacacacaaccaaaaaaactgcacttgcacacgtgcatgagatgatcagcatatcactgtttaaacagccaacaaaagagaaataaatgtctgtggctaggaagacagctaaactgtggggtacctaccaataccaatagcacggaacaccttcccatggctaaaaataatgaggaagatctttatgtgctagcatggttgaaacttgaagacatactgttgagtttggttcc

SEQ ID NO: 9600 - DNA, 418 bp, Homo sapiens
  AC026715.3_152939
  Located on chromosome 5
  Distance between a terminus base of telomere on chromosomal short arm and 5'-terminus of this base sequence : 179730686
  Distance between 3'-terminus of neighbour sequence of sequence listing upward to telomere on chrosomal short arm and 5'-terminus of this base sequence : 121743
tgctggatgtctagtccattaccctcactccagccccttttttaaaaaaattctttcattattattattattattattattattattattatttttagacagagtctcactctgcctcccaggctggagcatagtgatgtaatcacggctcacagcagcctggaactcctgggctcggtgatcctcttgacatagccccaggagcggctgggattacaggcatgcatcaccatgcctggctcagcctttttaagggagtctctgatgtgcccagatcacctgctttcagaagagctgacctcaggttgctaacccctcctggctccatcagtgctggccactggtgaggcggtgagggggatcacagagcagctctccatattgggctatctattacaggttatcattaatctgcatt

SEQ ID NO: 9601 - DNA, 353 bp, Homo sapiens
  HUMUT5261
  Located on chromosome 5
  Distance between a terminus base of telomere on chromosomal short arm and 5'-terminus of this base sequence : 179812765
  Distance between 3'-terminus of neighbour sequence of sequence listing upward to telomere on chrosomal short arm and 5'-terminus of this base sequence : 81661
tgtggttcctcaagagaggggatgagaaatgctggcagcccatgcctcccagtgtgatatggtgagcttgagtggcagctgagcaaggagggaaccacctactcttaacccgacctacctggagcagagcctccatcactctgagctgggggaaggaggagaagggagtgggttgtagctcaatatcacagagactcatggttctttctgaatttttgtagattttctagaataaatatttcttcatttgctgtatgcccttaggacaatttccagacactttatttatttatttatttatttatttatttatttatttagagacaaagcctcactttatcaccaggctggag

SEQ ID NO: 9602 - DNA, 227 bp, Homo sapiens
  DISO7_10017160
  Located on chromosome 5
  Distance between a terminus base of telomere on chromosomal short arm and 5'-terminus of this base sequence : 179993358
  Distance between 3'-terminus of neighbour sequence of sequence listing upward to telomere on chrosomal short arm and 5'-terminus of this base sequence : 180240
gacccaggttagtggtggccttcccagcaccacgccctgctcccacctctgccggccggctttgctcttacccgcgccccgctcctgtggcgacccgctcctatccctgcctggcccgctccccgctcctgcccctgcccctgcccctgcccctgcccctgcccctgcccctgcctggcccccgccccgctcctgcccttgcacagtccgcgctcctctcctacatg

SEQ ID NO: 9603 - DNA, 101 bp, Homo sapiens
  DISD22_0010612
  Located on chromosome 5
  Distance between a terminus base of telomere on chromosomal short arm and 5'-terminus of this base sequence : 180186323
  Distance between 3'-terminus of neighbour sequence of sequence listing upward to telomere on chrosomal short arm and 5'-terminus of this base sequence : 192738
ttcttgccagcctgactagcagggcaaattagtttcggtcagaatcctgtttgtttgtttgtttgtttgtttgtttgaagtggagagtccttctaagttgg

SEQ ID NO: 9604 - DNA, 378 bp, Homo sapiens
  chr5.fa.O7frz.195793378
  Located on chromosome 5
  Distance between a terminus base of telomere on chromosomal short arm and 5'-terminus of this base sequence : 180439570
  Distance between 3'-terminus of neighbour sequence of sequence listing upward to telomere on chrosomal short arm and 5'-terminus of this base sequence : 253146
tctgcagtgctagatagcataggctcagcctgctgtgtaggagtcagctcttacacacacacacacacacacacacacatacacacacacacacagaggccacatttaccacaatgtattgcacattgagaatggtcacttgggaaggtgtacaaaatgtcagctttccagggggttttcagactttggcacctagtaacgcgtgaaaggtttgcctttggtacgcagtgaactttgaggacgatgagagtaatgaaatgtctaaagtgtccagctccagagtgcaatctcttctacccaaagtgaggaggtgtcagctgccttaagggtattatttttgctattattactaagctgctacatgagtattcttgtacc

SEQ ID NO: 9605 - DNA, 379 bp, Homo sapiens
  chr5.fa.O7frz.198041535
  Located on chromosome 5
  Distance between a terminus base of telomere on chromosomal short arm and 5'-terminus of this base sequence : 180618032
  Distance between 3'-terminus of neighbour sequence of sequence listing upward to telomere on chrosomal short arm and 5'-terminus of this base sequence : 178084
actaccatttgatccagaaatcccactactgggtatctacctagaggaaaagaggtcattctacgaaaaagatacttgcacacacatgtttatagcagcacaattcacaattgcaaaaatgtggaaccaacccaaatgcccatcaataaataaactggtatatatatatatatatatatatatatatacacacatatatatattatggaatactactcagccataaaaaggaataaattaatggcatttgcagcatcctggatggaactggagactattattctaagtgaagtaactcaggaagggaaaaccaaacgtcgtatgttctcactcataactgggagctaagctatgaggctgtaaaggcataagaatgaca

SEQ ID NO: 9606 - DNA, 237 bp, Homo sapiens
  DISO7_10017163
  Located on chromosome 5
  Distance between a terminus base of telomere on chromosomal short arm and 5'-terminus of this base sequence : 180712816
  Distance between 3'-terminus of neighbour sequence of sequence listing upward to telomere on chrosomal short arm and 5'-terminus of this base sequence : 94405
tactcctgaggctcccagctggggctctcaattctccctcccttccttccttccttccttccttccttccttccttccttccttccttccttcccttcctccttccttccttctttcatttcttccctccctccttccttccctcctccctccctgcctcccttccatctctccttccttccacttcttcctccctctctctctgcccctcagggaaaagtatgtcctggagctgca

SEQ ID NO: 9607 - DNA, 467 bp, Homo sapiens
  AC008570.3_167601
  Located on chromosome 5
  Distance between a terminus base of telomere on chromosomal short arm and 5'-terminus of this base sequence : 180903224
  Distance between 3'-terminus of neighbour sequence of sequence listing upward to telomere on chrosomal short arm and 5'-terminus of this base sequence : 190171
gttagcatagtaaaggccattctggctgggcacggtggttcacacctgtattcccagcattttggggggccgaggcaggcggatcacctgaggtcgggagttcgagaccagcccgactaccattgagaaaccctgcctctactaaaaatacaaaaaattagccaggcatggtggcacatccctgtaatcccagctacttcggaggctggggtaggagaatcgcatgaacctggaaggtggaggttgtggtgagccgagattgtgccattgcattccagcctagacaacaaaagcaaaactctgtctcaaataaataaataaataaataaataaataaataaataaataataaaggccatttttgttgtagagttcctaatgtttggaagtaaaacaagataaaatacagctgtgaatttctgaatgctcattttatcatattaataaatcataagactgcaattctc

SEQ ID NO: 9608 - DNA, 205 bp, Homo sapiens
  AC008570.3_131080
  Located on chromosome 5
  Distance between a terminus base of telomere on chromosomal short arm and 5'-terminus of this base sequence : 180940016
  Distance between 3'-terminus of neighbour sequence of sequence listing upward to telomere on chrosomal short arm and 5'-terminus of this base sequence : 36325
agccaagattgtaccattgtactccggcctgggtgacagagcaagactctgtttaaaaaaataataataataataaataaaaattagccactgtagtcatacatatctgtagtcccagctactcgggagactgagtcaggagaatggctcgagcctgggaggtcatagctgcagtaaaagatgactgtgcaacagcactctagca

SEQ ID NO: 9609 - DNA, 383 bp, Homo sapiens
  AC027314.2_136209
  Located on chromosome 5
  Distance between a terminus base of telomere on chromosomal short arm and 5'-terminus of this base sequence : 181098806
  Distance between 3'-terminus of neighbour sequence of sequence listing upward to telomere on chrosomal short arm and 5'-terminus of this base sequence : 158585
tacggtaagatcattgtttgaggccaggagttcaagaccagcctgggcaacatagtgaaaccccgtctctaataaaaacacaaaaattggccaggcgcggtggcacgcgcctgtagtcccagctacttgggaggctgaggcagaagaatcgcttgaacccaggaggcggaggttgcagtgagccgagatcgtgccactgcactccagcctgggtgacagagcaagacttcatctcaaaataaataaataaataaataaataaataaaaataaataaaaaaattttaaaaaccccacacgtgtaatccatatgtgcatactggtattttaaaacatcaccaacatattaacagtatttctctcttggtgtaggatttaggtgat

SEQ ID NO: 9610 - DNA, 465 bp, Homo sapiens
  AC027314.2_49181
  Located on chromosome 5
  Distance between a terminus base of telomere on chromosomal short arm and 5'-terminus of this base sequence : 181106929
  Distance between 3'-terminus of neighbour sequence of sequence listing upward to telomere on chrosomal short arm and 5'-terminus of this base sequence : 7740
taatgcctgtaatcttagcactttgggaggccaaggtgggtggatcatctgaggtcaggagtttgagaccagcctggccaacatggtaaaaccccatctctactaaaaatacaaaactagccgggtgtggtgaagcatgcctgtaatccctgctacttgggagatagaggcaggacaatcacttgaacctgggaggcagaggttgcagtgagccgagattgtgccattgcactccagcctgagcaacagcaaaactcggacacacacacacacacacacacacacacacacacaagaagaagaagaaaaaagaagaaaaaaaagagggtcagaggcttctcacaataagaaacccacatggggaaggtaatacccaggggtcagagttcagtcatcacttcctcacctggagattgtggattttgttttgttcaagagatgaggtttcaagcatattcagaatca

SEQ ID NO: 9611 - DNA, 221 bp, Homo sapiens
  DISO7_10002103
  Located on chromosome 5
  Distance between a terminus base of telomere on chromosomal short arm and 5'-terminus of this base sequence : 181475376
  Distance between 3'-terminus of neighbour sequence of sequence listing upward to telomere on chrosomal short arm and 5'-terminus of this base sequence : 367982
gggcgagtaggtggataagtggatggatggatggatggatggatggacatgtaaatgaatgggcaggtgggtggtgggtggtgggtgggtgagtggatgattgatggatggatgagtgaacgtgtggatggatgggtgtgtgggtgagcggatggacgggtagatggtgaatgtgggtggatggatggaagaatggatatccagtagcagaactgagcttt

SEQ ID NO: 9612 - DNA, 384 bp, Homo sapiens
  AC024042.3_8297
  Located on chromosome 5
  Distance between a terminus base of telomere on chromosomal short arm and 5'-terminus of this base sequence : 181481973
  Distance between 3'-terminus of neighbour sequence of sequence listing upward to telomere on chrosomal short arm and 5'-terminus of this base sequence : 6376
gataaacaagtgcctgcagctccttggctggcgcccaggccgggggtggaataaacaatcccagtgactttctgaaaagcaagcgtgtgtggcaacaggcaccatggagacaagcagactgtaccagagcagagacagcagccaccccccaaagccacccctgcgcgcgcgcacacacacacacacacacacacacacacaaaatatgtatcttgccctctttcccctctcgttcacattcatatcatgttcatatctcctccataaagcacaatccccttctcacacccaggcagctactcccattctagctttgtttgaggctaaaacttttgaggtctgagactcccaagacaacagcatccacagttcctgaactcgttg

SEQ ID NO: 9613 - DNA, 262 bp, Homo sapiens
  D5S2111
  Located on chromosome 5
  Distance between a terminus base of telomere on chromosomal short arm and 5'-terminus of this base sequence : 181482009
  Distance between 3'-terminus of neighbour sequence of sequence listing upward to telomere on chrosomal short arm and 5'-terminus of this base sequence : -348
aggccgggggtggaataaacaatcccagtgactttctgaaaagcaagcgtgtgtggcaacaggcaccatggagacaagcagactgtaccagagcagagacagcagccaccccccaaagccacccctgcgcgcgcgcacacacacacacacacacacacacacacaaaatatgtatcttgccctctttcccctctcgttcacattcatatcatgttcatatctcctccataaagcacaatccccttctcacacccaggcagct

SEQ ID NO: 9614 - DNA, 384 bp, Homo sapiens
  AC010297.3_80451
  Located on chromosome 5
  Distance between a terminus base of telomere on chromosomal short arm and 5'-terminus of this base sequence : 181647877
  Distance between 3'-terminus of neighbour sequence of sequence listing upward to telomere on chrosomal short arm and 5'-terminus of this base sequence : 165606
ctgttctagtgatggtgagttatcatgaggtctggtggtttaaagtgtttacgtagcacctcctcactctttattctgctgtggccacgtaaaacgtgtctgcttccccttgagccacgattgtgtttcctgaggcctcactggaagcaaaggccactatgcctcctgtacagcctgtagaactgtgagccaactaaacttttctttataaattacccagtctcaggtgtgtgtgtgtgtgtgtgtatactcctgacctcaagtgatccgcaagcctcggcctcccaaagtgctgggattacaggtgtgagccaccgtgcctggcctactccatgttcttgtcaacagtatttaacatgagtgtgatcacgagtaagcaattaa

SEQ ID NO: 9615 - DNA, 136 bp, Homo sapiens
  DISO7_10002104
  Located on chromosome 5
  Distance between a terminus base of telomere on chromosomal short arm and 5'-terminus of this base sequence : 181744773
  Distance between 3'-terminus of neighbour sequence of sequence listing upward to telomere on chrosomal short arm and 5'-terminus of this base sequence : 96512
tggattacctgcagaggtcatatagaaaaagaagggtggtgagaaaaacagaaatacacacacacacacgcacacacgcacacacaactctgaagtcaaatataccccaactctccccaggatgactctataggaa

SEQ ID NO: 9616 - DNA, 448 bp, Homo sapiens
  AC010297.3_136848
  Located on chromosome 5
  Distance between a terminus base of telomere on chromosomal short arm and 5'-terminus of this base sequence : 181807890
  Distance between 3'-terminus of neighbour sequence of sequence listing upward to telomere on chrosomal short arm and 5'-terminus of this base sequence : 62981
ggctaccagttatacaagtttagtccagaggagaaatgaagtataaactgaggcagtggcaatgcatatgacaagagggttaactaaggactgtgactttttgtgactttaactccaataagaatttacaaacacacatttaaaaatattccccagtatttagtatgaaaaattgttctctttcaaatttattccaggactgtgagaaagttttcataatttccttggtggaaaagtccaaggcccacacacaggccccccaagtgttcacggtgatttctgctattcatcacttctggcactctcactaacagtagtattaaacacacacacacacacacacacacacccctgaaaacagttcaaatcaaataatcagttttatgactatttcatttttgatactaattttaagcaaaaatacaatgttggagaaacgacaactaga

SEQ ID NO: 9617 - DNA, 403 bp, Homo sapiens
  AC026097.3_138078
  Located on chromosome 5
  Distance between a terminus base of telomere on chromosomal short arm and 5'-terminus of this base sequence : 182041197
  Distance between 3'-terminus of neighbour sequence of sequence listing upward to telomere on chrosomal short arm and 5'-terminus of this base sequence : 232859
ccttctagcattctgatgacacaaatgttagatcgtctatgatagtcccatgggtctctgaggctccgttctctctttttattttttcttcttcttcttcttcttcttcctttggtctattttctctctgttgttcagattgggaaatttctgttatatcctatcttccagtttactgattcttttctctgtcatctctgtcctgctgttgataccatcttttgagtttttaattttggtttttgcatttttcagttctaaagccctcattttgtttgtatcttttccatttctgtattaagactctattcttaatttctcatttgttccaaacacatctgtaattgctcactgaagcatttttataatggctgttttacagtcctttccagataattccaac

SEQ ID NO: 9618 - DNA, 270 bp, Homo sapiens
  AC026097.3_26420
  Located on chromosome 5
  Distance between a terminus base of telomere on chromosomal short arm and 5'-terminus of this base sequence : 182142084
  Distance between 3'-terminus of neighbour sequence of sequence listing upward to telomere on chrosomal short arm and 5'-terminus of this base sequence : 100484
cagattctagttctggcttcactaatatctcacagtataaactgaaacaagctatagaccctcactttttatttatttatttatttattattattattttttttagaggtgggggtctcgctatattgcccaggctgctcttgaactcctggggtcgagcaatccttctgcctcggcctcccaaatgctgggattacaggggtgagccaccatgcctggccacctttttgtttttaaaacagagatgttgacatggaccagatttactat

SEQ ID NO: 9619 - DNA, 256 bp, Homo sapiens
  DISO7_10002107
  Located on chromosome 5
  Distance between a terminus base of telomere on chromosomal short arm and 5'-terminus of this base sequence : 182346781
  Distance between 3'-terminus of neighbour sequence of sequence listing upward to telomere on chrosomal short arm and 5'-terminus of this base sequence : 204427
tcaattaatctttactgtcttcagctagacttaatcaaaaattaaatcaattctttattattaaaattcataggactaaaaaagtataaaattgaactaaaccttcaaagaatatttttatatatttgcaatatttttgcttctaaaatcaataaaagttaaagtgcatgagaaattttggaatatttggcatacacacacacacatacacacacacacatatacacacataccctgtgacaaatcaattcagtat

SEQ ID NO: 9620 - DNA, 355 bp, Homo sapiens
  chr5.fa.O7frz.200540337
  Located on chromosome 5
  Distance between a terminus base of telomere on chromosomal short arm and 5'-terminus of this base sequence : 182402712
  Distance between 3'-terminus of neighbour sequence of sequence listing upward to telomere on chrosomal short arm and 5'-terminus of this base sequence : 55675
acttaaggtgcataagtaactgaccaggccacagctctcccctcgcctcccgcagctctcccctcacttccacctctctgtccctctgggtttcttgctgcactcataggaagcaggcttctgccttggggccttggcatatgctgtctccttctgtctggatggttctttccccagaagaacttccccctccactgcattcaggcagctactgaaaaccaccttctcacagagcccttccctaactccctgtcccatgataaccacacacacacacacacacacacacacacactgtacaccctcaccctgctttatttccttctgtgtataatttccagaaattactggattc

SEQ ID NO: 9621 - DNA, 285 bp, Homo sapiens
  DISO7_00024989
  Located on chromosome 5
  Distance between a terminus base of telomere on chromosomal short arm and 5'-terminus of this base sequence : 182570923
  Distance between 3'-terminus of neighbour sequence of sequence listing upward to telomere on chrosomal short arm and 5'-terminus of this base sequence : 167856
tactgttctgaaatggaattcctgggtcagaataagaacagatgtttactggaagaggccaggagccgctgacatcaccgagagcccctcaggacatggctgaggccaagggtcctctagctcttcccgccaatacagcattcctggggcagctgcccggctgggggtggacacacacacacacacacacacacacacgcacacacaaacgccatttctccaccaaatccttcccacctgaaaacaattagtcaaggtgcggaaaagatttccagtctggaatgg

SEQ ID NO: 9622 - DNA, 365 bp, Homo sapiens
  chr5.fa.O7frz.200819611
  Located on chromosome 5
  Distance between a terminus base of telomere on chromosomal short arm and 5'-terminus of this base sequence : 182690653
  Distance between 3'-terminus of neighbour sequence of sequence listing upward to telomere on chrosomal short arm and 5'-terminus of this base sequence : 119445
gaaacgtacctttaatgcaataatcataataacggccgggtgcggtggctcacgcctgtaatcccagcactttgggaggccgaggtgggcggatcacgaggtcaggagatcgagaccacggtgaaaccccgtctctactaaaaatacaaaaaattagccgggcgtggtggcgggcgcctgtagtcccagctactcaggaggctgaggcaggagaatggcgtgaacctgggaggcggagcttgcagtgagctgagatcgcaccactgcactctagcctcagtgacagagcgagactccgtctcaaaaataataataataataataataataataacaataaaaccataatggctacattatcgagc

SEQ ID NO: 9623 - DNA, 434 bp, Homo sapiens
  chr5.fa.O7frz.201027148
  Located on chromosome 5
  Distance between a terminus base of telomere on chromosomal short arm and 5'-terminus of this base sequence : 183016151
  Distance between 3'-terminus of neighbour sequence of sequence listing upward to telomere on chrosomal short arm and 5'-terminus of this base sequence : 325133
tgttaagccatctgtcttaaactgatagcccaaacaaaaggacatagttctggttttttgtttttttttgagatggagtcttgctctgttgcccaggctggagtgtagtggcacgatctcggctcactgcaagctctacctcccaggttcatgccattctcctgcctcctcagcctcccgagtagctggaactacaggcatgtgccaccatgcctggctatttgtgtgtgtgtgtgtgtgtgtatttttagtagagacagggtttcaccatgttagccaggatggttttgatctcctgatctcgtaatccgcctgccttggcctcccaaagtgctgggattacaggcgtgagccactgcgactggccgacatagttctgtttttatctttgccctccatagcatttcacagtattaactattcctatcgctgtg

SEQ ID NO: 9624 - DNA, 125 bp, Homo sapiens
  HUMUT6507
  Located on chromosome 5
  Distance between a terminus base of telomere on chromosomal short arm and 5'-terminus of this base sequence : 183166219
  Distance between 3'-terminus of neighbour sequence of sequence listing upward to telomere on chrosomal short arm and 5'-terminus of this base sequence : 149634
aaactgccaataaaataggagtcaatggatattcctctatctatctatctatctatctatctatctatctatctatctcatctatctatctcttcccatcctaaagtcagcatctttcttaatag

SEQ ID NO: 9625 - DNA, 242 bp, Homo sapiens
  chr5.fa.O7frz.202077469
  Located on chromosome 5
  Distance between a terminus base of telomere on chromosomal short arm and 5'-terminus of this base sequence : 183320820
  Distance between 3'-terminus of neighbour sequence of sequence listing upward to telomere on chrosomal short arm and 5'-terminus of this base sequence : 154476
agtaaagtatggctgttcatttattttccaaacgtcctcggcacttacgtgtgcctgctctgtgctaggccagggggtgtagagaggaaaccaaccgtttccacccttgaagagcttatagctcacagtctaacagcaaatacacacacacacacacacacacacacacacacacacacacacagaaaatagggagtggcattccaattctaactgaattttataagttggaaggcattcag

SEQ ID NO: 9626 - DNA, 433 bp, Homo sapiens
  chr5.fa.O7frz.201764301
  Located on chromosome 5
  Distance between a terminus base of telomere on chromosomal short arm and 5'-terminus of this base sequence : 183410432
  Distance between 3'-terminus of neighbour sequence of sequence listing upward to telomere on chrosomal short arm and 5'-terminus of this base sequence : 89370
aagatttggtatgtacgctttcagtcctcttaaaagtacattttttttttttttgagacggagtctcgctctgtcgcccaggctggagtgcggtggcgcgatctcggctcactgcaagctccgcctcccgggttcacgccactctcctgcctcagcctcccgagtaggtgggactacaggcacccgccaccacgcccagagaattttttgtatttttagtggagacgggatttcactgtgttagccaggatggtctccatctcctgacctcgtgatccgcccacctcggcctccaaaagtgctgggattacaggcgtgagccactgcgcccggctaaaaatacattttaaaatgtaacttcacacacacacacacacacacacacacacacacacccccctcattattcctggatcctgtatttgcaaatttg

SEQ ID NO: 9627 - DNA, 246 bp, Homo sapiens
  D5S2073
  Located on chromosome 5
  Distance between a terminus base of telomere on chromosomal short arm and 5'-terminus of this base sequence : 183572022
  Distance between 3'-terminus of neighbour sequence of sequence listing upward to telomere on chrosomal short arm and 5'-terminus of this base sequence : 161157
ggcagattgccagaggccaaagacagacaatgtgaattcaggactccttcaccccagcacgcgcgcgcgcgcgcgcacacacacacacacacacacacacacacacacactaaaaaatagcatctaggatttaggtgagcaaactgaaatcagtaattataaatacagtctttcctgttccaatgattgtgaagtgacagtgagataagagttccacagatgggccaggtgctgtggttcacgcct

SEQ ID NO: 9628 - DNA, 244 bp, Homo sapiens
  AC008393.4_23430
  Located on chromosome 5
  Distance between a terminus base of telomere on chromosomal short arm and 5'-terminus of this base sequence : 183622012
  Distance between 3'-terminus of neighbour sequence of sequence listing upward to telomere on chrosomal short arm and 5'-terminus of this base sequence : 49744
gcgacaaagctaaactgtctcaaaacaacaacaacaacaaaaacccacaaatttgaaagcaagcaatatgccactgcatttagtaggatggtggctcttgccatcctccaggtgcctgtgagctgcaaccagcctgcagtgcaggcctgtgctgttctgaaacctctgccagcctggacaagacttgcccgcctcccctgtccagccccagaagatgcccaaggtaagtcaaggacaagctcca

SEQ ID NO: 9629 - DNA, 471 bp, Homo sapiens
  chr5.fa.O7frz.201642352
  Located on chromosome 5
  Distance between a terminus base of telomere on chromosomal short arm and 5'-terminus of this base sequence : 183810214
  Distance between 3'-terminus of neighbour sequence of sequence listing upward to telomere on chrosomal short arm and 5'-terminus of this base sequence : 187958
tacatttaaggatccaatgataacctgcaatacattttaggaggatttttgttataaacagaggagaaaagtattagcacttaatatacttaacaaacaggctgggcgcggtggctcacgcctgtaatcccagcactttgggaggccgaggcgggcagatcacgaggtcaggagatcgagaccatcctggctaacacggtgaaaccccgtctctactaacaatacaaaacattagccgggcatggtggcgggtgcctgtactcccagctactcgggaggctgaggcaagagaatggcatgaacccaggaggcggagcttgcggtgagccgagatcgcaccactgcactccagcctgggcgacagagcaagactgtctcaaaacaaacaaacaaacaaacaaaaaaagaaggcggcggctagcggtaacaacagagggtaagttactgtttttcaagtttctacactgttgg

SEQ ID NO: 9630 - DNA, 271 bp, Homo sapiens
  DISD22_0010614
  Located on chromosome 5
  Distance between a terminus base of telomere on chromosomal short arm and 5'-terminus of this base sequence : 183979786
  Distance between 3'-terminus of neighbour sequence of sequence listing upward to telomere on chrosomal short arm and 5'-terminus of this base sequence : 169101
gactttctggtaggaagtgagagaaaactgttctgtggttttgtttgtttttgttttgaaatagagacaaggtctcacctgttgcccaggccagaatgcagtggcatgatcgtagctcactgtaaccttgaacccctgggttcaagcaatcctcccacctcatcctccccagtagatgggactgcaggcacatgtcatgatgccccactcagttcgtgtgtgtgtgtgtgtgtgtgtgtgtgtttggttttagctttgtgatggtcaatca

SEQ ID NO: 9631 - DNA, 255 bp, Homo sapiens
  D5S408
  Located on chromosome 5
  Distance between a terminus base of telomere on chromosomal short arm and 5'-terminus of this base sequence : 184088677
  Distance between 3'-terminus of neighbour sequence of sequence listing upward to telomere on chrosomal short arm and 5'-terminus of this base sequence : 108620
actgtgcctagccttcatttattttatttttcagttctaatattcccatttggttttaaatgttttatttgcctgaactttgtttctttgctcagtcttcctgttttcttgtgtgttttgtgtgtgtgtgtgtgtgtgtgtgtgtgtgtgtgtgttttcaagcatgtttttaatttctcattgaagcatttttgtcatgattcctttgtcttggttgggtaattctgtttctgtcatctcagggttggaagttgt

SEQ ID NO: 9632 - DNA, 438 bp, Homo sapiens
  AC022095.4_12021
  Located on chromosome 5
  Distance between a terminus base of telomere on chromosomal short arm and 5'-terminus of this base sequence : 184100872
  Distance between 3'-terminus of neighbour sequence of sequence listing upward to telomere on chrosomal short arm and 5'-terminus of this base sequence : 11940
aggtaggagcaggattcaggaaggtctttggaaagcagttgaacctgacattgaaagattaagaaggaattgacctcataacaagtagaagaaagtgttccaggcagaatggtggaggggggcagtgtgtgtgtgtgtgtgtgtgtgtgtgtgtgtgtgtgtgtgtgtgtgtgtccgtccgtccgtccgtcctggggcaggaaagaacttggtacctataggtcccctcacatcctcacccctttctcattccaaaggctagtgtggaagcagggaaagtggcacaaattaggctaggaaagagaagcagaggctgcatcctgaaaggccttttaggtcttgttaaagatccagataagaagaatgcttcattctgctagatttgacattttgcacggggaccatttggtgtatgtagtacagacctcatcctacaag

SEQ ID NO: 9633 - DNA, 372 bp, Homo sapiens
  AC022095.4_12069
  Located on chromosome 5
  Distance between a terminus base of telomere on chromosomal short arm and 5'-terminus of this base sequence : 184100938
  Distance between 3'-terminus of neighbour sequence of sequence listing upward to telomere on chrosomal short arm and 5'-terminus of this base sequence : -372
gaattgacctcataacaagtagaagaaagtgttccaggcagaatggtggaggggggcagtgtgtgtgtgtgtgtgtgtgtgtgtgtgtgtgtgtgtgtgtgtgtgtgtccgtccgtccgtccgtcctggggcaggaaagaacttggtacctataggtcccctcacatcctcacccctttctcattccaaaggctagtgtggaagcagggaaagtggcacaaattaggctaggaaagagaagcagaggctgcatcctgaaaggccttttaggtcttgttaaagatccagataagaagaatgcttcattctgctagatttgacattttgcacggggaccatttggtgtatgtagtacagacctcatcctacaag

SEQ ID NO: 9634 - DNA, 341 bp, Homo sapiens
  chr5.fa.O7frz.202282850
  Located on chromosome 5
  Distance between a terminus base of telomere on chromosomal short arm and 5'-terminus of this base sequence : 184184553
  Distance between 3'-terminus of neighbour sequence of sequence listing upward to telomere on chrosomal short arm and 5'-terminus of this base sequence : 83243
acatttatcaaaactaacctttcacttaggggggtgtgtgtgtgcgtgtatgtgtgtgtgtatgtgtattgtatgtgtgtgtatgtgtgtgtctatgtgtatgtgtgtgtatgtgtgtatgtgtctatgtgtatgtgtgtgtatgtgtatgtgtgtgtatgtgtatgtgtgtatgtgtatgtgtgtatgtgtatgtgtgtatgtgtgtgtatgtgtgtatgtgtatgtgtgtatgtgtatgtgtgtgtgtgtatgtatgtgtgtgtgtatgtatatgtgtgtatgtgtatgtgtgtgtgtatgtgtgtgtgtgtgtgtgtgtcatacctttccacttgaag

SEQ ID NO: 9635 - DNA, 457 bp, Homo sapiens
  AC016572.5_34546
  Located on chromosome 5
  Distance between a terminus base of telomere on chromosomal short arm and 5'-terminus of this base sequence : 184393497
  Distance between 3'-terminus of neighbour sequence of sequence listing upward to telomere on chrosomal short arm and 5'-terminus of this base sequence : 208603
atgaatctggagaaacctgttaccagaggctcttaagggataacccacagtccctgggaaaaggtctagaaggagcaagcagcctcctactgttatcatttctgggtcctgtggaaagggagatgtctgtgtcaggagttctgactgacacttacatctaaaatgataatcaacaacagcgagaaattttatggggcttattttgtgccaagcactcttctaaatgctttatatatatagatacattgaatcttctcaacagccctttgatgaaggcactgtgtgtgtgtgtgtgtgtgtgtgtatatatatatatatatatatatatatatatatatatatatgcacatacatatacctgttctacagaaggggaaacagagagggaaagcaaattgtcccaggacacacagctggtagttttgaggctgtgatctttgacatctttgaaatgctc

SEQ ID NO: 9636 - DNA, 466 bp, Homo sapiens
  AC016572.5_86691
  Located on chromosome 5
  Distance between a terminus base of telomere on chromosomal short arm and 5'-terminus of this base sequence : 184445665
  Distance between 3'-terminus of neighbour sequence of sequence listing upward to telomere on chrosomal short arm and 5'-terminus of this base sequence : 51711
gaacatggaggacattatgttaagtaaaataagccagacataaaaatgatctcacttatatgtgtaatctaaaatcatcagtcatagaatcatagagcataactgtgattgccagggaatgaggggagggaaaaatgggaaggtgatattcaaaaggtataaaaaagtttcatttgtgcaagatgaagaagttctggagatctactatacagcacagtgcctgtagctaacaataaactattgtattcttaaattctgtgaagagggtagatcttatattctgctcatactacacacacacacacacacacacacacacacacacacagacacacacacaataattgtaataattataataaaaggggtaggaggaaactacgggagatgatggatatgtctatagtcttgatggtggtgatgatttgaatgggtatatacttatcaccaaactctttgagttgta

SEQ ID NO: 9637 - DNA, 155 bp, Homo sapiens
  D5S2006
  Located on chromosome 5
  Distance between a terminus base of telomere on chromosomal short arm and 5'-terminus of this base sequence : 184445906
  Distance between 3'-terminus of neighbour sequence of sequence listing upward to telomere on chrosomal short arm and 5'-terminus of this base sequence : -225
tgtattcttaaattctgtgaagagggtagatcttatattctgctcatactacacacacacacacacacacacacacacacacacacagacacacacacaataattgtaataattataataaaaggggtaggaggaaactacgggagatgatggat

SEQ ID NO: 9638 - DNA, 445 bp, Homo sapiens
  AC016572.5_111020
  Located on chromosome 5
  Distance between a terminus base of telomere on chromosomal short arm and 5'-terminus of this base sequence : 184470187
  Distance between 3'-terminus of neighbour sequence of sequence listing upward to telomere on chrosomal short arm and 5'-terminus of this base sequence : 24126
ttcattaagttgaactaagtgctcttccttgaatggattatccaaggcatctacgcaatgaaaaaccatgatagctctttgtacataaaataaacattaataaataaataaataaataaataaataaatggacaacaggtacatgaagaaatgctcagcatctctaatcattgtggaaacgcaaattaaaccacaatgagatatcaccttacacctctttgaatggctattatcaaaaagattaaagataagtgttggcaaggatgctgagaaaaggaactcatacattattggtgggaatgtaaattagtatggcaattatggaaaactgtatggagttttcttaaaaaactaagaatagaactactctatgattcagcagtcctacttgtgggaatatatgaaaatggattgtaatcaatatgttgatggaatagctgtatta

SEQ ID NO: 9639 - DNA, 337 bp, Homo sapiens
  chr5.fa.O7frz.203020562
  Located on chromosome 5
  Distance between a terminus base of telomere on chromosomal short arm and 5'-terminus of this base sequence : 184670741
  Distance between 3'-terminus of neighbour sequence of sequence listing upward to telomere on chrosomal short arm and 5'-terminus of this base sequence : 200109
tagtgaaagtaggtcaatgacatcccaaattactccaaataaagcccagttcttacagtggcaagcaaagccctacatcacacaccacacacacacacacacacacacacacacacacacacagagacacacagacagacactaatacacacatagacacacacacagacagacatatagacacacacacagacacatggaaatacacagacacacacatatacacatgaaaatacacatgcagaaacacatagatacacggagtcacacacacagccatataaacaaagacacacacacagatacacacccagagacatacagacatggaaagata

SEQ ID NO: 9640 - DNA, 221 bp, Homo sapiens
  Z66649
  Located on chromosome 5
  Distance between a terminus base of telomere on chromosomal short arm and 5'-terminus of this base sequence : 184707452
  Distance between 3'-terminus of neighbour sequence of sequence listing upward to telomere on chrosomal short arm and 5'-terminus of this base sequence : 36374
aggaaatgtggacacacagggccatcacgggtacatgtgcacagacgaaagaccatgtgcggacacatgtttggggtgtgtgtgtgtgtgtgtgtgtgtgtgtgtgtgtgtgtgtgtttggaacagggtcttgctctgttgtcctggcagcagtgcagcagtgacgtctctgcttactccagcctcaaactcccaggctcaacccatactcccaccttagc

SEQ ID NO: 9641 - DNA, 201 bp, Homo sapiens
  DISO7_10002273
  Located on chromosome 5
  Distance between a terminus base of telomere on chromosomal short arm and 5'-terminus of this base sequence : 184811590
  Distance between 3'-terminus of neighbour sequence of sequence listing upward to telomere on chrosomal short arm and 5'-terminus of this base sequence : 103917
ccagggttcttcattattcccacaaacaaaaatatatatatttttgcccatatatatacacacatatacgtatatattatatatatatgtatacacacatatacatatatattatatatatatatgtatacacacatatacatatatattatatatatatatgtatacacacacacatatatgtatctccaggacagtgcc

SEQ ID NO: 9642 - DNA, 334 bp, Homo sapiens
  chr6.fa.O7frz.257173
  Located on chromosome 6
  Distance between a terminus base of telomere on chromosomal short arm and 5'-terminus of this base sequence : 554167
  Distance between 3'-terminus of neighbour sequence of sequence listing upward to telomere on chrosomal short arm and 5'-terminus of this base sequence : 0
atgtttagaacaatgtttcttgacttctgcttcatcatcaaggcttgttagagatggagattcctcagccccagggtagatctttctaactagcctcttggcagttcctagggtgttaaacttcagagccactcatgtagaacacacacacacacacacacacacacacacacacacacatactataaagaaggaagaaaacccttgtaattccgtctctgagctggggctgtctttgtaccagtcccgccatcctccctgccatgtgtttgtctctgcatttttatacgttgggtttgtgtcatatttatggtttggtacctgctttacatta

SEQ ID NO: 9643 - DNA, 190 bp, Homo sapiens
  DISO7_10017194
  Located on chromosome 6
  Distance between a terminus base of telomere on chromosomal short arm and 5'-terminus of this base sequence : 645313
  Distance between 3'-terminus of neighbour sequence of sequence listing upward to telomere on chrosomal short arm and 5'-terminus of this base sequence : 90812
aaggcctcagtgcttaccctttaatgtgtgtatgtgagtgtgtttatatataaattatatagacataaataattaagcacctaattctatatataatttatatatgtacacacacacacacacacacacacatttgctttttacctaaatgatgtcatgttattattttggggacgtttcaggtatgtgg

SEQ ID NO: 9644 - DNA, 186 bp, Homo sapiens
  AL031770.12_40058
  Located on chromosome 6
  Distance between a terminus base of telomere on chromosomal short arm and 5'-terminus of this base sequence : 797877
  Distance between 3'-terminus of neighbour sequence of sequence listing upward to telomere on chrosomal short arm and 5'-terminus of this base sequence : 152374
tttgagtttcaacagatgaatttatacacatgataatatatgtttgtgaatctccttaaatacatgtatacattttaaaaagtgtgtgtgtatatatacatatgtatatatgcagtgtatgcatacatctgtttgtgtataagtgtgtgtgtgtgtgtgtgtgtgtgtatctatttgaggctgtgc

SEQ ID NO: 9645 - DNA, 417 bp, Homo sapiens
  chr6.fa.O7frz.620675
  Located on chromosome 6
  Distance between a terminus base of telomere on chromosomal short arm and 5'-terminus of this base sequence : 974218
  Distance between 3'-terminus of neighbour sequence of sequence listing upward to telomere on chrosomal short arm and 5'-terminus of this base sequence : 176155
gcttgtaatacttggcatgtatgcttgagacatgcttgttcaccatggtgccaatttaaaagtcatagctaattgcatgcatttataaaaatgaaggcagtgtatcccggaatcttgcagtgacagctttctctcagggtgatccctatttcacaccatctgagacacaggcttaaagagcagatgggcagaagccagtctcctgatcgatggtggggtgtcccgttctgaggccgggctcccacactgcagctctgcctggctggctcccggtaacactcagaaacatgtctctgcactttgtgggcatctgattccgtactcctgcatcttaacaaacgagagagagagagagagagagagagatcaggcaagaaagtagaaaagagcaaaggcacattggcaagaatgatttca

SEQ ID NO: 9646 - DNA, 218 bp, Homo sapiens
  HUMUT6540
  Located on chromosome 6
  Distance between a terminus base of telomere on chromosomal short arm and 5'-terminus of this base sequence : 1065126
  Distance between 3'-terminus of neighbour sequence of sequence listing upward to telomere on chrosomal short arm and 5'-terminus of this base sequence : 90491
gccatgtcttcttcaataatgctaagtggcagttgttcttcaaaaattatctatctatctatctatctatctatctatctatctatctatctatctatctaatctatttctctatcatctctatcaattttctatctgtctatcttatgaaaactctatatatttatggaatttttcttactaaaatgtgacagtcttccttctagaagccagaggaa

SEQ ID NO: 9647 - DNA, 227 bp, Homo sapiens
  AL033381.2_109420
  Located on chromosome 6
  Distance between a terminus base of telomere on chromosomal short arm and 5'-terminus of this base sequence : 1282344
  Distance between 3'-terminus of neighbour sequence of sequence listing upward to telomere on chrosomal short arm and 5'-terminus of this base sequence : 217000
gcctacagataatgcctttaagagaacgtgctcttttctgtggttttctaaacagttaaaaaatgtttgtttgtttgtttgtttgtttgcaaaattaaattggaagagaatgtttgcagaaccacggaagcacatctttggggcacaggtgttccaggaacatggttcaaaatccacaggaacaaacactgcctgggaatcatgacactgataacttagaagtgcac

SEQ ID NO: 9648 - DNA, 395 bp, Homo sapiens
  AL033381.2_108190
  Located on chromosome 6
  Distance between a terminus base of telomere on chromosomal short arm and 5'-terminus of this base sequence : 1283532
  Distance between 3'-terminus of neighbour sequence of sequence listing upward to telomere on chrosomal short arm and 5'-terminus of this base sequence : 961
aacataagcttgttccagtgatacttaatcaactggcactttaaaaccttgtgtctctaaatcctaatctagtatttaagaactataaacaacactttcaaatctgtgtgtgtgtgtgtgtgtgtgtgtgtctatatttggggaggattccccccactttgtaaaaatgagtggtttaatttcacccaatgtaaaaaaaaaagaaagaaagaagaaatccatgaatcttgagcttgctctcacaccttcaccagtgccatcagcggcagggcccttcccttcctaggtatttaacgtttgtggaagatgctaaaatgctctcccgtatatgtgaaataggtaaaacagacatcattgtctaaatttttccagtcaataaacagaagttacatgcc

SEQ ID NO: 9649 - DNA, 426 bp, Homo sapiens
  AL033381.2_35361
  Located on chromosome 6
  Distance between a terminus base of telomere on chromosomal short arm and 5'-terminus of this base sequence : 1356319
  Distance between 3'-terminus of neighbour sequence of sequence listing upward to telomere on chrosomal short arm and 5'-terminus of this base sequence : 72392
ccagaatcaaagatgtctgaacgtgtctgcatgaacagaacccaggacgctccttactaagcaggctctgcagaacaaacgcaagccaggaggaaaagaggaaaacgtaggttggtgacatggtttggaatggggaagttcgtgtgtgtgtgtgtgtgtgtgtgtgtgtgtgtataatttcgttgaggtataattcatataccacagaatttccttttaaatatacaactggctcatttgcagtaagtttttagagttgtgcaccagcatcacaagctcatttcacaacatttccatcaccccaaaagaagcctcctgccatgagcagacactgcccactcccactccgagcacaaccaccaccacccatctactttcttctgtacatatttgccttttctggaaattacataacgtggaatcgtg

SEQ ID NO: 9650 - DNA, 307 bp, Homo sapiens
  AL035531.17_6257
  Located on chromosome 6
  Distance between a terminus base of telomere on chromosomal short arm and 5'-terminus of this base sequence : 1430339
  Distance between 3'-terminus of neighbour sequence of sequence listing upward to telomere on chrosomal short arm and 5'-terminus of this base sequence : 73594
tgatagaaagacagatggatagacagacagacagacagacagacagacagacagacagacagacagacaggctggccatagctgttttgctggtgaagctgcagtggcagaacactgttgcaaaaataaatgcaggcaaaaaatgtggacatttggaaggtggaagccaatggactgtcagtgggatctgctaaaaagaaatttatggtctgatcccacagatggtgatatctgtggaggaccagccaccttgtgcaaaagctgggaagaatgagaggagaaactagacaagaactaaacaagtgaa

SEQ ID NO: 9651 - DNA, 236 bp, Homo sapiens
  AL035531.17_35327
  Located on chromosome 6
  Distance between a terminus base of telomere on chromosomal short arm and 5'-terminus of this base sequence : 1459298
  Distance between 3'-terminus of neighbour sequence of sequence listing upward to telomere on chrosomal short arm and 5'-terminus of this base sequence : 28652
ttccagatcactgtaatttctttacaattttctatactgtttaaaaggtctttctacaataatcatttatcatttatgtaatcaaaaagttatttttattattttagtttacatgcctttgtggaatatgagtgtgtgtgtgtgtgtgtgtgtggtgtgtgtgtgtgtatttgggaaaagggtttaatatctcttattgatcttactgtcaactgatgcgtttattcaattgaatg

SEQ ID NO: 9652 - DNA, 372 bp, Homo sapiens
  chr6.fa.O7frz.1421707
  Located on chromosome 6
  Distance between a terminus base of telomere on chromosomal short arm and 5'-terminus of this base sequence : 1591016
  Distance between 3'-terminus of neighbour sequence of sequence listing upward to telomere on chrosomal short arm and 5'-terminus of this base sequence : 131482
aaagccagttattcataggaacccaaaggctcagtctttggcacatgaaaataataaagcttgtctatccatggtattgttcctgttgtttttaatagtagtgatagagttttacatattcatctctgccctgtccaccaggcttgtgtccaacaataacaactgatgtttactgagggctatttcttaagcacagtgtttagttctttcacatatctcctttaatatatctccttttagatacatagatagatagatagatagatagatagatagatagatagatagctctccagtaataattggataatcctagggtcctagtgctactatggtcttttacacataaggaagctggtacataggaaggta

SEQ ID NO: 9653 - DNA, 197 bp, Homo sapiens
  Z67528
  Located on chromosome 6
  Distance between a terminus base of telomere on chromosomal short arm and 5'-terminus of this base sequence : 1671074
  Distance between 3'-terminus of neighbour sequence of sequence listing upward to telomere on chrosomal short arm and 5'-terminus of this base sequence : 79686
ttcgatctcacttagaccgttaggtaatttgattacagagattttgtgtgtgtgtgtgtgtgtgtgtgtttttattattattattattttggtagagacaggggtctcgctttgttgctcaggctggtctcaaaatcccgcctcgaacgatcctccgactattacgtaatttgattgcagagattttgtgtgtgtcg

SEQ ID NO: 9654 - DNA, 281 bp, Homo sapiens
  AL034344.24_47031
  Located on chromosome 6
  Distance between a terminus base of telomere on chromosomal short arm and 5'-terminus of this base sequence : 1845584
  Distance between 3'-terminus of neighbour sequence of sequence listing upward to telomere on chrosomal short arm and 5'-terminus of this base sequence : 174313
aaagctcaacatctacagtcctacttccttccggtatactctacctacccctctccacacacacacacacacacacacacacacacacacacacacacacacacagacaaaacatcctcagcaacatggatcttgcttaatctttaataaaatacaagcttcttcccatgcagccatagaaaagaatgaaatcatgtcctctgcagcaacatggatggagctgggggccattaccctaagaagcagaaaatcaaatatcttatgttctcacttatgaatgg

SEQ ID NO: 9655 - DNA, 147 bp, Homo sapiens
  D6S344
  Located on chromosome 6
  Distance between a terminus base of telomere on chromosomal short arm and 5'-terminus of this base sequence : 1853793
  Distance between 3'-terminus of neighbour sequence of sequence listing upward to telomere on chrosomal short arm and 5'-terminus of this base sequence : 7928
ctccagcctgggtcactaagacacacacacacacacacacacacacacacacactctctctctctctctctctatatatatatacacacacacacacacatatatgtatttccatatatatatggaaatattattgtcatgcattag

SEQ ID NO: 9656 - DNA, 381 bp, Homo sapiens
  AL033517.1_92658
  Located on chromosome 6
  Distance between a terminus base of telomere on chromosomal short arm and 5'-terminus of this base sequence : 2059571
  Distance between 3'-terminus of neighbour sequence of sequence listing upward to telomere on chrosomal short arm and 5'-terminus of this base sequence : 205631
tttgcttatcataggctaacgtactgaatactactaaaggttcttataaattgaaaactcggttttggattagagaggcagattcctttagattagggtttatgctgtcaatgtaattcaaatcaaagaaagactgaatttcaggatgggtgctctatcaactgtcaaaagagacctcgagcacatgggaacacacacacacacacacacacacacacacacaggcacgcacatgcatacacacaaatccttaatgagacccgagtctgtaggctcttttgtaactgaacaaatcggggcttaaacattgtttccactctgtccattttgttatttgacaccaaaaccgtctgttattacagctattaatagttggcagtg

SEQ ID NO: 9657 - DNA, 157 bp, Homo sapiens
  AL033517.1_105995
  Located on chromosome 6
  Distance between a terminus base of telomere on chromosomal short arm and 5'-terminus of this base sequence : 2073052
  Distance between 3'-terminus of neighbour sequence of sequence listing upward to telomere on chrosomal short arm and 5'-terminus of this base sequence : 13100
agcctaggcaataaagtgagactctgcctcaaaaaaaaaaaaaaaaatatatatatatatatatatatctaccttgggttatgtttctcatagagatagaatatgacaagtagacattttaggagtaatgtttgtctccttgcttcactgtaatgat

SEQ ID NO: 9658 - DNA, 378 bp, Homo sapiens
  chr6.fa.O7frz.2154969
  Located on chromosome 6
  Distance between a terminus base of telomere on chromosomal short arm and 5'-terminus of this base sequence : 2267111
  Distance between 3'-terminus of neighbour sequence of sequence listing upward to telomere on chrosomal short arm and 5'-terminus of this base sequence : 193902
ggtgtaaccaacatgtaatgagaatgccagaaaaagagcaaagaaaggaagaaatggctgagaatttcccaaatctagcaacaaataacaaatcaaaagtcaaggaagctcagagaacaccagagaggataaaaaccatatatatatatatatatatatatatatatatatgcatatcataactgcaaaaaaccaaagagaaagagagtattttgaaagaagcttgtcaaaaaacaagcaagccaaaagacaactgtatgaaatatttaaaagtattaaaagaaaaacacccaacaaactaaaattttatatacaacaaaattatcccccccccccaaaaaaataaaaataaaaactttctaaggcaaataaaactga

SEQ ID NO: 9659 - DNA, 445 bp, Homo sapiens
  chr6.fa.O7frz.2273809
  Located on chromosome 6
  Distance between a terminus base of telomere on chromosomal short arm and 5'-terminus of this base sequence : 2415702
  Distance between 3'-terminus of neighbour sequence of sequence listing upward to telomere on chrosomal short arm and 5'-terminus of this base sequence : 148213
cactaattaagactgtggctttctgtggctcaaatcaaataatagacatctgtttccaaagttctttcccataattttttccttatacctctggggcttgaaagtacttgtctgctaaaaggaagcagaaaaaaggagtagaccttattgttttttctagtctcatgtattcagggttagaattttaaacttcatacttaaaacagtcttacttattgctagcaaaattattcctggttcaaataatagaataaaaatatcaggttttcataacattccaacacacacacacacacacacacacacacacacacacacacacacacacacaaaactttcctggtgcttccctacattaccagatttgagtgagacccatgagataagtaacgtctaagaagtggccctgggttgagaggagacagcagcagtgatgcatacttcc

SEQ ID NO: 9660 - DNA, 463 bp, Homo sapiens
  chr6.fa.O7frz.2383188
  Located on chromosome 6
  Distance between a terminus base of telomere on chromosomal short arm and 5'-terminus of this base sequence : 2521255
  Distance between 3'-terminus of neighbour sequence of sequence listing upward to telomere on chrosomal short arm and 5'-terminus of this base sequence : 105108
gagagttggatttaaccaagactgtgactttggtgaggatgtatgaccaaaagagagaggaggggggtatatggaagagattgcttgtatggatgaagcatggaataaccgtggcaaggagagaaataacgagatgaggggtgagggacagtgaggtggaggatggatcaatgtgttgtgggtcctgcaatggtagaaagaccatcaaggtgcttgagggagtgaggaggaaaataggaaatagtggctggagagtggttacttgaaactgagtttatggcaaggatgtagaggggtgtgtgtgtgtgtgtgtgtgtgtgtgtgtgtgtgtgttccgtaatgggaatgtctaaggtataatcatggaagtcaagctttttggaggtggggagagaactgagggggccaggacactggatggatcaccagatgctgaaatcactaagtcttgttggagtgacaa

SEQ ID NO: 9661 - DNA, 401 bp, Homo sapiens
  chr6.fa.O7frz.2463083
  Located on chromosome 6
  Distance between a terminus base of telomere on chromosomal short arm and 5'-terminus of this base sequence : 2596960
  Distance between 3'-terminus of neighbour sequence of sequence listing upward to telomere on chrosomal short arm and 5'-terminus of this base sequence : 75242
tagtatagccactatggagaacagcatggaggttcctcaaaaaactacaaacagaactacaatatgatccagcaattccactactggaatttatccaaagcaaaggaaatcattatattgaagagacatctgcacctccacatttattgcatcagtattcacaatagccaagatgtgagatcaacctaggtgtccaaaaccagatgaatggataagaaaaattatacacacacacacacacacacacacacacacacacacacacacacacactggaatactattcagtcatgaaaaataatgaaatcttgtcatttgcagcaccgtggatgaaactggaggacactatgttaagtgaagtaaggctagaagagaaagttaaatactgcatgttctcactt

SEQ ID NO: 9662 - DNA, 349 bp, Homo sapiens
  AL031768.9_16061
  Located on chromosome 6
  Distance between a terminus base of telomere on chromosomal short arm and 5'-terminus of this base sequence : 2640543
  Distance between 3'-terminus of neighbour sequence of sequence listing upward to telomere on chrosomal short arm and 5'-terminus of this base sequence : 43182
aatttctgatttctagctccagaactgtgagagaatagatttctgttgttttaagccacccagtttatgatactctgttacagtaactacagaaaactaattatctatctattggtctatctatctatctatctatctatcatctatctatctatcatctgtctatctacctatctacctacctacctacctacctgatatggtttggccgtgtccccacccaaatctcatcttgaattgtagctcccataattcccacctgttgtgggaggggcccggtgggaggtaattgagtcatgggggtggtttcccccatatcgttcttgtggtagtgaataagtctcacaag

SEQ ID NO: 9663 - DNA, 257 bp, Homo sapiens
  AL031768.9_53585
  Located on chromosome 6
  Distance between a terminus base of telomere on chromosomal short arm and 5'-terminus of this base sequence : 2678075
  Distance between 3'-terminus of neighbour sequence of sequence listing upward to telomere on chrosomal short arm and 5'-terminus of this base sequence : 37183
actggcttatttcacttagcatagtgtccacaaggtgcatccatgttgtagcatgtgtcagaatttccttcctttttaagtctgaatactattccattgtgtgtttatgtgtgtgtgtgtgtgtgtgtgtgtgtgtatacatatattccacgttttctttatccatttatctgttgttggacacgtgagttgtttccaccttttgctattgtgaacaatgctgctatgaacatgggtgcatacaaacctgtttcagt

SEQ ID NO: 9664 - DNA, 107 bp, Homo sapiens
  DISO7_10002111
  Located on chromosome 6
  Distance between a terminus base of telomere on chromosomal short arm and 5'-terminus of this base sequence : 2792868
  Distance between 3'-terminus of neighbour sequence of sequence listing upward to telomere on chrosomal short arm and 5'-terminus of this base sequence : 114536
ttaggctctgaaggtcatgtactatttatcatgtatgtgtgtgtgtgtgtgtgtgtgtgtgtgtgtgtgtgtatgatgtactaaattggacctgtctgttggaaatt

SEQ ID NO: 9665 - DNA, 114 bp, Homo sapiens
  DISO7_10002112
  Located on chromosome 6
  Distance between a terminus base of telomere on chromosomal short arm and 5'-terminus of this base sequence : 2975804
  Distance between 3'-terminus of neighbour sequence of sequence listing upward to telomere on chrosomal short arm and 5'-terminus of this base sequence : 182829
gaatgagagcaggaagtaggacataaaaggagtgtgtgtgtgtgtgtgtgtgtgtgtgtgtgtgtgtgtgtgtgttggaggtggaaaatagaagagacctaatcctcatctttc

SEQ ID NO: 9666 - DNA, 468 bp, Homo sapiens
  AF053630.1_12171
  Located on chromosome 6
  Distance between a terminus base of telomere on chromosomal short arm and 5'-terminus of this base sequence : 3087492
  Distance between 3'-terminus of neighbour sequence of sequence listing upward to telomere on chrosomal short arm and 5'-terminus of this base sequence : 111574
ttatggcaattggtgaaatagggcagaggtggtgttccaagtcatcaaaggttcaagggatttgtacattgggtccatcatccactcacccacccatccacccatccatccacccatttgtccactcatccatccatccatccatccatccatccatccatccatccacccagctacccagcaacacagccacccatccatccatccatttattcacctatctacccacccacccatccaaccatctatccacctattcatcatccatctacccatccacccatccatccatccattcacctatccacccacccacccatccaacaatctatccacctatctatcatccatccacccatttactcatccacccatccacccatccatctacccattcatccatccatccattcatccagggtttactaaacccctaccacaatggattacagtgataggtcatgacag

SEQ ID NO: 9667 - DNA, 104 bp, Homo sapiens
  DISO7_10017219
  Located on chromosome 6
  Distance between a terminus base of telomere on chromosomal short arm and 5'-terminus of this base sequence : 3411597
  Distance between 3'-terminus of neighbour sequence of sequence listing upward to telomere on chrosomal short arm and 5'-terminus of this base sequence : 323637
ctgcgtccttgtaaaggccttttaaatgtggaaaattctgcgggtgtgtgtgtgtgtgtgtgtgtgtgtgtgtgtgtgtgtcagagaggaaagacaggaggaat

SEQ ID NO: 9668 - DNA, 465 bp, Homo sapiens
  chr6.fa.O7frz.3456641
  Located on chromosome 6
  Distance between a terminus base of telomere on chromosomal short arm and 5'-terminus of this base sequence : 3605540
  Distance between 3'-terminus of neighbour sequence of sequence listing upward to telomere on chrosomal short arm and 5'-terminus of this base sequence : 193839
tacacggacatgtacagacacacagacactcacaaacatacacacacagacatgcacacacacacacacacacagccatagacacttacaagcatgcacacacagacatgcacagacacacacacacacagccacaaacacaagcacatacagacatgcacagacacactcacacacagacacagccacagaagctcaccggcatgcatgcacagacacacacagacacatattgacccattcacatacacggccacatacacacataggcatacttgcagacacacaaatacacagacagagagaaagagagcaggtgagcacacaccaagccccggccataacaaaagggagaaaaggctctgatctctgccattcttgtttttccatctgaaaatgagaaacctgctactgggactcacctgaatcatggaaaatggactcacttgagtccttaaatcatac

SEQ ID NO: 9669 - DNA, 471 bp, Homo sapiens
  chr6.fa.O7frz.3578057
  Located on chromosome 6
  Distance between a terminus base of telomere on chromosomal short arm and 5'-terminus of this base sequence : 3726778
  Distance between 3'-terminus of neighbour sequence of sequence listing upward to telomere on chrosomal short arm and 5'-terminus of this base sequence : 120773
ttcctttctggtaacataattaaaatgctacactaacaaaagtgaaagagctttgcaaagttaaaaatggtgcaaattcattatttgttaaatgacactaataatgaattagtatcgttattattattattattattattattattattattattattattgagacagagtcttgctctgtcacccaggctggagtgcagtggtgctatctcggctcactgcaacctccgcctcctgggttcaggtgattctcctgcctcagcctcccgagtagctgggactacaggcacgtgccaccacacccggctaattttttgtatttttagcagagacagggtttcactgtgttagccaggatggtctcgatctcctgatcgcgtgatccgcctgcctctgcctcccaagtgctgggattacaggcatgagccaccacacctggccgtcattattatttggcatgaaagtgacttc

SEQ ID NO: 9670 - DNA, 229 bp, Homo sapiens
  AL031943.11_83553
  Located on chromosome 6
  Distance between a terminus base of telomere on chromosomal short arm and 5'-terminus of this base sequence : 3816628
  Distance between 3'-terminus of neighbour sequence of sequence listing upward to telomere on chrosomal short arm and 5'-terminus of this base sequence : 89379
ctatgtgctaaacggtgagaagacagcagggagcaacgcgagtaacaggaaagtgagtgtgtgtgtgtgtgtgtgtgtgtgtgtgtgtgtgtagaccaagcaaatcactggaaaacatatgccattgtaaatctaattattagcctacttcattattaatttatcatatggtggcatttaaacaaatggcttatctgtagtaatcttgtaacaatccagtaggtgtgga

SEQ ID NO: 9671 - DNA, 219 bp, Homo sapiens
  AL031943.11_85954
  Located on chromosome 6
  Distance between a terminus base of telomere on chromosomal short arm and 5'-terminus of this base sequence : 3819052
  Distance between 3'-terminus of neighbour sequence of sequence listing upward to telomere on chrosomal short arm and 5'-terminus of this base sequence : 2195
aacaggtttagctactgttcagagaggtggggagtgtgtgtgtgtgtgtgtgtgtgtgtgtgtgtgtgtgcatgcgcgtgtatgcaatcctgcatggtgcatggtgcatgatgcagagaggcctattgcaggttgcaggcgcctgtgctgaatgcacacactgacccagctatgtgaaggtcgtctcatggctgcttcaacacttaggagtgttactga

SEQ ID NO: 9672 - DNA, 152 bp, Homo sapiens
  AL031943.11_103780
  Located on chromosome 6
  Distance between a terminus base of telomere on chromosomal short arm and 5'-terminus of this base sequence : 3836804
  Distance between 3'-terminus of neighbour sequence of sequence listing upward to telomere on chrosomal short arm and 5'-terminus of this base sequence : 17533
tttccaggatatacatgaccaggtttggtccatcctaccatatgatgatatgatgatctctattaatctatataaaagatacaggtgttttcttcatcttgggagattctctctctctctctctctctctctctcctgtttcatttgttctg

SEQ ID NO: 9673 - DNA, 238 bp, Homo sapiens
  chr6.fa.O7frz.3774096
  Located on chromosome 6
  Distance between a terminus base of telomere on chromosomal short arm and 5'-terminus of this base sequence : 3922785
  Distance between 3'-terminus of neighbour sequence of sequence listing upward to telomere on chrosomal short arm and 5'-terminus of this base sequence : 85829
gtggagcaactagaactctttctggggaagatccagatatagggagagtatgaagccattccagaggcccagagataagctggccccaaaagatggggtgttacatatattcctttattttggtccacaacaactgttaagaggcaaatattattattattattattattattattattatcattattattattcccttccttttaggtcaagacactaatggacaggaagcttaaag

SEQ ID NO: 9674 - DNA, 472 bp, Homo sapiens
  chr6.fa.O7frz.18168429
  Located on chromosome 6
  Distance between a terminus base of telomere on chromosomal short arm and 5'-terminus of this base sequence : 4571296
  Distance between 3'-terminus of neighbour sequence of sequence listing upward to telomere on chrosomal short arm and 5'-terminus of this base sequence : 648273
cgagtagctatagtgaaactgaagtcagaggcaaccttatccgcaaagtgtttcaagaagctcagcacagctgtgagttttaataacttcagaagtctatttgctaaaatcttgcaaaacacacccctgaaaaattcaattatttaaatttctatgatacttagttttataaactttcagaaatatattttttatttttatctttctttctttctttctttctttcccttccttccttcctttccttccttccttccttccttccttccttccttccttccttccttccttccttccttccttccttctttccttctgtctttctttctgtctttcttgtctttctttgacagagtctctctctgtctcccaggctggagggcagtggtgtgacctcggcccactgcaacctccgcctcctgggtttcagggattctcctgcctcagcctcttgagtagctgtgattacagg

SEQ ID NO: 9675 - DNA, 213 bp, Homo sapiens
  D6S1667
  Located on chromosome 6
  Distance between a terminus base of telomere on chromosomal short arm and 5'-terminus of this base sequence : 4595933
  Distance between 3'-terminus of neighbour sequence of sequence listing upward to telomere on chrosomal short arm and 5'-terminus of this base sequence : 24165
ccaggccaagggattttaacatagaaacacaaaacccatccttgaacaacaaaacatcaattctcacaggaagtagctcttgctttgttttaataaaaaacagtcttagagcacttacacacacacacacacacacacgcaaaccacacgtggaaaaaatgtgtcatttgtacctttgcctagaggaaaatgttgaaactgcaccttggttaa

SEQ ID NO: 9676 - DNA, 374 bp, Homo sapiens
  chr6.fa.O7frz.18040687
  Located on chromosome 6
  Distance between a terminus base of telomere on chromosomal short arm and 5'-terminus of this base sequence : 4674966
  Distance between 3'-terminus of neighbour sequence of sequence listing upward to telomere on chrosomal short arm and 5'-terminus of this base sequence : 78820
acctcttaagttctgaggtcagagcttgaagcaggcagaggcaggcatataatttttagaagttccttgttttatctttaaaatcgttgcagctattttttatcacacacacacacacacacacacacactccatgtttgcattaaaataaaaaataattctctctaccaaatctttgagtaaaatcaacaagacaagcaccatcaagtttattccatggcttcaggtactaatatctcccaaagaccatcgttagcccccaagagcatgagtacgcctatgctctcaagctttagaggcttgttcccagggcatccattcctgcagattccagatagtcacatgtaggggctgaggttatctaccatgagttt

SEQ ID NO: 9677 - DNA, 178 bp, Homo sapiens
  D6S274
  Located on chromosome 6
  Distance between a terminus base of telomere on chromosomal short arm and 5'-terminus of this base sequence : 4797942
  Distance between 3'-terminus of neighbour sequence of sequence listing upward to telomere on chrosomal short arm and 5'-terminus of this base sequence : 122602
ctcatctgttgaatggggatgataatatcacctaactcacagaatcactggaaagattaaatgtgcactcactctctagatgttgcttatggtagtatctcaataactaataaaaacagacacacacacacacacacacacacacacacacacacacacggaaggcatagcatttaag

SEQ ID NO: 9678 - DNA, 131 bp, Homo sapiens
  D6S1584
  Located on chromosome 6
  Distance between a terminus base of telomere on chromosomal short arm and 5'-terminus of this base sequence : 4829792
  Distance between 3'-terminus of neighbour sequence of sequence listing upward to telomere on chrosomal short arm and 5'-terminus of this base sequence : 31672
atggggccaggttttggtgtgtgtgtgtgtgtgtgtgtgtgtgtgtgtgtgtgtgtgtgtggtgtgtggttttttttttctttctttttttctacagtcttactctgtcgcccaggctggcatggagtggt

SEQ ID NO: 9679 - DNA, 405 bp, Homo sapiens
  AL031120.1_88856
  Located on chromosome 6
  Distance between a terminus base of telomere on chromosomal short arm and 5'-terminus of this base sequence : 4957785
  Distance between 3'-terminus of neighbour sequence of sequence listing upward to telomere on chrosomal short arm and 5'-terminus of this base sequence : 127862
agaaatcttagaatcattgagcagggaaggaggggcaggaacgggattattttgatagtggtgtcctcaaggggaggagatggggtgggaagcaacccctggccagaacccactcatccctggggatagggacctgctgtgtctctgcctgctgagtttttgacattctgatttaaaaaccttgtgtgtgtgtgtgtgtgtgtgtgcgcatgcttgcgtgtgtgcatgtgtgtgtgagagattatgcaatatgatgtttcccgtttctgtgacttcagcgaatgtgaatgaagaccacagaagcagcctaactcagtgagaatattgtttttataattacaggtctaggcgttttacactgagattctccactgccaccctttctactcaagcaaaatcttcgtg

SEQ ID NO: 9680 - DNA, 423 bp, Homo sapiens
  AL031120.1_90651
  Located on chromosome 6
  Distance between a terminus base of telomere on chromosomal short arm and 5'-terminus of this base sequence : 4959465
  Distance between 3'-terminus of neighbour sequence of sequence listing upward to telomere on chrosomal short arm and 5'-terminus of this base sequence : 1275
ttgaaacttaccagatttcgacatttcagaaataatattaaatccagaaggagtagaagggtcctagggaattttaagttcttcctttctggccaagtatttttagacaactatgaaatcactagatacaatcatttttcagtggaaagcataatttttcatttcttaaaaagagcaaaaaggtatttaataaaaaaattttattagatatgtatctgaagttatactgctcattagtttaaaaatatgtatgtgcctatatatgtatgtgtgtgtgtatatatatatatgtgtatatgtgtgtgtgtgtgtgtgtgtgtgtgtgtatatatatatatatatatatgtccaatatcgggaacatgattaaatataactatgttagtgccatatgatggaaaagctgtagataagattgcaagc

SEQ ID NO: 9681 - DNA, 405 bp, Homo sapiens
  AL031120.1_93698
  Located on chromosome 6
  Distance between a terminus base of telomere on chromosomal short arm and 5'-terminus of this base sequence : 4962525
  Distance between 3'-terminus of neighbour sequence of sequence listing upward to telomere on chrosomal short arm and 5'-terminus of this base sequence : 2637
ttaaataacaggctctgctcagagatttcttttatctccttaggccttgacctgcatttggtaaaggctgcatttttagcttcggatttactgtctttgacgaacctttttctctattgtatccctccctggtcagctgctctcttcgggccctcaaacatccaccacgtactctacccagatgttttcttctttctttaacatgtccagttgagttgcccatatcatcccctactccccatccacacacccacccagcacacacacacacacacacacgcgcgcacacacacacacacacacacacacacacagtgcattctcgaacatggggtcttttccccttcaggcaccgtatgtaacccaccccgcccctcagctcttaggaaatgtttcctttatcct

SEQ ID NO: 9682 - DNA, 303 bp, Homo sapiens
  AL034375.23_85174
  Located on chromosome 6
  Distance between a terminus base of telomere on chromosomal short arm and 5'-terminus of this base sequence : 5058882
  Distance between 3'-terminus of neighbour sequence of sequence listing upward to telomere on chrosomal short arm and 5'-terminus of this base sequence : 95952
gcctatgaatacctctgaggacgagaagatattatcttcaaattttaggaaatgacaagccaatttcttctaggtttttgttgttgtttttgtgtatatataaatacatatatttctgtaatatatatgtatactcttgtttatgtatgtgtgtgcgtgtacacacacacacacacacacacacacacacacacacacacacacatatatatttaggtttccagcttcttaactcagccagaaaacttttttgaacatgtattacctattttttttgcagttgcctacaagatttgtaaagag

SEQ ID NO: 9683 - DNA, 211 bp, Homo sapiens
  AL034375.23_71915
  Located on chromosome 6
  Distance between a terminus base of telomere on chromosomal short arm and 5'-terminus of this base sequence : 5072183
  Distance between 3'-terminus of neighbour sequence of sequence listing upward to telomere on chrosomal short arm and 5'-terminus of this base sequence : 12998
gaagttaaggcctgttaggtattccgagtgtcttataaagaaaaataggctaccttaattcaaattgttgttgctcttccaaccttctcttatgtaaactccctgtatattacaatgacagactctctctctttctgtctcacacacacacacacacacacacgcatgcatgcacacatacgcacactcctgacatgctctactgaaagct

SEQ ID NO: 9684 - DNA, 191 bp, Homo sapiens
  AL034375.23_71418
  Located on chromosome 6
  Distance between a terminus base of telomere on chromosomal short arm and 5'-terminus of this base sequence : 5072675
  Distance between 3'-terminus of neighbour sequence of sequence listing upward to telomere on chrosomal short arm and 5'-terminus of this base sequence : 281
actaaccatagttcagtttcaggatgacactgaaaattcaaaattacttcctgtgattaacttacattgtgatggttgggaattatttcgcagaagacctgttcatcttctgatgaagcccttttcaagttttgaattgtgtgtgtgtgtgtgtgtgtgtgtgtgtgttttaattgccagaagtctttcag

SEQ ID NO: 9685 - DNA, 232 bp, Homo sapiens
  D6S288
  Located on chromosome 6
  Distance between a terminus base of telomere on chromosomal short arm and 5'-terminus of this base sequence : 5153197
  Distance between 3'-terminus of neighbour sequence of sequence listing upward to telomere on chrosomal short arm and 5'-terminus of this base sequence : 80331
aggacctgttactgacgccagtttacatctgagatgctgcagtggagaggaattggaactagaaccgacacttacggcttcttgtctggtgtactctctgctgttccatcttcattgcttgtgtgcatgcgtgtgtgtgtgtgtgtgtgtgtgtgtgatgtgtttatttgactccttgaatctatgttgtcttgtttttcgtaaatggattaacgccactaccacggatcat

SEQ ID NO: 9686 - DNA, 358 bp, Homo sapiens
  AL021407.1_120276
  Located on chromosome 6
  Distance between a terminus base of telomere on chromosomal short arm and 5'-terminus of this base sequence : 5453651
  Distance between 3'-terminus of neighbour sequence of sequence listing upward to telomere on chrosomal short arm and 5'-terminus of this base sequence : 300222
gtgcatgataggaaagcaatacagtatagttcagaaacaaccaccatacaaagatactagcatcaagctgtcttcttctctgattatatagtgattgaatagctcctaagatcaatagacccaatttgtctcataaaaattacacacacacacacacacacacacacacacacacacacacacatcctatctggttttacttgtttgtctagtttggggaagaatttttaataaaggaaaactttattctaacagtccacatttgcccatataagtttctatttcttatttgggaaaaattgccatttccaaaaataagtacaaaggagactgatatagatttccaaatacctccatg

SEQ ID NO: 9687 - DNA, 367 bp, Homo sapiens
  AL021407.1_126529
  Located on chromosome 6
  Distance between a terminus base of telomere on chromosomal short arm and 5'-terminus of this base sequence : 5459833
  Distance between 3'-terminus of neighbour sequence of sequence listing upward to telomere on chrosomal short arm and 5'-terminus of this base sequence : 5824
gaatggatcctgccttagagcctctggatggagcgtagccctgcaaacaccctgattttggcccagtgatactgattttggacttctggagtccaaaattgtgagaaaataaatttctgttgttttaagccactaagtttgcagtaatgttacaacaaatttatttctatccataggaaactaatacaatgtctatttagaattatagttgatgtgtgtgtgtgtgtgtgtgtgtgtgtgtgtgtgtattctagttggtgtgtgctttcgtagagaagaaggggatcttatagactggctttaaatcataatgataatgaagacttatccaacttattgttcctcctgactctcaactacagcaacc

SEQ ID NO: 9688 - DNA, 223 bp, Homo sapiens
  Z66716
  Located on chromosome 6
  Distance between a terminus base of telomere on chromosomal short arm and 5'-terminus of this base sequence : 5459885
  Distance between 3'-terminus of neighbour sequence of sequence listing upward to telomere on chrosomal short arm and 5'-terminus of this base sequence : -315
tgattttggcccagtgatactgattttggacttctggagtccaaaattgtgagaaaataaatttctgttgttttaagccactaagtttgcagtaatgttacaacaaatttatttctatccataggaaactaatacaatgtctatttagaattatagttgatgtgtgtgtgtgtgtgtgtgtgtgtgtgtgtgtgtattctagttggtgtgtgctttcgtagag

SEQ ID NO: 9689 - DNA, 103 bp, Homo sapiens
  D6S1676
  Located on chromosome 6
  Distance between a terminus base of telomere on chromosomal short arm and 5'-terminus of this base sequence : 5469170
  Distance between 3'-terminus of neighbour sequence of sequence listing upward to telomere on chrosomal short arm and 5'-terminus of this base sequence : 9062
cttgggatctgtggaacatgaaaaacatacacatacacacacacacacacacacacacacacacacacacacacacactcttttgtcagccatacggtatcgt

SEQ ID NO: 9690 - DNA, 287 bp, Homo sapiens
  D6S1630
  Located on chromosome 6
  Distance between a terminus base of telomere on chromosomal short arm and 5'-terminus of this base sequence : 5581434
  Distance between 3'-terminus of neighbour sequence of sequence listing upward to telomere on chrosomal short arm and 5'-terminus of this base sequence : 112161
tgcaggatgttaatgaccatttcctgttcattttttgactctgcagtgaaggcttttgtttctgtagcttttcctgccgttggcagcccttacacacacacatacacacacacacacacacacacacacacacactcactctctctctctctttctcaggggttaaagtcagcctctactctttgttgagggaaagaatacatctctctctctctctctctctctgtcattctctttttagaggttttggccaattctgctcttcacctccatactccctacagact

SEQ ID NO: 9691 - DNA, 187 bp, Homo sapiens
  AL031407.3_102207
  Located on chromosome 6
  Distance between a terminus base of telomere on chromosomal short arm and 5'-terminus of this base sequence : 5679965
  Distance between 3'-terminus of neighbour sequence of sequence listing upward to telomere on chrosomal short arm and 5'-terminus of this base sequence : 98244
ttctaaacgtaactcacgtatgaagaaccctcatgttcacactgtgtcctgctatcattcaggtcactctgttattcaacagaacatcactgcaaaagtcatttcatagaatgttgcacacacacacagacacacacacacacacacacacacacacaattttcttcatcctaatggcaactattaa

SEQ ID NO: 9692 - DNA, 139 bp, Homo sapiens
  G10198
  Located on chromosome 6
  Distance between a terminus base of telomere on chromosomal short arm and 5'-terminus of this base sequence : 5706526
  Distance between 3'-terminus of neighbour sequence of sequence listing upward to telomere on chrosomal short arm and 5'-terminus of this base sequence : 26374
tggttccaggaaatacaggacacgtgtttgctgtaaaacactgaactaaaaatacagaagagggaacatgtgtttattcattcattcattcattcattcattcattcattcattcattatgtatgatatgtgccaggcc

SEQ ID NO: 9693 - DNA, 351 bp, Homo sapiens
  AL136443.11_46093
  Located on chromosome 6
  Distance between a terminus base of telomere on chromosomal short arm and 5'-terminus of this base sequence : 5810260
  Distance between 3'-terminus of neighbour sequence of sequence listing upward to telomere on chrosomal short arm and 5'-terminus of this base sequence : 103595
gctgtcatgtttagagtgcacgcagcagtgaagctgaaagggacataataatgcaagggtttgggagcctcccttggaaatgtgtgagggagtttttgctgcattctcacagttgaaaggatgtggggtgttgacaatcctggcagactcgagctcaacagatgaaaactgctgcttggatatggcagggaaccggtgtgtgtgtgtgtgtgtgtgtgtgtgtgtgtgtgtcagacttgtctaccttctttcttttaccaataattcaaatgtttctacaattatcttaccacattattaaatccctaaactgacagtgggagatttctttaggatagtctaaggaaaccg

SEQ ID NO: 9694 - DNA, 221 bp, Homo sapiens
  AL021978.1_10397
  Located on chromosome 6
  Distance between a terminus base of telomere on chromosomal short arm and 5'-terminus of this base sequence : 5958799
  Distance between 3'-terminus of neighbour sequence of sequence listing upward to telomere on chrosomal short arm and 5'-terminus of this base sequence : 148188
gtgagccatatccaaagatagtataaagttaaaattcattctatggtactatatggatttatctaaaatggctgattttcaatatggattttgaaaaatgtcataatgcttcatacaggttgaatatatatatatatatatatatatatatatatatatatatatatatattcttttcataatttcatataacttcagtgtattccttatctgttagccag

SEQ ID NO: 9695 - DNA, 382 bp, Homo sapiens
  chr6.fa.O7frz.16636236
  Located on chromosome 6
  Distance between a terminus base of telomere on chromosomal short arm and 5'-terminus of this base sequence : 6083213
  Distance between 3'-terminus of neighbour sequence of sequence listing upward to telomere on chrosomal short arm and 5'-terminus of this base sequence : 124193
gagacaggagaataccttgaacatgggaggcggaggttgcagtgagccgagatcacgccactgcactccagcctgggtgacacagggtgggagacttcgtctcaaaaaacaaaacaacaacaacaacaacaacaacaacaaaatgagcattctaacagccactacagacaacagtctttgtgcgaatcatgtgaggccttcctcagttcccaatggagaagctgaatactcaacttccctgcgggacacagacaccagggactttagtgctataaatgaaaccccttcagtcagcaaggtgcttggccaacaaaacagcactgccatacttaaagtcttatttccatgttctctaagtggatttcagaaagactcaaggact

SEQ ID NO: 9696 - DNA, 263 bp, Homo sapiens
  AL021938.1_89071
  Located on chromosome 6
  Distance between a terminus base of telomere on chromosomal short arm and 5'-terminus of this base sequence : 6110434
  Distance between 3'-terminus of neighbour sequence of sequence listing upward to telomere on chrosomal short arm and 5'-terminus of this base sequence : 26839
catatgaccgcctaatacaaaggaaatccaagattaaatcacattgtttgctctaataagttgcttacatcaggaaaagactttcacttggatgacatgcccttaggtaggatgcacgccacctaagcgactgcctaaactgaaattatacacacacacacacacacacacacacacacacacacacacagagagacatgggggttggggaggaggcatgcagccaacaactagactataaataatttcaaataaaccgcaag

SEQ ID NO: 9697 - DNA, 322 bp, Homo sapiens
  AL021938.1_117949
  Located on chromosome 6
  Distance between a terminus base of telomere on chromosomal short arm and 5'-terminus of this base sequence : 6139429
  Distance between 3'-terminus of neighbour sequence of sequence listing upward to telomere on chrosomal short arm and 5'-terminus of this base sequence : 28732
caaagacagctttcattttcagcagcaatttctgtgtgtgtgtgtgtgtgtgtgtgtgtgtgtgtgtgtgtgtgtgtgtgtgtgtgcactttaagatgatagaaaaattataaaagcagcccccatggctgaggtagggccctctctgaggtcatcagaatgcatggtttgctgccattgatagtgaaaaataaatgttatgttcactcaagttttgcaaagagaaaaaaaaatgaattgctttttaagcagggtaggcattccgatgccagggcagatttggctttgggcctgcttggcatggtcaatatgaacatggagt

SEQ ID NO: 9698 - DNA, 179 bp, Homo sapiens
  D6S260
  Located on chromosome 6
  Distance between a terminus base of telomere on chromosomal short arm and 5'-terminus of this base sequence : 6139440
  Distance between 3'-terminus of neighbour sequence of sequence listing upward to telomere on chrosomal short arm and 5'-terminus of this base sequence : -311
ttcattttcagcagcaatttctgtgtgtgtgtgtgtgtgtgtgtgtgtgtgtgtgtgtgtgtgtgtgtgtgtgtgcactttaagatgatagaaaaattataaaagcagcccccatggctgaggtagggccctctctgaggtcatcagaatgcatggtttgctgccattgatagtgaaaa

SEQ ID NO: 9699 - DNA, 324 bp, Homo sapiens
  AL021938.1_194971
  Located on chromosome 6
  Distance between a terminus base of telomere on chromosomal short arm and 5'-terminus of this base sequence : 6216295
  Distance between 3'-terminus of neighbour sequence of sequence listing upward to telomere on chrosomal short arm and 5'-terminus of this base sequence : 76676
aagactgtcctagaaccaaatttctatagttctgctgttttaccccagagattgctacgtgcccttctttccaaggcttcctgtgtcctttatgacctccctccctcattcttagtcctctctactcctccccaccacccactggcagcatgcggggatgcacgcacatgcacacgcacacacacgcgcacacacacacacacacacacactcttccagaatggaagggatggcagctgaatgcagtatcactcacatttatacctgccctagatgccatcatcagatctccccctcgtggcctcaccaagtatgctgaatgtt

SEQ ID NO: 9700 - DNA, 223 bp, Homo sapiens
  D6S289
  Located on chromosome 6
  Distance between a terminus base of telomere on chromosomal short arm and 5'-terminus of this base sequence : 6262010
  Distance between 3'-terminus of neighbour sequence of sequence listing upward to telomere on chrosomal short arm and 5'-terminus of this base sequence : 45391
ttcgctgagatcatgccactgcactccagccttggcaactgagcaagactctgtctcaaacacacacacacacacacacacacacacacacacacacacagagcacataccctggaccctgcacttccaattcaatcatatgctaatattaccatatgtttgaaaggtgtatggacagaaatgttttaaagcaaacaaaacagcatgaacaacctaaaggtct

SEQ ID NO: 9701 - DNA, 178 bp, Homo sapiens
  D6S469
  Located on chromosome 6
  Distance between a terminus base of telomere on chromosomal short arm and 5'-terminus of this base sequence : 6279274
  Distance between 3'-terminus of neighbour sequence of sequence listing upward to telomere on chrosomal short arm and 5'-terminus of this base sequence : 17041
tataggtacaccacataaaagcggcccggcagaacacagatttccagttaaacaatgcaaagtttaaaatattaactccttcttagatattctctctctctctctatctctctctctctcacacacacacacacacacacacacacactcacacctaccttctaaactgaggtgggtg

SEQ ID NO: 9702 - DNA, 167 bp, Homo sapiens
  Z24581.1_191
  Located on chromosome 6
  Distance between a terminus base of telomere on chromosomal short arm and 5'-terminus of this base sequence : 6279314
  Distance between 3'-terminus of neighbour sequence of sequence listing upward to telomere on chrosomal short arm and 5'-terminus of this base sequence : -138
tttccagttaaacaatgcaaagtttaaaatattaactccttcttagatattctctctctctctctatctctctctctctcacacacacacacacacacacacacacactcacacctaccttctaaactgaggtgggtgtctaaactagtaaattcttggctacttgg

SEQ ID NO: 9703 - DNA, 139 bp, Homo sapiens
  chr2.fa.O7frz.129570664
  Located on chromosome 6
  Distance between a terminus base of telomere on chromosomal short arm and 5'-terminus of this base sequence : 6352063
  Distance between 3'-terminus of neighbour sequence of sequence listing upward to telomere on chrosomal short arm and 5'-terminus of this base sequence : 72582
caacagattgagattctgtcttataaaataaaataaaataaaataaaataaaataaaataaaataaaataaagctatattcagatgatttagggtggacctcctaaatctaatatgtgtagtgtccttgtaggaagagg

SEQ ID NO: 9704 - DNA, 285 bp, Homo sapiens
  AL033383.26_21838
  Located on chromosome 6
  Distance between a terminus base of telomere on chromosomal short arm and 5'-terminus of this base sequence : 6708521
  Distance between 3'-terminus of neighbour sequence of sequence listing upward to telomere on chrosomal short arm and 5'-terminus of this base sequence : 356319
cttaaactatgaacgtggtcaaacttggggacattttcaatataaatttcaaaggacatgagaaataagaggccttcataagaggaggtagagaagataaatgtaacagggaaaataaaaatgtggtaagataaatagtcatgtatatgtacacacacacacacacacacacacacacacacacacacacacacagagcaataggaacaccaacctataaatgaattaggagaggatgaaatgagtattgacccagttttggtgtcagtactcatttgcttggtt

SEQ ID NO: 9705 - DNA, 102 bp, Homo sapiens
  D6S1617
  Located on chromosome 6
  Distance between a terminus base of telomere on chromosomal short arm and 5'-terminus of this base sequence : 6873177
  Distance between 3'-terminus of neighbour sequence of sequence listing upward to telomere on chrosomal short arm and 5'-terminus of this base sequence : 164371
tgcaaaacaggcacacatacacacacgcgcgcgcgcacacacacacacacacacacacagttcctactcttataatttttatctttgcagaaaattgattaa

SEQ ID NO: 9706 - DNA, 166 bp, Homo sapiens
  D6S1713
  Located on chromosome 6
  Distance between a terminus base of telomere on chromosomal short arm and 5'-terminus of this base sequence : 7000797
  Distance between 3'-terminus of neighbour sequence of sequence listing upward to telomere on chrosomal short arm and 5'-terminus of this base sequence : 127518
aatcactgttacccatagggttatctgcaggcctttttgacattttcaacaatatctttatcccacagagtagagaatacacacacacacacacacacacacacacacacacacacacacacacacacacacacacacagtaagtaatgcacagaggtcttggcct

SEQ ID NO: 9707 - DNA, 191 bp, Homo sapiens
  AL034376.10_62272
  Located on chromosome 6
  Distance between a terminus base of telomere on chromosomal short arm and 5'-terminus of this base sequence : 7272824
  Distance between 3'-terminus of neighbour sequence of sequence listing upward to telomere on chrosomal short arm and 5'-terminus of this base sequence : 271861
gatggtctgtattcaatcctagatttaaaacacacacacacacacacacacacacacacacacgttgcttaacgtccttcgcatcaggaaactaccagaatacagcagactgcgattgttagaagtgtagagtcaaggtaccatttctaattttctctttttttctatagtcaacacttattcagtgagcc

SEQ ID NO: 9708 - DNA, 390 bp, Homo sapiens
  chr6.fa.O7frz.4745451
  Located on chromosome 6
  Distance between a terminus base of telomere on chromosomal short arm and 5'-terminus of this base sequence : 7371380
  Distance between 3'-terminus of neighbour sequence of sequence listing upward to telomere on chrosomal short arm and 5'-terminus of this base sequence : 98365
ccatccaatctattcagctacttcttccaacagatgcctctgctccaaggctcatccaggtcccacaggcacgctgtgctcccgtctttattctctgctccttgtacctggatgtttcccttctcccctcccctactcacattctaaccatccttccaagctattccctcctcctcaaagcttcccagaccactactatcatccctttctaaatccctgtggttgaaataagcatgctgaccgtagctaataacactgtattgaatgctggaaattggcaaagagtgtagatttcaggtgttctcaccacacacacacacacacacacacacacacaaaggtaactgtcaggagatggatatgttaatttgcttgactgtagtattcatt

SEQ ID NO: 9709 - DNA, 341 bp, Homo sapiens
  AL022725.8_74946
  Located on chromosome 6
  Distance between a terminus base of telomere on chromosomal short arm and 5'-terminus of this base sequence : 7479805
  Distance between 3'-terminus of neighbour sequence of sequence listing upward to telomere on chrosomal short arm and 5'-terminus of this base sequence : 108035
ctgagtattgtccataaatccaactgtttttataccttgataatggaaatgctacctggctctttttctttttaggttcgttctctctctctctctctctctctctctctctctctctctctctctctgtgtgtgtgtgtgtgtgtgtagctcttcaccagtttttcatttttcgtgaatagggatgttatttatgtgcattggatttaatgcttttattataaatcattaaagtcttacttgtatgttgaaatttggggatactttattcatactcaactcatagaagtaaagaattacgtgtgtcaatcattggttctcaagcttcctttgttaagatg

SEQ ID NO: 9710 - DNA, 427 bp, Homo sapiens
  AL022725.8_41549
  Located on chromosome 6
  Distance between a terminus base of telomere on chromosomal short arm and 5'-terminus of this base sequence : 7512999
  Distance between 3'-terminus of neighbour sequence of sequence listing upward to telomere on chrosomal short arm and 5'-terminus of this base sequence : 32853
tggttaccaggtggaactattttgcaaggaagagctgtcaccaactggggcaaatgatgattcctcctaaaaaggcagggccagtcttccttccttccttccttccctccttccttccttccaatcttccttccttccttcctccttccttcctatcttccttccttcctccttccttccttccaatcttccttccttcctccttccttccttccttccaatcttccttccttccttccaatcttccttccttccttccttccaatcttccttccttccttccaatcttccttccttccttccaatcttccttccttccttccttccttccaatcttccttccttccttccaatcttccttcctccttccttcctccttccttccttccttcctgtttagatttaaatcaagtttacatttggtgta

SEQ ID NO: 9711 - DNA, 341 bp, Homo sapiens
  chr6.fa.O7frz.5002869
  Located on chromosome 6
  Distance between a terminus base of telomere on chromosomal short arm and 5'-terminus of this base sequence : 7622662
  Distance between 3'-terminus of neighbour sequence of sequence listing upward to telomere on chrosomal short arm and 5'-terminus of this base sequence : 109236
ttcaacagtagacgactaatacaaccagggtggtcattctcacagctcacttttgataaatatacagatagatagatagatagatagatagatagatagatagatagatagagataaatacaaacagacattgatatagatggggtctcagacaaaattttcatcttcacgtcctgtaacagcttgctaaaatagtctattctctgcatttaaatgtccctttatgtgggattggatgtacaaatgatcttatgcccatactgtgcaactctttaagagaacatgtagcaatgatggtgatgaatatttattactgtcttagatgagaattacaatcagcc

SEQ ID NO: 9712 - DNA, 271 bp, Homo sapiens
  AL035653.12_17241
  Located on chromosome 6
  Distance between a terminus base of telomere on chromosomal short arm and 5'-terminus of this base sequence : 7750626
  Distance between 3'-terminus of neighbour sequence of sequence listing upward to telomere on chrosomal short arm and 5'-terminus of this base sequence : 127623
aagtgccaacttctcattgtagactaatagcaaacattatgcagtgaaatgtaaaggtaataaaaataggttttctttgtttttgaaaagttatttcaaaggaaagggcaatacgaccagagtgaggaagtatttaagagtgtatttcctgaaaggaagacacacacacacacacacacacacaccacacacacaccacaaacaaaatccctgcaatgcagtcagtgcttttttgcagcaatatttgcttcaacttgagtaagtgaaggtc

SEQ ID NO: 9713 - DNA, 275 bp, Homo sapiens
  AL035653.12_26617
  Located on chromosome 6
  Distance between a terminus base of telomere on chromosomal short arm and 5'-terminus of this base sequence : 7760072
  Distance between 3'-terminus of neighbour sequence of sequence listing upward to telomere on chrosomal short arm and 5'-terminus of this base sequence : 9175
agcgatcttcctagctcagcctcccgagtagctgggaccactatagcacgtgccaccacactcggctaattaaaaaaaaaatctatttctctatctatctatctatctatctatctatctatctatattttatagcgatgaggcctcactatattgcccaagctgatcttgaattactgtgctcaagtgatcctcctgccttggcctcccaaagtgctgggatagaaccaattttgactctaatgttgttccttgtagcctatgtcaattatcag

SEQ ID NO: 9714 - DNA, 320 bp, Homo sapiens
  AL035653.12_75888
  Located on chromosome 6
  Distance between a terminus base of telomere on chromosomal short arm and 5'-terminus of this base sequence : 7809398
  Distance between 3'-terminus of neighbour sequence of sequence listing upward to telomere on chrosomal short arm and 5'-terminus of this base sequence : 49051
taggtgacaggtaatgacctttacacacacacacctctctctctctctctctctctgcttatagtgactgagaaatcagctctcccataactttaccaacaataattcttgaagatgagagcctcttgtctgaaatcattttccatttatagttatatgaaagatataatggaataactgctaattaaatctataaatatacatataaaaattaccttgtcatttgtagcgcgcttccaagtataaaattaaacgtggttctgaatttttcccctagaactctaagttttcatttcttaatcgtctagaatagctccttt

SEQ ID NO: 9715 - DNA, 353 bp, Homo sapiens
  AL121978.5_19597
  Located on chromosome 6
  Distance between a terminus base of telomere on chromosomal short arm and 5'-terminus of this base sequence : 7905833
  Distance between 3'-terminus of neighbour sequence of sequence listing upward to telomere on chrosomal short arm and 5'-terminus of this base sequence : 96115
ctgactttatttgcaggaagaccttaaaaaaaaaaaaaaaaaaaaaaaaatatatatatatatatatatatatatatatatatatatatatatatatataaaataggtgaatttctggaacaaaaaagatcaatataaatttggtttgggaaaacagcacctgatcttaaaattctatgggaatctttcatgttcttatgtgatgaggaaggaaggacaaggaagtgagtgactgggtctgaacatggccgccccggtagttcacccaaatccctttactcctacttgttaataagcagcacacacacatgcagtgttcactcagccaacggttcttatgctttgcagtgttc

SEQ ID NO: 9716 - DNA, 399 bp, Homo sapiens
  AL121978.5_76286
  Located on chromosome 6
  Distance between a terminus base of telomere on chromosomal short arm and 5'-terminus of this base sequence : 7962464
  Distance between 3'-terminus of neighbour sequence of sequence listing upward to telomere on chrosomal short arm and 5'-terminus of this base sequence : 56278
gtggcaactaatatcaaacaatttttttttaaactaacattctagttttattgaaaatgagtccagcctgctgggtgacagagtaagatgctatctcacacacacatacacacacacacacacacacacacacacacacacacacacacacaaagaaaatggggctaaattggtggaccccacacaagtaagggttatgtcagatgattttggtgaaccatccttcatgttgggaattcactcaataaaacagattaagaagacttggtccctaccctcttaagaacttacaaggagctccttatgttgttggtcatttatcttcttagccatgcacttttccagttaccagtcatgcccacctaccctctttgtcacttacagactccaggtgacagt

SEQ ID NO: 9717 - DNA, 415 bp, Homo sapiens
  chr6.fa.O7frz.5406551
  Located on chromosome 6
  Distance between a terminus base of telomere on chromosomal short arm and 5'-terminus of this base sequence : 8042061
  Distance between 3'-terminus of neighbour sequence of sequence listing upward to telomere on chrosomal short arm and 5'-terminus of this base sequence : 79198
ggcctatagcaatgatttctaattttcttttcttttcctatttgagagtctgatgagaaatttgcatactccccagaaacacacacacacacacacacacacacacacacacatacacacacacacacagatgcagaattttttatatagtttaaagggttttataggcttattagttaaagggttttatgggctactggattagattatgaaatttgaagtcagggtcaaggagatagtttttgcttttaataggtaattcccaatctcagtctgtagtaaattggaaaatctgttctggattctttcagcaatcctctctctttccacatctgccacttttctgtgacacttcttttgggtcacattgccatgctggggttatgtttggtggtcgattatgtaagtagcaacg

SEQ ID NO: 9718 - DNA, 258 bp, Homo sapiens
  AL021328.1_2934
  Located on chromosome 6
  Distance between a terminus base of telomere on chromosomal short arm and 5'-terminus of this base sequence : 8104731
  Distance between 3'-terminus of neighbour sequence of sequence listing upward to telomere on chrosomal short arm and 5'-terminus of this base sequence : 62255
gccactgaaatagtttctcagtattttagtgggctgtggtggtggttctgaaaaccagacagggattggtggtgggaatgtcctctacatgggaggtttttgaaaagccactgatatatggaagatcctcgtgtgtgtgtgtgtgtgtgtgtgtgtgtgtgtgtatgtgtgcatgcacgcacgtgcatatgttcgcaatataatctttttaaaattttagcgcaggctgggtgcaatggctcaagcctgtaatccgag

SEQ ID NO: 9719 - DNA, 387 bp, Homo sapiens
  AL021328.1_59775
  Located on chromosome 6
  Distance between a terminus base of telomere on chromosomal short arm and 5'-terminus of this base sequence : 8161607
  Distance between 3'-terminus of neighbour sequence of sequence listing upward to telomere on chrosomal short arm and 5'-terminus of this base sequence : 56618
tatttaggacagccacttgaaggtggtgccactggaatgacttggaacaaaacattttctgtccttgtgacattccagtcaagcttcaaatccccgagagagagagagagagagagagagagagagagagagatgccaggtctggtcttgttcttgttttgggagatggggctagaagagggaatgcagtgattaacaaacacaagattcattcacccagagaaaactggactgtgcttatcaaaagaaggggttagagttgctagacagaccaagccagcagatgtaaacatgatatgaatgaacattgccactcgccatctagtatctaaacctcaaagagtttaagtagtatcggtatacctcagccttgtactaaggtaaaca

SEQ ID NO: 9720 - DNA, 260 bp, Homo sapiens
  AL022097.1_96615
  Located on chromosome 6
  Distance between a terminus base of telomere on chromosomal short arm and 5'-terminus of this base sequence : 8335946
  Distance between 3'-terminus of neighbour sequence of sequence listing upward to telomere on chrosomal short arm and 5'-terminus of this base sequence : 173952
aatgcgttatatttgcagatagacacacacacacacacacacacacacacacacacacacacggtgctatgtagtagctggtaaccacatgtgtgctgtcagtccatacagggacttgattgtcatgtatcccagtctttgtggctctgttcaaaggaagaagctctggggaggagtaacagagaattttaggagacagagaaaatagacttcttttcaatggaaacttatcagaattgttgaagtgagaaagccataca

SEQ ID NO: 9721 - DNA, 424 bp, Homo sapiens
  AL022097.1_138767
  Located on chromosome 6
  Distance between a terminus base of telomere on chromosomal short arm and 5'-terminus of this base sequence : 8377893
  Distance between 3'-terminus of neighbour sequence of sequence listing upward to telomere on chrosomal short arm and 5'-terminus of this base sequence : 41687
aacctacagtcagacaaggtagataagagaaatgtgggggtagattagagtcctgccttggggagaaaaaggagcagggaaaaagaaggtagaaggtcagagagagattctgttttctaaggcctgcatctgagacctaaagtgccccaatgttgtaacaaaagactgtaacaaaggtcgtgggagttatgagccaggaaccgtggatagaaacatagatatgtatatgtgtgtgtgtgtgtgtgtgtgtgtgtgtgtgtgtgtgtctatgtatatctctctcacaaccccctctctagccattctgttgtttttgaagaaactgggttgttggccctgtgcagtttcccatgtttggaattttgccagttgtatccccatggtgtcatttaacatgttcttctatcctctgtattgcctgaaa

SEQ ID NO: 9722 - DNA, 373 bp, Homo sapiens
  AL133473.5_50513
  Located on chromosome 6
  Distance between a terminus base of telomere on chromosomal short arm and 5'-terminus of this base sequence : 8438726
  Distance between 3'-terminus of neighbour sequence of sequence listing upward to telomere on chrosomal short arm and 5'-terminus of this base sequence : 60409
gataaacctaatctccagtgacagaaacagatcagaggtcgtctggggctggaaagggatttactgtaaaggggaacgagggaaattttcaggtgatgggaaatgttctctatctttttttttttttttttttttttttttggtgaggctgcccagattcccaaatagcaattctctctatctctctctctctctctctctctctctctctctctctctctctttttttttttttttcctctaagaaacagggtcttactatgttgctcaggctggtctcaaactcctggcttccagcaattctccctcagcctcccaaagtgttaggattacaggcatgagctaccacacctgaccagaaatgttcttgtct

SEQ ID NO: 9723 - DNA, 226 bp, Homo sapiens
  D6S1685
  Located on chromosome 6
  Distance between a terminus base of telomere on chromosomal short arm and 5'-terminus of this base sequence : 8471354
  Distance between 3'-terminus of neighbour sequence of sequence listing upward to telomere on chrosomal short arm and 5'-terminus of this base sequence : 32255
tacactaatggctctcctgggtctcctgctggctgaccacagatctggaacttctcagcctccacagtcatgtgaaccagtttcttgtaataaaggtatttacacacacacacacacacacacacaacattggttctgtttctctagagaaccctgatgtgtttgatgtatagagatagagtctacaggaaaatttgatttctggactacagcagagaaatctggc

SEQ ID NO: 9724 - DNA, 394 bp, Homo sapiens
  AL136307.12_42028
  Located on chromosome 6
  Distance between a terminus base of telomere on chromosomal short arm and 5'-terminus of this base sequence : 8558010
  Distance between 3'-terminus of neighbour sequence of sequence listing upward to telomere on chrosomal short arm and 5'-terminus of this base sequence : 86430
gttaatggtgagttctcaccagggaagccaggcagcatcaatcctccagccagcagggcctggggcctgggctgtggtcaggcacagcaccccacaatggtggttcttgcaaagtctttgaatttgtgaagaaaatgatactcgggccctcttgcagggaaacacacacacacatacacacacacacacacacacacacacacacacacacacacacacacagagagagagagagagagagagagctttggatgcaatatagtcggggagccggactcccaggctaaaaacatttgatcgaagtttattctgtttggaactagtttcttagttttgaaaaaaaagtaaataaacctcatatgtgcccaggatttgacaatctacagtcctagga

SEQ ID NO: 9725 - DNA, 174 bp, Homo sapiens
  D6S1574
  Located on chromosome 6
  Distance between a terminus base of telomere on chromosomal short arm and 5'-terminus of this base sequence : 8672673
  Distance between 3'-terminus of neighbour sequence of sequence listing upward to telomere on chrosomal short arm and 5'-terminus of this base sequence : 114269
aagaacttcccaaaccaattttgttttaaagaacacacacacacacacacacacacacacacacacacacacaccctaaataagtttcacagaagaaaaaacagcaatatggtccaaactggtttaacattcaaaatttacagtgtgtcacagtctttgatgtcctggatggtt

SEQ ID NO: 9726 - DNA, 201 bp, Homo sapiens
  D6S1591
  Located on chromosome 6
  Distance between a terminus base of telomere on chromosomal short arm and 5'-terminus of this base sequence : 8680978
  Distance between 3'-terminus of neighbour sequence of sequence listing upward to telomere on chrosomal short arm and 5'-terminus of this base sequence : 8131
agagcctgtttggtgtcatctttcctgctcttaaggttttctgtgaatttttaaaaaataggttcaactgattcatccttttgaattatatccttttatatattatatgtgtgtgtgcgtgtgtgtgtgtgtgtgtgtgtgtgtgtatttcccaactataattctgaaaaatgccattttagaccctatgctgctgaaaca

SEQ ID NO: 9727 - DNA, 224 bp, Homo sapiens
  G08543
  Located on chromosome 6
  Distance between a terminus base of telomere on chromosomal short arm and 5'-terminus of this base sequence : 8801054
  Distance between 3'-terminus of neighbour sequence of sequence listing upward to telomere on chrosomal short arm and 5'-terminus of this base sequence : 119875
gatttgccatgatagatggcttcctaggctcaattaggttcttaattatggagatagttatatttacttctgtcacagggctgatgaggtgaaatatttgcaaaacaatctatctatatctatctatatctatctgtctatctatctatctatctatctatctatctatctatctatctatcatcttatatgtgttgttgttgaggttgtttgagatatccccc

SEQ ID NO: 9728 - DNA, 411 bp, Homo sapiens
  AL133326.10_91932
  Located on chromosome 6
  Distance between a terminus base of telomere on chromosomal short arm and 5'-terminus of this base sequence : 8976678
  Distance between 3'-terminus of neighbour sequence of sequence listing upward to telomere on chrosomal short arm and 5'-terminus of this base sequence : 175400
aggtttagtcgcttagcaaatttcgtcccttagtgacttggagaaaacttgatatatagtgccagaaaacctgcttttagaacaattaaatataaatctgaaatgcaaaaggtaaccaggagatagacctccttgttcagatggtttgtgtgctgctatgtgtgtgtgcatatatatatatatatatatatatatatatatatatatatatatatatatatatatatatatatagtttttttcctgtccttctcatctgggacttgctgtcatgattctgggcttcagaaaccgtatccccagagcatgtaacacttatcttgtctgtgaaaaatattaaatgaatgcatatgtatgaaatctgtagcttgttattaataataaattataatgccactagagctatgagtc

SEQ ID NO: 9729 - DNA, 350 bp, Homo sapiens
  AL133326.10_130598
  Located on chromosome 6
  Distance between a terminus base of telomere on chromosomal short arm and 5'-terminus of this base sequence : 9015264
  Distance between 3'-terminus of neighbour sequence of sequence listing upward to telomere on chrosomal short arm and 5'-terminus of this base sequence : 38175
tgtggagaacgaatttgttaacgctgcaaagaaatgtgaattgtggtgtaatttcatattaaacagtgtgaaaagtcataggaaatcttctttcacaagatattatttaagcgatgcatttatttactagagatgaaaatagaaataatctaaatccatttttaaatgtttttttaaaaaccacgctaaattttttaaatgtttttttaaaaaccatgctaccaaataatacaaagaacaaatttgtgcgtgtgtgtgtgtgtgtgtgtgtgtgtgtgtctgtctatcctatgcatataaatgtcttattatttacctgttataaaattctagatgtcacctcattaagc

SEQ ID NO: 9730 - DNA, 358 bp, Homo sapiens
  AL133326.10_145034
  Located on chromosome 6
  Distance between a terminus base of telomere on chromosomal short arm and 5'-terminus of this base sequence : 9029823
  Distance between 3'-terminus of neighbour sequence of sequence listing upward to telomere on chrosomal short arm and 5'-terminus of this base sequence : 14209
caaatctgaattgatcgtagacactttagctgaagattcctttcttctttaagtatgtccaccaaattctgggccttgcccaagaatcaacaggtaatgtcctgaaaaaaaagaaagaaagaaaagaagaaagaaagaaagaaagaaagaaagaaagaaagaaagaaagaaagaaagaaagaaaaaaagaaagaaagaaaggaaggaagggagagggaggagggaaggagggagggaggaagggaggaaggaagatgtttgagtatgcaaatgtggtgacatagaaagaaatggcacacggggtatttattcaggacattttgggatataagatgtgactatcaagtaatgcaatgta

SEQ ID NO: 9731 - DNA, 258 bp, Homo sapiens
  D6S1677
  Located on chromosome 6
  Distance between a terminus base of telomere on chromosomal short arm and 5'-terminus of this base sequence : 9144817
  Distance between 3'-terminus of neighbour sequence of sequence listing upward to telomere on chrosomal short arm and 5'-terminus of this base sequence : 114636
gtttccaagggctggggattagagaaatgggagatgttggtcaaagtgtacaaaccttcagttataagatcaatacattctggggacctaatgtatagcaggttgactataactaaaaatattgtattatttacttgaaatttgataaaagagcatattttatgtgtcctcaccccaccacacacacacacacacacacacacacacacacacacatacagtaattatgggtgacagaggatgtgttattttgatttc

SEQ ID NO: 9732 - DNA, 403 bp, Homo sapiens
  AL355363.3_63555
  Located on chromosome 6
  Distance between a terminus base of telomere on chromosomal short arm and 5'-terminus of this base sequence : 9231186
  Distance between 3'-terminus of neighbour sequence of sequence listing upward to telomere on chrosomal short arm and 5'-terminus of this base sequence : 86111
ctttgaagatcctgcaggtattttttaaggtttgagaaaatgacattaaaaatgaaagaaacctttcagaggccaaagcaggtggatcacaaggtcaagagagccagaccatcctggccaacatggtgaaaccccatctctactaaaaatacaaaaattagctgggtgtggtggtgcacacctgtagtcccagctactcgggaggctgaggcaggagagttgcttgaactgggaggcggaggttgcagtgagctgagatcatgccactctactccagcctgatgacagagcaagactccgtctcaaaaagcaagcaagcaagagaaagaagaaaggaaggaaggaaggaaggaaggaaggaaggaaggaaggaaagaaagaatctctacctgctccaactaat

SEQ ID NO: 9733 - DNA, 175 bp, Homo sapiens
  AL031123.14_110913
  Located on chromosome 6
  Distance between a terminus base of telomere on chromosomal short arm and 5'-terminus of this base sequence : 9308668
  Distance between 3'-terminus of neighbour sequence of sequence listing upward to telomere on chrosomal short arm and 5'-terminus of this base sequence : 77079
gtatagccaactgcttccaaggattcttattaaccatctcccagaaatagagctcttcaatcatcacatacacacacacacacacacacacacacacacacacacacacacacttcctcatcaggcttccctaatctcaataaatggcacccccatctatccagatgctcaaacc

SEQ ID NO: 9734 - DNA, 152 bp, Homo sapiens
  D6S1668
  Located on chromosome 6
  Distance between a terminus base of telomere on chromosomal short arm and 5'-terminus of this base sequence : 9308668
  Distance between 3'-terminus of neighbour sequence of sequence listing upward to telomere on chrosomal short arm and 5'-terminus of this base sequence : -175
gtatagccaactgcttccaaggattcttattaaccatctcccagaaatagagctcttcaatcatcacatacacacacacacacacacacacacacacacacacacacacacacttcctcatcaggcttccctaatctcaataaatggcaccc

SEQ ID NO: 9735 - DNA, 258 bp, Homo sapiens
  AL136361.6_19815
  Located on chromosome 6
  Distance between a terminus base of telomere on chromosomal short arm and 5'-terminus of this base sequence : 9411224
  Distance between 3'-terminus of neighbour sequence of sequence listing upward to telomere on chrosomal short arm and 5'-terminus of this base sequence : 102404
ccaaatgaaataaagaatatccagttcctcctttttaaataaataaatatatatatatatatatatataaaattatgaaataatttaaatacgtagaaatatgcagaaataatagatcaaaggcccaagtacccactcatcagctttaacattttgctgtctatactacagatttttttattttcaaaaacaaaaatgtaatcagtcaagcaagcacatggcagctcctgaagggatttgatgttgagcaatcgcaat

SEQ ID NO: 9736 - DNA, 336 bp, Homo sapiens
  chr6.fa.O7frz.7077302
  Located on chromosome 6
  Distance between a terminus base of telomere on chromosomal short arm and 5'-terminus of this base sequence : 9540808
  Distance between 3'-terminus of neighbour sequence of sequence listing upward to telomere on chrosomal short arm and 5'-terminus of this base sequence : 129326
gtcgctaacatgtatcaaatctttgctatgtatagaccactgttctatgtctttaaataaatatattctctcatttaatctgctcctccaaaaacaaaaaacaaaaaaacaaaaaaacccagccaaacaaaaactacacagttgttactattattattcccagtttctcagtttggaaactgaagcacagaaatgttaagaaacttgtctaaagacacacagcacttagcaagtagtggagtttggatttgaagccaagcaatgctgtttcttctcgtgtgtgtgtgtgtgtgtgtgtgtgtgtgtgtgtgtgtgtatttactttccatggtacat

SEQ ID NO: 9737 - DNA, 227 bp, Homo sapiens
  D6S1598
  Located on chromosome 6
  Distance between a terminus base of telomere on chromosomal short arm and 5'-terminus of this base sequence : 9654621
  Distance between 3'-terminus of neighbour sequence of sequence listing upward to telomere on chrosomal short arm and 5'-terminus of this base sequence : 113477
agcatggattctgttgtttgtaactaaaagacctgactgatacaggatccaaaagattgacaactgtgtgtgtgtgtctgtgtgtgtgtgtgtgtgtgtgtgtgccctcacattcaaattaatgagtctccaaaatgctattgatttctccaaatgcattttaaaaacctaggttgaatgacaagaagttatttaacttgattgatgattgcctcagaaagccttga

SEQ ID NO: 9738 - DNA, 478 bp, Homo sapiens
  chr6.fa.O7frz.7408997
  Located on chromosome 6
  Distance between a terminus base of telomere on chromosomal short arm and 5'-terminus of this base sequence : 9871755
  Distance between 3'-terminus of neighbour sequence of sequence listing upward to telomere on chrosomal short arm and 5'-terminus of this base sequence : 216907
gacttctgtcagaaataccactaatctttattttctcagtgtggagacttggcagacatacatcctaagctcttaacgtgtgttttcccatactgtttctgtaaagtgtctaagaaaagagtaccagtgtgcacttcctcttgagcccctctgctgagcccagagatgaaatgaagagcttttacaattgtttccatgctttctacctgttttttctagctaaagcgcaagcttcataagcattcgggactcttttgtcctcacttttttattaccagtgcctggcagatacccggtgctgcaaaagtacttgtcaggtgggtgggagggtgggtggatggatggatggacagatggatggatggatggatggatggatggatggatggatggatggatggatggtagcgttctgggagtatttgttgtgtgaatgaatgaatggtcaggtccttaataatcaggattggataatgca

SEQ ID NO: 9739 - DNA, 458 bp, Homo sapiens
  chr6.fa.O7frz.7704939
  Located on chromosome 6
  Distance between a terminus base of telomere on chromosomal short arm and 5'-terminus of this base sequence : 9939040
  Distance between 3'-terminus of neighbour sequence of sequence listing upward to telomere on chrosomal short arm and 5'-terminus of this base sequence : 66807
gctgtcataagcttacattcacaaggggtgatgggcaatggaaggacaaggtaacttctgtgtgtgtgtgtgtgtgtgtgtgtgtgtgtgagagagagagagagagagagagagagagtctgtctcgctctgtcgcccaggctgagagacagagagacttgctctgtcgcccaggctgcagtgcagtggcatgatctcggctcactgcaacctctgcctcccgggttcaagtgattctcctgcctcagctttccaagtagctgggattacaggtgcgcgccacacctggctaatttttgtatttttagtagacacagggtttcaccatgttggccaggttggtctcgaactcctgacctcaagtgatctgcccacctcagcctcccaaagtgctgggattacaggtgtgagccactgcggccagcccaaggtaacttctgatagtggtgaagataatg

SEQ ID NO: 9740 - DNA, 262 bp, Homo sapiens
  D6S1640
  Located on chromosome 6
  Distance between a terminus base of telomere on chromosomal short arm and 5'-terminus of this base sequence : 10069925
  Distance between 3'-terminus of neighbour sequence of sequence listing upward to telomere on chrosomal short arm and 5'-terminus of this base sequence : 130427
ggattacaggcacccagtagctgggattacaggagcccaccaccactcccgactaattgtgtgtgtgtgtgtgtgtgtgtgtgtgtgtgtgtgtgtgtgtgtgtgtgtgtgtgtttgagatggagtctggctctctcacccatgctggagtacagtggcacgatctcggctcaccacaacctctgcctcccgggttcaagtgattctcctgcctcagcctccaagtaactgagatttcaggtgcatgttagcatgcctggct

SEQ ID NO: 9741 - DNA, 335 bp, Homo sapiens
  AL390026.1_21190
  Located on chromosome 6
  Distance between a terminus base of telomere on chromosomal short arm and 5'-terminus of this base sequence : 10280675
  Distance between 3'-terminus of neighbour sequence of sequence listing upward to telomere on chrosomal short arm and 5'-terminus of this base sequence : 210488
cttgattgtattaatgacagcaaggcaggtgctcactcagtctcaggttcttgtgagaccaacttggagactgaatgtggacttctcatgtcctctcgcagtttgaaactgtgtggctctgccctgggctcactcactgtatttgtcagggtttttccagagaaatagagtcaatagggcgtgtggagagagaaagagaaagagagagagagagagagagagatttatttcaagggatcagctcatgcaattgtggaggctgacaatttcgaagtccacagggtggacccgcaggctggagacccagggaagagttgatgttacaggtgaagtcc

SEQ ID NO: 9742 - DNA, 424 bp, Homo sapiens
  AL390026.1_29062
  Located on chromosome 6
  Distance between a terminus base of telomere on chromosomal short arm and 5'-terminus of this base sequence : 10288434
  Distance between 3'-terminus of neighbour sequence of sequence listing upward to telomere on chrosomal short arm and 5'-terminus of this base sequence : 7424
ctccagtatgacctcatcttaacttaattacatctgcaaagaccttatttccaaataagatcatatttacaggtaccaggggttagaactcaaacataatctttttggaggacgcaattcaactcacaaaacacactaaggatggagaacgggaagacagaagcccctgatagccttgtgcagccactcccaaccttgggcagcctacttgtgacttcttgttgtgtgattcaaataaattccctatttactgaagccaccgtttaggttttcttttgctcgcagttgaacacatttctaactgccacactttatccatccatccatccatccatccatccatccatccatccattccatccatccatccagtcaatcagtttttaggaagtacctatattgtgctagtgatgtcttactcaga

SEQ ID NO: 9743 - DNA, 469 bp, Homo sapiens
  chr6.fa.O7frz.8505863
  Located on chromosome 6
  Distance between a terminus base of telomere on chromosomal short arm and 5'-terminus of this base sequence : 10304413
  Distance between 3'-terminus of neighbour sequence of sequence listing upward to telomere on chrosomal short arm and 5'-terminus of this base sequence : 15555
gattaacttcttagatgaggatcatgcttcttcatctctgcctgaaagagaaagttgttattattattattattattattattattattttgagatggagtttcactcttgttgcccaggctggagtgcaatggtgtgatcttggctcaccacaatgtccgcctcttgggttcaagcgattctcctgcctcagcctcccgtgtagctggggttacaggcatgtgccaccatgcctggctaattttgtatttttagtagagacagggtttctccatgttggtcaggctggtctcgaactcccaacctcaggtgatctgcccgcctcggcctcccaaagtgctgggattataggcgtgagccaccgcgcccatccaaaaaaggtgttttttcccctctttgttatgcaagttattttagtttgggtctccacagcaagcttgaatatttctttgaaatttaccgcttatct

SEQ ID NO: 9744 - DNA, 199 bp, Homo sapiens
  AL096800.20_3628
  Located on chromosome 6
  Distance between a terminus base of telomere on chromosomal short arm and 5'-terminus of this base sequence : 10586136
  Distance between 3'-terminus of neighbour sequence of sequence listing upward to telomere on chrosomal short arm and 5'-terminus of this base sequence : 281254
aaaccattgtgacttagctgactcttcagtacacttgagagaaccaagaaaagaatcaataaacttgaagataggatattagaaattacccaaccaaaacacagagaaaacagttaaaaacacacacacacacacacacacacacagaacattgaagagctgtggaacaatatcaaacgatctaacaatgagtggttac

SEQ ID NO: 9745 - DNA, 231 bp, Homo sapiens
  AL096800.20_95527
  Located on chromosome 6
  Distance between a terminus base of telomere on chromosomal short arm and 5'-terminus of this base sequence : 10678047
  Distance between 3'-terminus of neighbour sequence of sequence listing upward to telomere on chrosomal short arm and 5'-terminus of this base sequence : 91712
tagaagttcgaattgcttgaacctgagaggcggaggttgcagtgagccgagactgcaccactgaactccagcctgggtaacagagcgagactccgtctcaaaaacaaacacacacacacacacacacacctacaaagcacccgaagtcactgttaattttggcatgttaattccagcacttgaatgaaaaagggacacgcagcgtactcagatgctggttaactcagatgt

SEQ ID NO: 9746 - DNA, 137 bp, Homo sapiens
  D6S1674
  Located on chromosome 6
  Distance between a terminus base of telomere on chromosomal short arm and 5'-terminus of this base sequence : 10707888
  Distance between 3'-terminus of neighbour sequence of sequence listing upward to telomere on chrosomal short arm and 5'-terminus of this base sequence : 29610
ccttaaacaaacaataagaccacctctctctctctctctctcacacacacacacacacacacacacacacacacacacacagtcaacagtaattttttttttttttgagacaaggtctggctctgttttctaggctg

SEQ ID NO: 9747 - DNA, 357 bp, Homo sapiens
  chr6.fa.O7frz.8612358
  Located on chromosome 6
  Distance between a terminus base of telomere on chromosomal short arm and 5'-terminus of this base sequence : 10804603
  Distance between 3'-terminus of neighbour sequence of sequence listing upward to telomere on chrosomal short arm and 5'-terminus of this base sequence : 96578
gcaaacagaatctttatatgttctctagagaaaaggtcagaggctctgtctgggtatgtgtgtgttttccggaacattctttttcatagcagtctctgtgaacttccagatttatatagcctgtaaaggtgaaagcaaatgtaaagaacattgtttggtttccttagaagagaggtgcagaaaatgtgtttagttctattacttggataataaaacaaatcttacggattttgagccttttttagaacatggtctatgttactccagttagcaacttgcctatttttttatttttatatttatttatttatttatttatttatttattttgcagtttggtacaggaaagtttataca

SEQ ID NO: 9748 - DNA, 262 bp, Homo sapiens
  D6S309
  Located on chromosome 6
  Distance between a terminus base of telomere on chromosomal short arm and 5'-terminus of this base sequence : 10885533
  Distance between 3'-terminus of neighbour sequence of sequence listing upward to telomere on chrosomal short arm and 5'-terminus of this base sequence : 80573
cttgtgcgaatgaacaccgtggagtgcagttgcacagacccagatggtggagcctgccgcacacctaggctgtgtggtagaaacctttgctcccaggtcacaaaactgcacaggctggtactgtactgaatactgtaggcaattgtgacacaatggtaagtgtgtgtgtgtgtgtgtgtgtgtgtgtgtgtgtgtgtttgtgatggagtcttgctctgttgcccaggctggaatgcagtggcacaatctcggctcactgcaa

SEQ ID NO: 9749 - DNA, 334 bp, Homo sapiens
  chr6.fa.O7frz.8802490
  Located on chromosome 6
  Distance between a terminus base of telomere on chromosomal short arm and 5'-terminus of this base sequence : 10983664
  Distance between 3'-terminus of neighbour sequence of sequence listing upward to telomere on chrosomal short arm and 5'-terminus of this base sequence : 97869
aggaatgcctgttcttatttagggcctcgggttctcaggcttgagggtggggcctttgcaggggaacagccctcttctacccagtatttccctgccttctgttcatttccctccctccctcctttctttctttccttccttctttcctttcttccttccttccttccttccttccttccttccttccttccttccttccttttctctctctttatggcaggtttttctctgtcacccaggctggagtgcaatcatagctcactccagctttgaactcctgggttcaagtgatcctcctgcctcagcttcctgagtaggagtagctaggactgca

SEQ ID NO: 9750 - DNA, 208 bp, Homo sapiens
  AL031780.1_82599
  Located on chromosome 6
  Distance between a terminus base of telomere on chromosomal short arm and 5'-terminus of this base sequence : 11165100
  Distance between 3'-terminus of neighbour sequence of sequence listing upward to telomere on chrosomal short arm and 5'-terminus of this base sequence : 181102
actgaagagtatccacttgtcaagctgccattctgaaacccagatgagtagctgagaagctcattttgcttgccctcgggacagctaagctttacatttttgatgacaatggaatgcagtagtttatgtcaggtgtgtgtgtgtgtgtgtgtgtgtgtgtgtgtgcgtgcatgtgcgcacctgcatgttattcagcttctgtttgagg

SEQ ID NO: 9751 - DNA, 102 bp, Homo sapiens
  D6S277
  Located on chromosome 6
  Distance between a terminus base of telomere on chromosomal short arm and 5'-terminus of this base sequence : 11165195
  Distance between 3'-terminus of neighbour sequence of sequence listing upward to telomere on chrosomal short arm and 5'-terminus of this base sequence : -113
atttttgatgacaatggaatgcagtagtttatgtcaggtgtgtgtgtgtgtgtgtgtgtgtgtgtgtgtgcgtgcatgtgcgcacctgcatgttattcagct

SEQ ID NO: 9752 - DNA, 90 bp, Homo sapiens
  D6S263
  Located on chromosome 6
  Distance between a terminus base of telomere on chromosomal short arm and 5'-terminus of this base sequence : 11210392
  Distance between 3'-terminus of neighbour sequence of sequence listing upward to telomere on chrosomal short arm and 5'-terminus of this base sequence : 45095
cttaaggcaaaattcttttcaacacacacacacacacacacacacacacacggagacttcctgcttggtattttatgttcttactttgag

SEQ ID NO: 9753 - DNA, 278 bp, Homo sapiens
  AL031780.1_7128
  Located on chromosome 6
  Distance between a terminus base of telomere on chromosomal short arm and 5'-terminus of this base sequence : 11240636
  Distance between 3'-terminus of neighbour sequence of sequence listing upward to telomere on chrosomal short arm and 5'-terminus of this base sequence : 30154
gagttggaggctgttagacttacttgcatctagatctaagcccataggggattgtgtatgtgatgcttaagtgtgtgtgtgtgtgtgtgtgtgtgtgtgtatgaagctggctttatcagaattactgggtgatggtatggaagaaagagaggctctcaaagggcactaaaaaggatactgaagctatgaatgaatgtctaaaagtgattgaagatgagtgatatggtttcactgtccaaaaatatctaaagggaattagcctttacgtatcaaggaaa

SEQ ID NO: 9754 - DNA, 219 bp, Homo sapiens
  AL133261.8_3448
  Located on chromosome 6
  Distance between a terminus base of telomere on chromosomal short arm and 5'-terminus of this base sequence : 11251143
  Distance between 3'-terminus of neighbour sequence of sequence listing upward to telomere on chrosomal short arm and 5'-terminus of this base sequence : 10229
gaagctttcttgtacttattgcagtagagtaattaaagtgtaccttttcatctttacctacacacgtacacacacacacacacacacacacacacaaacacacacacacaccaatccattttactctgacatagacttgctgcgggcggggcttgggggcccagaggttgggggagatgcaaattctctctggagccctcctgagacctaggaatgaac

SEQ ID NO: 9755 - DNA, 312 bp, Homo sapiens
  AL135912.7_27778
  Located on chromosome 6
  Distance between a terminus base of telomere on chromosomal short arm and 5'-terminus of this base sequence : 11342666
  Distance between 3'-terminus of neighbour sequence of sequence listing upward to telomere on chrosomal short arm and 5'-terminus of this base sequence : 91304
caaatgagaaggactcatcttagcttcccatgggccggtcgcacaaaggagtgatgttggagaagagtcgctgagtccattgcttctctcagtggttttgcacctttggggaaccatgtgtgcctgctttggccccacattcagccctaaccttttcttgtagcccaccagtaggagtttggtcctcttgccccagtgttaaatctcactgctcaaagaactttaccccatggaatttatgtattcattcattcattcattcattcattcattcattcattctttagtgggtgcctacaatgtactaggttg

SEQ ID NO: 9756 - DNA, 233 bp, Homo sapiens
  AL135912.7_51877
  Located on chromosome 6
  Distance between a terminus base of telomere on chromosomal short arm and 5'-terminus of this base sequence : 11366957
  Distance between 3'-terminus of neighbour sequence of sequence listing upward to telomere on chrosomal short arm and 5'-terminus of this base sequence : 23979
catcaacatagatccttatttcctgaaatattcggaacctacatatacttacacacacacacacacacacacacacacaccccgcacccaagcacacaattatttttgtttgttagtatgtggtgttcttttacaaatatattaatgagctatttttaaggttttaaaaatggtttgctttgtaatgggtggcctaaaagtcttagttttacttctctggaaattctgacttt

SEQ ID NO: 9757 - DNA, 298 bp, Homo sapiens
  D6S296
  Located on chromosome 6
  Distance between a terminus base of telomere on chromosomal short arm and 5'-terminus of this base sequence : 11514234
  Distance between 3'-terminus of neighbour sequence of sequence listing upward to telomere on chrosomal short arm and 5'-terminus of this base sequence : 147044
tctatcccaggtttctccaatagttacaaggaaattcattgcctacttgtaaagttattctgatttaaaacaatccagcaaccaaaaatctagtttagtagagagccaaaaaggtcatgaccaattgctcagaaacagagaaaagtctggacacaggttaggtcatcagataggatacatgcacacacacacacacacacacacacacacacacacacacacacacacacacacagagagagagagagagagagagagagagagagagagagatgagtgtcttgattatagatgaagc

SEQ ID NO: 9758 - DNA, 247 bp, Homo sapiens
  D6S410
  Located on chromosome 6
  Distance between a terminus base of telomere on chromosomal short arm and 5'-terminus of this base sequence : 11655894
  Distance between 3'-terminus of neighbour sequence of sequence listing upward to telomere on chrosomal short arm and 5'-terminus of this base sequence : 141362
tttctgttttatgaatttcttgttagtattgagaattcacgaaggctatgtgtaatacaaataattctaaatactacattttgtttacttaaaataaaaatctaaacttcctttaattcaatatcactctcactcccatctcaccacccagtcaagtattttgattgaactcacatgcacatacacacacacacacacacacacacacacacaaacacacagacatgcacacacagtcatatagaca

SEQ ID NO: 9759 - DNA, 177 bp, Homo sapiens
  AL137220.8_31420
  Located on chromosome 6
  Distance between a terminus base of telomere on chromosomal short arm and 5'-terminus of this base sequence : 11729653
  Distance between 3'-terminus of neighbour sequence of sequence listing upward to telomere on chrosomal short arm and 5'-terminus of this base sequence : 73512
attaaagaatgaccagtctttgagaatgttgtcacctaaattttctaaacacattgccatgaatttttatgaaaacacagctctcctgtgtgggtatgtgtgagtgtgagtgtgtgtgtgtgtgtgtgtgtgtgtgtgtgtgtgtgtatgtctgtcttagccagaagtagagtcctt

SEQ ID NO: 9760 - DNA, 345 bp, Homo sapiens
  AL137220.8_82791
  Located on chromosome 6
  Distance between a terminus base of telomere on chromosomal short arm and 5'-terminus of this base sequence : 11780910
  Distance between 3'-terminus of neighbour sequence of sequence listing upward to telomere on chrosomal short arm and 5'-terminus of this base sequence : 51080
aattaagagtgatctgagcagaagttataattactctggacatacttcttggcatgagactctaggttagtatagaaaagatatcctctgatgtactttttactcattcctttgtcttcatttctgggaaaattcacttctaaacctgtatcacccacagaaataagtatcacaccaatattaagactagtctattcaagtggctgagggaatttctgctgtcgtgtgtgtgtgtgtgtgtgtgtgtgtgtgtgtgtgtgtgtgtgtgtgcgcgcgcgcgcgcatgtgtattttaaaatgtactgtaagataaatttatttttctgttaaggtcaccaaatttga

SEQ ID NO: 9761 - DNA, 273 bp, Homo sapiens
  Z66877
  Located on chromosome 6
  Distance between a terminus base of telomere on chromosomal short arm and 5'-terminus of this base sequence : 11797310
  Distance between 3'-terminus of neighbour sequence of sequence listing upward to telomere on chrosomal short arm and 5'-terminus of this base sequence : 16055
tgggctacttgacagcacagttggggaccagagacaaccttgttgaatttatgggttctgttttggttttgaccaaaagttaaaaaccacagggctgtgtgtgtgtgtgtgtgtgtgtgtgtgtgtgtacatctgtgtgtgtaaaacatgaatcattgagaatggtgaaacaatccagagtagaatgttccagttgtttgcatatctatttttcataaaaaccacagacattttgatgtgtatgccttgaattaatgcagaaaccaatggcct

SEQ ID NO: 9762 - DNA, 189 bp, Homo sapiens
  AL031785.1_102129
  Located on chromosome 6
  Distance between a terminus base of telomere on chromosomal short arm and 5'-terminus of this base sequence : 11860668
  Distance between 3'-terminus of neighbour sequence of sequence listing upward to telomere on chrosomal short arm and 5'-terminus of this base sequence : 63085
gcatctcagcatccattactagatgtaggtggactagtgtgtgaacaacagcattgtctttttaaaacactgatgaagatgaactcatatctataggtaaagcagtttaaaaagtttacacacacacacacacacacacacatatatatgtatatataattttttttctcaccaactgcaaataagatt

SEQ ID NO: 9763 - DNA, 256 bp, Homo sapiens
  Z67082
  Located on chromosome 6
  Distance between a terminus base of telomere on chromosomal short arm and 5'-terminus of this base sequence : 11964607
  Distance between 3'-terminus of neighbour sequence of sequence listing upward to telomere on chrosomal short arm and 5'-terminus of this base sequence : 103750
cctttaagtaattcggccttttattatcatgttgcttacccagtatatgtatgttctccctcttattctacaaacacacacacacacacacacacacacacacacacaaaatagaataatttcatttgattgtttattgattaatgatttatacatgacctttatcaaagatgagtgctaacctttttataccctttgtataacattttgttctcttttttttttgagtcagagtctcgttctatcatgcagtgac

SEQ ID NO: 9764 - DNA, 349 bp, Homo sapiens
  chr6.fa.O7frz.9742826
  Located on chromosome 6
  Distance between a terminus base of telomere on chromosomal short arm and 5'-terminus of this base sequence : 12045143
  Distance between 3'-terminus of neighbour sequence of sequence listing upward to telomere on chrosomal short arm and 5'-terminus of this base sequence : 80280
agttaaccggtgacttgttaacgtatctctctttttcgctctgtctggattttcctttctctctttcacatcacatctctctctctctctctctctctctctctcacacacacacacacacacacacacacacacacacacacagcattctactttgtgaatatctatgaacctttttattagcttcaacttaattgccagaagtctttgctcccttcctctagattaagttagatgtttcttctttatgttcctgtaagatcctacttttcctctgtcataacactcaagcttattaaatataattgaccatttaatcatgtcttcctgactagatggtaacatctac

SEQ ID NO: 9765 - DNA, 279 bp, Homo sapiens
  AL031904.1_71217
  Located on chromosome 6
  Distance between a terminus base of telomere on chromosomal short arm and 5'-terminus of this base sequence : 12115331
  Distance between 3'-terminus of neighbour sequence of sequence listing upward to telomere on chrosomal short arm and 5'-terminus of this base sequence : 69839
ttagatagcttacaaatgtttccaccaaaagaagttaaatgatggctttccatgaaaagaaatcaaatcctaaataatccaggaaaatctctgttctaatgtgctctctgtccttagattgagaccccccgcaaatcagaatctgtatttcttcagtccttggtacacctgcttttaacatggggaatgcagggggagagggaacacaaacacacacacacacacacacacacacacacacacacacacacaactccctgaatcgatgaattgttcaat

SEQ ID NO: 9766 - DNA, 218 bp, Homo sapiens
  AL031904.1_16920
  Located on chromosome 6
  Distance between a terminus base of telomere on chromosomal short arm and 5'-terminus of this base sequence : 12169821
  Distance between 3'-terminus of neighbour sequence of sequence listing upward to telomere on chrosomal short arm and 5'-terminus of this base sequence : 54211
atctgcataatacatagctgcataatatatgtatatatatatatatatatatatatatagtatacctctgcttttctatcctaaactctaatttgagtctttgcagaaactcagatgtctttaccatgggatttatttctcgtttttaagatgtacaatataaacgttgtctaggattttgttttcttaagtttttgcttactttccactgactaaat

SEQ ID NO: 9767 - DNA, 348 bp, Homo sapiens
  AL031906.1_75254
  Located on chromosome 6
  Distance between a terminus base of telomere on chromosomal short arm and 5'-terminus of this base sequence : 12210284
  Distance between 3'-terminus of neighbour sequence of sequence listing upward to telomere on chrosomal short arm and 5'-terminus of this base sequence : 40245
cagactggctatccttgctcctcagcttgcagacagcctattgtgggaacttgtgaccatataagttaatacttaataaagtcctatatatatacacacacacacatatatacacatatatgtgtgtatatatatatgtgtgtgtgtatatatatgtgtgtgtgtgtgtgtgtgtgtgtgtgtgtgtgtgtgtgtgtatcctattagttttgtccctctaagaaaaccctaatacagattttggtaccaggagtggggtccagaagagtagaaggctctgcaacaggtccaggctgctgcgtaagctgttctgccacttgggccatatgaccaagcagattcaatggt

SEQ ID NO: 9768 - DNA, 321 bp, Homo sapiens
  AL031906.1_70927
  Located on chromosome 6
  Distance between a terminus base of telomere on chromosomal short arm and 5'-terminus of this base sequence : 12214621
  Distance between 3'-terminus of neighbour sequence of sequence listing upward to telomere on chrosomal short arm and 5'-terminus of this base sequence : 3989
tatcaggagaacagcataggagtaatcacccccatgattcaattacctctcacctggtccctaccatgacacatggggattatgggaactacagttcaagatgagatatgcgggagggggacagagttaagccatatcacacgtgtatgtgcatgtgcctgcacacacacacacacacacacacacagaggaaaatattgacatgaagggagctatgatttcctgcttatattaatatatgtaaaacccattggcacaatttatggggccttcaatgctattccttgtctgatccaagtccaggacacttctagctttatt

SEQ ID NO: 9769 - DNA, 323 bp, Homo sapiens
  AL021332.1_4084
  Located on chromosome 6
  Distance between a terminus base of telomere on chromosomal short arm and 5'-terminus of this base sequence : 12423135
  Distance between 3'-terminus of neighbour sequence of sequence listing upward to telomere on chrosomal short arm and 5'-terminus of this base sequence : 208193
ttgcataattaactgaatggacattgtaaacattctccctgaagtcctttcactcagaaaataataataattaaagcttcccagtggacagtatcttttttgacctgaaatgcacatatatctatctatctatctatctatctatctatctatctatctatctatctatagatatgccatttatctctatatactcatgtctaacatataatttttagaattcaactgttcattttcttttctgtaggacagaacatacatgtgtcacctacaaagtatcagtagggctcctacagctactggtttcaagtaggatagaaatt

SEQ ID NO: 9770 - DNA, 256 bp, Homo sapiens
  AL021332.1_21747
  Located on chromosome 6
  Distance between a terminus base of telomere on chromosomal short arm and 5'-terminus of this base sequence : 12440718
  Distance between 3'-terminus of neighbour sequence of sequence listing upward to telomere on chrosomal short arm and 5'-terminus of this base sequence : 17260
tgagataaattcatggcatgtgcttttttttgcaaattttaattttccattcaataagaaattatggtcatctctacaagtcataaaatatacatccaccttttttcttaaaatggcctttttcttcttgatcccccttcaggccttccatccatagttccctaaatccttttcaattcacctgccccatataatcagacacacacacacacacacacacacacacacacacacaaatgaacatatggacatgtac

SEQ ID NO: 9771 - DNA, 247 bp, Homo sapiens
  AL021332.1_22555
  Located on chromosome 6
  Distance between a terminus base of telomere on chromosomal short arm and 5'-terminus of this base sequence : 12441634
  Distance between 3'-terminus of neighbour sequence of sequence listing upward to telomere on chrosomal short arm and 5'-terminus of this base sequence : 660
gacaaatggataattccatgtaactcccaacacaaataaaatctaaaacattttttgcatcacactaaaaagttttcctgtaccctttatacacacacacacacacacacacacacacacactcctagcaaacagtgatctgatccccagcatgataaattagaattctgctacaatatctcacatagatataataatgcagtattggctctcttggttctggcttctttcactcagaacagtagct

SEQ ID NO: 9772 - DNA, 155 bp, Homo sapiens
  HUMUT6077
  Located on chromosome 6
  Distance between a terminus base of telomere on chromosomal short arm and 5'-terminus of this base sequence : 12503049
  Distance between 3'-terminus of neighbour sequence of sequence listing upward to telomere on chrosomal short arm and 5'-terminus of this base sequence : 61168
cgagtttttagccattctatttcagcatagaattctcatctatctatctatctatctatctatctatctatctatctatctatctatctatctatctatagagagagagagacctgctaaagtttctctaaagagtcctacaggagaaaaagcac

SEQ ID NO: 9773 - DNA, 276 bp, Homo sapiens
  AL021332.1_83917
  Located on chromosome 6
  Distance between a terminus base of telomere on chromosomal short arm and 5'-terminus of this base sequence : 12503057
  Distance between 3'-terminus of neighbour sequence of sequence listing upward to telomere on chrosomal short arm and 5'-terminus of this base sequence : -147
tagccattctatttcagcatagaattctcatctatctatctatctatctatctatctatctatctatctatctatctatctatctatctatagagagagagagacctgctaaagtttctctaaagagtcctacaggagaaaaagcacagcaggcagctgggtcaatacaattgatctcatcgtttaacattttgcatcagagaaaaagtcagtggcaagagcctcaccttccagcggggtcctgctgctccctttgagtcattagttacttctgtg

SEQ ID NO: 9774 - DNA, 256 bp, Homo sapiens
  chr6.fa.O7frz.10275983
  Located on chromosome 6
  Distance between a terminus base of telomere on chromosomal short arm and 5'-terminus of this base sequence : 12579623
  Distance between 3'-terminus of neighbour sequence of sequence listing upward to telomere on chrosomal short arm and 5'-terminus of this base sequence : 76290
tatgctcagtcctaaactgaacatggcttaacttaactaaactgaaatcccaattatactattatggtgtatctacacacacacacacacacacacacacacacacacactattttggccatatatctacaaatattcattgaataaaagaaacgctatttataaaacatataaaatagatgtaaaaattgtatatgagcacataatatatgtgtttgagagtgccagatgaatctgaattgatcaactgtaattt

SEQ ID NO: 9775 - DNA, 336 bp, Homo sapiens
  AL031122.3_69639
  Located on chromosome 6
  Distance between a terminus base of telomere on chromosomal short arm and 5'-terminus of this base sequence : 12651937
  Distance between 3'-terminus of neighbour sequence of sequence listing upward to telomere on chrosomal short arm and 5'-terminus of this base sequence : 72058
tccaaagtaaccactaaagacaattttggtaaagttatatgttgcataaacatccaacccatgacatagctgtgcttgggaaccagtctaactagtgtatcttgactttcaggccagaatttaaaataacaaaaacatacacacacacacacacacacacacacacacacacacacacacacacacagaaagacaagagaaagcgagagagcaagagagagaagtgagagagaaagacaccacaaaattctattgcaaagcaaaaatcacctgtgttacaattatttccttctgccgtcctctgcattctttctttatttgaggctgtcatagttc

SEQ ID NO: 9776 - DNA, 283 bp, Homo sapiens
  AL031122.3_68403
  Located on chromosome 6
  Distance between a terminus base of telomere on chromosomal short arm and 5'-terminus of this base sequence : 12653277
  Distance between 3'-terminus of neighbour sequence of sequence listing upward to telomere on chrosomal short arm and 5'-terminus of this base sequence : 1004
tggaagtaatgatagccaagacaaagaacatactgtgatttaaacacacacacacacacacacacacacacacacacacacacgaaacaagggagacacactgaatttgaagcatagctttataactttttatccctgtggtcttggccaagccatttaactctattctccttcagatttttctgtttaatcagagtaataacaacacaatcaaaggaaagttgctatatgaattgaataagataatgctgattgagcccttaagacagatcaaggagcatta

SEQ ID NO: 9777 - DNA, 120 bp, Homo sapiens
  D6S470
  Located on chromosome 6
  Distance between a terminus base of telomere on chromosomal short arm and 5'-terminus of this base sequence : 12686320
  Distance between 3'-terminus of neighbour sequence of sequence listing upward to telomere on chrosomal short arm and 5'-terminus of this base sequence : 32760
acactgcaaaacgattaccacaatgaaattaattaacacatccatcaccacacttgctaccaatgtgtgtgtgtgtgtgtgtgtgtgtgtgtgtggtatgtgtatatggtgagatcgctt

SEQ ID NO: 9778 - DNA, 147 bp, Homo sapiens
  Z24589.1_76
  Located on chromosome 6
  Distance between a terminus base of telomere on chromosomal short arm and 5'-terminus of this base sequence : 12686329
  Distance between 3'-terminus of neighbour sequence of sequence listing upward to telomere on chrosomal short arm and 5'-terminus of this base sequence : -111
aacgattaccacaatgaaattaattaacacatccatcaccacacttgctaccaatgtgtgtgtgtgtgtgtgtgtgtgtgtgtgtggtatgtgtatatggtgagatcgcttaagagataccctcttagcaaatttcaagtgaacaat

SEQ ID NO: 9779 - DNA, 184 bp, Homo sapiens
  AL031122.3_35348
  Located on chromosome 6
  Distance between a terminus base of telomere on chromosomal short arm and 5'-terminus of this base sequence : 12686329
  Distance between 3'-terminus of neighbour sequence of sequence listing upward to telomere on chrosomal short arm and 5'-terminus of this base sequence : -147
aacgattaccacaatgaaattaattaacacatccatcaccacacttgctaccaatgtgtgtgtgtgtgtgtgtgtgtgtgtgtgtggtatgtgtatatggtgagatcgcttaagagataccctcttagcaaatttcaagtgaacaatacaaaattattagctagtcaccatgctgtacattaga

SEQ ID NO: 9780 - DNA, 280 bp, Homo sapiens
  AL031122.3_16968
  Located on chromosome 6
  Distance between a terminus base of telomere on chromosomal short arm and 5'-terminus of this base sequence : 12704620
  Distance between 3'-terminus of neighbour sequence of sequence listing upward to telomere on chrosomal short arm and 5'-terminus of this base sequence : 18107
taccaggcacttaccatctaatacaaagacaacagactcacacataaggggagacattccatccagacacaaaagtgagggtttattctgtgttggctgtgtttggggtgcttggattttgttgtctactttaggggtgtgtgtgtgtgtgtgtgtgtgtgtgtgtgtgtgtgtgagagagagaatgcaagattcttgagatgcaagattacaagcactaaaacagttacggaactaggggacaaaacagagttcgctgattatcaatttaaggcttcac

SEQ ID NO: 9781 - DNA, 232 bp, Homo sapiens
  AL031122.3_13142
  Located on chromosome 6
  Distance between a terminus base of telomere on chromosomal short arm and 5'-terminus of this base sequence : 12708458
  Distance between 3'-terminus of neighbour sequence of sequence listing upward to telomere on chrosomal short arm and 5'-terminus of this base sequence : 3558
gaagtcattgcctttgtattagacttaacaacatgttaacattctgtgaaaagaagacctgtttctacaagttcttcatggagctcagaggagcaggcagaaacatcttgcccacagtcagtcacacacacacacacacacacacacacacacacacacacactctttctctctcgatctcctgagaaaattttaaatccttaaaacttctgaaggctttataggaaatgtc

SEQ ID NO: 9782 - DNA, 230 bp, Homo sapiens
  Z67730
  Located on chromosome 6
  Distance between a terminus base of telomere on chromosomal short arm and 5'-terminus of this base sequence : 12748450
  Distance between 3'-terminus of neighbour sequence of sequence listing upward to telomere on chrosomal short arm and 5'-terminus of this base sequence : 39760
caatggacccaaggattcgccaatacattgtgaagatgagacgagttgctgtcaacttttaggaggtgacccaggacactgaaagccattcttccagaagaggcaggagcctgtgatgcccctaaacacaggtgcaaccatatatgtacacacacacacacacacacacacacacacacacgcaccccaaagcctacttacttaagctcatttcaacagaacactgccag

SEQ ID NO: 9783 - DNA, 264 bp, Homo sapiens
  G12428
  Located on chromosome 6
  Distance between a terminus base of telomere on chromosomal short arm and 5'-terminus of this base sequence : 12864312
  Distance between 3'-terminus of neighbour sequence of sequence listing upward to telomere on chrosomal short arm and 5'-terminus of this base sequence : 115632
tcgtgggacttctcagtctccataattgcatgagccaattccttgtaaacctcatgtgatggatagatagatagatagatagatagatagatagatagatagatctatagagcatatcctatttgttctgtttctctgcagaatcatgataaatataccttttctttgccttttttcctctgctaatgttctgatcactaacaaaacacaactcttgtcatgggtatttgtttaatagcaggcatttgtggtttactgcccact

SEQ ID NO: 9784 - DNA, 134 bp, Homo sapiens
  DISO7_10002116
  Located on chromosome 6
  Distance between a terminus base of telomere on chromosomal short arm and 5'-terminus of this base sequence : 13245733
  Distance between 3'-terminus of neighbour sequence of sequence listing upward to telomere on chrosomal short arm and 5'-terminus of this base sequence : 381157
tccttccacccttgtgtcctgcctgtgcccccaagggtgtaattctttgttccctcttcccatagtcagtgtgtgtgtgtgtgtgtgtgtgtgtgtgtgtgtgtgtgtgtgtgtgcgcgctatattctgacaca

SEQ ID NO: 9785 - DNA, 196 bp, Homo sapiens
  chr6.fa.O7frz.11127588
  Located on chromosome 6
  Distance between a terminus base of telomere on chromosomal short arm and 5'-terminus of this base sequence : 13298550
  Distance between 3'-terminus of neighbour sequence of sequence listing upward to telomere on chrosomal short arm and 5'-terminus of this base sequence : 52683
aaagtgctaggattataggcatgacccactgcacccagccaaaaaaaaaaaaaagtttttttaaagtgtcaggtggcatttaaaaaatttctggtgtgtgtgtgtgtgtgtgtgtgtgtgtgtgtgtgtgtgtgtttaaattagtatttaatttttctcttttattccatttgatcacagaatgttatccgtatta

SEQ ID NO: 9786 - DNA, 327 bp, Homo sapiens
  AL024498.12_85315
  Located on chromosome 6
  Distance between a terminus base of telomere on chromosomal short arm and 5'-terminus of this base sequence : 13477867
  Distance between 3'-terminus of neighbour sequence of sequence listing upward to telomere on chrosomal short arm and 5'-terminus of this base sequence : 179121
ttcaagtaacatcctcagaccttgagcgagagtgtgtgtgtgtgtgtgtgtgtgtaagaatcaaagagaaatcaacatcattacttcggaaaattatttctaagtatttcagagtttgttgttgaacatttctcactttaaaagcaggcaaaatggatgttaatctcccagacatgaccagaaccaccaccaaaacattatctccccaagcccagggcggaagaccaaagctctccctttacagattctgcccacacatatttaaaaattgtgaatttccttgggattggtaacacatcaagtcttatcactgacttgtgcattcta

SEQ ID NO: 9787 - DNA, 181 bp, Homo sapiens
  AL024498.12_125943
  Located on chromosome 6
  Distance between a terminus base of telomere on chromosomal short arm and 5'-terminus of this base sequence : 13518506
  Distance between 3'-terminus of neighbour sequence of sequence listing upward to telomere on chrosomal short arm and 5'-terminus of this base sequence : 40312
atgcaaagccaactatttgtacacacacacacacacacacacacacacacacacacacatacacacacacatatatatcctattggttctatttctctgaagaatcctgactattttggacccctccctgaggggctttcacactccctggcatgtaatgtctatgattccacagctaatt

SEQ ID NO: 9788 - DNA, 119 bp, Homo sapiens
  DISO7_11215105
  Located on chromosome 6
  Distance between a terminus base of telomere on chromosomal short arm and 5'-terminus of this base sequence : 13542283
  Distance between 3'-terminus of neighbour sequence of sequence listing upward to telomere on chrosomal short arm and 5'-terminus of this base sequence : 23596
cacttgagagggcctcagaaacccagaaattttgcgggtatgtgtgtgtgtgtgtgtgtgtgtgtgtgtgtgtgtgtgtgtgtgtgtgtgtgtatggtccgtccgcagactcttcaaga

SEQ ID NO: 9789 - DNA, 314 bp, Homo sapiens
  AL136139.6_8122
  Located on chromosome 6
  Distance between a terminus base of telomere on chromosomal short arm and 5'-terminus of this base sequence : 13751034
  Distance between 3'-terminus of neighbour sequence of sequence listing upward to telomere on chrosomal short arm and 5'-terminus of this base sequence : 208632
tcttccaccttgtaaggacacagcaagaggtgccatctatgaagcagcgagccctcaccagacattgaatctgctggcactttgatcttggacttcttagcctccaaaactgtatgcaataaatttctgttgtttacaaactacccaatctaaggtattttgttacagcagcctgaagtaagacatatatgaacatatatatatatatatatatatatatgaagtgctaaatataaaacaatccaagggctatcacaaggtgggcacacaattgctaaatgtaatttacactagcatttctcaagtctgttcat

SEQ ID NO: 9790 - DNA, 300 bp, Homo sapiens
  AL139807.6_6805
  Located on chromosome 6
  Distance between a terminus base of telomere on chromosomal short arm and 5'-terminus of this base sequence : 13871462
  Distance between 3'-terminus of neighbour sequence of sequence listing upward to telomere on chrosomal short arm and 5'-terminus of this base sequence : 120114
taagccatctccactatgaaagaaaggaaggaagggaggaagggagggagagggaaggagggagggatggggggagagagagagagagagagagagagatagaaaagagaagtgaggaagggagtgaaaagaaaggaagaggcaaccacactcccatggatgtgaaccactgctctggggtacatggagagaggcagcctagagacccaggatcaggatactgtggagaagcccttggtatttggcagggaaggtgccagggccaccctcttgccctccccatcctggccatgtcactac

SEQ ID NO: 9791 - DNA, 366 bp, Homo sapiens
  AL022098.1_97737
  Located on chromosome 6
  Distance between a terminus base of telomere on chromosomal short arm and 5'-terminus of this base sequence : 13937682
  Distance between 3'-terminus of neighbour sequence of sequence listing upward to telomere on chrosomal short arm and 5'-terminus of this base sequence : 65920
aggaatagctctttggttacaggatctggaaacaaacaaacaaacaaacaaacaaactagtgatggaaatgaaaatagagtcactgcagagtttccaaggcagcgaagcaagtgtaccagcacagtacaagagggctctgatgcccggggggtgcatctggaagtgactaattttcatttgtaatatggtgcagtggcaaagcatggggcggaactatcacgctgcaaagacatccactgggaaagccaccagccactctgagcaatgtctcttgtccttacacttaaaatggaagctgctggaagaaaagggtttctgcctctacttacaccactgagtacttgataggtagtgagactatggtt

SEQ ID NO: 9792 - DNA, 237 bp, Homo sapiens
  AL022098.1_41618
  Located on chromosome 6
  Distance between a terminus base of telomere on chromosomal short arm and 5'-terminus of this base sequence : 13993670
  Distance between 3'-terminus of neighbour sequence of sequence listing upward to telomere on chrosomal short arm and 5'-terminus of this base sequence : 55622
ctgcatagaagcggttaatagtcccccttatgtcagctcagcacatagatatatgaggagtcccacggtttcccataagccaaataagacaaagtaaaagcaataatggtccatacacttcagaaaaaggaaggaaggaaaaaaggaaggaaggaaggaagggagggagggagggagggagggagggaaggaaggaaggacaattttcccatgagtctactgtcagtgaaagctatt

SEQ ID NO: 9793 - DNA, 361 bp, Homo sapiens
  chr6.fa.O7frz.12034704
  Located on chromosome 6
  Distance between a terminus base of telomere on chromosomal short arm and 5'-terminus of this base sequence : 14140223
  Distance between 3'-terminus of neighbour sequence of sequence listing upward to telomere on chrosomal short arm and 5'-terminus of this base sequence : 146316
atgcatcattgcacttaattaggaggttttatacatttcaaatgaaaggttgagatgaatgtgttatttcaactgaaaaattcaataacacccaggtagaaaaggaggcaaattctaaggtccacaaataagtgatttataaactcaaaaacacattaacaccaactttaatagaaaataagttcattccttcccccttagcttttgttcacttatctttgctttttgtatgcagatagaaaccgctcaaaaaataaataaataaataaataaaaggaactaaggaggatggtgtggaaatggaagaaaggagtgagtgaaggaaaaagaacactttttcttaacaggaagacagagtatg

SEQ ID NO: 9794 - DNA, 432 bp, Homo sapiens
  chr6.fa.O7frz.12152793
  Located on chromosome 6
  Distance between a terminus base of telomere on chromosomal short arm and 5'-terminus of this base sequence : 14158405
  Distance between 3'-terminus of neighbour sequence of sequence listing upward to telomere on chrosomal short arm and 5'-terminus of this base sequence : 17821
catttctgtccagtaggaaatataaatcctacagattatagttgtgttgttttataatttaccagtttcaacttcacttgcagtcttattccagcattctttttgttcattgactatatatagtaatttttcttctccttcttcattcattgataagttaaataaacctttgtcacatgtgtgcatacacacacacacacacacacaaacgcacacacacaccagctccttggcagaatgcagagtgagaattctctccaatatggggatatggagctattatgatctcccttcaagaaagaacttgtagattagctgtgagggtgcagttaggtgatggccttggttgcagtgcctctggttgcttagccacagcagttgagctgaggccatgcttttcctaggcagacctttaacagctaatgagcacag

SEQ ID NO: 9795 - DNA, 215 bp, Homo sapiens
  AL022724.2_133977
  Located on chromosome 6
  Distance between a terminus base of telomere on chromosomal short arm and 5'-terminus of this base sequence : 14348807
  Distance between 3'-terminus of neighbour sequence of sequence listing upward to telomere on chrosomal short arm and 5'-terminus of this base sequence : 189970
ggctactcttgttaacctggttactctgctgtctttgtttcttctctttctctctctctctctctgtgtgtgtgtgtgtgtgtgtgtgtgtgtgtgtgtgtgtgtatgtgcgtacgtctgtaggtagctagatacatggctgtggtaagtagttctacagcaggcaaatatcccaaaacagtcgaaagggccaatgttcttagttgaatgcgact

SEQ ID NO: 9796 - DNA, 401 bp, Homo sapiens
  AL022724.2_131031
  Located on chromosome 6
  Distance between a terminus base of telomere on chromosomal short arm and 5'-terminus of this base sequence : 14351541
  Distance between 3'-terminus of neighbour sequence of sequence listing upward to telomere on chrosomal short arm and 5'-terminus of this base sequence : 2519
ccactttatagagcttggaaacagactcttccccagtcaagcctccagatgagaatatagccctgctgaggctgtgctggaattctgtctcatgggaattgtgagataataaatttgtgttgtaagctgctaagtttgtggtaatttattatgcagcaatataaaactaatacactgggtgcagtggtgtgtgcctctagtctcagctacttaggaagctgaagcaggtgtatcagttgagcccaggagttggaggccagccagggagacatagcaagaccccatctcagataaataaataaataaataaataaatacaacttaaaatatgcacaatggcctaaaaataaacaaatagaaaactaatataattatccagtactgtactccaagaagtgagg

SEQ ID NO: 9797 - DNA, 307 bp, Homo sapiens
  AL022724.2_114570
  Located on chromosome 6
  Distance between a terminus base of telomere on chromosomal short arm and 5'-terminus of this base sequence : 14368090
  Distance between 3'-terminus of neighbour sequence of sequence listing upward to telomere on chrosomal short arm and 5'-terminus of this base sequence : 16148
aaagctgtcatactcatgcattttgagggaaatttgagaaatatcaatacccaaagcttctacatggagccattcatgttatccagtctttgtttccagaatcatcgtaggaccctgatgagagtagcaccaactctccaacataaattcgagaaaatgaaaaagtggcattgaatatctacacggaacttcagaaatacaacacacacacacacacacacacacacactcatacacacaaactcatgagcaatcatagtaatttgaacaacaacaaaaaccatgatgttgaaatttggaggatgta

SEQ ID NO: 9798 - DNA, 425 bp, Homo sapiens
  AL022724.2_94111
  Located on chromosome 6
  Distance between a terminus base of telomere on chromosomal short arm and 5'-terminus of this base sequence : 14388544
  Distance between 3'-terminus of neighbour sequence of sequence listing upward to telomere on chrosomal short arm and 5'-terminus of this base sequence : 20147
tgaggcaagatgatagtaatttaccaagggtactcagcagagaggcgtgaatgaggacagagtcacactgttagttgacatcacttctttatggcttgcctgaatatgaggggaaggtgggaagagagaggggaaagaagaaggaaggaaggaaggaaggacggaaagaaggaaggaagggaggcagggagggagggaggtaggtagggagggagggagggagggagggagggaactttgcattcaacatgtcttctatttcagccaatgtcagccctccattcaatcttgcccccaagtttgatcccatgaaatcatatctatactaaacttccttctaaatgtttcttcagcgcacacatttcacaatcttccttcagcctccttcattccatttgggtttctgtcattgtctaccaactagg

SEQ ID NO: 9799 - DNA, 467 bp, Homo sapiens
  AL022724.2_25449
  Located on chromosome 6
  Distance between a terminus base of telomere on chromosomal short arm and 5'-terminus of this base sequence : 14457138
  Distance between 3'-terminus of neighbour sequence of sequence listing upward to telomere on chrosomal short arm and 5'-terminus of this base sequence : 68169
tcatgcctataatcctagcactttgggaggccgaggcaggtggattgcctgagctcaggagtttgagaccagcctgggcaacacggcgaaaccccgtttctattaaaatacaaaagaaattagctgggagtggcggctggcacctatagtcccaggtactcaggaggctgaggcaggagaattgcttgaacccgggaggtggaggttgcagtgagccgagatcacgccactgcattccagcctgggtgacagagcgactccatctctacaaaacaaacaaacaaacaaacaaacaaacaaaccctggcttcacttgttcccaaccgtgtggccatgggcatgttcatgaaactttctgtgtctcagtttcctcaactacgaaatgaggatgatgataataatacacaacttacagcattgctgtgtggattggaggagacagtgctcgtggagtactaaagacagaa

SEQ ID NO: 9800 - DNA, 283 bp, Homo sapiens
  AL035671.5_5335
  Located on chromosome 6
  Distance between a terminus base of telomere on chromosomal short arm and 5'-terminus of this base sequence : 14486941
  Distance between 3'-terminus of neighbour sequence of sequence listing upward to telomere on chrosomal short arm and 5'-terminus of this base sequence : 29336
taagatttccatcacctcaaacattatcatttatttgtgttggtaacaatttcaaatcttctcttctagctattttgaaatctacaataaattattgttaactacagccaccctattatgctatggaacactgaaacttattcttttatctaaatatatatatatatatatatatatacatttttaatctattaaccaaactctcttcatccccctaaaacacacccttgccagcctctggtaactatcattctaatttctacctccatgagatcaacttcta

SEQ ID NO: 9801 - DNA, 198 bp, Homo sapiens
  AL035671.5_32438
  Located on chromosome 6
  Distance between a terminus base of telomere on chromosomal short arm and 5'-terminus of this base sequence : 14514104
  Distance between 3'-terminus of neighbour sequence of sequence listing upward to telomere on chrosomal short arm and 5'-terminus of this base sequence : 26880
aacaggattcatcttccgtagggctctgtgatggttgtttctcaggactagatattgttagagatcaaatatagttatatatatttctgtgtctatatatatatatatatatatatggatgtatatataggtgtgtgtttatatagatatatatatatagacatttatgtatatatgtctacggatctaacactccaa

SEQ ID NO: 9802 - DNA, 388 bp, Homo sapiens
  AL035671.5_34215
  Located on chromosome 6
  Distance between a terminus base of telomere on chromosomal short arm and 5'-terminus of this base sequence : 14515725
  Distance between 3'-terminus of neighbour sequence of sequence listing upward to telomere on chrosomal short arm and 5'-terminus of this base sequence : 1423
caaagaaatctattctcagctgatatgatgggaaaagaatttgatatcttaaaaagaaatactcagtatttaccactgatttgcagcatgacctcggggaactccctggcttaaaagcacaatgactcatgagttctccgtgatctgtgacatattgagagcacatagtgttgcctctctctgtttattcttctaattcgttaaaagaatcaactatgatttattgaaaacaatatatatatatatatagtgtgtgtgtgtgtgtgtgtgtgtgtgtgtgtgtgtgtgtggtgtcagcctacctttttcctccatcaacagggagggtttgattaggggatgaaccccaaatgctactactgccctactccaacagatcctattttca

SEQ ID NO: 9803 - DNA, 249 bp, Homo sapiens
  AL035671.5_55372
  Located on chromosome 6
  Distance between a terminus base of telomere on chromosomal short arm and 5'-terminus of this base sequence : 14536970
  Distance between 3'-terminus of neighbour sequence of sequence listing upward to telomere on chrosomal short arm and 5'-terminus of this base sequence : 20857
acctgttatttgttctggaatccttattaaagttttgatccaaaaccaaaaaaagaaaaaaaagaaagaaaggaaggaaggaaggaggtgggggagggatggagggaaggaagaaacgaaggcaggaaggtgagacagaaaagaaaagaaagaaagaaagaaaagaaagaaagaaagaaagaaagaaagaaagaaagaaagaaagaaagaaagaaagaaagaaagaaagaaagatttagaaaccagagc

SEQ ID NO: 9804 - DNA, 257 bp, Homo sapiens
  AL035671.5_125986
  Located on chromosome 6
  Distance between a terminus base of telomere on chromosomal short arm and 5'-terminus of this base sequence : 14607659
  Distance between 3'-terminus of neighbour sequence of sequence listing upward to telomere on chrosomal short arm and 5'-terminus of this base sequence : 70440
gccttcagttcatactggaacttaaaccattggctctcctgattctccagcccactgactcaattccttataataaatctctttatacacacacacacacacacacacacacacacacacactcacatcctattgagaactctgagatagtatgttaccattacctaggttttttcttctgctttcatgcctatataatttattttctttatctgtgaaattaaaaaaatttactattacctaggaatggattgctt

SEQ ID NO: 9805 - DNA, 307 bp, Homo sapiens
  AL035671.5_134960
  Located on chromosome 6
  Distance between a terminus base of telomere on chromosomal short arm and 5'-terminus of this base sequence : 14616678
  Distance between 3'-terminus of neighbour sequence of sequence listing upward to telomere on chrosomal short arm and 5'-terminus of this base sequence : 8762
ctgctaggcactgtactaagagacatctaaagatgcacaagacacacacacacacacacacacacacacacacacacacacacacacactcttccagttattttaagcaattcttaatcactaatattaagacaagcattcttatttttccagaaatgagaaccaaacatctctaattataatggtggtcttatgacaagagtaattaagattaaacatacatcaaattatctataaatttgatgtaattccaactttaaaatcctcaccaaattatataggccttcataaatggattctgaagttc

SEQ ID NO: 9806 - DNA, 327 bp, Homo sapiens
  chr6.fa.O7frz.12679116
  Located on chromosome 6
  Distance between a terminus base of telomere on chromosomal short arm and 5'-terminus of this base sequence : 14735237
  Distance between 3'-terminus of neighbour sequence of sequence listing upward to telomere on chrosomal short arm and 5'-terminus of this base sequence : 118252
agttagtgttcaatagcaccataaaaatgtatctttgaatcctcattcacagtgcaagaataatgatagtgtagtgtaggtctgtagcaggggttcttgacatggatttaggggtctccatagatcgctgcagtccttaattgtatgaaaaagtgtgtgtgtgtgtgtgtgtgtgtgcgcgcgcgtgcatgtccttgtctctctttctgagagaggctgtacgctggtcatgagatttttttttttatagagatcttttgaagttttattctttttaaaaaattatcacttttttaatagaaaaagtgatggatcagtattggagta

SEQ ID NO: 9807 - DNA, 442 bp, Homo sapiens
  Z98050.1_47909
  Located on chromosome 6
  Distance between a terminus base of telomere on chromosomal short arm and 5'-terminus of this base sequence : 14844460
  Distance between 3'-terminus of neighbour sequence of sequence listing upward to telomere on chrosomal short arm and 5'-terminus of this base sequence : 108896
attcgtctagccatctacactcaaaatcgtagtgtggcacatacctctaatattcatatataagcccaaattaactatatcgtaataattttgttatatcccttgagatacaatatacaaaagcaagagatagaatttatggttgtatttgcccatgtgaagttactgaagtttgaacaataaatagctaacaaaaataaatttaaaagaatttcagataattaaactcaacattattttaaggagctacagtggcagggattccaggccaaatcacattgtaaagatagatagatagatagatagatagatagatagatagatagatagatagacagacagacagacagacagacagacagacagacagactgatttggggggaagtgggagcaatttgtcagaacgtaaaagagaactatttgaattctgtcaaatcatt

SEQ ID NO: 9808 - DNA, 171 bp, Homo sapiens
  G08566
  Located on chromosome 6
  Distance between a terminus base of telomere on chromosomal short arm and 5'-terminus of this base sequence : 14844699
  Distance between 3'-terminus of neighbour sequence of sequence listing upward to telomere on chrosomal short arm and 5'-terminus of this base sequence : -203
taaggagctacagtggcagggattccaggccaaatcacattgtaaagatagatagatagatagatagatagatagatagatagatagatagatagacagacagacagacagacagacagacagacagacagactgatttggggggaagtgggagcaatttgtcagaacgta

SEQ ID NO: 9809 - DNA, 192 bp, Homo sapiens
  Z98050.1_58248
  Located on chromosome 6
  Distance between a terminus base of telomere on chromosomal short arm and 5'-terminus of this base sequence : 14855015
  Distance between 3'-terminus of neighbour sequence of sequence listing upward to telomere on chrosomal short arm and 5'-terminus of this base sequence : 10145
aattggatatgtggctaccattggccagcacaggtctagggaattatatgatatcagattttaggaaggaagttataaaattttagttcttcaggaagagatctaaaggagagtacagagagagagagagagagagagaatctaccacataactaaattaagtaaagggagtgctacagcactgaccattat

SEQ ID NO: 9810 - DNA, 215 bp, Homo sapiens
  Z98050_71629
  Located on chromosome 6
  Distance between a terminus base of telomere on chromosomal short arm and 5'-terminus of this base sequence : 14868460
  Distance between 3'-terminus of neighbour sequence of sequence listing upward to telomere on chrosomal short arm and 5'-terminus of this base sequence : 13253
gtccaggagttctagaccagcctgggcaatacagcaagaacagtctctacaaaataataataataataataataattagccaggtgtggcggtacatgaccgtggtctcagcttctctggaggctgaggttggaggattgtttgagccccagggggtcaaggctgcagtgagctgtgatcacaccactgcactccagcctgagactctgtctcaa

SEQ ID NO: 9811 - DNA, 225 bp, Homo sapiens
  Z98050.1_138869
  Located on chromosome 6
  Distance between a terminus base of telomere on chromosomal short arm and 5'-terminus of this base sequence : 14935618
  Distance between 3'-terminus of neighbour sequence of sequence listing upward to telomere on chrosomal short arm and 5'-terminus of this base sequence : 66943
gtctaccttggatttaaggaacaattctggttctttgctgagaggactgggtactggctgctagaaagctttttgaattatttcttccttctccttccttccttccttccttccttccttccttgctccttccttccctccctccctccctccctcccttccttccttccttcttttcccccaaagacccctgatatgaactagataggttactagtggatttcc

SEQ ID NO: 9812 - DNA, 221 bp, Homo sapiens
  Z98050.1_139689
  Located on chromosome 6
  Distance between a terminus base of telomere on chromosomal short arm and 5'-terminus of this base sequence : 14936503
  Distance between 3'-terminus of neighbour sequence of sequence listing upward to telomere on chrosomal short arm and 5'-terminus of this base sequence : 660
taattagctggctagattgcagactcactctttgagcgagaggacttggtttgtgtgtttgggggcaccgtgtgtgtgtgtgtgtgtgtgtgtgtggatgcatgcatgcccatttgtatttgtacataagttaaaaaataagaatcgtgccgggcatggtggctcacgcctgtaatcccagcactttgggaggccaaggtgggtggatcacaaggtcagga

SEQ ID NO: 9813 - DNA, 231 bp, Homo sapiens
  Z98050.1_186039
  Located on chromosome 6
  Distance between a terminus base of telomere on chromosomal short arm and 5'-terminus of this base sequence : 14982799
  Distance between 3'-terminus of neighbour sequence of sequence listing upward to telomere on chrosomal short arm and 5'-terminus of this base sequence : 46075
tatcttgctgtaaaggtggaagtaatggtttcttgctactttttatatcctaataagaagcaagtgtctaaaagtggtcttaaaaattattaggtagctgaaattacacactattaattaagtacacacacacacacacacacacacacacacactccatttcctaatttctctttatttttttttcctactcagtcatccacagcactttctattgtccacctgtagttc

SEQ ID NO: 9814 - DNA, 397 bp, Homo sapiens
  chr6.fa.O7frz.13091909
  Located on chromosome 6
  Distance between a terminus base of telomere on chromosomal short arm and 5'-terminus of this base sequence : 15117692
  Distance between 3'-terminus of neighbour sequence of sequence listing upward to telomere on chrosomal short arm and 5'-terminus of this base sequence : 134662
gatcattagtgacaatacaccatccgcaatgtcatcagaattgtttgtacttctgggtctgtgtctttgctctatcttctctctccctgccatctctccactctcttctctctgtttctgtccctcttctgtctctcttctccctcctcttcttcctcttctccctcctcctcctcctcctccttctctctctctctctcacacacacacacacacacacacacagcaacatacagcacgcctggatttcaaacaatggggtgccctttcccacattacccatagagcacacaactccagccctctctattcacagatttagctgctgtagaggttcatggtgtactgtcacgtacaattttctttcttttgtggagtaattgaaatggagtcatga

SEQ ID NO: 9815 - DNA, 226 bp, Homo sapiens
  D6S994
  Located on chromosome 6
  Distance between a terminus base of telomere on chromosomal short arm and 5'-terminus of this base sequence : 15117712
  Distance between 3'-terminus of neighbour sequence of sequence listing upward to telomere on chrosomal short arm and 5'-terminus of this base sequence : -377
catccgcaatgtcatcagaattgtttgtacttctgggtctgtgtctttgctctatcttctctctccctgccatctctccactctcttctctctgtttctgtccctcttctgtctctcttctccctcctcttcttcctcttctccctcctcctcctcctcctccttctctctctctctctcacacacacacacacacacacacacagcaacatacagcacgcctgga

SEQ ID NO: 9816 - DNA, 454 bp, Homo sapiens
  Z99495.1_112227
  Located on chromosome 6
  Distance between a terminus base of telomere on chromosomal short arm and 5'-terminus of this base sequence : 15289189
  Distance between 3'-terminus of neighbour sequence of sequence listing upward to telomere on chrosomal short arm and 5'-terminus of this base sequence : 171251
gctggtattcaaggaaacttaggtaatgatggaaaagatggataaatattctaaggagatgagaacaatctcagctctaatcttctctttagctttgagcaagtttgttcactttcacaaacccgctttcagattttagggcacattccccttccttccttccttccttccttccttccttccttccttccttcctccctccctccctcccttccttccttcctcccttctttccttccatggcatctcactatgttggtcaggctggagtgcagtggctattcatgggcatgatcatagcacacgctggttgcaagagatcctcctgccgtagcctccaagtagcagagactacaggtgtgtgccatgacacgtcactttcttttctgttaagagagatgattattttcatattgtctcacaattacacgggtaatacatgctcatttccaga

SEQ ID NO: 9817 - DNA, 199 bp, Homo sapiens
  Z99495.1_87366
  Located on chromosome 6
  Distance between a terminus base of telomere on chromosomal short arm and 5'-terminus of this base sequence : 15314074
  Distance between 3'-terminus of neighbour sequence of sequence listing upward to telomere on chrosomal short arm and 5'-terminus of this base sequence : 24431
gcgtgatggtgtacctgtagtcccagctacttgaggggttgaggtgggaggaatgcttgagcccaggaggttgaggctgcagtgagccatgatcacgccactgcactctggcctgggagacagagcaagatcttgttccccagcaaaaaaagagagagagagagagagagagttagcctagcatcagcttgtgatcttt

SEQ ID NO: 9818 - DNA, 427 bp, Homo sapiens
  Z99495.1_60002
  Located on chromosome 6
  Distance between a terminus base of telomere on chromosomal short arm and 5'-terminus of this base sequence : 15341436
  Distance between 3'-terminus of neighbour sequence of sequence listing upward to telomere on chrosomal short arm and 5'-terminus of this base sequence : 27163
acggtgcttgttactgacataggggaaaaaagagaaggagattttggggtgagatgattaattcagttctgaatatgtcgagtttgaggggcctaaaagaagtccaaataagacaatcccataggcaattgtgatatatatacacacacacacacacacacacacacacacacatatatagatacatacatacaatacataaatatgtatatatatgcacatgtatacagatatatatacacagagtatatatatctgtgtgtatatgtgtatatatatgtgtatatacatatacatacacacacacatatatatacatgtacacatatatgtgtatatatctgaggctcagaaggcagaacgatcggtatttacaagtcatccctgtaaatacaggtttttggagttatcacaatctaggtggcaa

SEQ ID NO: 9819 - DNA, 253 bp, Homo sapiens
  Z99495.1_28315
  Located on chromosome 6
  Distance between a terminus base of telomere on chromosomal short arm and 5'-terminus of this base sequence : 15373186
  Distance between 3'-terminus of neighbour sequence of sequence listing upward to telomere on chrosomal short arm and 5'-terminus of this base sequence : 31323
tgtgactaatttgtcagccttctccaggagagttgaaaataaatcacacacacacagagagggggagagtaaggaaagaaagagagagagagagagagagagagagagagaatgaaagaattgagggcaatgtgattttcttgccagagggaataagtcaaatatcattattatgtatcctaaaattcatgtaaaaaaattactattgtcaatgtacttctccatcattgggtggtcatcttaacgtcttcat

SEQ ID NO: 9820 - DNA, 142 bp, Homo sapiens
  Z79008.1_168
  Located on chromosome 6
  Distance between a terminus base of telomere on chromosomal short arm and 5'-terminus of this base sequence : 15458774
  Distance between 3'-terminus of neighbour sequence of sequence listing upward to telomere on chrosomal short arm and 5'-terminus of this base sequence : 85335
tttcttggactgtcaatgtctcatcatttcctagacacacacacacacacacacacacacacacccctacataagctctataaggggagggactttggttaattactgtatcttcagtgtctggtaccatactgtggttagc

SEQ ID NO: 9821 - DNA, 353 bp, Homo sapiens
  HUMUT2018
  Located on chromosome 6
  Distance between a terminus base of telomere on chromosomal short arm and 5'-terminus of this base sequence : 15661253
  Distance between 3'-terminus of neighbour sequence of sequence listing upward to telomere on chrosomal short arm and 5'-terminus of this base sequence : 202337
ctgcagtgagacatgattgcaccactgcactccagcctcagcgacagagtctccaaaaaaagagtaggggagagagagacaaagagagagtgggagggggagaaagagaagagagggaaggagggaagggaggaaggaaggaaggaaggaaggaaggggggagggagggaggaaggggaaggaaggaaggaaggaaggaaggaaggagagaaaaacaaaggtggtggaagatgcagctatagaggaagattaagcctgtcttggctgcaggtcaccatttgttaccttagaaaggtaaatgctcacagcaagctctcacttcaatctagagtgtcatttttcctcttccaaca

SEQ ID NO: 9822 - DNA, 195 bp, Homo sapiens
  AL008729.1_2286
  Located on chromosome 6
  Distance between a terminus base of telomere on chromosomal short arm and 5'-terminus of this base sequence : 15840059
  Distance between 3'-terminus of neighbour sequence of sequence listing upward to telomere on chrosomal short arm and 5'-terminus of this base sequence : 178453
tcaaattcataacacttggaattaccaagcattaggaattcccagataattccttagcttaatgatgggtatatacagcccattacattaatgtttcgtgtgtgtgtgtgtgtgtgtgtgtgtgtgtgtgtgtgtgtttaaaaatgtcataataaaaaatttaaaatattacttaaaagtggcagtattactcca

SEQ ID NO: 9823 - DNA, 409 bp, Homo sapiens
  AL008729.1_2582
  Located on chromosome 6
  Distance between a terminus base of telomere on chromosomal short arm and 5'-terminus of this base sequence : 15840241
  Distance between 3'-terminus of neighbour sequence of sequence listing upward to telomere on chrosomal short arm and 5'-terminus of this base sequence : -13
cagtattactccatccttaaatgaatccaagtaaaatagtttttacttttattgctacccatcttggtcataaatgatattaataatgaatttgtacttattgaatggttttcatttctttctactagatatgtatacacatatatggatggatgggtggttgataggtaggaagataggtaggtaggtaggtagatagataagtagatagagatagatagatagatagatagatagatagatagatagatagatagacagaacaaggttatcaatattaatgttgaagaaattgccaaaagctaaaatatgtgtatggtctgtacatttcttctaattgtgtaaattggaaaatcctttaataaaacaatttcacaggatccatgtatgtgtcagtagacattggaat

SEQ ID NO: 9824 - DNA, 430 bp, Homo sapiens
  AL008729.1_41734
  Located on chromosome 6
  Distance between a terminus base of telomere on chromosomal short arm and 5'-terminus of this base sequence : 15879436
  Distance between 3'-terminus of neighbour sequence of sequence listing upward to telomere on chrosomal short arm and 5'-terminus of this base sequence : 38786
gtgacacctgttagtacaagctactcaggaggctgaggtgggaggattgcttgagcccaaaggtccaaggttgcaatgagctatttaaaaagaagaagaagaagaaggaggaggagaagaagaagaaggaggaggaggaggagaaaaagaggaggaggaggaggaggaaagagaagagaagagaagagaagagaagagaagagaagagaagagaagagaagagaagagaaaaggtagaaaaagggaaaggaggcagaaatggttatctacccgggctctcaacctatgcatctcctacttagtttaacagagttaaagagaagagtcgagttttccaaaaagaaggcttggtaaaggtcattcttggtgggaacaagaccaagggaatagagtacagcttttcacctccctaaggcatcctgtagatgtg

SEQ ID NO: 9825 - DNA, 414 bp, Homo sapiens
  chr6.fa.O7frz.14014964
  Located on chromosome 6
  Distance between a terminus base of telomere on chromosomal short arm and 5'-terminus of this base sequence : 16034718
  Distance between 3'-terminus of neighbour sequence of sequence listing upward to telomere on chrosomal short arm and 5'-terminus of this base sequence : 154852
aagactagtctgatctgctcatagcacaaatggtacaatttcaaatagcaacaacagtcatttattgagtgcttactttgtgccagaggaggcacaatgtattttgcatgcattttcatgttttagtctacacaaccaggtacttgtcctgttcccatcttacagatgtggaaactgagcctctgaggggtaagcaacttgcctctgattccacaactcgatagtagtagagtcaaatctggaatttgaacccagattgtctggctacaaagccagcctagtctttttaaaaatatgttttttttttgtgtgtgtgtgtgtgtgtgtgtgtgtgtgtgtttgttttttttttttgagacagagtctcactctatcgcctaggctggagtgcagtggtacaatctcaactcactg

SEQ ID NO: 9826 - DNA, 207 bp, Homo sapiens
  AC010305.3_101893
  Located on chromosome 6
  Distance between a terminus base of telomere on chromosomal short arm and 5'-terminus of this base sequence : 16125518
  Distance between 3'-terminus of neighbour sequence of sequence listing upward to telomere on chrosomal short arm and 5'-terminus of this base sequence : 90386
ggacttgaactgcaacattaacttttctttaggtctctagcccactggccaggtctaccctgcagggcttccctgcaccctctcttcctctttccgtgtgtgtgtgtgtgtgtgtgtgtgtgtgtgtgtgtgtgtgtgtgtatccttttggttctgtttctctgaagaaacagaagtttccttgactactaccttcctcgtcattca

SEQ ID NO: 9827 - DNA, 220 bp, Homo sapiens
  D6S1593
  Located on chromosome 6
  Distance between a terminus base of telomere on chromosomal short arm and 5'-terminus of this base sequence : 16142269
  Distance between 3'-terminus of neighbour sequence of sequence listing upward to telomere on chrosomal short arm and 5'-terminus of this base sequence : 16544
taggtgctgtgggagccactgaaagtggagagtgataccttacacacacacacacacacacacacacacacacacacacacgtgtgcacatgtgctcactttccccattgtacagagtagactgcataagaaacaagactggacccaggcaggctggcttggggacacaaaggtgagtgaggcttctttgccttgtctgcgtcctgaccgtcaagacgct

SEQ ID NO: 9828 - DNA, 265 bp, Homo sapiens
  AC010305.3_85229
  Located on chromosome 6
  Distance between a terminus base of telomere on chromosomal short arm and 5'-terminus of this base sequence : 16142288
  Distance between 3'-terminus of neighbour sequence of sequence listing upward to telomere on chrosomal short arm and 5'-terminus of this base sequence : -201
tgaaagtggagagtgataccttacacacacacacacacacacacacacacacacacacacacgtgtgcacatgtgctcactttccccattgtacagagtagactgcataagaaacaagactggacccaggcaggctggcttggggacacaaaggtgagtgaggcttctttgccttgtctgcgtcctgaccgtcaagacgcttgctgggagaggcaacaaggaaattaacaaaaaatacagtgtcattttaggtgccagttaatta

SEQ ID NO: 9829 - DNA, 371 bp, Homo sapiens
  AC010305.3_8067
  Located on chromosome 6
  Distance between a terminus base of telomere on chromosomal short arm and 5'-terminus of this base sequence : 16213148
  Distance between 3'-terminus of neighbour sequence of sequence listing upward to telomere on chrosomal short arm and 5'-terminus of this base sequence : 70595
agagaaataggcactcctgtattttctttttttctttctttctttctttctttctttctttctttctttctttctttctttctttctttccttctttctttctttccctttctctctttctctctttctttctctcttttttttcttttcttgagactgaatcttgctctgtcatccaggctggagttcagtggcgcgatcttggcggctcactgcaacctctgcctccccggttcaagcgattctcttggctcagcctcctgagtagctgggattacaggtgcccgccaccatgacagctactttttgtatttttagtagagatggcatttcaccatgttggccaggctggtcttgtattttcttattgc

SEQ ID NO: 9830 - DNA, 129 bp, Homo sapiens
  DISO7_10017254
  Located on chromosome 6
  Distance between a terminus base of telomere on chromosomal short arm and 5'-terminus of this base sequence : 16290593
  Distance between 3'-terminus of neighbour sequence of sequence listing upward to telomere on chrosomal short arm and 5'-terminus of this base sequence : 77074
cacctgaccttcaacattaatcaaatctctcaatctctctctctcatgtctctgtctctctctctctctctctctctctcgtgtgtgtgtgtgtgtgtgtgtatttgcatgaacttctgagtcacatga

SEQ ID NO: 9831 - DNA, 333 bp, Homo sapiens
  Z93020.1_99113
  Located on chromosome 6
  Distance between a terminus base of telomere on chromosomal short arm and 5'-terminus of this base sequence : 16319825
  Distance between 3'-terminus of neighbour sequence of sequence listing upward to telomere on chrosomal short arm and 5'-terminus of this base sequence : 29103
tacagctatgcactctactgacacctataaaaaatctcgccaacttatttacagataaatgtttgggattaagatttctcacaaaaaaagcacagagggattgcagaaggaaaaaaaatgttaaggaaacaaatgtgtttcccaagggacacagtacaaatttagaccccacacacacacacatacacacacacacacacacacacacacacacacacacacggaaatatggattcatatttggaaaaaatttcaaactcacataaaaatatcttaataaaattaccccaaggtatgtattttctatactagctttctaaaactgagcaaact

SEQ ID NO: 9832 - DNA, 368 bp, Homo sapiens
  Z93020.1_24834
  Located on chromosome 6
  Distance between a terminus base of telomere on chromosomal short arm and 5'-terminus of this base sequence : 16394211
  Distance between 3'-terminus of neighbour sequence of sequence listing upward to telomere on chrosomal short arm and 5'-terminus of this base sequence : 74053
gtgatagttatagccatgttcagaggattttcccatcaagtagaatagttgagtctagttccataagtaactggatacacatgtacacacacacacacacacacacacacacacatatgcacgctcgtttagttgcccagggagtatcttaagaaatcaaactagcattttgacttttgttccatatgtcagggatcactcagaggttgcctctgagcattcttgttccttgtggagcactgaggggaatgactgctttaggatagggcttttttttttttttttttttttttaggatagggctagctcataaagaactgtttgctgaagtcctttgtttgcttaactaccatcctgaatcaacgtac

SEQ ID NO: 9833 - DNA, 199 bp, Homo sapiens
  AL023583.25_4875
  Located on chromosome 6
  Distance between a terminus base of telomere on chromosomal short arm and 5'-terminus of this base sequence : 16423849
  Distance between 3'-terminus of neighbour sequence of sequence listing upward to telomere on chrosomal short arm and 5'-terminus of this base sequence : 29270
tttccttgatcaagaggttaaataaaaaaacaactctctttcacactctaagggaaaggaaaataaaaaccaccagtagctaagacacacacacacacacacacacacacacaaacacacacacacatttggcagaaataaattaagaaaaatcattctatgtatgagaccattctgaaactaagtgatgcatgatatt

SEQ ID NO: 9834 - DNA, 172 bp, Homo sapiens
  AL023583.25_110803
  Located on chromosome 6
  Distance between a terminus base of telomere on chromosomal short arm and 5'-terminus of this base sequence : 16529828
  Distance between 3'-terminus of neighbour sequence of sequence listing upward to telomere on chrosomal short arm and 5'-terminus of this base sequence : 105780
catagagttacctttcacgcacatgcacacttctgtgtgtgtgtgtgtgtgtgtgcggcgcctaagagtacctcaaatctactcttttggcaaattacccatctataatacaatattaactatagtcctcatgtacattagatctctagactcattaatcctgtgaaactgc

SEQ ID NO: 9835 - DNA, 197 bp, Homo sapiens
  AL022396.1_12904
  Located on chromosome 6
  Distance between a terminus base of telomere on chromosomal short arm and 5'-terminus of this base sequence : 16664306
  Distance between 3'-terminus of neighbour sequence of sequence listing upward to telomere on chrosomal short arm and 5'-terminus of this base sequence : 134306
acctttaagaactgtaatgctcaccgtgagggtccgtggcttcattcttgaagttagtgagaccaagaacccacccatgctggacacaaagggagcatgtatatatatatatatatatatatatatatatatatatatccacgttgggaaagaaatctatgttatggaggaagttagaccaaatagtgtctaggacc

SEQ ID NO: 9836 - DNA, 322 bp, Homo sapiens
  AL022396.1_40557
  Located on chromosome 6
  Distance between a terminus base of telomere on chromosomal short arm and 5'-terminus of this base sequence : 16691990
  Distance between 3'-terminus of neighbour sequence of sequence listing upward to telomere on chrosomal short arm and 5'-terminus of this base sequence : 27487
acatcgtttgtagcaatttgtttcagcagccctagaaaactaatataccttttccctctctctctctaacacacacacacacacacacacacacacacacacacacacacacacacactcacacactcttccacctttaaaaaaaaagaagaagatgaaaacaacattaagggggagaaatactgaagtattcatatgcccagaaaagtaacgtctcccctactcgagggcgagacccctggaaagaatttctccctccctactctctttctctgctccctctaaaaggttggagaaaggctgtcaggtttattcagctgtt

SEQ ID NO: 9837 - DNA, 343 bp, Homo sapiens
  AL022396.1_60487
  Located on chromosome 6
  Distance between a terminus base of telomere on chromosomal short arm and 5'-terminus of this base sequence : 16711890
  Distance between 3'-terminus of neighbour sequence of sequence listing upward to telomere on chrosomal short arm and 5'-terminus of this base sequence : 19578
tctgtcaatcctctgatatcctaggttttgcagggaagcagagctaagaaagcgtgtgtagattgtggtcacctgggtgatctcttgcacaggactgtacacacacacacacacacacacacaaacaaatggtaggaagtgaaggggctccattttgctaaagcaaaactaaaacaacaactatctctgtgcagttgctctgctggtcaggcagcaaatggctctgccacacaattagaacgatataaccattttctttcagtttgcatgcctcctgctattgcagcacctgttcaggagaccctgggggctttccatccttgtactcataatcctgcagatt

SEQ ID NO: 9838 - DNA, 236 bp, Homo sapiens
  D6S429
  Located on chromosome 6
  Distance between a terminus base of telomere on chromosomal short arm and 5'-terminus of this base sequence : 16734972
  Distance between 3'-terminus of neighbour sequence of sequence listing upward to telomere on chrosomal short arm and 5'-terminus of this base sequence : 22739
aacactggggattacaattcaacatgagatttgtgtggaaacagagtcaagccatatctgagggtttttgtacctctcacaatctgtctctcctgggattctaatgtacaggtgagtttgataaccactaggctagaggaaatgtactagaaaacacacacacacacacacacacacacacacacacacacacagagagagagagatttaatgtctcaaaatgtgtctgctcaaaa

SEQ ID NO: 9839 - DNA, 170 bp, Homo sapiens
  HUMUT7170
  Located on chromosome 6
  Distance between a terminus base of telomere on chromosomal short arm and 5'-terminus of this base sequence : 16944998
  Distance between 3'-terminus of neighbour sequence of sequence listing upward to telomere on chrosomal short arm and 5'-terminus of this base sequence : 209790
gagaggaggaaaggaagaggtgggtaaataataaattgtttagcactggaagaatcatctagtgctactccagtcatttcaagggttgtgtgtgtgtgtgtgtgtatgtgtgtgtgtattttgggcacctgtgggcaggggggatcaaagtgggagtacaggcacaactg

SEQ ID NO: 9840 - DNA, 278 bp, Homo sapiens
  AL080313.13_44967
  Located on chromosome 6
  Distance between a terminus base of telomere on chromosomal short arm and 5'-terminus of this base sequence : 17043550
  Distance between 3'-terminus of neighbour sequence of sequence listing upward to telomere on chrosomal short arm and 5'-terminus of this base sequence : 98382
agcaactaaagtcctctggtagttttcaaatggccagttctgtcctcctctcaaaatatactttgctcttgtatttccagtttcaaagtagcaaaatgcaaagtcctgtcttccttccttccttccttccttccttccttccttccttcctcttcttcctttcctttttccttccttccttcctccttccttccttccttccttccttccttccttccttccttcctccttccttccttctctccctccttacatccctctacaagtatcaggccgtg

SEQ ID NO: 9841 - DNA, 324 bp, Homo sapiens
  AL009177.1_21142
  Located on chromosome 6
  Distance between a terminus base of telomere on chromosomal short arm and 5'-terminus of this base sequence : 17109690
  Distance between 3'-terminus of neighbour sequence of sequence listing upward to telomere on chrosomal short arm and 5'-terminus of this base sequence : 65862
cagcacaggaccttatgactagcaagtattcaagtaagagctattgaatgagaatgtcaatggactgcatccagcttcctaaagctcaggtgactatatatatatatatatatatatatatatatatatatatatatatgtatatatatgtgtgtgtgtgtgtgtgtgtgtgtgtctgtgtgtgtgtatttttgagaccgtctcactctgtcatccaggctaaagtgcagtggcatggtcaccacttactgcagcctcaatctcctgggctcaagtgatcctcccacctcagcctcctgagtacctgggactacaggataattt

SEQ ID NO: 9842 - DNA, 428 bp, Homo sapiens
  AL009177.1_21196
  Located on chromosome 6
  Distance between a terminus base of telomere on chromosomal short arm and 5'-terminus of this base sequence : 17109695
  Distance between 3'-terminus of neighbour sequence of sequence listing upward to telomere on chrosomal short arm and 5'-terminus of this base sequence : -319
caggaccttatgactagcaagtattcaagtaagagctattgaatgagaatgtcaatggactgcatccagcttcctaaagctcaggtgactatatatatatatatatatatatatatatatatatatatatatatgtatatatatgtgtgtgtgtgtgtgtgtgtgtgtgtctgtgtgtgtgtatttttgagaccgtctcactctgtcatccaggctaaagtgcagtggcatggtcaccacttactgcagcctcaatctcctgggctcaagtgatcctcccacctcagcctcctgagtacctgggactacaggataattttttttatttttagtagaaacaaggtttcactatgttctccaagctggtctcaaactcctgagcccaagtgatcctccagccttggcctcatccaagtgttgagattaca

SEQ ID NO: 9843 - DNA, 180 bp, Homo sapiens
  D6S1653
  Located on chromosome 6
  Distance between a terminus base of telomere on chromosomal short arm and 5'-terminus of this base sequence : 17109749
  Distance between 3'-terminus of neighbour sequence of sequence listing upward to telomere on chrosomal short arm and 5'-terminus of this base sequence : -374
atggactgcatccagcttcctaaagctcaggtgactatatatatatatatatatatatatatatatatatatatatatatgtatatatatgtgtgtgtgtgtgtgtgtgtgtgtgtctgtgtgtgtgtatttttgagaccgtctcactctgtcatccaggctaaagtgcagtggcatggt

SEQ ID NO: 9844 - DNA, 163 bp, Homo sapiens
  D6S1058
  Located on chromosome 6
  Distance between a terminus base of telomere on chromosomal short arm and 5'-terminus of this base sequence : 17124762
  Distance between 3'-terminus of neighbour sequence of sequence listing upward to telomere on chrosomal short arm and 5'-terminus of this base sequence : 14833
tgcaatcatttcagaagcaatggttgcatttcccaagaaaaaaaacaacaacaaaataactaacagcagtggtggtagcagcagcagcagcagcagcagcagccgattgctgactcatcaaacgaggaggcaccaacagctttgcctcccaactaaggaacat

SEQ ID NO: 9845 - DNA, 221 bp, Homo sapiens
  AL009177.1_64099
  Located on chromosome 6
  Distance between a terminus base of telomere on chromosomal short arm and 5'-terminus of this base sequence : 17152615
  Distance between 3'-terminus of neighbour sequence of sequence listing upward to telomere on chrosomal short arm and 5'-terminus of this base sequence : 27690
ggaagttgacagaatttgtcattgatatcaatctttattaagtttactgctgagagctcagaaaatggcggttctggagcaaggaacagggtgaaagcaggaagaacatcaggcactaagaaaagctgtgtgtgtgtgtgtgtgtgtgtgtgtgtgtgtgtgtgtgtgtgtgtgtgtgtttaaaatgtttgtcattgttgctccaaccttaatttgctgat

SEQ ID NO: 9846 - DNA, 164 bp, Homo sapiens
  AL109914.16_114579
  Located on chromosome 6
  Distance between a terminus base of telomere on chromosomal short arm and 5'-terminus of this base sequence : 17267637
  Distance between 3'-terminus of neighbour sequence of sequence listing upward to telomere on chrosomal short arm and 5'-terminus of this base sequence : 114801
aacaggtcactagataccgctctgtgactgaagctagagttaactttccccttcacacagtcactatatatatatgatgaaaagatcctatgctatcacatgcccccatcaaacacacacacacacacacacactcgcaaatcttagaccatggtcacctaatg

SEQ ID NO: 9847 - DNA, 420 bp, Homo sapiens
  AL109914.16_113296
  Located on chromosome 6
  Distance between a terminus base of telomere on chromosomal short arm and 5'-terminus of this base sequence : 17268832
  Distance between 3'-terminus of neighbour sequence of sequence listing upward to telomere on chrosomal short arm and 5'-terminus of this base sequence : 1031
ggtagttcaactcaaaatgagtctttgcggctgggtgtggtggtgcacatctatagtccaagagatattctggaggctgaggtaagaggatcacttcagcccacgagttcggggctgcagtaagctatgattgtgccactgcatttcagcctaggcaacaaagtgagacctcatctctaataaataaataagcaaacacacacacacacacacacacacacaacgagtgagtgtcatccttgaaacaatcatcgtatactggtacacagcagaatgtttatttatatttcccatttgattacacagaatatgacaaagagtaaagtgttgagattttataaagattacacagaatatgacaaacagtaaactgttgagattttataaagttaatcagttgtactgctttatcaaggtcat

SEQ ID NO: 9848 - DNA, 208 bp, Homo sapiens
  AL109914.16_95168
  Located on chromosome 6
  Distance between a terminus base of telomere on chromosomal short arm and 5'-terminus of this base sequence : 17287096
  Distance between 3'-terminus of neighbour sequence of sequence listing upward to telomere on chrosomal short arm and 5'-terminus of this base sequence : 17844
tttgtggaattacaaatagcctggtgtggttttgtgtgtgtgtgtatgtgtgtgcctgtgtgtgtgtgtgtgtgtgtgtgtgtgtgccaggagagtgaaccctaagtatcatgctaagcagtttggactggtttcttgttcgtttcctggggtcgctgtaagaaggtaacacagactgactggcctaaaggaacagaaattgagtgtc

SEQ ID NO: 9849 - DNA, 434 bp, Homo sapiens
  AL109914.16_38305
  Located on chromosome 6
  Distance between a terminus base of telomere on chromosomal short arm and 5'-terminus of this base sequence : 17343757
  Distance between 3'-terminus of neighbour sequence of sequence listing upward to telomere on chrosomal short arm and 5'-terminus of this base sequence : 56453
caatgagtcaactcataggaatttagaacagtccctgagatacagtaatccctcaataagtgttagttagtattactattttcaagagtctctctccaaacttcccacctctagccatcaaataatcagatagcagcaactaattccctcacctgttttccttttatgcagagtattttagctctctcctgccagaccacgccatgtatattagggttctcatagaagaacagaactaataggatacacacacacacacacacacacacacacacacacacacacacatatatataaaggggaggttattaagtattaatttacaggatcacaaggccccacaataggctgtctgcaagccctgaggagcgacaagagccagtccaagtcccaaatctgaagaacttggagtctgatgttcaagaacttggagt

SEQ ID NO: 9850 - DNA, 237 bp, Homo sapiens
  Z67338
  Located on chromosome 6
  Distance between a terminus base of telomere on chromosomal short arm and 5'-terminus of this base sequence : 17383971
  Distance between 3'-terminus of neighbour sequence of sequence listing upward to telomere on chrosomal short arm and 5'-terminus of this base sequence : 39780
agcttattgccatccacaacatatatttcccagcctacctggcaggtaaatgtggccatatgactaggttctggacaatacaacataagcagaagtattgtgtggaatttctaggaagttcctctgtaaaaacacacacacacacacacacacacatgagccaggtgcagtggctcatatccgtaatcctagcaactttgggaggccaaggcaggagatcaaggccaggatttcaag

SEQ ID NO: 9851 - DNA, 360 bp, Homo sapiens
  AL008731.1_14279
  Located on chromosome 6
  Distance between a terminus base of telomere on chromosomal short arm and 5'-terminus of this base sequence : 17396467
  Distance between 3'-terminus of neighbour sequence of sequence listing upward to telomere on chrosomal short arm and 5'-terminus of this base sequence : 12259
acctacaacaggtaaggctaagtctctgtggggttgaggtcccttgcccccagcgcacatacacacacacacacacacacacacacacacacacacacacagccaccaatgccatgctcatgctttgtatagttttgggatttgtgacaacttttaagtctgaggggaatgaatgtactcatgaagaaaatctccaccgttaaggaaatgcccttggtgtggactagtgctagaggcacagaccttgagtagggagtcctgaattcctatcccagtgctgagttaagcagctctatagttattcaaggtctcttgccctccatgtgctctgtcctcagttatgcactggagatcagaata

SEQ ID NO: 9852 - DNA, 275 bp, Homo sapiens
  D6S259
  Located on chromosome 6
  Distance between a terminus base of telomere on chromosomal short arm and 5'-terminus of this base sequence : 17396480
  Distance between 3'-terminus of neighbour sequence of sequence listing upward to telomere on chrosomal short arm and 5'-terminus of this base sequence : -347
aaggctaagtctctgtggggttgaggtcccttgcccccagcgcacatacacacacacacacacacacacacacacacacacacacacagccaccaatgccatgctcatgctttgtatagttttgggatttgtgacaacttttaagtctgaggggaatgaatgtactcatgaagaaaatctccaccgttaaggaaatgcccttggtgtggactagtgctagaggcacagaccttgagtagggagtcctgaattcctatcccagtgctgagttaagc

SEQ ID NO: 9853 - DNA, 228 bp, Homo sapiens
  chr6.fa.O7frz.16023960
  Located on chromosome 6
  Distance between a terminus base of telomere on chromosomal short arm and 5'-terminus of this base sequence : 17598900
  Distance between 3'-terminus of neighbour sequence of sequence listing upward to telomere on chrosomal short arm and 5'-terminus of this base sequence : 202145
aagtccgtactttattcagatttccttagttttaaccaagtgtcctttatgtcctttttcggttccagaatccctcataggaaatcatgtttaacacacacacacacacacacacacacacacacacacacacatatacatatatatacttttttttttttttttttttgaggcagggaggcaaggtctcagtctgtcacccaggctggactgcgttagtccaatcac

SEQ ID NO: 9854 - DNA, 107 bp, Homo sapiens
  D6S1578
  Located on chromosome 6
  Distance between a terminus base of telomere on chromosomal short arm and 5'-terminus of this base sequence : 17681977
  Distance between 3'-terminus of neighbour sequence of sequence listing upward to telomere on chrosomal short arm and 5'-terminus of this base sequence : 82849
actttcccgcccattcccatgtgcctgccacacacacacacacacacacacacacacaacacacacacacactttccctcactcctttgcaagcagttcaagacagc

SEQ ID NO: 9855 - DNA, 217 bp, Homo sapiens
  D6S1559
  Located on chromosome 6
  Distance between a terminus base of telomere on chromosomal short arm and 5'-terminus of this base sequence : 17814896
  Distance between 3'-terminus of neighbour sequence of sequence listing upward to telomere on chrosomal short arm and 5'-terminus of this base sequence : 132812
ctgagcaaagtttcaatgccttctttgaggtactgaatcccagcaggctgctaggggaagattatttttctagcagcatttgtcaatagatctgtatcctattataatctacacaaacaggcgtgtggtgtgtgtgtgtgtgtgtgtgtgtgtgtgtgtgtgtgtgtgtgtatatatatattttttttttttttagagagggagtattgctttgctg

SEQ ID NO: 9856 - DNA, 269 bp, Homo sapiens
  DISD22_0011484
  Located on chromosome 6
  Distance between a terminus base of telomere on chromosomal short arm and 5'-terminus of this base sequence : 18171395
  Distance between 3'-terminus of neighbour sequence of sequence listing upward to telomere on chrosomal short arm and 5'-terminus of this base sequence : 356282
gatggcctgagtctgttatgctgtgtgtgtttgtgtgtgtgtgtgtgtgtgtgtgtgtgtgtgtgtgtgtgtgtgtgtgtgtgtgaatgtctatttgaaacataaaacaagaagcataataaaattccttttaaaaattatgcacctttaaagataaattgatctaattatattatatgatttatatattcatgttttattgaggaaacaagtaatgataattattttctttgattaaattgctgtttccaaattgcattgttgtaatc

SEQ ID NO: 9857 - DNA, 158 bp, Homo sapiens
  DISO7_10002118
  Located on chromosome 6
  Distance between a terminus base of telomere on chromosomal short arm and 5'-terminus of this base sequence : 18407079
  Distance between 3'-terminus of neighbour sequence of sequence listing upward to telomere on chrosomal short arm and 5'-terminus of this base sequence : 235415
aatggttgcttatgttcactatgctatatttactaaggcacaaaatatatatatatatatatatatatatatatatatatatatatgcatgcagattagaaaaaccatttaaaaactagagataaaaagggttttcgcttgacttctcttaagaaatt

SEQ ID NO: 9858 - DNA, 135 bp, Homo sapiens
  DISO7_10002119
  Located on chromosome 6
  Distance between a terminus base of telomere on chromosomal short arm and 5'-terminus of this base sequence : 18462486
  Distance between 3'-terminus of neighbour sequence of sequence listing upward to telomere on chrosomal short arm and 5'-terminus of this base sequence : 55249
tgtcctttctctgctcatagacaaaatctcagacaaactccataacttttccagacacacatctgcatgtgctgcacgtgcacacacacacacacacacacacacacacacacacagtgaagtgctgtttgcctc

SEQ ID NO: 9859 - DNA, 297 bp, Homo sapiens
  DISO7_10002120
  Located on chromosome 6
  Distance between a terminus base of telomere on chromosomal short arm and 5'-terminus of this base sequence : 18496670
  Distance between 3'-terminus of neighbour sequence of sequence listing upward to telomere on chrosomal short arm and 5'-terminus of this base sequence : 34049
gccattcctgaagtgtttctccccttacaatatgttcatatatatacatatatatatatatatacacacacacacacacacatatatatacacatacatatgtatatgtatattaacatatatatgttcatatataagtatatatatatttaaatcagtgtatatttataatcaacaggttaaaaacagattcttagaagtgtaaatatttaattcccataaatgtgtatatttgggcctaggctaatttattttgatatatagaattacattatttcttgcaaagtataaggcagc

SEQ ID NO: 9860 - DNA, 428 bp, Homo sapiens
  chr6.fa.O7frz.18649569
  Located on chromosome 6
  Distance between a terminus base of telomere on chromosomal short arm and 5'-terminus of this base sequence : 18555916
  Distance between 3'-terminus of neighbour sequence of sequence listing upward to telomere on chrosomal short arm and 5'-terminus of this base sequence : 58949
agaatttaaacttcaagagtaccagaaatacgtgttttgaagagggagaacgagatctaaaataaaagtcttggagtatgggagcaaaaagggaaatggagcaggaataccaggcagctcttaaggccctaccaaggccagagacttaaaatgctgtatcatttttaaatgagccaatatttagatttatttatttatttatttatttatttatttattttttaattttttgtttagacagagtctcactctgtcgcccaggctgcagtgcagtggtgcaatctcggctcactgcaagctctgcctcccgggttcatgccattctcctgcctcagcctcctgagtagctgggactacaggcgcccaccaccacgcccggctaattttttgtatttttagtagagacagggtttcaccatgttagccag

SEQ ID NO: 9861 - DNA, 110 bp, Homo sapiens
  D6S1567
  Located on chromosome 6
  Distance between a terminus base of telomere on chromosomal short arm and 5'-terminus of this base sequence : 18683539
  Distance between 3'-terminus of neighbour sequence of sequence listing upward to telomere on chrosomal short arm and 5'-terminus of this base sequence : 127195
agactattagattgccatgtctctgtagatttttgtttctctctctccacacacacacacacacacacacacacacacacacacacaacacgagtcctgattttatcaca

SEQ ID NO: 9862 - DNA, 383 bp, Homo sapiens
  chr6.fa.O7frz.18860033
  Located on chromosome 6
  Distance between a terminus base of telomere on chromosomal short arm and 5'-terminus of this base sequence : 18806827
  Distance between 3'-terminus of neighbour sequence of sequence listing upward to telomere on chrosomal short arm and 5'-terminus of this base sequence : 123178
gacgaacttatcagtttacattcttggggttccataaggaaaaacaggtttctcccccaaagggagtctggcggcgccttctccattttctttaaggaacctgaggctgttataaactattttaggtcccccatgcagcagacggtgcaagaaaaaggagagacagcataagtaaatgaagaaaccagaattcagccaactgagaagaaaaaacttttgctcaaaaaaaacacaaggtcttaggagaaaaacaaaaacaaaaacatgaaagccttttaaatacaaacacacacatatgcacacacacacacacacacacacacacacatcttggatgttagtttttaattaagctgacttttaaccattgagttcctttagaa

SEQ ID NO: 9863 - DNA, 368 bp, Homo sapiens
  chr6.fa.O7frz.18984190
  Located on chromosome 6
  Distance between a terminus base of telomere on chromosomal short arm and 5'-terminus of this base sequence : 18931721
  Distance between 3'-terminus of neighbour sequence of sequence listing upward to telomere on chrosomal short arm and 5'-terminus of this base sequence : 124511
atacatgtggagcactagtcagacaatatttaagattataatgaaaatattctaaagtgaatcaggtaaacaaatcttacagaccattttagactgtgctaaatacatacagttcataaaattattttcctagtgtttcccaaactttagccatgattttcacctatactgtttttctctgaatccactcacttggatttaaagtttttctttactcacttttcttaaaatttagctttttcctacacacacacacacacacacacacacacacacacttataaaatcacagatttgatgctgtgctggtatccacttgcccttttctcagcccatttttgataggctgtttctatggactgcactac

SEQ ID NO: 9864 - DNA, 174 bp, Homo sapiens
  chr6.fa.O7frz.19058726
  Located on chromosome 6
  Distance between a terminus base of telomere on chromosomal short arm and 5'-terminus of this base sequence : 19004886
  Distance between 3'-terminus of neighbour sequence of sequence listing upward to telomere on chrosomal short arm and 5'-terminus of this base sequence : 72797
ggtttaaagcatctgtacaattagaactactaggtgcatgtaaagacctggaaccgaagcatcagccttactcattaagtttgcattttattaatttacttattttatttttaagatttatttatttatttatttatttatttatttattttgagatggagtttcactcttgtt

SEQ ID NO: 9865 - DNA, 253 bp, Homo sapiens
  AL023807.6_162241
  Located on chromosome 6
  Distance between a terminus base of telomere on chromosomal short arm and 5'-terminus of this base sequence : 19092641
  Distance between 3'-terminus of neighbour sequence of sequence listing upward to telomere on chrosomal short arm and 5'-terminus of this base sequence : 87581
acgtatagtgagcttcacaattattggtcatgttccatttatttatttatttatttatttaattttagctagagtacttttgactaagtcatgttccatttattaagccaatgtaggtaggcagttgtttttattactctttatgccttacaggtgttataaatgttattttgtatgcattaaatagttaacagcttcttaagagtaaatataaacattttctttgattgggtcacttccttgtcactcataa

SEQ ID NO: 9866 - DNA, 399 bp, Homo sapiens
  AL023807.6_141136
  Located on chromosome 6
  Distance between a terminus base of telomere on chromosomal short arm and 5'-terminus of this base sequence : 19113657
  Distance between 3'-terminus of neighbour sequence of sequence listing upward to telomere on chrosomal short arm and 5'-terminus of this base sequence : 20763
ccattcctgaattacttcatttagaacaatagtctccaatctcatgcaggtcgctgcaaatgccgttaattcattcctttttatggctaagtagtattccaccacacacacacacacgcacacgcacgcacacacacacacacacacacagcatggttcctttatccacttgttgactgatggacatttgggttggttccacgattttgcgattgtgaactgtgccactataaacatgcatgtgcaagtatctttttcgtataatgacttattttcctctggatagatacccaggagtgggattgttggatcagatggtagttctacttttagttctttaaggaatctccacactgttttccatagtggttgtactagtttacatttccactagcaatg

SEQ ID NO: 9867 - DNA, 202 bp, Homo sapiens
  Z66690
  Located on chromosome 6
  Distance between a terminus base of telomere on chromosomal short arm and 5'-terminus of this base sequence : 19239940
  Distance between 3'-terminus of neighbour sequence of sequence listing upward to telomere on chrosomal short arm and 5'-terminus of this base sequence : 125884
ctgcactcccatgttcattacggcgttgttcacagtaaccaaaatgtggaaatgtaagtgtccattgatggctgaatagatacacacacacacacacacacacacacacacacacacagttgaatcacattcagccataacaaagaagaaaatcctgccatttgtgacaacatggatgaacctggaggacgttatgtgctaa

SEQ ID NO: 9868 - DNA, 163 bp, Homo sapiens
  AL023807.6_14885
  Located on chromosome 6
  Distance between a terminus base of telomere on chromosomal short arm and 5'-terminus of this base sequence : 19239983
  Distance between 3'-terminus of neighbour sequence of sequence listing upward to telomere on chrosomal short arm and 5'-terminus of this base sequence : -159
atgtggaaatgtaagtgtccattgatggctgaatagatacacacacacacacacacacacacacacacacacacagttgaatcacattcagccataacaaagaagaaaatcctgccatttgtgacaacatggatgaacctggaggacgttatgtgctaagtga

SEQ ID NO: 9869 - DNA, 357 bp, Homo sapiens
  AB045146.1_4323
  Located on chromosome 6
  Distance between a terminus base of telomere on chromosomal short arm and 5'-terminus of this base sequence : 19390231
  Distance between 3'-terminus of neighbour sequence of sequence listing upward to telomere on chrosomal short arm and 5'-terminus of this base sequence : 150085
tacagatcaagaccttgtcttaagaaaaaaacaaaaaaaagaataggtataaaatgaatgaaggcaaagaatgtgggtggggcttataatgtagggtgatgtgagtggatttcatttggaaacctagatttatttatttatttatttatttatttatttatttatttatttatttgaggcagggtctcgctctgtcacccaggctgtagtgcagtggcacaatacagcctcaaacttctgggctcaagtgatcctcccgcctcagcctttaaagtatctgggactgcagctgcacaccctcatgcctggctaatgtctttaatttccttgtggtagtcagactttccatagatggat

SEQ ID NO: 9870 - DNA, 170 bp, Homo sapiens
  D6S1688
  Located on chromosome 6
  Distance between a terminus base of telomere on chromosomal short arm and 5'-terminus of this base sequence : 19523628
  Distance between 3'-terminus of neighbour sequence of sequence listing upward to telomere on chrosomal short arm and 5'-terminus of this base sequence : 133040
tgggcaacatagcaagaccttgcttttcacacacacacacacacacacatacacacacacacacacacacacacggaaaaaaagtcaagcaactgcttttaacaatactttcccccataatatttaattagtcatgatttgttttcttctaaagtcatactctcagccag

SEQ ID NO: 9871 - DNA, 470 bp, Homo sapiens
  chr6.fa.O7frz.19819196
  Located on chromosome 6
  Distance between a terminus base of telomere on chromosomal short arm and 5'-terminus of this base sequence : 19691431
  Distance between 3'-terminus of neighbour sequence of sequence listing upward to telomere on chrosomal short arm and 5'-terminus of this base sequence : 167633
ctaagttctgccagttcaaagcactgtattattctgttggtttctggtacctaaatatgcttgcttgcaaggttagtttttttctttattattattattattattattattgttattattatttttgagatggagtcttgctctgttgcccaggctggagtgcagtggcacaatctcggctcactgtaacttccgcctcccgggttcaagtggttctcctgcctcagcctccggagtagctgggattacaggcatgtgccaccaggcctgactaattttttttgtatttttagttgagttggggtttcactatgtaggtcaggctggtcttgaactcctgacctcgtgatccacctgcctcggcctcccaaagtgctgggattataggcgtgagccaccgtgcccagccgcaaggttagttttatgctttcccttaactttgcttggggtggttagcagtaaatcagtga

SEQ ID NO: 9872 - DNA, 459 bp, Homo sapiens
  chr6.fa.O7frz.19906418
  Located on chromosome 6
  Distance between a terminus base of telomere on chromosomal short arm and 5'-terminus of this base sequence : 19778416
  Distance between 3'-terminus of neighbour sequence of sequence listing upward to telomere on chrosomal short arm and 5'-terminus of this base sequence : 86515
cttgtctattaacaatgctgtctcttggccgggtgcggtggctcacccctgtaatcccagcactttaggaggccgaggcgggtggatcacctgaagtcaggagtttgagacgagcctggccaacatggtgaaactctgtctctactaaaaattaaaaaaataaataaaaatcagccaggtgtggtggcaggcccctgtgaccccagctacttgcaaggctgaggcaggagaatcacttgaacccaggaggcagaggttgcagtaagccgaaatcgagtcattgcactccagcctgggcaacaagagtgaaactccatctcaaaacaacaacaacaacaacaacaacaacaacaacctctctcctgatattatggcaaaaaaagagttccctgagacttggttttagatacaaatgaacaaatgaagtagtagggattctgttcaatctagttcagcatc

SEQ ID NO: 9873 - DNA, 278 bp, Homo sapiens
  AL023655.1_54333
  Located on chromosome 6
  Distance between a terminus base of telomere on chromosomal short arm and 5'-terminus of this base sequence : 19857146
  Distance between 3'-terminus of neighbour sequence of sequence listing upward to telomere on chrosomal short arm and 5'-terminus of this base sequence : 78271
aaagcgatattaatgctctgtacttaagaaaattgtgaaatggagaatgacacagacacacacacacacacacacacacacacacacacatcaatcatatgaggtcttataacatttgtaaatatgagttttcttccttaaatttgaatgctagagacaaaaagaaagatgaagatggagtaaactgagtgaaggaaaggcaacacattgtggcctaaagatacaaccagggcttgatttctattggatgaattgtgttcgtacttgacatagtctca

SEQ ID NO: 9874 - DNA, 215 bp, Homo sapiens
  D6S285
  Located on chromosome 6
  Distance between a terminus base of telomere on chromosomal short arm and 5'-terminus of this base sequence : 19857179
  Distance between 3'-terminus of neighbour sequence of sequence listing upward to telomere on chrosomal short arm and 5'-terminus of this base sequence : -245
tgtgaaatggagaatgacacagacacacacacacacacacacacacacacacacacatcaatcatatgaggtcttataacatttgtaaatatgagttttcttccttaaatttgaatgctagagacaaaaagaaagatgaagatggagtaaactgagtgaaggaaaggcaacacattgtggcctaaagatacaaccagggcttgatttctattgga

SEQ ID NO: 9875 - DNA, 358 bp, Homo sapiens
  HUMUT1404
  Located on chromosome 6
  Distance between a terminus base of telomere on chromosomal short arm and 5'-terminus of this base sequence : 19867837
  Distance between 3'-terminus of neighbour sequence of sequence listing upward to telomere on chrosomal short arm and 5'-terminus of this base sequence : 10443
ggaaaatcttagtttaagccctaacctaatttatacctcattctatagtaatgatttttctctttgttctcattctctttttctctcctcaaggtgtttccttccttccttcctccctccctccctcccccacttctctctctctctttctttctttctttctttctttctttctttctttctttctttctttctttctttctctttctttctttttctttcttctttttcttggtctcactctctcacccagaccggactgcagtgacacaatctcagcttaccacaacctctgcctcccaggctcaagctattctcctgcctcagcctcccaagtagctgggattacaggtgcatg

SEQ ID NO: 9876 - DNA, 254 bp, Homo sapiens
  AL023655.1_127922
  Located on chromosome 6
  Distance between a terminus base of telomere on chromosomal short arm and 5'-terminus of this base sequence : 19930677
  Distance between 3'-terminus of neighbour sequence of sequence listing upward to telomere on chrosomal short arm and 5'-terminus of this base sequence : 62482
atcactgttgaagcctcactagaaatggaaagttagcttgggatagtggggagaatagcactttaagtccgaaagtttattttgaagttcaaatgggatacacacacacacatacacacacacacacacacacacacacacacacacacacatacaggttgagtatcccttatccaaaatgcttgggacccgaggtgtttgggtttcagattttttttttattttggaatatctgcattataccagttcagcat

SEQ ID NO: 9877 - DNA, 389 bp, Homo sapiens
  AL136230.9_30395
  Located on chromosome 6
  Distance between a terminus base of telomere on chromosomal short arm and 5'-terminus of this base sequence : 20000434
  Distance between 3'-terminus of neighbour sequence of sequence listing upward to telomere on chrosomal short arm and 5'-terminus of this base sequence : 69503
caaagtaatttccatctgaatagttcttagtggcccaagtggaattaatatatctctttgaagaccaacacctgcttacctgaaattaatttctaaataataatttactagtcccttgtataatttactagatactagttccttgtatcaaccacaacaaagtgggtaaggagtgatgtcatgaagccaaagggttttctgttcccaaggaagcacttaaaacaaaaaaaaaagactcattagtatttatttatttatttatttatttatttttaaatttccaacttttattttaagttcatggcacatctgcaggatgggcaggtttgtcgcataggtaaacatgtgccatggtggtttgctgcacagatcatccaatcacttgttaa

SEQ ID NO: 9878 - DNA, 253 bp, Homo sapiens
  AL136230.9_114126
  Located on chromosome 6
  Distance between a terminus base of telomere on chromosomal short arm and 5'-terminus of this base sequence : 20084257
  Distance between 3'-terminus of neighbour sequence of sequence listing upward to telomere on chrosomal short arm and 5'-terminus of this base sequence : 83434
tagattaggcctcatctttagctataagtcatctctatcttcagtagagtgttttgtgggaacctagctcctgaaattctacatttggccccttgggcctattgtcccaagtattgtctctcactgtttgtgtgtgtgtttgtgcttgcatgagagagagagagagagagagagagagagagagagagagagagaaacgtgtctaaaactgtgcatatgcatatgtagagaggctcaagattagctaagaact

SEQ ID NO: 9879 - DNA, 434 bp, Homo sapiens
  chr6.fa.O7frz.20333871
  Located on chromosome 6
  Distance between a terminus base of telomere on chromosomal short arm and 5'-terminus of this base sequence : 20206025
  Distance between 3'-terminus of neighbour sequence of sequence listing upward to telomere on chrosomal short arm and 5'-terminus of this base sequence : 121515
tatctgattctgcttgttagaatcatactctaattctagtattctgctctgggcattttgtaggtaatattgtatggattaacaatgatttttaaaatatcttttaaccattgaggatacataagctattatacccacagcttaaatctctttctctctttctcagacacacacacacacacacacacacacacactcacaaacatacttaaggataggtctagggagatgtgatattgcacgtggaaacccgaagcaaaatctttgaggttgatgaactaaaattttgttagaacacacacaaaaaaaatgtttacaaaccgtcttttaaaataatgctctgcctaacttccccccccgagttcaggtacatggcttaagtgctgctttgtccttaatgccatcttcttgtcagttgctctgtatgattaaat

SEQ ID NO: 9880 - DNA, 438 bp, Homo sapiens
  AL021329.1_16993
  Located on chromosome 6
  Distance between a terminus base of telomere on chromosomal short arm and 5'-terminus of this base sequence : 20329549
  Distance between 3'-terminus of neighbour sequence of sequence listing upward to telomere on chrosomal short arm and 5'-terminus of this base sequence : 123090
tgtaaagtccacctgactttctacgagccctattatagaaaggaaattgtagctatacttaaatcctttcaattcacgctcttagatccaataggatgtaaaaggtaagagaaacactaacatcttacagggcctgggttcaattctacactgaaaacacacacacacacacacacacaaaacaccctatgtcctttacatctcagaacttcattttcctcaccaataaaaatacagttgaacaaaattgcttctaaagtcctctctttttctgaaagtgtcttttccttgatagtatttccttcgagtaacatttgcactatgtatttactatttctctatattgattttgtggctactctattaactagaaacatacttacctttgtcttcatgagtgtaacaggccaaaatggagaaagtgacatgaccttcaac

SEQ ID NO: 9881 - DNA, 291 bp, Homo sapiens
  AL021329.1_22796
  Located on chromosome 6
  Distance between a terminus base of telomere on chromosomal short arm and 5'-terminus of this base sequence : 20335431
  Distance between 3'-terminus of neighbour sequence of sequence listing upward to telomere on chrosomal short arm and 5'-terminus of this base sequence : 5444
gtagcattgactgctttattgtaatgtaacgcttctttttatctctgataactctccttgctttgaagtctgttctggtgtgtgtgtgtgtgtgtgtgtgtgtgtgtgtgtgtgtgtgtgtgtgtgtgtagcatggtatatctttctccatccatttacttttaatctatgtgtgtctttatatttaaagtgggtatcttgtagacaacatatggttgggtcttgtttttaattcattctgacaatcttttttctttaagtagatcatttagaccattgacattcaaagtg

SEQ ID NO: 9882 - DNA, 442 bp, Homo sapiens
  AL136180.5_8779
  Located on chromosome 6
  Distance between a terminus base of telomere on chromosomal short arm and 5'-terminus of this base sequence : 20542325
  Distance between 3'-terminus of neighbour sequence of sequence listing upward to telomere on chrosomal short arm and 5'-terminus of this base sequence : 206603
tggatcttagaacagaaagataacttaatttaaaaactggtaaagttaggctgggcgcggtggctcatgcctgtaataccagcacttagggaggccgaggtaggcagatcacaaggtcaggagtttgagaccatcctggctaacatggtgaaactccatatctactaaaagtaaaaaaaaaaaaaaaaaattagccaggcatggtggcaggtgcctgtagtcccagctactcgggaagctgaggcaggagaattgcttgaacccaggaggtggaggttgcagtgagctgagattgcaccactgcactccagcctgggcaaaagggcaagactccgcctcaaataaataaataaataaataaataaataaataaataataaataaataaaaactggtaaagtgtggatgaagtctctagttaacagcatagtaccaatgttag

SEQ ID NO: 9883 - DNA, 351 bp, Homo sapiens
  chr6.fa.O7frz.20749768
  Located on chromosome 6
  Distance between a terminus base of telomere on chromosomal short arm and 5'-terminus of this base sequence : 20614556
  Distance between 3'-terminus of neighbour sequence of sequence listing upward to telomere on chrosomal short arm and 5'-terminus of this base sequence : 71789
aaggaaagttctttaaagtgctacacaatcttgtattcaatgtcactcccatcatcgggcttagaaaaccagtcccttttcatgtgaatgtggtaaattgaatttaaatttgtatatgtatggaattccccaggtgggaactgagctgggactggtcaatgccctcctttctgggactgtaaaggatttgtcttgtatttaaaattggagaccaggatatatatatatatatatatatatgtgtgtgtgtgtgtgtgtgtgtgtgtgtgtgtgtgtgtgtgtgtgtgtgtgttttgaatatgatgaaaaaagaaatcctcaagaatttcctaacctttaggaagtctggaa

SEQ ID NO: 9884 - DNA, 275 bp, Homo sapiens
  Z67557
  Located on chromosome 6
  Distance between a terminus base of telomere on chromosomal short arm and 5'-terminus of this base sequence : 20817570
  Distance between 3'-terminus of neighbour sequence of sequence listing upward to telomere on chrosomal short arm and 5'-terminus of this base sequence : 202663
ttgacctggcaatgacaaggtgccattctgaaacagccatatgaagtttccaaagcaacaagcaaacactttcactttatactccagaggcacattttgcacatttataaggcacgcacacacacacacacacacacaaaggaaggaaagaaaaagatattatgtatgatggttgattttaggtgtcaagttgactggattaaggaatattcagttagctggtaaagcattatttctgggtgtgtctgtgagggtgtttctggatgagattggcc

SEQ ID NO: 9885 - DNA, 169 bp, Homo sapiens
  AL022068.2_29805
  Located on chromosome 6
  Distance between a terminus base of telomere on chromosomal short arm and 5'-terminus of this base sequence : 20817607
  Distance between 3'-terminus of neighbour sequence of sequence listing upward to telomere on chrosomal short arm and 5'-terminus of this base sequence : -238
catatgaagtttccaaagcaacaagcaaacactttcactttatactccagaggcacattttgcacatttataaggcacgcacacacacacacacacacacaaaggaaggaaagaaaaagatattatgtatgatggttgattttaggtgtcaagttgactggattaagga

SEQ ID NO: 9886 - DNA, 311 bp, Homo sapiens
  AL022068.2_47491
  Located on chromosome 6
  Distance between a terminus base of telomere on chromosomal short arm and 5'-terminus of this base sequence : 20835321
  Distance between 3'-terminus of neighbour sequence of sequence listing upward to telomere on chrosomal short arm and 5'-terminus of this base sequence : 17545
attcaatccacttcatacttcaacctatcctctagccacatccactccaaaacacacacacacacacacacacacacacacaatgccacttaaccaattttcactaatagcactgatgtcttcctaatttttcgttataaagctttggttttcatgaggttttctacagtattggacatcattaacaattgcagatgtccgcaaacatcaccttgctactttctctgctgtccattcttcatgccattcctattgggctcatttgttaataccatctactcccccatcctcttaaatggtgatgtacacca

SEQ ID NO: 9887 - DNA, 407 bp, Homo sapiens
  AL022068.2_60904
  Located on chromosome 6
  Distance between a terminus base of telomere on chromosomal short arm and 5'-terminus of this base sequence : 20848494
  Distance between 3'-terminus of neighbour sequence of sequence listing upward to telomere on chrosomal short arm and 5'-terminus of this base sequence : 12862
catgattgtaagtttcctgaagtctccctagccatgtggaactgtgagtcaattaaacctcttttctttataaattagcaagtcttgggcagtgctttagagcaatgtgagaatggatgaatacagaattctccaaagggacagaaccaagaggactatatatatatgtgtgtgtattatctctgataaactcataaatatatatatatatatacacacacatacacacatatatacacataaacacatatatacacacatatacatatacatacacacatatatatatacatatatatatatatatatatatccttttcctccagaccatcctgggttgggttaaactaatatatatatatatgagttcatcagagagaattagcttacacgattacaaggcaaag

SEQ ID NO: 9888 - DNA, 328 bp, Homo sapiens
  AL022068.2_76628
  Located on chromosome 6
  Distance between a terminus base of telomere on chromosomal short arm and 5'-terminus of this base sequence : 20864304
  Distance between 3'-terminus of neighbour sequence of sequence listing upward to telomere on chrosomal short arm and 5'-terminus of this base sequence : 15403
atcagaatcacctttaacattcatctttcttctaacagtcttttagagcaatttaggcttggtttagcatatatctcaaattcctccagcctctgcccattacccagctctaaagctgcttccacattgttacagcaacatcccacttattggtaccaaaatctctattagtcaggattcttcagagaaacagaagcatatatacatatatatatatatatatatatacacacacatatatatatacacacacacacacatatatatacatatatacagaaacaatagtatatacatacatactgttgactcgaacagtatttgaact

SEQ ID NO: 9889 - DNA, 328 bp, Homo sapiens
  AL022068.2_112587
  Located on chromosome 6
  Distance between a terminus base of telomere on chromosomal short arm and 5'-terminus of this base sequence : 20900269
  Distance between 3'-terminus of neighbour sequence of sequence listing upward to telomere on chrosomal short arm and 5'-terminus of this base sequence : 35637
aaggacttcaatcttggtgataccctggacagcagcaaccccatgcaaaccatccaaaagaccaccaccagccggatagtggatggcaaagtggtgtctgagaccaacgacaccaaagtttggagacattaagccagcagaagcagagtaccctttggggaccaggaggccaataaaaagctcagaggtagataaataaatatatatatatatatatatatatatatatatatatatatatatatatatggacacatatatacacacacagaggtggtacagtaaaatgaaattgaagatggggacttagattctaattcaagatggc

SEQ ID NO: 9890 - DNA, 418 bp, Homo sapiens
  chr6.fa.O7frz.20966606
  Located on chromosome 6
  Distance between a terminus base of telomere on chromosomal short arm and 5'-terminus of this base sequence : 20917283
  Distance between 3'-terminus of neighbour sequence of sequence listing upward to telomere on chrosomal short arm and 5'-terminus of this base sequence : 16686
tggcttattaatacaatggaatactatatagcagtttaaatagatgaacatatatctacacaaaccttaaaacatattgttgagtgaaaaaaataagttgcaaaaggacactttcaggggaacatcaaaaatatacatttttaaatcatattgtaagttttcatgcatttatagtttcaaaaacatttaaaaatgcctgggaaaagttcacatcaatttctcaaaagtgtcttcctctgagggtgaaaatgtagatatagccgtagagtgctgtttgtttaaaatctgtgtgtgtgtgtgtgtgtgtgtgtgtgtgtgtgttgtgaaagcgagaaagacggagagagaaaaagagaagagaaagagttgaactaaacacagcaaatgttaacaactatttaaacttggtgttgcatat

SEQ ID NO: 9891 - DNA, 239 bp, Homo sapiens
  AL137839.6_93692
  Located on chromosome 6
  Distance between a terminus base of telomere on chromosomal short arm and 5'-terminus of this base sequence : 21026588
  Distance between 3'-terminus of neighbour sequence of sequence listing upward to telomere on chrosomal short arm and 5'-terminus of this base sequence : 108887
tagtgaacgttagttcctgaaattattcagaagggtgctgttcactcgtcagagtcttaatgaaggggaaaacagaacagggcatttttctgggaggggagaattatatccttttctcctgtgggtactgtggtctgcttgcttgcttgcttgcttgctggcttgcttgctggtgaatttttgctttgtagagagtttctggtttccttgggaagttgtgtttctgatcactacattgg

SEQ ID NO: 9892 - DNA, 286 bp, Homo sapiens
  AL022726.1_86106
  Located on chromosome 6
  Distance between a terminus base of telomere on chromosomal short arm and 5'-terminus of this base sequence : 21110500
  Distance between 3'-terminus of neighbour sequence of sequence listing upward to telomere on chrosomal short arm and 5'-terminus of this base sequence : 83673
gaagattaaatgagcctcactcagtccatggtagagctagcaccacagtcagattaggtctcaggtctcattacttctcagagcagggatctatgaggttttatttatttatttatttatttatttatttatttatttattttttccccagaatattttgcaaaggattagtcacattttccccagatcaactgattttttcttcagataatgtgctaattacagaagttatatagttcagtttcataaaaagatacgttgtatgtaacttcggcttaaaatgaag

SEQ ID NO: 9893 - DNA, 295 bp, Homo sapiens
  AL022726.1_16889
  Located on chromosome 6
  Distance between a terminus base of telomere on chromosomal short arm and 5'-terminus of this base sequence : 21179662
  Distance between 3'-terminus of neighbour sequence of sequence listing upward to telomere on chrosomal short arm and 5'-terminus of this base sequence : 68876
cttaaagccatactcaaccaacagtaagtgctgtacttggtaattcttccctagtatcctaacctgagaaaactactgggaagtcatccctggtgtaaaacatttaggccctgatggagccccacctctcgggagacagtttattctatagcaagaaagtcgctgtgtgcacacacacacacacacacacacacacatacgtaaaccataacagacctagtggtgacacttgccacctgagaaaaagtgggcttagaatcagaatatggcttaattatcctatgagaaacgcttc

SEQ ID NO: 9894 - DNA, 290 bp, Homo sapiens
  AL031057.10_56532
  Located on chromosome 6
  Distance between a terminus base of telomere on chromosomal short arm and 5'-terminus of this base sequence : 21198088
  Distance between 3'-terminus of neighbour sequence of sequence listing upward to telomere on chrosomal short arm and 5'-terminus of this base sequence : 18131
attaccaaactattgatgcctctgcttttgttacccaagaaagattaaataatgttaaatagaaattgtattatattttaattccttaaaaagtataattgaaataataaaaataatacctaatagttattgagtatttgctaagtgccaagcactattttaagtgttttaatgtagatagatagatagatagatagatagatagatagatagatagagagacagagagatagagagatagatgcattttaatgtatagacagatagatagatttaatcttcatggcatt

SEQ ID NO: 9895 - DNA, 274 bp, Homo sapiens
  D6S1700
  Located on chromosome 6
  Distance between a terminus base of telomere on chromosomal short arm and 5'-terminus of this base sequence : 21295897
  Distance between 3'-terminus of neighbour sequence of sequence listing upward to telomere on chrosomal short arm and 5'-terminus of this base sequence : 97519
tcaggcttctaagcaatcctcaggcagagtagtatgttttgtacagaactcaatgataagttatgtgtttttcttaaagaaaccagattatcccctcttcatcctccctttcaagccaacagaatatatatgtgcatatatatatacatacatacatacatatatatatacacatacatacacacacacacacacacacacacacacacacacacacatatatatatactttttttgtgtgagatggagtctcgctcttattgcccagggtgga

SEQ ID NO: 9896 - DNA, 287 bp, Homo sapiens
  D6S1678
  Located on chromosome 6
  Distance between a terminus base of telomere on chromosomal short arm and 5'-terminus of this base sequence : 21320600
  Distance between 3'-terminus of neighbour sequence of sequence listing upward to telomere on chrosomal short arm and 5'-terminus of this base sequence : 24429
tctcaggatctcgggggggggggggtgtgtgtgtgagtgtgtgtgtgtgtaaccgagtagcctgtcagagcctcattttccagaatgcaagttctccccctaactgataatactctaaataacaggtgagtgactcctggcaggaaggagattatctgacctcattgtttgcctttttcccccctctttgttcttcacaaataaaggttttttaataaactgaaaggtcctccgctcttgcctgatgataaaatgaaaggaaccagtgaggtatggtacaacgtggc

SEQ ID NO: 9897 - DNA, 197 bp, Homo sapiens
  AL008627.1_67398
  Located on chromosome 6
  Distance between a terminus base of telomere on chromosomal short arm and 5'-terminus of this base sequence : 21339335
  Distance between 3'-terminus of neighbour sequence of sequence listing upward to telomere on chrosomal short arm and 5'-terminus of this base sequence : 18448
atttagctgtcagcattcaaagctgggaaagacaatagtttgatagattttgtagatggagagagagagagagagagagagaaagaaaatcttctaaattcttttcctgtatcaggaaacaagcctgagggctcaggtctcagactttcttctataatgtagataagattcccattctgcttatgacaggccattat

SEQ ID NO: 9898 - DNA, 336 bp, Homo sapiens
  chr6.fa.O7frz.21088572
  Located on chromosome 6
  Distance between a terminus base of telomere on chromosomal short arm and 5'-terminus of this base sequence : 21471176
  Distance between 3'-terminus of neighbour sequence of sequence listing upward to telomere on chrosomal short arm and 5'-terminus of this base sequence : 131644
taaatgtctacctcgaaccacctctgtaccacctctatactacctatatgtacctaacattataactgcagtgtgtgtgtgtgtgtgtgtgtgtgtgtgtgtattttagctaaatttgagttctctgaagataaggacaagttttattcatctgtgtaagggcaggcatagtggctcacatccataatcagcactttgggaggctgaggtgagaggatcgcttgaggcaaggagttcaagatcagcctgggtagcatagtgagaccccatctctacaaaaaaaaatttaattagctgggcacagtgacacatgcctcaagtatcagctactcagga

SEQ ID NO: 9899 - DNA, 197 bp, Homo sapiens
  D6S422
  Located on chromosome 6
  Distance between a terminus base of telomere on chromosomal short arm and 5'-terminus of this base sequence : 21656264
  Distance between 3'-terminus of neighbour sequence of sequence listing upward to telomere on chrosomal short arm and 5'-terminus of this base sequence : 184752
tgcctacatggtgaagactctcaaacctactcctcctgcctagacctctctctctctctctctctctctctctgtgtgtgtgtgtgtgtgtgtgtgtgtgtgtgtgtgtgtagtttaggctcacttttttcaactacctactaaacaatttcccctaaatactccacagtcccccaaatatcccacagtcccctaaa

SEQ ID NO: 9900 - DNA, 262 bp, Homo sapiens
  D6S1643
  Located on chromosome 6
  Distance between a terminus base of telomere on chromosomal short arm and 5'-terminus of this base sequence : 21673213
  Distance between 3'-terminus of neighbour sequence of sequence listing upward to telomere on chrosomal short arm and 5'-terminus of this base sequence : 16752
tccctagcagtggagagcagaggatgtgctcacaaaagcagcagccgcttatggacacacacacacacacacacacacacacgagtatcacacacacacacacacgagtatcacacacacacacgagtatcacacacacacacacgagtatcacacacacacacgagtatcacacacacacacacgagtatcacacacatataaatccacgtatgtctatttatccaacaaacatttactaagcctgtcctatgcactaagc

SEQ ID NO: 9901 - DNA, 173 bp, Homo sapiens
  AL033521.2_105860
  Located on chromosome 6
  Distance between a terminus base of telomere on chromosomal short arm and 5'-terminus of this base sequence : 21831214
  Distance between 3'-terminus of neighbour sequence of sequence listing upward to telomere on chrosomal short arm and 5'-terminus of this base sequence : 157739
ccaggtccttctctgattctacactagtggagtgtgttggggtgcttgattgtaggtagaagtccaagctctccccacttggcctttgtagcgtgcctgggggtgggattacagttttgtgtgtgtgtgtgtgtgtgtgtgtgtgtttgtgtttggctggagtagaatgatta

SEQ ID NO: 9902 - DNA, 400 bp, Homo sapiens
  AL033521.2_33972
  Located on chromosome 6
  Distance between a terminus base of telomere on chromosomal short arm and 5'-terminus of this base sequence : 21903008
  Distance between 3'-terminus of neighbour sequence of sequence listing upward to telomere on chrosomal short arm and 5'-terminus of this base sequence : 71621
ctttgctgaagttgcttatcagcttaaggagattttgggctgagacaatggggttttctagatatatttgactttttatggccaggagcagtggctcatgcctgtaatcccagcactttgggaggctgaggtgggcagatcatttagcccaggagttcgagaccagcctggacagcatggcgaaaccccgactctaccacacacacacacacacacacacacacacacacacacacacactacaaaaattagctggacatgatggtgtgcacctgtagttttagttactttagaggcttaggctggagaatcacctgagtgcacgaagttgaggctgcagtgagctgtgattgcaccactgcactccaggctgggtgagtgaaacctttctgtctcagaa

SEQ ID NO: 9903 - DNA, 236 bp, Homo sapiens
  AL035090.10_5065
  Located on chromosome 6
  Distance between a terminus base of telomere on chromosomal short arm and 5'-terminus of this base sequence : 22040260
  Distance between 3'-terminus of neighbour sequence of sequence listing upward to telomere on chrosomal short arm and 5'-terminus of this base sequence : 136852
catcagcaatgtatgaaggttccaatttctccacattttcaccaacactcgttattatctgtatgtgtgtgtgtgtgtgtgtgtgtgtgtgtgtgtattttaagagacagggtctcactctgtcacctacgctggagtccagtggtgtgatcataggtcactgtaattttgaactcctgggctcaagcggtctttcccccttagcctctcaagtatttaggactacaggtgagcac

SEQ ID NO: 9904 - DNA, 353 bp, Homo sapiens
  chr6.fa.O7frz.22379776
  Located on chromosome 6
  Distance between a terminus base of telomere on chromosomal short arm and 5'-terminus of this base sequence : 22188422
  Distance between 3'-terminus of neighbour sequence of sequence listing upward to telomere on chrosomal short arm and 5'-terminus of this base sequence : 147926
ctgtccgtctacagtaaccactgtccccctgacttctaacactgtggattattactgtctttgtaaatgaccaagttggaaatgttgaactttatctcaagaacctttatttcaaggttttagcagtgaaatgacatcatctgatttgcatttccaaaggatcagtagctgctgtgtggagaataaattgtaggggttcagaatgtaagtggagggaccagagaagaggctacttaaagaaatcacgtggtggattcacacacacacacacacacacacacacacacacacacacacacacacaatgtgtttattgggcctttaataaactgagtttagctatgaggtatgag

SEQ ID NO: 9905 - DNA, 210 bp, Homo sapiens
  D6S1665
  Located on chromosome 6
  Distance between a terminus base of telomere on chromosomal short arm and 5'-terminus of this base sequence : 22274440
  Distance between 3'-terminus of neighbour sequence of sequence listing upward to telomere on chrosomal short arm and 5'-terminus of this base sequence : 85665
tgcatccagccagacatatcattttaaacatctctaaactttggtgtttttatccgtaacatgagaatgcatcagtggattaatcaaagtccttcaaagaaacataatatgtgtgtgtgtgtgtgtgtgtgtgtgtgtgtgtgtgtagtgagggagaattcactcttgctctgccattttgtttaatttgagccctcaaaggattggatg

SEQ ID NO: 9906 - DNA, 194 bp, Homo sapiens
  AL022717.1_84805
  Located on chromosome 6
  Distance between a terminus base of telomere on chromosomal short arm and 5'-terminus of this base sequence : 22274519
  Distance between 3'-terminus of neighbour sequence of sequence listing upward to telomere on chrosomal short arm and 5'-terminus of this base sequence : -131
ttaatcaaagtccttcaaagaaacataatatgtgtgtgtgtgtgtgtgtgtgtgtgtgtgtgtgtgtagtgagggagaattcactcttgctctgccattttgtttaatttgagccctcaaaggattggatgctacccacccattgatgaggatggatcttcttttactctgtctgctgattgaaatgctaatct

SEQ ID NO: 9907 - DNA, 179 bp, Homo sapiens
  G12405
  Located on chromosome 6
  Distance between a terminus base of telomere on chromosomal short arm and 5'-terminus of this base sequence : 22501145
  Distance between 3'-terminus of neighbour sequence of sequence listing upward to telomere on chrosomal short arm and 5'-terminus of this base sequence : 226432
cccatgaatgctgagactttacttcattcacctttgtgtccttaatgactaggatagggcctggcagggagcaaatgctcagtaaacgtctgttggatgaatgaatgaatgaatgaatgaatgaatgaatgaatttgttccggagatatatgtataccccttactgaaaaggactgcaa

SEQ ID NO: 9908 - DNA, 228 bp, Homo sapiens
  AL031767.13_31857
  Located on chromosome 6
  Distance between a terminus base of telomere on chromosomal short arm and 5'-terminus of this base sequence : 22634305
  Distance between 3'-terminus of neighbour sequence of sequence listing upward to telomere on chrosomal short arm and 5'-terminus of this base sequence : 132981
gtgccaaagacaggtagatagatagataatagatgatagaaagatagatagatagatagatagatagatagatagatagatagatagatgatagatagataaatattttactctttgtatttttatagctctgttgactttgtctttcactgtgtacctctcaaggagggtatccttgtctctaaaaatgaacaactatctcttttgcttaggaacagaatcacttgc

SEQ ID NO: 9909 - DNA, 253 bp, Homo sapiens
  Z67085
  Located on chromosome 6
  Distance between a terminus base of telomere on chromosomal short arm and 5'-terminus of this base sequence : 22809111
  Distance between 3'-terminus of neighbour sequence of sequence listing upward to telomere on chrosomal short arm and 5'-terminus of this base sequence : 174578
cctaaatgtgccgctgtttcgaatcgctgtctccacaggctgtctttttttgttttttccaaattattaaaaatcacatccatgatgatatttgttgggctcttcgattagatgaattaaaacacacacacacacacacacacatacaccacacacaagggcatcactgcgaagaagagttatgttccgctaacatcacaagagaagagaaagtgatgctttctgcttccttctttgttgtcagcatgaccca

SEQ ID NO: 9910 - DNA, 239 bp, Homo sapiens
  AL136179.15_31193
  Located on chromosome 6
  Distance between a terminus base of telomere on chromosomal short arm and 5'-terminus of this base sequence : 22901772
  Distance between 3'-terminus of neighbour sequence of sequence listing upward to telomere on chrosomal short arm and 5'-terminus of this base sequence : 92408
gattaccaggaaggtattgaagtattttgtatgtttggaaggtaacagggtgaggttaaaaggtaaatctagtttttctctgtccacattccctacacacacacacacacacacacacacacacacacacagagcacactcaagccctcatgttgtactgtttctgccaccgtttccctgctgttgtattgctagaagaggaaggtgatattttggaagacatttgatccatctaatgg

SEQ ID NO: 9911 - DNA, 450 bp, Homo sapiens
  AL136179.15_115960
  Located on chromosome 6
  Distance between a terminus base of telomere on chromosomal short arm and 5'-terminus of this base sequence : 22986392
  Distance between 3'-terminus of neighbour sequence of sequence listing upward to telomere on chrosomal short arm and 5'-terminus of this base sequence : 84381
tctgaggacaaatgaatttgagtatcttatttcttttgatcactcaagtgccctcattcatgaagcagtttaaagtaatcacgggctgtgggcggtggctcacacctgaaatcctagcactttgggagtccaaggccgtcggatcacttaagccctgggaggtcaaggctgcagtgagctgtgatggcgccactgcactccagcctgggtgacagagcaagatcctgtttaaaaaaaaaaaatatatatatatatatatatataaattatatatatatataatttatatatatataaatatatatatataaattatatatataaatatatataaatatatatataaatatatataatatgtatatatataataataataaaataaagtaatcacggccaccaatccatcactggtgtcctcaaaaactcttccaagtcttaagcaaataa

SEQ ID NO: 9912 - DNA, 190 bp, Homo sapiens
  D6S1597
  Located on chromosome 6
  Distance between a terminus base of telomere on chromosomal short arm and 5'-terminus of this base sequence : 23012448
  Distance between 3'-terminus of neighbour sequence of sequence listing upward to telomere on chrosomal short arm and 5'-terminus of this base sequence : 25606
ggcctggtgacagagcgagactccatctcaaaaaacaaaaaacaaaaacaaaatacacacacacgcgcgcgcgcgcacacacacacacacacacacacacaaacaaaggggctactgtcccgtttatcactgtagtccaagtttggacacagacccttctcatagttcctcaacgatttctaagataaag

SEQ ID NO: 9913 - DNA, 251 bp, Homo sapiens
  HUMUT6259
  Located on chromosome 6
  Distance between a terminus base of telomere on chromosomal short arm and 5'-terminus of this base sequence : 23078870
  Distance between 3'-terminus of neighbour sequence of sequence listing upward to telomere on chrosomal short arm and 5'-terminus of this base sequence : 66232
ctttgactgccatggcatgctgacctgcattttactgttgatcaaacttatgaaaacactctctagaggatgaattctctttctttctttctttctttccttccttccttccttccttccttccttccttccttccttccttccttctttttctttctttctttctttttttttttgagacagagactcactctgtcacccaggctggagagcagtggcatgatcttggcccactgcaaactttgcctcct

SEQ ID NO: 9914 - DNA, 334 bp, Homo sapiens
  chr6.fa.O7frz.23390283
  Located on chromosome 6
  Distance between a terminus base of telomere on chromosomal short arm and 5'-terminus of this base sequence : 23280616
  Distance between 3'-terminus of neighbour sequence of sequence listing upward to telomere on chrosomal short arm and 5'-terminus of this base sequence : 201495
tagtggaaagaacctattggttttaaagcacatcaaatgtggttttagatttatattgaatacaagaagaaagggatataagtgtaatttctaaaaaaattgcttggtaactgaagcaataaaatcacaaattttgaatttgtctttaacatctaacaggtttctcgtgtatatatatgtgtgtgtgtgtgtgtgtgtgtgtgtgtgtgtgtatccttctatattctttgtgtgtgtgtgtgctttttacaaaagtttatattcttctatgtgttcatccaaattattgatctgggtcattcacttataaacttaataagaacaggtgatgctt

SEQ ID NO: 9915 - DNA, 259 bp, Homo sapiens
  D6S1686
  Located on chromosome 6
  Distance between a terminus base of telomere on chromosomal short arm and 5'-terminus of this base sequence : 23356910
  Distance between 3'-terminus of neighbour sequence of sequence listing upward to telomere on chrosomal short arm and 5'-terminus of this base sequence : 75960
cactgggtgctaggaatgtaagtaagaagaagatgggatctgtgtaccttaggaatcaaatgatagtctttatgtgctctggtacaggtctgtgtgtgtgtgtgtgtgtgtgtgtgtgtttctttcaagcctttgtgagactcctatggcaattaggaaggctcacagatattctgatggccttccttgggcacactcagcacagttgtactttcttgcctcctttaagtctaggcatgactatgaaagtggcttgcca

SEQ ID NO: 9916 - DNA, 192 bp, Homo sapiens
  AL008732.1_70186
  Located on chromosome 6
  Distance between a terminus base of telomere on chromosomal short arm and 5'-terminus of this base sequence : 23356970
  Distance between 3'-terminus of neighbour sequence of sequence listing upward to telomere on chrosomal short arm and 5'-terminus of this base sequence : -199
tgatagtctttatgtgctctggtacaggtctgtgtgtgtgtgtgtgtgtgtgtgtgtgtttctttcaagcctttgtgagactcctatggcaattaggaaggctcacagatattctgatggccttccttgggcacactcagcacagttgtactttcttgcctcctttaagtctaggcatgactatgaaagtgg

SEQ ID NO: 9917 - DNA, 124 bp, Homo sapiens
  D6S1029
  Located on chromosome 6
  Distance between a terminus base of telomere on chromosomal short arm and 5'-terminus of this base sequence : 23364151
  Distance between 3'-terminus of neighbour sequence of sequence listing upward to telomere on chrosomal short arm and 5'-terminus of this base sequence : 6989
ttttcatttaccttggctgccatttaataataataataataataataataataataatacgacaaatgattaaggcagagctaggagtggacccgagaacgcatgtctcgttatatgtctatta

SEQ ID NO: 9918 - DNA, 385 bp, Homo sapiens
  AL023883.6_120074
  Located on chromosome 6
  Distance between a terminus base of telomere on chromosomal short arm and 5'-terminus of this base sequence : 23596003
  Distance between 3'-terminus of neighbour sequence of sequence listing upward to telomere on chrosomal short arm and 5'-terminus of this base sequence : 231728
gattgaggtgacagtcactgtcttaaaaatgaatattaatgcatttgagttcttgtcaacattttagtagttgctctagagattacaatatatacccatagtttttcccaggctagttaacattaataatgttccatgtcacataaaatatagcaactttgcaattgtataggtctatttacctctcctcatcctttctactatagttgtcatatggattacatatatatatatatatatatatatatatatatatatatatatatatatatatgttgtgcagctcataaaaactacagtttttcttcacagactgtgaaaatagttttatatatttaccatttctggtgttttccattccgtcctaaaggtccaaatttacttc

SEQ ID NO: 9919 - DNA, 265 bp, Homo sapiens
  AL023883.6_118540
  Located on chromosome 6
  Distance between a terminus base of telomere on chromosomal short arm and 5'-terminus of this base sequence : 23597679
  Distance between 3'-terminus of neighbour sequence of sequence listing upward to telomere on chrosomal short arm and 5'-terminus of this base sequence : 1291
tttaattggcaatcgatttaacaagattcaaacttcaaactccatttcatgtgtggcaattcaaaatttcagttcagctgtgctgtttggagtctgacacacacacacacacacacacacacacacacacactctctctctttctctctttagccagaaatttgcatagagtttatacatggaattttgggcccctcctcctttctgttttcttcccatctagaattcttctttcacttttcagtggctacaattgtccagaata

SEQ ID NO: 9920 - DNA, 127 bp, Homo sapiens
  Z67232
  Located on chromosome 6
  Distance between a terminus base of telomere on chromosomal short arm and 5'-terminus of this base sequence : 23651111
  Distance between 3'-terminus of neighbour sequence of sequence listing upward to telomere on chrosomal short arm and 5'-terminus of this base sequence : 53167
ggtttataagactgcttacattggaattcttgaatgtgatagtatttttaactgcactggccctaacacacacacacacgcgcacacacacacacacacacacacacgttcgcactgactctcactc

SEQ ID NO: 9921 - DNA, 371 bp, Homo sapiens
  chr6.fa.O7frz.24218909
  Located on chromosome 6
  Distance between a terminus base of telomere on chromosomal short arm and 5'-terminus of this base sequence : 23815954
  Distance between 3'-terminus of neighbour sequence of sequence listing upward to telomere on chrosomal short arm and 5'-terminus of this base sequence : 164716
gtgaggcacctaatagaactttaattttttataacctacatttggaaaattttgtgttccaccccacctcaaccaatacacacacacacacacacacacacacaaacacacacacacatattttctagaactacaatattctaaaatagtacccaggggatgccttagatattccatgaaatatgtccagccaattgctatataatattcccactgttctcctcttctcctgctcagtttctctccttgctgttagaatccagattctgcttgttgtcaaaacattgttgagttctctggagttgtcaaagtgctaagggcagttcatattcaggcagtagtttagagaatcactttggacagtacatagc

SEQ ID NO: 9922 - DNA, 330 bp, Homo sapiens
  AL033539.18_42198
  Located on chromosome 6
  Distance between a terminus base of telomere on chromosomal short arm and 5'-terminus of this base sequence : 23886337
  Distance between 3'-terminus of neighbour sequence of sequence listing upward to telomere on chrosomal short arm and 5'-terminus of this base sequence : 70012
ccattagttgaactcattgagaagcaagcttggttcatccagagtgaatctggaggaggaagcaaatgttgtccagcatagttgtgtatgtgtgtgtgtgtattcacactcacacacacacacacacacacacacacacaaagtcgaaagcagctcattccagtaactcccacttgagtcttcacccctgccagcgtaaggttaaatgctataacgtgattatttgggctcggaagacaaataactgaggtagttaactatatcaggacaaaaggtcagagcagtgattcatcatataattttcaacttcttaggcactgctaggatagc

SEQ ID NO: 9923 - DNA, 221 bp, Homo sapiens
  AL033539.18_44699
  Located on chromosome 6
  Distance between a terminus base of telomere on chromosomal short arm and 5'-terminus of this base sequence : 23888796
  Distance between 3'-terminus of neighbour sequence of sequence listing upward to telomere on chrosomal short arm and 5'-terminus of this base sequence : 2129
ctcagagcatacaaggtatcattaactatttttttatttgtttaatatattcttatggtttgtcttccctgtacattgtaatcagcttgaggacaaatacttgtttggtaatggccttgtgacacatagaggaacagctggaaaaaaatcatacacacacacacacacacacacacacacgatttctaaataaataactcttgaaagaatggtgcttgtac

SEQ ID NO: 9924 - DNA, 233 bp, Homo sapiens
  AL033539.18_47238
  Located on chromosome 6
  Distance between a terminus base of telomere on chromosomal short arm and 5'-terminus of this base sequence : 23891401
  Distance between 3'-terminus of neighbour sequence of sequence listing upward to telomere on chrosomal short arm and 5'-terminus of this base sequence : 2384
cagtactttgatcctgagtaccaggacaatagggaccaacaggagacggcaggtatttaagaaaaaagggatacacagacacacagacacacacacacacacacacacacacacacacagatatgctataagtaaacacatttcttcacagttttgcttagaactgggccttaagttcagtattgaaaaattggttagtaagttatgttgttaaccaatatcactgatccact

SEQ ID NO: 9925 - DNA, 363 bp, Homo sapiens
  chr6.fa.O7frz.24393212
  Located on chromosome 6
  Distance between a terminus base of telomere on chromosomal short arm and 5'-terminus of this base sequence : 23990253
  Distance between 3'-terminus of neighbour sequence of sequence listing upward to telomere on chrosomal short arm and 5'-terminus of this base sequence : 98619
ctatcctaggttcatggctaagatccctgtaataataataatttatatatataatatatattgatatgatagatataatattatatatatatatatatatacatcaagacagattaacaagagaaaaggagacagatttatttactataatatttacatatcctgggaatcttcataaggaaatgaaggcccaaagaaacagttaaacctgagtatatattatggcagtttgatggagagtagagagtgttggagaaatatgatagggtaaagtgtatggtttaatagtaacgtattaggagaagctttgaaaggcccctgcattcagtttcttctgtgtcgtcagttcatcttcagagatca

SEQ ID NO: 9926 - DNA, 347 bp, Homo sapiens
  AL031391.1_11078
  Located on chromosome 6
  Distance between a terminus base of telomere on chromosomal short arm and 5'-terminus of this base sequence : 24132649
  Distance between 3'-terminus of neighbour sequence of sequence listing upward to telomere on chrosomal short arm and 5'-terminus of this base sequence : 142033
ggattcattactatgaaaggacagaattcagaataatatagtataaagtttggaatcaggttccattagtcagcttcagtccttaccctgttctttttataacactttcaacttgacatcattgattctcatcctttctcactttccctccagagagtcaactccctcttccacgtttatttctccttacagcccattccttaaaaggcttaatccatatatatatatgtatacacacacacacacacacacacacacacacacacacacatatatatatacaaacatacatatgtatattgattgttgtgcaattaacaaacacatgaataaattaccactgtgaa

SEQ ID NO: 9927 - DNA, 339 bp, Homo sapiens
  AL031391.1_8079
  Located on chromosome 6
  Distance between a terminus base of telomere on chromosomal short arm and 5'-terminus of this base sequence : 24135776
  Distance between 3'-terminus of neighbour sequence of sequence listing upward to telomere on chrosomal short arm and 5'-terminus of this base sequence : 2780
cggaaatgtacattctgtaccttggaaaactgacccaaataacaaagaccaatatacagtccaggaaattattggactttaaagttttatgtgcatacatgtgtatacacacacacacacacacacacacacacacacacacatatacaggcacttagacaaaatgaagtctaagtcacttacaaaaaataaaaacaaaattatattgtcatcatgctttataccatatgtcaaaggagtaataaatttaagttactcaagaaaatgtgagctagaattttatctagtcaaaatgacctttgattctaaaagctatcaatgaaactttatgaatgttca

SEQ ID NO: 9928 - DNA, 313 bp, Homo sapiens
  AL031391.1_7726
  Located on chromosome 6
  Distance between a terminus base of telomere on chromosomal short arm and 5'-terminus of this base sequence : 24136093
  Distance between 3'-terminus of neighbour sequence of sequence listing upward to telomere on chrosomal short arm and 5'-terminus of this base sequence : -22
aatgaaactttatgaatgttcaagaactcaggcaatattgttccttgtgcttttctgtattagtcagggttctccaaagaaacagaactaactgaagaaagacatagatagatagattataaatagatagacaggtagatagatagatagatagatagatagatagatagatagatagacagacagatagatagatagatcttcatcatgagaaattggctcacaagattatgaaggctaggaagtctcacaatctgtgatctgcaaactggagaacaagaaaagctggtggtacaattctgtcagagtccaa

SEQ ID NO: 9929 - DNA, 260 bp, Homo sapiens
  AL035401.23_4647
  Located on chromosome 6
  Distance between a terminus base of telomere on chromosomal short arm and 5'-terminus of this base sequence : 24250136
  Distance between 3'-terminus of neighbour sequence of sequence listing upward to telomere on chrosomal short arm and 5'-terminus of this base sequence : 113730
agcactacaatgatggctaagtactgctccagagggcaccattcacatatatatatatgtgagaatttgaaagctcccgtatatatatacatatacatatatatatatatatatatatatacacacatatacatatatatatatatatacacatatacatatatatatatacggggattgtgcctctgagactgtgcaatccacaacccacttgggtttgagcagtggccctggggtaggaatctcatgattgtactgtc

SEQ ID NO: 9930 - DNA, 267 bp, Homo sapiens
  AL035401.23_25361
  Located on chromosome 6
  Distance between a terminus base of telomere on chromosomal short arm and 5'-terminus of this base sequence : 24270841
  Distance between 3'-terminus of neighbour sequence of sequence listing upward to telomere on chrosomal short arm and 5'-terminus of this base sequence : 20445
ggaacttagaggacaggtcaacaggtgcaacaaaccaccatggcacacatatacctatgtaacaaacctgcatgttctacacatgtatcccagaacttaaaaaaaacacacacacacacacacacacataggaggcttgccttatagatactgagatttattatgaattagagtatttaaggcagctcagtactggcacagtaacagacaaacccctagaactgcaaagagagtctccagaaccagagtcgtacatgtatgcacctt

SEQ ID NO: 9931 - DNA, 460 bp, Homo sapiens
  AL035401.23_76117
  Located on chromosome 6
  Distance between a terminus base of telomere on chromosomal short arm and 5'-terminus of this base sequence : 24321544
  Distance between 3'-terminus of neighbour sequence of sequence listing upward to telomere on chrosomal short arm and 5'-terminus of this base sequence : 50436
atttacatcaaacaagttgacaacttcctgaaactgaactttttcagcaatcattcttgaaagtggtgtttctttccatcagtggtttcatagactttccaaagcaacatgactttttttttctatatggtcatttatttcacacattatttacaaacgtatgtatgtatgtatgtatgtattaactcattcagcagaaaggtatccatcatccactgcgtgccaggtgctctggtaggtgctagggatataattttagacacgagagaaaggaaaatgatctctgacatcatgggatatacaagctgggaggaagtatgaacttcaaatgagtaattacaaatttcaattagagaacagaagttttatatacatataaagggaatttcttacagagatgcaaatttacccaagggtggaagccggttaagcagtctctgtaagacttatgttggagctt

SEQ ID NO: 9932 - DNA, 341 bp, Homo sapiens
  AL035401.23_84261
  Located on chromosome 6
  Distance between a terminus base of telomere on chromosomal short arm and 5'-terminus of this base sequence : 24329588
  Distance between 3'-terminus of neighbour sequence of sequence listing upward to telomere on chrosomal short arm and 5'-terminus of this base sequence : 7584
atcactttagaggcagtgacagacagatgcagttccagattgtccagatttattatagttttctttggtcttcccctgtcttcctcacttcacattcatttctcattaccagtcttgcctggagctggatgctcaagcaacagatttatataaattctctgagcatctcctatgactgtgtaaaatctaatctctaatatacatccttgattctagatgatgcataatgggttttcttccttgatcaaatcctgattctgtgtgtgtgtgtgtgtgtgtgtgtgtgtgtgtgtgtgtgtgtgtggtttcctcgctctgttcactgagtacctagaagcaat

SEQ ID NO: 9933 - DNA, 211 bp, Homo sapiens
  D6S1660
  Located on chromosome 6
  Distance between a terminus base of telomere on chromosomal short arm and 5'-terminus of this base sequence : 24600033
  Distance between 3'-terminus of neighbour sequence of sequence listing upward to telomere on chrosomal short arm and 5'-terminus of this base sequence : 270104
gagtcttgagtaactcccacgcataaaataattttcaattatttatgcccccgcccctactcccatccttttgcctctctgtgcacacatgcacacacacacacacacacacacacacacacacacttctgactttcaaaagaagggctcaatcccaatgttttcattatttataaagttgtcccatttgaagtgggggatactcattgtc

SEQ ID NO: 9934 - DNA, 321 bp, Homo sapiens
  AL031347.1_151313
  Located on chromosome 6
  Distance between a terminus base of telomere on chromosomal short arm and 5'-terminus of this base sequence : 24736100
  Distance between 3'-terminus of neighbour sequence of sequence listing upward to telomere on chrosomal short arm and 5'-terminus of this base sequence : 135856
tatggcagttggttagatttagtgaatgataagcttttagataaaaaatgggaaactaagtaagataggcagcatttgatttcatttagctgctgtctctgtcttagcatgtcatcaagaaacacaaattaatacagattgaatgtagcaaaattgaaagactagaagacgaatattgtactttttcttgagccccacaaattgccttggggtgtgtgtgtgtgtgtgtgtgtgtgtgtgtgtgtgtgtaaacttgcctggattttccctggtctggttaatttaatctgggatactctcaaatcctagttggtaaatctg

SEQ ID NO: 9935 - DNA, 273 bp, Homo sapiens
  AL031347.1_87621
  Located on chromosome 6
  Distance between a terminus base of telomere on chromosomal short arm and 5'-terminus of this base sequence : 24799844
  Distance between 3'-terminus of neighbour sequence of sequence listing upward to telomere on chrosomal short arm and 5'-terminus of this base sequence : 63423
tgactcctaccactgttcctaggactactactactagtactacaaccactatgtagttagtgctatgtctaaaaagggtgcttaataagtcatagatagatagtaggtaggtagatagatgaatagatggatagatagatagatatcacactcacgtgtgtgtgtgtgtgtgtgtgtgtgtgtgtgtgtgtgtgtgtatgtataacaaacttaatatgtttcatttccactttggaagtgattacatttcttaatagatgccttactaaggca

SEQ ID NO: 9936 - DNA, 260 bp, Homo sapiens
  D6S461
  Located on chromosome 6
  Distance between a terminus base of telomere on chromosomal short arm and 5'-terminus of this base sequence : 24867779
  Distance between 3'-terminus of neighbour sequence of sequence listing upward to telomere on chrosomal short arm and 5'-terminus of this base sequence : 67662
tatgacttctggacagttaggggatggggtctctctccctgtctcatacacacacacacacacacacacacacgtatatatacacacatatatatacatatatatacatatatacacatatacacacatatacatacacacacatacacacacacacacacacacgtatatatacacacacacacacacacacacactctagagaaacataactttttgttactttgcagtagacaccctaaagtgggctgatgggttgt

SEQ ID NO: 9937 - DNA, 411 bp, Homo sapiens
  chr6.fa.O7frz.25320363
  Located on chromosome 6
  Distance between a terminus base of telomere on chromosomal short arm and 5'-terminus of this base sequence : 25038460
  Distance between 3'-terminus of neighbour sequence of sequence listing upward to telomere on chrosomal short arm and 5'-terminus of this base sequence : 170421
gagttctaataaatggcctcagttagtagagaaacaattctagagaaagcagcacaacaggtaaaaggccacctgtaagtcacaatggaaaccaaacagaattgttctaaaaaaaaaaacacacacacacacacacacacacacacaattttgccaaacatttttcactagcattttataaatgttgagattacaactaaaaattggtcaatctttggagatatttgcaaatcttttcaatgttgtcttagataatatatgcaataagtttgctcaaaagtatttcttcaagttctatttaaattgtcagtgaaataaacgataggaagtccctgctcagctgtgttgattttttaagtgctaaattaaaactctactatcatttttgccttatgcttattgaggtcatga

SEQ ID NO: 9938 - DNA, 239 bp, Homo sapiens
  Z67156
  Located on chromosome 6
  Distance between a terminus base of telomere on chromosomal short arm and 5'-terminus of this base sequence : 25210676
  Distance between 3'-terminus of neighbour sequence of sequence listing upward to telomere on chrosomal short arm and 5'-terminus of this base sequence : 171805
gggcagaggacagaattttgcctctagaaggtctgaagtaggtttattgtgcactgatgatcacttcagcccactgcatcttgggctgcacttttatgacttgtccgagtctggtaagacagaacattcacacatacacacacacacacacacacacacacacacacacacacacacacacacagacacacacacacacgttatataaactaggtttattacttatacaggagcagcaa

SEQ ID NO: 9939 - DNA, 231 bp, Homo sapiens
  D6S1691
  Located on chromosome 6
  Distance between a terminus base of telomere on chromosomal short arm and 5'-terminus of this base sequence : 25210682
  Distance between 3'-terminus of neighbour sequence of sequence listing upward to telomere on chrosomal short arm and 5'-terminus of this base sequence : -233
aggacagaattttgcctctagaaggtctgaagtaggtttattgtgcactgatgatcacttcagcccactgcatcttgggctgcacttttatgacttgtccgagtctggtaagacagaacattcacacatacacacacacacacacacacacacacacacacacacacacacacacacagacacacacacacacgttatataaactaggtttattacttatacaggagcagc

SEQ ID NO: 9940 - DNA, 228 bp, Homo sapiens
  AL032822.1_76981
  Located on chromosome 6
  Distance between a terminus base of telomere on chromosomal short arm and 5'-terminus of this base sequence : 25210783
  Distance between 3'-terminus of neighbour sequence of sequence listing upward to telomere on chrosomal short arm and 5'-terminus of this base sequence : -130
agtctggtaagacagaacattcacacatacacacacacacacacacacacacacacacacacacacacacacacacagacacacacacacacgttatataaactaggtttattacttatacaggagcagcaagggacagcagaagtctaggattcagggaaagcgggtcccccaaggctgaagaaagcttcctacttatactgtgcctcacttatactgcagctgagg

SEQ ID NO: 9941 - DNA, 224 bp, Homo sapiens
  D6S299
  Located on chromosome 6
  Distance between a terminus base of telomere on chromosomal short arm and 5'-terminus of this base sequence : 25211520
  Distance between 3'-terminus of neighbour sequence of sequence listing upward to telomere on chrosomal short arm and 5'-terminus of this base sequence : 509
aggtcattgtgccaggtgactctccagggcaacagttctccatgcagtaactcagatctaggataatctatatgttatcatatataatacacacacacacacacacacacacacacacagacacacacacagacacacacagacacagacacacagacacacagacacacacacagactcagagggagggagagaagagagacattcaggagtatacatagaaa

SEQ ID NO: 9942 - DNA, 297 bp, Homo sapiens
  chr6.fa.O7frz.25563844
  Located on chromosome 6
  Distance between a terminus base of telomere on chromosomal short arm and 5'-terminus of this base sequence : 25281889
  Distance between 3'-terminus of neighbour sequence of sequence listing upward to telomere on chrosomal short arm and 5'-terminus of this base sequence : 70145
aaagtataactaccatttgatccagcaatcccagtactgggtatctacccagaggaaaagaagtcattatataaagatgacactgcacatgcatgtttatagcagcacaatttgcaatatatatttgcaaaatatatattgcaaatatatatattacatatatattgcatgtatacacacacacacacacacacacacacacaccatggaatactactcagccataaaaacgaatgaaataatggcatttacagcaacctggatggaactggagacaatcgttctaagtgaagtaaa

SEQ ID NO: 9943 - DNA, 460 bp, Homo sapiens
  chr6.fa.O7frz.25652438
  Located on chromosome 6
  Distance between a terminus base of telomere on chromosomal short arm and 5'-terminus of this base sequence : 25363495
  Distance between 3'-terminus of neighbour sequence of sequence listing upward to telomere on chrosomal short arm and 5'-terminus of this base sequence : 81309
ctctagagtgcagtttaagtcaagtgtttctttgttgactttctgcctcggtaatctgtcaagtactttcagaggagttgaagtcccccactattattgtgttactgtttatctttttacttaggtctagtagcaattgtttatgaatctgggagctccagagttagggttaaatatttaggattgtagtatcttcttattggattaatccatttattattatataattaccatctttgcctttttcaactattgttgctttaaagtctgtgttatccaatataagaatagctactgctgctcacttttggaaactgccaacaaaggaatattcccaaacagtcaaagcaaattagccatcatttgctcagatacatacacacacacacacacacacacacacaaaaaccctaagaacctaacaaaattttcaacttttcactggcctaattcatactta

SEQ ID NO: 9944 - DNA, 220 bp, Homo sapiens
  D6S276
  Located on chromosome 6
  Distance between a terminus base of telomere on chromosomal short arm and 5'-terminus of this base sequence : 25472000
  Distance between 3'-terminus of neighbour sequence of sequence listing upward to telomere on chrosomal short arm and 5'-terminus of this base sequence : 108045
tcaatcaaatcatccccagaaggaacaccgggttttacacccatccatacacatacacacacacacacacacacacacacacacacacacacatatacacacagataaaatctataccatggtgacagtctgcaaagaaggaaaagggcactccctctatgtaactattctttaggataaaaaagaaatacaagaggcaaaggaggaacaagttgcaccc

SEQ ID NO: 9945 - DNA, 214 bp, Homo sapiens
  chr6.fa.O7frz.19423549
  Located on chromosome 6
  Distance between a terminus base of telomere on chromosomal short arm and 5'-terminus of this base sequence : 25559323
  Distance between 3'-terminus of neighbour sequence of sequence listing upward to telomere on chrosomal short arm and 5'-terminus of this base sequence : 87103
taagtgtccatcaatggataactggaaaaagaaaatgtgtgtataaagacatacacacacacacacacacacacactttgtgggtatgtgtatatagatgtagatatacacatacatataaacacacacagtaaaatactattcagtcataaaaatgaaatcatgtcttttgcagcaatgtggatgggactggaggccattatcctaacaaata

SEQ ID NO: 9946 - DNA, 207 bp, Homo sapiens
  chr6.fa.O7frz.25963115
  Located on chromosome 6
  Distance between a terminus base of telomere on chromosomal short arm and 5'-terminus of this base sequence : 25682036
  Distance between 3'-terminus of neighbour sequence of sequence listing upward to telomere on chrosomal short arm and 5'-terminus of this base sequence : 122499
ggtaaggcaaagtaagatgaaccagaagctttcattggaagaaggcatcatgccctccaggcagggcagattattttattttttttattttgtttttttattttattttattttattttattttattttatttattttatattatgttgtttttgagacagagtttcgctcttgtcgcccaggctggagtacaatggcacgatcttg

SEQ ID NO: 9947 - DNA, 345 bp, Homo sapiens
  AL031230_44301
  Located on chromosome 6
  Distance between a terminus base of telomere on chromosomal short arm and 5'-terminus of this base sequence : 25786836
  Distance between 3'-terminus of neighbour sequence of sequence listing upward to telomere on chrosomal short arm and 5'-terminus of this base sequence : 104593
tcagattcatagagacagaaagtagaatggtccaggcatggtggctcatgattgtaatctcagcactttgggaggccaaggcaggaggatcgcttaaagccaggagtctgaggttgcagtgagctatgattgcgccactgcactccagcctgggcatcagatcaagaccgtatctaaaataataataataataataataataataataataacgtagggaactatatacctttgtatggtaaaattaaagttgttcttatttaccataagcaataatagctgtttccacaaaacttattttatcttttataatttatgacgcagtatacctctttagatgcaact

SEQ ID NO: 9948 - DNA, 212 bp, Homo sapiens
  AL031230.1_66132
  Located on chromosome 6
  Distance between a terminus base of telomere on chromosomal short arm and 5'-terminus of this base sequence : 25808684
  Distance between 3'-terminus of neighbour sequence of sequence listing upward to telomere on chrosomal short arm and 5'-terminus of this base sequence : 21503
actataagttggtgttggaccacattcctcttagcctctgctgttgctgcagcatcacagtctcctaggagaattgcactctttccccaccccccagggaaacaaaataaaagccatttgaaaaaaacatggattgggtggcttttttttcttttctttcgtgtgtgtgtgtgtgtgtgtgtgtgtacaggtgcttattgccaactaatcac

SEQ ID NO: 9949 - DNA, 320 bp, Homo sapiens
  AL031230.1_96948
  Located on chromosome 6
  Distance between a terminus base of telomere on chromosomal short arm and 5'-terminus of this base sequence : 25839607
  Distance between 3'-terminus of neighbour sequence of sequence listing upward to telomere on chrosomal short arm and 5'-terminus of this base sequence : 30711
acctgtaaggccacttaggtacttgtgagatagatatatatatatatatatatacacacacacacacacacacacacacacacacacacacacacgcacatatatatatatatatatctgtatgtatgttttcatcacagttcctggctaataactcccacggcccttgttataatgctggggcactttaggcctcagaaaacagaatctccctctctctctctgaccttctcctgccttctttcacctgctttttattctccccaaagcaagaaacttcccctgcctttctgtctcggagctggctagaaagacattct

SEQ ID NO: 9950 - DNA, 266 bp, Homo sapiens
  AL031230.1_102019
  Located on chromosome 6
  Distance between a terminus base of telomere on chromosomal short arm and 5'-terminus of this base sequence : 25844597
  Distance between 3'-terminus of neighbour sequence of sequence listing upward to telomere on chrosomal short arm and 5'-terminus of this base sequence : 4670
tactaagccatgatggctaaggccatctctactaaaaataccaaaaaaaaagaaaagaaaaaaggagttattaaaaattaagttactccatattataattgagaaagtcaattgtagatggatatatatatatctagatagatagatagatagatagatagatagatagatagatatctgaaacaaattaaattttactgcccaaacattatcatttcccttgtaactctcatttccctggagtctactgaaataaccacttcaac

SEQ ID NO: 9951 - DNA, 176 bp, Homo sapiens
  chr6.fa.O7frz.26399935
  Located on chromosome 6
  Distance between a terminus base of telomere on chromosomal short arm and 5'-terminus of this base sequence : 26032389
  Distance between 3'-terminus of neighbour sequence of sequence listing upward to telomere on chrosomal short arm and 5'-terminus of this base sequence : 187526
cataatggacagagattctttagtttgtttgtttgtttgtttacagagaagatataagatccttaatgagctctacaaaaatattttggtgttttttgtttgtttgtttgtttgtttttttgacacaaggctcgttctgttgcccaggctgaagtgtagtagcatgatccaagctc

SEQ ID NO: 9952 - DNA, 166 bp, Homo sapiens
  D6S1554
  Located on chromosome 6
  Distance between a terminus base of telomere on chromosomal short arm and 5'-terminus of this base sequence : 26129989
  Distance between 3'-terminus of neighbour sequence of sequence listing upward to telomere on chrosomal short arm and 5'-terminus of this base sequence : 97424
ccagacagaatataaggcaattacaatgaaaaaacccagaactttcagaatgttagcattttatttgttgatgccgtgtgtgtgtgtgtgtgtgtgtgtgtgtgtgtgtgtgtgtgtgtgtatctggcaaaagaaaacagaccatcaaggactgtttctattgttg

SEQ ID NO: 9953 - DNA, 322 bp, Homo sapiens
  AL078584.17_59942
  Located on chromosome 6
  Distance between a terminus base of telomere on chromosomal short arm and 5'-terminus of this base sequence : 26199339
  Distance between 3'-terminus of neighbour sequence of sequence listing upward to telomere on chrosomal short arm and 5'-terminus of this base sequence : 69184
aagatgaacaagtaacttcctgatgatcacaaagatgaagctagtgttgaaagtcagatgtgattccaaatcaagtgctctttttactacagcacattccactcccacccccaacttaccctattgggctgaggggtatcttgctgaggtttgggcatgactgtgggcatgacttgagtgtgtgtgtgtgtgtgtgtgtgtgtgtatgtgcacatacagagcagagaccagaaagaagcatggagtggctccccaagctgctgcctttagagattccatgaggttgccccactcaccgctgtggatttaggactgaagctct

SEQ ID NO: 9954 - DNA, 162 bp, Homo sapiens
  D6S1571
  Located on chromosome 6
  Distance between a terminus base of telomere on chromosomal short arm and 5'-terminus of this base sequence : 26250415
  Distance between 3'-terminus of neighbour sequence of sequence listing upward to telomere on chrosomal short arm and 5'-terminus of this base sequence : 50754
tggctctaatggttactttttacataactttagtgcagtatcaaaaccaggaaattgacattggtgcagtatcaaaacaaggaaattgacattggctctgtgtgtgtgtgtgtgtgtgtgtgtgtgtgtgtttctttgccatttcaccagatgcgtaggtcc

SEQ ID NO: 9955 - DNA, 257 bp, Homo sapiens
  chr6.fa.O7frz.31395517
  Located on chromosome 6
  Distance between a terminus base of telomere on chromosomal short arm and 5'-terminus of this base sequence : 26423404
  Distance between 3'-terminus of neighbour sequence of sequence listing upward to telomere on chrosomal short arm and 5'-terminus of this base sequence : 172827
agttctaggaaatggtcagaagagtcactgttcagggcaggaacagtcggggccctgctatttttgtttagtaatcacaactagcctcccgggaaaattctatctgctgtccagcaggctttggaaaagagccctcctatacacacatgcacacacacaggagcatgcacacacacacacacacacacacttatgggagagagaggaaggagacccataggaggcttgggtctttgaataccaaaccaggtaaatgt

SEQ ID NO: 9956 - DNA, 337 bp, Homo sapiens
  AL024509.1_28976
  Located on chromosome 6
  Distance between a terminus base of telomere on chromosomal short arm and 5'-terminus of this base sequence : 26551737
  Distance between 3'-terminus of neighbour sequence of sequence listing upward to telomere on chrosomal short arm and 5'-terminus of this base sequence : 128076
gaaacagagctccatctcaagaaaaaaagaaggaaggaaggaaggaaggaaggaaggaaggaaggagagagagagagagagagagagagagagagagagaaagaaagaaagaaagaaagaaagaaagaaagaaagaaagaaaagaaagaaaggaaagaaagaaagaaagaaagaaagaaagaaagaaagaaagaaagaaagaaagaaagaaagaaagaaagaccatcactgctttgtgtggagacagcttctgtgttctttcaggacaacttgagaagttttaccaacaaaaactctcctgggatctccatttgttcattccataaatattgagtgc

SEQ ID NO: 9957 - DNA, 154 bp, Homo sapiens
  AL024509.1_31430
  Located on chromosome 6
  Distance between a terminus base of telomere on chromosomal short arm and 5'-terminus of this base sequence : 26554153
  Distance between 3'-terminus of neighbour sequence of sequence listing upward to telomere on chrosomal short arm and 5'-terminus of this base sequence : 2079
aacaaccatggcacttgtatacctatgtaacaaatctgcacgttctgcacatgtatcccagtacttaaagttaaataaataaataaataaataaataaataaagagagagagagagagagagagagagagagagactagccaggtgcagtgagt

SEQ ID NO: 9958 - DNA, 189 bp, Homo sapiens
  G08569
  Located on chromosome 6
  Distance between a terminus base of telomere on chromosomal short arm and 5'-terminus of this base sequence : 26583164
  Distance between 3'-terminus of neighbour sequence of sequence listing upward to telomere on chrosomal short arm and 5'-terminus of this base sequence : 28857
agaagcagctgtgctttgttttttgctaagtcttgggcagttcagtttggcacttagagtattccagctccttttcttataagaatatctatctttatctatctatctatctatctatctatctatctatctatctttaactaactaactaactaactaactaactaaagcattttaaaacgtggcatc

SEQ ID NO: 9959 - DNA, 102 bp, Homo sapiens
  DISD22_0011489
  Located on chromosome 6
  Distance between a terminus base of telomere on chromosomal short arm and 5'-terminus of this base sequence : 26897565
  Distance between 3'-terminus of neighbour sequence of sequence listing upward to telomere on chrosomal short arm and 5'-terminus of this base sequence : 314212
ttggttcgggtaacactggactattttatttatttatttatttatttatttatttatttatttatttatttttactgtagcggggagaaggcaagaaaccat

SEQ ID NO: 9960 - DNA, 102 bp, Homo sapiens
  DISD22_0011501
  Located on chromosome 6
  Distance between a terminus base of telomere on chromosomal short arm and 5'-terminus of this base sequence : 27538558
  Distance between 3'-terminus of neighbour sequence of sequence listing upward to telomere on chrosomal short arm and 5'-terminus of this base sequence : 640891
tcatctcacactgacatcagtgccactggagcttttctcaccagggctgcttgtgtgtcctccctccctccctccctccccccacaccaactctcctgcaca

SEQ ID NO: 9961 - DNA, 461 bp, Homo sapiens
  AC026010.3_134784
  Located on chromosome 6
  Distance between a terminus base of telomere on chromosomal short arm and 5'-terminus of this base sequence : 27703202
  Distance between 3'-terminus of neighbour sequence of sequence listing upward to telomere on chrosomal short arm and 5'-terminus of this base sequence : 164542
agaatactctggagctatggagaaggtagatctggacatggaggtaattttgcatgtttttcagtagaatagcattacaaagcaatctttcctcatattattattattattattattattattattattattttgagacgaagtctcactctgtcacccaggctggagtgcagtggcacgatttcggctcactgcaagctctgtctcccaggtttacaccattctcctgcctcagcctcttgagtagctgggactacaggcgcccgccatcacccctggctaattttgtttttgtatttttagtagagatggggtttcactgtgttagcgaggatggtcttgatctcctgacctcgtgatccgcctgcttctgcctcccaaagtgctgggattacagtcgtgagccaccgcgcctggcctcctcatattattttttattgtgcagtttattcaagtgagtt

SEQ ID NO: 9962 - DNA, 133 bp, Homo sapiens
  D6S1666
  Located on chromosome 6
  Distance between a terminus base of telomere on chromosomal short arm and 5'-terminus of this base sequence : 27717395
  Distance between 3'-terminus of neighbour sequence of sequence listing upward to telomere on chrosomal short arm and 5'-terminus of this base sequence : 13732
acccagcattttggagttgtgtgcatttgtgtgtgtgtgtgtgtgtgtgtgtgtgtgtctgtaatataaggggtatactgaatggcataatgaccagagtcatgcagaaatctacaaatgctgcccaactcag

SEQ ID NO: 9963 - DNA, 222 bp, Homo sapiens
  DISD22_0011514
  Located on chromosome 6
  Distance between a terminus base of telomere on chromosomal short arm and 5'-terminus of this base sequence : 28022952
  Distance between 3'-terminus of neighbour sequence of sequence listing upward to telomere on chrosomal short arm and 5'-terminus of this base sequence : 305424
aaccaatcctttctctgagcccccgaggagcccctccagcgcctcatagattgtgtgtgtgtgtgtgtgtgtgtgtgtgtgtgtgtgtgtgtgtgtgtgtgtgtcagggccctgctggtgcttttatggaagctatatttttatgactaccctccccaaactgtgcaccccttgagatggggccctgccccaccatctttgcgtccgttggtcttaccctgt

SEQ ID NO: 9964 - DNA, 408 bp, Homo sapiens
  chr6.fa.O7frz.42794562
  Located on chromosome 6
  Distance between a terminus base of telomere on chromosomal short arm and 5'-terminus of this base sequence : 28130689
  Distance between 3'-terminus of neighbour sequence of sequence listing upward to telomere on chrosomal short arm and 5'-terminus of this base sequence : 107515
tctttgtagtgcttacaaggatgttccatgaaatcttttttgcactttttttattttaccttgatgaactttgtggcttttccaaagtcttacatcagcaattttattttacttttaaaagatggtagacaatcccctcaccagctcctagatagaagacattctctctctctccctcacacacacacacacacacacacacacacacacacgcacagacacgatggcccttttctttgttagttagacatgcagcgtttttgttcatgtgtctgcctggttgttctgatctgagggatacattttcttagtcttctaataaggtattttataacagtctccaggcttcctgtagcctttatatgttctaagctactcctttttatattcatctatccagcaatactc

SEQ ID NO: 9965 - DNA, 259 bp, Homo sapiens
  AL096712.20_62634
  Located on chromosome 6
  Distance between a terminus base of telomere on chromosomal short arm and 5'-terminus of this base sequence : 28307275
  Distance between 3'-terminus of neighbour sequence of sequence listing upward to telomere on chrosomal short arm and 5'-terminus of this base sequence : 176178
cataatttggctgcttgtttacttttcggagtccttagttacattttgtccagaatttttagttgtgatcagtggcagagactgcagtgccttactccattttgtctggtactggaagcctcccaacttctttctgaccacggcctatgaaaaaacacattttacattgagactcagtacacacacacacacacacacacacacacaatatttcacaaacaatgcttacccttactgtgtgtgatggcctcttacgcta

SEQ ID NO: 9966 - DNA, 107 bp, Homo sapiens
  Z67398
  Located on chromosome 6
  Distance between a terminus base of telomere on chromosomal short arm and 5'-terminus of this base sequence : 28307407
  Distance between 3'-terminus of neighbour sequence of sequence listing upward to telomere on chrosomal short arm and 5'-terminus of this base sequence : -127
tctgaccacggcctatgaaaaaacacattttacattgagactcagtacacacacacacacacacacacacacacaatatttcacaaacaatgcttacccttactgtg

SEQ ID NO: 9967 - DNA, 176 bp, Homo sapiens
  chr6.fa.O7frz.43093585
  Located on chromosome 6
  Distance between a terminus base of telomere on chromosomal short arm and 5'-terminus of this base sequence : 28395331
  Distance between 3'-terminus of neighbour sequence of sequence listing upward to telomere on chrosomal short arm and 5'-terminus of this base sequence : 87817
tctgatgtaagatccatagtcattctaattgtttttcccctaaatgtgatacatagttttgtcaacctaagcaacagagacagagagagagagagagagagagagagagagagagagagagagagagagagagaaactctctaaaaaagacgctgtgtttattcaggaataagcat

SEQ ID NO: 9968 - DNA, 199 bp, Homo sapiens
  D6S1602
  Located on chromosome 6
  Distance between a terminus base of telomere on chromosomal short arm and 5'-terminus of this base sequence : 28432222
  Distance between 3'-terminus of neighbour sequence of sequence listing upward to telomere on chrosomal short arm and 5'-terminus of this base sequence : 36715
acctgagtgggaaattctggatcatagaggagatgtatgtttattttaaaataccacatagttttctaaaacgctgtgtgtgtgtgtgtgtgtgtgtgtgtgtgtgtgtgtacagacaaacaataaaacaatgtatatgtatatagtatacatataatatgtatattatggccgggcgcggtggctcacgcctgtaatc

SEQ ID NO: 9969 - DNA, 247 bp, Homo sapiens
  D6S1548
  Located on chromosome 6
  Distance between a terminus base of telomere on chromosomal short arm and 5'-terminus of this base sequence : 28543774
  Distance between 3'-terminus of neighbour sequence of sequence listing upward to telomere on chrosomal short arm and 5'-terminus of this base sequence : 111353
attcatgtgtgtgcctgtgcgtgtgtgtacatgtgcgcatgtgtgttcgtgtgtgtgcacatttatggacatgtatgtgtgtgtgcatgtgtgtgcatgttcaagtgtgtgtgtgtgtgtgtgtgtgtgtgtgttttgcttccacccttcctcccagtcttattcatcctaagcctcatcctattgccctctgggagatgtcctgatggcctcagaatgcccctcctttatgtcctcagcactccct

SEQ ID NO: 9970 - DNA, 314 bp, Homo sapiens
  AL353173.3_2957
  Located on chromosome 6
  Distance between a terminus base of telomere on chromosomal short arm and 5'-terminus of this base sequence : 28662017
  Distance between 3'-terminus of neighbour sequence of sequence listing upward to telomere on chrosomal short arm and 5'-terminus of this base sequence : 117996
tgtatctggccaaagattctagcatcacaaggaactcagcgacctcctgtcatcctcctcctcctcctcctaaatcttctgccttcatccacctcaataaagactttttacccagcaatttccctgaagccccaacactgcctgaagccaagctctcaaaggaaaagtggcatgtcacccaagggcccagggtcggccccagcacacccagcccactttgattggctctgagtgagagcaaatgggacctaggcacaggcgggaggggagaaaacacagagagaaaagggtatagataagcctatggctgaatc

SEQ ID NO: 9971 - DNA, 228 bp, Homo sapiens
  AL049553.20_125126
  Located on chromosome 6
  Distance between a terminus base of telomere on chromosomal short arm and 5'-terminus of this base sequence : 28668422
  Distance between 3'-terminus of neighbour sequence of sequence listing upward to telomere on chrosomal short arm and 5'-terminus of this base sequence : 6091
gctagactgctagacctgacatgggccatagggcacaggatgagcctgaggtcaggctatctggaggcttggtggtcagcacccagctgccaagtcttcggttccactcaagatcattctaggtcacttcccactagaaaaaaaaatatatatatatatatgtgtgtgtgtatatatatatatatatatatatatatatatatatatatttgcctcaaagaaaaccta

SEQ ID NO: 9972 - DNA, 241 bp, Homo sapiens
  AL121574.19_51202
  Located on chromosome 6
  Distance between a terminus base of telomere on chromosomal short arm and 5'-terminus of this base sequence : 28832024
  Distance between 3'-terminus of neighbour sequence of sequence listing upward to telomere on chrosomal short arm and 5'-terminus of this base sequence : 163374
tttgtatgaagaccaattcaagaaaaaaatatatgtatgtgtgtgggtgtatatgtgtgtatatatgtatatatgtgtgtatgttcatatgtttatgtatgtttatatatgtggttatacacacacacacacacacacacacacacacacatgcacacatacacgcacactctcactctatatttattctttggtattcctgggggattgattccagaacctcctgtagataccaaatccg

SEQ ID NO: 9973 - DNA, 472 bp, Homo sapiens
  chr6.fa.O7frz.43720965
  Located on chromosome 6
  Distance between a terminus base of telomere on chromosomal short arm and 5'-terminus of this base sequence : 28981664
  Distance between 3'-terminus of neighbour sequence of sequence listing upward to telomere on chrosomal short arm and 5'-terminus of this base sequence : 149399
agataaatcactaattggtgaaatagtagagatttttgtttgtaattttactttattattattattattatttttttttttttgagatggagtttcactcttgtcgcctaggctggagtgccgtggcgcgatcttggctcactgcaacctccacctccctggtttaagcgattctcccgcctcagcctcccgagtagctgggattacaggcacctgccaccatgcccagctaatttttgtatttttagtagagacggggttttgtcatatgagtcaggctggtcttgaactcctgacctcaggtgatctacccgcctcagcctcccaaagtgctgggattacaggcgtgagccaccatggccagccctagatttttgtttttaatttttaaaaatattggagtgcacagagtatatctggcttcaatcatctcttttcattcatgttgctgtttgactgaaatcctctttct

SEQ ID NO: 9974 - DNA, 256 bp, Homo sapiens
  AL033518.14_97821
  Located on chromosome 6
  Distance between a terminus base of telomere on chromosomal short arm and 5'-terminus of this base sequence : 29138802
  Distance between 3'-terminus of neighbour sequence of sequence listing upward to telomere on chrosomal short arm and 5'-terminus of this base sequence : 156666
aatgtatttgtcaggaatcgacacttcatttaataggatttaaaaagtgacaatttaaagagcaattgagaagagtcccacatccatcatggcttgtgcttctaactaaaatcaaaggaatgaaagcagaaaaagcactgagaaaatggtaaaacgggtgtgtgtgtgtgtgtgtgtgtgtgtgtgtgtgtgtgtgtgtgtgtgtgagagggagagacggtgggggcggggggtggttcatagctgcttcaagtcc

SEQ ID NO: 9975 - DNA, 424 bp, Homo sapiens
  chr6.fa.O7frz.44089248
  Located on chromosome 6
  Distance between a terminus base of telomere on chromosomal short arm and 5'-terminus of this base sequence : 29295626
  Distance between 3'-terminus of neighbour sequence of sequence listing upward to telomere on chrosomal short arm and 5'-terminus of this base sequence : 156568
tacgcactattatggactgaactgtgtcctcccagaattcatatactgaagcttcacccctaacttagaatgttactgtattaggagacaggggctttaaagaggaaattaagggtagggcactaatccaatatgactgatgtccttataagaagaggaagaaacaccacaggccactcagacagaggaagggctatgtgagggtatagcgagaaggtggccatttacatgccaaggagagagaccttagaagaaaccaaacctggcaataccttgatcttgatcttggactttcagcctccagaactgtgaaaaaaatatatttcggccatttaagccaccgtgtgtgtgtgtgtgtgtgtgtgtgtgtgtgtgtgtgtgtgtgtgtgttttatggctgtcctagcaaattcatacatgcaat

SEQ ID NO: 9976 - DNA, 447 bp, Homo sapiens
  AL031905.7_93723
  Located on chromosome 6
  Distance between a terminus base of telomere on chromosomal short arm and 5'-terminus of this base sequence : 29384958
  Distance between 3'-terminus of neighbour sequence of sequence listing upward to telomere on chrosomal short arm and 5'-terminus of this base sequence : 88908
cttgagtctgcgactttgatactagcctgggcagcatagcaaaaccacgtctctacaaaaaatacaaaaataagctgggcatggtggcacgtgcctatagtcccagctacttgggggctgaggtgggaggatcactggagcctgggaggttgaggctgcagtgagccctgattgcgccactgcattccagcctaggtgacagagcaacaccctgtctcgaggagagagagagagagagagagagagaaaaaaaatattgacacataactggtatttttcaaataaataagtatatgaatattagttttagttgactttcattttcccataatatgaagcagtctttgttttggatagccaatcatcacagctaactttttcccaaaggggaagattttttaaaaggcacaccttttaaaagtcattcatttatcagctttctaccat

SEQ ID NO: 9977 - DNA, 314 bp, Homo sapiens
  chr6.fa.O7frz.44289159
  Located on chromosome 6
  Distance between a terminus base of telomere on chromosomal short arm and 5'-terminus of this base sequence : 29553132
  Distance between 3'-terminus of neighbour sequence of sequence listing upward to telomere on chrosomal short arm and 5'-terminus of this base sequence : 167727
cagccactcatttatcacttagcaaaacaaaagtctagattcaggcactgtgctactaggtaggtgcttgaaaaacaaaggcaaaacaacataattacattgttcaaaaagctcaacctagtataagaatctaagcaaacaaaccaagaaatataatatcacagttgcaagctccctcagtctgaggaaactatagggataggtacagggtaaacaggacagaccacacacacacacacacacacacacacacacacacacacacgcatatttatgtgttaaccaataatgtaacttagcagtcctatgaacag

SEQ ID NO: 9978 - DNA, 411 bp, Homo sapiens
  chr6.fa.O7frz.44408792
  Located on chromosome 6
  Distance between a terminus base of telomere on chromosomal short arm and 5'-terminus of this base sequence : 29672587
  Distance between 3'-terminus of neighbour sequence of sequence listing upward to telomere on chrosomal short arm and 5'-terminus of this base sequence : 119141
tgagcttctcagactatgtgagatataaagcatgtaaatgaataggaagactcaatatcataaaatatcaattcatttactaattaatctgttcatgtaatgaaattccaataaaaatcccaacagagtcctttctttctttctttctttctttctttctttctttctttctttctttctttctttctttcttctttctttatttgtttctttctttatttctttctttctttcttctttctttcttttctttcttctttctttctttcaagatagggtctcactctgttgcccagtgtggagtgcagtggtgctgtctcagctcactgcagcctcaacctctcaggctccagcaatccacccacccacccacctcagcctcacaaatagctaagactataggcatgcacc

SEQ ID NO: 9979 - DNA, 274 bp, Homo sapiens
  AL035555.10_85223
  Located on chromosome 6
  Distance between a terminus base of telomere on chromosomal short arm and 5'-terminus of this base sequence : 29749636
  Distance between 3'-terminus of neighbour sequence of sequence listing upward to telomere on chrosomal short arm and 5'-terminus of this base sequence : 76638
gtgaatcgaaacctaaatcttttgatttttaaataaagaaattttatttattttttaaatatttatttatttatttatttattatggagttttgctctctcgcccaggctggagtgcagtggcgcagtctcggctcactgcaacctccgcatcctgggttcaagcaattctcctgcctcagcctctggagtagctgggattacaggcacccactaccatgcctggctaatttttttgtatttttagagagacagcgtttcactatgttggcgag

SEQ ID NO: 9980 - DNA, 270 bp, Homo sapiens
  AC022402.4_48833
  Located on chromosome 6
  Distance between a terminus base of telomere on chromosomal short arm and 5'-terminus of this base sequence : 29772037
  Distance between 3'-terminus of neighbour sequence of sequence listing upward to telomere on chrosomal short arm and 5'-terminus of this base sequence : 22127
agatggcactgccttacagggatgaagttaattagctaattaccaacatatttgaagtagggaatctgtgggaagctggctttttggagtgagagaacattccagtcaagcagagatcccatgaaagtgacatagcaagaagagagagagagagagagagagagagagagaaagagaaaactgtgcctggaacagtggttcttaatgggactggaagggattttgcccccaagggaatatttggcaaggtctggagacatttcagttgtc

SEQ ID NO: 9981 - DNA, 231 bp, Homo sapiens
  AC022539.5_2726
  Located on chromosome 6
  Distance between a terminus base of telomere on chromosomal short arm and 5'-terminus of this base sequence : 29783334
  Distance between 3'-terminus of neighbour sequence of sequence listing upward to telomere on chrosomal short arm and 5'-terminus of this base sequence : 11027
aggttggataaacttaaggtaaacataaattcgtcacttaagtagttatgaatatgatatgatagtgacccaaaatgttatgaacatttttttgacacttcctgtatagaaagaaactggtttcttttttattttattttattttgttttattttattttattttattttattttagttctagggtacatgtgcaggatgtgtaggtttgttacataggtaaacatgtgcc

SEQ ID NO: 9982 - DNA, 422 bp, Homo sapiens
  AL035555.10_51432
  Located on chromosome 6
  Distance between a terminus base of telomere on chromosomal short arm and 5'-terminus of this base sequence : 29783334
  Distance between 3'-terminus of neighbour sequence of sequence listing upward to telomere on chrosomal short arm and 5'-terminus of this base sequence : -231
aggttggataaacttaaggtaaacataaattcgtcacttaagtagttatgaatatgatatgatagtgacccaaaatgttatgaacatttttttgacacttcctgtatagaaagaaactggtttcttttttattttattttattttgttttattttattttattttattttattttagttctagggtacatgtgcaggatgtgtaggtttgttacataggtaaacatgtgccatggtggtttgctgcacctatcaacccatcacataggtgttaagcaagcatgcattagctatttttcctgatgctctccctcccttcacccccatcccccaccaacaggctccagtatgtgttgttcccctccctatgtcaatgtgttcacattgttcagctcccacttacaagtgagaacatgtagtgtt

SEQ ID NO: 9983 - DNA, 313 bp, Homo sapiens
  AL034345.3_5463
  Located on chromosome 6
  Distance between a terminus base of telomere on chromosomal short arm and 5'-terminus of this base sequence : 29834548
  Distance between 3'-terminus of neighbour sequence of sequence listing upward to telomere on chrosomal short arm and 5'-terminus of this base sequence : 50792
atcttgtaactgtagcgcaataacaaaactggaaatggacactgaagcagtccacagagtttaaggtttcatcagttatacatgcactggtgtgtgtatatgtgtgtgtgtgtgtgtgtgtgtgtgtagttgtatggaatatgtaagatacggctctgttccatcaccacaaggttccctcatgctactttatagccacacccacctctctcccaaatccctaacccattaaccttttctccatgtctagaattttattgcaagaatgttatgtaaacggaatcacatagtatgtaacctcttggttatgcat

SEQ ID NO: 9984 - DNA, 323 bp, Homo sapiens
  AL034345.3_63518
  Located on chromosome 6
  Distance between a terminus base of telomere on chromosomal short arm and 5'-terminus of this base sequence : 29892656
  Distance between 3'-terminus of neighbour sequence of sequence listing upward to telomere on chrosomal short arm and 5'-terminus of this base sequence : 57795
ggataatttaacaaaggtggaggctggttggctcattggatctctgattattttattttattttattttattttattttattttattttattttattttattttattttttttagagacaaagtcttgctctgtagcccagacggaagtgcagtgctgtgatcatggctcacagcagcctcaaattcctgggctcaagtgaccctcccagactcccaaaatgctgggattataggcatgaaccactgcgcctggcccggtgattttattgatcacatggtgggaggctggcaatcccctctaaatttggagaaggaaatattc

SEQ ID NO: 9985 - DNA, 341 bp, Homo sapiens
  HUMUT8005B
  Located on chromosome 6
  Distance between a terminus base of telomere on chromosomal short arm and 5'-terminus of this base sequence : 30025870
  Distance between 3'-terminus of neighbour sequence of sequence listing upward to telomere on chrosomal short arm and 5'-terminus of this base sequence : 132891
ggggtacagagatttgcagaggctgcaagaggatccctgactggagggttagttaatgtgccccgctatctatcccagcctcccttgctgagcccagtttcacccaggcaccgtggaggataacaggagacaagcaccctcatggcaaggagctcccagtctccataaggggagaaaagatatttccctatcatcatcatcatcatcatcatcatcaccatcaccatcatcatcgtcatcatagccagcatttattgagtacctactgtgtgccaagtcctgccctaaaagcagggctttataactaccctgtggttatacctgctgtacagatgaggaaa

SEQ ID NO: 9986 - DNA, 319 bp, Homo sapiens
  AL035690.10_81538
  Located on chromosome 6
  Distance between a terminus base of telomere on chromosomal short arm and 5'-terminus of this base sequence : 30031177
  Distance between 3'-terminus of neighbour sequence of sequence listing upward to telomere on chrosomal short arm and 5'-terminus of this base sequence : 4966
gtcaccagactctgcagtaaagttgtccctgccacattttttgctagggtgaaaaatagaactcccagactagatggttgcccctgtcctgcacccctgagggtcaggccctggggctgccacagtccccatcgtgtacacacacacacacacacacagacacataacacacacacacacacacacacacacacacacacaccccacattaatgaagcctcttctcaggagactcagttctttttttttttttttttttgaggcagagtctcactctgtcgcctaggctggagtagttagtggcttgatcttaactcac

SEQ ID NO: 9987 - DNA, 190 bp, Homo sapiens
  D6S1680
  Located on chromosome 6
  Distance between a terminus base of telomere on chromosomal short arm and 5'-terminus of this base sequence : 30197920
  Distance between 3'-terminus of neighbour sequence of sequence listing upward to telomere on chrosomal short arm and 5'-terminus of this base sequence : 166424
aaaattccacccccgccaccttatctccctcgttggctttatgtccttcctagtactaaattccctctgctatattatataactttatttattgtttactctgtattgtgccctctccccgccacacacacacacacacacacacacacacacacacacacacacacggaaatgtctgctggggagatgg

SEQ ID NO: 9988 - DNA, 131 bp, Homo sapiens
  D6S1610
  Located on chromosome 6
  Distance between a terminus base of telomere on chromosomal short arm and 5'-terminus of this base sequence : 30259244
  Distance between 3'-terminus of neighbour sequence of sequence listing upward to telomere on chrosomal short arm and 5'-terminus of this base sequence : 61134
atttccagcagagccttggcattggtggattgaacatttgtggtttgggttactttttagtggatcgtgtgtgtgtgtgtgtgtgtgtgtgtgtgtgtgtgcgcgtgcctgcaagcatctatctcaccagg

SEQ ID NO: 9989 - DNA, 389 bp, Homo sapiens
  AL035464.20_97589
  Located on chromosome 6
  Distance between a terminus base of telomere on chromosomal short arm and 5'-terminus of this base sequence : 30455162
  Distance between 3'-terminus of neighbour sequence of sequence listing upward to telomere on chrosomal short arm and 5'-terminus of this base sequence : 195787
cagtcctatagatgacaatctgagatgtgattatttctatcttaaatgtcagacttctaaaaatccaagcagtaatttttcataaaatttcagatttattcctatatccccaaaatttatttcatcatggggttatgaagctttggcctccacttcaggtgaatattaaccctcaacattggccatttggcatttggccaagatatagtcagggcacctcaaactatatacttgcatttataggcatctatctatctatctatctatctaatcatccatccactcatctaaaataaaatctcatgaaataatacttgcccttattatacataatgtcctctaataatttctattatatttcattttttaaattgctcattatgacctac

SEQ ID NO: 9990 - DNA, 148 bp, Homo sapiens
  D6S1641
  Located on chromosome 6
  Distance between a terminus base of telomere on chromosomal short arm and 5'-terminus of this base sequence : 30778507
  Distance between 3'-terminus of neighbour sequence of sequence listing upward to telomere on chrosomal short arm and 5'-terminus of this base sequence : 322956
acaaggggtccagcattgtctcttctcaaggcagatattcttagaaactttgatttgcatttgtaagcctgtaaactgaagggagtgtgtgtgtgtgtgtgtgtgtgtgtgtgtgtgtgtgtgattttccatcttgtggcaatggcag

SEQ ID NO: 9991 - DNA, 107 bp, Homo sapiens
  DISO7_00000026
  Located on chromosome 6
  Distance between a terminus base of telomere on chromosomal short arm and 5'-terminus of this base sequence : 31076609
  Distance between 3'-terminus of neighbour sequence of sequence listing upward to telomere on chrosomal short arm and 5'-terminus of this base sequence : 297954
caggtagattcctgccaacaactgggcagggcagggcagggcagggcagggcacaccaggccctggccagtcctgcccaatggaggaccaagcattctttatgctag

SEQ ID NO: 9992 - DNA, 281 bp, Homo sapiens
  D6S1562
  Located on chromosome 6
  Distance between a terminus base of telomere on chromosomal short arm and 5'-terminus of this base sequence : 31274880
  Distance between 3'-terminus of neighbour sequence of sequence listing upward to telomere on chrosomal short arm and 5'-terminus of this base sequence : 198164
tgaaacaaaagtctggaaagataaataccaaacttataccagtagttaactctagggtgtgtgtgtgtgtgtgtgtctgtgtgtttatgagggggtgagacattcctattttccttccagtattgatacagtgcttggctctgttgtgatgaagattgttttcagatattttacgtgaaaaaaattaataaaataagaaaaaagaaaggcaccaaatgggattgttctgtggaatacacaatattatagacgtatgaagaaggacctgcacttcctacaca

SEQ ID NO: 9993 - DNA, 334 bp, Homo sapiens
  chr6.fa.O7frz.46176390
  Located on chromosome 6
  Distance between a terminus base of telomere on chromosomal short arm and 5'-terminus of this base sequence : 31364003
  Distance between 3'-terminus of neighbour sequence of sequence listing upward to telomere on chrosomal short arm and 5'-terminus of this base sequence : 88842
aaagcctgctaggatgaagagcagaaaggcggaaggcggctcctgattcctctgctctgtgtgtgtgtgtgtgtgtgtgtgtgtgtgtgtgtgtgtgtgtgtatgtgtgcgtgtgtacgtctgtgtgtgtgtgttggcggtaggaggagttggggtgacttaaggagagccagagccagctaactcaaaacagccctggctggcaaggtcaagtttgccttttctaataacaataataaccagtatttgcctagcacttacttgtcctggcaagtttacacgcattatctcatttaatctcctacaaccctctgaggaagttattccggtttag

SEQ ID NO: 9994 - DNA, 283 bp, Homo sapiens
  D6S1607
  Located on chromosome 6
  Distance between a terminus base of telomere on chromosomal short arm and 5'-terminus of this base sequence : 31523936
  Distance between 3'-terminus of neighbour sequence of sequence listing upward to telomere on chrosomal short arm and 5'-terminus of this base sequence : 159599
gcttgtcctgaggatggaaagttattagaggggaggtaaggtaaatggccacaagggcatatggctagtcagtgtggagagtgaattagaaccaggtctctctctctctctctctctctctctctctttgtttctctctctcttacctacatagacacacacacacacacacacacacacacacacacacgcacacactcctactgatgctcttggccaccttctggatggctgatttcttgaactcctgttcccctgtctgagtgaccccaagtttgaccca

SEQ ID NO: 9995 - DNA, 343 bp, Homo sapiens
  AL033380.11_50129
  Located on chromosome 6
  Distance between a terminus base of telomere on chromosomal short arm and 5'-terminus of this base sequence : 31530088
  Distance between 3'-terminus of neighbour sequence of sequence listing upward to telomere on chrosomal short arm and 5'-terminus of this base sequence : 5869
aaagaaacctagcctatttctgtctgtgcatggagatgaagacattcctagaaattgactcctaagcctccatggtacatgcaaaggcacatgtgagcgtgcttatgtgcgtgcactcactcacacacacacacacacacacacacacacacacactctattatccccaaggggccagatttgggacttgcctgtagctgtggctctcaagaggctgcaggtgaatctgaggtaggggctggccatggcggtgtgggggtcagtttgtgtgtgtctgtgcatgggagtgttataagcatgtctccctgagagctatgttcaagatttccttaagtgctgactg

SEQ ID NO: 9996 - DNA, 190 bp, Homo sapiens
  D6S1616
  Located on chromosome 6
  Distance between a terminus base of telomere on chromosomal short arm and 5'-terminus of this base sequence : 31597422
  Distance between 3'-terminus of neighbour sequence of sequence listing upward to telomere on chrosomal short arm and 5'-terminus of this base sequence : 66991
tttagggagtggtcacccaagtagtagccttctctgtttaaacagtttttcccagtcacagcagcgaggccccagatgcagtctaggcagattgcgtgtgtgcctctgagtgtgtgtgtctgtgtgtgtgcttgtgtgtgtgtgtgtgtgtgtgtgtgtgtgtgtcccagcagtatcctggctggaagct

SEQ ID NO: 9997 - DNA, 209 bp, Homo sapiens
  D6S426
  Located on chromosome 6
  Distance between a terminus base of telomere on chromosomal short arm and 5'-terminus of this base sequence : 31641847
  Distance between 3'-terminus of neighbour sequence of sequence listing upward to telomere on chrosomal short arm and 5'-terminus of this base sequence : 44235
ggaaccagaaactgtggcatagagagcatacagacgttaaaggaaaatgcacgtacctagtcctcaatcctctgccggcgcgtgtgtgtgtgtgtgtgtgtgtgtgtgtgtgtgtgagaaagagacagagagatctttgaaaaatatgactacatttttgggggagtggggtgggaaagattgacctcacttatggtgcagagcacatg

SEQ ID NO: 9998 - DNA, 314 bp, Homo sapiens
  AC068250.2_21544
  Located on chromosome 6
  Distance between a terminus base of telomere on chromosomal short arm and 5'-terminus of this base sequence : 31721518
  Distance between 3'-terminus of neighbour sequence of sequence listing upward to telomere on chrosomal short arm and 5'-terminus of this base sequence : 79462
acgtggaattaaatagcctgtaatatttctagcacagtgccttgcctattggacctgctcagtaaataaataatgatgatgatgatgatgatgatgatgatgatgatgatgatgatgataacgatgatgatagtagtggtagtaatagtaacagttatgctccagggccttgagggtaggagcatgtcttagaacccagtggagggtcaaacacaccaaaggagaagcagcaagatggaagatttggggagtgagtgggagcagccagactcactgctggcaagagaacagcacatgccatgcatctgtttatc

SEQ ID NO: 9999 - DNA, 252 bp, Homo sapiens
  chr6.fa.O7frz.46825350
  Located on chromosome 6
  Distance between a terminus base of telomere on chromosomal short arm and 5'-terminus of this base sequence : 31828205
  Distance between 3'-terminus of neighbour sequence of sequence listing upward to telomere on chrosomal short arm and 5'-terminus of this base sequence : 106373
cctttcttatgagtgctaggacaaaaccccattgcccactgctgggtgtctgtggatgtatatttgtgtgtgtgtgtgtgtgtgtgtgtatgtgtgtgaatgcatttgtgatgcaagtgagcctacatttaaacgtgcttatatgtggaggtttcacgattaggggactgtgttgtacaggtgtatgtattttttcatatctgtatcctcagtgtttggaacatggaggtgcaaagtaaatatttgcttaac

SEQ ID NO: 10000 - DNA, 436 bp, Homo sapiens
  chr6.fa.O7frz.46824980
  Located on chromosome 6
  Distance between a terminus base of telomere on chromosomal short arm and 5'-terminus of this base sequence : 31828611
  Distance between 3'-terminus of neighbour sequence of sequence listing upward to telomere on chrosomal short arm and 5'-terminus of this base sequence : 154
gtttggagactatgttcttattgtctctgtggtgtgtgtgtgtgtgtgtgtgtgtgtgtgtgatatgaatgtgtccatgagtaagcccaacctaccttcagaaacagcctcaggctgggatccctgtgccacccttcttatccctgcacctcaggtgtggcagttttcaggcatgtccatgtgaagagaccaccaaacaggctttgtatgagcaataaagctttttaatcacctgggtgcaggcaggctgagtgcaaaaagagaatcagcaaagggagagagggatgggactgttttataggatttgggtgggtagtggaaaattacagtcaaagggggttgttctcttgtgggcaggggcggggatcacaaggtgctcagtgggtgagcttctgagccaggagaaggactttcacaaggttagttgctcagttaa

SEQ ID NO: 10001 - DNA, 221 bp, Homo sapiens
  Z66701
  Located on chromosome 6
  Distance between a terminus base of telomere on chromosomal short arm and 5'-terminus of this base sequence : 31958242
  Distance between 3'-terminus of neighbour sequence of sequence listing upward to telomere on chrosomal short arm and 5'-terminus of this base sequence : 129195
ttcaataggtcgggtgtagggctcaggcatcacacacatgcacacacacacacacacacacacacacgcacacacacaaagagatataatctcccaaagttattctaacttcgttttagatatgtggttctaaaagtatgtccttgtaccagcagcatcaacatacctgggaacttgttagaaatgaaaattcttggacctccaccccaagtctactgaat

SEQ ID NO: 10002 - DNA, 252 bp, Homo sapiens
  AL031778.1_52781
  Located on chromosome 6
  Distance between a terminus base of telomere on chromosomal short arm and 5'-terminus of this base sequence : 31974417
  Distance between 3'-terminus of neighbour sequence of sequence listing upward to telomere on chrosomal short arm and 5'-terminus of this base sequence : 15954
gagaatcatttgaacctaggaggcagaggatgcagtgagccgagatcacgccattgcactccagcctgagcaacaagagcaaaattccatctcaagaaaaaaaaaaaaaaagaaaaaagaaagaaacatagataaatagatagatagatagatagatagatagatagatagatagatagatagatgatagatagataggcataggcatagatagagagagagagacatggctaatgtaagtgaaacgttcca

SEQ ID NO: 10003 - DNA, 181 bp, Homo sapiens
  AL133404.8_44791
  Located on chromosome 6
  Distance between a terminus base of telomere on chromosomal short arm and 5'-terminus of this base sequence : 32122660
  Distance between 3'-terminus of neighbour sequence of sequence listing upward to telomere on chrosomal short arm and 5'-terminus of this base sequence : 147991
attgaatagcaaacataccttgagtgcaacgtccagagatttgctcgcattcttcctcttcttcaccggagatttacattccagagtaaacgtttctctctctctctctctctctctctctctcttccagagaggaagatataccagattctctatataaactccaagtctcctaatttgg

SEQ ID NO: 10004 - DNA, 102 bp, Homo sapiens
  D6S1575
  Located on chromosome 6
  Distance between a terminus base of telomere on chromosomal short arm and 5'-terminus of this base sequence : 32147245
  Distance between 3'-terminus of neighbour sequence of sequence listing upward to telomere on chrosomal short arm and 5'-terminus of this base sequence : 24404
gcatctccccaaacacaaacacacacacacacacacacacacacacacacacacacacacacacacacaatctttaagggaacagggacccagaagcatagt

SEQ ID NO: 10005 - DNA, 289 bp, Homo sapiens
  AL133404.8_8975
  Located on chromosome 6
  Distance between a terminus base of telomere on chromosomal short arm and 5'-terminus of this base sequence : 32158523
  Distance between 3'-terminus of neighbour sequence of sequence listing upward to telomere on chrosomal short arm and 5'-terminus of this base sequence : 11176
cagtcactccaggtcagtagacacctgtgtgtgtgtgtgtgtgtgtgtgtgtgtgtgtgtgtgtgtgtgtgtgtgtgtaggggaatccaggctgcattctccagccttcattgctggacgccaagccagtgctctggacaatagaggctgagtctgagccctgagtcagtgggtgggaggcagattcctcgggacattgggtccctggccagaggctacttgggctccattttccctgtccccctgcctgggccagtcctccaggccgtggtcagttccaagttactgt

SEQ ID NO: 10006 - DNA, 316 bp, Homo sapiens
  DISO7_00025728
  Located on chromosome 6
  Distance between a terminus base of telomere on chromosomal short arm and 5'-terminus of this base sequence : 32210479
  Distance between 3'-terminus of neighbour sequence of sequence listing upward to telomere on chrosomal short arm and 5'-terminus of this base sequence : 51667
gctttaggaagcctgcacgaggagctaggagtctagagggagctggtgatgagtagagacaacaggaggagaggcagggagagggacagaggagacacatggatagggaaaaggagaggcggctggagggtgtgtgagactgtgtgcatgggcgtgtgtgtgtgtgtgtgtgtgtgtgtgtgtatgagagagaaagcaagactatgtgtgtgagtgtgagtgtatgtgcactcacacccatgtgtgagagtacaggaacccctcccacaacccaaactttatgggaaaccaaacagatttcaagtaagcctgtaag

SEQ ID NO: 10007 - DNA, 405 bp, Homo sapiens
  chr6.fa.O7frz.49652124
  Located on chromosome 6
  Distance between a terminus base of telomere on chromosomal short arm and 5'-terminus of this base sequence : 32476093
  Distance between 3'-terminus of neighbour sequence of sequence listing upward to telomere on chrosomal short arm and 5'-terminus of this base sequence : 265298
tcacagagtatgaaatggctacacaactattggcagggtcgaagacataggcttaaggtggagctttcaggaacagctctcaaagtcacactgcagaactgggccaccaagggagctgctgcctctttggcaatcatgaggtcaccagccccagaaccacactgcagtgtgatcaggaggctgccactgctgccagctccacactgcacctgctggggtccatgctaggagccagacacactgtgtctctcctcttgaccccctctgcccgtactgcagcaaaacaacaacaacaacaacaacaacaacaacaacaacacacaccccttcttattcccagaaagcagctggcgctgcagaagcacagccttccaaatttcatgcacgtgcatctgattggctaaa

SEQ ID NO: 10008 - DNA, 134 bp, Homo sapiens
  D6S451
  Located on chromosome 6
  Distance between a terminus base of telomere on chromosomal short arm and 5'-terminus of this base sequence : 32588047
  Distance between 3'-terminus of neighbour sequence of sequence listing upward to telomere on chrosomal short arm and 5'-terminus of this base sequence : 111549
gaggccaagtcctcaagttcctgggcctccacattcacaaacctacacaggcatatgcacaaacacacacacacacacacacacacacacacacacatacacacacacacggaggggtgaatgggcaggcagat

SEQ ID NO: 10009 - DNA, 444 bp, Homo sapiens
  chr6.fa.O7frz.49410189
  Located on chromosome 6
  Distance between a terminus base of telomere on chromosomal short arm and 5'-terminus of this base sequence : 32730192
  Distance between 3'-terminus of neighbour sequence of sequence listing upward to telomere on chrosomal short arm and 5'-terminus of this base sequence : 142011
actcataagaccagtctgatgtccctgctacaggcctgtccctccctgctccaccccacactgtgacataggaaaatagccagacgccttgcagcagacacccatatgaactcccatctgctcacaggggacccagacgcctaaccccactcacccctgcacacacacacacacgcacacacacacacactccttcacagcgcctctctgctcacatgtgtgctgggtggccccacatctcccagagtctctccataagcccaaagcactgctctgagatttaggccctgctattaactccctgggtgacctcacacaagattcctccccttctcttttggggcctcagttccctcctctgatctgggactcacacgtctccaagatcctttctagaccttaatttaaggtggggcatggtgattacagactacggtgaatgat

SEQ ID NO: 10010 - DNA, 103 bp, Homo sapiens
  DISO7_10002145
  Located on chromosome 6
  Distance between a terminus base of telomere on chromosomal short arm and 5'-terminus of this base sequence : 32801362
  Distance between 3'-terminus of neighbour sequence of sequence listing upward to telomere on chrosomal short arm and 5'-terminus of this base sequence : 70726
tccaatcatttccatgctcctttgtgctcatgtgtgcattcatttattcattcattcattcattcagcaaacgtatcatattctagtctgagcccatcctagg

SEQ ID NO: 10011 - DNA, 280 bp, Homo sapiens
  DISO7_10002144
  Located on chromosome 6
  Distance between a terminus base of telomere on chromosomal short arm and 5'-terminus of this base sequence : 32813478
  Distance between 3'-terminus of neighbour sequence of sequence listing upward to telomere on chrosomal short arm and 5'-terminus of this base sequence : 12013
tcctacaacctctttctactgatgggaaaatgtaaaacacatgcgcacacacgcacacacacacacacacacacacagggaggggcacaggataatgagcctgggctttagggttcatttggcctgggttcaagttgcaaccctgcacttgacacctgtgtgatcctggacaggtaacttagcctctctgagccttgatatagcctcataaaagtaagactactcatagctaacttccagggttgcaaggataaaattgcatagcctctgaaataaggta

SEQ ID NO: 10012 - DNA, 116 bp, Homo sapiens
  DISO7_10002142
  Located on chromosome 6
  Distance between a terminus base of telomere on chromosomal short arm and 5'-terminus of this base sequence : 32826374
  Distance between 3'-terminus of neighbour sequence of sequence listing upward to telomere on chrosomal short arm and 5'-terminus of this base sequence : 12616
tccagataggtccatccgggccctatgtcacacaggggacacacacacaaacacacacacacacacacacacacacaaacacacacattcacacaccccaaacagaacctctggag

SEQ ID NO: 10013 - DNA, 147 bp, Homo sapiens
  DISO7_10002139
  Located on chromosome 6
  Distance between a terminus base of telomere on chromosomal short arm and 5'-terminus of this base sequence : 33027352
  Distance between 3'-terminus of neighbour sequence of sequence listing upward to telomere on chrosomal short arm and 5'-terminus of this base sequence : 200862
ccagctaacctcctatgaaaggagagagacagagacacagagagagagagagacagagagagtgtgtgtgtgtgtgtgtgtgtgtgtgtgtgtgtgtgtgtgtgtgtgtgtgtctggcccctcattcccacacctgcggaacttatc

SEQ ID NO: 10014 - DNA, 476 bp, Homo sapiens
  chr6.fa.O7frz.48951983
  Located on chromosome 6
  Distance between a terminus base of telomere on chromosomal short arm and 5'-terminus of this base sequence : 33176753
  Distance between 3'-terminus of neighbour sequence of sequence listing upward to telomere on chrosomal short arm and 5'-terminus of this base sequence : 149254
tgtactatcttaggaccgagttagagcggcttcataaacaacaaggtatcagctgctttgcatgactgcctttttgtaataacttgcgtaggagacccaaatttggtactctcacacaggttcagtaacctgaaacttcattaaaaatttttttttgacgtaattaaacttacaaaaaagttgcaataatagtgcaaagaattctcaggtactcttctcccagatgatggtggtggtgatgatgatgatgatgatgatgatgatgatgatgatgatttgagacgaagttttgctctttcacccaggctggagtgaagtggtgtgattttggctcactacaacctctgtcccccgggttcaagtgattctcctgcctcagcctcccaagtagctgagattacaggcacctgccaccatgcccagctaatttttttcgtatttgtagtagagatggggtttcaccatgttgaccagtt

SEQ ID NO: 10015 - DNA, 118 bp, Homo sapiens
  D6S282
  Located on chromosome 6
  Distance between a terminus base of telomere on chromosomal short arm and 5'-terminus of this base sequence : 33262095
  Distance between 3'-terminus of neighbour sequence of sequence listing upward to telomere on chrosomal short arm and 5'-terminus of this base sequence : 84866
atggcccagacagtgggtatgcacagaacacacacacacacacacacacacacacacacacacacacacacacacacacacgcatgctccaggctctctctgatcctgcacaaaccat

SEQ ID NO: 10016 - DNA, 132 bp, Homo sapiens
  chr6.fa.O7frz.48857522
  Located on chromosome 6
  Distance between a terminus base of telomere on chromosomal short arm and 5'-terminus of this base sequence : 33276934
  Distance between 3'-terminus of neighbour sequence of sequence listing upward to telomere on chrosomal short arm and 5'-terminus of this base sequence : 14721
ctcctgagcaaccatacacacacacacacacacacacacacacacacacacacacacagagccagatgtcaggaaagggtaaaagacctgtgaccccgtatagacatggagaaagcctaatgtaggattctg

SEQ ID NO: 10017 - DNA, 147 bp, Homo sapiens
  D6S1582
  Located on chromosome 6
  Distance between a terminus base of telomere on chromosomal short arm and 5'-terminus of this base sequence : 33398053
  Distance between 3'-terminus of neighbour sequence of sequence listing upward to telomere on chrosomal short arm and 5'-terminus of this base sequence : 120987
agtagggctggaaccttctagaggtgtttgcttcctctaaaaagtgtgtgtgtgtgtgtgtgtgtgtgtgtgtgtgtgtgtgtgtgtgtgtgatgtctttgccacactggatcacgctatctagactatgaccacctgactacctag

SEQ ID NO: 10018 - DNA, 274 bp, Homo sapiens
  AL035587.5_93768
  Located on chromosome 6
  Distance between a terminus base of telomere on chromosomal short arm and 5'-terminus of this base sequence : 33671425
  Distance between 3'-terminus of neighbour sequence of sequence listing upward to telomere on chrosomal short arm and 5'-terminus of this base sequence : 273225
agtgtctagtgcaaagccatcccatctggagccggcagtccatacaaagctttggatttactgtccctaatttgtcaataaaatactctgacattagggtaccctcctaaaaaatatatatatatatatatatatttttttttttttttaagagacagtgtctccctatgttgcccaggcaggagtgcaatggctatttacaggcgtgatcatagcacactatagtctcaaactcctgggctcacatgatcttcttgctttagccttctgagta

SEQ ID NO: 10019 - DNA, 239 bp, Homo sapiens
  AL049843.18_108064
  Located on chromosome 6
  Distance between a terminus base of telomere on chromosomal short arm and 5'-terminus of this base sequence : 33896967
  Distance between 3'-terminus of neighbour sequence of sequence listing upward to telomere on chrosomal short arm and 5'-terminus of this base sequence : 225268
ctaggatccagaggtttacgacacagattctctagaactcagtatgaaacaatattttctctttatttccttagttgagatttattttttgtttgtgtgtgtgtgcatgtgtgtacatatatatatatatatatatattttttttttttttaaataagcaaatacatgtaaatcatactaaatgcaacagggagtctcctagctcctgaggtcttctttctaaaggcaaatcttgttaa

SEQ ID NO: 10020 - DNA, 463 bp, Homo sapiens
  chr6.fa.O7frz.48145440
  Located on chromosome 6
  Distance between a terminus base of telomere on chromosomal short arm and 5'-terminus of this base sequence : 33988625
  Distance between 3'-terminus of neighbour sequence of sequence listing upward to telomere on chrosomal short arm and 5'-terminus of this base sequence : 91419
agtttctgcctctagtgcttacacctaatcctgttttctctccctttctttctttctttctttctttctttctttctttctttctttctttctttctttctttctttctttcttctttctttccttctttctttctctttctttccttccttccttcctttctttctttctttctttccttccttccttccttccttccttccttccttccttccttcctttctctctctttctctctttctccttccttccttccttccctccttccttttttgaaatggagtctcgctttatcgcccaggctggagtgcagtggtgcgatctcagctcactgcaacctctgcctcccgggttcaagtgattctcctgcctcagcctcctaagtagctgggattataggtgtgcaccaccacgcccggctagttttttgtatttttagtagacatggagtttcaccatgttg

SEQ ID NO: 10021 - DNA, 471 bp, Homo sapiens
  chr6.fa.O7frz.48053754
  Located on chromosome 6
  Distance between a terminus base of telomere on chromosomal short arm and 5'-terminus of this base sequence : 34043556
  Distance between 3'-terminus of neighbour sequence of sequence listing upward to telomere on chrosomal short arm and 5'-terminus of this base sequence : 54468
gcaatcctttatctgaaacttttaggacccagtgtgttttgaaactcagaattttggggccttgtgtggtgactcatgcctgtaatccaacactttgagaggcctaggtgggaggattgtttgagcctaggaatcagagaccagtcctggcaacatagcgagaccccatctttacaaaaaatcaaacaattagcctggcatggtggcacatgcctacagtcccagctactcaaaaggttgaggtgggaggattgcctgagccggggaggttgaggctacagtaagccatgattgtgccactgcactccagcctcagtgacagagtgagaacctgacacacacacacacacacacacacacacacacacacagaatgtttggatattagataaataatattgtaattttaccatatattactcaatgccctctttggggtgtagggcaataccttgtaatccaacttgatta

SEQ ID NO: 10022 - DNA, 330 bp, Homo sapiens
  AL096814.26_37749
  Located on chromosome 6
  Distance between a terminus base of telomere on chromosomal short arm and 5'-terminus of this base sequence : 34266514
  Distance between 3'-terminus of neighbour sequence of sequence listing upward to telomere on chrosomal short arm and 5'-terminus of this base sequence : 222487
attttaagtgcttcactcaaacagcttaatttgcctctgggaagggtttccgtctgtctgtctctctctctctctctctctctctctctctctctctctctctctctctctctctctctctctctctctctctctctctctctctctctctctctctctctctctctctctctctctctctctctctctctctcctctctctctctctctctctctctctctctctgcccctagggaatttgtgacctgtgtggttggcaatatcaaacctaccccctccccacaaagtggcatgttgggtcatatttgtccttaggaataggtagctgc

SEQ ID NO: 10023 - DNA, 407 bp, Homo sapiens
  AL096814.26_61344
  Located on chromosome 6
  Distance between a terminus base of telomere on chromosomal short arm and 5'-terminus of this base sequence : 34290160
  Distance between 3'-terminus of neighbour sequence of sequence listing upward to telomere on chrosomal short arm and 5'-terminus of this base sequence : 23316
gttttggaataagataggccaggttttgaatctcagttcaacttttttaccagctgtgtgaccttgagaaacttatttattgggtcaatttcctcatttgtttaaaaatgaaaaaattttacagtgttatgagaactagaaattgtgtgtgtgtgtgtgtgtgtgtgtgtgtgtgtgtgaaatgcatgattctcagcaggcattcaatgttgtcatcgtcatcattattattagtgactaacacacaaatttgtgtctttgagcagatttgggttgttgagcatttgtattctgacttaccaatttctcataatatgaattccatttgcatgcttgggaaataaaaatatcctcctcaagaaactcttattgtggacactcgagggtctgagcaccatgttaaatgt

SEQ ID NO: 10024 - DNA, 151 bp, Homo sapiens
  HUMUT2081
  Located on chromosome 6
  Distance between a terminus base of telomere on chromosomal short arm and 5'-terminus of this base sequence : 34340178
  Distance between 3'-terminus of neighbour sequence of sequence listing upward to telomere on chrosomal short arm and 5'-terminus of this base sequence : 49611
agcctgggtaacttagtgagaccctgtttctaaaaataaatagacagatgatagatagtcagatagagagagagagagagagatgatatagatatagatagatagatagaatgttctctaccccaagggtggagaaagacttgagcaaaga

SEQ ID NO: 10025 - DNA, 393 bp, Homo sapiens
  AL096814.26_161333
  Located on chromosome 6
  Distance between a terminus base of telomere on chromosomal short arm and 5'-terminus of this base sequence : 34390054
  Distance between 3'-terminus of neighbour sequence of sequence listing upward to telomere on chrosomal short arm and 5'-terminus of this base sequence : 49725
taaggagtaatcaactgtttgctctgtggttgcagccatgtaaaaatctgtttgcacaagggtaggctgggtacagcgggtaaatgcaaacagtcatgtgagagtggtgatgagcaaaaaaattttctttacagaatttctctaatatgtattccagcaattaggagggcttcactgaatgcatttgcaatcctaacaaagtcttctgccctctcccagcccaagcaaggccacacgagtgtgtgtgtgtgtgtgtgtgtgtgtgtgtgtttaaatgcatgagaaagcagagatgtggatcttcgcaaatcccaagataaaggactgggctgttactggagacaaagctgccagtcactcaggactcctcccttgcatcttggattaactgag

SEQ ID NO: 10026 - DNA, 186 bp, Homo sapiens
  D6S1552
  Located on chromosome 6
  Distance between a terminus base of telomere on chromosomal short arm and 5'-terminus of this base sequence : 34541584
  Distance between 3'-terminus of neighbour sequence of sequence listing upward to telomere on chrosomal short arm and 5'-terminus of this base sequence : 151137
agcctgaacgacagaacaagactctgtctctaaaacacacacacacacacacacacacacacacacacacacagagagagagagagagagagagagagagagagagagagagaaaagcctggtccatgggagttgtggttacagaaggcaaagcttttaatataccaaagatctaaagttaagcag

SEQ ID NO: 10027 - DNA, 304 bp, Homo sapiens
  AL035588.21_10312
  Located on chromosome 6
  Distance between a terminus base of telomere on chromosomal short arm and 5'-terminus of this base sequence : 34807718
  Distance between 3'-terminus of neighbour sequence of sequence listing upward to telomere on chrosomal short arm and 5'-terminus of this base sequence : 265948
ttcaagtgtattgctcagtatcagtaagcattgttgtgtagaacatgtttcgtgtgtgtgtgtgtgtgtgtgtgtgtgtgtgtatgtgtgcctagtgtcaaataaagtatatttttctgtgagccatggtccaaaactttggtgccactgcattagagattctgtccctcctgtgccatgtttatagagcacctactgaatataaggcgcagcagcagtgctatggccagggtgcctgtcctcagcaaacctcatggtctgactggagaatcagggcccagttcttagcaaggtggttaccaag

SEQ ID NO: 10028 - DNA, 193 bp, Homo sapiens
  AL035588.21_75499
  Located on chromosome 6
  Distance between a terminus base of telomere on chromosomal short arm and 5'-terminus of this base sequence : 34872872
  Distance between 3'-terminus of neighbour sequence of sequence listing upward to telomere on chrosomal short arm and 5'-terminus of this base sequence : 64850
gagtacgtgactgtatggaaagtctgtgtgagtgtatgtgtgtgtgcatacaggtgtgaagtgtgtgtgtgtgtgagtgtgtgagtgtgtgtgtgtgtgtgtgtgtgtgtgtgtgctggggggctggctaaatccttcccctgtcccgccccaacccagcttagcctctagggtttcagccactgtcctaaag

SEQ ID NO: 10029 - DNA, 112 bp, Homo sapiens
  D6S1672
  Located on chromosome 6
  Distance between a terminus base of telomere on chromosomal short arm and 5'-terminus of this base sequence : 34959024
  Distance between 3'-terminus of neighbour sequence of sequence listing upward to telomere on chrosomal short arm and 5'-terminus of this base sequence : 85959
ggacctgcagaccaaagacaactgttgactgcgtgtgtgtgtgtgtgtgtgtgtgtgtgtgtgtgtgtgtcagggggtggtggggggcaaattcaccctctgaatcctcccc

SEQ ID NO: 10030 - DNA, 402 bp, Homo sapiens
  chr6.fa.O7frz.47240890
  Located on chromosome 6
  Distance between a terminus base of telomere on chromosomal short arm and 5'-terminus of this base sequence : 35008668
  Distance between 3'-terminus of neighbour sequence of sequence listing upward to telomere on chrosomal short arm and 5'-terminus of this base sequence : 49532
gtacaagcgatatctgtcaaatgacaggaggaaaactcaaaaccctttgaggcaggtgtgttgttttcacagcagagaggaactagggctctagttctgggttaggtggcttgtccaaggtcacagagctggccatacccagctgtgtattgggctgctgagtatgaggctgtttggggtgggccttgagcctgagcctgttctgagctttgtgtgtgtgtgtgtgtgtgtgtgtgtgtgtgtttggtggcttcctaggggatttctgcctgcattccaaccagcaggtccttccaggcacccctcccctcctttacagggcttcttcccttcctgcagctcctttcagcccctgctttcttgccccaagcctggagaggcctgtgagtgcagtccagctaa

SEQ ID NO: 10031 - DNA, 304 bp, Homo sapiens
  AL136967.5_110765
  Located on chromosome 6
  Distance between a terminus base of telomere on chromosomal short arm and 5'-terminus of this base sequence : 35104937
  Distance between 3'-terminus of neighbour sequence of sequence listing upward to telomere on chrosomal short arm and 5'-terminus of this base sequence : 95867
gaggctggtataacttcagatctaacctatttcagaggcagaggttaaagatagacaattcacctggatttttctcttcttactggggtatgggtgcaggggtgagggtgggcacacaactaaatccagtcctacttagagatccaaaatgaccaactcaatcagagggatgcgtgtgtgtgtgtgtgtgtgtgtgtgtgtgtgtgtatgtggtgttacaattgcaagtaagagtgccttataaagtttctttttttcacctgcatcttataatttactcctcactgctagtattagccatttc

SEQ ID NO: 10032 - DNA, 248 bp, Homo sapiens
  AL136967.5_104473
  Located on chromosome 6
  Distance between a terminus base of telomere on chromosomal short arm and 5'-terminus of this base sequence : 35111292
  Distance between 3'-terminus of neighbour sequence of sequence listing upward to telomere on chrosomal short arm and 5'-terminus of this base sequence : 6051
tggtcttacctggaccaaaaggagcaattctggaagcttggctgtggcccaagccgggctatgggcctggagtggcagattgtgagcagggacccagcactgactctgtgtgtgtgtgtgtgtgtgtgtgtgtgtgtgtgtgtgagtgagagagagagagagagagaaagagagagagaggctgagaggctgagagtgtgtgacaaagaggaaagacggaggaccatatgcctattttctttgaggaa

SEQ ID NO: 10033 - DNA, 116 bp, Homo sapiens
  D6S1549
  Located on chromosome 6
  Distance between a terminus base of telomere on chromosomal short arm and 5'-terminus of this base sequence : 35111381
  Distance between 3'-terminus of neighbour sequence of sequence listing upward to telomere on chrosomal short arm and 5'-terminus of this base sequence : -159
ggacccagcactgactctgtgtgtgtgtgtgtgtgtgtgtgtgtgtgtgtgtgtgagtgagagagagagagagagagaaagagagagagaggctgagaggctgagagtgtgtgaca

SEQ ID NO: 10034 - DNA, 381 bp, Homo sapiens
  AL136967.5_58027
  Located on chromosome 6
  Distance between a terminus base of telomere on chromosomal short arm and 5'-terminus of this base sequence : 35157753
  Distance between 3'-terminus of neighbour sequence of sequence listing upward to telomere on chrosomal short arm and 5'-terminus of this base sequence : 46256
cttcaagacaccaggacactaggaccagagggaaggatgcagggagcagggctggggaagaggaagcagtgcatagaggaggctgtcccgtctctctctctctttctctctctctctctctctctctctgtgtgtgtatgtgtgtgtgtgtggggggggggtgggggttcctactgccactccaagaatggggagaaagcaatgaagagatgagctgcgcctacggtctgtgctctgggcccagatcagacttacctgctgccgtattctcttcaccacaatgaatagcagcaacaagatgatgctgaatgccacacagtaggcacaaaataagcgcacaatacatattgaattaaatttaccaacagctgtcactatcac

SEQ ID NO: 10035 - DNA, 288 bp, Homo sapiens
  D6S1621
  Located on chromosome 6
  Distance between a terminus base of telomere on chromosomal short arm and 5'-terminus of this base sequence : 35430003
  Distance between 3'-terminus of neighbour sequence of sequence listing upward to telomere on chrosomal short arm and 5'-terminus of this base sequence : 271869
accacagatgagaatgcctttttactctggggcagaaaaataaattaaaattttaaaaagtacattgtgcactattgatattattgcatcttctaagaaaaaacatcttttggtttatgaccttggcaggagtcactgatctacaaaagttgtactcccaggtacttactattgcttttatattaacctctgttcattccatttcaggcatattcgtttgttcgtgtgtgtgtgtgtgtgtgtgtgtgtgtgtgtgtgtgttttcatcagcatttactctaaatcttt

SEQ ID NO: 10036 - DNA, 215 bp, Homo sapiens
  AL022170.1_74853
  Located on chromosome 6
  Distance between a terminus base of telomere on chromosomal short arm and 5'-terminus of this base sequence : 35531508
  Distance between 3'-terminus of neighbour sequence of sequence listing upward to telomere on chrosomal short arm and 5'-terminus of this base sequence : 101217
aacctgtatactctgtcaccaaacacacagacacacacacacacacacacacacacacgtactcatgtacttagacacacacttttccttgccccactttctttatttaattttatcataattggtgtctttgtctgttttctgttgttataacaaaatacttatgagtgggtaatttataaaggaaagaggtttatttagctcatggttctgga

SEQ ID NO: 10037 - DNA, 279 bp, Homo sapiens
  AL022170.1_122336
  Located on chromosome 6
  Distance between a terminus base of telomere on chromosomal short arm and 5'-terminus of this base sequence : 35578918
  Distance between 3'-terminus of neighbour sequence of sequence listing upward to telomere on chrosomal short arm and 5'-terminus of this base sequence : 47195
ttgacattaagaactcaatgatctctaacgatgtggtggatgaagtatgctgctcacccactgtattagtctaggttctctaaagggacagaaccaataagatacacacacacacacacacacacacacacacacacacacacatatatatataaaggggagtttattaagtagtattaactcacgagatcatgatgtcccacaataggctgtctgcaagctgaggagcaatgaagccagtctgagtcccaaagctgaagaacttggagtccagtgttc

SEQ ID NO: 10038 - DNA, 473 bp, Homo sapiens
  chr6.fa.O7frz.27383417
  Located on chromosome 6
  Distance between a terminus base of telomere on chromosomal short arm and 5'-terminus of this base sequence : 35833663
  Distance between 3'-terminus of neighbour sequence of sequence listing upward to telomere on chrosomal short arm and 5'-terminus of this base sequence : 254466
tccatagcacttatcagtagctgacaaactgtatatgtttttacttttttattgtctgtagctcccaagtagaatacaaacatctgaaactcactgtatccatcctgagtaatgttcttttcagctcagtcacaatcattttttgatagcctatcctataagcttaacttatagtgttaatcagtattaatacatcttagtgggaaagaaggaaaaaataaacgatcacacacacacacacacacacacacacacatacatttacgtaacagagcaagtgtgaaaatacctaaaggctttatagctccttttgtcaatggatacatgacagcatttttggcattctttactactcttattctatgctccatttgtcttcagtcagcacctcagctgcccttatgttttacttggtaaggcaaattcctaaatgagcctggtaattagtcatccagcttataggaaggtactat

SEQ ID NO: 10039 - DNA, 323 bp, Homo sapiens
  AL353759.8_43073
  Located on chromosome 6
  Distance between a terminus base of telomere on chromosomal short arm and 5'-terminus of this base sequence : 36071290
  Distance between 3'-terminus of neighbour sequence of sequence listing upward to telomere on chrosomal short arm and 5'-terminus of this base sequence : 237154
ctgtttcatccacttaatgtttactttgtggtaatggaacctcccagcttttattttccttccttccttccttccttccttccttccttccttccttccttcctccctccctccctccctccctcccttcctttctttcttcacagagtctagctctgttgcccaggctggaatgcagtggtgcgatctcagctcactgcaacctctgcctcccgggttcaagcgattctcctgcctcagcctcccaagtatctaggattacaggtgcatgctgccacacctggctagtttttgtatttttagtaaagatggagtttcagatg

SEQ ID NO: 10040 - DNA, 302 bp, Homo sapiens
  HUMUT1051
  Located on chromosome 6
  Distance between a terminus base of telomere on chromosomal short arm and 5'-terminus of this base sequence : 36071317
  Distance between 3'-terminus of neighbour sequence of sequence listing upward to telomere on chrosomal short arm and 5'-terminus of this base sequence : -296
gtggtaatggaacctcccagcttttattttccttccttccttccttccttccttccttccttccttccttccttcctccctccctccctccctccctcccttcctttctttcttcacagagtctagctctgttgcccaggctggaatgcagtggtgcgatctcagctcactgcaacctctgcctcccgggttcaagcgattctcctgcctcagcctcccaagtatctaggattacaggtgcatgctgccacacctggctagtttttgtatttttagtaaagatggagtttcagatgttggcc

SEQ ID NO: 10041 - DNA, 318 bp, Homo sapiens
  AL353759.8_44111
  Located on chromosome 6
  Distance between a terminus base of telomere on chromosomal short arm and 5'-terminus of this base sequence : 36072262
  Distance between 3'-terminus of neighbour sequence of sequence listing upward to telomere on chrosomal short arm and 5'-terminus of this base sequence : 643
gttcaagtgcacttaactagcttcctccaagtggaatcagaggataaatttaccatacaaaatacaggatacccaattatatttgaatttcaaacaggcaacaaataattgcttaagtatgcccctcactgcacacccaaatattacatgagacattctatacatatatatatatatatatatatatatatatatatatatatatatatatatatatttgaaattcagatttaactggacatttggtatttttaatgtgccaaatctagcaaccctatctgaagagcaaaactggagtgtctagtctggataggtcct

SEQ ID NO: 10042 - DNA, 117 bp, Homo sapiens
  DISO7_10002121
  Located on chromosome 6
  Distance between a terminus base of telomere on chromosomal short arm and 5'-terminus of this base sequence : 36147690
  Distance between 3'-terminus of neighbour sequence of sequence listing upward to telomere on chrosomal short arm and 5'-terminus of this base sequence : 75110
gcattgacccttatagtcactcttttttcctaaaactatatgtgtgtgtgtgtgtgtgtgtgtgtgtgtgtgtgtgacatcatgtaaataagaatacactacttggcaacttggatt

SEQ ID NO: 10043 - DNA, 255 bp, Homo sapiens
  DISO7_10002122
  Located on chromosome 6
  Distance between a terminus base of telomere on chromosomal short arm and 5'-terminus of this base sequence : 36163828
  Distance between 3'-terminus of neighbour sequence of sequence listing upward to telomere on chrosomal short arm and 5'-terminus of this base sequence : 16021
aataatgtaacccaactgatggaattttttaattcagacacacacacacacacacacacacgcccctagagtagtggaaaataagacaaatgctctagagttcagtttagttaatgggagaaaataatagatgcattaaaatttttctattgataataattgttctcaactattaaatgtcatgaaagcacattttcagagataagtttatgttttgaattagagggatttttgcatggagatgtaatttcagaa

SEQ ID NO: 10044 - DNA, 111 bp, Homo sapiens
  DISO7_10002124
  Located on chromosome 6
  Distance between a terminus base of telomere on chromosomal short arm and 5'-terminus of this base sequence : 36237670
  Distance between 3'-terminus of neighbour sequence of sequence listing upward to telomere on chrosomal short arm and 5'-terminus of this base sequence : 73587
tttcagtcagctattgctccattaaaacacacacacacacacacacacacacacaaatgcttaaaaacatacaataagcatctgtgtgtgtcagttgaaggtcaatagttc

SEQ ID NO: 10045 - DNA, 475 bp, Homo sapiens
  chr6.fa.O7frz.28190685
  Located on chromosome 6
  Distance between a terminus base of telomere on chromosomal short arm and 5'-terminus of this base sequence : 36504757
  Distance between 3'-terminus of neighbour sequence of sequence listing upward to telomere on chrosomal short arm and 5'-terminus of this base sequence : 266976
tggagatggatctaaactgatagctcccccatgaacttgctttttgaaagctggttgggggcaaaagaaaaatggccttttgtttgtggttttttgagacggagtctcgctctgtcgcccagcctggagtgcagtggctccatctcagctcactgcaacctccaccttccggattcgagagattctcccgcctcagtctcccgagtagctaggattacaggcgtccgccaccacgccgggctaatttttgtgtttgtggtagaaacggggtttcaccatgttggccaggctggtctggaactcctgacttcagttgatccaccaacctcggcctcccaaagtgctggaatttcaggcgcaagccaccgcacccagccagaaaacaaaacaaaacaaaacaaaacaaataggtattttcaaaggtaatgtttggggcttgaatgcaacatttgttaaatagtcctggactaagctt

SEQ ID NO: 10046 - DNA, 364 bp, Homo sapiens
  AL133255.13_121332
  Located on chromosome 6
  Distance between a terminus base of telomere on chromosomal short arm and 5'-terminus of this base sequence : 36882283
  Distance between 3'-terminus of neighbour sequence of sequence listing upward to telomere on chrosomal short arm and 5'-terminus of this base sequence : 377051
catctgaaagtctggtactgattcctggccaaaatgagggcaagattaaatacagtctgtttaaagtttgaaactcctgtggctagtttatgtattgatggcttacacctggtataaccaggcatgcagcctgacaaaaggttcacctggaaatttgggagaccttgcttctaagtcaaaattcctcacaaaatcttgatggattgtgtttcagagatgaagtatgtcccatgcaaacacacatacacaatacaacacacacacacaacacaccacacacacacacacacacacacacacacacacacacacacacacacacacacccccttacaaccgtggatagaagcacctgaaatgtttg

SEQ ID NO: 10047 - DNA, 250 bp, Homo sapiens
  D6S1558
  Located on chromosome 6
  Distance between a terminus base of telomere on chromosomal short arm and 5'-terminus of this base sequence : 36966736
  Distance between 3'-terminus of neighbour sequence of sequence listing upward to telomere on chrosomal short arm and 5'-terminus of this base sequence : 84089
tggccaggagggctagtggtgtttaaatctctgcagatatgggcttcattaattacattgtttttcaagtctctctttctatatatatgtgtgtgtgtgtgtgtgtgtgtgtgtgtgtgtgtgtgtgttgtttttgtttttgtttttgagacagaacctcactctgtctcccaggctggagtgcagaggtgtgatcttggttcactgaaacctctacctcccagactcaagtccagcctcccaagtagct

SEQ ID NO: 10048 - DNA, 233 bp, Homo sapiens
  AL021808.1_143231
  Located on chromosome 6
  Distance between a terminus base of telomere on chromosomal short arm and 5'-terminus of this base sequence : 37127646
  Distance between 3'-terminus of neighbour sequence of sequence listing upward to telomere on chrosomal short arm and 5'-terminus of this base sequence : 160660
attctggcttaaggtgaaacttcccttgtgtatcacactagtccttctgttatttggttttcagaattttgctactgctttctactttcccattattgtccttttgtacttatgaacggctctctctccttttttcttttttctttctttctttcttttcttccttccttctctttcttctctctctctctctctctctctgaatttttggctagaaagatagcagatgcctg

SEQ ID NO: 10049 - DNA, 161 bp, Homo sapiens
  AL021918.1_15050
  Located on chromosome 6
  Distance between a terminus base of telomere on chromosomal short arm and 5'-terminus of this base sequence : 37368281
  Distance between 3'-terminus of neighbour sequence of sequence listing upward to telomere on chrosomal short arm and 5'-terminus of this base sequence : 240402
cataggtgagcctagagtaatcacaagggtctttataagagggaggtaagcatatcagagtaggagacagaaagacagaagacaagtcagagtcagagggagagagagagagagagagagagagagagataaatttgaagatgccacagtactagctttga

SEQ ID NO: 10050 - DNA, 356 bp, Homo sapiens
  AL021918.1_85872
  Located on chromosome 6
  Distance between a terminus base of telomere on chromosomal short arm and 5'-terminus of this base sequence : 37438986
  Distance between 3'-terminus of neighbour sequence of sequence listing upward to telomere on chrosomal short arm and 5'-terminus of this base sequence : 70544
aggtcagaagttcaagagcagcctggccgacatggtgaaactcccgtctctactaaaaatataaaaaattagccaggcgtgttggcgggcgcctgtaatcccagctacttgggaagctgaggcaggagaattgcttgaactcaggagacggaggttgcagtgagcccagatcacgccgttgcactccagtctgggcgacaaggcgaaactctgtctcacacacacacacacacacacacacacaaacacacacagtagaaaatattaaatttttgtggtgggccaggtgttgtgcttagtgctatagacacaaaggtaaacaaaacacaagcacagttgctgaccttatggtgatt

SEQ ID NO: 10051 - DNA, 410 bp, Homo sapiens
  AL031229.1_5927
  Located on chromosome 6
  Distance between a terminus base of telomere on chromosomal short arm and 5'-terminus of this base sequence : 37567981
  Distance between 3'-terminus of neighbour sequence of sequence listing upward to telomere on chrosomal short arm and 5'-terminus of this base sequence : 128639
agcactttcagttctatgcttaactccctgtgtttctactttcactcagaatttggtctgttaaatccttaaattattatcagcactttgaatttttttagaagctttgcttgttttgtacagcattttagttgttttcagttgcagggacagtcccagtgcatagctagtcatttttactgtgcagagacgcaagagaggacatattaaaaataacctgaattttagtaatactaaggctatatgtgattacacacacacacacacacacacacacacatatatgcgcatatatatattcacattgtaaaataaatgagctgggcacagtggcaggtgcgggagcacagtggccccagatacttgggaggctcaggcgagaggatcacttggttctataaatcaaggcc

SEQ ID NO: 10052 - DNA, 202 bp, Homo sapiens
  AL009179.1_75985
  Located on chromosome 6
  Distance between a terminus base of telomere on chromosomal short arm and 5'-terminus of this base sequence : 37649933
  Distance between 3'-terminus of neighbour sequence of sequence listing upward to telomere on chrosomal short arm and 5'-terminus of this base sequence : 81542
ttgttcctcaaactcctgatctcctgcctcagcctttgaaaatgctgggattataggtgtgagccactgtgccaggcctgtttccactttttttttcttttttctttctttccttttattttctttctttcctttctttctctctctctctctctctctctctctctttctttctttcttcttgagacaatcttgctctgtc

SEQ ID NO: 10053 - DNA, 207 bp, Homo sapiens
  D6S464
  Located on chromosome 6
  Distance between a terminus base of telomere on chromosomal short arm and 5'-terminus of this base sequence : 37666163
  Distance between 3'-terminus of neighbour sequence of sequence listing upward to telomere on chrosomal short arm and 5'-terminus of this base sequence : 16028
tgctccattgcactccagcctgggcaacaagagcaaaactccgtctcaaaaccaaacaaacaatcaacaacacgcacgcgcgcgcgcgcgcacacacacacacacacacacacacacacacacacacaaaagacagaccaggaggccagggtaataagatatcaaggtgagacataaggaatttggtaaaatatcgagggtgatcag

SEQ ID NO: 10054 - DNA, 238 bp, Homo sapiens
  D6S306
  Located on chromosome 6
  Distance between a terminus base of telomere on chromosomal short arm and 5'-terminus of this base sequence : 37860563
  Distance between 3'-terminus of neighbour sequence of sequence listing upward to telomere on chrosomal short arm and 5'-terminus of this base sequence : 194193
tttacttctgttgccttaatgttttcattgaacaagcccccagaattgaccttccaattcaccaaaaattgtaatcacaacatcttcaaggtttgtcaaacatcccatcaatgcttgtacaattcaatgtaaattagatccgtagaaaagccagaagttctttctccaatatcacacacacacacacacacacacacacacacacacactagttaaacgaggctcactgaaactctca

SEQ ID NO: 10055 - DNA, 337 bp, Homo sapiens
  AL121944.14_33785
  Located on chromosome 6
  Distance between a terminus base of telomere on chromosomal short arm and 5'-terminus of this base sequence : 37916967
  Distance between 3'-terminus of neighbour sequence of sequence listing upward to telomere on chrosomal short arm and 5'-terminus of this base sequence : 56166
aaggaagtgttcaaagaatgactgggacatgtgaaaaggacaaagagccatggttatgtaaaatgttgacattagaaaagctgggtaaagagtatatgagaagtctctgttctatattgcatctcttctgtgaatataaaatttttccaaatgaaatgtttctttaaagtggacataaaagccaggttaaaggaattcccactgtacaaatttgggaaagttgagcatcaaaataaatcatgatattaatatactataacccgtatatattcagaaagaaggaaggaaggaaggaaggaaggaagactgatttttccttggagtagaatgccaatta

SEQ ID NO: 10056 - DNA, 308 bp, Homo sapiens
  AL121944.14_36884
  Located on chromosome 6
  Distance between a terminus base of telomere on chromosomal short arm and 5'-terminus of this base sequence : 37920151
  Distance between 3'-terminus of neighbour sequence of sequence listing upward to telomere on chrosomal short arm and 5'-terminus of this base sequence : 2847
ccttgtatccagtgactctaatcttaaacaaatggaacataaaatactgaaccaattagcaaaatgaactgtttcttaaacgtttataacaatctatggatcttattgtgcctaaatagattaatcattttaatttttttaaaaatttaaaatttctctaaagttttcttttgctttctagatacacaaattacacacacacacacacacacacacacaaacacacacacagtggcaattaaatattcgtgccttgaaaagtgagaaaggatacagatgtccttctgcctagtagacctgtttatgag

SEQ ID NO: 10057 - DNA, 378 bp, Homo sapiens
  chr6.fa.O7frz.29724394
  Located on chromosome 6
  Distance between a terminus base of telomere on chromosomal short arm and 5'-terminus of this base sequence : 38027362
  Distance between 3'-terminus of neighbour sequence of sequence listing upward to telomere on chrosomal short arm and 5'-terminus of this base sequence : 106903
acctgaggatctgtagttctagtccagataaataacttcctctaagttacacaatagagcacagattcaaatcatatccctgcgtcactgttttttgttttgttttgttttgttttgtttcagcttcctataagactgttttctctgattgacttctggtggcttggcttcattatgatgtgtttatgttcacagaaatttttgtaatttctctatggtaacaactttttatgccttaggagtgtctctgaggcaggattctaagagattctctttgactcaatcccagatagaggataaatctcctggcaaagcccagaatgaccacagccctggaacctgaggaccaaaaaggacttctgataattaaggcagagg

SEQ ID NO: 10058 - DNA, 178 bp, Homo sapiens
  AL022393_56738
  Located on chromosome 6
  Distance between a terminus base of telomere on chromosomal short arm and 5'-terminus of this base sequence : 38097801
  Distance between 3'-terminus of neighbour sequence of sequence listing upward to telomere on chrosomal short arm and 5'-terminus of this base sequence : 70061
tggtatgaacatagctcactgcagcctctagctcctgggctcaagtgatcctccagcctcagcctcccaagtagctaggactacaggtgagtgccaccacactaagttaaattttgttgttgttgttgttgttgtatagatgggggtttcactatgttgcttaggctgatcttgaact

SEQ ID NO: 10059 - DNA, 371 bp, Homo sapiens
  AL022393.1_51293
  Located on chromosome 6
  Distance between a terminus base of telomere on chromosomal short arm and 5'-terminus of this base sequence : 38103181
  Distance between 3'-terminus of neighbour sequence of sequence listing upward to telomere on chrosomal short arm and 5'-terminus of this base sequence : 5202
acggtcattctacatgaaagttttttaggaaccaccatactgttttttatagtggctgcaccattttacattcccaccaacaatgcacaagaattccaatttccctacattctcaccaacacttgttattttcatatataggtatatatgtgtatgtgtatatatctagatagatagatagatagatagatagatagatacatagatagatacatagatacatagatagatacatagatagatacatagatatagacatcatatctgttagaatagcatatatataatatatatgaaagtaacaagtgtgtgtacaattctctctctctctcatatatacatatatgctattctaacagatgtgaggtcac

SEQ ID NO: 10060 - DNA, 279 bp, Homo sapiens
  AL021997.1_51556
  Located on chromosome 6
  Distance between a terminus base of telomere on chromosomal short arm and 5'-terminus of this base sequence : 38214615
  Distance between 3'-terminus of neighbour sequence of sequence listing upward to telomere on chrosomal short arm and 5'-terminus of this base sequence : 111063
gatgttggaagtcagaatgaagaaggaagatagcaccaaattcaactgtctgataagttttctctccaggacaaatttaccaaagtattcagattgactatatctgtggctctgctctgtgtgtgtgtgtgtgtgtgtgtgtgtatacacatacatatatttgtcttctaaggtagggatgatgtcagtgtcaattcaagctccagctctgttttattttccatgctcctgctccagcttgatacactctcagaaataggtgacagtaccgctattagt

SEQ ID NO: 10061 - DNA, 386 bp, Homo sapiens
  AL021997.1_46957
  Located on chromosome 6
  Distance between a terminus base of telomere on chromosomal short arm and 5'-terminus of this base sequence : 38219165
  Distance between 3'-terminus of neighbour sequence of sequence listing upward to telomere on chrosomal short arm and 5'-terminus of this base sequence : 4271
ttctcagaacttcagaagcaacataataggtaaacaagttcttaaaagaagtattctagataacagtaaatgggattctttcaacaatagtactctgttgcagtgagagatgatttttctgaagaatcccaaacctcacaatattctctatatttcccagccccttacacacacacacacacacacacacacaaatgtaaaatcttgatctcacatatatagaaaggctctataaatgacaggaaaaagtgaaaaaataacagcatatgtcaaagaaatacaaaataggcatgtgttacgactttaacagaaattatagaaaaacacttttagttaaatacctttacgttgttacaacagaactgatgaaaccataactttcgtag

SEQ ID NO: 10062 - DNA, 335 bp, Homo sapiens
  Z98745.1_73218
  Located on chromosome 6
  Distance between a terminus base of telomere on chromosomal short arm and 5'-terminus of this base sequence : 38356686
  Distance between 3'-terminus of neighbour sequence of sequence listing upward to telomere on chrosomal short arm and 5'-terminus of this base sequence : 137135
gtccatctatgactacagttgaacaagggtatatcaagaggcaactaagtgaaccatctgagcttcatatgtattccaccctgatctcactatgtaaaaacagctctaccttctcttctcttctcttctcttctcttctcttctcttctgatccctggacacaaagatctcaaaatgcctaggtggcagttgtagcttttacttcaatgggcttcttgctatatcccctggcaagagtggactgtctttgagactaggagtctaattttgccaagctcagaattgtgggaatgggaaatacaaatccccaagtggtctactggaagtaatgatta

SEQ ID NO: 10063 - DNA, 101 bp, Homo sapiens
  DISO7_10002130
  Located on chromosome 6
  Distance between a terminus base of telomere on chromosomal short arm and 5'-terminus of this base sequence : 38421089
  Distance between 3'-terminus of neighbour sequence of sequence listing upward to telomere on chrosomal short arm and 5'-terminus of this base sequence : 64068
tgtattacctcttccttattcctgttctgttataatttagcttgagcacacacacacacacacacacacacacacacacagacacaagaagtcagtgcagg

SEQ ID NO: 10064 - DNA, 269 bp, Homo sapiens
  chr6.fa.O7frz.30433399
  Located on chromosome 6
  Distance between a terminus base of telomere on chromosomal short arm and 5'-terminus of this base sequence : 38597127
  Distance between 3'-terminus of neighbour sequence of sequence listing upward to telomere on chrosomal short arm and 5'-terminus of this base sequence : 175937
cagtgtaggactatgcttagaaacagaggagttcttcgtcttatcatttttactggccccttgtttataccgtcagtgtttatttcaggaaactcaataacttaggcatctgtctatgcttaaactgttccccaccccgccaccacacacacacacacacacacacacatacacacacacacacacacacacacacacacacacacactgcccctttggctgcatctaccgcagggatctttggtgtgctgttaactcatgaattctac

SEQ ID NO: 10065 - DNA, 218 bp, Homo sapiens
  AL133258_25523
  Located on chromosome 6
  Distance between a terminus base of telomere on chromosomal short arm and 5'-terminus of this base sequence : 38661979
  Distance between 3'-terminus of neighbour sequence of sequence listing upward to telomere on chrosomal short arm and 5'-terminus of this base sequence : 64583
ttgcttgaacctaggaggtggaggttgcagtgagtgagatcatgccattgctctccagcctgggcaacaagagtgaaactctctctcaaataataataataataataataaagtaaaaaaaaattttttttaaagtttgctcctctatgttcttgaaccctggtatttattattatttatcatgattagggctgtgttctttgaactacataagaaga

SEQ ID NO: 10066 - DNA, 226 bp, Homo sapiens
  AL133258.16_58237
  Located on chromosome 6
  Distance between a terminus base of telomere on chromosomal short arm and 5'-terminus of this base sequence : 38694688
  Distance between 3'-terminus of neighbour sequence of sequence listing upward to telomere on chrosomal short arm and 5'-terminus of this base sequence : 32491
gagtatgtgaagcaattggaacgtgcatacatggctgatgagactgtaaactgctatatctacactgggaaactatctgaaaatatcaactaaatatatatatatatatatatatatatatatatatatatatatatgctatgaccccaaaactagacggttacatttatacccaagagaagtgcatgagcatctcccttgaaggacatgtatcagaatgtttaca

SEQ ID NO: 10067 - DNA, 324 bp, Homo sapiens
  AL133258.16_62195
  Located on chromosome 6
  Distance between a terminus base of telomere on chromosomal short arm and 5'-terminus of this base sequence : 38698617
  Distance between 3'-terminus of neighbour sequence of sequence listing upward to telomere on chrosomal short arm and 5'-terminus of this base sequence : 3703
tctgaagtagagaattgcttgaacccgggaggcagaggttgcagtgagccgagatcgggccactgcactccagcttgagcgacagagcgagactccgtctcaaaaaaagaaagaaagaagaaagagagagagagagagagagagagacagaaacaaagaaagaaagagagaaataaagagaaagaaagaaagagaaaagaaaggaaagtagcttagtggtaaaaataaaggcactgttcctgatttgtggtcaacccaagatcaactcaccccaaggtggactctccatcacgttagacttcctggagcatacttgcattctat

SEQ ID NO: 10068 - DNA, 199 bp, Homo sapiens
  D6S1624
  Located on chromosome 6
  Distance between a terminus base of telomere on chromosomal short arm and 5'-terminus of this base sequence : 38709806
  Distance between 3'-terminus of neighbour sequence of sequence listing upward to telomere on chrosomal short arm and 5'-terminus of this base sequence : 10865
tggaagtcttcagtggagagagtgttacaaatatatatatatatatgtgtttgtgtgtaaatatatatatatagatgtgtgtgtgtgtgtgtgtgtgtgtgtgtgtgtgtatacattacctttatggaattttcagaaaacagccaaaaaaaagaaaaaagaaaaaagaaacaaaaaaaccacaaacacctggagttat

SEQ ID NO: 10069 - DNA, 474 bp, Homo sapiens
  Z84474.1_84444
  Located on chromosome 6
  Distance between a terminus base of telomere on chromosomal short arm and 5'-terminus of this base sequence : 38794373
  Distance between 3'-terminus of neighbour sequence of sequence listing upward to telomere on chrosomal short arm and 5'-terminus of this base sequence : 84368
accagaatagaggacataccactacccacttattgaacatattctaaataagttttcttatcctaaaatattttatattccaatattggaatcgcctgagtccagggtggtcaaggctgcagtgagctatgattgtgctactgcactccagcctgagtgacagagtgagaccctgtataaaaaggaaggaaggaaggaaggaaggaaggaaaagaaaaaaaattatagaaaatagattgtcggttgcctgcaggttgggggaggctgagagatggggagtgactgctaaggagtatttttttttaccttgaggtgataaaaatgttctaacactgatggtgataatgtttgcacaactctgaatattctaaaagtgattgaattgaattgaatggtgtgtaaattatatctcaataaagctggtaaaaatttagtgattcaataaaatcctttatttggtcaatgtacggtatt

SEQ ID NO: 10070 - DNA, 429 bp, Homo sapiens
  chr6.fa.O7frz.32602993
  Located on chromosome 6
  Distance between a terminus base of telomere on chromosomal short arm and 5'-terminus of this base sequence : 38878829
  Distance between 3'-terminus of neighbour sequence of sequence listing upward to telomere on chrosomal short arm and 5'-terminus of this base sequence : 83982
ggtagacctactgtatatggcacagaaaagggtctcagttaatgttggctgacagaaggagtgattgaacaattatctgtacatatttaccacttacacaaggtggaaatgcacccaacatgaaatcgtacaaatgtcatggcttccaccatggaaaaaattatgtatgcgtgaggacaagagctaaaaaacaagaaagaaaatgtctagagtcacttgtgaggctggaactgtggttttctttctttcctttctttctttctctgtttctttcctttctttctttcttcctttctttctctttctctctcttctttctctctctctttctttctctctctttctctttctttctctctctttctttctttctttcttttcttttcatgttctaatattataatgatgtgacaagaacttgtagaacca

SEQ ID NO: 10071 - DNA, 197 bp, Homo sapiens
  D6S258
  Located on chromosome 6
  Distance between a terminus base of telomere on chromosomal short arm and 5'-terminus of this base sequence : 38955268
  Distance between 3'-terminus of neighbour sequence of sequence listing upward to telomere on chrosomal short arm and 5'-terminus of this base sequence : 76010
ccaaatcaagaatgtaattccctttaaaatacacacacacacacacacacacacacacacacacacacacaaaatctaggaatacttctaaccaaggaagtgaaagatttccacaaaaagaactacaaagcactgctgaaagaaatcatagatgacacaaacaaatggaaaaaccttccatgcttatggattggaag

SEQ ID NO: 10072 - DNA, 354 bp, Homo sapiens
  AL022727.1_25147
  Located on chromosome 6
  Distance between a terminus base of telomere on chromosomal short arm and 5'-terminus of this base sequence : 39005977
  Distance between 3'-terminus of neighbour sequence of sequence listing upward to telomere on chrosomal short arm and 5'-terminus of this base sequence : 50512
tggtttatttcacttagcacaatatcctccagttcatccatgttataacaaatggcaggattttctttttattggctgaataatatttctcgctgtgtgtgtgtgtgtgtgtgtgtatgagatcacattttctttatccattcctccatcaatggatgcttaggttgtttcttcatcttggctgtcatgaatagtgctgcaatgaacatgggggcatagatacctcttcggaatacttacttcatttttcttggataagtacccagtgggattattgggatcacatcacatctcacacagacttcacaaaatatgagaacatagattcctcctgcctccgtggaaatcttacca

SEQ ID NO: 10073 - DNA, 478 bp, Homo sapiens
  AL022727.1_32180
  Located on chromosome 6
  Distance between a terminus base of telomere on chromosomal short arm and 5'-terminus of this base sequence : 39012797
  Distance between 3'-terminus of neighbour sequence of sequence listing upward to telomere on chrosomal short arm and 5'-terminus of this base sequence : 6466
atggaaattatcttccttagctaggttaggaatttccttcaattaccatttacctagatgtcaccctaaaatgaatgagaacttgatagttatttttctataataaggcaaacatctaaataaaatataaaattaaaaaattattttgtatttttgtgactttttattatggtaaaatttcaaacttagagaagagttgcaaaaaagtagtacaaaagactaacatttacccttttaccagattgagtattagtttacattttcccccaaagctttgttatatcatctatcaactatctatctatttatctatctatctatctatctatctatctatctatctatctacctatctatctctttttctgggctagttgagagtaagttggagatgacacgttcctttatgccaaatactttattcagtgttttttgtctaaggaaaaggatgttactttacataagtccagcacagtac

SEQ ID NO: 10074 - DNA, 213 bp, Homo sapiens
  AC006162.1_38368
  Located on chromosome 6
  Distance between a terminus base of telomere on chromosomal short arm and 5'-terminus of this base sequence : 39562621
  Distance between 3'-terminus of neighbour sequence of sequence listing upward to telomere on chrosomal short arm and 5'-terminus of this base sequence : 549346
caaaatccttccactgcactccagcatgggggacacagcgagactccatctcaaaaaaaaaaaaaaaaccctgtatttgtgagcgcacacacacacacacacacacacacacctgtgcttggtcctagtgaataagcaagtaaatcaaatgtctaaatataattatagaaaggagatgtcaccttttggctgtacctccactatttcattctg

SEQ ID NO: 10075 - DNA, 360 bp, Homo sapiens
  AF055066.1_308034
  Located on chromosome 6
  Distance between a terminus base of telomere on chromosomal short arm and 5'-terminus of this base sequence : 39628576
  Distance between 3'-terminus of neighbour sequence of sequence listing upward to telomere on chrosomal short arm and 5'-terminus of this base sequence : 65742
ctgatacgaatttgttcatgaatattttctctatagtgtgagacagcttccttgtgtgggactgagaagcaagatatcaatgtagcagaattgcacttgtgcctcacgaacatacataaattttaaaaataaagaataaaaatatatctttttatagatacaggtagatatgtttttatagcatgcacgtaaatgtgtgtgtgtgtgtgtgtgtgtgaagagaaagagtgaatagagagattaagattcttttaatggtgaaaagatatacatatatttggaactagccagcttgactcagtttaggtgatcccaattttggtggcaacaaccaaagcatcgtagtcaggagccagtcga

SEQ ID NO: 10076 - DNA, 381 bp, Homo sapiens
  chr6.fa.O7frz.33382117
  Located on chromosome 6
  Distance between a terminus base of telomere on chromosomal short arm and 5'-terminus of this base sequence : 39658184
  Distance between 3'-terminus of neighbour sequence of sequence listing upward to telomere on chrosomal short arm and 5'-terminus of this base sequence : 29248
ttctgaccactataaggtcctcctcctccccatttcttgcgtgcttcccccttgcctcgccccctcccctttgtctccacttccccgctcctaagtatctcctgctttcttcagaggacttctcatgaagtacagactcctccacctccaggaaaaagagacaaagtccactgagaaggacctgagggatgcctgtgaccccgcccctgaggtcagcccctcccgcatcgctggctttggctctgtatgtgtgtgtgtgtgtgtgtgtgtgtgtgtgtgtgtgtttgtgtgtgcgcgcgcgcttgtgtgtgtgtctgtgtgaatgttaatggagagtcaaagtgctaaactcggcatctatcataggaaactttctcacct

SEQ ID NO: 10077 - DNA, 268 bp, Homo sapiens
  AF055066.1_278401
  Located on chromosome 6
  Distance between a terminus base of telomere on chromosomal short arm and 5'-terminus of this base sequence : 39658297
  Distance between 3'-terminus of neighbour sequence of sequence listing upward to telomere on chrosomal short arm and 5'-terminus of this base sequence : -268
gaggacttctcatgaagtacagactcctccacctccaggaaaaagagacaaagtccactgagaaggacctgagggatgcctgtgaccccgcccctgaggtcagcccctcccgcatcgctggctttggctctgtatgtgtgtgtgtgtgtgtgtgtgtgtgtgtgtgtgtgtttgtgtgtgcgcgcgcgcttgtgtgtgtgtctgtgtgaatgttaatggagagtcaaagtgctaaactcggcatctatcataggaaactttctcacct

SEQ ID NO: 10078 - DNA, 126 bp, Homo sapiens
  D6S265
  Located on chromosome 6
  Distance between a terminus base of telomere on chromosomal short arm and 5'-terminus of this base sequence : 39952208
  Distance between 3'-terminus of neighbour sequence of sequence listing upward to telomere on chrosomal short arm and 5'-terminus of this base sequence : 293643
acgttcgtacccattaacctacctctcttcatcacccccctcacacacccacaaacacacacacacacacacacacacacacccttcccagcctctggatactatctttctgctgtttacctcgat

SEQ ID NO: 10079 - DNA, 205 bp, Homo sapiens
  AB023054.1_140729
  Located on chromosome 6
  Distance between a terminus base of telomere on chromosomal short arm and 5'-terminus of this base sequence : 39995198
  Distance between 3'-terminus of neighbour sequence of sequence listing upward to telomere on chrosomal short arm and 5'-terminus of this base sequence : 42864
tttcttgtaaccacaacctcacttgatcccacaaacacatatcctcactattcccactgtccctggtttatagctatttcaaatacacacacacacacacacacacacacacacacacacacatttctatgtgtataaaacacagatatgtaaatacacacaaacatgtcctgaaggatcaaatcaaactaggattcaggaagat

SEQ ID NO: 10080 - DNA, 377 bp, Homo sapiens
  AC004191.1_22940
  Located on chromosome 6
  Distance between a terminus base of telomere on chromosomal short arm and 5'-terminus of this base sequence : 40145834
  Distance between 3'-terminus of neighbour sequence of sequence listing upward to telomere on chrosomal short arm and 5'-terminus of this base sequence : 150431
gtttcactatgttggccaggctggtctcgaactcctgaccttgtgatctgctcgcctcagcctcccaaagtgctgggattacaggcatgagccaccacgcccgcccccctctttcttttcttttcttttcttttcttttttttttttttaagagacaagggtctccttatgttgcccaggccggactcctgggctcctgggctcaagcgatcctctcacttcagactcccaagtacctgggaatacaggcacatactgccacactcagctgtgtagttctattttatctcttctatttgcctgtcccttttttccctcctacttttatggattgttgagccctgcttttacaaagtaccttaatttctagcatatgg

SEQ ID NO: 10081 - DNA, 265 bp, Homo sapiens
  AB014085.1_16319
  Located on chromosome 6
  Distance between a terminus base of telomere on chromosomal short arm and 5'-terminus of this base sequence : 40261402
  Distance between 3'-terminus of neighbour sequence of sequence listing upward to telomere on chrosomal short arm and 5'-terminus of this base sequence : 115191
tagtattggaagttctagccagagtaactaggcaagaaaaataaagtaaaacacccaaaatggaaaggaagaagtagaattatctttgttagaagacagcatgatcatatatgcagaaaaccctaaggattacacacacacacacacacacacacacacacacacagaggaagagagagagagagcactaataaacaaattcagcaaagttgcaggatacaaaatcaatatgtagcagtcagttgtatttctataccatgccttg

SEQ ID NO: 10082 - DNA, 110 bp, Homo sapiens
  HUMUT680
  Located on chromosome 6
  Distance between a terminus base of telomere on chromosomal short arm and 5'-terminus of this base sequence : 40267644
  Distance between 3'-terminus of neighbour sequence of sequence listing upward to telomere on chrosomal short arm and 5'-terminus of this base sequence : 5977
gaggaagatgatgggaagctttgaagggctgcccttgactctgtgtgtgtgtgcgtgtgtgtgtgcgtgtgtgtgtgtgtgtgtgcatgtgcgtgccccttattctctct

SEQ ID NO: 10083 - DNA, 411 bp, Homo sapiens
  AC004207.1_36642
  Located on chromosome 6
  Distance between a terminus base of telomere on chromosomal short arm and 5'-terminus of this base sequence : 40280926
  Distance between 3'-terminus of neighbour sequence of sequence listing upward to telomere on chrosomal short arm and 5'-terminus of this base sequence : 13172
caagccaggaactgttatttagtagaagaataaagaataaagcttttcttcgaagccctggaacttgagcagtgagctcctatgcctgtttcacacacacacacacacacacacacacacacacgcacacacacacacacacgcacacacacacacacacacacacacatatccaaggaagcatttaggccaaatggcagatatgtttgatgcctgcctggatcagaatgacatttccatttcttatggaatgttttgaacttgtactaacttaccggattttggtgcagagaaatcccctcacaagataagaaatcacattttttctttgttgaaattatttatcttcattaacgtttaataacaccggtgcagttatttttcaaagagcttgtactccaatcttggagg

SEQ ID NO: 10084 - DNA, 411 bp, Homo sapiens
  AP000514.1_98099
  Located on chromosome 6
  Distance between a terminus base of telomere on chromosomal short arm and 5'-terminus of this base sequence : 40344359
  Distance between 3'-terminus of neighbour sequence of sequence listing upward to telomere on chrosomal short arm and 5'-terminus of this base sequence : 63022
cttctatgctgattttgctgaggcttttaatcataaagggatgctggattttatcgaatacttttctgcattttattgaaacgattatttcagagagagagagagagagggagggagggagggagagagagagagagagagagatggggtgaaggaacaggctgggaacctgggaggagacccggccgcaggcgcgaagcctggaggcgatggtgagccctgccacgcgtgagtcacggaccacccccgccgcgctctgcaccccgcctggctctcttcttcccagcccctcccttcctcctcctgtccgctgatccctactcaggcttctttcgcttaagaattccagaagggacagaactaaggatgaagtgtggcatttgaacagggtttacggctagatcctaggag

SEQ ID NO: 10085 - DNA, 374 bp, Homo sapiens
  AP000513.1_1054
  Located on chromosome 6
  Distance between a terminus base of telomere on chromosomal short arm and 5'-terminus of this base sequence : 40541355
  Distance between 3'-terminus of neighbour sequence of sequence listing upward to telomere on chrosomal short arm and 5'-terminus of this base sequence : 196585
tgcagtcacagaatagtgacacaaatggcccaaaatttaaatgttacttttagaagataacactcagagtttataacatttccaaccagataatgaaattgatatggagaaaccaaacctcagaggcactaaaatgctgtccagattccccatcccatatacacacacacacacacacacacacacacacacaaacacacttactgacagtctgagccccactccttcctcttcctcaccacctccaccttaccaacttctgacagctgtacagtgcttgcttgcacagaagagcccccttcctgagctggctctgtggccaggaaaggatgtaaccaccatccaaacagcagtctgtaaccagctatgagcat

SEQ ID NO: 10086 - DNA, 103 bp, Homo sapiens
  DISD22_0011527
  Located on chromosome 6
  Distance between a terminus base of telomere on chromosomal short arm and 5'-terminus of this base sequence : 40713790
  Distance between 3'-terminus of neighbour sequence of sequence listing upward to telomere on chrosomal short arm and 5'-terminus of this base sequence : 172061
agtggcttaagctctgcccagcatgttcttgaccctgtgtgcctgtggggtgtgtgtgtgtggtgtgtgtgtgtgtatgtgcacacagtcatgtgcactctca

SEQ ID NO: 10087 - DNA, 104 bp, Homo sapiens
  DISD22_0011530
  Located on chromosome 6
  Distance between a terminus base of telomere on chromosomal short arm and 5'-terminus of this base sequence : 40792003
  Distance between 3'-terminus of neighbour sequence of sequence listing upward to telomere on chrosomal short arm and 5'-terminus of this base sequence : 78110
tgcaggatatggagtttggggtgggagggaggactgtgtgtgtgtgtgtgtgtgtgtgtgtgtgtgtgagtgtgtgtgtgtaggggggctggtaagtagggtgg

SEQ ID NO: 10088 - DNA, 294 bp, Homo sapiens
  AC004196.1_10556
  Located on chromosome 6
  Distance between a terminus base of telomere on chromosomal short arm and 5'-terminus of this base sequence : 40970469
  Distance between 3'-terminus of neighbour sequence of sequence listing upward to telomere on chrosomal short arm and 5'-terminus of this base sequence : 178362
tatcacggttaaattgagaaatagttatatttttctcatagcagagtctttcaaacaatacgcaatgacaatcaaaatagcaaagtagctgtggaaacagtgtccatggcgaccaatggtcccatcttttctttctttctttttttctttctttctttctttctttcttcttctttttctttctttttcaaggtctctgagtttcaagtcaagcctaaaaaaaattttaagtttttttaatttgctggaatgcagtggcatgatcatggctcatagaagccttaatctcactgg

SEQ ID NO: 10089 - DNA, 315 bp, Homo sapiens
  AC004205.1_20618
  Located on chromosome 6
  Distance between a terminus base of telomere on chromosomal short arm and 5'-terminus of this base sequence : 41220139
  Distance between 3'-terminus of neighbour sequence of sequence listing upward to telomere on chrosomal short arm and 5'-terminus of this base sequence : 249376
gtaatgctgataacatttactgtcttttatttctgtaagtgctcacatggttacagctggttatttatttatttatttacttacttatttatttgagacagggtcttgttctgttgcccaggctggagtgcagtggcattaccttggctcactacaacctccacctcctgggcacaagtgatcctcctacctcaacctcctaagtagctgggactacaagcacaccaccaagtctgactaattttttgtaatttattttcagtagagatggagtttcagcattttgctcaggttggtctcacattcctagactta

SEQ ID NO: 10090 - DNA, 219 bp, Homo sapiens
  U65416.1_5752
  Located on chromosome 6
  Distance between a terminus base of telomere on chromosomal short arm and 5'-terminus of this base sequence : 41402404
  Distance between 3'-terminus of neighbour sequence of sequence listing upward to telomere on chrosomal short arm and 5'-terminus of this base sequence : 181950
gttggatcatacggtatttcattttttaatttttagaggaatcaccatagtgttttccattgcaggcgtgccattttgtatttctagaagcagtatacaggggcttcagtttctctacctccttgccaaacttgctgtttgtgtgtgtgtgtgtgtgtgtgtgtgtgtgtgtgtgtgtgtgtgtgataatagccaccctgattggtttgaagtggtatc

SEQ ID NO: 10091 - DNA, 132 bp, Homo sapiens
  D6S273
  Located on chromosome 6
  Distance between a terminus base of telomere on chromosomal short arm and 5'-terminus of this base sequence : 41614450
  Distance between 3'-terminus of neighbour sequence of sequence listing upward to telomere on chrosomal short arm and 5'-terminus of this base sequence : 211827
accaaacttcaaattttcggcattagttaaggaccagggaggggtgtgtgtgtgtgtgtgtgtgtgtgtgtgtgtgtgtacatgtttttaatattttattttaacataattttggattgacagaaaagttgc

SEQ ID NO: 10092 - DNA, 277 bp, Homo sapiens
  AF129756.1_10918
  Located on chromosome 6
  Distance between a terminus base of telomere on chromosomal short arm and 5'-terminus of this base sequence : 41637449
  Distance between 3'-terminus of neighbour sequence of sequence listing upward to telomere on chrosomal short arm and 5'-terminus of this base sequence : 22867
ttccaattactggttagcacagctaggtcatctcacccccaccatctttcctaacttcttgggttggggggctggggaggaatctccccatctcagggtactaggaacaaagctggggaggatggtgcatttaaagggattatatatatatatatatatattttttttctttctccctcataaccccacccccgcaacacacacacacacacacacacacacacacacacacacacacacagacgcacaaataagctttatggagcagtgacttcat

SEQ ID NO: 10093 - DNA, 145 bp, Homo sapiens
  D6S1615
  Located on chromosome 6
  Distance between a terminus base of telomere on chromosomal short arm and 5'-terminus of this base sequence : 41639815
  Distance between 3'-terminus of neighbour sequence of sequence listing upward to telomere on chrosomal short arm and 5'-terminus of this base sequence : 2089
tctccagagaggtggggatggaaccatgaattcctctgctctctgggattgcagatgtgttacacacacacacacacacacacacacacacacacacacacacatattttttttttctagacagagtcttgctctgttacccagg

SEQ ID NO: 10094 - DNA, 134 bp, Homo sapiens
  D6S1014
  Located on chromosome 6
  Distance between a terminus base of telomere on chromosomal short arm and 5'-terminus of this base sequence : 42089587
  Distance between 3'-terminus of neighbour sequence of sequence listing upward to telomere on chrosomal short arm and 5'-terminus of this base sequence : 449627
gggtctgaccactgagacacatagcagcagcagcagcagcagcagcagcagtgaagggggctgcattccacagccccttctccaagccccagtccctgtccctcttcaggcagggaccctcagagctctcactg

SEQ ID NO: 10095 - DNA, 257 bp, Homo sapiens
  D6S1061
  Located on chromosome 6
  Distance between a terminus base of telomere on chromosomal short arm and 5'-terminus of this base sequence : 42108099
  Distance between 3'-terminus of neighbour sequence of sequence listing upward to telomere on chrosomal short arm and 5'-terminus of this base sequence : 18378
tgtttttctaactttggggacaaaagattttctttctttctttctttctttctttccttccttccttccttccttccttccttctttctttccttccttccttccttcattccttctttccttccttccttccttccttctttctttccttccttccttctttccttccttccttccttccttctttccttccttccttccttccttccttccttctttctttctttccttctttcgcaacaaaggcatgataagaa

SEQ ID NO: 10096 - DNA, 311 bp, Homo sapiens
  AF044083.1_23738
  Located on chromosome 6
  Distance between a terminus base of telomere on chromosomal short arm and 5'-terminus of this base sequence : 42132261
  Distance between 3'-terminus of neighbour sequence of sequence listing upward to telomere on chrosomal short arm and 5'-terminus of this base sequence : 23905
gtttcaccatgttagccaggatggtcttgatctcctgacctcgtgatccacctgccttggcctcccaaagtgctgggattacaggcatgagccaccacgcccggcctatttatttatttatttatttattttgagactgagtgcaaaagtgtgtcacccaggttggagtgcaatggcgctatatcggctcactgcaacctccaccttctggattcaagtgattctcatgcctcagcctccgaagtagctgggactacaggtgtgtgccaccacgcccagcctctgattagtttcttacatgtactgctcac

SEQ ID NO: 10097 - DNA, 358 bp, Homo sapiens
  AF044083.1_13960
  Located on chromosome 6
  Distance between a terminus base of telomere on chromosomal short arm and 5'-terminus of this base sequence : 42141998
  Distance between 3'-terminus of neighbour sequence of sequence listing upward to telomere on chrosomal short arm and 5'-terminus of this base sequence : 9426
gtgccttacatttcacttaacataatgtcctccaggttcatccatgttgtcacaaatgacagaatttccttgttttttaaaagctgaatagtattccactacatacatacatacatacatatatatatatatatatatatatatatatatatatatatatatatatatatatcacattttctttatccatttgatgcaggacagacatgccccaaaattagagcttagcccaggaaagttcttgactttgcccaggaatgaattcaagggcaagccagtggttttagacagcaatcttttattgaactttattgctccttgcagagcagggctaactcatagataatgtgccaagttg

SEQ ID NO: 10098 - DNA, 327 bp, Homo sapiens
  AL034394.2_36696
  Located on chromosome 6
  Distance between a terminus base of telomere on chromosomal short arm and 5'-terminus of this base sequence : 42232683
  Distance between 3'-terminus of neighbour sequence of sequence listing upward to telomere on chrosomal short arm and 5'-terminus of this base sequence : 90327
ttgagttctggagataggactagtcagaaagagagaaagagggaaggaaagagagagagagagagagagagagagagagagagagagagagagagagagagacagccgagggaacatctataggcagccctggtgagtggatactgaaagagaacattgagtgttggggcgtgagggttagggatagccatggtacattgaaattagtggtactggtgtgtcccttcaaaaaagtagacagcgcattgccatcttctcataactctcacgtttcaaaacctgaatttgatatccagctccctcctcagctaggtgaacttgagtaag

SEQ ID NO: 10099 - DNA, 381 bp, Homo sapiens
  AL034394.2_25349
  Located on chromosome 6
  Distance between a terminus base of telomere on chromosomal short arm and 5'-terminus of this base sequence : 42243906
  Distance between 3'-terminus of neighbour sequence of sequence listing upward to telomere on chrosomal short arm and 5'-terminus of this base sequence : 10896
ttacatttagagattcgaaatgagaatatatactttacaaattaaaccacatactttgacattttctttaaaaactacatttataaattgtatggtaacaccaatgtttatctattccctgggccaatctactaaattatcatgatatggataataatcctccatggcaatgtcaaagatggtatttaaatagacatttgatagatagatagatagatagatagatgatagacacacacataaaatttgtttgatttttattatttctatacctggagtcaaggggttaactgagctaggtgcaatctgattctttttattctaagtaaaatagccaggcacagaaagacaaatactgtgatctcacttatacatggaatc

SEQ ID NO: 10100 - DNA, 334 bp, Homo sapiens
  Z84814.1_105321
  Located on chromosome 6
  Distance between a terminus base of telomere on chromosomal short arm and 5'-terminus of this base sequence : 42295008
  Distance between 3'-terminus of neighbour sequence of sequence listing upward to telomere on chrosomal short arm and 5'-terminus of this base sequence : 50721
gaagaacaaatacgttgaactcactgagtacttttgtaccccattgtttactattgtacagttgtatgaatatcatgtactttacaaatttttattttagaaacatttctattcattcgcttattcattttccaacctgcttattccagttcaaggtcatggatgactggagcctatcccggcagctcaaggacaagagaggaaccaaccttgtataggatgccatcccatccattgtgggatgcagacacacacacacatacacacacacacacacacacacacaaagtcactctgctgggacaatttagactcaccaattaacctaacatgc

SEQ ID NO: 10101 - DNA, 448 bp, Homo sapiens
  chr6.fa.O7frz.36045595
  Located on chromosome 6
  Distance between a terminus base of telomere on chromosomal short arm and 5'-terminus of this base sequence : 42396112
  Distance between 3'-terminus of neighbour sequence of sequence listing upward to telomere on chrosomal short arm and 5'-terminus of this base sequence : 100770
cttgaactcttgaccacgtgatctgcccacctcagcctctcaaagtgctgggactacaggcttgagccaccatgcacagccctgtttttgtttgtttgtttgtttgttttttagacggagtctcactctgtcgcccaggctggagtgcagtggcgcgatcttggctcactgcaacctccacctcccggcttcacgccattctctgcctcagcctcccaagtagctgggattacaggcacctgccaccatgccctgctaatgtttttgtatttttagtagagacgaggtttcaccatcttggccaggctggtcttcaagtcctgacctcgtgatccacccgccttggcctcccaaagttctgggattacaggtgtgaaccatcacacctagcaacaatgtcttatttttttaaaaaagaattattttaacaggtttactgaagcataat

SEQ ID NO: 10102 - DNA, 225 bp, Homo sapiens
  chr6.fa.O7frz.38444552
  Located on chromosome 6
  Distance between a terminus base of telomere on chromosomal short arm and 5'-terminus of this base sequence : 42398099
  Distance between 3'-terminus of neighbour sequence of sequence listing upward to telomere on chrosomal short arm and 5'-terminus of this base sequence : 1539
ataacatgtcagcatacttgagttctaaaaacaatcctttttacttgcttttttgttttattgtaattgagttaatggctgacatttaatactcaatgtgagtatattatatatgtttatatgtttttaaaatatatatatatttaaatatatgtataataaatatatatgtatttaaaaagacccagaaaccctgaattgaggatgcctatcgggaatctctag

SEQ ID NO: 10103 - DNA, 320 bp, Homo sapiens
  U92032.1_56036
  Located on chromosome 6
  Distance between a terminus base of telomere on chromosomal short arm and 5'-terminus of this base sequence : 42492582
  Distance between 3'-terminus of neighbour sequence of sequence listing upward to telomere on chrosomal short arm and 5'-terminus of this base sequence : 94258
acagtctgtactggcacatagtaagtagtcagtaggtgttaacaattagtgttattgttattttctggagaccaactaacaaatcccatagcggatgacaccacagggatgaaaccaacaagatccagaatatgggaacttccactagataactccatttttttagcaacaattcaaagacagacagagagagagagagagagagagagaaagaagagaagagaagagaagagaagctatacatttttaaaaggctgaagaaatatatgaaccaaattgatatgaggcaatcagaaaaattgacaccgactgtattaagg

SEQ ID NO: 10104 - DNA, 101 bp, Homo sapiens
  DISD22_0000187
  Located on chromosome 6
  Distance between a terminus base of telomere on chromosomal short arm and 5'-terminus of this base sequence : 42590587
  Distance between 3'-terminus of neighbour sequence of sequence listing upward to telomere on chrosomal short arm and 5'-terminus of this base sequence : 97685
gaacccagcattctggaggtgtgtgcatttgtgtgtgtgtgtgtgtgtgcgtgtgtgtgtgtaaggcttacattgaatggcattataaccagagtcataca

SEQ ID NO: 10105 - DNA, 159 bp, Homo sapiens
  DISD22_0000191
  Located on chromosome 6
  Distance between a terminus base of telomere on chromosomal short arm and 5'-terminus of this base sequence : 42727370
  Distance between 3'-terminus of neighbour sequence of sequence listing upward to telomere on chrosomal short arm and 5'-terminus of this base sequence : 136682
cattgtggttggaatagatacacacagtgattgatttaggtagattagaaggtggatggatagatagatagatagatagatagatagatagatagatagatagatatgcgcacacacattcctctccttgagtccccctgggtaagccgaggcatgagt

SEQ ID NO: 10106 - DNA, 322 bp, Homo sapiens
  AL031228.1_137386
  Located on chromosome 6
  Distance between a terminus base of telomere on chromosomal short arm and 5'-terminus of this base sequence : 42989740
  Distance between 3'-terminus of neighbour sequence of sequence listing upward to telomere on chrosomal short arm and 5'-terminus of this base sequence : 262211
gcttgatttagccattaaacaatgtgtgtgtgtgtgtatatatatatatatatatatatatataaacatcatattgtataccataaacagattcaatttttgtcaattaaagaattaaatgaatacatatatttttgttgcacagatgtatgagagattgatcaataaagattctaaaatatttgttaaaagttacaaactgagggaaagccttcgacatcgtatttgcaagaaagaaagtgtacatagttagacagtcctagtatctgtaaagtgggtgtgatcatcggagagcaatcccttgagcagtgctgtcctatac

SEQ ID NO: 10107 - DNA, 226 bp, Homo sapiens
  AL031228.1_129887
  Located on chromosome 6
  Distance between a terminus base of telomere on chromosomal short arm and 5'-terminus of this base sequence : 42997258
  Distance between 3'-terminus of neighbour sequence of sequence listing upward to telomere on chrosomal short arm and 5'-terminus of this base sequence : 7196
atttggatcatgagtcaaacacacacacacacacacacacacacaaaacctacaaaacaatcttggaaatctgaacactgactggatatttgatgacaacaggaatgattattaaaattgtggtaacagaattgtgattacattttaagagtaaaccagtaaaatctttaacaaagacacaaggagggcccatggatccattatgtacagtagccacagtgcctag

SEQ ID NO: 10108 - DNA, 307 bp, Homo sapiens
  D84401.1_37366
  Located on chromosome 6
  Distance between a terminus base of telomere on chromosomal short arm and 5'-terminus of this base sequence : 43046686
  Distance between 3'-terminus of neighbour sequence of sequence listing upward to telomere on chrosomal short arm and 5'-terminus of this base sequence : 49202
ggttggtcagatgcttgagggtgctggggagcacctggggggtctgagggaggtaccagcattcagccctctccagaatcggcagccactctccttcccacagacatgggatccgctgtaactctgtcctcccagggttcattgcaacacccatgacacagaaagtgccacagaaagtggtggacaaggtaggaggctgtgggtggagggcagaatcattcagagactcaatctctctgggcttcacagagagagagagagagagagagagagaatactgggcacagttcctggcaaacattaaata

SEQ ID NO: 10109 - DNA, 411 bp, Homo sapiens
  Z97183.1_16345
  Located on chromosome 6
  Distance between a terminus base of telomere on chromosomal short arm and 5'-terminus of this base sequence : 43175312
  Distance between 3'-terminus of neighbour sequence of sequence listing upward to telomere on chrosomal short arm and 5'-terminus of this base sequence : 128319
tgagatcgtgtcactgcactccagcctgggcgacagagcgagactctgtttcagaaaaaaaaaaaaaaaaaaaatacaaaatgttagccgggcgtggtcgtgggtgcctgtaatcccagctactcaatcgggaggctgaggcaggaaaattgcttgaacctgggaggcagaggttgcactgagccgagatcttgccattgcactccagcctgggtgacagagcaagattccgtctcaaaacacacacacacacacacacacacacacacaaaagactgccagcaaaccaccggaaactagtagaaaggcctggaacagattctcccttacacccctcagaaagaaccaaccctgcctacaccttgatctcagacttccagcctccagaactgtaaggcaatacatttctgc

SEQ ID NO: 10110 - DNA, 231 bp, Homo sapiens
  D6S1701
  Located on chromosome 6
  Distance between a terminus base of telomere on chromosomal short arm and 5'-terminus of this base sequence : 43175524
  Distance between 3'-terminus of neighbour sequence of sequence listing upward to telomere on chrosomal short arm and 5'-terminus of this base sequence : -199
ggtgacagagcaagattccgtctcaaaacacacacacacacacacacacacacacacaaaagactgccagcaaaccaccggaaactagtagaaaggcctggaacagattctcccttacacccctcagaaagaaccaaccctgcctacaccttgatctcagacttccagcctccagaactgtaaggcaatacatttctgctgtttaagtctcccagtttgtgatactttgtt

SEQ ID NO: 10111 - DNA, 434 bp, Homo sapiens
  AL050332.15_35876
  Located on chromosome 6
  Distance between a terminus base of telomere on chromosomal short arm and 5'-terminus of this base sequence : 43250497
  Distance between 3'-terminus of neighbour sequence of sequence listing upward to telomere on chrosomal short arm and 5'-terminus of this base sequence : 74742
gccttatttcggtatttctgagggcagccctagcattggaggatgggagatcttgggaaaaatgttgtattggttacgctgcaaacttttatcctgtctaaccccctgcccccaggtgaaccagtgtgttattggtactgctcaggccaacaggaagtgaagacggatccagatctgtgtgtgtgtgtgtgtgtgtgtgtgtgtgtgtgtgtgtgtgtgtgtgtccctatgtctatgtatcgggtgaggggtgggagggttgctggagggtgctttattgggtggagggcaccatgtcccagggctatcaaataaagaatagtttggttttttttttaaataaaggttttattagcatttgcccaagaaggcagatactttcatatctgtaaaagtgggagctgtgatctgtaccctctgccaaacgtttacgt

SEQ ID NO: 10112 - DNA, 434 bp, Homo sapiens; identical to SEQ ID NO: 10111
  AL021366.1_25644
  Located on chromosome 6
  Distance between a terminus base of telomere on chromosomal short arm and 5'-terminus of this base sequence : 43250497
  Distance between 3'-terminus of neighbour sequence of sequence listing upward to telomere on chrosomal short arm and 5'-terminus of this base sequence : -434

SEQ ID NO: 10113 - DNA, 272 bp, Homo sapiens
  Z93017.6_2832
  Located on chromosome 6
  Distance between a terminus base of telomere on chromosomal short arm and 5'-terminus of this base sequence : 43336313
  Distance between 3'-terminus of neighbour sequence of sequence listing upward to telomere on chrosomal short arm and 5'-terminus of this base sequence : 85382
ttattggtgactatttggatttatttatttatttatttatttatttttgaaacagagtcttgctctgtcacccaggctggagtgctatggcacgatcttggctcactgcaacctccgcctcctgggttcaagcaattctcctgcctcagcctcccgagtagctgggattacaggctcccgccaccatgtctggctaatttttgtatttttagtagagacaaggtttcaccatgttggtcaggctggtctcaaactcctgacctcatgataat

SEQ ID NO: 10114 - DNA, 234 bp, Homo sapiens
  D6S1560
  Located on chromosome 6
  Distance between a terminus base of telomere on chromosomal short arm and 5'-terminus of this base sequence : 43427847
  Distance between 3'-terminus of neighbour sequence of sequence listing upward to telomere on chrosomal short arm and 5'-terminus of this base sequence : 91262
ctccagcccccactgcctgggtagggtaggcataatgccttcttggtggtagtgtttctaaattcaggaccctggccccctgagtgagtgcacactgcatgcacataaacacacacacacacacacacacacacacacttctccatcagtctctctgtttctcacttgactcagagtcacaatgtccattatttttgtctcaactttgctattcctttgctatgtggccttggg

SEQ ID NO: 10115 - DNA, 92 bp, Homo sapiens
  DISO7_10017355
  Located on chromosome 6
  Distance between a terminus base of telomere on chromosomal short arm and 5'-terminus of this base sequence : 43427930
  Distance between 3'-terminus of neighbour sequence of sequence listing upward to telomere on chrosomal short arm and 5'-terminus of this base sequence : -151
gtgagtgcacactgcatgcacataaacacacacacacacacacacacacacacacttctccatcagtctctctgtttctcacttgactcaga

SEQ ID NO: 10116 - DNA, 189 bp, Homo sapiens
  D6S1583
  Located on chromosome 6
  Distance between a terminus base of telomere on chromosomal short arm and 5'-terminus of this base sequence : 43592339
  Distance between 3'-terminus of neighbour sequence of sequence listing upward to telomere on chrosomal short arm and 5'-terminus of this base sequence : 164317
gcagatggccccactgactgggaagcaagggtgttaccacttaggtcctcagggacagacaacctctgcaggccgtgtgtgtgtgtgtgtgtgtgtgtgtgtgtgtgtgtttggccccgggaatgggaggtgtgaggggagccaccatgcccaccctatggccatgatcagtagaagcaggttaggggc

SEQ ID NO: 10117 - DNA, 233 bp, Homo sapiens
  D6S1629
  Located on chromosome 6
  Distance between a terminus base of telomere on chromosomal short arm and 5'-terminus of this base sequence : 43660955
  Distance between 3'-terminus of neighbour sequence of sequence listing upward to telomere on chrosomal short arm and 5'-terminus of this base sequence : 68427
agctgagggctgctgatgctagggaaggggtatctggggctccccaattatctctgcttgtgtgtgtgtgtgtgtgtgtgtgtttaaattctccagaataaaaaagttaaaaagaaaaccaaaaaagaataaaacccagcatcactttgaaaataaaaactttcaactgagctttcagtacaagtcactgtgtatgaaattcccaatgacaaaaatccactatgggttcagca

SEQ ID NO: 10118 - DNA, 116 bp, Homo sapiens
  D6S1542
  Located on chromosome 6
  Distance between a terminus base of telomere on chromosomal short arm and 5'-terminus of this base sequence : 43910553
  Distance between 3'-terminus of neighbour sequence of sequence listing upward to telomere on chrosomal short arm and 5'-terminus of this base sequence : 249365
ctttacaacccttggcagcccccagtgtgtgtgtgtgtgtgtgtgtgtgtgtgtgtgtgtgtgtgaccctgagcgcctgcctcttctcccaggagggtctccctgatgcacccagt

SEQ ID NO: 10119 - DNA, 88 bp, Homo sapiens
  D6S1568
  Located on chromosome 6
  Distance between a terminus base of telomere on chromosomal short arm and 5'-terminus of this base sequence : 43928697
  Distance between 3'-terminus of neighbour sequence of sequence listing upward to telomere on chrosomal short arm and 5'-terminus of this base sequence : 18028
acatgaccagaacttcccagacatgcacccctacacacacacacacacacacacacacacacacacacacacacgtcctggcctagct

SEQ ID NO: 10120 - DNA, 101 bp, Homo sapiens
  DISO7_10002135
  Located on chromosome 6
  Distance between a terminus base of telomere on chromosomal short arm and 5'-terminus of this base sequence : 44011655
  Distance between 3'-terminus of neighbour sequence of sequence listing upward to telomere on chrosomal short arm and 5'-terminus of this base sequence : 82870
gcatctgaaattcattccatcattacagtaataataataataataataataataacaataataaaagaaaaaatataaatgtccaacaagagacaattggt

SEQ ID NO: 10121 - DNA, 119 bp, Homo sapiens
  HUMUT6615
  Located on chromosome 6
  Distance between a terminus base of telomere on chromosomal short arm and 5'-terminus of this base sequence : 44304378
  Distance between 3'-terminus of neighbour sequence of sequence listing upward to telomere on chrosomal short arm and 5'-terminus of this base sequence : 292622
ctaattgcaataaccctatgaggcaagtgtaaccatcatcatcatcatcatcatcatcatcatcaatacaacaaaactaactgagtacgtatgtgctaagcagttcacctaattgtctt

SEQ ID NO: 10122 - DNA, 146 bp, Homo sapiens
  HUMUT2253
  Located on chromosome 6
  Distance between a terminus base of telomere on chromosomal short arm and 5'-terminus of this base sequence : 44363407
  Distance between 3'-terminus of neighbour sequence of sequence listing upward to telomere on chrosomal short arm and 5'-terminus of this base sequence : 58910
cagttgcacctttccctagctgggtgtattaggctccccagagagacagaaccaattggatggatgggtggatggatggatggatggatgacagatggatagataggtaggtagagaaagatggatgagaagggatttattagggg

SEQ ID NO: 10123 - DNA, 395 bp, Homo sapiens
  chr6.fa.O7frz.40115462
  Located on chromosome 6
  Distance between a terminus base of telomere on chromosomal short arm and 5'-terminus of this base sequence : 44514499
  Distance between 3'-terminus of neighbour sequence of sequence listing upward to telomere on chrosomal short arm and 5'-terminus of this base sequence : 150946
gataaacagtaagattggtgacacatgcctgtaatgccagcactttgggaggccaaggcaaaaggatggcttgagctcaggagttcaaaactagcctgggcaacacagtgcaacactgagtgtggtggcacatgcctgtagttccaggtactggagtggctgaggaggatcacctgtgcgcaggaggtcaaggctgcagtgagctgtgatcatgccgctgggtgacagagagatcctgtctcaaaaacagtaacaaccacatacacacacacacacacacacacacacgctgggtgacagagagatcctgtctcaaaaacagtaacaaccacatacacacacacacacacacacacacacacacacgaaaactgatttagccaaattacaaataa

SEQ ID NO: 10124 - DNA, 263 bp, Homo sapiens
  AL033520.16_3307
  Located on chromosome 6
  Distance between a terminus base of telomere on chromosomal short arm and 5'-terminus of this base sequence : 44686946
  Distance between 3'-terminus of neighbour sequence of sequence listing upward to telomere on chrosomal short arm and 5'-terminus of this base sequence : 172052
ctaatccatgaacatggaatatctttccatttttttgtgtccacttccatttcttttccctcccctcccctcccctcccctcccctcccctccctttcccttcccttccctccttccttctttccttgcttccattttttttgagacagagccttgctctgtcacccaggctggagtactgtggcgcaatctcagctcactgcatcctccacttcccaggttcaagcgattctcctgcctcagcctctggagtagccgagaat

SEQ ID NO: 10125 - DNA, 276 bp, Homo sapiens
  AL033520.16_9763
  Located on chromosome 6
  Distance between a terminus base of telomere on chromosomal short arm and 5'-terminus of this base sequence : 44693404
  Distance between 3'-terminus of neighbour sequence of sequence listing upward to telomere on chrosomal short arm and 5'-terminus of this base sequence : 6195
tctaccatagttgagctggtatccaaattgcaagacaaagtcccctgtattcgcccctctcctctcctctcctctcctctcctctcctctcctctcctctcctcaggtgcaaggaagcagtctctcccagagctgcaaactgtgctgcatggggttgggggaggggtgatgcaagcattcctttggctatcccagttggcatctcaggtcacttgcaccccaagtccattggctctgatcccagcatagcaccagtagttgctcaggaattaacaa

SEQ ID NO: 10126 - DNA, 113 bp, Homo sapiens
  DISO7_10017368
  Located on chromosome 6
  Distance between a terminus base of telomere on chromosomal short arm and 5'-terminus of this base sequence : 44764985
  Distance between 3'-terminus of neighbour sequence of sequence listing upward to telomere on chrosomal short arm and 5'-terminus of this base sequence : 71305
gcacttgacatagaatagagggggctttttcgtgtgtgtgtgtgtgtgtgtgtgtgtgtgtgtgtgtgtatttttcttttcccctgtatttgtgggtgttaatatgaaccatc

SEQ ID NO: 10127 - DNA, 278 bp, Homo sapiens
  D6S439
  Located on chromosome 6
  Distance between a terminus base of telomere on chromosomal short arm and 5'-terminus of this base sequence : 45025229
  Distance between 3'-terminus of neighbour sequence of sequence listing upward to telomere on chrosomal short arm and 5'-terminus of this base sequence : 260131
gatgatttaagtttcctgtggacctagtgatcagattcacagaaactcaggcttcacaactttggcactactcatattttgggctggataattttttgttgtgggtggggctgtcctgtgcttcagaggatgtttcgtggtacccctattctccacccactagatgtcaatagcagacagacagacagacagacacacacacacacacacacacacacacacacacacacaccagtcaaaatgattaaaaatgtgtcttccctgaggctgtccttgaa

SEQ ID NO: 10128 - DNA, 398 bp, Homo sapiens
  chr6.fa.O7frz.40729330
  Located on chromosome 6
  Distance between a terminus base of telomere on chromosomal short arm and 5'-terminus of this base sequence : 45113094
  Distance between 3'-terminus of neighbour sequence of sequence listing upward to telomere on chrosomal short arm and 5'-terminus of this base sequence : 87587
aggtggctcatacttgttaatctcagcactttgggaggctgaggtgagatgatcacttgaggccaggagttcaagaccagcctgggcaacatagcaagaccccatctctacaaaaataagtaaatagagatagatgtaagtaaataaataaattagccaggcttggtagtgcacacctgtagtcccagatatttgagagtctcaggcaagaagattactttagtctaggagttcaaggttgcagtgagctatgatcatgccgttgcacttgtagtgtgggtgacagagcaagaccctgtttctgtgtgtgtgtgtgtgtgtgtgtgtgtgtgtgtgtgtgtgtgtatgtatatgcacatatatatatccaagaggtagttggacttctggtagttaaa

SEQ ID NO: 10129 - DNA, 242 bp, Homo sapiens
  D6S1645
  Located on chromosome 6
  Distance between a terminus base of telomere on chromosomal short arm and 5'-terminus of this base sequence : 45455955
  Distance between 3'-terminus of neighbour sequence of sequence listing upward to telomere on chrosomal short arm and 5'-terminus of this base sequence : 342463
caggagaaccacttgaacctgggaggcggaagttgcagcgagctgagattgcaccactgtactccagcctgggcgacagagtgagactctgtcgcaaacaacaacaacaacaacaacaacaacaactacacacacacacacacacacacacacacacagaggctgatgtagaaatacatatagatgtatacgtatgtatgttgaggtccatatattctctatctctctgtctgctaagtggg

SEQ ID NO: 10130 - DNA, 427 bp, Homo sapiens
  Z99128.1_452
  Located on chromosome 6
  Distance between a terminus base of telomere on chromosomal short arm and 5'-terminus of this base sequence : 45667619
  Distance between 3'-terminus of neighbour sequence of sequence listing upward to telomere on chrosomal short arm and 5'-terminus of this base sequence : 211422
taaggtgcatctgcctataacccacaccttgctcagctactcgggaggcagaggcaggacaattgcttgaatctgggaggcagaggttgcagtgagccgagattgtgccactgcactccagcctgggtgacagagcgagactccgtctcaaaaataaataaataaataaataaataaataaaacaaaaaaacaaacaaaaatcagtaatgtcagcactccttttatgaagtcaaccttattcttttctcactctggcttgcctctctctgctttgggctgttctgtagagtcagttatggtgctcgagcttcactgacagccctgagtagatatggtcaaaataggaagggccagtcatttataggtgaaatgtgaacctgaagaatatcctcagtgctcatgacctgacaatcctgttacctactg

SEQ ID NO: 10131 - DNA, 273 bp, Homo sapiens
  chr6.fa.O7frz.41399034
  Located on chromosome 6
  Distance between a terminus base of telomere on chromosomal short arm and 5'-terminus of this base sequence : 45756992
  Distance between 3'-terminus of neighbour sequence of sequence listing upward to telomere on chrosomal short arm and 5'-terminus of this base sequence : 88946
aaattatggttggctggacacagtggtatgtgcctgtaatcccagctactcgagaaactgagacaggagaatcgcttgaacccaggaggctgaggttgcagtgagctgagatctcaccactgcactccagactggatgacaagagcgaagactctgcctcaaataaataaataaataaattaattaattaattaattaaattatggcatatcaacttaatggaatgctagatgaggttctctttctgtcctgacatggaactatttctaagac

SEQ ID NO: 10132 - DNA, 155 bp, Homo sapiens
  G10173
  Located on chromosome 6
  Distance between a terminus base of telomere on chromosomal short arm and 5'-terminus of this base sequence : 45864029
  Distance between 3'-terminus of neighbour sequence of sequence listing upward to telomere on chrosomal short arm and 5'-terminus of this base sequence : 106764
ggggccctgttaaaatacaagcacttttggcctagctctttcaccctccatagtacccttatccatccatccatccatccatccatccatccatccatccatccatttatctaattatttacattatctgtgttcagagtgctttaaaagtaaag

SEQ ID NO: 10133 - DNA, 372 bp, Homo sapiens
  Z95152.1_62874
  Located on chromosome 6
  Distance between a terminus base of telomere on chromosomal short arm and 5'-terminus of this base sequence : 45944120
  Distance between 3'-terminus of neighbour sequence of sequence listing upward to telomere on chrosomal short arm and 5'-terminus of this base sequence : 79936
ggagcttatttgctacctaaacttaaaggaatggcttcctatgccttcaagatccttggcagagggaagtgatggtggcagctgaagatatgtgttgccttggctaaaaaaggagttgctttattattattatttatttatttatttatttatttattttggtagtgtcagggtctcgctcttttacccaggctagagtacagtggcacaatcatagctcactgcaagcttgaactcctgggctccagtgatcctcctgcctcagccttccaaatagctaggactacaggcatgcatccccaagcctggctaattttttaaagaattctttgtagagacagggtctcaccatcttactaatcgtggactcct

SEQ ID NO: 10134 - DNA, 450 bp, Homo sapiens
  Z84485.1_72244
  Located on chromosome 6
  Distance between a terminus base of telomere on chromosomal short arm and 5'-terminus of this base sequence : 46014943
  Distance between 3'-terminus of neighbour sequence of sequence listing upward to telomere on chrosomal short arm and 5'-terminus of this base sequence : 70451
ttacagatttgattagctcaagacattttaaagtatgcatggtgaaattttaatggtaaccacgaaataataaaattagaatgtataatttccaaaccaatagagagaagatatatgcaaaagaaagaaaagaaaggaagaatgggggggaaggagggagggagggagggagggagggagggagagagggaaggaaggaaggaaagaaagattggcaaaaatctaaaatgagacaagaaatgtgtatatgcgtgtggtggggggaatataatgaaaaggggacaaagcacaaagcaaggtgatggaaataaggccaaatatatcataattacaataaagttaatgacctaaaagtgccatttaggacagagatacttaaatttgaaataaaaacaaagtccattaatatactgtacaataggctcacttaaaacataagtcaacaggttg

SEQ ID NO: 10135 - DNA, 272 bp, Homo sapiens
  Z84484.1_33333
  Located on chromosome 6
  Distance between a terminus base of telomere on chromosomal short arm and 5'-terminus of this base sequence : 46125285
  Distance between 3'-terminus of neighbour sequence of sequence listing upward to telomere on chrosomal short arm and 5'-terminus of this base sequence : 109892
gaagtgctgaataggtcagagttgttttgctgttggtgaaaccctgtaatgcatttagggcagagcagcaaaatgtgagttttcacatacattctagttctatttctgcaaacaaaaactgtgtgacctaggtcctagggtatgtccttcctttatccatccatccatccaaccaaccatccaaccatccatccactcatccatccatccatccatccatccatccatccatccatccatccatccggctgacatttactgaggctcatctt

SEQ ID NO: 10136 - DNA, 200 bp, Homo sapiens
  D6S291
  Located on chromosome 6
  Distance between a terminus base of telomere on chromosomal short arm and 5'-terminus of this base sequence : 46138665
  Distance between 3'-terminus of neighbour sequence of sequence listing upward to telomere on chrosomal short arm and 5'-terminus of this base sequence : 13108
ctcagaggatgccatgtctaaaatatccatccggcattcaggcatgcctggccaaacctctcttccgccctcctcccccactcccttcttccctctcacagtttggtaagtgactctgtctctctgtacacacacacacacacacacacaccctgtgaaaccatcaccacaattaagttagtgaataattcgtcatcccc

SEQ ID NO: 10137 - DNA, 178 bp, Homo sapiens
  chr6.fa.O7frz.41927164
  Located on chromosome 6
  Distance between a terminus base of telomere on chromosomal short arm and 5'-terminus of this base sequence : 46239966
  Distance between 3'-terminus of neighbour sequence of sequence listing upward to telomere on chrosomal short arm and 5'-terminus of this base sequence : 101101
gaaattggcttatcaaatagtttatttgattgcctatgttctctatgtttattttctctttatttctctcttgctttattttattttattttatttcatttcatttcatttcatttcattttttgggacagagtctcactctgtcatccagactggagtacagtggcataatctcagc

SEQ ID NO: 10138 - DNA, 395 bp, Homo sapiens
  Z85986.1_67378
  Located on chromosome 6
  Distance between a terminus base of telomere on chromosomal short arm and 5'-terminus of this base sequence : 46396746
  Distance between 3'-terminus of neighbour sequence of sequence listing upward to telomere on chrosomal short arm and 5'-terminus of this base sequence : 156602
ctaactgccatctgataactgatctcataaatttcctaaaaatggaagcatttggatcccatttgttccaaatagaggtaacagcacacacacacacacacacacacacacacactctctctctctctctctctctctctctatctctctctctctctctctctctctctctctccaaagtgttttatatccataaatgtgcagagtgctgggttaggtaaaagttacatgtttctttgttgcaggacttctcaggacctttaattgcattctgaccttccatcaggaacacttattatacaggatttcccaaatgtatttgagatgctttgtggagaatgattaacatttccctaaactcattctttcaggaacctggatctagataatcacca

SEQ ID NO: 10139 - DNA, 399 bp, Homo sapiens
  Z85986.1_67345
  Located on chromosome 6
  Distance between a terminus base of telomere on chromosomal short arm and 5'-terminus of this base sequence : 46396746
  Distance between 3'-terminus of neighbour sequence of sequence listing upward to telomere on chrosomal short arm and 5'-terminus of this base sequence : -395
ctaactgccatctgataactgatctcataaatttcctaaaaatggaagcatttggatcccatttgttccaaatagaggtaacagcacacacacacacacacacacacacacacactctctctctctctctctctctctctctatctctctctctctctctctctctctctctctccaaagtgttttatatccataaatgtgcagagtgctgggttaggtaaaagttacatgtttctttgttgcaggacttctcaggacctttaattgcattctgaccttccatcaggaacacttattatacaggatttcccaaatgtatttgagatgctttgtggagaatgattaacatttccctaaactcattctttcaggaacctggatctagataatcaccatcag

SEQ ID NO: 10140 - DNA, 216 bp, Homo sapiens
  D6S1576
  Located on chromosome 6
  Distance between a terminus base of telomere on chromosomal short arm and 5'-terminus of this base sequence : 46414844
  Distance between 3'-terminus of neighbour sequence of sequence listing upward to telomere on chrosomal short arm and 5'-terminus of this base sequence : 17699
ccaaagtagtggaattacaggtgtaagccaccacgcccggcctgtgtaagtgcattctatgatgttcccacaatgaggaaatcatctgacaatgcatttctcagaatgtacctccgtccttaagcaatgcatgactctgtgtgtgtgtgtgtgtgtgtgtgtgtgtgtgtgtattccatctcccccaatagttttctcttgccccttaataattct

SEQ ID NO: 10141 - DNA, 229 bp, Homo sapiens
  D6S1051
  Located on chromosome 6
  Distance between a terminus base of telomere on chromosomal short arm and 5'-terminus of this base sequence : 46506147
  Distance between 3'-terminus of neighbour sequence of sequence listing upward to telomere on chrosomal short arm and 5'-terminus of this base sequence : 91087
ggtattttttgcccacatgagcctgtatatagatatatagatagtctctgacttatgatggttcagcttataatttttttactttatcataaaattgaggaacattatctatctatctatctatctatctatctatctatctatctatctatcatctatctatgtctatatctatctgaatatattcttgtattggttctgtttctctggagaaccccgactaatacag

SEQ ID NO: 10142 - DNA, 187 bp, Homo sapiens
  Z85996.1_26793
  Located on chromosome 6
  Distance between a terminus base of telomere on chromosomal short arm and 5'-terminus of this base sequence : 46543141
  Distance between 3'-terminus of neighbour sequence of sequence listing upward to telomere on chrosomal short arm and 5'-terminus of this base sequence : 36765
ctaatagtggactccagctcaccactgcggttttacatttatgatcttaaaacttcatctgaaacagacttcgaagggggagagagagagagagagagagagagagagagagagagagagagagaatgtacttctgtttgaagtttggggcctcctaaggatgagagattgcttcatccagttctgt

SEQ ID NO: 10143 - DNA, 366 bp, Homo sapiens
  Z85996.1_49152
  Located on chromosome 6
  Distance between a terminus base of telomere on chromosomal short arm and 5'-terminus of this base sequence : 46565400
  Distance between 3'-terminus of neighbour sequence of sequence listing upward to telomere on chrosomal short arm and 5'-terminus of this base sequence : 22072
tcacctaagctactgtttactgaccacctcccatgcactaggcatcttccatacatgtcttattccttacaacagccttccttagaatggagcctcctcctttattatgtggtaagaagttctcacaaaattcaatcaagaaaaacacagctgcataatcgtgaaaccaaccaaccaatcaaccaaccaaccaaccaaccaaccaaccaaccaaccaaccaaccaggcaagccggcatgcactgctagcctgctgggagtacctgagatccaagtgcttggtccagatctgtcccaatcccaagctatggtttgctgccccccggtggctatcgtcttttctggtttaaataccacaggaaatgat

SEQ ID NO: 10144 - DNA, 429 bp, Homo sapiens
  AL122034.12_105694
  Located on chromosome 6
  Distance between a terminus base of telomere on chromosomal short arm and 5'-terminus of this base sequence : 46687237
  Distance between 3'-terminus of neighbour sequence of sequence listing upward to telomere on chrosomal short arm and 5'-terminus of this base sequence : 121471
ctaaacatttattcagcatctgtcatgaattgagctgtttacttgttgtttgacaactatcacattgtgactttctgggcccctgggccaataccacagagaagggaagggatttttatgtgtttactaaggactcaccatgcaataagcatgtaagaatttaacatccatcacttatttatttatttatttatttatttatttatttatttgagatggagtctcgctctgtcacccaggctggagtgcagtggcgcggtctcggctcaccgcaagctccgcctcctgggatcacgccattctcctgcctcagccttccgagtagctggaactacaggtgcccgcctccacgcctggctaattttttgtatttttagtagagacagggtttcaccgtgttaggcaggattgtctcgatctcctgacctc

SEQ ID NO: 10145 - DNA, 178 bp, Homo sapiens
  Z85996.1_184310
  Located on chromosome 6
  Distance between a terminus base of telomere on chromosomal short arm and 5'-terminus of this base sequence : 46700627
  Distance between 3'-terminus of neighbour sequence of sequence listing upward to telomere on chrosomal short arm and 5'-terminus of this base sequence : 12961
tgctactcagatgtcaattatcagttagaaagccaacaatttggaagctttgcaggttctgtgcctggtctagcacagacacaatgaagataggcagacctgttttctattgtgtgtgtgtgtgtgtgtgtgtgtgtgtgtgttttgagacagaatctcactctatcaccaggctgga

SEQ ID NO: 10146 - DNA, 386 bp, Homo sapiens
  DISO7_00025636
  Located on chromosome 6
  Distance between a terminus base of telomere on chromosomal short arm and 5'-terminus of this base sequence : 46801233
  Distance between 3'-terminus of neighbour sequence of sequence listing upward to telomere on chrosomal short arm and 5'-terminus of this base sequence : 100428
ttgggcttgcagataagatgtgtgtgtgtgtgtgtgtgtgtgtgtgtgtgtgtgtgtaggggaattaacattagtgttactgaattattttttctcctcccagtgcttatgtgttgtacaaataataacatgacaaacaaaagaaaagaaaccaaccatcttcccacccacatccaccaattccatttctcagtgtctctttttcatggtatttttagtcttcatctttagggaggaaatcccagcagcacccacccaggtcagaaagttgtgagggcccagcacccttcctggccctttccctctggatcctgccacccctccctctccctccaccccccccctccctctacccccacccacttgctcctgcagggattgttatc

SEQ ID NO: 10147 - DNA, 364 bp, Homo sapiens
  AB031005.1_2319
  Located on chromosome 6
  Distance between a terminus base of telomere on chromosomal short arm and 5'-terminus of this base sequence : 47191322
  Distance between 3'-terminus of neighbour sequence of sequence listing upward to telomere on chrosomal short arm and 5'-terminus of this base sequence : 389703
ctcactctgatggtcaagctagagcagtgtcccgatcacagctcattgcaggctccaactcctggattcaggcaatcctcccacctcagcttctcgagtagctgggactacagactggagccaccacacccagtatgtgtgtgtgtgtgtgtgtgtgtgtgtgtatttttttcttttcttttcttttctttttttttttggtagagactgggtcttgctttgttacccatgctggtcttgaacttctggcttcaagcaattctcatgcctcagcctcccaaagtgctgagattacgggcataaaccacaacgcctggcccctgtgtgtgtatatacaaagtcaaagtgctaaacctggcaccta

SEQ ID NO: 10148 - DNA, 119 bp, Homo sapiens
  D6S1650
  Located on chromosome 6
  Distance between a terminus base of telomere on chromosomal short arm and 5'-terminus of this base sequence : 47424047
  Distance between 3'-terminus of neighbour sequence of sequence listing upward to telomere on chrosomal short arm and 5'-terminus of this base sequence : 232361
gggctccactgtttaaccccgcccccgcagcccccctcacagtctctttgaataaagacacacacacacacacacacacacacacacacacacacacacctgtaatcatagcccgaggg

SEQ ID NO: 10149 - DNA, 101 bp, Homo sapiens
  DISO7_10002148
  Located on chromosome 6
  Distance between a terminus base of telomere on chromosomal short arm and 5'-terminus of this base sequence : 47541461
  Distance between 3'-terminus of neighbour sequence of sequence listing upward to telomere on chrosomal short arm and 5'-terminus of this base sequence : 117295
catagccctgctgtagccagagggtgtgtgtgtgtgtgtgtgtgtgtgtgtgtgtgtgtgtgtgtgtgtgtttgaagatcaaggatctgtttggtagagaa

SEQ ID NO: 10150 - DNA, 103 bp, Homo sapiens
  DISO7_10002147
  Located on chromosome 6
  Distance between a terminus base of telomere on chromosomal short arm and 5'-terminus of this base sequence : 47606083
  Distance between 3'-terminus of neighbour sequence of sequence listing upward to telomere on chrosomal short arm and 5'-terminus of this base sequence : 64521
ggatttcagcaaggaaggggctccacaaaccaattgaagatacgtgtgtgtgtgtgtgtgtgtgtgtgtgtgtgtgcatttttccatcagagaaccgattgct

SEQ ID NO: 10151 - DNA, 241 bp, Homo sapiens
  DISO7_10002149
  Located on chromosome 6
  Distance between a terminus base of telomere on chromosomal short arm and 5'-terminus of this base sequence : 47673256
  Distance between 3'-terminus of neighbour sequence of sequence listing upward to telomere on chrosomal short arm and 5'-terminus of this base sequence : 67070
cttcctggtattctctggtttagaaatcttttttgtactctcttcagagagtaaagcccctctgttttttgtaaatcctgtgagagacagagagagagagagagagagagagagagagtgtgtgtgtgtgtgtgactaaaaatcctatagactttgttttttattatcactctttttcttctcattttatattgtttcgtgaaagtttacaaaattatggcacactagttattagccagct

SEQ ID NO: 10152 - DNA, 102 bp, Homo sapiens
  DISO7_10002150
  Located on chromosome 6
  Distance between a terminus base of telomere on chromosomal short arm and 5'-terminus of this base sequence : 47704067
  Distance between 3'-terminus of neighbour sequence of sequence listing upward to telomere on chrosomal short arm and 5'-terminus of this base sequence : 30570
cctttgttctattcctcctctcttgcttgtgtgtgtgtgtatgttgtgtgtgtgtgtgtgtgtgtgtgtgtgtgtgtgtcttaatggctttctgtagtggta

SEQ ID NO: 10153 - DNA, 221 bp, Homo sapiens
  chr6.fa.O7frz.50175969
  Located on chromosome 6
  Distance between a terminus base of telomere on chromosomal short arm and 5'-terminus of this base sequence : 47765881
  Distance between 3'-terminus of neighbour sequence of sequence listing upward to telomere on chrosomal short arm and 5'-terminus of this base sequence : 61712
gctactggctgacagtgacatgcactgtgatggcaccccacttggccatctcattcatccttgggatgtcaagtggcttacccaaggttgccagtaaacaggtcatgtagagttttctaaagcatttgtgtgtgtatgtgtgtgtgtgtgtgtgtgtgtgtgtgaacatgcacagaaagagagttatgacagaaagagagttatgaccttaggccttataa

SEQ ID NO: 10154 - DNA, 221 bp, Homo sapiens
  AL133334.16_104636
  Located on chromosome 6
  Distance between a terminus base of telomere on chromosomal short arm and 5'-terminus of this base sequence : 47958817
  Distance between 3'-terminus of neighbour sequence of sequence listing upward to telomere on chrosomal short arm and 5'-terminus of this base sequence : 192715
agaggtggacaggactctaaagggctttcattcattccttcaaccctctctcgcgcccccaaaaacccatcgagggaggcagcagaggtatctttgatatattcatggcttagagtcacacacacacacacacacacacacacacacacacacaccagtcatgctcaagctttgaaaaatgtcatttacaaattttttaatgtagctgtgctgataacatt

SEQ ID NO: 10155 - DNA, 285 bp, Homo sapiens
  chr6.fa.O7frz.50522432
  Located on chromosome 6
  Distance between a terminus base of telomere on chromosomal short arm and 5'-terminus of this base sequence : 48112367
  Distance between 3'-terminus of neighbour sequence of sequence listing upward to telomere on chrosomal short arm and 5'-terminus of this base sequence : 153329
aggagtcttggaagtttatgactgaaatactgaactttcttttttcaattattttgttcattgtcagtcagaatccagggaagctgggcttattttgcttttggttttatatacatctatctatctatctatctatctatctatctatctatctatctatctataaatgtaccttgtatgtacaaacatatatagatgctatgaagccaccatttatagctttcagttttctcagttatagtcatattagcattcataataagctactggtttatctagcggttt

SEQ ID NO: 10156 - DNA, 191 bp, Homo sapiens
  HUMUT1254
  Located on chromosome 6
  Distance between a terminus base of telomere on chromosomal short arm and 5'-terminus of this base sequence : 48419915
  Distance between 3'-terminus of neighbour sequence of sequence listing upward to telomere on chrosomal short arm and 5'-terminus of this base sequence : 307263
ttggtctgggtagaaaccatagagatagatagatagatagatagatagatagatagatagatagataatgcctatattttatatatataaatatacatatatatatatatatatatatatttttttttttttttttttgagatggagtctcactatgtcacccaagctggaatgtagtggcactatctcgg

SEQ ID NO: 10157 - DNA, 464 bp, Homo sapiens
  chr6.fa.O7frz.51165321
  Located on chromosome 6
  Distance between a terminus base of telomere on chromosomal short arm and 5'-terminus of this base sequence : 48735783
  Distance between 3'-terminus of neighbour sequence of sequence listing upward to telomere on chrosomal short arm and 5'-terminus of this base sequence : 315677
taatccagtgaaatatgatttgtcaaccctgaaaacacatcttaaggtcaggttaattgcattctgtctgtccaaacccttagtgcagatttagttggcttttctgttttctttttttttttttccctttgcccagcatcaggggctataaaactttctctgaactaatttgtcacagtgctattgtgccctagagataggtatagtagagtaaaaggtaaagtgaataaaagtttagtttgtataatggctagggaatatttgggaataaactaagttaggaaaagatattaaacaatggccaccatatttttatgttttatatatgtgtgtgtgtgtgtgtgtgtgtgtgtgtgtgtatttcagtagacaatacaatgtgtgcattgtgagaaatcattgtggattttatctttttttttgagaggagtgggcagtcttcctggttagtctttgctgtagaa

SEQ ID NO: 10158 - DNA, 456 bp, Homo sapiens
  chr6.fa.O7frz.51554294
  Located on chromosome 6
  Distance between a terminus base of telomere on chromosomal short arm and 5'-terminus of this base sequence : 48922277
  Distance between 3'-terminus of neighbour sequence of sequence listing upward to telomere on chrosomal short arm and 5'-terminus of this base sequence : 186030
cagtgctctttggttcaaggttttgctggggcctattaagtgaatggctgtagaggtcttcttttcttctcttctcttctcttctcttctcttctcttctcttctcttctcttctcttctgttctcttctcttctcttctcttttctcttttcagatggaatctcgccgtgttacccaggttggagtgcagtggcgcgatctcagctcactgcaacctccgcctcccgggttcaagagattctcctgcctcagcctccgagtagctggcatcacaggtgcttgccaccatacccagctaatttttgtatttttagtagagacagggtttcaccatgttggccaggctggtctcgaactcctgacctcataatccgcctgcctcggcctcccaaagtgctgggattacagacgtgagccaccgcgcccagccgaggtcacctttcttatacctctgg

SEQ ID NO: 10159 - DNA, 428 bp, Homo sapiens
  chr6.fa.O7frz.51341554
  Located on chromosome 6
  Distance between a terminus base of telomere on chromosomal short arm and 5'-terminus of this base sequence : 48951167
  Distance between 3'-terminus of neighbour sequence of sequence listing upward to telomere on chrosomal short arm and 5'-terminus of this base sequence : 28434
cagtttcttaatgcttctacgtattatttgaattttctactattgaaatatatcactttttaaaatagaaaacaacccaaagcaatacaagatttctttctttctcctttcctttctctttccatctttctttctttccgtctttctttcctttcttttcttttttctttctttctttctttctttctttctttctttctttctttcttttctttcttctttctttctttctttctttctttctttctttctttctttctttctttctttctttctttctttctttccttccttctccctttctccttccctccttccttccttccttccttcctcttctttttttgaaggccccacagcctcctgtgtgcagaggcttcaggggaagggcccaactctcccatgcttttactcctgtggccaagtag

SEQ ID NO: 10160 - DNA, 106 bp, Homo sapiens
  D6S459
  Located on chromosome 6
  Distance between a terminus base of telomere on chromosomal short arm and 5'-terminus of this base sequence : 49093324
  Distance between 3'-terminus of neighbour sequence of sequence listing upward to telomere on chrosomal short arm and 5'-terminus of this base sequence : 141729
caggagttccctgagagtcctcccacagtgtgtgtgtgtgtgtgtgtgtgtgtgtgtgtgtgtgtgtttctgcgtggggagtgtgtttctaatgtggtggtgcaga

SEQ ID NO: 10161 - DNA, 454 bp, Homo sapiens
  chr6.fa.O7frz.51636861
  Located on chromosome 6
  Distance between a terminus base of telomere on chromosomal short arm and 5'-terminus of this base sequence : 49190116
  Distance between 3'-terminus of neighbour sequence of sequence listing upward to telomere on chrosomal short arm and 5'-terminus of this base sequence : 96686
tgttctacaggttaacttatccagagatattctcccctaaaggtcagcagaaacttggaaaaagtttcctcaaagctacgtcctaaccacagacaaggggttatgaatgtagtaattgtataaaccaactgtgatactttcaacctacacacacacaatgaaatgtagacacacacacccatggacacactattgtacttctgtggtctgcatatcctgtgcttagtgggatattgtgtcccatcatgaatatattgtgtcccatcatgaatataattttgcatgtaagcactttcttttagattaattgaaatgagcctgtctaaggaggtatgtgatggcctttgccagtacataagaacatcagaacacacacgaagtgcataagtgtgtgtgtgtgtgtgtgtgtgtgtgtagagagagagagattgagaaacgtatttggttcctatgt

SEQ ID NO: 10162 - DNA, 438 bp, Homo sapiens
  chr6.fa.O7frz.51796236
  Located on chromosome 6
  Distance between a terminus base of telomere on chromosomal short arm and 5'-terminus of this base sequence : 49349576
  Distance between 3'-terminus of neighbour sequence of sequence listing upward to telomere on chrosomal short arm and 5'-terminus of this base sequence : 159006
aactggtgttaatgctaagtgtactaaataactaatgaagaataaacgagctgcatatttgtcatcactatcattctgcctaaaggaaatgtgctttctgctatggccaatttgagtccattgagctttctcaccccaggttctttttaattatgtttctctacctttgacagttttattttgtgatttgaagggttttgggattttatcatttagggattttcttctccaaagacatctgggaagtttggtcttatattataaaaccaaagcaaactctatcagcgtactctctcgctctctttctgtgtgtgtgtgtgtgtgtgtgtgtgtgtgtgtgacactgtataatatatacttctcaatatagtatatattataaaaattgttactctgaaccatccaggaaagataaagaaagtacttaaggctttggaa

SEQ ID NO: 10163 - DNA, 444 bp, Homo sapiens
  AL035701.13_16705
  Located on chromosome 6
  Distance between a terminus base of telomere on chromosomal short arm and 5'-terminus of this base sequence : 49454030
  Distance between 3'-terminus of neighbour sequence of sequence listing upward to telomere on chrosomal short arm and 5'-terminus of this base sequence : 104016
gccaaagctgattgaagacacccagcccagactaagaagctcactcccatttgattagatgtcccaatttctataggcatatctctgagagtgtttttcaacttgaggttgtggttcattgtttgttaaattcatttagtagttggaaactatgttttaaaaatgataaaatagaatacaatggatcattatagaaaatatcagagtgcatcacacatagcaaggataggtattattttatgaaactttgtttcagtttatacacacacacacacacacacacacacatacatccaaacacacatatatgtatttctgcactgagtctcaatgtaaaatgttttaccagttatggatcccaatataataaacaaatgataaaatcagatgggacagggaagaagatgcaaaaaatgtctttactaggctagcaactctttaggc

SEQ ID NO: 10164 - DNA, 239 bp, Homo sapiens
  AL035701.13_13744
  Located on chromosome 6
  Distance between a terminus base of telomere on chromosomal short arm and 5'-terminus of this base sequence : 49457106
  Distance between 3'-terminus of neighbour sequence of sequence listing upward to telomere on chrosomal short arm and 5'-terminus of this base sequence : 2632
tcttgtatcatgtcatagaagcagtgtggcatgtatgagaattagctaatagaatttagaatcagatggatatgggtatgagggctctggttcttattgcctttgtaagctggagataatattttggaataatgatataaaaaatgagaagtgtgtgtgtgtgtgtgtgtgtgatagaaagagaatgaatgagaaatgctatatgcctggcatagtactggtgcagtataaacactggt

SEQ ID NO: 10165 - DNA, 137 bp, Homo sapiens
  D6S1632
  Located on chromosome 6
  Distance between a terminus base of telomere on chromosomal short arm and 5'-terminus of this base sequence : 49457180
  Distance between 3'-terminus of neighbour sequence of sequence listing upward to telomere on chrosomal short arm and 5'-terminus of this base sequence : -165
ggtatgagggctctggttcttattgcctttgtaagctggagataatattttggaataatgatataaaaaatgagaagtgtgtgtgtgtgtgtgtgtgtgatagaaagagaatgaatgagaaatgctatatgcctggc

SEQ ID NO: 10166 - DNA, 379 bp, Homo sapiens
  chr6.fa.O7frz.52025411
  Located on chromosome 6
  Distance between a terminus base of telomere on chromosomal short arm and 5'-terminus of this base sequence : 49544076
  Distance between 3'-terminus of neighbour sequence of sequence listing upward to telomere on chrosomal short arm and 5'-terminus of this base sequence : 86759
taacacggtgaaacctcatctctactaaaaaaaaaaaacaaaaaattagccggctgtggtggctggtgccaagatcgtgccactgcactccagcctgggtgacagagcaagactctgtctcaaaacaaacaaacaaacaaacaaacaaacaaaaggtcacactggtcaagagaaaatgatgctgtcttaatccttaaatttctctgaaaagatgaccctctatcttcatctactgaatatgtttgtgttcatttctaaatcgcactgtgaaaccaaagcctgtttttggaccactgatctagagcttaggaggagacgttcatctttatgattcaatgatggccccataagtaatcttatacttgaagttattgatggc

SEQ ID NO: 10167 - DNA, 442 bp, Homo sapiens
  chr6.fa.O7frz.52134203
  Located on chromosome 6
  Distance between a terminus base of telomere on chromosomal short arm and 5'-terminus of this base sequence : 49644785
  Distance between 3'-terminus of neighbour sequence of sequence listing upward to telomere on chrosomal short arm and 5'-terminus of this base sequence : 100330
tatcaggaacttgaacatgaagtacaaagtaataaaagtgataagagtagagataaaacatcaggagagttcaaaggaaggaaaagattcgtgcagcctgggtagtgtgtgtgtgtgtgtgtgtgtgtgtgtgtgtgtgtgtgtacgtgtgtatggtaggagaggcaaccagagaaggcttagtggaggaggaggcatttgaagtacgccttgaagaatgaatagaatttgcatgagtggaatgaaagaagtggaggaggaagcgtatctgggagtcaggaacagcttaggcgaagactcagaggtaggtaattttttgcttcctttttacccagactttatatctgtgaaaacaaatagttcttgtgataccacttttcaaatctttcttgttgggcaagaaagatatgaatattaaaggttagaagcataattctagtca

SEQ ID NO: 10168 - DNA, 196 bp, Homo sapiens
  D6S1638
  Located on chromosome 6
  Distance between a terminus base of telomere on chromosomal short arm and 5'-terminus of this base sequence : 49764548
  Distance between 3'-terminus of neighbour sequence of sequence listing upward to telomere on chrosomal short arm and 5'-terminus of this base sequence : 119321
tggcctacacggacatccatgggaaatgtgactgggtcccacccaacttggaactggggaagatgggagcactgtgacttcttggtgaggctgggctgtgccagcaacagggacttgccttagttctcctccctcccctaacacacacacacacacacacacacacacatacacacagtggctactggtcatgtga

SEQ ID NO: 10169 - DNA, 312 bp, Homo sapiens
  AL035670.29_40604
  Located on chromosome 6
  Distance between a terminus base of telomere on chromosomal short arm and 5'-terminus of this base sequence : 49846911
  Distance between 3'-terminus of neighbour sequence of sequence listing upward to telomere on chrosomal short arm and 5'-terminus of this base sequence : 82167
atagtcaacaggtaatccttgaccattggcccatactacacacttcattgcaagacatttcagtcattggtttaaaatactgctagctccaggtcaaggatgattacaataaattatttagttgctattggtatagatagatagatagatagatagatagatagatagatagacagacagatagctagatatagtgatataaagaaacctgaaaaaagtagcatctattgtttttagaagaactattcttaggacattgacatttggtatgtgacaaaaacaaaaaatttgttattggcttaagaactgctt

SEQ ID NO: 10170 - DNA, 130 bp, Homo sapiens
  D6S1541
  Located on chromosome 6
  Distance between a terminus base of telomere on chromosomal short arm and 5'-terminus of this base sequence : 49946007
  Distance between 3'-terminus of neighbour sequence of sequence listing upward to telomere on chrosomal short arm and 5'-terminus of this base sequence : 98784
acacaatcaaaaccaggagcaaattgacattggtacaatccacagattccaaagtcactaatttataagcacacatttgtgtgtgtgtgtgtgtgtgtgtgtgtgtcattccatgcaatttcatcacctt

SEQ ID NO: 10171 - DNA, 188 bp, Homo sapiens
  chr6.fa.O7frz.52535797
  Located on chromosome 6
  Distance between a terminus base of telomere on chromosomal short arm and 5'-terminus of this base sequence : 50059408
  Distance between 3'-terminus of neighbour sequence of sequence listing upward to telomere on chrosomal short arm and 5'-terminus of this base sequence : 113271
tggccacttgattacatagtacatcacttcatgtctctggactctatttctttctccatttctctcaatagtctttctttctttttctttctttctttctttctctttctttctttctttctttctttctttctttctttctttctttctctctctctttctttctttcttactttctacctttcctt

SEQ ID NO: 10172 - DNA, 291 bp, Homo sapiens
  AL096772.5_50296
  Located on chromosome 6
  Distance between a terminus base of telomere on chromosomal short arm and 5'-terminus of this base sequence : 50171684
  Distance between 3'-terminus of neighbour sequence of sequence listing upward to telomere on chrosomal short arm and 5'-terminus of this base sequence : 112088
ccattctagtccaacctctaacagagcaagaccctatctctcaataaaataaaataaaataaaataaaataaaaaatagagaaacaatcagtgcttaagatcaactcttctcttagaaatccttcatcagccctgagatcagaaaactaggcctagaaagagctgagtgtctcagagctcagaggtggctaggagctgagttcgtcagaactccaagagatctaccaatgattctcaaaattttagccaatgatatcctccgacagttggagcaaccatttatgataggat

SEQ ID NO: 10173 - DNA, 276 bp, Homo sapiens
  D6S452
  Located on chromosome 6
  Distance between a terminus base of telomere on chromosomal short arm and 5'-terminus of this base sequence : 50210120
  Distance between 3'-terminus of neighbour sequence of sequence listing upward to telomere on chrosomal short arm and 5'-terminus of this base sequence : 38145
taaaggatcagaaactggcctagaataatagtaaagttctgggtgattcaggtatctgatacttgctctagtgagtgtgtgtgtgtgtgtgtgtgtgtgtgtgtgtgtgtgtgtatgtgtgtgtttattggggctgtgtgtacacagatttatggcttttttaaaacaaaatattcttaaaatcactttattaattgcaattcaagccaagatcctcaaacagcatcgctgtctcaggtctagaccagaattcacttcacagtacgggtgagattt

SEQ ID NO: 10174 - DNA, 312 bp, Homo sapiens
  chr6.fa.O7frz.53019602
  Located on chromosome 6
  Distance between a terminus base of telomere on chromosomal short arm and 5'-terminus of this base sequence : 50292825
  Distance between 3'-terminus of neighbour sequence of sequence listing upward to telomere on chrosomal short arm and 5'-terminus of this base sequence : 82429
aggaactatttagaccacagtttatagtgctggagctttcaaatgggataacagttttggtgcctgcagagtgatccgttctgcctctttgtgccagtctgtttccaaatgggagacctggcctgcatactgctctctgctcactctgtgtctctctctctcttctctctctctctctctctctctgtctgactctctctgtctctctgtctctctctctctcttctctctctctctctctctgtctctctctctctctctctctctctctctctctctccttgaaaaatcttcctcatacatgtactccag

SEQ ID NO: 10175 - DNA, 349 bp, Homo sapiens
  HUMUT894B
  Located on chromosome 6
  Distance between a terminus base of telomere on chromosomal short arm and 5'-terminus of this base sequence : 50404646
  Distance between 3'-terminus of neighbour sequence of sequence listing upward to telomere on chrosomal short arm and 5'-terminus of this base sequence : 111509
catttcagcttccgcagtagcttgggttacaggtgtgtgatgccacactcagcttagaatggtaactgtgtttcttcattgtcttgtttgtttcccatctccttccttccttttctttctttctttcttccttcctttctttctttctttctttttctacttcctttttttttctttctttctttctttctttctttctttctttctttctttctttctttctttcttctttctttctctctctctctctttctttctttctctctctctttcctttctttctttttttttttcagtgtcttgctctgtcaaccaggctggagtgcagtggcacaatctggcctcactg

SEQ ID NO: 10176 - DNA, 222 bp, Homo sapiens
  AL049814.6_88160
  Located on chromosome 6
  Distance between a terminus base of telomere on chromosomal short arm and 5'-terminus of this base sequence : 50464355
  Distance between 3'-terminus of neighbour sequence of sequence listing upward to telomere on chrosomal short arm and 5'-terminus of this base sequence : 59360
ctccttcagttcaatttagcagcattgattaaacactttcaatgagcaccaatagtaagacactacactatcctttttcttctgcctcctcgatgtcttctctctctccctctctctctctctttcacacacacacacacacacacacacccttgaaattgtgagcagcttgttctgcccacagggaacttctgtccaaagtccatgaaatgtcactttaag

SEQ ID NO: 10177 - DNA, 203 bp, Homo sapiens
  Z66926
  Located on chromosome 6
  Distance between a terminus base of telomere on chromosomal short arm and 5'-terminus of this base sequence : 50507050
  Distance between 3'-terminus of neighbour sequence of sequence listing upward to telomere on chrosomal short arm and 5'-terminus of this base sequence : 42473
gtacagggctcaatacataatgggtgctctgataatctattaaataaattgtctgtgttgaattatctcaaccttaaaggcaatactaagaagaagtgtgtgtgtgtgtgtgtgtgtgtgtgtgtttgtgtgtgtgtgtgtgtgtgttgggcagggagtgtatattaatataaagaccccaagaatctgtttcctagactttt

SEQ ID NO: 10178 - DNA, 298 bp, Homo sapiens
  AL096801.18_8779
  Located on chromosome 6
  Distance between a terminus base of telomere on chromosomal short arm and 5'-terminus of this base sequence : 50599313
  Distance between 3'-terminus of neighbour sequence of sequence listing upward to telomere on chrosomal short arm and 5'-terminus of this base sequence : 92060
gaccgatttcaaatttctgacccctaaaactgtaagagaataaatttgtgttgttttaaggggagagagagagagagagagagagagagagagaaagagagagaattttctgccttaaggccatgtgagagctgtcaattgccaaggtgtctgctgaatttaaccaggaagccactctcattgaatcatcatcatcaccatcctcctcctcattattagcacctctgggattccattgccactaccaccacagcaacagctgacatttatcaagcagttaccttacaccaggttcctt

SEQ ID NO: 10179 - DNA, 152 bp, Homo sapiens
  D6S1018
  Located on chromosome 6
  Distance between a terminus base of telomere on chromosomal short arm and 5'-terminus of this base sequence : 50606411
  Distance between 3'-terminus of neighbour sequence of sequence listing upward to telomere on chrosomal short arm and 5'-terminus of this base sequence : 6800
cctgagtagagtttagccaaggagataatcttttgtcaatgtataggtggatgaatggatggatggatggatggatggatggatggatggatggatggatcaatggacaaaagaacttcctcttaacccccacaagtccctttgggtacaaa

SEQ ID NO: 10180 - DNA, 225 bp, Homo sapiens
  chr6.fa.O7frz.53190790
  Located on chromosome 6
  Distance between a terminus base of telomere on chromosomal short arm and 5'-terminus of this base sequence : 50719186
  Distance between 3'-terminus of neighbour sequence of sequence listing upward to telomere on chrosomal short arm and 5'-terminus of this base sequence : 112623
ctgtaatcctagcacttcctttaggaggccagggttggacaatcacttgacaccaagagttcgagatcagcctgggcaacacagtgagaccccgtctctaaaatgtgtgtgtgtgtgtgtgtgtgagtgtgtgtgtgtgtaaaatattaacaggtggtttggatgaactacacagtttgagaagctctgacctagggaagagttaagtctttgacttagcaggta

SEQ ID NO: 10181 - DNA, 374 bp, Homo sapiens
  chr6.fa.O7frz.53299455
  Located on chromosome 6
  Distance between a terminus base of telomere on chromosomal short arm and 5'-terminus of this base sequence : 50827725
  Distance between 3'-terminus of neighbour sequence of sequence listing upward to telomere on chrosomal short arm and 5'-terminus of this base sequence : 108314
ccttaggtttcttaaggatgttaggaacattcctctctcacagcctttgtgcttgttgtatacctttgtctggaatcctcttcttcaagatgtcctgatggctacttgtctgattcaggattctctcagaaatcaccttatcagtgaggcccttactgacagctctgtgtaaaacagcagaaagtccccattatccactttttaattctcttctcttttttttttaacgtttcaaagaagaatttgttgctattgcttattaagcttattgtctgtctacctgctcattagaatatatatatatatatatatatacacatacacatatatatatatgtatgtatgtatttgtttactcattgtctagaatggtc

SEQ ID NO: 10182 - DNA, 266 bp, Homo sapiens
  D6S1689
  Located on chromosome 6
  Distance between a terminus base of telomere on chromosomal short arm and 5'-terminus of this base sequence : 50851064
  Distance between 3'-terminus of neighbour sequence of sequence listing upward to telomere on chrosomal short arm and 5'-terminus of this base sequence : 22965
agttgtttgatgaccaggaactcttgaatatacacacacacacacaaatgtatatacacacacatatatatacacaaatatacacacatacacacacacaaatatatatacatatatacacacacatatacacatatgtatgtgcacatatatatacacatacgtatgtacacacatatatacacatatgtacacatatatatacacacacacacacatatatatatatatatttgtcagagtcatctgctagaagtaggagagct

SEQ ID NO: 10183 - DNA, 459 bp, Homo sapiens
  chr6.fa.O7frz.53464892
  Located on chromosome 6
  Distance between a terminus base of telomere on chromosomal short arm and 5'-terminus of this base sequence : 50993385
  Distance between 3'-terminus of neighbour sequence of sequence listing upward to telomere on chrosomal short arm and 5'-terminus of this base sequence : 142055
cacagaagtcatgtcttgttagtattgccttgtgtttatttctttatgcacaaacaacaccttaaaaatgagagagagagagagagagagagagagagagagagagagagagagactgagtttgttaaaaagcttttccaagccttattttcctattttgtagtcagcacctccataatgccttgagaacctctctagtgtccctacactactgtgaggcttatggtgtcactgtaggaactagaaattaagtcatgattaactttggataaatgaaacccttgctttattcctatgctgaagaggccagcagttattcctatgtgggagaggctcaaagtagcacccagctcccaattcagagagccatactattactaatcttagtaaatactttacttgagcttgtctttggctgggtaccaaatgctgataccctacaccaaatgataatcctga

SEQ ID NO: 10184 - DNA, 369 bp, Homo sapiens
  chr6.fa.O7frz.53743245
  Located on chromosome 6
  Distance between a terminus base of telomere on chromosomal short arm and 5'-terminus of this base sequence : 51269355
  Distance between 3'-terminus of neighbour sequence of sequence listing upward to telomere on chrosomal short arm and 5'-terminus of this base sequence : 275511
tacctaattagttcaccagcagttttagcaaaacccctagcaagccctaagatgtctaatatgaagactgtcttgctcatgtcagttcaccaccaataagctatttgcagctcattctctaaatcactacacatagggaattacatcacacctgatgtgtagaaccctcttgctgaaccaacagctatcactatcatcatctcttttctgataagacacatcagtcttgttgctaagcacttacgtgcctttattcccagatttgatcttctctttgaaagaatatgtgcgcgcgcgcacacacacacacacacacacacacacgcaccacctacatagtattttctagaccatttatgtatagctgga

SEQ ID NO: 10185 - DNA, 246 bp, Homo sapiens
  D6S1669
  Located on chromosome 6
  Distance between a terminus base of telomere on chromosomal short arm and 5'-terminus of this base sequence : 51331792
  Distance between 3'-terminus of neighbour sequence of sequence listing upward to telomere on chrosomal short arm and 5'-terminus of this base sequence : 62068
cttcagatcaggtcaacttcaaaaactaatattaataagtgtgtgtttgtgtgtgtgtgtgtgtgtgtgtgtgtgtgtgtatatatatatatgaattttttagggcaaactctaaagtgtgattgtgaactggagatttgctttccaaagtttctgttctttttggaatgacttcatagaaaagattgagtttcaagagatgttctgtgcacaatttcttaataacagtgaaagtgcccattttta

SEQ ID NO: 10186 - DNA, 286 bp, Homo sapiens
  HUMUT596
  Located on chromosome 6
  Distance between a terminus base of telomere on chromosomal short arm and 5'-terminus of this base sequence : 51353679
  Distance between 3'-terminus of neighbour sequence of sequence listing upward to telomere on chrosomal short arm and 5'-terminus of this base sequence : 21641
gcccagattaagagtacacacatacacatacacacacacacatacacacacacacatacacacacacaataaagacctagataaaatttcacgagacaacttactctaatatatttcatacatctgtcttctgtcctaaatttgttggggttcatctaccctgaacaaaaatgattctctgagttcagtggttttaattctaattttcccattccatatttggaaaatgaaacccagggagaaattaaaataggaatccactgatgagataagcctattagccatg

SEQ ID NO: 10187 - DNA, 473 bp, Homo sapiens
  chr6.fa.O7frz.54213198
  Located on chromosome 6
  Distance between a terminus base of telomere on chromosomal short arm and 5'-terminus of this base sequence : 51581277
  Distance between 3'-terminus of neighbour sequence of sequence listing upward to telomere on chrosomal short arm and 5'-terminus of this base sequence : 227312
tatgtcgtatgcagttaggaatgattcagaagagagaggaagaaattaggattcagaataaaagggcagagttaataaaggaaatttctggctaagacaagaggaaacatctgtgagacagagagaaaaggggctgtttcagaggagcagggaaggtaagacaaagggcatgagaagagagtgagggtgtaagagaattgccgtttatctggttgcttctattttctcagggaagcaggtggcaagagtcatggaagtacatgattggacaggttttgtgaaaaagagagatacgaaatgactactttaaaaatggtaatgcaaaccagagaaggatgaatatgtgtgtgtgtgtgtgtgtgtgtgtgtgtgtgtgcgtgcattttaacaatggtagttgcttgagtgccagggcagagtagggagctagtagattcaccaggcttagggttcactagatgagtgaaatggag

SEQ ID NO: 10188 - DNA, 344 bp, Homo sapiens
  chr6.fa.O7frz.54323877
  Located on chromosome 6
  Distance between a terminus base of telomere on chromosomal short arm and 5'-terminus of this base sequence : 51692194
  Distance between 3'-terminus of neighbour sequence of sequence listing upward to telomere on chrosomal short arm and 5'-terminus of this base sequence : 110444
tgtcagcttctatttgaattagactttgggccaaatacaaagcagaacctaattcattcccctaatgatcatttctaggatctctagcaggctgtttactgctcagggcaagagaagacagatgaaacagaaaaatggcacaaaggaccctgtaacacacacacacacacacacacacacacacacacacacacacaaagacactgaaagcctgaagattccaggagtatatttaactatttttggaggtgtaaagtccagcagaactgaataatgtaaggaaagaaagagaacacatgcaaaggtagttccattagatgatcctaggctgtcaaatgcactat

SEQ ID NO: 10189 - DNA, 206 bp, Homo sapiens
  DISO7_10002152
  Located on chromosome 6
  Distance between a terminus base of telomere on chromosomal short arm and 5'-terminus of this base sequence : 51781792
  Distance between 3'-terminus of neighbour sequence of sequence listing upward to telomere on chrosomal short arm and 5'-terminus of this base sequence : 89254
gaggagtcagatgaattgaggtatgtttataaaaatccttaagataaaagatataattagctagaattactaagaaagaactttttcttttgatgaatgtaaccaggaatgtgtgtgtgtgtgtgtgtgtgtgtgtgtgtgtgtgtgtgtgtgtgtgtctaacttctatttttattttttatttacccttctcatccactgttatg

SEQ ID NO: 10190 - DNA, 193 bp, Homo sapiens
  DISO7_10002153
  Located on chromosome 6
  Distance between a terminus base of telomere on chromosomal short arm and 5'-terminus of this base sequence : 51791868
  Distance between 3'-terminus of neighbour sequence of sequence listing upward to telomere on chrosomal short arm and 5'-terminus of this base sequence : 9870
gattcatgactaggtggataagcttttcctcattttcagaaaatactttccaccttcttttaaacattgcttttactctctctttccttccctttgggacttcaaacacacacacacacacacacacacaaaacactctttacctctaccctttctaactagacattttcaattgtcctgtaatttagttcca

SEQ ID NO: 10191 - DNA, 192 bp, Homo sapiens
  DISO7_10002156
  Located on chromosome 6
  Distance between a terminus base of telomere on chromosomal short arm and 5'-terminus of this base sequence : 51933016
  Distance between 3'-terminus of neighbour sequence of sequence listing upward to telomere on chrosomal short arm and 5'-terminus of this base sequence : 140955
acaatgagattctgaaagtgtagagtaatatcttgtgatttttgtattattataccttagggactagcaaaggggatgaaaccaagtagtattaatagcagcagcagtagtagtagcagcagcagtagtagtagcagtagtaatagtagtagtagtagtaagaacaggaaaaactcctaggcagtagaccca

SEQ ID NO: 10192 - DNA, 261 bp, Homo sapiens
  DISO7_10002157
  Located on chromosome 6
  Distance between a terminus base of telomere on chromosomal short arm and 5'-terminus of this base sequence : 51962670
  Distance between 3'-terminus of neighbour sequence of sequence listing upward to telomere on chrosomal short arm and 5'-terminus of this base sequence : 29462
aaagtccaggcaatgtggaaaaaccatccacatccccaagtaaaaaaaaaaaaaaaaaaaatatatatatatatatacacacacacacatatatatatatacacatatatatacacatatatgcacatatatacacatatatacacatatatatgcacatatatacacacatatatatatgcacatatatatacatatatatataattgtgcataatattgttttacttaatgtttttcctcccactcgtcccacattgtc

SEQ ID NO: 10193 - DNA, 197 bp, Homo sapiens
  DISO7_10002158
  Located on chromosome 6
  Distance between a terminus base of telomere on chromosomal short arm and 5'-terminus of this base sequence : 52012976
  Distance between 3'-terminus of neighbour sequence of sequence listing upward to telomere on chrosomal short arm and 5'-terminus of this base sequence : 50045
tctgctgaaagaggaagtcccatctaaagagttacctctgtaataagacatttcagaaatagattttagatctccatatcactgtttattaaatgtgtgtgatgcatgatgtgtgtgtgtttgtctgtgtgtgtgtgtgtgtgtgtgtgtgtgttttgtattagatattaaaatactaagctctaatgggcttagcg

SEQ ID NO: 10194 - DNA, 107 bp, Homo sapiens
  DISO7_10002159
  Located on chromosome 6
  Distance between a terminus base of telomere on chromosomal short arm and 5'-terminus of this base sequence : 52029632
  Distance between 3'-terminus of neighbour sequence of sequence listing upward to telomere on chrosomal short arm and 5'-terminus of this base sequence : 16459
ttaggtgtttgttattagccattacttattagctattacacacacacgcgcacacacacacacacacacacacttcagttcaaaagtagaggtggtagtgctggtag

SEQ ID NO: 10195 - DNA, 229 bp, Homo sapiens
  DISO7_10002160
  Located on chromosome 6
  Distance between a terminus base of telomere on chromosomal short arm and 5'-terminus of this base sequence : 52121651
  Distance between 3'-terminus of neighbour sequence of sequence listing upward to telomere on chrosomal short arm and 5'-terminus of this base sequence : 91912
gcacattaactcaaggtaatgcattttatttgtaactgctttccacagtttaactttacttagcttttaggtgacctcttaacctataatttttcaaagaaagtgtgtgtgtgtgtgtgtgtgtgtgtgtgtgtgtgtgtgtgtgtgttttgaagcacctttccagccaggggacctggattttcttttgacttttcattttcattaggaccctaatcacaaggaatca

SEQ ID NO: 10196 - DNA, 170 bp, Homo sapiens
  G08568
  Located on chromosome 6
  Distance between a terminus base of telomere on chromosomal short arm and 5'-terminus of this base sequence : 52143849
  Distance between 3'-terminus of neighbour sequence of sequence listing upward to telomere on chrosomal short arm and 5'-terminus of this base sequence : 21969
atcatcacatgagcaatttcttactataaacctcttaaaagatgactagatagaaacatatctagctagctagctagctagatgatagatagatagatagatagatagatagatagatagatagatatcctgttggttcagtttttctaggaacccctgactaaattccg

SEQ ID NO: 10197 - DNA, 242 bp, Homo sapiens
  AL022099.1_113906
  Located on chromosome 6
  Distance between a terminus base of telomere on chromosomal short arm and 5'-terminus of this base sequence : 52143851
  Distance between 3'-terminus of neighbour sequence of sequence listing upward to telomere on chrosomal short arm and 5'-terminus of this base sequence : -168
catcacatgagcaatttcttactataaacctcttaaaagatgactagatagaaacatatctagctagctagctagctagatgatagatagatagatagatagatagatagatagatagatagatatcctgttggttcagtttttctaggaacccctgactaaattccgtttctatgtggcttacatatccttgcatattttagcatatttagcatatttttctacgactgaacaaagtccta

SEQ ID NO: 10198 - DNA, 397 bp, Homo sapiens
  AL022099.1_105623
  Located on chromosome 6
  Distance between a terminus base of telomere on chromosomal short arm and 5'-terminus of this base sequence : 52152076
  Distance between 3'-terminus of neighbour sequence of sequence listing upward to telomere on chrosomal short arm and 5'-terminus of this base sequence : 7983
gcctaaccgtatcattgtaattagtctttgtcaaataattacaatttttaataagtaatggaatatttacatatatacatattctgttttagtagttttatcatggatagatacatatttgtctctatgtctgtaactgtatatatatatatatatatatatatatatatatatatatatataactattaaagagtccaaaaaagattaaaaattggaaaacagaaaagctgtggccaaaataagtggtactaatcagaaccagtataggaaatcatccatatagaaaatgagtctaatggtgtggctcagtaagtgttccatgacaacggctggttgtgtggcctcaactatttaacttctgaaatataaacatctggatgacctattaactggaa

SEQ ID NO: 10199 - DNA, 225 bp, Homo sapiens
  AL022099.1_78542
  Located on chromosome 6
  Distance between a terminus base of telomere on chromosomal short arm and 5'-terminus of this base sequence : 52179195
  Distance between 3'-terminus of neighbour sequence of sequence listing upward to telomere on chrosomal short arm and 5'-terminus of this base sequence : 26722
gaaggtgaatttggaagaatagaggatggcaaaaataaatgatatataggtagataaatgatagatcaatatttatgttagatgataggtttatgttagatgataggtagatagatagatagatagatagatagatagatagataataaaagctatatgtgtatctcctgctaaggaaggcttatgccgaaagtggttttgctcctgtatttgaaggcctacaaa

SEQ ID NO: 10200 - DNA, 324 bp, Homo sapiens
  AL022099.1_75138
  Located on chromosome 6
  Distance between a terminus base of telomere on chromosomal short arm and 5'-terminus of this base sequence : 52182555
  Distance between 3'-terminus of neighbour sequence of sequence listing upward to telomere on chrosomal short arm and 5'-terminus of this base sequence : 3135
taccttctgccatgactctaagcttcctgaggccctaaccagaagcaaatgacagcaccatgcttcctataaatcctgcagaactttgaaccagttaaacctctttttaaagtaattcatagtgtaaggtattcctttatagcaatacaagaaaagactaacacgtgtgtgtgtgtgtgtgtgtgtgtgagagagagagagagggagagatagactatcaccacaaccaagaaaaagaacatattcatcactccaaaaactttcccattgccctttgtaaccctttccttccaccatatccccaggcaaccgtaaattagtcat

SEQ ID NO: 10201 - DNA, 254 bp, Homo sapiens
  AL022099.1_62566
  Located on chromosome 6
  Distance between a terminus base of telomere on chromosomal short arm and 5'-terminus of this base sequence : 52195148
  Distance between 3'-terminus of neighbour sequence of sequence listing upward to telomere on chrosomal short arm and 5'-terminus of this base sequence : 12269
aatgagtttgcaagtattcctccctcttttatttttcaaaatagtttgagtaggattggtattagttattctgaaaatgcttggtaaaattcatctgtgaagccatcaggtctgcgttttttgtttgtgtgtggtttggtatttatttatttatttatttatttattttggatgctttttataatgccttcaatcttgttacttgttattattctgttcaggtttcaaatttcttcatggttcaatctttgtag

SEQ ID NO: 10202 - DNA, 370 bp, Homo sapiens
  HUMUT5011
  Located on chromosome 6
  Distance between a terminus base of telomere on chromosomal short arm and 5'-terminus of this base sequence : 52406134
  Distance between 3'-terminus of neighbour sequence of sequence listing upward to telomere on chrosomal short arm and 5'-terminus of this base sequence : 210732
gtgaataaaatcatatagtatggaccttccttcctttctttcctttctttcctttcttttctttcttttctttctttctttctcttctttctcttctttctcttctttctcttctttctttctttctttctttctttctttctttctttctttctttctttctttctttctttctttctttccttccttccttccttccttccttctttctttctttctctctttgacagagtctcactctgtcaccaggctggagtagagtggcgtgaccttggctcactgcaacctctgcctcccaggtttaagcgattcctgtgcctcagcctcctgagtagctgggactacaggtgtgtgccaccacacctatcta

SEQ ID NO: 10203 - DNA, 180 bp, Homo sapiens
  D6S269
  Located on chromosome 6
  Distance between a terminus base of telomere on chromosomal short arm and 5'-terminus of this base sequence : 52470835
  Distance between 3'-terminus of neighbour sequence of sequence listing upward to telomere on chrosomal short arm and 5'-terminus of this base sequence : 64331
ccttgctcatggttttacaagaaccttctgtcatgaagatgagaaaaaaagtttacttttcctttgggtaaggtcagttagcaaacacagatagccagtgatccttttcagtcccagacacacgcacacacacacacacacacacacacacacacactcctcttctaccatgtctttctg

SEQ ID NO: 10204 - DNA, 162 bp, Homo sapiens
  Z98748.1_36243
  Located on chromosome 6
  Distance between a terminus base of telomere on chromosomal short arm and 5'-terminus of this base sequence : 52470856
  Distance between 3'-terminus of neighbour sequence of sequence listing upward to telomere on chrosomal short arm and 5'-terminus of this base sequence : -159
aaccttctgtcatgaagatgagaaaaaaagtttacttttcctttgggtaaggtcagttagcaaacacagatagccagtgatccttttcagtcccagacacacgcacacacacacacacacacacacacacacacactcctcttctaccatgtctttctgtgg

SEQ ID NO: 10205 - DNA, 412 bp, Homo sapiens
  AL035687.13_53897
  Located on chromosome 6
  Distance between a terminus base of telomere on chromosomal short arm and 5'-terminus of this base sequence : 52589649
  Distance between 3'-terminus of neighbour sequence of sequence listing upward to telomere on chrosomal short arm and 5'-terminus of this base sequence : 118631
catttagccttcctacctcatctaaggggtggaaaggaagctaagaaatattcctgaaaggcaacagcccagggatggagacacacaaaaagactgagtcccaattgcagtataatagaacacttacccacccactcacacacacacacacacacacacacaccccttaccatcacatcaacaggactcctgtataataacaatgaatacaactaaaggaacagcagatcctaaataaagctcagatcctaaataaaaaggagtctctatggaaacacaaagacaacagaggatacaaaaaccaggactctagaggagtctgacgctctggctcctacagtcacagcaaatattgaaaacagcctaccttctagccagataaacataacttcttatgccaaagacctattta

SEQ ID NO: 10206 - DNA, 360 bp, Homo sapiens
  AL035687.13_49821
  Located on chromosome 6
  Distance between a terminus base of telomere on chromosomal short arm and 5'-terminus of this base sequence : 52593747
  Distance between 3'-terminus of neighbour sequence of sequence listing upward to telomere on chrosomal short arm and 5'-terminus of this base sequence : 3686
aaagttggtctttgtgatcaatagaatgtggcagaaatgacggtatatcatttctgataataagtgttaaaaaaaaaaacacggtcccatcttggttgctctctttctctctctctctctctctctctctctctctctctcggattatttacactgagagaagccaactgtcctgtcatgaacagcgcagtagagaagcccatgttgtaaggaaccacggtctttagccaacaacagcataaatgatcttaaaaacaaagcagatcctcccagtccagtcaagccttcagatgacttcagccctgatcagcagcttgactggaacctcatcagaaaccctgagccaaaactatgcagtag

SEQ ID NO: 10207 - DNA, 398 bp, Homo sapiens
  AL121950.8_72042
  Located on chromosome 6
  Distance between a terminus base of telomere on chromosomal short arm and 5'-terminus of this base sequence : 52944559
  Distance between 3'-terminus of neighbour sequence of sequence listing upward to telomere on chrosomal short arm and 5'-terminus of this base sequence : 350452
gtttcaagttgaggttaccaggcacagtggctcacacctgtaatctcagcactttgtgaggccgaaaaggggggatcacctgaggtcaagagttcagaaccagcctggccaacatggcgaaaccccatctctattaaaaaacaaaaattagctgggcatggtggcatgtgcctgtaatcccagctaatctggaggctaaggcaggagaattgcttgaacccggaaggcagaggttgtagagagctgagatcacgccattgcactccagcctgggcgacatgagtgaaactccatctcaaaataaataaataaataaataaataaataaataaataaatagagacatgcagtgtatacaatacagcacacaaaatcttaattgcatagctcatttaatt

SEQ ID NO: 10208 - DNA, 320 bp, Homo sapiens
  AL121950.8_72577
  Located on chromosome 6
  Distance between a terminus base of telomere on chromosomal short arm and 5'-terminus of this base sequence : 52945170
  Distance between 3'-terminus of neighbour sequence of sequence listing upward to telomere on chrosomal short arm and 5'-terminus of this base sequence : 213
gaccaagatggtgaaacctcgcctctactaaaaatacaaaaattagccgggcacggtggcaggcgcctgtaatcccaactacttgggaggctgaggcaggagaatcacttgaactggcgggatggaggttgcagtgagccgagatcatgccactgcactccagcctgggcagcagagtgagactccatttcaaaaaaaaaaaaaaaaaaaaaaaaaaaaaaaatatatatatatatatatatatatatatagaagttgataggactaagtcactatgtaatttataaagacatattctaagcctgactaccattgaacta

SEQ ID NO: 10209 - DNA, 178 bp, Homo sapiens
  chr6.fa.O7frz.55685459
  Located on chromosome 6
  Distance between a terminus base of telomere on chromosomal short arm and 5'-terminus of this base sequence : 53024721
  Distance between 3'-terminus of neighbour sequence of sequence listing upward to telomere on chrosomal short arm and 5'-terminus of this base sequence : 79231
tgaccatctaatctgtggtactttaaaagagaaagaagacactattaaaaaattattgcagaacaacctgtgtgtatatatatatatatatatatatatatatatatatatatgccaagaacttcccagaaaatcaagaaatactttcattttagtgagaatggaatactaggataca

SEQ ID NO: 10210 - DNA, 258 bp, Homo sapiens
  chr6.fa.O7frz.55803353
  Located on chromosome 6
  Distance between a terminus base of telomere on chromosomal short arm and 5'-terminus of this base sequence : 53142601
  Distance between 3'-terminus of neighbour sequence of sequence listing upward to telomere on chrosomal short arm and 5'-terminus of this base sequence : 117702
tgttggcatatagaaatgctactaattttgtatattgattttgtatcctgtaactttactgatttttttttatcagttctaatagttttgtgtgtgtgtgtgtgtgtgtgtgtgtgtgtgtgtgtgtagtctttaggtttttccatatataagatcatattatctacaaacaaggataatttgactcttcctttccaatttggatatcttgtatttctttctcttgcctgatttctctatctagaactgccagcatta

SEQ ID NO: 10211 - DNA, 267 bp, Homo sapiens
  chr6.fa.O7frz.56107758
  Located on chromosome 6
  Distance between a terminus base of telomere on chromosomal short arm and 5'-terminus of this base sequence : 53307891
  Distance between 3'-terminus of neighbour sequence of sequence listing upward to telomere on chrosomal short arm and 5'-terminus of this base sequence : 165032
cataattccatcatgaattgaggagcactgtgtgtgtgtgtgtgtgtgtgtgtgtgtgtgtgtgtgtatcttagagagaatcatacagtttgtttgtttctggatttttaaatttatattcataaaattgaactttgtggttggatgtagtttgcagtactgattttcattaatacatagcattcactttatctaataaactttatatgatcatataggttatttgctacagggagaatttggctgctcttaacattcttgtactgt

SEQ ID NO: 10212 - DNA, 380 bp, Homo sapiens
  chr6.fa.O7frz.56013065
  Located on chromosome 6
  Distance between a terminus base of telomere on chromosomal short arm and 5'-terminus of this base sequence : 53402565
  Distance between 3'-terminus of neighbour sequence of sequence listing upward to telomere on chrosomal short arm and 5'-terminus of this base sequence : 94407
caagtttacactttgtccttgtttgttttctaatttactcattaaaaaaaaaaatatatatatatatatatatatatatatatatgttttccccatagtgaactttgaaatagttcaatggccagaattatatcttatactttctttgtatcttctttagaaaatagcacagtaggaaccttataaatgcttgctggattttggagttaaatgtgatcatcaaatgatttttcaaattagtcattctgaaacctgttgtgaggaaaaaatatataaacaaatttacataaagttacaaattacagttagtagcttaatatattagcctttccaaagtttactaggcagaagcaagcctttaggtaaaggaagagcactat

SEQ ID NO: 10213 - DNA, 313 bp, Homo sapiens
  chr6.fa.O7frz.56364941
  Located on chromosome 6
  Distance between a terminus base of telomere on chromosomal short arm and 5'-terminus of this base sequence : 53612443
  Distance between 3'-terminus of neighbour sequence of sequence listing upward to telomere on chrosomal short arm and 5'-terminus of this base sequence : 209498
ttatgttggcattagaccatacattttctgattacaggcagcatggcttccttgcttcatttatcggtttgtccccaaaccatcatgttcttatgttcacctcattaaaggtgctcagtaatatgttcaaaccaataagagaagagagatctaaagaagcattttccgtaaactgtgtgtgtgtgtgtgtgtgtgtgtgtgtgtgtaacagtttaagaaactagcctttgtatattaatgtcctcaaaaattggaggtaattcagggattcagtcttctactcaattaagtgaattaaatgttcatcctaaga

SEQ ID NO: 10214 - DNA, 359 bp, Homo sapiens
  chr6.fa.O7frz.56479071
  Located on chromosome 6
  Distance between a terminus base of telomere on chromosomal short arm and 5'-terminus of this base sequence : 53778987
  Distance between 3'-terminus of neighbour sequence of sequence listing upward to telomere on chrosomal short arm and 5'-terminus of this base sequence : 166231
ttaattaggcatcactaaccttaccatgatatacacttatacacatacacacacaaaaaacacatattctcaaacttctctggatactataaagttatatacatagttatatatatatatatatatatatatatgcagacagagagatggagtctcgctctgtcaccaaggctgaagtgcagtgtcaccatctcggctcactgcaacatctgcctcctgggttcaagtgattctcctgcctcagccatctgagtagctgggattacaggtgcctgccaccatgcccggctaatttttgtatttttagtagagacagggtttcaccatgttggtcaggttggtctcgaactcctgacctc

SEQ ID NO: 10215 - DNA, 188 bp, Homo sapiens
  AL031224.1_100228
  Located on chromosome 6
  Distance between a terminus base of telomere on chromosomal short arm and 5'-terminus of this base sequence : 53993112
  Distance between 3'-terminus of neighbour sequence of sequence listing upward to telomere on chrosomal short arm and 5'-terminus of this base sequence : 213766
tccgctcttgacatagtaagaccctcaaacccactttcatacacacacacacacacacacacacattgaagttttagtactatgtacaatattctctgacattttaatttgattccatattttgtttcttttaatgttccttgtaaacccactacatttatttcacaactcactgtcgagtcatgagt

SEQ ID NO: 10216 - DNA, 113 bp, Homo sapiens
  Z67404
  Located on chromosome 6
  Distance between a terminus base of telomere on chromosomal short arm and 5'-terminus of this base sequence : 53995630
  Distance between 3'-terminus of neighbour sequence of sequence listing upward to telomere on chrosomal short arm and 5'-terminus of this base sequence : 2330
agctgaaatttgttatgatagaagatcaaattctctctctctgtctctctttctgtgtatgtgtgtgtgtgtgtgtgtgtgtgtgtgtgtgtttaaacagtgtgggacaatgg

SEQ ID NO: 10217 - DNA, 355 bp, Homo sapiens
  HUMUT892
  Located on chromosome 6
  Distance between a terminus base of telomere on chromosomal short arm and 5'-terminus of this base sequence : 54004166
  Distance between 3'-terminus of neighbour sequence of sequence listing upward to telomere on chrosomal short arm and 5'-terminus of this base sequence : 8423
atcctcctgtttgccctgttttacctctcccactattgtgcaaacagtaaagaaaaaggattggatggatggatggatggatgggtggatggacacatagacagacacacatagatagatagatagatagatagatagatagatagatagatagatagatagatagatgatagatagatagactctgttaaaatgttatttaaatatctgttttggtgtgaacaataacaatgtgcagctatattaatacatgtaacttgacttgctgtacaaagatgatgccactgatggtattatcctgttagttacaagatacttttgaagcctaaggtccacatgagtttatcctctggtc

SEQ ID NO: 10218 - DNA, 354 bp, Homo sapiens
  AL031224.1_24981
  Located on chromosome 6
  Distance between a terminus base of telomere on chromosomal short arm and 5'-terminus of this base sequence : 54068368
  Distance between 3'-terminus of neighbour sequence of sequence listing upward to telomere on chrosomal short arm and 5'-terminus of this base sequence : 63847
catgaaaatgaactaatccatacacacacacacacacacacacacacacacacacatatatatgtatttaatttaccaatcactaatcacaatttttatttttaaaaaactttctggccggtctcagtggctcacgcctgtaatcccaacactttgggaggccaaggcgggcggatcacctgaggccgggagtttgagactagcctgaccaacatggagaaaccccgcctctactaaaaatacaaaattagccaggcatggtggcacatgcctgtaatcccagctactcgggaggctgaggcaggagaattgcttgaatccaggaggcagaggttacagtgcattgtccaaaat

SEQ ID NO: 10219 - DNA, 250 bp, Homo sapiens
  AL049693.16_31092
  Located on chromosome 6
  Distance between a terminus base of telomere on chromosomal short arm and 5'-terminus of this base sequence : 54124282
  Distance between 3'-terminus of neighbour sequence of sequence listing upward to telomere on chrosomal short arm and 5'-terminus of this base sequence : 55560
gtttagtcaatagtaccagatgcaggaatattgtgttttatagtcttctttctcctcttccttctcccctgcctcttcttttcgatagagatttagtaagtggggccaagatgcacacacacacacacacacacacacacactctctctctctccatgtgtgtgtgtctctgaatatataggtagatctccatttccttcttcctctccctctcctttaaatagatcactgagtcaaccagatcttcatt

SEQ ID NO: 10220 - DNA, 190 bp, Homo sapiens
  D6S272
  Located on chromosome 6
  Distance between a terminus base of telomere on chromosomal short arm and 5'-terminus of this base sequence : 54140457
  Distance between 3'-terminus of neighbour sequence of sequence listing upward to telomere on chrosomal short arm and 5'-terminus of this base sequence : 15925
actgtgagcgtttgtgtctgtgtgtgttagtatggtaggagtttcaaaaagaaaaaatggttcttttcacttactgtgtatcagtcaggtttcaaccagagaacctgtaggatgggtgtgtgtgtgtgtgtgtgtgtgtgtgtgtgtgtgtgtgtgtgaaaaacaagaattgctttgcattttcagagct

SEQ ID NO: 10221 - DNA, 323 bp, Homo sapiens
  AL049693.16_65273
  Located on chromosome 6
  Distance between a terminus base of telomere on chromosomal short arm and 5'-terminus of this base sequence : 54158437
  Distance between 3'-terminus of neighbour sequence of sequence listing upward to telomere on chrosomal short arm and 5'-terminus of this base sequence : 17790
tttactgttaggccaatactacattgatttgattactgtagcagtgtactaaattttgaaattgggaagtgtgaattttccaactttgtttttctttttcaagactatttttttttcaaatttagtttttttattaaagtctttctttctttctttctttcttttctttctttctctctctttctctctctttattccttccttccttccttccttccttccttccttccttcctttcttccttccttccttcctttctttcttttcttttctttcctgctgttatcacccaggctggagtgcaatgctataatctgtaatct

SEQ ID NO: 10222 - DNA, 186 bp, Homo sapiens
  D6S436
  Located on chromosome 6
  Distance between a terminus base of telomere on chromosomal short arm and 5'-terminus of this base sequence : 54205156
  Distance between 3'-terminus of neighbour sequence of sequence listing upward to telomere on chrosomal short arm and 5'-terminus of this base sequence : 46396
cgtgttggacaagcctgatatagagtataccttaagaaatgtaatcttttcttaattcaaaatcaattgttagagtaataaagtaggactaagattcttatttcaactcgatgattaagtaggggtgtgtatgtgtgtgtgtgtgtgtgtgtgtgtgtgtgtgtgcgcgtgggaggttaccttaat

SEQ ID NO: 10223 - DNA, 232 bp, Homo sapiens
  AL049693.16_111984
  Located on chromosome 6
  Distance between a terminus base of telomere on chromosomal short arm and 5'-terminus of this base sequence : 54205246
  Distance between 3'-terminus of neighbour sequence of sequence listing upward to telomere on chrosomal short arm and 5'-terminus of this base sequence : -96
aagattcttatttcaactcgatgattaagtaggggtgtgtatgtgtgtgtgtgtgtgtgtgtgtgtgtgtgtgtgcgcgtgggaggttaccttaattgagagatcccctcaatcatctccctaggctttggcttgatttacttcattgacatttagcaagtttcattggataaattccaagtcccttccatttccaaacctatgaatttagtcaccatgaattaacatatgc

SEQ ID NO: 10224 - DNA, 229 bp, Homo sapiens
  AL136973.7_58365
  Located on chromosome 6
  Distance between a terminus base of telomere on chromosomal short arm and 5'-terminus of this base sequence : 54269746
  Distance between 3'-terminus of neighbour sequence of sequence listing upward to telomere on chrosomal short arm and 5'-terminus of this base sequence : 64268
taccattggagatctttattgaagcatgtttttgtatgtccattgctcccttatgatgaatccttagaagtggactttctacattaatgcctttatgtgtacgtgtgtgtgtgtgtgtgtgtgtgtgtgtgtgtgtgtgtgtgttttgtgtgcatatgtttggataaactttgtttctggaaacacagtaaaatttcactctcaagtagaattgtaccttccactgttc

SEQ ID NO: 10225 - DNA, 184 bp, Homo sapiens
  D6S427
  Located on chromosome 6
  Distance between a terminus base of telomere on chromosomal short arm and 5'-terminus of this base sequence : 54282589
  Distance between 3'-terminus of neighbour sequence of sequence listing upward to telomere on chrosomal short arm and 5'-terminus of this base sequence : 12614
cccatacctatgttgctccttatcaggggacacacacacacacacacacacacacatatacacacacacagagataatagttccccaggagtaaatatcttgtcttatttttccttttttatctcacagataaaaattgcaatttgaaaagataattcttcccaactgtcagaccccactagaa

SEQ ID NO: 10226 - DNA, 196 bp, Homo sapiens
  D6S465
  Located on chromosome 6
  Distance between a terminus base of telomere on chromosomal short arm and 5'-terminus of this base sequence : 54458190
  Distance between 3'-terminus of neighbour sequence of sequence listing upward to telomere on chrosomal short arm and 5'-terminus of this base sequence : 175417
ccattttatgccatttctctcttttcaatcatataactttaaaaatgcctatatatatatatatatgtgtgtgtgtgtgtgtgtgtgtgtgtgtgtgtgtgtgtttttacaaagagtagaaaattcccttctggacttattttccatgtgctgagtttaagcctggagcacacttttactgctggaaatagggggt

SEQ ID NO: 10227 - DNA, 321 bp, Homo sapiens
  chr6.fa.O7frz.57352269
  Located on chromosome 6
  Distance between a terminus base of telomere on chromosomal short arm and 5'-terminus of this base sequence : 54540326
  Distance between 3'-terminus of neighbour sequence of sequence listing upward to telomere on chrosomal short arm and 5'-terminus of this base sequence : 81940
ggcctaagaatttgtatcattcacaagttcccgggtattactgatgctgctggtctcagggtcgcagattgacaatcactgggagtccctatcctgtgaagaaaaccacattttctctcctatcttcttagattattcttgattgtgctgtctttgcattttgttcccaccattattatggtgtagacaatattgtattatattatattatgttatattatattatattatattatattataattaaattatgttatatgggaattatttgcctatacatttattcaggtgaaagtcctttatctaggcataatccagata

SEQ ID NO: 10228 - DNA, 119 bp, Homo sapiens
  D6S1714
  Located on chromosome 6
  Distance between a terminus base of telomere on chromosomal short arm and 5'-terminus of this base sequence : 54850987
  Distance between 3'-terminus of neighbour sequence of sequence listing upward to telomere on chrosomal short arm and 5'-terminus of this base sequence : 310340
tgtatccactgccatcacttttgcttctggaaagtttaagaattctgtagaaaatcacataattcacacacacacacacacacacacacacaccactgagttctgtgtcatttggtgct

SEQ ID NO: 10229 - DNA, 368 bp, Homo sapiens
  chr6.fa.O7frz.57754360
  Located on chromosome 6
  Distance between a terminus base of telomere on chromosomal short arm and 5'-terminus of this base sequence : 54960188
  Distance between 3'-terminus of neighbour sequence of sequence listing upward to telomere on chrosomal short arm and 5'-terminus of this base sequence : 109082
gaagataaggatgcagtctttctataactaaactcttttcaaagaagtgctagctttatagtctgcctttttcatcaaatccacacaggtggtttctttattctactctgcccatcattttttttcaaactggtcttaaaaataggcagaagaggcagtttcaaagtgcccagaggcacacgattcaagactaaaagccagtttcctgacaccctgaagaaaaaccatctgctggcctgattgtgtgtgtgtgtgtgagagagagagagagagagagagagagacaggatggaaggggaggagagaaaaatagctcttctcactctcacctcatgagaagagtcccatttaaactttggacaataaat

SEQ ID NO: 10230 - DNA, 309 bp, Homo sapiens
  AL121946.20_79428
  Located on chromosome 6
  Distance between a terminus base of telomere on chromosomal short arm and 5'-terminus of this base sequence : 55075871
  Distance between 3'-terminus of neighbour sequence of sequence listing upward to telomere on chrosomal short arm and 5'-terminus of this base sequence : 115315
ctctgtttgcttactttgtaggacttaaatctttattctaagaataactgccaaggcctttcaaaatcatttagggtgggggagggagagagggagagagggagaggtgggggggagagagagagagagagagagaaaggagaaagaaaaggataatttattaaaataatgtttgcatcagaataaaggaacttacaaaaaaaactagaaatattgtcctcaaatatatacaaattatttcccccttatttctggatgcaacatcaccattatccatagcaaaacattagatgctgtcttgtatgtgga

SEQ ID NO: 10231 - DNA, 338 bp, Homo sapiens
  AL121946.20_129118
  Located on chromosome 6
  Distance between a terminus base of telomere on chromosomal short arm and 5'-terminus of this base sequence : 55125643
  Distance between 3'-terminus of neighbour sequence of sequence listing upward to telomere on chrosomal short arm and 5'-terminus of this base sequence : 49463
ctatttgatatggagtgatcagagactgctctgattggattggattggattggattggattggattggattggattgggaaaggagcagagaagtagagtatgagccagaggctatcaaaggaggaccttgaaaaaagggtgtgcttggagtactgcagctgcagcctgaaggatcaggcggctggccctggaggaaggaacgctgtatagccagatggcctttctagtgatgcaatgagaaacactgcacaaagacctgggtagacatcaagttcttcatatgtcatagaaaaaaaaaatcaaggaaaacactcagtaacatataacgaggtcagca

SEQ ID NO: 10232 - DNA, 220 bp, Homo sapiens
  AL121946.20_129887
  Located on chromosome 6
  Distance between a terminus base of telomere on chromosomal short arm and 5'-terminus of this base sequence : 55126336
  Distance between 3'-terminus of neighbour sequence of sequence listing upward to telomere on chrosomal short arm and 5'-terminus of this base sequence : 355
tactggaaactgattcaattcttcccattttttagtacacaataagccagatctcagaaagccacagaaaggcaagtggaagtgtgggaagttgtgtgtgtgtgtgtatgtgtgtgtgtgtgtgtgtgtgtatgccactcacgcactcacgtgcatgcacatgaatacacacacacacacacacagagccagatcagaagattgacagatacatgctagc

SEQ ID NO: 10233 - DNA, 168 bp, Homo sapiens
  HUMUT7510
  Located on chromosome 6
  Distance between a terminus base of telomere on chromosomal short arm and 5'-terminus of this base sequence : 55217484
  Distance between 3'-terminus of neighbour sequence of sequence listing upward to telomere on chrosomal short arm and 5'-terminus of this base sequence : 90928
ctggtctgcctttttaacatattaacccagttacctcagccctgtggttatttatgcttctccagctctctatctatctatctatctatctatctatctatctatctcttacaattgagtagtactcaaatgagaatagatgggccatgttcagagaaggaacaacca

SEQ ID NO: 10234 - DNA, 458 bp, Homo sapiens
  chr6.fa.O7frz.58101566
  Located on chromosome 6
  Distance between a terminus base of telomere on chromosomal short arm and 5'-terminus of this base sequence : 55289895
  Distance between 3'-terminus of neighbour sequence of sequence listing upward to telomere on chrosomal short arm and 5'-terminus of this base sequence : 72243
ttatgctatttcgagtaaccatgtactagtaataatgataatgataattcagtccaaatgaaaaatgttaatacttagctctatagttgctagaaattaaagcaattttattgattgattgattgattgattgagacagggtctccctctgtcaccaggctggagttcagtggcatgattgcagctcacttaacctctgcctccaaggttcaagtgatcctctcacctcagcctgctgagtagctgagaccacaagtgcacaccaccatgcccagctaatttttgtatttttttgtagaaattgggtttcgccatgttgcctaggcttacttttatttttaattacaaagtttaaatttgaagtttaatttcaagtttgtatatacatttatctgttgaagtctctaatagagtaataaataacatatttgcaaacataatgcattacagtacgataa

SEQ ID NO: 10235 - DNA, 224 bp, Homo sapiens
  AL034343.17_8723
  Located on chromosome 6
  Distance between a terminus base of telomere on chromosomal short arm and 5'-terminus of this base sequence : 55498146
  Distance between 3'-terminus of neighbour sequence of sequence listing upward to telomere on chrosomal short arm and 5'-terminus of this base sequence : 207793
gatatgattctaggatatgcaggagccatcttgcccttgaagggaaagttaagagaacagcagagaagtctaccagggaccctgatgttattgagtctatatatatatatatatatatatatatatatattattttattttttattttttatttttttttttgagacagagtcttgctctgttgccaggctggagtgcagtggtagaatcttggcttgctgtaa

SEQ ID NO: 10236 - DNA, 376 bp, Homo sapiens
  AL136125.5_21219
  Located on chromosome 6
  Distance between a terminus base of telomere on chromosomal short arm and 5'-terminus of this base sequence : 55572572
  Distance between 3'-terminus of neighbour sequence of sequence listing upward to telomere on chrosomal short arm and 5'-terminus of this base sequence : 74202
gtctgcctcgcattctagtggtgataaaaaaaatagtaaaccaaacaaatagggaaaagaccatggctccacggaaagctccagccatctagcctcctctgtggcccaccagaaagctgttgtgctcttttcataaactctacgttgaaaagagattagatgccctcctaccctctaaaaggatctgggtgtgtgtgtgtgtgtgtctaaaaggatctgggtgtgtgtgtgtgtgtgtgtgtgtgtgtatgtgtatgtgtgtgtgtgtgtgtgtgtgtgatatttattcagagttggtaggtggggggtgggtaaaaaggaaagaaagacttaactcacacaaaccaaacccttctacatgttgcattctctaaag

SEQ ID NO: 10237 - DNA, 436 bp, Homo sapiens
  chr6.fa.O7frz.58494258
  Located on chromosome 6
  Distance between a terminus base of telomere on chromosomal short arm and 5'-terminus of this base sequence : 55684585
  Distance between 3'-terminus of neighbour sequence of sequence listing upward to telomere on chrosomal short arm and 5'-terminus of this base sequence : 111637
tcctaattcagattgagtctttacagagataaattaaaatgaggtcattagggtgggacctgtttcaatatgactggtggtcttctaaaaagggagaaatttagacacagagacagacacaaacagagggagggtgatgacaagagacagggagatgacgaccatttacaagccaagagagacctagaacagatccttccctcacagccctcagaaggaatcaaccctgccaccatcttgatttcagacttctggtctccagaactgtgagacaatacatttctgttgtttaagccattcagtttgtggtactttgttatggccatcctaggaaatacacacagacagacacacacacacacacacacacacacacacacacacacacacacacacacacacacgccagagaattaaagatctgacagatcttcag

SEQ ID NO: 10238 - DNA, 354 bp, Homo sapiens
  AL109918.25_67965
  Located on chromosome 6
  Distance between a terminus base of telomere on chromosomal short arm and 5'-terminus of this base sequence : 55836881
  Distance between 3'-terminus of neighbour sequence of sequence listing upward to telomere on chrosomal short arm and 5'-terminus of this base sequence : 151860
gacctgtaaaccaagtactcagaggttgatgtttcacaatctactttagaaagaactcagtttaaaatgctaagattgtttttgaaaaaaaattttcactgtcaaagacaatgtctaaataacttctattacagaacagaaaagaacatctgggcatttttgcctgcctttatgagaggtggaaagaaagtggggagagagatatagagagtgtgtgtatgtgtgtgtttgtgtgtgtgtgtgtgtgtgtgtgtgtgtgtgtgtgtgtgtggaaggaatcattttattctaactcacatctcttcattgtttaccagctggtgggaacaaatgaaattacattagctgtgaggt

SEQ ID NO: 10239 - DNA, 226 bp, Homo sapiens
  AL109918.25_147618
  Located on chromosome 6
  Distance between a terminus base of telomere on chromosomal short arm and 5'-terminus of this base sequence : 55916610
  Distance between 3'-terminus of neighbour sequence of sequence listing upward to telomere on chrosomal short arm and 5'-terminus of this base sequence : 79375
ctgacttaagatgacctaactcagaacctacctctactccagctgcagccaggagccaccggatggactccattctgccccgtatattggagtagtggagcttgggcttctctgccatggtagcagtctcctggaggtttctctaagcctgagtgaatgaatgaatgaatgaatgaataattgaaacgatagaatcaaaaatgtactttaggatgtatggttgaaa

SEQ ID NO: 10240 - DNA, 281 bp, Homo sapiens
  AF052051.1_536
  Located on chromosome 6
  Distance between a terminus base of telomere on chromosomal short arm and 5'-terminus of this base sequence : 56155770
  Distance between 3'-terminus of neighbour sequence of sequence listing upward to telomere on chrosomal short arm and 5'-terminus of this base sequence : 238934
aagtagcaccatgagtttgaagaatatgagtaagaaaaggtgaaatactaaggaggtaggtggtaaagcaattgctaatcagatcaaagggaagggaggaggaagaaaagtctagaatgatgccctgtccaacacacacacacacacacacacacacacacacacacacacacacacacacacacacttcttgtcttttttttaataacatgtattgtcatctaacaggacttttttatttatttgtctgtagattcctagaatgtaaattccacgagatc

SEQ ID NO: 10241 - DNA, 427 bp, Homo sapiens
  AL034374.2_39692
  Located on chromosome 6
  Distance between a terminus base of telomere on chromosomal short arm and 5'-terminus of this base sequence : 56463020
  Distance between 3'-terminus of neighbour sequence of sequence listing upward to telomere on chrosomal short arm and 5'-terminus of this base sequence : 306969
aaacacggactaaatcctagttacagatggcatttcctcggggaaaactttctcagtgctagttatctggaactctaacagaggtgctctcttctcttctactacatgatcagtaaagacactttgtaaagtgtgagcccataaaaaacaaaaacagaaacaaaaaatgcatgtacacacacaaacacacacacctcttttattttattttattttattttattttattgatcattcttgggtgtttctcgcagagggggatttggcagggtcataggacaacagcggagggaaggtcagcaggcaaacaagtgaacaaaggtctctggttttcctaggcagagtgtttgtgtccctgggtacttgagactggggagtggtgatgactctcaacgagcatgctgccttcaagcatctgtttaacaaa

SEQ ID NO: 10242 - DNA, 342 bp, Homo sapiens
  chr6.fa.O7frz.59331412
  Located on chromosome 6
  Distance between a terminus base of telomere on chromosomal short arm and 5'-terminus of this base sequence : 56582410
  Distance between 3'-terminus of neighbour sequence of sequence listing upward to telomere on chrosomal short arm and 5'-terminus of this base sequence : 118963
ggaattaggcttagcattaaatgataatatccaaaaagaacagtggcttttaaaagatctttctttcttttctcccttccttccttccttcctctctttctctctctttctttctttctttcttttctcccttccttccttccttcctctctttctctctctctctctttctttctttctttcttctccttccttccttccttcatttctttctttctttttttcttctcaggatcttgctctgttgcccaggctggagtacagtggtgtgatcttggctcactgcaacttctgcctcctgggctccagtgatcctctcacctcatctttctgagtagctgg

SEQ ID NO: 10243 - DNA, 375 bp, Homo sapiens
  AL033397.7_83926
  Located on chromosome 6
  Distance between a terminus base of telomere on chromosomal short arm and 5'-terminus of this base sequence : 56699172
  Distance between 3'-terminus of neighbour sequence of sequence listing upward to telomere on chrosomal short arm and 5'-terminus of this base sequence : 116420
aagtgaaatacatcggtcacagaaggacaaatactgcttaattctacttatatcaagtactaaagtagtcaaactcatagaatcagaaagcagaattgttgccaggagctaggtggaggggaaaattgaggaactgctaatcggtgagcatggtttcaattatgcaagataaactagttctagagatctgtaaaacattgcccctgtagttaacaatactatatttgtgcacttaaaaatctgttaaggaggtagagctcatgttaagtgtcttgccacacacacacacacacacacacacacacacacacacaaaagtcctggttggaatcttctaaatgtatgtcaacccactactgaatcatgacctgcagt

SEQ ID NO: 10244 - DNA, 270 bp, Homo sapiens
  D6S1623
  Located on chromosome 6
  Distance between a terminus base of telomere on chromosomal short arm and 5'-terminus of this base sequence : 56699357
  Distance between 3'-terminus of neighbour sequence of sequence listing upward to telomere on chrosomal short arm and 5'-terminus of this base sequence : -190
atctgtaaaacattgcccctgtagttaacaatactatatttgtgcacttaaaaatctgttaaggaggtagagctcatgttaagtgtcttgccacacacacacacacacacacacacacacacacacacaaaagtcctggttggaatcttctaaatgtatgtcaacccactactgaatcatgacctgcagtctgaaaaataatgctcttacaaaagggtgattagattcacatgatgatgccgctagaggaatggttacaggcatcagcaa

SEQ ID NO: 10245 - DNA, 449 bp, Homo sapiens
  AL033397.7_102842
  Located on chromosome 6
  Distance between a terminus base of telomere on chromosomal short arm and 5'-terminus of this base sequence : 56718007
  Distance between 3'-terminus of neighbour sequence of sequence listing upward to telomere on chrosomal short arm and 5'-terminus of this base sequence : 18380
gaaagtccaagcatgtcatgaatgatctgtgtaagtcacaataagaggatttatttaaaaaaaaaaactttcagccgggcacggtggctcacacctgtaatcccagcactttgggaggccgaggcaggtggatcacctgaggtcaggagttcaagaccagcctggccaacatggcaaaacctcatctctactaaaaaatacaaaaaaattagccaggtgtggtgtcaggtgcctataatcccagatacgcagaaggttgaggcagggagaattgcttgaacccgtgaggtggaggttgcagtgagccaagattgcgccactgcatgccagcctgggtgacagagtgagagtctgtctcaaaacaaaacaaaacaaaacaaaacaaaacttttatatgatcaagttgtatatgattaaagggaaattataatggtctttctagaaattgg

SEQ ID NO: 10246 - DNA, 412 bp, Homo sapiens
  chr6.fa.O7frz.59566034
  Located on chromosome 6
  Distance between a terminus base of telomere on chromosomal short arm and 5'-terminus of this base sequence : 56816260
  Distance between 3'-terminus of neighbour sequence of sequence listing upward to telomere on chrosomal short arm and 5'-terminus of this base sequence : 97804
ataaatccacctcattccttataatcggtgcatagtaatgcatagtaagggtatatcatacattgttcaactattatcctgttgataagcatttatgtatttaggtggtttacaattttttgtttttgttttgtgtgtgtgtgtgtgtgtgtgtgtgtgtgtgtgtgtgtgtgtgttttaaatcccattgtaatttcatcctgaggggtaaaactcagctttggctctccttgaagggttttcaatttgatgggtggtgtatgtgttaaagtaattttgtagcccttctattgtatttgctcctgttcctatccatgcagaagaagagtagcaggtaggcagaaaatagagatggtctaattcttttccagtgcttttgttttcctctttaagctccaattatcatattcac

SEQ ID NO: 10247 - DNA, 253 bp, Homo sapiens
  D6S1662
  Located on chromosome 6
  Distance between a terminus base of telomere on chromosomal short arm and 5'-terminus of this base sequence : 56902787
  Distance between 3'-terminus of neighbour sequence of sequence listing upward to telomere on chrosomal short arm and 5'-terminus of this base sequence : 86115
gaatcgcttgaacccgggaggcagaggttgcagtgagctgagatggcaccattgcactccagactggcaacagaggcagactccatctcaaaaacaacaacaacaacaacacacacacacacacacacacacacacacacacacacacacacaaactctcaggctgaggcagtgtgaattacaagggggtgcctggacctacaccctcccacctttttttcagagttcttccttcatccaactccaaagctta

SEQ ID NO: 10248 - DNA, 255 bp, Homo sapiens
  D6S1573
  Located on chromosome 6
  Distance between a terminus base of telomere on chromosomal short arm and 5'-terminus of this base sequence : 57170040
  Distance between 3'-terminus of neighbour sequence of sequence listing upward to telomere on chrosomal short arm and 5'-terminus of this base sequence : 267000
tcatctgctacacctggcacttaattgaatgctggaattatgtggttttatgccactgatcacactcaagcctagtttattagatgtctccagggaaacagaactaataggacacacacacacacacacacacacacacacacgtgaatatatatatatataaatcatatatatatgaatctattcctaatctctctctctgagacagatttattaggaattaattcatatatttctggggactgagaaattcca

SEQ ID NO: 10249 - DNA, 274 bp, Homo sapiens
  AL133265.5_14679
  Located on chromosome 6
  Distance between a terminus base of telomere on chromosomal short arm and 5'-terminus of this base sequence : 57412158
  Distance between 3'-terminus of neighbour sequence of sequence listing upward to telomere on chrosomal short arm and 5'-terminus of this base sequence : 241863
ttattgaatcttaaagctgcacagagctctcagatcatctggtccagtggctttcaaatttgtgaaccacaaatacagtgtgtgtgtgtgttcatatatatctgaaacagagtctctgaaatagtgcttattaatatattttcgattaaattctattctattctattctattctattctattctattctattctattctattctattctattcttcttttatctaattcgttttttaaaatgccaaacaggactcactgatagtcatgacttgt

SEQ ID NO: 10250 - DNA, 290 bp, Homo sapiens
  chr6.fa.O7frz.60093239
  Located on chromosome 6
  Distance between a terminus base of telomere on chromosomal short arm and 5'-terminus of this base sequence : 57621415
  Distance between 3'-terminus of neighbour sequence of sequence listing upward to telomere on chrosomal short arm and 5'-terminus of this base sequence : 208983
tagcaaggctatcttcctattctctctgtctctttgtctctctctctcttacacacacccacacacacacacacacacaccactttgctctacattgaaaaagggactgtattatgtcccccaaaaaacacagatcagagaaagtggtttggcagaacatggtatttcctctttaaggtttacattttacatatttaaatatacctgaaaactgccaattataaacatgactgtaatttccacttttcagtccattttcacagcatctagctaagatcttatgtcaggaa

SEQ ID NO: 10251 - DNA, 99 bp, Homo sapiens
  D6S295
  Located on chromosome 6
  Distance between a terminus base of telomere on chromosomal short arm and 5'-terminus of this base sequence : 57733515
  Distance between 3'-terminus of neighbour sequence of sequence listing upward to telomere on chrosomal short arm and 5'-terminus of this base sequence : 111810
gcaatttcttggagggagagagggtgtgtgtgtgtgtgtgtgtgtgtgtgtgtgtgtgtgtgtgtgtgttggggaaagtccaagcagagcatgaggctc

SEQ ID NO: 10252 - DNA, 120 bp, Homo sapiens
  DISO7_10017434
  Located on chromosome 6
  Distance between a terminus base of telomere on chromosomal short arm and 5'-terminus of this base sequence : 57989296
  Distance between 3'-terminus of neighbour sequence of sequence listing upward to telomere on chrosomal short arm and 5'-terminus of this base sequence : 255682
gccactaattcaatcattcaacacgtgtgtgtgtgtgtgtgcgtgtgtgtgtgtgcatgtgtgtgtgtgtgtgtgtgtctgtgtgtgtgtgtgtaccagggggttacctgctatgtgcca

SEQ ID NO: 10253 - DNA, 122 bp, Homo sapiens
  DISO7_10017436
  Located on chromosome 6
  Distance between a terminus base of telomere on chromosomal short arm and 5'-terminus of this base sequence : 58128864
  Distance between 3'-terminus of neighbour sequence of sequence listing upward to telomere on chrosomal short arm and 5'-terminus of this base sequence : 139448
ttcttaggagtcaagatctcaaagaaaagaaagcaagcaagcaagaaagaaagaaagaaagaaagaaagaaagaaagaaagaaagaaagaaagaaagaaaagaaagagcacaacttcctagg

SEQ ID NO: 10254 - DNA, 173 bp, Homo sapiens
  Z67314
  Located on chromosome 6
  Distance between a terminus base of telomere on chromosomal short arm and 5'-terminus of this base sequence : 58230096
  Distance between 3'-terminus of neighbour sequence of sequence listing upward to telomere on chrosomal short arm and 5'-terminus of this base sequence : 101110
ggaatgcagaatgacacacagcgtgtgtgtgtgtgtgtgtgtgtgtgtatgtgtaatagaaaaatattttatacatttttatatagaatgttaccaactatttgtttgcttctttgttttttgatacagatgttagaattgaaagaaatgcccctaaactttacttaggaagt

SEQ ID NO: 10255 - DNA, 389 bp, Homo sapiens
  AC026838.4_22517
  Located on chromosome 6
  Distance between a terminus base of telomere on chromosomal short arm and 5'-terminus of this base sequence : 58597550
  Distance between 3'-terminus of neighbour sequence of sequence listing upward to telomere on chrosomal short arm and 5'-terminus of this base sequence : 367281
gaacaaacttctgttcagtgatactatttactacagtcacagccttaaagatatatgattttttttgtggcctgggtccttgagacatatgccagctcacaagaaaatagaaattattttgccctccatatctttttgtgctttgcttcttattaattattattattattattattattattatttttgctaacagaaatttaatacaaatttattatggccacctgctagatactctcttctgcttttaagaactttataaacatgttatgttactggatgggttttattctttctttctctttctaatcttttttctcttttagtcagtctaaattcaatgaaaattggatttacctctctctgggttacgtatttggatttcctgt

SEQ ID NO: 10256 - DNA, 92 bp, Homo sapiens
  D6S294
  Located on chromosome 6
  Distance between a terminus base of telomere on chromosomal short arm and 5'-terminus of this base sequence : 58598470
  Distance between 3'-terminus of neighbour sequence of sequence listing upward to telomere on chrosomal short arm and 5'-terminus of this base sequence : 531
tgcattgttgtcatgccttcttgctgtaacacacacacacacacacacacacacacacacactgatacagacaatcgaagatggagacttta

SEQ ID NO: 10257 - DNA, 268 bp, Homo sapiens
  D6S1636
  Located on chromosome 6
  Distance between a terminus base of telomere on chromosomal short arm and 5'-terminus of this base sequence : 58709824
  Distance between 3'-terminus of neighbour sequence of sequence listing upward to telomere on chrosomal short arm and 5'-terminus of this base sequence : 111262
cattgcactccagcctcggcgacagagcgagactccatctcacacacatacacacacacacacacacacacacacacacacacacacaagtagtggtctaactcacagggcattggatggtgcatgcatatatttttacagcaaaatagaagtgaatctttataaaaaaatataatctatcgcaataccctttttatataggggaaacatgaggctcagaggttaaattaactgtccaagagtagtgcatctagtggacgactcattt

SEQ ID NO: 10258 - DNA, 235 bp, Homo sapiens
  D6S428
  Located on chromosome 6
  Distance between a terminus base of telomere on chromosomal short arm and 5'-terminus of this base sequence : 58956633
  Distance between 3'-terminus of neighbour sequence of sequence listing upward to telomere on chrosomal short arm and 5'-terminus of this base sequence : 246541
gctcagcatgaacatcaaaattatatacattcccctggtcttccttctataatttgatatgtgtgtgtgtgtgtgtgtgtgtgtatgtgtctgtgtgtgtctgtgtgtgtgtgtttcccatcagcattaaattgatatcatagatacatgtatgtacagcatatttaatggaattattcattagagaatgaagactaaatcattgtcacaacagtggctttgtaaatccaagagg

SEQ ID NO: 10259 - DNA, 283 bp, Homo sapiens
  D6S1661
  Located on chromosome 6
  Distance between a terminus base of telomere on chromosomal short arm and 5'-terminus of this base sequence : 59092424
  Distance between 3'-terminus of neighbour sequence of sequence listing upward to telomere on chrosomal short arm and 5'-terminus of this base sequence : 135556
ttgcaaagactgacatgaattgtgcattcgtaatattttgttgaaagactgtgtgtgtgtgtgtgtgtgtgtgtgtgtgtgtagacacacctgaagaaaattagataatagtcctccaaataatgaaaaggtaaatattttaatcattgtcttcttatgtctttctcctgctaatctcagaaaaataaaactgagtagcataattcacatgtattgacttaagtacgaaagaaaggattttacatttaatttacctggttgaccatccatttttgaaaggccc

SEQ ID NO: 10260 - DNA, 411 bp, Homo sapiens
  AL137178.7_78870
  Located on chromosome 6
  Distance between a terminus base of telomere on chromosomal short arm and 5'-terminus of this base sequence : 59139664
  Distance between 3'-terminus of neighbour sequence of sequence listing upward to telomere on chrosomal short arm and 5'-terminus of this base sequence : 46957
ggattacttgcatgagctactctgccccgtgttgtttgtttgtttgtttgtttgtttgtttgtttgcttttaaagcattttttataaattcttacccctggtccagtacaaagtctctcaaaaacctctgtcattattcagaattgagaggggaacatattttccctctttagtaaccttccaaacaaatgaagtcaaagaactgttccttttgggaatattaagaaatgctgaagaatttaggacagtaagtatcagacatattattatataatctggctgtgtaagatagtgtattgtacaagtggtattaattgattcacaaagctcaaaaattggaaatctttagaagattaattaaaatttataacactgctatacatatatgaaacttaggatcctaagctagaa

SEQ ID NO: 10261 - DNA, 296 bp, Homo sapiens
  AL137178.7_62959
  Located on chromosome 6
  Distance between a terminus base of telomere on chromosomal short arm and 5'-terminus of this base sequence : 59155515
  Distance between 3'-terminus of neighbour sequence of sequence listing upward to telomere on chrosomal short arm and 5'-terminus of this base sequence : 15440
actttgtagattgccagttgacaatatctgggctgtaaagatcttaactgcctaacctcaccccaccaacacacacacaaacacatacatacatacacacacacacacacacacacacacacacacgtaggcattactggaagacctcccaggttatcttgtttaccctcccagcctttagactggtgccaactaacatattccagagtgctgtcaactctacgttcacacagctgtactttcatgattttttattccagtgcaaagaatcagtgttaggaagttccttgaatcta

SEQ ID NO: 10262 - DNA, 429 bp, Homo sapiens
  AL137178.7_57995
  Located on chromosome 6
  Distance between a terminus base of telomere on chromosomal short arm and 5'-terminus of this base sequence : 59160324
  Distance between 3'-terminus of neighbour sequence of sequence listing upward to telomere on chrosomal short arm and 5'-terminus of this base sequence : 4513
gaacagaatctcattggtcactggagctatgtttttctccaaaaaaaattttgattctcttttcttcagtttaaattgtttctattgatttgttttcaagtataatggcccagagtccatatatattgtgttactttgctaaggctgccacaacaaaatgccacagactggttagcttaaaccacaaaaatgtatttcctcatagtactaaagactacaagaccaaactcaaggtgtcacaggtctggtggtggtgtttgtttgtttgtttgtttgtttgtagtccttttcttggcatgcagatggtcaccctcttgctgcctcttcacatggctgtctctctgtgcatacacaccccctggggtctttctgtgcatccaaatgtcctctttttataaagacattagctcagttgaattatgtttcacc

SEQ ID NO: 10263 - DNA, 177 bp, Homo sapiens
  AL137178.7_57679
  Located on chromosome 6
  Distance between a terminus base of telomere on chromosomal short arm and 5'-terminus of this base sequence : 59160836
  Distance between 3'-terminus of neighbour sequence of sequence listing upward to telomere on chrosomal short arm and 5'-terminus of this base sequence : 83
gcttcaacatatgaatttggagagaacaaagttcagcccataacagagagagagagacagagagagagagagagagagagagagatttttctatccttaaacatatttatgcatttccaaatccttgtctgctaattcaaatatctgtatcatcttgcagtagatttctattaaccg

SEQ ID NO: 10264 - DNA, 195 bp, Homo sapiens
  G10114
  Located on chromosome 6
  Distance between a terminus base of telomere on chromosomal short arm and 5'-terminus of this base sequence : 59169236
  Distance between 3'-terminus of neighbour sequence of sequence listing upward to telomere on chrosomal short arm and 5'-terminus of this base sequence : 8223
cttagacatgcctggcaaatgtcaagtagaacataaatatttacctgatagaaaagtttatgtgtgtatttatagataggtagttaggtaagtaggtagatagatagatagatagatagatagatagatagatagatcgatagatatagatagatagatagattagaggtagatagatagatccctacctaggat

SEQ ID NO: 10265 - DNA, 403 bp, Homo sapiens
  AL034452.8_92704
  Located on chromosome 6
  Distance between a terminus base of telomere on chromosomal short arm and 5'-terminus of this base sequence : 59372613
  Distance between 3'-terminus of neighbour sequence of sequence listing upward to telomere on chrosomal short arm and 5'-terminus of this base sequence : 203182
actatgcaaaggtaaagcagataggcaacacatcaaaatataaacggcttaattgtgatttaggtattcaacttatgagaacaatttttttcttctttggaataattaagttgtaagaaaataaatctagccatacttttaaaaatgagaaaatgttcaggctaaagatatatagttataacttataagacttacaagattaatataatgaagaagagattatcatagtgtgtgtgtgtgtgtgtgtgtgtgtgtgtgtgtgtgtgtgtgtgtgtgtgtgtggctgccctctactggggaccgaaggacgagttctcaattgagttctcccagctcaatttcagttgaaaatctcttcatgacaaaaattaaatcaagcacctagcaaagttctaagcaccag

SEQ ID NO: 10266 - DNA, 308 bp, Homo sapiens
  Z16440.1_53
  Located on chromosome 6
  Distance between a terminus base of telomere on chromosomal short arm and 5'-terminus of this base sequence : 59372623
  Distance between 3'-terminus of neighbour sequence of sequence listing upward to telomere on chrosomal short arm and 5'-terminus of this base sequence : -393
ggtaaagcagataggcaacacatcaaaatataaacggcttaattgtgatttaggtattcaacttatgagaacaatttttttcttctttggaataattaagttgtaagaaaataaatctagccatacttttaaaaatgagaaaatgttcaggctaaagatatatagttataacttataagacttacaagattaatataatgaagaagagattatcatagtgtgtgtgtgtgtgtgtgtgtgtgtgtgtgtgtgtgtgtgtgtgtgtgtgtgtggctgccctctactggggaccgaaggacgagttctca

SEQ ID NO: 10267 - DNA, 172 bp, Homo sapiens
  D6S257
  Located on chromosome 6
  Distance between a terminus base of telomere on chromosomal short arm and 5'-terminus of this base sequence : 59372758
  Distance between 3'-terminus of neighbour sequence of sequence listing upward to telomere on chrosomal short arm and 5'-terminus of this base sequence : -173
tgagaaaatgttcaggctaaagatatatagttataacttataagacttacaagattaatataatgaagaagagattatcatagtgtgtgtgtgtgtgtgtgtgtgtgtgtgtgtgtgtgtgtgtgtgtgtgtgtgtggctgccctctactggggaccgaaggacgagttctc

SEQ ID NO: 10268 - DNA, 343 bp, Homo sapiens
  AL031782.1_164
  Located on chromosome 6
  Distance between a terminus base of telomere on chromosomal short arm and 5'-terminus of this base sequence : 59449047
  Distance between 3'-terminus of neighbour sequence of sequence listing upward to telomere on chrosomal short arm and 5'-terminus of this base sequence : 76117
caggttctgaagattcctcactcaacactgaggaacacagctgaagcagggcatagcaggggttctgcctccctgagagcattcatgacagggttttatatatatatatatatatatatatatatatatatatatatatataaaatttcaaattacatatttataatttaaaatttgaaattaaaatttcaaattatatacatgtatattatatatatatatttcccttttgcttggagcaggaatgggcagagttctgagagagagaaagaggactggagttaagaaaacaatctgagttgactctttagaaaacactacattgagataaccagttaaaggt

SEQ ID NO: 10269 - DNA, 323 bp, Homo sapiens
  AL031782.1_20513
  Located on chromosome 6
  Distance between a terminus base of telomere on chromosomal short arm and 5'-terminus of this base sequence : 59469299
  Distance between 3'-terminus of neighbour sequence of sequence listing upward to telomere on chrosomal short arm and 5'-terminus of this base sequence : 19909
tcctagctaacacggtgaaaccccatctctactaaaaatacaaaaaattagcagggcgtggtggcgggcgcttgtagtcccagctactggagaggctgaggcaggagaatggcgtgaacctgggaggcggagcttgcagtgagccgagagcgcgccactgcgctccagcctgggcgacagagcgagactccatcacacacacacacacacacacacacacacacacacacacacacacacacacaagagtggggggaactgaatcacgaactgtgacccagtgaccaatccactcttttgtctattggtagcagtgagctatc

SEQ ID NO: 10270 - DNA, 369 bp, Homo sapiens
  AL031782_47103
  Located on chromosome 6
  Distance between a terminus base of telomere on chromosomal short arm and 5'-terminus of this base sequence : 59495845
  Distance between 3'-terminus of neighbour sequence of sequence listing upward to telomere on chrosomal short arm and 5'-terminus of this base sequence : 26223
ggaggaaagaggaggaagggggaggaaagggaggaaaggggaggaagggggaggaagggggaggaggaaggaggaggagggaggaggaaggaatgagggaggcaggagcagggaggaagagggaggaggaaggaggagggagaaggaggaggaagaagaagaggaggaggaggaagtagtagtagaagtagtagtagaaaaagaagtagtagtagaagaggaagtggtagtagtagaagtagtagtagtagtagtactagcagtagtagctgcagcagcagcacaagtcttttacacagataaaggaatcatcacctatcagagaaaggagagtattagagacaactcttccagagaaataataggtcc

SEQ ID NO: 10271 - DNA, 189 bp, Homo sapiens
  AL031779.5_40522
  Located on chromosome 6
  Distance between a terminus base of telomere on chromosomal short arm and 5'-terminus of this base sequence : 59709453
  Distance between 3'-terminus of neighbour sequence of sequence listing upward to telomere on chrosomal short arm and 5'-terminus of this base sequence : 213239
tacatagagtggctgaatggacacacacacacacacacacacacacacacacacacacacgaccctactatatgctgcctacaagaaattcaatctataaagatacaaacagcctgataataaaggaatggaaaaaatatccaatgcaaatggaaactaaaaaagagcaggagtacctacacttgtact

SEQ ID NO: 10272 - DNA, 104 bp, Homo sapiens
  D6S414
  Located on chromosome 6
  Distance between a terminus base of telomere on chromosomal short arm and 5'-terminus of this base sequence : 59718267
  Distance between 3'-terminus of neighbour sequence of sequence listing upward to telomere on chrosomal short arm and 5'-terminus of this base sequence : 8625
agcttttatgtttgcatggtgtgtgtgtgtgtgtgtgtgtgtatttatctgtagtataataaaaaataaatacttgatctttgatcctctactcttggcacaaa

SEQ ID NO: 10273 - DNA, 267 bp, Homo sapiens
  AL137008.9_39825
  Located on chromosome 6
  Distance between a terminus base of telomere on chromosomal short arm and 5'-terminus of this base sequence : 59789717
  Distance between 3'-terminus of neighbour sequence of sequence listing upward to telomere on chrosomal short arm and 5'-terminus of this base sequence : 71346
ggacttgaatttattgacttcctattacacatatgccaggcaacacacacacacacacacacacacacacacacacacacacacagaaaacaccttaagaatcatatattattaactttattattctaacaagttctcagcctcagtggagggaacaacatatctgtgattacacagttagtgagtgttcctgactccagagccacaaattttaccaaaaaaacatttttttaagggtcgtgacttcctaggcaacttataagacaa

SEQ ID NO: 10274 - DNA, 227 bp, Homo sapiens
  AL096710.8_27063
  Located on chromosome 6
  Distance between a terminus base of telomere on chromosomal short arm and 5'-terminus of this base sequence : 59899472
  Distance between 3'-terminus of neighbour sequence of sequence listing upward to telomere on chrosomal short arm and 5'-terminus of this base sequence : 109488
gctatgatcatgctactgttaattccagcctgggtgacagagtgatattcctactttcttaaaataaataaataaataaataaataaaaatttaaaaaaataaatttcataattacagaatgttctagtagacagcactgctggagagggcaggaacaaaggacaagaggagacaagagtagaagtgtccaaagattttgagcctaggtaattagcggaatttactt

SEQ ID NO: 10275 - DNA, 325 bp, Homo sapiens
  chr6.fa.O7frz.62422521
  Located on chromosome 6
  Distance between a terminus base of telomere on chromosomal short arm and 5'-terminus of this base sequence : 59988849
  Distance between 3'-terminus of neighbour sequence of sequence listing upward to telomere on chrosomal short arm and 5'-terminus of this base sequence : 89150
atgtaagtattagcgtggatttagctgttaataatgctcaccaggaaactatttaccaccccaaaactggcaattgttaagcccactcactagagtaattagactaggagatatgaactggaaacttgtgggctacaagtccaaactaaactctaaccttcaaactcagcagttctttagaggcaaaatcaaagtctgctatctgcgaagttactgacaacatccgaagacatattacagctgtgtgtgcgagcgcccgtgcgtgtgtgtgtgtgtgtgtgtgtgtgtgtgtgtgtgtgtgtataagctacaattcagaatcatg

SEQ ID NO: 10276 - DNA, 102 bp, Homo sapiens
  DISD22_0000220
  Located on chromosome 6
  Distance between a terminus base of telomere on chromosomal short arm and 5'-terminus of this base sequence : 60083032
  Distance between 3'-terminus of neighbour sequence of sequence listing upward to telomere on chrosomal short arm and 5'-terminus of this base sequence : 93858
gcacccttcctcacagtcaaaaccttttcccaaagtgcacatgcacacacacacacacacacacacacacacacacagcctcagatgcctctggaagagaca

SEQ ID NO: 10277 - DNA, 166 bp, Homo sapiens
  DISD22_0000225
  Located on chromosome 6
  Distance between a terminus base of telomere on chromosomal short arm and 5'-terminus of this base sequence : 60253381
  Distance between 3'-terminus of neighbour sequence of sequence listing upward to telomere on chrosomal short arm and 5'-terminus of this base sequence : 170247
tcatcagcccactagtgcacttttatatacatataaaatatacatattatatattatattatatatatatatatatatatatatatatcgtgagagagagagaaggaggggagagagagagagagaatatgacatggagagagagaattaaggcacactaatgtct

SEQ ID NO: 10278 - DNA, 367 bp, Homo sapiens
  AL136311.7_14451
  Located on chromosome 6
  Distance between a terminus base of telomere on chromosomal short arm and 5'-terminus of this base sequence : 60457502
  Distance between 3'-terminus of neighbour sequence of sequence listing upward to telomere on chrosomal short arm and 5'-terminus of this base sequence : 203955
aaggaattgagcactttaacttatcagatatcttatttcccattccttttcccagtttgtagaatgtatttgcagctatgccatatatatatatatatatatatatatatatatatatatgtgtgtgtgtgtgtgtgtgtgtgtgtgtgtgtgtatatatatatataaaattttttttttttttttgagagagaggtggtctcaaattcctgggcaaagcagtcctcccacctcagcctccttaagtgctgggattacaggtgtgagccactgctcctggccaagtatgccatatttttgtaataagtatattctaataaaattttatgtagaatcacattttggttctgttgagcaaatcatttaa

SEQ ID NO: 10279 - DNA, 332 bp, Homo sapiens
  AL136311.7_42929
  Located on chromosome 6
  Distance between a terminus base of telomere on chromosomal short arm and 5'-terminus of this base sequence : 60485833
  Distance between 3'-terminus of neighbour sequence of sequence listing upward to telomere on chrosomal short arm and 5'-terminus of this base sequence : 27964
ttatagtctttcagctggcaagtttaatccctataagctcactggaggtatgatatctttgtatagatgttgctgtacttaatgatggtttgatttatgatttttttactttataaggatgtgaaagcaatatgcatttagtataaaccatacttcaaattttgaattttagttcaaagatttttataactttaattgtaaaacagacgttgtgatttcgtatatatatacacacacacacacacacacacatatatacatataacctactatcatttgttaaaaagacctttccctgtcattctgcagtgctacctttgttataaatccag

SEQ ID NO: 10280 - DNA, 267 bp, Homo sapiens
  chr6.fa.O7frz.62908050
  Located on chromosome 6
  Distance between a terminus base of telomere on chromosomal short arm and 5'-terminus of this base sequence : 60575434
  Distance between 3'-terminus of neighbour sequence of sequence listing upward to telomere on chrosomal short arm and 5'-terminus of this base sequence : 89269
ggattgcgttatcttttctaacaaaagtagacttttgctccttctccaagttttctttctctctttctctttctcttacacacacacacacacacacacacacacacacatgccatgcaggcacacacacacagtttttcctttctctttctctcactttcacacacacacacacacacacacacacacatacactcttacatcttagtccaaagtaaaaatatcctgcttatcagatgctctgccttattttcaaggcttatgctt

SEQ ID NO: 10281 - DNA, 416 bp, Homo sapiens
  chr6.fa.O7frz.63259609
  Located on chromosome 6
  Distance between a terminus base of telomere on chromosomal short arm and 5'-terminus of this base sequence : 60870365
  Distance between 3'-terminus of neighbour sequence of sequence listing upward to telomere on chrosomal short arm and 5'-terminus of this base sequence : 294664
tgtcaacattgtagccttttactctagtctacagaactaaacaccgctgattttcaccattctaaaaattgtcattatattatgattatttttccatatttttgaccaatctttgaaaatatcttaatgagttacataatatatcctttgaaagtgatgtaatttgtttaatcattctcctattgttggacatttggttgtgtctaatttgactctgttatatatgttactaatttaaataacagagtcaaatagctaatatcctgtggacatagataattgattatagttttgattatattctgtgtgtgtgtgtgtgtgtgtgtgtgtgtgtgtatgcattcaccaggaaataaaattataagaaactacacacagctgggaaggttggctcatgcctataatcctagcacttt

SEQ ID NO: 10282 - DNA, 440 bp, Homo sapiens
  chr6.fa.O7frz.63341041
  Located on chromosome 6
  Distance between a terminus base of telomere on chromosomal short arm and 5'-terminus of this base sequence : 60951837
  Distance between 3'-terminus of neighbour sequence of sequence listing upward to telomere on chrosomal short arm and 5'-terminus of this base sequence : 81056
cagatcacaaggtcaggatatcgagaccatcctggctgacacgatgaaaccccgtctctactaatacaaaaaattagccgggcgtgctagcgggcgcctgtagtcccagctacttgggaggctgaggtaggagaatggtgtgaacctgggaggtggagcttgcagtgagcagagatcatgccactgcactccagcctgggcaacagagcgagactctgtctcaatatatatatatatatatatatatatatatatatatatatatatatatgtgtgtgtgtgtgtgtgtgtgtgtgtgtgtgtgtgtatacattttaatctcaatactttcattaatttcttttcaaaattggcagtgagttaaaaaatcctttcaatattttgttagtttgggtatcgtatctattatcaatagtttctgcctaagttagatgtctgaa

SEQ ID NO: 10283 - DNA, 115 bp, Homo sapiens
  DISD22_0000231
  Located on chromosome 6
  Distance between a terminus base of telomere on chromosomal short arm and 5'-terminus of this base sequence : 61219114
  Distance between 3'-terminus of neighbour sequence of sequence listing upward to telomere on chrosomal short arm and 5'-terminus of this base sequence : 266837
ctgagatgatgctaattgtacaagaaaaaagatgaataaagagaatgtaagagagaggagagagagagagagagagagagacagacagacagacgatcttcttcctgacaaggaa

SEQ ID NO: 10284 - DNA, 123 bp, Homo sapiens
  DISD22_0000233
  Located on chromosome 6
  Distance between a terminus base of telomere on chromosomal short arm and 5'-terminus of this base sequence : 61295932
  Distance between 3'-terminus of neighbour sequence of sequence listing upward to telomere on chrosomal short arm and 5'-terminus of this base sequence : 76703
ggagtcgctcttgtatattccattttataaactatttaatgtcatgtacacacacacacacacacacacacaattatttttccttctttaactagcagaaatggattcgtttctctgctactg

SEQ ID NO: 10285 - DNA, 284 bp, Homo sapiens
  DISD22_0000239
  Located on chromosome 6
  Distance between a terminus base of telomere on chromosomal short arm and 5'-terminus of this base sequence : 61505164
  Distance between 3'-terminus of neighbour sequence of sequence listing upward to telomere on chrosomal short arm and 5'-terminus of this base sequence : 209109
cagacagctgtcttatgtttcactttccttccaggttttcatcttgttttccatgagagatgtgttataaaccagtcatttattttcagaagaattctatacttctatttttatctcctaatgtaaacattattagttttgttttaaacggtcaatgcttaatcaatttgatttaatttaagtcaattaaattaaattaatcaatttaatttaagtcaatgctttctttactctccatttatttatttatttatttatttattgaagtgcattgtttcacattg

SEQ ID NO: 10286 - DNA, 125 bp, Homo sapiens
  DISO7_10000314
  Located on chromosome 6
  Distance between a terminus base of telomere on chromosomal short arm and 5'-terminus of this base sequence : 61587978
  Distance between 3'-terminus of neighbour sequence of sequence listing upward to telomere on chrosomal short arm and 5'-terminus of this base sequence : 82530
cagacagccctatctagatcatcttttctacctatataggcttttaaaattgatattctttaagtattattcccctaaattatacacacacacacacacacacacgcacatacataccacaagca

SEQ ID NO: 10287 - DNA, 340 bp, Homo sapiens
  AL035688.8_42757
  Located on chromosome 6
  Distance between a terminus base of telomere on chromosomal short arm and 5'-terminus of this base sequence : 61653139
  Distance between 3'-terminus of neighbour sequence of sequence listing upward to telomere on chrosomal short arm and 5'-terminus of this base sequence : 65036
gtcaaggtctgattctagaaacactttcagtttaagttctccccaaataactgatagtcacagaatcacctcatgtttctgcctctgtaataaatagaaagaaagacacacacacacacacacacacacacacaaaacaaggaatgtctgaaagtacatattattccacaaaaagttttataccatgaaacttaaggcctgaaattgcttaggagatcattagaatgttaattattcctcacctcattgattgcttatcaatgcaaatagcaaagaaagaattattttaattaaagggaggaagaaattgtgcctttatggctgatgttctgtataagaa

SEQ ID NO: 10288 - DNA, 280 bp, Homo sapiens
  AL021368.1_1038
  Located on chromosome 6
  Distance between a terminus base of telomere on chromosomal short arm and 5'-terminus of this base sequence : 62025614
  Distance between 3'-terminus of neighbour sequence of sequence listing upward to telomere on chrosomal short arm and 5'-terminus of this base sequence : 372135
ccactcacctcataattacaactgggtaaccttgagagcagaaagctcgacaaaaaatttcccgtttcttccatcagctagtgagaaagaccaattatatgatatagcttgcagttttttctgtaatctatatccctttaccactcattttactcaaaccactgacaagccaaaaaacaaacaaacaaacaaacaaacaaaaaaaaacccaaaaaacctaaatgacttttccattctaagctaatgttgagtcagccttcaaactgttatctcatagcat

SEQ ID NO: 10289 - DNA, 247 bp, Homo sapiens
  AL021368.1_8461
  Located on chromosome 6
  Distance between a terminus base of telomere on chromosomal short arm and 5'-terminus of this base sequence : 62033068
  Distance between 3'-terminus of neighbour sequence of sequence listing upward to telomere on chrosomal short arm and 5'-terminus of this base sequence : 7174
agacatatgacatagcttgcagtttctggtgtaatttatatgtcttcaccacgccttgtactcaagcgactgagaagccaaaagaaggaaaaaataaataaagacagaaagagaaaggaaaggaaagaaggaaggaaggaaggaagaaagaaagaaagaaagaaagaaagaaagaaagaagaaaagaaaactcacttttaaattttaagctaatatttggtctgtcttgaaatcattatctcatagc

SEQ ID NO: 10290 - DNA, 383 bp, Homo sapiens
  AL021368.1_40789
  Located on chromosome 6
  Distance between a terminus base of telomere on chromosomal short arm and 5'-terminus of this base sequence : 62065375
  Distance between 3'-terminus of neighbour sequence of sequence listing upward to telomere on chrosomal short arm and 5'-terminus of this base sequence : 32060
gacattgacatagcttgtagtttcttgtgtaatttatatctcttcaccacgccttgtattcaaaccactaagaagccaaaagaaggaaaaagagaaaaagaaagaaagaaagaaagaagaaaggaagaaagaaaggaagaaagaaaaagaaagaaagaaagaaaaaagaaagaaagaaagaaagaaagaaagaaagaaagaaagaaagaaagaaagaaagaaagaaagaaagaaaggaaagctcatttttaaattttaagctaatatttggactgtcttgaaatcattatctcatagcatttgtgttccattatttatcacacctatttcatttcccttaacggaaagagcggcaaaagctgtaccttgtctgatgttcaaac

SEQ ID NO: 10291 - DNA, 411 bp, Homo sapiens
  chr6.fa.O7frz.63788638
  Located on chromosome 6
  Distance between a terminus base of telomere on chromosomal short arm and 5'-terminus of this base sequence : 62229644
  Distance between 3'-terminus of neighbour sequence of sequence listing upward to telomere on chrosomal short arm and 5'-terminus of this base sequence : 163886
gaaacactacattaggtgtcgtagttatgactgagatgatgctaattgtacaagaaaaaagatgaataaagagaatgtaagagagaggagagagagagagagagagagagagacagacagacagacagacagacgatcttcttcctgacaaagaaggggaaaggagttagtagtgatagctggtgtgtttcttggcattcttggcattcttttttggaaactaactttctaagtgggtggagagttttcttgaagaagacagcatggttcatggaggaaggcttccctttgggcacggggtcttttcagccttgccaaagattcccacatccctgggatgtgcagagccccggacatgaggactaatctcagtcatgactatgataatctcaacagtgattagtgaagacc

SEQ ID NO: 10292 - DNA, 252 bp, Homo sapiens
  DISO7_10002166
  Located on chromosome 6
  Distance between a terminus base of telomere on chromosomal short arm and 5'-terminus of this base sequence : 62534846
  Distance between 3'-terminus of neighbour sequence of sequence listing upward to telomere on chrosomal short arm and 5'-terminus of this base sequence : 304791
catgccagatgtctacaaagacacctatatatctgataacaatgatctgataaaatatattttttggctgaggcaggagaatcacttcaacccgggaggtggaagttgcagtgagccgagactgcgccacggcactccagcctgggtgacagagagagactcagtctccaaaaaaatcatctatagatatatagatatagatatagatatagatatagatacagatattttaacctgatgacattcccgaga

SEQ ID NO: 10293 - DNA, 386 bp, Homo sapiens
  chr6.fa.O7frz.71886351
  Located on chromosome 6
  Distance between a terminus base of telomere on chromosomal short arm and 5'-terminus of this base sequence : 65751199
  Distance between 3'-terminus of neighbour sequence of sequence listing upward to telomere on chrosomal short arm and 5'-terminus of this base sequence : 3216101
actctattccactccagtaaactccactccactccattgcattccattccactccactccactccattccattccattacactccactcctctccattccattacactccattccattccattcccaaccacttcactccactccactccattccattccattccagtccagtccattctgctccatttcaatccactccacttcgttcaattccattccttcccattccattccattccaatccattccactccacttcaagctactccattcaattccattctaccccatttcattcaactcaattccactccactccacatcacggcattccattcgaacccatttgatgctatttgatgtcatttgattctattacattcca

SEQ ID NO: 10294 - DNA, 318 bp, Homo sapiens
  chr6.fa.O7frz.71790163
  Located on chromosome 6
  Distance between a terminus base of telomere on chromosomal short arm and 5'-terminus of this base sequence : 65831696
  Distance between 3'-terminus of neighbour sequence of sequence listing upward to telomere on chrosomal short arm and 5'-terminus of this base sequence : 80111
agtacaatccatttgagtcctttccattggattacattggtttccagttaattctatttcagttcattctatttgagtccattctattccactgcattccattccattccattccattctattccgttccattccgttccattccattgcattccattttactccactccactccaatccactccattccattccactctactccactgtactccattccattctattccactggattccactccaatacactccattccactccactcaatttgattccactccactcaactgcactccatttcattcctctacatt

SEQ ID NO: 10295 - DNA, 267 bp, Homo sapiens
  G08570
  Located on chromosome 6
  Distance between a terminus base of telomere on chromosomal short arm and 5'-terminus of this base sequence : 65944140
  Distance between 3'-terminus of neighbour sequence of sequence listing upward to telomere on chrosomal short arm and 5'-terminus of this base sequence : 112126
aatcacagtttcttgcagccccaaactccttggctcaagcaattcttccacctcaaattcccgagtagctgagactgcaagtgccaaccaccacacccagctaactctatctatctatctatctatctatctatctatctatctatctaactggacaggagtctcactcagttgcctaggctgcaattttcttttataagtgaaggagagataaaatctttcacagacaaacacaaacccatggatatttgtcaccactagactttc

SEQ ID NO: 10296 - DNA, 151 bp, Homo sapiens
  DISD22_0000258
  Located on chromosome 6
  Distance between a terminus base of telomere on chromosomal short arm and 5'-terminus of this base sequence : 66538221
  Distance between 3'-terminus of neighbour sequence of sequence listing upward to telomere on chrosomal short arm and 5'-terminus of this base sequence : 593814
tcattgtgaaggaaggtggaggggattatgttagctcatacgtaaaatatttttagctaatctctgtgtgtgtgtgtgtgtgtgtgtgtgtctttctctgcttgtatatatttctttctaattttcacacacatacatcaattcatgctca

SEQ ID NO: 10297 - DNA, 446 bp, Homo sapiens
  AL049544.4_13923
  Located on chromosome 6
  Distance between a terminus base of telomere on chromosomal short arm and 5'-terminus of this base sequence : 66609100
  Distance between 3'-terminus of neighbour sequence of sequence listing upward to telomere on chrosomal short arm and 5'-terminus of this base sequence : 70728
gcaatagttattcttgtcctcaatgactatatgtgtggagttgagggtaaaataattgggcagtggttagctggaaaaatgaaatgggatgaccctatgctaagatgctaagaatgttataacaaaattttacttttacaatgaaagaatatacatatatatatatatatatatatatatataatgctattgctttctaaaccattaataacataaatttttttaaataatatttgtagatgatcaagtgatttaattaatttgattgattgattagggtagattcttggcatctgcaaaggtcaaatatgaatgataaacttacatatattgcacatgtagtgttgcctgttactttatttctttttgcttgaccccaacaacccttttgagaggtgtattaatgagaagactaagactcaaaggggtcaagtggcttgcaaagt

SEQ ID NO: 10298 - DNA, 177 bp, Homo sapiens
  AL049544.4_51066
  Located on chromosome 6
  Distance between a terminus base of telomere on chromosomal short arm and 5'-terminus of this base sequence : 66646365
  Distance between 3'-terminus of neighbour sequence of sequence listing upward to telomere on chrosomal short arm and 5'-terminus of this base sequence : 36819
ggaacttcaagtctaatgtgaaactgagagacagagagagagagagagagagagagaggtaaatataccatttcataaaacgctctatggaggcacaaattgaggctacaaatcaatgcttcccagacagtgactgggagagttcagagaatactactgcaaggatagttacttggc

SEQ ID NO: 10299 - DNA, 159 bp, Homo sapiens
  D6S1695
  Located on chromosome 6
  Distance between a terminus base of telomere on chromosomal short arm and 5'-terminus of this base sequence : 66647957
  Distance between 3'-terminus of neighbour sequence of sequence listing upward to telomere on chrosomal short arm and 5'-terminus of this base sequence : 1415
ggtctgtattccaaacactaggttcttagaacgtttaaatacatacatacatacacacacacacacacacacacacacacacacacactatttatttcttgagaaggagttttgcactgtcgcccagactggagtgcagtggtgcaatttggctccctg

SEQ ID NO: 10300 - DNA, 160 bp, Homo sapiens
  AL049544.4_60953
  Located on chromosome 6
  Distance between a terminus base of telomere on chromosomal short arm and 5'-terminus of this base sequence : 66656261
  Distance between 3'-terminus of neighbour sequence of sequence listing upward to telomere on chrosomal short arm and 5'-terminus of this base sequence : 8145
attagcataaggcatgagacaccatatatatatatatatatatatatatgcagctgggacatggcagtagaaatctgactacctatggcttgggcaagcttctgactaccgctgaccattattttgtaaagtgaaactggttaagtctggtagcagtatc

SEQ ID NO: 10301 - DNA, 215 bp, Homo sapiens
  D6S1711
  Located on chromosome 6
  Distance between a terminus base of telomere on chromosomal short arm and 5'-terminus of this base sequence : 66828475
  Distance between 3'-terminus of neighbour sequence of sequence listing upward to telomere on chrosomal short arm and 5'-terminus of this base sequence : 172054
agctaatgttgatgtgtgcgtgtgtgtgtgtgtgtgtgtgtgtgtgtgcatgagagagaaagattgagagagagagagagagacttctaagacaaatttcaacagaagcagttaaggtactaagaaaattaataatatgctgtaatcttattaatgaattacctaaccagtgttgaaaatctgatgaccatcatttatttcctcaacgctcatgc

SEQ ID NO: 10302 - DNA, 130 bp, Homo sapiens
  D6S1710
  Located on chromosome 6
  Distance between a terminus base of telomere on chromosomal short arm and 5'-terminus of this base sequence : 67040832
  Distance between 3'-terminus of neighbour sequence of sequence listing upward to telomere on chrosomal short arm and 5'-terminus of this base sequence : 212142
tgcaccaagagtaattgataggttataggttttccaaactttaccactgagaagagagtcatgccataaacatacacacacacacacacacacacacacacacacacacaaaccccaaaccatttcagat

SEQ ID NO: 10303 - DNA, 237 bp, Homo sapiens
  Z93021.2_96412
  Located on chromosome 6
  Distance between a terminus base of telomere on chromosomal short arm and 5'-terminus of this base sequence : 67238722
  Distance between 3'-terminus of neighbour sequence of sequence listing upward to telomere on chrosomal short arm and 5'-terminus of this base sequence : 197760
caaataaacatctggacctcacaacctcagggctgtggtaccctgggccatgcagcaggaactgcaaaccttgctcacaccaagaaagtaaaggtgactttctgctgaggagaatatagtattttatgagttctacagcatagaaacattaattcaatcaattttatatatatatatatatatatatatatatatataatcaatgttaaagctactcagataagctagtgctaacct

SEQ ID NO: 10304 - DNA, 126 bp, Homo sapiens
  D6S402
  Located on chromosome 6
  Distance between a terminus base of telomere on chromosomal short arm and 5'-terminus of this base sequence : 67248343
  Distance between 3'-terminus of neighbour sequence of sequence listing upward to telomere on chrosomal short arm and 5'-terminus of this base sequence : 9384
aacaaccatgcagtgctgtatttaccctcattcctcatgctttaaaacacacacacacacacacacacacacacacacacacacacacacacacacaatgtagaaatagttgttgtttgcctgtga

SEQ ID NO: 10305 - DNA, 272 bp, Homo sapiens
  Z93021.2_14121
  Located on chromosome 6
  Distance between a terminus base of telomere on chromosomal short arm and 5'-terminus of this base sequence : 67321064
  Distance between 3'-terminus of neighbour sequence of sequence listing upward to telomere on chrosomal short arm and 5'-terminus of this base sequence : 72595
atttatctgatgttttctgctcagtacctgccttctgttgttgcttccctgtcctgtcattcttttctatgtctctctctctctgcctctcttttcactttctctctctctcacaccacacacacacacacacacacacacacacaccttccaaggataagtattaattttcagagacaacatgttctaagctccaggacacaaactagaagaatgctgccagagccagcaaggtaatgtaaatataaaataggatgaattcagcctcttta

SEQ ID NO: 10306 - DNA, 104 bp, Homo sapiens
  DISO7_11295100
  Located on chromosome 6
  Distance between a terminus base of telomere on chromosomal short arm and 5'-terminus of this base sequence : 67441595
  Distance between 3'-terminus of neighbour sequence of sequence listing upward to telomere on chrosomal short arm and 5'-terminus of this base sequence : 120259
aacaatgattctatggatacttgtctatatatatatatatataataatatatatatattattaaaatgaagtgagttgtagaagtgccgatagcaagatggtaa

SEQ ID NO: 10307 - DNA, 264 bp, Homo sapiens
  D6S1046
  Located on chromosome 6
  Distance between a terminus base of telomere on chromosomal short arm and 5'-terminus of this base sequence : 67764507
  Distance between 3'-terminus of neighbour sequence of sequence listing upward to telomere on chrosomal short arm and 5'-terminus of this base sequence : 322808
ctatgatcatgccactgcaatccaggctgggtgacagaaatagagaccctgtctttttaaataataataataatacccatgataaaaatacttgtattttattacttttcttttaatatttataactcagtgtgtgtcagactttttgctaagtctttcatatatataaataatagatagatagatagatagatagatagatagatagatagatagatgctctatgaggtattgattatctggacatgaattctctgctacatt

SEQ ID NO: 10308 - DNA, 138 bp, Homo sapiens
  D6S1048
  Located on chromosome 6
  Distance between a terminus base of telomere on chromosomal short arm and 5'-terminus of this base sequence : 67764633
  Distance between 3'-terminus of neighbour sequence of sequence listing upward to telomere on chrosomal short arm and 5'-terminus of this base sequence : -138
tcagtgtgtgtcagactttttgctaagtctttcatatatataaataatagatagatagatagatagatagatagatagatagatagatagatgctctatgaggtattgattatctggacatgaattctctgctacatt

SEQ ID NO: 10309 - DNA, 167 bp, Homo sapiens
  DISD22_0000264
  Located on chromosome 6
  Distance between a terminus base of telomere on chromosomal short arm and 5'-terminus of this base sequence : 67962093
  Distance between 3'-terminus of neighbour sequence of sequence listing upward to telomere on chrosomal short arm and 5'-terminus of this base sequence : 197322
gatcttgaggttcgtataaacatcaaaattttcccactccttaaatatagttttgtctttgtcctgtctttcatcacacacacacacacacacacacacacacacacactcacacacatacacacggtattattctgtctaaatgtcaaatatagtgctaattgcca

SEQ ID NO: 10310 - DNA, 181 bp, Homo sapiens
  DISD22_0000268
  Located on chromosome 6
  Distance between a terminus base of telomere on chromosomal short arm and 5'-terminus of this base sequence : 68168567
  Distance between 3'-terminus of neighbour sequence of sequence listing upward to telomere on chrosomal short arm and 5'-terminus of this base sequence : 206307
atgtcagtgggtgtatgactgtaattgtgtgtgtgtgtgtgtgtgtgtgtgtgtatatatatatatgcacacacaaacatacatatatatatatagagagagagagagaaagagagcacactttacaacccccttctctttagtcttacccatctaaaatccatctgtcacactgctttga

SEQ ID NO: 10311 - DNA, 104 bp, Homo sapiens
  DISO7_10017480
  Located on chromosome 6
  Distance between a terminus base of telomere on chromosomal short arm and 5'-terminus of this base sequence : 68250579
  Distance between 3'-terminus of neighbour sequence of sequence listing upward to telomere on chrosomal short arm and 5'-terminus of this base sequence : 81831
aagctagaccagaaattccaagaaaacacacacacacacacacacacacacacacactttaaatggaatgtgtgcatgaaaggactaaaggatagaatggtgac

SEQ ID NO: 10312 - DNA, 185 bp, Homo sapiens
  D6S1628
  Located on chromosome 6
  Distance between a terminus base of telomere on chromosomal short arm and 5'-terminus of this base sequence : 68377177
  Distance between 3'-terminus of neighbour sequence of sequence listing upward to telomere on chrosomal short arm and 5'-terminus of this base sequence : 126494
ttccactaccgttatgagcagaattgtgttgaattaatacgttgaagctctaactcccagtaccttagaatatgaatgcctttggaaataacaccttgtgtgtgtgtgtgtgtgtgtgtgtgtgtgtgtgtgtgtgtgtgtgtgatggagttttgctcttgttgcccaggctggagtgcaatggc

SEQ ID NO: 10313 - DNA, 219 bp, Homo sapiens
  D6S1658
  Located on chromosome 6
  Distance between a terminus base of telomere on chromosomal short arm and 5'-terminus of this base sequence : 68634264
  Distance between 3'-terminus of neighbour sequence of sequence listing upward to telomere on chrosomal short arm and 5'-terminus of this base sequence : 256902
aacctctttggcctttgatagctttagtgatttattgttaggtgtgtatgtgtgtgtgtgtgtgtgtgtgtgtgtgtgtgtgtgtgtgttttaggaaataataggatagaattcataggtttactttgaaggtgttttaaagtgagtttttgtaaagtgtaatttttttttttcgagacggagttttgtttttgtcttccaggctggagtgcaatggtg

SEQ ID NO: 10314 - DNA, 452 bp, Homo sapiens
  chr6.fa.O7frz.70173286
  Located on chromosome 6
  Distance between a terminus base of telomere on chromosomal short arm and 5'-terminus of this base sequence : 68727913
  Distance between 3'-terminus of neighbour sequence of sequence listing upward to telomere on chrosomal short arm and 5'-terminus of this base sequence : 93430
tcagtttaatttgtacctttgaagcttttgttttgttttggtttctctgtctacaccacgtttgctgtgtctgagtttacttttgagttgctttaaaaaatcattttgtgcaatggaaacaatggcggtttgagtgttgagggtgcttataagaggtgtgtaataatggaaatataattttttataactcactttgaaacaattttgaacttatagataagttgccataacaaaaagaactctcatctctttcacccagactctccaattgttcctattttattgcattttctcatctttttcgttctctcatttcctgtctctgtcttcctgtgtctctgtctgtctctgtcacacacacacacacacacacaccctacttattattagacctttttcccaacctataaaaacaagctaaagatgcagtgtcctacaacttctaaacattc

SEQ ID NO: 10315 - DNA, 299 bp, Homo sapiens
  D6S1053
  Located on chromosome 6
  Distance between a terminus base of telomere on chromosomal short arm and 5'-terminus of this base sequence : 68873157
  Distance between 3'-terminus of neighbour sequence of sequence listing upward to telomere on chrosomal short arm and 5'-terminus of this base sequence : 144792
gcttgcagacagcctattgtgggaccttgtgatcatgtaagttaaaacttaacaaacttcccattatatctctgtctatctgtctgtctgtctgtctgtctgtatctatctatctatctatctatctatctatctatctatctattctgtccctttatggaaacctgactaattcaggcttggaccaatattttgtgttaagttgttgagactgagacacaaagatcagataactgaaaacagttttcctgaagaaggaactactgataataaatcactgctttgctgcctttgaaata

SEQ ID NO: 10316 - DNA, 247 bp, Homo sapiens
  G09478
  Located on chromosome 6
  Distance between a terminus base of telomere on chromosomal short arm and 5'-terminus of this base sequence : 69250511
  Distance between 3'-terminus of neighbour sequence of sequence listing upward to telomere on chrosomal short arm and 5'-terminus of this base sequence : 377055
accgctgctctgcaatgaatggtgtggatgatgatgatgatgatgatgatgatgatgatgatgatgttggccatgacagcaaccgtgatcattattccaattttacactgtgacaacagaaaacactacaggtacattcccaagaccttacttaattgttgacaactaaaaagatcctgattacatcacatagaaaggattcagggcaaattttgagattcagtgcaagttttcacactctcacgcc

SEQ ID NO: 10317 - DNA, 285 bp, Homo sapiens
  D6S1026
  Located on chromosome 6
  Distance between a terminus base of telomere on chromosomal short arm and 5'-terminus of this base sequence : 69500035
  Distance between 3'-terminus of neighbour sequence of sequence listing upward to telomere on chrosomal short arm and 5'-terminus of this base sequence : 249277
ggagaaatgatatccgcatgcctggcatgagttctgcttttctaagtatttattattattattattattattattattattattattattgggcttggactcaagtgcctgttgcatttgttatcttaggcttatagtggttttcaatcttgttggtctcaggactctcctatgctcttaaaaattattgaggactccgaagagctttggtttatgtgaattacattacagtacattaaagcttaagtgatcaccaatgttaagtatcacttgccagttgctacc

SEQ ID NO: 10318 - DNA, 369 bp, Homo sapiens
  chr6.fa.O7frz.71246077
  Located on chromosome 6
  Distance between a terminus base of telomere on chromosomal short arm and 5'-terminus of this base sequence : 69828988
  Distance between 3'-terminus of neighbour sequence of sequence listing upward to telomere on chrosomal short arm and 5'-terminus of this base sequence : 328668
aatagtactgacagttctggtcagagcaatttggtaagagaaagaaataaaaaacatcaaaatgaaaaaagagtaagtcaaattgtcccattgtccctgttttcagatgacatatatatataatgatatgtatatgatagatatatgatatatatgatatatgatatgtatatgatagatatatgatatatatgatatatgatatgtatatgatatatatatatataggatatatatatatatgtatatcctaaagagtccaccaaaaaacttttggaatcaacatatgagtttagtatactgcaggatacaaaatcaacttaccaaaaatcagtggcatttctatatgctaatagcaaactatctgaa

SEQ ID NO: 10319 - DNA, 167 bp, Homo sapiens
  AL109922.9_68492
  Located on chromosome 6
  Distance between a terminus base of telomere on chromosomal short arm and 5'-terminus of this base sequence : 69957387
  Distance between 3'-terminus of neighbour sequence of sequence listing upward to telomere on chrosomal short arm and 5'-terminus of this base sequence : 128030
agtttatggcttgaaatttgttactgaaagttctgtcttttttaaaaggcagcgactttaagaagtgtttggttgcctaatagctgctgaaaattgtgagtgtgtgtgtgtgtgtgtgtgtgtgcgcctgtgtgtgtatttcgaagtctattcaaaatgcttgtcca

SEQ ID NO: 10320 - DNA, 377 bp, Homo sapiens
  HUMUT1266
  Located on chromosome 6
  Distance between a terminus base of telomere on chromosomal short arm and 5'-terminus of this base sequence : 70107396
  Distance between 3'-terminus of neighbour sequence of sequence listing upward to telomere on chrosomal short arm and 5'-terminus of this base sequence : 149842
gttcaccccacatgtttctgacttccaacattatacttcataacactgtggtgtaacttctctcaatgaaataactatgtctgtctgtctgtctgtctatctaatctatctatctatctatctatctatctatctatctatctatctatctgtttctgtcctcatgagtatttaaatgctggcttgacatctaaaacaaattagatagtagacaacactaaacagtaacattttggaaaacatacctggagtaatttaccctctccctacattcaaatttaaatattcatgaaaacacagaaaaacttatgagttgtttaaagtagaatggaaactaagcttagtggtctataatatgccaaacattcataagctca

SEQ ID NO: 10321 - DNA, 319 bp, Homo sapiens
  chr6.fa.O7frz.71656302
  Located on chromosome 6
  Distance between a terminus base of telomere on chromosomal short arm and 5'-terminus of this base sequence : 70305914
  Distance between 3'-terminus of neighbour sequence of sequence listing upward to telomere on chrosomal short arm and 5'-terminus of this base sequence : 198141
tatcattcctagcactcagaatagtgcctgtcacaagaaatggagggcactcaacatatatccattgaatgcataaaacaggataagaaagtcttaaacatttgcttaatgtgtcttcatcaatccttaaaggttcaaaagcactcaaccctctttctcttctttggacttccccttatggtgtgtgtgtgtgtgtgtgtgtgtgtgtgtgtgtgtgtgtgtgtgtgttttccagctaaaacctaatatccttgagtcacaccattaagagagttgcagctagctcttcagaaatcttgtatctactgaactccaagaa

SEQ ID NO: 10322 - DNA, 249 bp, Homo sapiens
  AL132767.7_17070
  Located on chromosome 6
  Distance between a terminus base of telomere on chromosomal short arm and 5'-terminus of this base sequence : 70399222
  Distance between 3'-terminus of neighbour sequence of sequence listing upward to telomere on chrosomal short arm and 5'-terminus of this base sequence : 92989
catgtcatttgtgaataaagacagttttactgctttcctttcaactaataagtccgtgtgtgtgtgtgtgtgtgtgtgtgtgtgtgtgtgtgtgtgtatgtctaacaaatagcctggaacttcctatgttccagtgttaaatagaaatggtgaaagtagatatcatagtcttgttcccaattcttccaagaaaagctgtcagcctgacacctttaatgtggtgttccctggacatttgtcatagatgct

SEQ ID NO: 10323 - DNA, 302 bp, Homo sapiens
  AL109612.7_55270
  Located on chromosome 6
  Distance between a terminus base of telomere on chromosomal short arm and 5'-terminus of this base sequence : 70467155
  Distance between 3'-terminus of neighbour sequence of sequence listing upward to telomere on chrosomal short arm and 5'-terminus of this base sequence : 67684
cagaaagtcattggtcaataactgttttaaaataactgaaataaaaatcatctgacatatgttgtttaccttacctaaagtatatactcattttataaatttttgtaccccctgacagacagacagacagacagacacacacacacacacacacacagagacagagagagagagagagaaagagagacattagcacttttcccagctttctcttcatggagtaattaaatttattccatttttaaaatcttagactcagaaaataataaataaggaatattacagaaccgattacatgattt

SEQ ID NO: 10324 - DNA, 349 bp, Homo sapiens
  chr6.fa.O7frz.72111656
  Located on chromosome 6
  Distance between a terminus base of telomere on chromosomal short arm and 5'-terminus of this base sequence : 70547744
  Distance between 3'-terminus of neighbour sequence of sequence listing upward to telomere on chrosomal short arm and 5'-terminus of this base sequence : 80287
tgtagtcctagctgttcagaaggctgaggcaggaggattgcttgagaccaggagtttgaggacagcctgggcaacatagaaagaccccatttatttttaaaaatatatgcataactgaactcataaaatttcccttacagctttactatttaatatgtggaggagactgctgggtttgtgtgtgtgtgtgtgtgtgtgtatgtgtgactaagagagaattttgaaggactaacatgtgtcagatcctcttttagtgatattacatgagatgtctcattttaattaaagtccatgtaagagagatatcattcctattttacagacagagaaagaatcttgaggaagattg

SEQ ID NO: 10325 - DNA, 319 bp, Homo sapiens
  chr6.fa.O7frz.72294997
  Located on chromosome 6
  Distance between a terminus base of telomere on chromosomal short arm and 5'-terminus of this base sequence : 70671456
  Distance between 3'-terminus of neighbour sequence of sequence listing upward to telomere on chrosomal short arm and 5'-terminus of this base sequence : 123363
atctaagaacatctccagacctactgaatcagaattatggtggatggtacacaggaatctgtattttaagtattctttccaggtgaaaattatgtacataaaacttgtgacgttgctttatatgaaagcttatattcatatatattatgcgctcctaaattttcacacacacacacacacacacacacacacaaagcaaatgttctcaatcaatataagttacattgaagttaaattcattgtttgactttgactctaagatgtgggtcacgtatcttcactaaactcttctaatcttactgatcacacttgataatcc

SEQ ID NO: 10326 - DNA, 381 bp, Homo sapiens
  chr6.fa.O7frz.72224265
  Located on chromosome 6
  Distance between a terminus base of telomere on chromosomal short arm and 5'-terminus of this base sequence : 70704689
  Distance between 3'-terminus of neighbour sequence of sequence listing upward to telomere on chrosomal short arm and 5'-terminus of this base sequence : 32914
tttgaggactgttaagaggatcacaaatcatgcatgtgacacacatgcatgcatgcacacacacacacacaagagagagaaagcacatgaaaagtatttagcacttggctagtgctccacatatgttaactggtattatttcaaattcatggccagaggtgcacatcaccatgacagatgctcttatggtttcgtgacagtgtgagatgaaaatatgtctctatgttttttctgtcttcatttactctttgctcttgatattttgcaattgtttcttgaacaaaatcaaaggcatggacctatacgcaaacacacacacacacacacacacacacacactcttaaacactcttacaatacttacaaacatttaccgaacag

SEQ ID NO: 10327 - DNA, 134 bp, Homo sapiens
  D6S1551
  Located on chromosome 6
  Distance between a terminus base of telomere on chromosomal short arm and 5'-terminus of this base sequence : 70837604
  Distance between 3'-terminus of neighbour sequence of sequence listing upward to telomere on chrosomal short arm and 5'-terminus of this base sequence : 132534
attactcacaaatacgtacacacacatacacacacacacacacacacacacacatgcttctactgtttcctcttaacatttcaaatgctgtaaaagtacatttcctggaatcctttgatgctgaggttctggat

SEQ ID NO: 10328 - DNA, 470 bp, Homo sapiens
  chr6.fa.O7frz.72488447
  Located on chromosome 6
  Distance between a terminus base of telomere on chromosomal short arm and 5'-terminus of this base sequence : 71010193
  Distance between 3'-terminus of neighbour sequence of sequence listing upward to telomere on chrosomal short arm and 5'-terminus of this base sequence : 172455
aatggagtactattcagccataaaaaataatgaactgaaagtatatatatatatatatgtatatatatatacatacacacacacaaacatatatgtagcagcatagtataaactgtataaatatataactatatgtaaaacaaaatagctagaaatatatataatgtcttattggtataaaaaaatctagtctcagattaatacatatggtatgataacatttagtgggagtcttgattaggattttcctcaaagcaaacccagaggcaaaaagttgactgcagatagattatttagaaggttatcctagaaaacacctgtcagagtccctctgaaatagtttgaagtgtgtctcataaggttccactggaggacagagggaaaattgtaggtatttatccatagacttctgttctttatgttgtaagaatcctcacctccctaccctgtgatttctaatgtcttggcta

SEQ ID NO: 10329 - DNA, 215 bp, Homo sapiens
  HUMUT1202
  Located on chromosome 6
  Distance between a terminus base of telomere on chromosomal short arm and 5'-terminus of this base sequence : 71093063
  Distance between 3'-terminus of neighbour sequence of sequence listing upward to telomere on chrosomal short arm and 5'-terminus of this base sequence : 82400
ccatagcactgcagatttctccttctagtctatctacctgtgtctgtctatctatctatctatctatctatctatctatctatctatctatctatctatctataatctgaggtttaaagtgttccaacattacgaaaaggctgtgggagtaaaaagaaatttctttttaccttctggaatttttaccacagaaatgcaagcaaagagaagagaaa

SEQ ID NO: 10330 - DNA, 228 bp, Homo sapiens
  D6S430
  Located on chromosome 6
  Distance between a terminus base of telomere on chromosomal short arm and 5'-terminus of this base sequence : 71286343
  Distance between 3'-terminus of neighbour sequence of sequence listing upward to telomere on chrosomal short arm and 5'-terminus of this base sequence : 193065
acaatggtctcagcatagttccttcaagcacatagaacatgtaagcgtgttttgctccatttggaaaatgaaggaaaaaaaaaaactcaggctttgctgtgtaatctctctctctcctctctctcttttccttggtttctcccccctacctctctctctctcttacacacacacacacacacacacacacacacacacagcatactgtaggtgtttgtctaccactga

SEQ ID NO: 10331 - DNA, 139 bp, Homo sapiens
  G08562
  Located on chromosome 6
  Distance between a terminus base of telomere on chromosomal short arm and 5'-terminus of this base sequence : 71523599
  Distance between 3'-terminus of neighbour sequence of sequence listing upward to telomere on chrosomal short arm and 5'-terminus of this base sequence : 237028
taggcacccagaacatattcagatatctatctatctatctatctatctatctatctatctatctatctagatataaagacaactaaatattcaattataagatgatacagtgaggttggggtatgcccaggtttacaca

SEQ ID NO: 10332 - DNA, 101 bp, Homo sapiens
  DISO7_10002167
  Located on chromosome 6
  Distance between a terminus base of telomere on chromosomal short arm and 5'-terminus of this base sequence : 71574766
  Distance between 3'-terminus of neighbour sequence of sequence listing upward to telomere on chrosomal short arm and 5'-terminus of this base sequence : 51028
gtctccaggatagcctatttgttataacacacacgcacacacacacacacacacacacagagagataaatatcttcctgcactcttcaaaccatgctaaga

SEQ ID NO: 10333 - DNA, 293 bp, Homo sapiens
  DISO7_10002168
  Located on chromosome 6
  Distance between a terminus base of telomere on chromosomal short arm and 5'-terminus of this base sequence : 71578423
  Distance between 3'-terminus of neighbour sequence of sequence listing upward to telomere on chrosomal short arm and 5'-terminus of this base sequence : 3556
agttacataccttccctccttctcttccttcctcccttccttctttccttccttttcctccttccttccttcctcccttccttctttccttccttttcctccttccttccttcctttccttctttccttccttttcctccttccttccttcctttccttccttcccttccttcttccctccctccctctttcctttctttctctctccctttgtttgtttgtttcgttctttctttttctttctttctttctctctcacacacacgtacacacactctcacagacacagtatg

SEQ ID NO: 10334 - DNA, 169 bp, Homo sapiens
  DISO7_10002171
  Located on chromosome 6
  Distance between a terminus base of telomere on chromosomal short arm and 5'-terminus of this base sequence : 71684356
  Distance between 3'-terminus of neighbour sequence of sequence listing upward to telomere on chrosomal short arm and 5'-terminus of this base sequence : 105640
ggatatagggcataattatttctccccaaaaatttataaactgatgggatttactttggccatgaaatataaaatatgtgtgtgtgtgtgtgtgtgtgtgtgtgtgtgtgtgtgtttaaactaaaatcagaattttagtaatcattttggtaaattgcatgaactgagt

SEQ ID NO: 10335 - DNA, 121 bp, Homo sapiens
  DISD22_0001165
  Located on chromosome 6
  Distance between a terminus base of telomere on chromosomal short arm and 5'-terminus of this base sequence : 71822580
  Distance between 3'-terminus of neighbour sequence of sequence listing upward to telomere on chrosomal short arm and 5'-terminus of this base sequence : 138055
agttggcttgtgtttctgcttacacacacacacacacacacacacgtgtgtgtgtgtgcctggtaaattttgaatttgtataattttcctaagtatttcttcctaaagtcgtcctgataat

SEQ ID NO: 10336 - DNA, 101 bp, Homo sapiens
  DISD22_0001168
  Located on chromosome 6
  Distance between a terminus base of telomere on chromosomal short arm and 5'-terminus of this base sequence : 71905772
  Distance between 3'-terminus of neighbour sequence of sequence listing upward to telomere on chrosomal short arm and 5'-terminus of this base sequence : 83071
ttgatgagacactgtgtaggagaatgtgtgtgtgtgtgtgtgtgtgtgtgtgtgtgtgtgtgtgtgaagagggagagagaatattgtagttattgcatgga

SEQ ID NO: 10337 - DNA, 118 bp, Homo sapiens
  D6S1032
  Located on chromosome 6
  Distance between a terminus base of telomere on chromosomal short arm and 5'-terminus of this base sequence : 72177022
  Distance between 3'-terminus of neighbour sequence of sequence listing upward to telomere on chrosomal short arm and 5'-terminus of this base sequence : 271149
taaatctattctccctattcctgctctctctgctgaaaataataataataataagaagaagaagaagaagaagaaaagttaaaatcaaataagttgacaagcctcttattagaaaact

SEQ ID NO: 10338 - DNA, 467 bp, Homo sapiens
  chr6.fa.O7frz.73836167
  Located on chromosome 6
  Distance between a terminus base of telomere on chromosomal short arm and 5'-terminus of this base sequence : 72263548
  Distance between 3'-terminus of neighbour sequence of sequence listing upward to telomere on chrosomal short arm and 5'-terminus of this base sequence : 86408
caccagatcaacctaagtatctaccaatggatcaatggctgattggataaagaaacacacacacacacacacacacacacacatttatatgtgctatggaatgctactcaccctaaaaaaaagaaaataaatcgtgtgttttgcagcaataaggacggacaagactctataatcgtaagtgaaatgaatcagatgtgggagctaattaagcatacacttggacaaagagtggagtaatagacattggcgactcggtagggtgagagaatgggaagggtgcgtgtgttgagaaattacttaaagggtacaatgaatactattctgctgatggctatactaaaagctcagccaccacccctatgcaatatatccatgtaacaaaactgcactcgtaccctctaaatctataataaaacataagtaaattaaaattaaaaaaataagtgtcatttcatgtcagtagcagt

SEQ ID NO: 10339 - DNA, 216 bp, Homo sapiens
  D6S405
  Located on chromosome 6
  Distance between a terminus base of telomere on chromosomal short arm and 5'-terminus of this base sequence : 72473708
  Distance between 3'-terminus of neighbour sequence of sequence listing upward to telomere on chrosomal short arm and 5'-terminus of this base sequence : 209693
gcaagcgatgataatatgggctgctggaacaaaaaggaatctggaaaatacacacacacacacacacacacagaaagagagagagagacatacacaatatttggctctagtattatttcatccttgtcctcaacttcaaattatattataaaagcgtcaacaaaagagggactagaaaacaaagagaaatctgatgtgaacccacttccactcaat

SEQ ID NO: 10340 - DNA, 243 bp, Homo sapiens
  D6S1561
  Located on chromosome 6
  Distance between a terminus base of telomere on chromosomal short arm and 5'-terminus of this base sequence : 72741248
  Distance between 3'-terminus of neighbour sequence of sequence listing upward to telomere on chrosomal short arm and 5'-terminus of this base sequence : 267324
caatacctggcataaagatagatttaaaacaggcactggtcattgcaatgctgtcataagacgttatccaatgttaaagaggtaacattataaaatctgcaatacttaaaataattctgtttggattactttcccattccaacaaactacacacacacacacacacacacacacacacacgctcacacacacatacatacaccacttcttttatgtaaaccctagtcttcttgaatttggtag

SEQ ID NO: 10341 - DNA, 459 bp, Homo sapiens
  chr6.fa.O7frz.74764683
  Located on chromosome 6
  Distance between a terminus base of telomere on chromosomal short arm and 5'-terminus of this base sequence : 73049239
  Distance between 3'-terminus of neighbour sequence of sequence listing upward to telomere on chrosomal short arm and 5'-terminus of this base sequence : 307748
aaacattccttttactcctatcagaaaggaggattagcaacattttacattaatttggaatgggctacattgtacatttataatcttgctatattaacttttctaccctctgttatagtatagtctctagcaacctggatcatagcaatattttatttcacagataatatattcttccacactaaaaatattaataggaacagctgggcaagaagttgaacaaactgtaaaagagtaagttgaaaaattagagctcataaaaattaaaaatgtctactcttcaaaagtcaatgtcgaaagaatgaaaagacaagctaccaattgggagaaaatatttataaatctcacacacacacacacacacacacatatgtgtgtgatttataaatatttatatttatattatatatatatataataagggacttgtatctagaatacataaggaactcaacgtca

SEQ ID NO: 10342 - DNA, 452 bp, Homo sapiens
  chr6.fa.O7frz.74878947
  Located on chromosome 6
  Distance between a terminus base of telomere on chromosomal short arm and 5'-terminus of this base sequence : 73163835
  Distance between 3'-terminus of neighbour sequence of sequence listing upward to telomere on chrosomal short arm and 5'-terminus of this base sequence : 114137
ctttgtacctgtgatagaattcagttgtgactctttctggtcctgggctctttttaattggtaggttatttattactgcctcaaattcagaactaattactgatctgttcagcgatttaatttcttcctagttcagtcttgggaaggtgtttgtgtccaggaatgtatccatttcttccagattttctagtatatgtacagagaggttgtttataatattctctgatggttgtatttctgtggggtcagtagtgttatcttccttaacacttctgattgtgtttatttgactcttctctcttttattttttattagtctagctagtaatctatctattttattaattttttcaaaaaaccagcttctggatttactaatttttgaaggttttgtgtgtgtgtgtgtgtgtgtgtgtgtgtgtgtctccagctccttcagtttagctctgatc

SEQ ID NO: 10343 - DNA, 466 bp, Homo sapiens
  chr6.fa.O7frz.74977062
  Located on chromosome 6
  Distance between a terminus base of telomere on chromosomal short arm and 5'-terminus of this base sequence : 73357253
  Distance between 3'-terminus of neighbour sequence of sequence listing upward to telomere on chrosomal short arm and 5'-terminus of this base sequence : 192966
agtgaactaagtgctacagtcaagctaatttacatagctgtctcttcacaggtgtgtgtgtgtgtgtgtgtgtggtgtgaaggcactaaagatctactctaagtataaaaagcacaaaatacagtattatcaactatagtcaccatgctgttcttagccctgtagagcttattcatactacaaaacttaaactttgactcatataccaacatcttcccattttcctcacccgtacttctaccctagcccttggtaaccactatgctatgctctgtttttgtgaattctgctgttttagaattcacatgtaagtaacatcatgcaatatttttctttctgtgtctgatttctttcacttttaaaagagaacgcttgaacattattggtgggaatgtaaattagaacagacattcagacattatggaatacactatggaggttccttgctaaacgtctttaaagaata

SEQ ID NO: 10344 - DNA, 227 bp, Homo sapiens
  DISO7_10016117
  Located on chromosome 6
  Distance between a terminus base of telomere on chromosomal short arm and 5'-terminus of this base sequence : 73369303
  Distance between 3'-terminus of neighbour sequence of sequence listing upward to telomere on chrosomal short arm and 5'-terminus of this base sequence : 11584
tggacactgttggtaagtccataaaaattaaatttgtaatttttccttcctctttattctatttctgttacacacacaggcacacacacacacacacacacacactctccccctaaatatttttagttgatttgatgtctttgatcacaaactctgataacaaactctggaaatctacatctgctttctttctgaattaaaacaaaatcttgattgatccaagcagc

SEQ ID NO: 10345 - DNA, 396 bp, Homo sapiens
  chr6.fa.O7frz.75132415
  Located on chromosome 6
  Distance between a terminus base of telomere on chromosomal short arm and 5'-terminus of this base sequence : 73663895
  Distance between 3'-terminus of neighbour sequence of sequence listing upward to telomere on chrosomal short arm and 5'-terminus of this base sequence : 294365
tctgacattggaagattgtaaggagataaaaatgtagcgtcctcgtgacttagaaaaaggtgaatgtagcttgggcattatatgtaagcagaagtgtgacacaagatgaagttagagagaggagcgagaatcagatgaggtagggcactgtcggtcacgattaaaagtttggattttattatttgtgctacgtgagaagtacctggaattaaaatgtttttccatttgattttaaagggatacgtttttgaagtataacttattagagatagattaacaaagaatattgaatgccaggtagaatagactaagcaaaaactacgtacatcacacacacacacacacaaaagataacagtgaaaaaagaaacaactggttaggtttgagatctatgta

SEQ ID NO: 10346 - DNA, 355 bp, Homo sapiens
  AL035469.7_93463
  Located on chromosome 6
  Distance between a terminus base of telomere on chromosomal short arm and 5'-terminus of this base sequence : 73803068
  Distance between 3'-terminus of neighbour sequence of sequence listing upward to telomere on chrosomal short arm and 5'-terminus of this base sequence : 138777
tcatgcataggcattaaagatcatcaaagacattttatccgcctattaacaccgatcgcattttctgttctttatgtgatgaaattacattggtagatttttctaaatttagatcatcattgcaaaaacctttcttgtcctgtatatattcttatagacacacacacacacacacacacacacacacacacacacacctggagcagagggttaattatgcttcttagttcatagtgtgctataattattgatccctgcaagggtcttgtcttattatattcatctttatttataagtttgaaaagcttataattttattcccatgtgatactatgcctagtcctaagatcaaagt

SEQ ID NO: 10347 - DNA, 365 bp, Homo sapiens
  AL035469.7_145233
  Located on chromosome 6
  Distance between a terminus base of telomere on chromosomal short arm and 5'-terminus of this base sequence : 73854900
  Distance between 3'-terminus of neighbour sequence of sequence listing upward to telomere on chrosomal short arm and 5'-terminus of this base sequence : 51477
cctgcttgacataaataccaataatcaagggcctgttttatcaattctgaattaattaatagtgaaaaggtatttattattcccttttgtccatgtatatatatatatatatatatatatatatatatatatatatatatatatatataatttctgactgtttcttttaaaaggcatgactttaaggcatgagttttattacttatgatattcattagatatctagttttttttcacatctaagcactctttaccacctggtactcctgtaaagtataaaagcctgtttaatggtttaatgtagtatgccactagaatgctaaaatagtacttttcagtgaaagtgttacaagcactcatgcata

SEQ ID NO: 10348 - DNA, 191 bp, Homo sapiens
  AL078598.4_8902
  Located on chromosome 6
  Distance between a terminus base of telomere on chromosomal short arm and 5'-terminus of this base sequence : 73876675
  Distance between 3'-terminus of neighbour sequence of sequence listing upward to telomere on chrosomal short arm and 5'-terminus of this base sequence : 21410
actaaactggttacatgacctgagaggaacacatttgccctctctctatctctctttctctctctcttccttcctctctctctgtctctctgtcacacacacacacacacacacacacacacattcccacatacacacattagaccttcctataacaagtcattaagttgtctaaattagaaatgtggtcc

SEQ ID NO: 10349 - DNA, 225 bp, Homo sapiens
  chr6.fa.O7frz.75557206
  Located on chromosome 6
  Distance between a terminus base of telomere on chromosomal short arm and 5'-terminus of this base sequence : 73976074
  Distance between 3'-terminus of neighbour sequence of sequence listing upward to telomere on chrosomal short arm and 5'-terminus of this base sequence : 99208
taaactggcaggtaacatgtatgtttttatcttgtataacatgatattttgaggtatatatatatatatatatatatatatatatgttgtgaaatggttaaatctaactaattaacaaatatattactgcatatagttatcatttttgtgctgagaacatttaacatccactctctctacattttttaagaatgcaatatatagtcattaaccatagtcaccatg

SEQ ID NO: 10350 - DNA, 195 bp, Homo sapiens
  D6S1619
  Located on chromosome 6
  Distance between a terminus base of telomere on chromosomal short arm and 5'-terminus of this base sequence : 74048703
  Distance between 3'-terminus of neighbour sequence of sequence listing upward to telomere on chrosomal short arm and 5'-terminus of this base sequence : 72404
gtctcctcttcaaagtgctgttctgttaggtttggttctatttatcagtctgatagtttagtaaatgtcaaagtgaatatatattcagtatgtattagtatgtgtatatatacatatatatgtgtgtgtgtgtgtgtgtgtgtgtgtgtgtgtatatatatattctatatgtgtgagacaagttagagcaaggcc

SEQ ID NO: 10351 - DNA, 324 bp, Homo sapiens
  chr6.fa.O7frz.75745546
  Located on chromosome 6
  Distance between a terminus base of telomere on chromosomal short arm and 5'-terminus of this base sequence : 74163730
  Distance between 3'-terminus of neighbour sequence of sequence listing upward to telomere on chrosomal short arm and 5'-terminus of this base sequence : 114832
ctagatactgtttctgaatatgcactaagtatatttctgaatatggactagttacaaataaaacctaacataataatttgtaatatagtatggtacataatatcaagaaattcccttccttcttgtattagatttccccagagaaacagaaccaataggaaatgattgatagatagataaatagatacacacatacatacatacatacatacatacatacatacatacatacacacatagataaagacatatgagaggagatttgttaggggaattggctcacacaatagtggagaggtcttgcaacaggccatctacaagcta

SEQ ID NO: 10352 - DNA, 445 bp, Homo sapiens
  chr6.fa.O7frz.75940153
  Located on chromosome 6
  Distance between a terminus base of telomere on chromosomal short arm and 5'-terminus of this base sequence : 74358397
  Distance between 3'-terminus of neighbour sequence of sequence listing upward to telomere on chrosomal short arm and 5'-terminus of this base sequence : 194343
gattctgatttcttcgtcaatatctttctttttactctgatagcttttaagatttttctctttattctctgttttcaaagatttcatcaaagtatatgtgcttgtgcatgtgtgtatgtgtgtgtgtgtgtgtgtgtgtgtgtgtatctttagtctctcctacgccgggagaatttttacagtgttttgagaaaattttctgtaatatatctttaaatgctacctttcccccaaatttcctgatttctgccttctggaaatacttttaaatagacttcagaacttctgtgtcatccatgcattatgacctttctacttcccatgtcttcattcctgctcccaatacctaattttgggctatggtacatattgtcaatttgttctttatatacttttgttttcaaggaatttctcacagtctctagtccatcacagttaacacttc

SEQ ID NO: 10353 - DNA, 260 bp, Homo sapiens
  chr6.fa.O7frz.76053899
  Located on chromosome 6
  Distance between a terminus base of telomere on chromosomal short arm and 5'-terminus of this base sequence : 74472586
  Distance between 3'-terminus of neighbour sequence of sequence listing upward to telomere on chrosomal short arm and 5'-terminus of this base sequence : 113744
atggtaaagagcacctgtaatcccagctactcagtaggctgaggcaggagaatcacttaaactcgggaggcggaggttgcagtgagctgagatcggccactgcactccagcctgggtgacagagtgagactctgtcaaataaataaataaataaataaataaaataaaactgttatgaccttttcttgcagttctcttcctttaaattctaacttttattgcagtttgttttaatttaagctaaccagattaaattcact

SEQ ID NO: 10354 - DNA, 340 bp, Homo sapiens
  AL135780.11_29422
  Located on chromosome 6
  Distance between a terminus base of telomere on chromosomal short arm and 5'-terminus of this base sequence : 74542871
  Distance between 3'-terminus of neighbour sequence of sequence listing upward to telomere on chrosomal short arm and 5'-terminus of this base sequence : 70025
attcaattagttaaaggccttaatagacaagagtgtccttttctaaccaagaaggaattgtgcccccagtcagccttcagacttgaaatgcagcttccacttttccctgaatctccagactgccaccctacacctgaagattttggacttgtcagcctccagtatcacattagccaattccctaaaataagtttctctggatagatagataaggtagagataaatagagatagagttaacgatagagacagacagataaatagatagatagatagatagatagatagatagatagatagatagacagatagatagatagataggcacatatcctattgat

SEQ ID NO: 10355 - DNA, 359 bp, Homo sapiens
  AL135780.11_29731
  Located on chromosome 6
  Distance between a terminus base of telomere on chromosomal short arm and 5'-terminus of this base sequence : 74543309
  Distance between 3'-terminus of neighbour sequence of sequence listing upward to telomere on chrosomal short arm and 5'-terminus of this base sequence : 98
ttaggcattggaataatggacttttggcaagagacaaattgtcttgtatgaagtagaactaatatatgcttgacaggaagcttgttgatataaataagagaactctaaatgaatcaaagaggtgagggaagtgtgtgtgtgtgtgtgtgtgttatattcctattggttttatgtgtgtgcatgtatattacatattcctactggttttattaattagtacctgcagactgaattttcaaatggtcctgctgagtttgtcattttagttcacaatctgaaagatatgagaggacagggttttaatcctacttcaactgctcatttcactcaggttcctaatttcaactgatggctaactc

SEQ ID NO: 10356 - DNA, 308 bp, Homo sapiens
  AL135780.11_51016
  Located on chromosome 6
  Distance between a terminus base of telomere on chromosomal short arm and 5'-terminus of this base sequence : 74564564
  Distance between 3'-terminus of neighbour sequence of sequence listing upward to telomere on chrosomal short arm and 5'-terminus of this base sequence : 20896
aaggaattcgaaattatcaatagacacataaaaatcaacttcattagtaatgaaaaatgaaaaggatttttacccatataaaattgttataggattttggtttgggtgttggttttggttttttttttgaggagaaagaaaaataagagtgtgtgtgtgcgtgtgtgtgtgtgtgtgtgtgtgtgtgtgtggtttggatgtaagaaagatgtattttcatagatttccaataagacatataaattggtgagcaattttgcaatatttacaaaaaaatctttaaatcataaatgccgtttgactaaaga

SEQ ID NO: 10357 - DNA, 286 bp, Homo sapiens
  AL135780.11_76246
  Located on chromosome 6
  Distance between a terminus base of telomere on chromosomal short arm and 5'-terminus of this base sequence : 74589870
  Distance between 3'-terminus of neighbour sequence of sequence listing upward to telomere on chrosomal short arm and 5'-terminus of this base sequence : 24998
cagtgatcctaattggtgacttaataatagagaacacgtccttaaccaggaaagggggaaagaagaaaaaacacacacacagatacacacacacacacacacacacacacacaccacaccctctgtgcccaacagcagaagtaaggaagcaaatgaaaaattgatgagggctaaaaactttgcattggagaatgctacttgaattctctctcactttttacctggcagaacatcatcttaaaaacctattaagtcttctgtcttcaaatgtattctgatatctcca

SEQ ID NO: 10358 - DNA, 423 bp, Homo sapiens
  AL135780.11_102874
  Located on chromosome 6
  Distance between a terminus base of telomere on chromosomal short arm and 5'-terminus of this base sequence : 74616406
  Distance between 3'-terminus of neighbour sequence of sequence listing upward to telomere on chrosomal short arm and 5'-terminus of this base sequence : 26250
attcattaatgccattgagtaaattgtaagctaattatttggaataacatttatttaagatgttatctgacatcatatgctaaatatatgacaattaaattgaagaaagagatgtaaaactgaagaataaaaataaaaaaatacgtatctgtgtgtgtctgtttgcatgtgtgtccgtgtgtgtgtgtgtgtgtgtgtgtgtgtgtgtgtgtgtgtgtttatctgggaggacctgatccctggttaaggaaggacttttttcacacaaggcacaatggaggaaataatctggggaggatggagcaattttgtcagcagcatcaaaattctaaaagtccacttttaaaatataagcaaaatgcaagaccatgagttttgaataatcatcaacaacaaataaaacaaggagctattagcattgta

SEQ ID NO: 10359 - DNA, 277 bp, Homo sapiens
  AL118519.25_118214
  Located on chromosome 6
  Distance between a terminus base of telomere on chromosomal short arm and 5'-terminus of this base sequence : 74966643
  Distance between 3'-terminus of neighbour sequence of sequence listing upward to telomere on chrosomal short arm and 5'-terminus of this base sequence : 349814
gtatcaatggtgaaagaattgatcttagcttccctacttagggaaatgatcacattcttagtcttcttaaattggtaaccttaaattcctgtgttactaatacagagcaataatttatatatcttataaaattttatctatagtgtatataaattatgtatatataaacttataaatggtttatataaacatttaaaataactacacacacacacacacacacacacactcttagatgttctcttaggaaggagcatattacattcaccagaatgcc

SEQ ID NO: 10360 - DNA, 248 bp, Homo sapiens
  D6S1718
  Located on chromosome 6
  Distance between a terminus base of telomere on chromosomal short arm and 5'-terminus of this base sequence : 74966707
  Distance between 3'-terminus of neighbour sequence of sequence listing upward to telomere on chrosomal short arm and 5'-terminus of this base sequence : -213
tcttaaattggtaaccttaaattcctgtgttactaatacagagcaataatttatatatcttataaaattttatctatagtgtatataaattatgtatatataaacttataaatggtttatataaacatttaaaataactacacacacacacacacacacacacactcttagatgttctcttaggaaggagcatattacattcaccagaatgccccatttctaaaccatttttgtagtggtgtttgctg

SEQ ID NO: 10361 - DNA, 203 bp, Homo sapiens
  AL118519.25_104624
  Located on chromosome 6
  Distance between a terminus base of telomere on chromosomal short arm and 5'-terminus of this base sequence : 74980326
  Distance between 3'-terminus of neighbour sequence of sequence listing upward to telomere on chrosomal short arm and 5'-terminus of this base sequence : 13371
cctggcttatttcacttacaacaatgtcattctgactcgtccatgttgctgcaaatgatgggattttactcttttttatggcttaatgtcattccattgtgtgtatgtgtgtgtgtgtgtgtgtgtgtgtgtgtgtataaaacattttctttatccatttattaattgatagacacccattttgattccatgtattagcgatt

SEQ ID NO: 10362 - DNA, 254 bp, Homo sapiens
  AL118519.25_61142
  Located on chromosome 6
  Distance between a terminus base of telomere on chromosomal short arm and 5'-terminus of this base sequence : 75023778
  Distance between 3'-terminus of neighbour sequence of sequence listing upward to telomere on chrosomal short arm and 5'-terminus of this base sequence : 43249
aagacagtctacaaagtcaggaagaaagcaaattttgccgctaattacattgtttttagtttcaaataacatacatagaaaagtgtcaattaaaataatagctgccagtaaaatgttaaatgacttacacgttttatatatatatatatatatatatatatatatacacacacacatatatatatattaatcctccttttataagtcagaaatgtgagggattatatgtttcagtttaagctgaggttattgat

SEQ ID NO: 10363 - DNA, 410 bp, Homo sapiens
  AL133388.7_59036
  Located on chromosome 6
  Distance between a terminus base of telomere on chromosomal short arm and 5'-terminus of this base sequence : 75143910
  Distance between 3'-terminus of neighbour sequence of sequence listing upward to telomere on chrosomal short arm and 5'-terminus of this base sequence : 119878
ttatttgttctgaagccaaattagtatattctcagtttcttacaaaatgtttgtaccaaaaggacaacttgtttaccaaaataatttctgacaaatagctaagtgtgtgcgtgtgtgtgtgtgtgtgtgtgtgtgtgtgtgtaagaggacaacgttttgtcccctgagacattatatctcctagggaaaaaagatttctaataatggaaaatttactaacactagttttattaaactaacattattaaattatctttgtgaatcagtgtttcatggaaagtcatgtatatcactccaatttagcttaactattattcaatagcaactttttgtgtctttaggacttatttgaaatttatacacatgcaatatgcatataatgaaactattcttaatcagagtgcttgtca

SEQ ID NO: 10364 - DNA, 296 bp, Homo sapiens
  AL133388.7_62248
  Located on chromosome 6
  Distance between a terminus base of telomere on chromosomal short arm and 5'-terminus of this base sequence : 75147186
  Distance between 3'-terminus of neighbour sequence of sequence listing upward to telomere on chrosomal short arm and 5'-terminus of this base sequence : 2866
agatacacgtagccatgaaataaccagttacatctccgttttgtaagtgtgtgtgtgtgtgtgtgtgtgtgtgtgtgtgtgtgtgtgtatctgcagcggtttgatttttttatgtgatgaaattactgttcctactgattcaaataaattattctgaaggtaatattgtttttagcccattatctttagtctttgagtggacggggaataggcttgtttgctgaaagaaaacaaaattgacaaaggtttgattgtagcccatttaatttcagtcttgtctgaatccactggatatc

SEQ ID NO: 10365 - DNA, 285 bp, Homo sapiens
  D6S313
  Located on chromosome 6
  Distance between a terminus base of telomere on chromosomal short arm and 5'-terminus of this base sequence : 75257662
  Distance between 3'-terminus of neighbour sequence of sequence listing upward to telomere on chrosomal short arm and 5'-terminus of this base sequence : 110180
tcatcatcaccacaaatgcttaatgagaatgctttctcttttccatgggcatacactatgctcattattgagcccatttttctcatgcataaactgagagttaggaaggtcaaataattgtccatagtcatatagccagaaatgaggacccttaaccactgcactaactgtattttcctacctattgatttttttaactctgtggaagggtgtggaggggtgtggcagggtgtgtgtgtgtgtgtgtgtgtgtgtgtggtcattttttttaattccttgggcctg

SEQ ID NO: 10366 - DNA, 291 bp, Homo sapiens
  chr6.fa.O7frz.76885088
  Located on chromosome 6
  Distance between a terminus base of telomere on chromosomal short arm and 5'-terminus of this base sequence : 75257812
  Distance between 3'-terminus of neighbour sequence of sequence listing upward to telomere on chrosomal short arm and 5'-terminus of this base sequence : -135
cttaaccactgcactaactgtattttcctacctattgatttttttaactctgtggaagggtgtggaggggtgtggcagggtgtgtgtgtgtgtgtgtgtgtgtgtgtggtcattttttttaattccttgggcctgagttgaccaggaagtagacagaggtacaaaaacaaagcacagtattgacttttgcagagctctaatgatcataagaaactaagatatttctctgaggttttgccctgtagaaataccagagaaaaaaaaacagccttaacatagcagattgtcagg

SEQ ID NO: 10367 - DNA, 444 bp, Homo sapiens
  AC067861.4_114593
  Located on chromosome 6
  Distance between a terminus base of telomere on chromosomal short arm and 5'-terminus of this base sequence : 75311187
  Distance between 3'-terminus of neighbour sequence of sequence listing upward to telomere on chrosomal short arm and 5'-terminus of this base sequence : 53084
ccatggtctaaacattgaatacttagatatgctgttgttatgcaagaagtgttttctatcatggcaggtaaagagggaattgtctgctgggaaataccacctgcaaatagaatatatattttctactgtacattcaaacttctctaaaatttttccactcatagtagaaatgcttaccataccagatgtcatcaacttatttctcatgtatattatgcagaaaactgcacatgtaccctaaaacttaaagtataataataaataaataaataaataaataaataaataaaaagatttcacaatggcagaattttacctaaagataggaaattttcaattctgtagctttacatttacttactggaaatccacgcgatccaggcacaccaggttctccctaaaaataaaaatagtttcattgtactgacctttcatatcatgaat

SEQ ID NO: 10368 - DNA, 134 bp, Homo sapiens
  D6S1557
  Located on chromosome 6
  Distance between a terminus base of telomere on chromosomal short arm and 5'-terminus of this base sequence : 75331083
  Distance between 3'-terminus of neighbour sequence of sequence listing upward to telomere on chrosomal short arm and 5'-terminus of this base sequence : 19452
tctcaccactctgaagatagtatgtctcaccctcctctctctctctctttcacacacacacacacacacacacacacacacacacacacacacattttcatatacatatatcatccaaatcagcgagtccctag

SEQ ID NO: 10369 - DNA, 375 bp, Homo sapiens
  AL078591.18_17888
  Located on chromosome 6
  Distance between a terminus base of telomere on chromosomal short arm and 5'-terminus of this base sequence : 75472468
  Distance between 3'-terminus of neighbour sequence of sequence listing upward to telomere on chrosomal short arm and 5'-terminus of this base sequence : 141251
ccatttccttgtcataagataaactactacaaagaacatattatgatttggaaatggaggaaagtaaggatatagatttagaaattatatatatacgtgtgtgtgtgtgtgtgtgtatatatatatatatatatatatatatatttttttttttttttagatggagtctcactcttgcccaggctggagggcagtggcgtgatcttggctcactgcaacctctgccttctgggttcaagcagttctccctgtctcagcctcctgaatagctgggattacaggtgcctgccaccacgcccagctaattgttatgtttttagtagaggtggcgttttgccctgttggccaggctggtctcaaactcctgaccttagg

SEQ ID NO: 10370 - DNA, 249 bp, Homo sapiens
  AL078591.18_109573
  Located on chromosome 6
  Distance between a terminus base of telomere on chromosomal short arm and 5'-terminus of this base sequence : 75564099
  Distance between 3'-terminus of neighbour sequence of sequence listing upward to telomere on chrosomal short arm and 5'-terminus of this base sequence : 91256
agtaaatttgatgccattacaaagcagccaagcagtacttcttacaacttcacttcttcgatttcctggtatgaaagttcaccaaaacctcaaatacaagcgtaagtaatggaacgtaatagtacctgctgctaaatatatacatatatatatacacacacacacacatacacacacacacacacacacacacacacacacacacatatatatataaaatcatagatagtgctaaaggattgagtgtct

SEQ ID NO: 10371 - DNA, 441 bp, Homo sapiens
  AL078591.18_121612
  Located on chromosome 6
  Distance between a terminus base of telomere on chromosomal short arm and 5'-terminus of this base sequence : 75576145
  Distance between 3'-terminus of neighbour sequence of sequence listing upward to telomere on chrosomal short arm and 5'-terminus of this base sequence : 11797
cctaagaatttcaacatttgtaactcagtgccagttttgttagtctatgtttttagaccatgtttctgcatgtcctatccccgctgttctagctgtctcccaccccaatcctcacccctttttataaactgccacgtttttctaccttcatattatgttatgttatattatattatattatattatattatattatattatattatattatattatatggctagcaagcatttctgaaagtgtcagaaactaaactattaatgattatcctttctacaattctcactactggataaatcttattacttattttttattaactaattattaaacatattccccatcttgcatatatattccaggcctttacaacctaaagttcccaactgctcctttgccatttttactgtctataaataaccttacttctgaccttatgat

SEQ ID NO: 10372 - DNA, 236 bp, Homo sapiens
  AC073199.3_55875
  Located on chromosome 6
  Distance between a terminus base of telomere on chromosomal short arm and 5'-terminus of this base sequence : 75717445
  Distance between 3'-terminus of neighbour sequence of sequence listing upward to telomere on chrosomal short arm and 5'-terminus of this base sequence : 140859
agaatgtttgaggtcttacacaacctgcctttaacagttattaaaaagctatagttatctgtggaacataatacgtagtccagaaatagactcacatattatggtcagtttttaacagaagtgccaaggtaactcaatggagagaaaggatagtcttttcaacaacaacaacaacaacaacaacaacaacaacagaatgtataataccttgaaccttacctcagaccattcacaaa

SEQ ID NO: 10373 - DNA, 159 bp, Homo sapiens
  D6S455
  Located on chromosome 6
  Distance between a terminus base of telomere on chromosomal short arm and 5'-terminus of this base sequence : 75846376
  Distance between 3'-terminus of neighbour sequence of sequence listing upward to telomere on chrosomal short arm and 5'-terminus of this base sequence : 128695
catttatttctagtgcaggctgtttccctgtgtgtgtgtgtgtgtgtgtgtgtgtgtgtgtgtgtgtacacacttactggtttcttgcatatatgccttggtggagtattcttagtttaaaatagattgttttcattggcatagagtccctaaagtatg

SEQ ID NO: 10374 - DNA, 452 bp, Homo sapiens
  AL121961.8_45806
  Located on chromosome 6
  Distance between a terminus base of telomere on chromosomal short arm and 5'-terminus of this base sequence : 75916643
  Distance between 3'-terminus of neighbour sequence of sequence listing upward to telomere on chrosomal short arm and 5'-terminus of this base sequence : 70108
tattctaattcactttggctaaagcgctttccttaagtgactttgtttttgttgttgttgttgtttgttttttgagaaaaatatttgaaatgtctcttttgccctcacacagacataatgatttcacggggtacaaaaaatcctaggatccatttcttttcttcagaactctaaacacctttctccattattctgtatcattcagtgttacagaaaaaaacctgatgctagtctgatttttccctccttcatagagaagcagttttccccctgaccccctgtgaatacccttgggattgttttattattaaatcctggcacagttgttctaaacttaggattcattcattcattcattcattcattcaacaaaaacatacataccaggcaaactgccagggactggggagaaggtggtaagcaaaatcagtcatgatctgcatcttagagtc

SEQ ID NO: 10375 - DNA, 414 bp, Homo sapiens
  AL096709.11_133807
  Located on chromosome 6
  Distance between a terminus base of telomere on chromosomal short arm and 5'-terminus of this base sequence : 76051335
  Distance between 3'-terminus of neighbour sequence of sequence listing upward to telomere on chrosomal short arm and 5'-terminus of this base sequence : 134240
taaaataccattatggcacgagatatatttctcaaaagagaaacaataaccaaatatattcagtttagccattaacatttttctcttatttcactttaatgggattatccttattgataatgctaaatatttacttgggccttcaacaaggggtgtgtgtgtgtgtgtgtgtgtgtgtgtctgtgtctgtgaaattgtcctataaccagcaatttcagatgaatgagtataaagtgcttcaggcacttggactaaagctggttcctaaaagcttgctgcacagggtccattgtcaaaggaagaaaaactggtgttggaggctgcctgccatgctgggttgattattgggatttcacactctgttctgtggggacaagaaccatccaactctggaaggattgacatctggagaat

SEQ ID NO: 10376 - DNA, 239 bp, Homo sapiens
  AL096709.11_126827
  Located on chromosome 6
  Distance between a terminus base of telomere on chromosomal short arm and 5'-terminus of this base sequence : 76058351
  Distance between 3'-terminus of neighbour sequence of sequence listing upward to telomere on chrosomal short arm and 5'-terminus of this base sequence : 6602
caatgttcattgcaacactataatagctaagatatggaatcaatctaagtgtgcttcagttaatgaatgcataaagaaaacatgagataaacgcgcacgcacgcacacacacacacacacacacacacacacacacacacacactggaagagtcttcagtgataaaaaagaatgagatcccatcatttgcaacaacaggatgaaccagggaaatgtcatgttaaatgagataaaccaga

SEQ ID NO: 10377 - DNA, 141 bp, Homo sapiens
  Z67116
  Located on chromosome 6
  Distance between a terminus base of telomere on chromosomal short arm and 5'-terminus of this base sequence : 76058400
  Distance between 3'-terminus of neighbour sequence of sequence listing upward to telomere on chrosomal short arm and 5'-terminus of this base sequence : -190
tgtgcttcagttaatgaatgcataaagaaaacatgagataaacgcgcacgcacgcacacacacacacacacacacacacacacacacacacacactggaagagtcttcagtgataaaaaagaatgagatcccatcatttgc

SEQ ID NO: 10378 - DNA, 269 bp, Homo sapiens
  D6S1673
  Located on chromosome 6
  Distance between a terminus base of telomere on chromosomal short arm and 5'-terminus of this base sequence : 76084319
  Distance between 3'-terminus of neighbour sequence of sequence listing upward to telomere on chrosomal short arm and 5'-terminus of this base sequence : 25778
tttcagtcggaatctcaacatttttgacaaattctgcttcagagatgtcaaagacctattgaaagcaatccattttaaaatgtcccttttctgcttgaaaaggcgatctattgtccatcagcaatcactttagaggccatgcatataaggcacatgtatttccataagtgtgagtgtgtgtgtgtgtgtgtgtgtttgcatgtgttctatctctattagtgttgttaaaatgatcgctgagggattaattgcaatcaaacttctgtggc

SEQ ID NO: 10379 - DNA, 225 bp, Homo sapiens
  AL096709.11_100808
  Located on chromosome 6
  Distance between a terminus base of telomere on chromosomal short arm and 5'-terminus of this base sequence : 76084360
  Distance between 3'-terminus of neighbour sequence of sequence listing upward to telomere on chrosomal short arm and 5'-terminus of this base sequence : -228
gagatgtcaaagacctattgaaagcaatccattttaaaatgtcccttttctgcttgaaaaggcgatctattgtccatcagcaatcactttagaggccatgcatataaggcacatgtatttccataagtgtgagtgtgtgtgtgtgtgtgtgtgtttgcatgtgttctatctctattagtgttgttaaaatgatcgctgagggattaattgcaatcaaacttctgt

SEQ ID NO: 10380 - DNA, 433 bp, Homo sapiens
  AL096709.11_87527
  Located on chromosome 6
  Distance between a terminus base of telomere on chromosomal short arm and 5'-terminus of this base sequence : 76097547
  Distance between 3'-terminus of neighbour sequence of sequence listing upward to telomere on chrosomal short arm and 5'-terminus of this base sequence : 12962
caactaggaaacagtgacttctagggcctgaagagaacacagatgacactgctaaggattttgcagcaggcatcttgagtggatctttttgcagaatctattagcatctgcagatattgagtctggaggagataaatttgaacagtttgatgcagatactgagaacaccatatagttagcctgtcagttttccatctcatgtatgtatgtatgtatgtatgtatgtatgtatgtatgtatgtatgtatttatttatttatttatttgtatagagacaaggtttcactgtattgcctaggctggacttgagctcctgggctcagacgatccttccgcctgagcctcctgagtagctgggactgcaggcacaggccaacatgcctagcttagcctgttagttttgataaaagaaaattctgagtctaggcagaag

SEQ ID NO: 10381 - DNA, 459 bp, Homo sapiens
  chr6.fa.O7frz.77960314
  Located on chromosome 6
  Distance between a terminus base of telomere on chromosomal short arm and 5'-terminus of this base sequence : 76197132
  Distance between 3'-terminus of neighbour sequence of sequence listing upward to telomere on chrosomal short arm and 5'-terminus of this base sequence : 99152
gcaaaggctagtcatgttaatccctccagaggtgttttctgccttatgcagggttttctgaatgtaatccttttgctcaaaggaagtactcctcaggaggaaatgctacactttgtaggattagagggggtgtgttttagcatggaaatgggagtggggtggtgtgtgtgtgtgtgtgtgtgtgtatgtgcatgtgtatgtgtgtatgtgtgtctgtagagatttctccttgcatccctgaatcccaactcttgacagacacctgatccatttacgtgaacagttttacggagaccatttgccccattctgattatggcacttaagaatttaagtaggatttttttgtttctgactttgctttcaagttttaagaaacaagctaatagactggaggcttactgtgatagatttagccatgtctctttctcttaattgcttcatgtttaaacttgaggtg

SEQ ID NO: 10382 - DNA, 470 bp, Homo sapiens
  chr6.fa.O7frz.78050671
  Located on chromosome 6
  Distance between a terminus base of telomere on chromosomal short arm and 5'-terminus of this base sequence : 76325264
  Distance between 3'-terminus of neighbour sequence of sequence listing upward to telomere on chrosomal short arm and 5'-terminus of this base sequence : 127673
cttctataggcttatgcctgtaatcccagctattgggaggctgaggcaggagaattgcttgaaaccaggaggcggaggttgcagtgagccgagatcgcgcctctgcactgcagcctgggcaacagagggagactctgtctcaaaaagaaagaaaagaaagaacagaacaacagaacagaacagaacagaacagaacagaacagaacagaacagaacagaacagaacagaaaaaagaaagaacttccctaacacagttctccctcctcctttcatttgcagaacagaccacagggccgaggcttcttccattagaaacagcccatctgttctactgattctgagatttttgcctacacggagcaccaatttgtagtgggtgtaaggttacccgcaaatcaatgtgatggtccagttgttactgttccttttgtttcacgagcgattgctcattagatgaggtgactgatag

SEQ ID NO: 10383 - DNA, 111 bp, Homo sapiens
  D6S421
  Located on chromosome 6
  Distance between a terminus base of telomere on chromosomal short arm and 5'-terminus of this base sequence : 76403144
  Distance between 3'-terminus of neighbour sequence of sequence listing upward to telomere on chrosomal short arm and 5'-terminus of this base sequence : 77410
cagtggtggttacaagaatctatgcatgtaataacatggtgtagaactacacacacacacacacacacacacacacacacacacacaattgtaccaatgtcagtttcctgg

SEQ ID NO: 10384 - DNA, 352 bp, Homo sapiens
  AL035467.23_111311
  Located on chromosome 6
  Distance between a terminus base of telomere on chromosomal short arm and 5'-terminus of this base sequence : 76484349
  Distance between 3'-terminus of neighbour sequence of sequence listing upward to telomere on chrosomal short arm and 5'-terminus of this base sequence : 81094
tcttcgcatatgcttcatataccatactttttaagtgaaatcttactcatttcttcacttagacattatgccttttaagatcatttgttcttgttcattccattttacatctatcacaatgcttagtgctttctgagccatagtaagtactaaacaaatttgcgatatgaatgaaagcatcataaatgcttctttctttctttctctgtctccctccctctttctttctttctttctttctttctttctttctttctttctttctttctttctttctttcttctttctttctttctttttttgttcagacagaatcttgctatgttgtccaggctggtcgactcctaggatc

SEQ ID NO: 10385 - DNA, 352 bp, Homo sapiens; identical to SEQ ID NO: 10384
  AC073889.1_138614
  Located on chromosome 6
  Distance between a terminus base of telomere on chromosomal short arm and 5'-terminus of this base sequence : 76484349
  Distance between 3'-terminus of neighbour sequence of sequence listing upward to telomere on chrosomal short arm and 5'-terminus of this base sequence : -352

SEQ ID NO: 10386 - DNA, 311 bp, Homo sapiens
  AL035467.23_55027
  Located on chromosome 6
  Distance between a terminus base of telomere on chromosomal short arm and 5'-terminus of this base sequence : 76540741
  Distance between 3'-terminus of neighbour sequence of sequence listing upward to telomere on chrosomal short arm and 5'-terminus of this base sequence : 56040
attgcaatatttagcgaatatcacttggattttcttcaaactcaacctctctccatagccttttccccccattctcaagcacttgtgccaagtttgaagagaagctaaaaatggaaaagaagtcacataaatgagctgaacaatgtgtgtgtgtgtgtgtgtgtgtgtgtgtgtctgtgtgtggatgtgtgcgtgctacaaagaaggtaagaactttctgtcttgtattctaaaaagaagttttgataatgttgagagtagaaccatttttctattcagagtagtaaaggctggtatagaagtgaggccag

SEQ ID NO: 10387 - DNA, 360 bp, Homo sapiens
  AL035467.23_44151
  Located on chromosome 6
  Distance between a terminus base of telomere on chromosomal short arm and 5'-terminus of this base sequence : 76551626
  Distance between 3'-terminus of neighbour sequence of sequence listing upward to telomere on chrosomal short arm and 5'-terminus of this base sequence : 10574
agaaaggctgacatctcatattaaccatgaatgacactgggctacatatatatctaacttacaaggaaacaaaacattgtgtaatataactatattagtcagagttccccaggaaaacggaaccaataggatgtgtatatatatatatatatatatatatatatagagagagagagagagagagagagagagagagagagagatagtgatttattttaaggaattggcttagtgtgattgtgtagcctgacgaatccaaaatctacaggataagccagcagtctagacacccaggaaaaagttgatattgcagtttgaggctgaaggcagccttttgtagaatttcctcttccttaggag

SEQ ID NO: 10388 - DNA, 424 bp, Homo sapiens
  AL035467.23_13177
  Located on chromosome 6
  Distance between a terminus base of telomere on chromosomal short arm and 5'-terminus of this base sequence : 76582467
  Distance between 3'-terminus of neighbour sequence of sequence listing upward to telomere on chrosomal short arm and 5'-terminus of this base sequence : 30481
taccaaatcaagctcctgtaagatactgatttgcctcatcatcttttagtaagctgaaagtggttattttggaagtatgaatagctagcttacagcatacttactccacttccttacctactaaaatcttcatttagttgtacatagtgggggcacaagactatgcagcaaattctgcacattcttgggacatgtgttttagagtagctgtgaataaatggggaaatctcatgaaagttttcttgtcctaaattattgaagattgataaagtgagagagagagagagagagagagagaacttccatgtatgcattacctctttatccatgttttctttttttcttccttagttgggtagtgataaaaactggatgatgatatactatgctgaaatagaatgtctggaaagatttgtctggacta

SEQ ID NO: 10389 - DNA, 459 bp, Homo sapiens
  chr6.fa.O7frz.78619590
  Located on chromosome 6
  Distance between a terminus base of telomere on chromosomal short arm and 5'-terminus of this base sequence : 76876529
  Distance between 3'-terminus of neighbour sequence of sequence listing upward to telomere on chrosomal short arm and 5'-terminus of this base sequence : 293638
gaacaggtaaactgtcagataaattgggtaggcattaaaagataattttgaacatttcactattttttcaatcaaataatttttaaaaatagcttcttgcatggtattgattatagagccttattgatataaacaatccgagccatattaagaagaaacaaagctttatataattcaagagtagttttagtcttaggtgttttatgaagacgggaaggcaatttaaagtgaaaactacttaggctttaggaaatttttctgtgctggaaattattcctttgcctaattgttattgaaaacatcttttaagcatatatatatatgtgtgtgtgtgtgtgtgtgtatgtatatatacacatatgtgtgtgtgtatatatatatgcatgcttaaaatacatatatatgcttaaaatacatacacatgtatatatgtatttctcagaaaactttcctttgaac

SEQ ID NO: 10390 - DNA, 333 bp, Homo sapiens
  AL034373.13_10334
  Located on chromosome 6
  Distance between a terminus base of telomere on chromosomal short arm and 5'-terminus of this base sequence : 76971005
  Distance between 3'-terminus of neighbour sequence of sequence listing upward to telomere on chrosomal short arm and 5'-terminus of this base sequence : 94017
tatgtatttgaccatctgcattacactggaaacggaaatggacttttttattgatacataatttccctttgaatttttgaagaccaaaataccagtggcagagagaagagatggtgtgagggagaggattttagctgccctacttccctcatataaatgtctatcagctcttcctcaatcacacacacacacacacacacacacacacacacacaagttgtattaaaatacaatatgaaattagcttcaaaagagtttcataggactttcttccaatcagatttccattctaacacagtcgttccagagctgataccatccaattactatcca

SEQ ID NO: 10391 - DNA, 249 bp, Homo sapiens
  AL034373.13_72103
  Located on chromosome 6
  Distance between a terminus base of telomere on chromosomal short arm and 5'-terminus of this base sequence : 77032882
  Distance between 3'-terminus of neighbour sequence of sequence listing upward to telomere on chrosomal short arm and 5'-terminus of this base sequence : 61544
cagtgatgcagtatgaactgaggcaagctgttctgtctctggtttctgattattttaatctgtaatatgacgtgtgtgtgtgtgtgtgtgtgtgtgtgtgtgtatgtttgtgtctgggtctgtctgcttgtttgtgtttgtttgtgtgtgtgtgtttactggatgtgttctagattatcttctttgtattagttttcttgggctgccataacaaaagctcatagactcagtggcttagacaacataaat

SEQ ID NO: 10392 - DNA, 439 bp, Homo sapiens
  chr6.fa.O7frz.79030938
  Located on chromosome 6
  Distance between a terminus base of telomere on chromosomal short arm and 5'-terminus of this base sequence : 77258687
  Distance between 3'-terminus of neighbour sequence of sequence listing upward to telomere on chrosomal short arm and 5'-terminus of this base sequence : 225556
cagtttgcatacttgtgaactaagtacacatccatatgtgcgatctaaaatgtgatacagtgataattatgtcagagattatggtaggcccaaagatctggggtgagtgtgtgtgtgtgtgtgtgtgtgtgtgtgtgattttttttttctcattaaaactattagtacatcactttgagaaacaaatagaaccatagaacttcttggtaataatggaaattataaaggccaataagatgtttttcagtgtttttagtccctttcaactgtaaataatgcaaaatggctagcctagggtagtaatgagtttctcatttgaaaactaagccattagaatacagttgcaacaattatcacaaattatttacaaatatatttcaaacgtgaataataaacattttatttataagctaaatgctacttatggtcttgccagtta

SEQ ID NO: 10393 - DNA, 383 bp, Homo sapiens
  AL035633.18_38569
  Located on chromosome 6
  Distance between a terminus base of telomere on chromosomal short arm and 5'-terminus of this base sequence : 77361451
  Distance between 3'-terminus of neighbour sequence of sequence listing upward to telomere on chrosomal short arm and 5'-terminus of this base sequence : 102325
tccaacttacaattttatgcttagtaaatattacccagaaatatctttcaggaaataaataaatgagtgcatgcatgcatagatagatagatagatagatagatagatagatagatagatagatagatagagaacaaagagaattcatcatgaggtgaccagcactacaaaaaatactaatgggagttcatgttgaagaaaagtatctccagttggaagcactagccttgaggaagaatgaagaacattggaaagagttcataatgataaaaacaacatcttgtggtagttaaaacatatgtagacgtgaaaaatatataaaatacctgagtgaaaggtgggaggggagtaaatggaagtaagttattgtacagatcttgcat

SEQ ID NO: 10394 - DNA, 293 bp, Homo sapiens
  AL035633.18_53391
  Located on chromosome 6
  Distance between a terminus base of telomere on chromosomal short arm and 5'-terminus of this base sequence : 77376179
  Distance between 3'-terminus of neighbour sequence of sequence listing upward to telomere on chrosomal short arm and 5'-terminus of this base sequence : 14345
aataagacatttatgcagccaaaacacacaagacatactattcccattttaaagttgaagacactgagacttagagggattgggtaatttgcccaaggtctcataactgattgggcctgaatttaaacccaggctacctggtgccaaacccatgcttttaaccaacttgtgaagagagagagagagagagagagagagagagagagagagaaagtgagtgcaagcacatttgagattttgaaataagttcaagcatttattgaacatctatgtggttagtacatgctaggcat

SEQ ID NO: 10395 - DNA, 230 bp, Homo sapiens
  AL035633.18_57168
  Located on chromosome 6
  Distance between a terminus base of telomere on chromosomal short arm and 5'-terminus of this base sequence : 77379960
  Distance between 3'-terminus of neighbour sequence of sequence listing upward to telomere on chrosomal short arm and 5'-terminus of this base sequence : 3488
aagatggataaatggaggtaactcttatgaacttttcttcagggagcttagcattaggaaggaaagagatcaaatgtagcagtccttttttctttgattctaccaacatttattagcacttttcttgtaccagactctgtaattgagggagtagtaagagtaagatgggtgtgtgtgtgtgtgtgtgtgtgtgtgtgtgggcatgcatgtttcagaacaaaggaatctga

SEQ ID NO: 10396 - DNA, 353 bp, Homo sapiens
  AL035633.18_76510
  Located on chromosome 6
  Distance between a terminus base of telomere on chromosomal short arm and 5'-terminus of this base sequence : 77399421
  Distance between 3'-terminus of neighbour sequence of sequence listing upward to telomere on chrosomal short arm and 5'-terminus of this base sequence : 19231
ttcataggttgtaaacattaggacatgaacatctttggaggaccattactgtattgtattgtattgtattgtattgtattgtattgtattgtattgtattgtaattttttcgcccaaattaatggttttatttccatctttaatgctagcagaggattccaaagcacactgatatccatggatatagtttaaatgtaacaaagagttgtactatatacactgagaaagggaaagggatttttttttcataccaatctttccctaggtcacagtttctgaatagtagaaactaaacatattgttttcttaccaatttaatttaggatgaagtagtacaagtctgctaatcaacc

SEQ ID NO: 10397 - DNA, 445 bp, Homo sapiens
  chr6.fa.O7frz.79257758
  Located on chromosome 6
  Distance between a terminus base of telomere on chromosomal short arm and 5'-terminus of this base sequence : 77491933
  Distance between 3'-terminus of neighbour sequence of sequence listing upward to telomere on chrosomal short arm and 5'-terminus of this base sequence : 92159
aggaatacatttaaccaaggaggagaaagatctctacaaggagaactatacactgttggtggggatgtaaactatttcagcaattgtagaaagcagtttggaaatttctcaaacaacttaaaacacagctaccatttgacccagcaatcgcattactggatatctccccaaaggaaaataaatagttttatcaaaaagacacatgaactcacatgcttattggagcactattcacaatagcgaagtcatggaaccaacctaagtgtccaccagcagttgactgaataaagaaaatgtgatacacacacacacacacacacacacacacacacacacacacacacacacgctatggaatattatgcaaccataaaaaagaatgagattatgttctttgcagcaacatggaaggagctggaagacattagcctaggtgagctaactc

SEQ ID NO: 10398 - DNA, 441 bp, Homo sapiens
  chr6.fa.O7frz.79333523
  Located on chromosome 6
  Distance between a terminus base of telomere on chromosomal short arm and 5'-terminus of this base sequence : 77570991
  Distance between 3'-terminus of neighbour sequence of sequence listing upward to telomere on chrosomal short arm and 5'-terminus of this base sequence : 78613
caacatggtgactcctcatctctactaaaattacaaaaattagccaggagtggtggcggacgcctgcagtcccagctactcagggggctgaggtaggagaatcacttgaaccctggaggcggaggttgcagtgaaccgagatcacgccattgcactccagtgtgggtgacagagcaagactccatctcaaaagaaagagagaaagagagagaaagagaaagagaaagaaagagaaagaaggaaggaaggaagggagggagggagggagggaagcaaggagaagaaagaaagagaaagaaaaaaagaaagaaagaaagaaaaagaaagaaagaaagaaagaaagaaagaaagaaagaaagaaagaaagaaagaaagaaagaaaaaaagtggaaagaggcagcagcacagtgacaccttctttacacttaacaatgaagttcc

SEQ ID NO: 10399 - DNA, 379 bp, Homo sapiens
  chr6.fa.O7frz.79424355
  Located on chromosome 6
  Distance between a terminus base of telomere on chromosomal short arm and 5'-terminus of this base sequence : 77661464
  Distance between 3'-terminus of neighbour sequence of sequence listing upward to telomere on chrosomal short arm and 5'-terminus of this base sequence : 90032
gaaaatctgtcagtgcatgtagcccttcctgccacggagaaggtggccaaggtctagaggaggccagcaggccaggcgaagcaacgctcccgcgctgcagggggcggggaggcagcggggaacctggggcgcaggaacgcgggcggaggtgcgatagcagaagcgcaaatgggtcgcctctgacagagatcgggcagtgggttaagtccccgtttgtggcgcggagtcaaagagtgtgtgtgtgtgtgtgtgtgtgtgtgtgtgtgtgtagtaagccttctccatctagcagagaatgcttaatgagaaaatgattggaagcaaatgtttatttttcccttaggcatttaaaacctttcagtggctttaaagtttacta

SEQ ID NO: 10400 - DNA, 236 bp, Homo sapiens
  G08520
  Located on chromosome 6
  Distance between a terminus base of telomere on chromosomal short arm and 5'-terminus of this base sequence : 77796890
  Distance between 3'-terminus of neighbour sequence of sequence listing upward to telomere on chrosomal short arm and 5'-terminus of this base sequence : 135047
atcccaactcttaaatgggcaggaagctcacataactcataactaacaaagctgggatacaaattcggttctgtttggttttagggtccagtcttttatcttcattcaaagagataaatggccaatctatatatctatatctatctatctatctatctatctatctatctatctatctatctaatctatcttagtttaaggtattctgaattcttcaaacaatttctgccatgaat

SEQ ID NO: 10401 - DNA, 247 bp, Homo sapiens
  AL049845.7_30696
  Located on chromosome 6
  Distance between a terminus base of telomere on chromosomal short arm and 5'-terminus of this base sequence : 77796910
  Distance between 3'-terminus of neighbour sequence of sequence listing upward to telomere on chrosomal short arm and 5'-terminus of this base sequence : -216
aggaagctcacataactcataactaacaaagctgggatacaaattcggttctgtttggttttagggtccagtcttttatcttcattcaaagagataaatggccaatctatatatctatatctatctatctatctatctatctatctatctatctatctatctaatctatcttagtttaaggtattctgaattcttcaaacaatttctgccatgaataattccatccctaccatcactattctggctc

SEQ ID NO: 10402 - DNA, 147 bp, Homo sapiens
  D6S1036
  Located on chromosome 6
  Distance between a terminus base of telomere on chromosomal short arm and 5'-terminus of this base sequence : 77796989
  Distance between 3'-terminus of neighbour sequence of sequence listing upward to telomere on chrosomal short arm and 5'-terminus of this base sequence : -168
cttcattcaaagagataaatggccaatctatatatctatatctatctatctatctatctatctatctatctatctatctatctaatctatcttagtttaaggtattctgaattcttcaaacaatttctgccatgaataattccatcc

SEQ ID NO: 10403 - DNA, 343 bp, Homo sapiens
  AL049845.7_90851
  Located on chromosome 6
  Distance between a terminus base of telomere on chromosomal short arm and 5'-terminus of this base sequence : 77856954
  Distance between 3'-terminus of neighbour sequence of sequence listing upward to telomere on chrosomal short arm and 5'-terminus of this base sequence : 59818
tgtaccaagaaaggctctagttagaagagcagcattagcattttagattttggtctaacagacagtgtagcaaggtctcctgggtaaagttttaagagcaattagagctaataaaaagacaggcttgtcagcacctgaacaatgtggaaaaggagagccagtggcttggcttttgattttgaactggacccaagttaaagctaatagaattgtttttttcaggagtacgtgtgtgtgtgtgtgtgtgtgtgtgtgtgtgtgcacgtgtgcacttgtttgtgcgtagcctgtgcatggggtgagggggttcatgaacatagatacagttcagctttggaataaa

SEQ ID NO: 10404 - DNA, 387 bp, Homo sapiens
  chr6.fa.O7frz.79694789
  Located on chromosome 6
  Distance between a terminus base of telomere on chromosomal short arm and 5'-terminus of this base sequence : 77952986
  Distance between 3'-terminus of neighbour sequence of sequence listing upward to telomere on chrosomal short arm and 5'-terminus of this base sequence : 95689
agtaatcttgaagttgacaatgacataagcctcttaccttaaaaggttcaaagattccctacatgaattttagtttcttagataagagtttttttttcataattggaaaatgtataatttgataagaatttaataataaaataggccaataattttaccaaatccttgatagcaatatatatgtatgtatacatacacacacacacacacacacatatatacacacacacacacacacacacacgtgtgtgtatttaaataaagatgctttccagcagggtagacaagttgggcaaaggaaatatggtatgagctctttcctttatgactcctctgccccattgaatccttataaaaatattagactagtgatggaaatttgtcaac

SEQ ID NO: 10405 - DNA, 434 bp, Homo sapiens
  chr6.fa.O7frz.79792863
  Located on chromosome 6
  Distance between a terminus base of telomere on chromosomal short arm and 5'-terminus of this base sequence : 78050922
  Distance between 3'-terminus of neighbour sequence of sequence listing upward to telomere on chrosomal short arm and 5'-terminus of this base sequence : 97549
aagcttctggttccaactataggtctgtgttagagagccacacctgaaaaatcaagcatgtcagatgcagacctgtatgcctttactgctgttcaagaggaaagtgtaagtgctgtgggaggaaggcaggaggaggagccagaggcttggtaggggtgaaggtagatggagaagaatgactaaaagtaagtgcaaaaaatactgcaggaaagcagtttgagataactaaggcagcattccagtgtatccacttaaggaagggttgttaatacagctatacttctgtggataagaaattaacttactgtataattgcattctcggaagatctttcaagacttttctgtgtgtgtgtgtgtgtgtgtgtgtgtgtgtgttgataaaaactctcacttctagtaaacttaggataataggctatgtcttgctaatct

SEQ ID NO: 10406 - DNA, 158 bp, Homo sapiens
  D6S280
  Located on chromosome 6
  Distance between a terminus base of telomere on chromosomal short arm and 5'-terminus of this base sequence : 78132683
  Distance between 3'-terminus of neighbour sequence of sequence listing upward to telomere on chrosomal short arm and 5'-terminus of this base sequence : 81327
tctcattcagatttctccagttttacttgaatacatttgtgtgtgtgtgtgtgtgtgtgtgtgtgtgtgtgtgtgtgtgtgtattggctctgtacagttttatcacttgcagagattagtatatctaaaacaacaatcaagatattggacagttccgg

SEQ ID NO: 10407 - DNA, 373 bp, Homo sapiens
  chr6.fa.O7frz.80274200
  Located on chromosome 6
  Distance between a terminus base of telomere on chromosomal short arm and 5'-terminus of this base sequence : 78510035
  Distance between 3'-terminus of neighbour sequence of sequence listing upward to telomere on chrosomal short arm and 5'-terminus of this base sequence : 377194
tacaaatggtgatccatttaacatttgttttataaaatggttagcgacattgcgccactgcactccagccctggcgacagagtgagactctgtctcaaaaataaataaatgaaataaaatgattagagacaaatagttggttgaaggaatggtaccaatagtattttgaggttaagtgacatctaagatacaaatcttgagtagaaacaggtaatttttttaggacgtctgccattttgcttagcagtttattaaaaacattaaccaatgagagagaagatgcattttgagctgatgtatgcggtctcaccctcaatcatgatgaccttgatgaactatgttctttgaatcctttaggctgtaagttcagtga

SEQ ID NO: 10408 - DNA, 398 bp, Homo sapiens
  chr6.fa.O7frz.80320594
  Located on chromosome 6
  Distance between a terminus base of telomere on chromosomal short arm and 5'-terminus of this base sequence : 78545986
  Distance between 3'-terminus of neighbour sequence of sequence listing upward to telomere on chrosomal short arm and 5'-terminus of this base sequence : 35578
agatcatgaggtcaggagatagagaccagcctggctaacacggtgaaaccccgtctctactaaaaatacaaaaattagctgggcatggtggcgggcgcctgtagtcccagctacttgggaggctgaggcaggagaatggtgtgaacccagtaggcagggcttgcagtgagccgagatcgcgccactgcactccagcctgggtgacagagtgagactctgtctcaaacacacacacacacacacacacacacacacacaaagtggttctgaatggagactgtcttctgaatgtcttgttctctaattctaactagtaactttctttttcctttggacccgccatatacagtaattgaactgaattgatacttacataataagaatcatgctcaatcaga

SEQ ID NO: 10409 - DNA, 211 bp, Homo sapiens
  D6S1596
  Located on chromosome 6
  Distance between a terminus base of telomere on chromosomal short arm and 5'-terminus of this base sequence : 78778037
  Distance between 3'-terminus of neighbour sequence of sequence listing upward to telomere on chrosomal short arm and 5'-terminus of this base sequence : 231653
ccatcaccttacagttaccatttgtgtgtgtgtgtgtgtgtgtgtgtgtgtgtgtgtgtatgtggtgagacatttaagatccactctttaagcatatttcaagaatacaatatggtattattgtattagtctgttttcacgctgctgataaagacacaccaagactgggtaatttatacaggaaaaagtgttccgtgtgactggggaggtc

SEQ ID NO: 10410 - DNA, 204 bp, Homo sapiens
  D6S406
  Located on chromosome 6
  Distance between a terminus base of telomere on chromosomal short arm and 5'-terminus of this base sequence : 78857720
  Distance between 3'-terminus of neighbour sequence of sequence listing upward to telomere on chrosomal short arm and 5'-terminus of this base sequence : 79472
cctgggtgacagagtgagactgtgtctaaacacacacacacacacacacacacacacacacacacacacacacacacacacacacaaacccagaaactaagtttggtactacagattttaaaaattattcttattttaaattttttggcaaaaaatcaatttttgacagccatgagcacatttggtgcttcagaatctatggtg

SEQ ID NO: 10411 - DNA, 192 bp, Homo sapiens
  chr6.fa.O7frz.80863274
  Located on chromosome 6
  Distance between a terminus base of telomere on chromosomal short arm and 5'-terminus of this base sequence : 78930890
  Distance between 3'-terminus of neighbour sequence of sequence listing upward to telomere on chrosomal short arm and 5'-terminus of this base sequence : 72966
tcttaattcacagtccacatcttaaattcatatctttagaatttctaccctataccatagagtctatcatctgtctatctatctatctatctatctatctatctatctatctatctatcatctatctatgtatccatctatctaataaatctgactgaggtactcagtgtactctgtaggctttacactgaa

SEQ ID NO: 10412 - DNA, 475 bp, Homo sapiens
  chr6.fa.O7frz.80949544
  Located on chromosome 6
  Distance between a terminus base of telomere on chromosomal short arm and 5'-terminus of this base sequence : 79076209
  Distance between 3'-terminus of neighbour sequence of sequence listing upward to telomere on chrosomal short arm and 5'-terminus of this base sequence : 145127
agccgtctattcagtcttaaagctgcttctactgctgaatgttatctttacaatagttcaatcatgaatactcatatggactaggttaaatacaaaaaggcttacctttattatattgtatttctttgcacaacatgctttaaaactttcactttctcttaaatccacttattggaggcatttcttgacaatggaaatatctccagtactttttgtttgtttcctacattgttcatggtttgctctttcccaaacctttcatccctgctaagtccatcccagctgaaacatttttggacagcatacaaaccagaactacttttggatagttcaatattgtctttcccaaacaacacacacacacacacacacacacatacacacacacacacacacacacacacacacacttctagcctcttgcctttcattggagtataatcctccccgtgtacatttcaaatttagcttcatt

SEQ ID NO: 10413 - DNA, 139 bp, Homo sapiens
  DISO7_10017499
  Located on chromosome 6
  Distance between a terminus base of telomere on chromosomal short arm and 5'-terminus of this base sequence : 79339662
  Distance between 3'-terminus of neighbour sequence of sequence listing upward to telomere on chrosomal short arm and 5'-terminus of this base sequence : 262978
ctgagatgaagggagactctctctctatacatatatatatatatatatatatatacacacacacacacacacacacatatacacacatatatatgcatatatatgtgtatatatatgcttattcacttctgttctcaga

SEQ ID NO: 10414 - DNA, 163 bp, Homo sapiens
  chr6.fa.O7frz.81248131
  Located on chromosome 6
  Distance between a terminus base of telomere on chromosomal short arm and 5'-terminus of this base sequence : 79433392
  Distance between 3'-terminus of neighbour sequence of sequence listing upward to telomere on chrosomal short arm and 5'-terminus of this base sequence : 93591
agagtggaactagctattccagataataattttgtatgttttggatctatacctagagctaagattgctctaacaatgtgtgtgtgtgtgtgtgtgtgtgtgtgtgtgtgtattctaactgcatacgcacacaatccatgcaataggttaagattccaccgta

SEQ ID NO: 10415 - DNA, 191 bp, Homo sapiens
  D6S1659
  Located on chromosome 6
  Distance between a terminus base of telomere on chromosomal short arm and 5'-terminus of this base sequence : 79532063
  Distance between 3'-terminus of neighbour sequence of sequence listing upward to telomere on chrosomal short arm and 5'-terminus of this base sequence : 98508
ccaatggtaggccaatccattctgtagctgtgttttctttggcctgtgtactggtgtgtgtgtgtgtgcgtgtgtgtgtgtgtaaattagctgtcagtgtttataaattgagaggttgttttgttttgttttgtttgagatggagtcctgctctgtcacccaggctggaatgcagtggcaccatctcagct

SEQ ID NO: 10416 - DNA, 463 bp, Homo sapiens
  chr6.fa.O7frz.81651430
  Located on chromosome 6
  Distance between a terminus base of telomere on chromosomal short arm and 5'-terminus of this base sequence : 79809670
  Distance between 3'-terminus of neighbour sequence of sequence listing upward to telomere on chrosomal short arm and 5'-terminus of this base sequence : 277416
atctgagtcctgaactccttagtttgtacataaaatttaattaaatctaataatcattttactgacatgtttccaaaatactcacatcaaaaaaaatttcctcactaaagagtcagataagataaattctatgtaataagtgaagaataaggaaatggaaacctagagaattaggaaactgtgagcatattactgacagaactagaagtaaatctagtatcttcagtcccaattccaaattctgaacttgaacttacatatatgtaagaatggccttgcgagcttgttaaaaaatgcacattttatgcagcatatgcagatcatctgcttctgtgggtgtctgtccaataatttcctttctttacaatatttatttatttatttatttatttatttatttatttatttatttttagtatcttgagtgcccaaggttgccatcattatactagtctggtcatgg

SEQ ID NO: 10417 - DNA, 434 bp, Homo sapiens
  chr6.fa.O7frz.81866177
  Located on chromosome 6
  Distance between a terminus base of telomere on chromosomal short arm and 5'-terminus of this base sequence : 79974971
  Distance between 3'-terminus of neighbour sequence of sequence listing upward to telomere on chrosomal short arm and 5'-terminus of this base sequence : 164838
cagtttcattccatgttgtaacatacatcagaacttcatcttacagtggaataatactctgttttatatatatatatatttatatatatatatacaccactattatttattccaacagttgatggacatatggattgtttctactttttatcattatgataaatgctgctattaacattcctatacaagtttgtgtgtgaagatgttttatttctcttgcatatatacttaaaggtaaaattactggacaatactgtaactctatattaactttctgaggaactggaaaactttttcacagcagttgcaccctttacatttccattaacaatgtattagagttccaaatttttcacatccttgaaagcacttgttattgtccaccatttttattataacaatcccagtggatgtgaagatccaactgagtaatg

SEQ ID NO: 10418 - DNA, 204 bp, Homo sapiens
  DISD22_0001202
  Located on chromosome 6
  Distance between a terminus base of telomere on chromosomal short arm and 5'-terminus of this base sequence : 80166317
  Distance between 3'-terminus of neighbour sequence of sequence listing upward to telomere on chrosomal short arm and 5'-terminus of this base sequence : 190912
gttaagtggcttagttcaggggaaactaaacaaaatcttcttaattgtcattttatttttataaaaaattttttgaagtttaaaagaaaattaaaataacttacactgtatgtatccttacttaaatagtgtgtgtgtgtgtgtgtgtgtgtgtgtgtgtgtgtgtgtgtccagaaattgatgcccctgctggatggagatgaa

SEQ ID NO: 10419 - DNA, 279 bp, Homo sapiens
  chr6.fa.O7frz.82253094
  Located on chromosome 6
  Distance between a terminus base of telomere on chromosomal short arm and 5'-terminus of this base sequence : 80428555
  Distance between 3'-terminus of neighbour sequence of sequence listing upward to telomere on chrosomal short arm and 5'-terminus of this base sequence : 262034
ctacgtctaacgttctgacaatagtagatcagttttgaccaaggtaagaactgaaaacaaagatagtaattactatatacaaaccccttaatgagaaaccagactatttcctagaagtaactctaatcttccagccaaattttctggtctgaacaatatttacacctcttcaatttctttgtgtgtgtgtgtgtgtgtgtgtgtgtgtgtgtgtgtgtgtggattagagtttaataaggagatattatttctaagtccataaatataggtgactcactt

SEQ ID NO: 10420 - DNA, 262 bp, Homo sapiens
  Z67613
  Located on chromosome 6
  Distance between a terminus base of telomere on chromosomal short arm and 5'-terminus of this base sequence : 80458351
  Distance between 3'-terminus of neighbour sequence of sequence listing upward to telomere on chrosomal short arm and 5'-terminus of this base sequence : 29517
catattttagcagtgtaactcgcaactgcaaaaatatgaaaccagcctgaatgcccatcaaccaacgagtggataaaaggtgagatatagataatagacagatgatagatgatagatagatagatagatagatagattagatagatagatagagagatagatagatatacacacacacacacacacacatcatgaaatactactcagccataaaaaggaacaaaataatggcattcacagcaacctggatggagttggaaac

SEQ ID NO: 10421 - DNA, 222 bp, Homo sapiens
  Z24265.1_136
  Located on chromosome 6
  Distance between a terminus base of telomere on chromosomal short arm and 5'-terminus of this base sequence : 80529802
  Distance between 3'-terminus of neighbour sequence of sequence listing upward to telomere on chrosomal short arm and 5'-terminus of this base sequence : 71189
gcatagtttgattacttcagaacacaactcatcttacacattgttttcaggttaaaaaagtttgctaattaaatatatatgtgtatatatatatacagatttttttacataacatatacacatataagacacacacacacacacacacacacacacacacacacacacacgtatacatatatatatatatatataattccaagttggcaggaattacaacat

SEQ ID NO: 10422 - DNA, 477 bp, Homo sapiens
  chr6.fa.O7frz.82799953
  Located on chromosome 6
  Distance between a terminus base of telomere on chromosomal short arm and 5'-terminus of this base sequence : 80751503
  Distance between 3'-terminus of neighbour sequence of sequence listing upward to telomere on chrosomal short arm and 5'-terminus of this base sequence : 221479
atgcagttcattggtattaagtacatttataatgttgtgcagccaccaccaatatttatttttggatcttttaaatcatcataaacaagaactgtgtacctgttaaacagtaattctccatttctctacttcctttagcctctggtaaccttgattctactttctgtctctatgaatttacctattctgggtacttcatatatgtggaatcatacaatatttgtccttttgcatctggcttatttcacttagtaactgttttcaaggttcatctgtcttgtatcctgtatccaattcgtatccctttaaggctgaataacattccgttgtgtctatgtgtgtgtgtgtgtgtgtgtgtgtgtgtacatatgtacacacatactgtattttgtttattaatctgttgatagaaatttgggttgtttccaccatttagcttactgtgaataatgctgctatgaacattggcatacaagt

SEQ ID NO: 10423 - DNA, 301 bp, Homo sapiens
  chr6.fa.O7frz.82780843
  Located on chromosome 6
  Distance between a terminus base of telomere on chromosomal short arm and 5'-terminus of this base sequence : 80770854
  Distance between 3'-terminus of neighbour sequence of sequence listing upward to telomere on chrosomal short arm and 5'-terminus of this base sequence : 18874
agaataccatgacttgttaatcagatacattataatgaatgcattttttctcaaggataagaaaaatgagcattgatgtgtctttgtgtgtgtagtgtgtgtgtgtgtgtgtgtgtgtgtgtgtgtgtgtatatatatatatatatatatatatatatatattttttttttttttttttttttttttttaactgttttccttttcctaactcccttggcttattgggaagtattatacctaacccgtttcttctacctctgtttttctacctatttcctttcctctgtacaggtgagtata

SEQ ID NO: 10424 - DNA, 395 bp, Homo sapiens
  chr6.fa.O7frz.82610192
  Located on chromosome 6
  Distance between a terminus base of telomere on chromosomal short arm and 5'-terminus of this base sequence : 80937098
  Distance between 3'-terminus of neighbour sequence of sequence listing upward to telomere on chrosomal short arm and 5'-terminus of this base sequence : 165943
taacagaataaatgactccgtaaggcagtcttggaaggattctgtttgccatatgctttctcctttttggtgtcttattctagcacttacagccaaaacccaaattacttttagttggtacttaatgtctaataccctaacatatatatacacatatatatgcgcatatatatatacacacacacacatatatatacatatatacacacatatataatatatacacatatatacatatatacacatatgtacacatatatacacatatatacacacacatatatatatacacacacacatatatatatatatatatattttttttttttttttttttgagacagagtctcactctgtcaacccaggctggagtgcagtggcatgatcttagctca

SEQ ID NO: 10425 - DNA, 327 bp, Homo sapiens
  chr6.fa.O7frz.83149968
  Located on chromosome 6
  Distance between a terminus base of telomere on chromosomal short arm and 5'-terminus of this base sequence : 81295018
  Distance between 3'-terminus of neighbour sequence of sequence listing upward to telomere on chrosomal short arm and 5'-terminus of this base sequence : 357525
gtcgcaagaaacttactatcatagcagaaggcaaagtggaagcaagcacatcttatcatggtggagcaggagagagagagagagaaagacagagagagagagagagagagaagggggaagtgccacgtgctttaaagtcatcagatttcatgagaactcactctcatgagaacagcaaggggaagtccgtcccatgatctaatcacttcccaccatgtctctcctccagttcaacatgagatttgggcagggacacaaatccaaaccatattaccccatgacaggccacttgcaagcaggagaccctaggatgctggtagagtagct

SEQ ID NO: 10426 - DNA, 301 bp, Homo sapiens
  chr6.fa.O7frz.83251598
  Located on chromosome 6
  Distance between a terminus base of telomere on chromosomal short arm and 5'-terminus of this base sequence : 81385380
  Distance between 3'-terminus of neighbour sequence of sequence listing upward to telomere on chrosomal short arm and 5'-terminus of this base sequence : 90035
tagaactacattccaatgacctatcctttataaattaaatcagtttgtcgagagttatctcatattaattgcaatatgattcacaatagcaaagatgtgaaatcaaagatgtgaaatcatcattggatgaaaggattaaaaattttacacacacacacacacacacacacacacacacacacaatatcgctcagccttaaaaacatgctactaatcggctttaagaaaagaagaaaattctgtcatttctgacaccatggaagaacttcaacattacgttaggtgaactaattcaggtaca

SEQ ID NO: 10427 - DNA, 370 bp, Homo sapiens
  HUMUT5958
  Located on chromosome 6
  Distance between a terminus base of telomere on chromosomal short arm and 5'-terminus of this base sequence : 81729724
  Distance between 3'-terminus of neighbour sequence of sequence listing upward to telomere on chrosomal short arm and 5'-terminus of this base sequence : 344043
aggtcaggagttcgtgaccatcctgaccaacatggtgaaactccatctctattaaaaatacaaaaaattagctggggatgatggtgggcacctgtaatcccagctactggggaggctacgccaggagaattgcttgaacccgggaggtggaggttgcagtgagccgcaataacgccactttactccagcctgggcaacagcagtgaaactctgtcaaaaagaaagcaagaaagcaagcaagaaggaaggaaggaaggaaggaaggaaggaaggaaggaaggaaggaaggaaggaaggaaagaaggaaggaaggaaggaagggagagagggagggagggaaaggttacaagcaatggaacttacacttgct

SEQ ID NO: 10428 - DNA, 333 bp, Homo sapiens
  chr6.fa.O7frz.83437363
  Located on chromosome 6
  Distance between a terminus base of telomere on chromosomal short arm and 5'-terminus of this base sequence : 81938536
  Distance between 3'-terminus of neighbour sequence of sequence listing upward to telomere on chrosomal short arm and 5'-terminus of this base sequence : 208442
ttgtactttgaacattactcatgtttaaatgggatcagattatatttttatgtgaataatgtggaacaactttggtagctgttccagtcaactgtgagctgctgcagtctcaagctttttgggacttactgtctcaaacattctcttaccaaatctacaatcttctttgccctggatgcacatcagctttcaatattgcgtgtgtgtgtgtgtgtgtgtgtgtgtgtgtgtgtgtgaaattaatggtttctaagcaatactcactaaacctctagctttctgatttgaaatctcgttgtttctccttacctttaccttcctactgtattctcc

SEQ ID NO: 10429 - DNA, 419 bp, Homo sapiens
  chr6.fa.O7frz.83653917
  Located on chromosome 6
  Distance between a terminus base of telomere on chromosomal short arm and 5'-terminus of this base sequence : 82224469
  Distance between 3'-terminus of neighbour sequence of sequence listing upward to telomere on chrosomal short arm and 5'-terminus of this base sequence : 285600
gtccattatgttgctttatgactttgcatcctcatagcttagctcccacttatgagtgagaacatacaacgtttggttttccattcctgagtaacttcacttagaataagtctccaatcccatccaggttgctgcaaatgcctttaattcattcttgttatggctgagtagtattccatcatatatatatatatatatatatgatggtatatatatatatatatatatatatatgcacacaccacagtttctttaactactcgttgattgatgggcatttgggttggttccacatttttgcaattgtgaattgtgctgctataaacatacatgtgtaagtatcttttttgtataatgacttcttttcctctgggtagatacccagcagtgggattgctggatcaaatggtaattctact

SEQ ID NO: 10430 - DNA, 328 bp, Homo sapiens
  chr6.fa.O7frz.83849537
  Located on chromosome 6
  Distance between a terminus base of telomere on chromosomal short arm and 5'-terminus of this base sequence : 82236157
  Distance between 3'-terminus of neighbour sequence of sequence listing upward to telomere on chrosomal short arm and 5'-terminus of this base sequence : 11269
gtgacagaaattaggtgaacagttggaatttaaaagtttgcatgcagagtgattggaacccacttcccctcctttactctatttgtccaagcagctgcctccgcctcattttatctacctaacctactttcaggttataagtttagcaaaatgcaattctagatgattattattattattattattattattattattattattattattttaccagagaaactctgaactcattgatggcagaaaaatcaatgggttggaactaaacaaagggcacagaactaaacatagagggattacatgaaagtttacataagtttgtgcagct

SEQ ID NO: 10431 - DNA, 163 bp, Homo sapiens
  D6S1625
  Located on chromosome 6
  Distance between a terminus base of telomere on chromosomal short arm and 5'-terminus of this base sequence : 82606883
  Distance between 3'-terminus of neighbour sequence of sequence listing upward to telomere on chrosomal short arm and 5'-terminus of this base sequence : 370398
gatgcctgtggaacatcttataatgccagaaagagagaaagtgcttcaacaaacacacacacacacatacacacacacacacacacacacacacagagtcacacacattaatgggggtatgtcaatgggacacaggagtcaactgaaaaagctctcaatggcc

SEQ ID NO: 10432 - DNA, 195 bp, Homo sapiens
  AL035466.3_74920
  Located on chromosome 6
  Distance between a terminus base of telomere on chromosomal short arm and 5'-terminus of this base sequence : 82606890
  Distance between 3'-terminus of neighbour sequence of sequence listing upward to telomere on chrosomal short arm and 5'-terminus of this base sequence : -156
gtggaacatcttataatgccagaaagagagaaagtgcttcaacaaacacacacacacacatacacacacacacacacacacacacacagagtcacacacattaatgggggtatgtcaatgggacacaggagtcaactgaaaaagctctcaatggccaaagctggaaataatttagcaataagtaaaggagtaccg

SEQ ID NO: 10433 - DNA, 292 bp, Homo sapiens
  AL035466.3_77007
  Located on chromosome 6
  Distance between a terminus base of telomere on chromosomal short arm and 5'-terminus of this base sequence : 82608870
  Distance between 3'-terminus of neighbour sequence of sequence listing upward to telomere on chrosomal short arm and 5'-terminus of this base sequence : 1785
cctgaacctgcagcttaagctaccccaaccttcatggaagcagattgtggtgcagtgggaccctctctgccccaaccccaagcagatcttcaggcattcagagcacatgcttgcctgaatcaccagcctgacccaccccacccttcttgtgccgagatcctggggtgagtgtgtgtgtgtgtgtgtgtgtgtgtgtgtgtgtgtgttggagcacaggggtcctctttgcttcatggccaggcagatatccataaatctggagcactcactatcctggattaagaattcaggt

SEQ ID NO: 10434 - DNA, 243 bp, Homo sapiens
  Z66785
  Located on chromosome 6
  Distance between a terminus base of telomere on chromosomal short arm and 5'-terminus of this base sequence : 82879988
  Distance between 3'-terminus of neighbour sequence of sequence listing upward to telomere on chrosomal short arm and 5'-terminus of this base sequence : 270826
agccatatcatgtgtctaaatggagttagcagcgtgaagttggtgagatgatgtattttatggtttaaattattaatccaaaagagtattcagtgctcaagtaatcaattggatactattacttatatttcttccaagaaacacacacacacacacacacacacagcacactacacacattgaatcatccagaatcagcagtctcaaaatatctttcttctgatattttgaagggctgatcct

SEQ ID NO: 10435 - DNA, 151 bp, Homo sapiens
  DISO7_10002175
  Located on chromosome 6
  Distance between a terminus base of telomere on chromosomal short arm and 5'-terminus of this base sequence : 83042504
  Distance between 3'-terminus of neighbour sequence of sequence listing upward to telomere on chrosomal short arm and 5'-terminus of this base sequence : 162273
tccactctcagcatcatataggtcttttagggagcttaatttttaatttgtttacccatctagccaatcccaattattattattattattattattattattattgtcaaaatgtgtttttacattttgtcttccagtatgcttacacatg

SEQ ID NO: 10436 - DNA, 104 bp, Homo sapiens
  DISD22_0001217
  Located on chromosome 6
  Distance between a terminus base of telomere on chromosomal short arm and 5'-terminus of this base sequence : 83240445
  Distance between 3'-terminus of neighbour sequence of sequence listing upward to telomere on chrosomal short arm and 5'-terminus of this base sequence : 197790
atgtgtcaaattgtgctggaatggtgtgtgtgtgtgtgtgtgtgtgtgtgtgtattttacctctattaaatctaatgacaaacagataggtgcaataaattgga

SEQ ID NO: 10437 - DNA, 344 bp, Homo sapiens
  AL050340.8_54165
  Located on chromosome 6
  Distance between a terminus base of telomere on chromosomal short arm and 5'-terminus of this base sequence : 83466160
  Distance between 3'-terminus of neighbour sequence of sequence listing upward to telomere on chrosomal short arm and 5'-terminus of this base sequence : 225611
aaattatgagcaccaacttgacaaatctagatatgccccaaacaatactttgtcaactctgacttcccaacaaatataaacactatttctgtactctgaaaattctatcaaaaaatggaatgtcttatccagacagggcagtaggacttctcttcctttgtagtagcttctccatttctgtgatgctgtgatgattagatacaattacaacgacgattgaacatctctctctctctctctctctctctctctctctctccacaccttcaccctgccctgttgcctagtcttcttactagaaatgttctcatatttcactactgtgtagaagtagagctgccttg

SEQ ID NO: 10438 - DNA, 260 bp, Homo sapiens
  chr6.fa.O7frz.85184178
  Located on chromosome 6
  Distance between a terminus base of telomere on chromosomal short arm and 5'-terminus of this base sequence : 83590369
  Distance between 3'-terminus of neighbour sequence of sequence listing upward to telomere on chrosomal short arm and 5'-terminus of this base sequence : 123865
ttgcattgtagtctttactaggtgtttcactaaatgttctccaagccaatagaatcagtgtaacacacagacagacacacacacacacacacacacacacacagagtgagagagagagacagagacagagagagacagacagacagagagagtaagagattaattttaaggacttggttcatgctcatgcaggggctggccagtgtgaaatttgtacggcagctcagcagtctgaaaactcaggcaagatgtttatgtta

SEQ ID NO: 10439 - DNA, 461 bp, Homo sapiens
  chr6.fa.O7frz.85282986
  Located on chromosome 6
  Distance between a terminus base of telomere on chromosomal short arm and 5'-terminus of this base sequence : 83705785
  Distance between 3'-terminus of neighbour sequence of sequence listing upward to telomere on chrosomal short arm and 5'-terminus of this base sequence : 115156
tctttgtactagaatcaggcacaattttatctgggggctttgtaaagagagctctttgatgtttagtcaacagcattctacaaactcaaaaaattccatagagatgttttgcataacattgtcaataaaaattgatgtcttctcacctaagcataatttagtaataataataataatagtgtgtgggttttggtaacaataataatttgtgtgtgtgtgtgtgtgtgtgtaggggcatagctttaacttaatactaattaggtggtcagctcttggctgaccttgaagagagttgaattctcagcacccaacccattgccctgaatgtagcaaatgccaataaatcttggttgaaagtgataattattcttcaaagggagcacataggaaaatatgtatgtgaatggtttttctatagagctcacacaattattttgttctacaaactacagctgtcctga

SEQ ID NO: 10440 - DNA, 308 bp, Homo sapiens
  AL035468.3_92991
  Located on chromosome 6
  Distance between a terminus base of telomere on chromosomal short arm and 5'-terminus of this base sequence : 83875268
  Distance between 3'-terminus of neighbour sequence of sequence listing upward to telomere on chrosomal short arm and 5'-terminus of this base sequence : 169022
gagcaaggatcttagtgaatacactgatcctagcattagttttggtcaggtccgatctaccccaatttcaaaatttgtaaaaatcaatttgtttaatgtataagcggtgtgtgtgtgtgtgtgtgtgtgtgtgtgtaagacagagagagagagagagagagagagagagagagagagagagagagagagagagaaatgatccccaagccttgggaatgcaaaattcctggctataacattgacagaacaatattcttatgtattcacattacaaaatcacatcaataaccaaagtaacttcatggaga

SEQ ID NO: 10441 - DNA, 402 bp, Homo sapiens
  AL035468.3_38895
  Located on chromosome 6
  Distance between a terminus base of telomere on chromosomal short arm and 5'-terminus of this base sequence : 83929417
  Distance between 3'-terminus of neighbour sequence of sequence listing upward to telomere on chrosomal short arm and 5'-terminus of this base sequence : 53841
agtgatacaattcagtaggtcaacagactctattcctttatttatttatttatttatttatttatttatttatttatttatttttgagatggagtctcgctctgtcgcccaggctggagtgcagtggcacgatcctggctcactgcaatctccgtctcctgggttcaagcaattctcctacctcagcctcccaagtagctgggattacaggtgcccaccaccatgctcagctaatttttgcacttttagtagagacaggttttcaacacgttggccaggctgatctcgaactcctgatctcaagtgatccacctgccttggcctcccaaagtgctgggattacacgcgtgagccaccacgcccggctgactattccattattctaagtacgaactcagagct

SEQ ID NO: 10442 - DNA, 200 bp, Homo sapiens
  AL035468.3_20262
  Located on chromosome 6
  Distance between a terminus base of telomere on chromosomal short arm and 5'-terminus of this base sequence : 83948027
  Distance between 3'-terminus of neighbour sequence of sequence listing upward to telomere on chrosomal short arm and 5'-terminus of this base sequence : 18208
aaacatcagtgcctgtttagattctccactattcctctgtgttcatcctctgtttatcctctttcagtgtgttcccgtgcatgtgtgtgtgtgtgtgtgtgtgtgtacacatgcacatctttgttttttcctacattttcattttcctcttcccttcctcttttatccattgtataatagcattgtagtttgctatttcc

SEQ ID NO: 10443 - DNA, 450 bp, Homo sapiens
  AL035468.3_7619
  Located on chromosome 6
  Distance between a terminus base of telomere on chromosomal short arm and 5'-terminus of this base sequence : 83960528
  Distance between 3'-terminus of neighbour sequence of sequence listing upward to telomere on chrosomal short arm and 5'-terminus of this base sequence : 12301
atttcgtgaacgaatcatagtaagggagagaataatgtgagatagagatggaaaaataggtaagttatagtagacattactaatacatacataaataagcattaaatatataacatacataatatatattatatgtaacataaaaagaacacatacgtatatactcacaccagtgaacaactaagtaaacaacaatataaacaactatatgtttatgtatatgtgtgtgtgtgtgtgtgtgtgtgtgtatacattttttctttctttctgggtatatagatggagtccacttccaagtctattttatttaatgtagacatgatcacataacacatttcagcaaataacatgtgaatggaaataatgtgtcactttcaagcataattatttaagagtttaacgtgtggtttgttatgtactgttttcctctatgtacaatctgaaggctgt

SEQ ID NO: 10444 - DNA, 471 bp, Homo sapiens
  chr6.fa.O7frz.85614549
  Located on chromosome 6
  Distance between a terminus base of telomere on chromosomal short arm and 5'-terminus of this base sequence : 84035341
  Distance between 3'-terminus of neighbour sequence of sequence listing upward to telomere on chrosomal short arm and 5'-terminus of this base sequence : 74363
tacaagaaagtaacgcagtagatcatttatatgatctaaaatatggtaagtattcaataaatacaaagtactctcccaggtgaatttaaaaaggtgcttccctttctccagtcacctgtcaagtaagcaagcagaagaaaatgggaaacaagagtctggaaaagaaattttattttaaaaacagaataattattataacacctatgcagcagtactaatctacataagaaaaaaaaatgcaaacctaggcagtgttttttgtggaagaaagtccaaatcagttttttttttaaaaaaaatgaagcatcatctgaaaaagaaaatatggaaatatgtgtgtgtgtatgcttgtgtgtgtgtgtgtgtgtgtgtgttaaggtctaggattcaacaacaacaacaaaaaaaatagagacattcttactaagcccctgtgaaaatcagatataatgaattaccttcaaagagttc

SEQ ID NO: 10445 - DNA, 247 bp, Homo sapiens
  D6S284
  Located on chromosome 6
  Distance between a terminus base of telomere on chromosomal short arm and 5'-terminus of this base sequence : 84120211
  Distance between 3'-terminus of neighbour sequence of sequence listing upward to telomere on chrosomal short arm and 5'-terminus of this base sequence : 84399
catggctgtctatcaaaccccactggtaagcaccttgtggataggcatgatattccacttaacatacatacaccacacacacacacacacacacacacacacacacacacacacacaaacactcaagttaacatgcagatgacaggtgttcaaatatttgttgacttgaattgaatttgatagaaaggtggagcaatgtcacaagagaaagatcgaaggtttattagcaagagccacacaaatgctt

SEQ ID NO: 10446 - DNA, 112 bp, Homo sapiens
  Z67307
  Located on chromosome 6
  Distance between a terminus base of telomere on chromosomal short arm and 5'-terminus of this base sequence : 84120237
  Distance between 3'-terminus of neighbour sequence of sequence listing upward to telomere on chrosomal short arm and 5'-terminus of this base sequence : -221
taagcaccttgtggataggcatgatattccacttaacatacatacaccacacacacacacacacacacacacacacacacacacacacacaaacactcaagttaacatgcag

SEQ ID NO: 10447 - DNA, 386 bp, Homo sapiens
  AL133226.16_10075
  Located on chromosome 6
  Distance between a terminus base of telomere on chromosomal short arm and 5'-terminus of this base sequence : 84175800
  Distance between 3'-terminus of neighbour sequence of sequence listing upward to telomere on chrosomal short arm and 5'-terminus of this base sequence : 55451
attagccttggagtctgttaagttcctttctcaattaagccctctacctgtgcctagtattcaaacatttgtaaagtgaatgaatgaatgaatgaatgaatgaatgtataagcagttcctgtgtctgccaaaggcagttctgatcagccccacagccctaggtattaacagcctgtaggagaatttatatttattaagctatttaaacacacattactagaagtaatttattattatctttaccttttaggggagaaatccaaggttaagaaatatgttcaggattatacgctgcctaataaattcaaaattgggattaaacccagttctgactgttttcaaaggtcatgctactataattctaccaagatacttctatgatttcc

SEQ ID NO: 10448 - DNA, 289 bp, Homo sapiens
  AL133226.16_50670
  Located on chromosome 6
  Distance between a terminus base of telomere on chromosomal short arm and 5'-terminus of this base sequence : 84216336
  Distance between 3'-terminus of neighbour sequence of sequence listing upward to telomere on chrosomal short arm and 5'-terminus of this base sequence : 40150
ccaaattctaccagatgtacaaagaagagctggtatcattcctactgaaactattctaaaagattgaggaaaagaaactccaccctaactcactctatgaggccagcatcaccctaataccaaaacctggcagagacacacacacacacacacacacacacacacacacacacaagaaaacctcaggccaatacccatgataatcgtcagtgcaaaactcctcaacaaaatatgggcaaactgaatctagcaacatattaaaaagcttatccactttgatcaaatagga

SEQ ID NO: 10449 - DNA, 211 bp, Homo sapiens
  D6S286
  Located on chromosome 6
  Distance between a terminus base of telomere on chromosomal short arm and 5'-terminus of this base sequence : 84216438
  Distance between 3'-terminus of neighbour sequence of sequence listing upward to telomere on chrosomal short arm and 5'-terminus of this base sequence : -187
ccagcatcaccctaataccaaaacctggcagagacacacacacacacacacacacacacacacacacacacaagaaaacctcaggccaatacccatgataatcgtcagtgcaaaactcctcaacaaaatatgggcaaactgaatctagcaacatattaaaaagcttatccactttgatcaaataggatttatctttgggatgcacgattgg

SEQ ID NO: 10450 - DNA, 215 bp, Homo sapiens
  AL133226.16_68088
  Located on chromosome 6
  Distance between a terminus base of telomere on chromosomal short arm and 5'-terminus of this base sequence : 84233840
  Distance between 3'-terminus of neighbour sequence of sequence listing upward to telomere on chrosomal short arm and 5'-terminus of this base sequence : 17191
tccatgtctgattcactcaatatttgtttgtttttatgtgttttttctcgtgtgtgtgtgtgtgtgtgtgtgtgtgtgtgtgtgtacatgtgtgcctggtcttttctttgatatgggtaagttttttattcaaaaatgagtgttttgaaagaaaagttgcataaataaattgaagccttagagaatgttatctgcttccaaagagtatttagtca

SEQ ID NO: 10451 - DNA, 329 bp, Homo sapiens
  chr6.fa.O7frz.86101786
  Located on chromosome 6
  Distance between a terminus base of telomere on chromosomal short arm and 5'-terminus of this base sequence : 84566412
  Distance between 3'-terminus of neighbour sequence of sequence listing upward to telomere on chrosomal short arm and 5'-terminus of this base sequence : 332357
caactgtcaaggatcttatttaacaagccacactcctcactgtggcttgctccccaatattgtgtgtttctgtccatgcttatctgactttctctctctcttacacacacacacacacacacacacatatccttcttcatagagcatgaatatttatcagatttgaagcacatgaacagatatactatttggctgctccaaaaagaatagagataaccaacttaagtgagccattccattatttaacaatgtttttgttatttaacattaacagttctcccttatatctcactgaggaatctttttacttaaattagagcacgtttcct

SEQ ID NO: 10452 - DNA, 348 bp, Homo sapiens
  chr6.fa.O7frz.86184415
  Located on chromosome 6
  Distance between a terminus base of telomere on chromosomal short arm and 5'-terminus of this base sequence : 84613889
  Distance between 3'-terminus of neighbour sequence of sequence listing upward to telomere on chrosomal short arm and 5'-terminus of this base sequence : 47148
acctgagcagtatacatgtcacccaatttgtagtcttttatccctcagtcccttcccatgctttcccccgagtccccaaagtccattgtgtcattcttatgcctttgcatcctgatagcttagctcccacttatgagtaagaagatacgatatttggttttctattcctgaggtactttacttaccataatagtttccaatctcatccaggtcattaattcactcctttttatggctgagtagtattttattttatatatatatatatatatatatatatatatatatatatatatatatatatatatatctatctatctcacagtttctttatccacttattgactg

SEQ ID NO: 10453 - DNA, 171 bp, Homo sapiens
  chr6.fa.O7frz.86296648
  Located on chromosome 6
  Distance between a terminus base of telomere on chromosomal short arm and 5'-terminus of this base sequence : 84722843
  Distance between 3'-terminus of neighbour sequence of sequence listing upward to telomere on chrosomal short arm and 5'-terminus of this base sequence : 108606
catgactatcattaaggcaaagaaagagacagagacattggcagacagacacacacacacacacacacacacacagagagagagagagagagagacagacagagggagaaaggaagaaaggggaaaagtgaaaatgatactgtgttgcttctgatagtttgtaattccaga

SEQ ID NO: 10454 - DNA, 174 bp, Homo sapiens
  DISD22_0001224
  Located on chromosome 6
  Distance between a terminus base of telomere on chromosomal short arm and 5'-terminus of this base sequence : 84814514
  Distance between 3'-terminus of neighbour sequence of sequence listing upward to telomere on chrosomal short arm and 5'-terminus of this base sequence : 91500
tcttggaagattcttcacaaagttaaattgcttaaaaatagacatggcacttataccagacagtcagaatgacagatagataggatatagatatagatatagatatagatatagatatagatatattggggttgccagatttagcaaaaacaataactagggcattcagttaca

SEQ ID NO: 10455 - DNA, 155 bp, Homo sapiens
  D6S460
  Located on chromosome 6
  Distance between a terminus base of telomere on chromosomal short arm and 5'-terminus of this base sequence : 85125774
  Distance between 3'-terminus of neighbour sequence of sequence listing upward to telomere on chrosomal short arm and 5'-terminus of this base sequence : 311086
cagtggttctctcacccttttgtgtgtgtgtgtgtgtgtgtgtgtgtgtgtgtgtgtgtgtgtgtggtttgttttaaatcacagtctctgcttatctttcactggttctcttttaataattatgttcattagcgtggtttcttcaaatgggaatt

SEQ ID NO: 10456 - DNA, 385 bp, Homo sapiens
  AL035700.13_13899
  Located on chromosome 6
  Distance between a terminus base of telomere on chromosomal short arm and 5'-terminus of this base sequence : 85134533
  Distance between 3'-terminus of neighbour sequence of sequence listing upward to telomere on chrosomal short arm and 5'-terminus of this base sequence : 8604
ccttgtaaacgtctgagtgaacctcttgacctttttaaagggttttgttttgttatttttaatgctagttcttatgtactctctctctctctctctcacacacacacacacacacacacacacacacagttaccctaattctcctttgttaatttcttcactttttctttggagtcaagatggaatggagaattatatggctgaagatatagagaaatttgaggtggagagaccagaatttgcaggcacactccaagttggacattcttctatttggaatgcaggaattaggatcatctgagggaagggcaagtgcctgtagagatttcagaaagatacaaaagttcccagtggcagttatgtaggacagaaatagcattgaatc

SEQ ID NO: 10457 - DNA, 316 bp, Homo sapiens
  AL078462.9_46006
  Located on chromosome 6
  Distance between a terminus base of telomere on chromosomal short arm and 5'-terminus of this base sequence : 85246777
  Distance between 3'-terminus of neighbour sequence of sequence listing upward to telomere on chrosomal short arm and 5'-terminus of this base sequence : 111859
tcacaggtattgtcaaatacaagaattaatatttgactggaaatttgggtagatgcactatatttagtgaggtttaatcatgtggcaatgcccataaatggaaggctgtgattcacattgccactgttcaggctttccctctctctctctctctctctctctctttttggaggaaacactggccagcatctcccctctatatttgtgggcattcttatattgttttaaaaatatggtgatgagaatgagttgtatgtatttttaaaatagtgtgcaatgggaaacaaaaacaaaagcaatcattcttgagatgtct

SEQ ID NO: 10458 - DNA, 139 bp, Homo sapiens
  chr6.fa.O7frz.87194052
  Located on chromosome 6
  Distance between a terminus base of telomere on chromosomal short arm and 5'-terminus of this base sequence : 85493495
  Distance between 3'-terminus of neighbour sequence of sequence listing upward to telomere on chrosomal short arm and 5'-terminus of this base sequence : 246402
ttatgctatggtttcatagcaccaaaatgtacattaaagtgtagctatgtaacttggtggtcaagtaaactatatatctgtgtgtgtgtgtgtgtgtgtgtgtgtgtgtgtgtgtgtagcgttaattggtagttcttta

SEQ ID NO: 10459 - DNA, 428 bp, Homo sapiens
  chr6.fa.O7frz.87267593
  Located on chromosome 6
  Distance between a terminus base of telomere on chromosomal short arm and 5'-terminus of this base sequence : 85563298
  Distance between 3'-terminus of neighbour sequence of sequence listing upward to telomere on chrosomal short arm and 5'-terminus of this base sequence : 69664
actgtaggagcacctgatactccaaggattcaaaccaaatcctctttctcctcacaataatgtaagcaacaaggcaaaattaaataggcagagattaatttactcttgaaggagaagaataaaagagtctcttgcctgacccaggcatatgtatacacacacacacacacacacacacacacacacacacatatatgtttctattgctgagtgcctttaaaaccttagttatcgccaaccctccgattctcagaactagtagtacgcaggagaaggcaagaactgaggacaaatgtcccaaaatcccaaaaagagtatgaccaaagagactgacaagatagaaatgcagaaataaattcaggggagcctaaactaagaagaaggtggggaaagtgtcaaaagcttgtgaatcctagctactggagtac

SEQ ID NO: 10460 - DNA, 394 bp, Homo sapiens
  AL049696.9_5075
  Located on chromosome 6
  Distance between a terminus base of telomere on chromosomal short arm and 5'-terminus of this base sequence : 85828624
  Distance between 3'-terminus of neighbour sequence of sequence listing upward to telomere on chrosomal short arm and 5'-terminus of this base sequence : 264898
tgacattaacgtactgttaaccaagacacagcaatcatcagtgttttgatggtaacaaactttgatggtaaagttggtaaaaggcaactttcagaagaaaataatgtgctttagaaaaaaaattcaaatttatagtagtatatttacatttttgttgttgttgttgttctgagatggagtctcactctgtcgcccaggctagactgcagtggtgcaatctcagctcactgcaacctcccccctacccctgagttcaagcgattctcctgcctcagcctgctgagtagttgggattacaggcgcccaccaccatgcccagctaatttttgtgtttttattggaggtggggtgtcactatgttggctcagctgatttcaaattcctgacctcaagt

SEQ ID NO: 10461 - DNA, 326 bp, Homo sapiens
  chr6.fa.O7frz.87694686
  Located on chromosome 6
  Distance between a terminus base of telomere on chromosomal short arm and 5'-terminus of this base sequence : 85953895
  Distance between 3'-terminus of neighbour sequence of sequence listing upward to telomere on chrosomal short arm and 5'-terminus of this base sequence : 124877
atcattaatgtcttgaagttcactggtttggcattttatgtatatttatatctgtatgcattaacaaagtttatttattattattactattattattattattattattattattattattattattattttggagacagagtcttgctctgtcacccagactggagtgcagtggcatgatcttggctcactgcaacctccgcctcctgggttcaagtgatattcctgcctcagcctcctgagtagctgggattacaggcatgcgccaccatgcctgactaattatttttatctttagtagagacaggatttcaccatgttggtca

SEQ ID NO: 10462 - DNA, 266 bp, Homo sapiens
  D6S1707
  Located on chromosome 6
  Distance between a terminus base of telomere on chromosomal short arm and 5'-terminus of this base sequence : 86047543
  Distance between 3'-terminus of neighbour sequence of sequence listing upward to telomere on chrosomal short arm and 5'-terminus of this base sequence : 93322
aaggccaattctgcaagcagacccatctaaagatagtaacccccaaaatgctacgttatctctctctctctctctatacacacacacacacacacacacacacacacacacgattttattttcaccaaaataatcttgttattgtgggatatcaagaagaagtgagaatatggtaaaccagaaaaagtcattatgttggaaaaagtaaataacataagatacagggaagcacaacatctgggaatgtggtatttgccttggtgcca

SEQ ID NO: 10463 - DNA, 371 bp, Homo sapiens
  chr6.fa.O7frz.88435706
  Located on chromosome 6
  Distance between a terminus base of telomere on chromosomal short arm and 5'-terminus of this base sequence : 86295226
  Distance between 3'-terminus of neighbour sequence of sequence listing upward to telomere on chrosomal short arm and 5'-terminus of this base sequence : 247417
cactattcataccaagcatgtatctgcacctatatttgtcacttcatgtcttgattttttacctgcttgactttgggacctagaagtttgagatgtctgagttctaatataaaataccagcttttctttttttggagaaattgagtgtgtgtgtgtgtgtgtgtgtgtgtgtgtgtgtcagtgtgttaaagcataagttaaaaatatgtaagctgtatctttcttcctaatttgattttctcaaatactgtatgtaaataggtagattggagtaagtaacctgaacataggattggccttagaaagacttactattgcaaagccaattacactaacaatccctaaagctatctaaacaagatcagctgaac

SEQ ID NO: 10464 - DNA, 303 bp, Homo sapiens
  chr6.fa.O7frz.88323828
  Located on chromosome 6
  Distance between a terminus base of telomere on chromosomal short arm and 5'-terminus of this base sequence : 86325654
  Distance between 3'-terminus of neighbour sequence of sequence listing upward to telomere on chrosomal short arm and 5'-terminus of this base sequence : 30057
aaagtatgtccaaccagaaatacaaaaaacaaaaaagtaaaataaatactaaaaagtattaaacgtattaaaaataataaaagtattaaacataacgaactagaaagcaaaataacagtaaaactgatcagtaaaaacaaaactgttgtaaatattgctgcaataaacatatgtgtgtgtgtgtgtctgtgtgtgtgtgtgtgtgtgtgtgtgtgtgtatttatagtagaatgatttataaccctttgggtatatacccagtaatgggattgctgggccaaatggtatttctggtcctagatc

SEQ ID NO: 10465 - DNA, 244 bp, Homo sapiens
  AL121930.13_42860
  Located on chromosome 6
  Distance between a terminus base of telomere on chromosomal short arm and 5'-terminus of this base sequence : 86425284
  Distance between 3'-terminus of neighbour sequence of sequence listing upward to telomere on chrosomal short arm and 5'-terminus of this base sequence : 99327
ctcagaactgttactgtcactcactcactcatacacacacacacacacacacacacacacacacaccacagagaaatagaattcctggaattagcaagaaaaagaaacctcctggaattactaactcattcttttactctccgaagaaaattaatgtagtgttaagctactgatgatgtgatggtctctcttttaatataataaacattgaaggttgttgacctcattgtgactgcaagaattt

SEQ ID NO: 10466 - DNA, 197 bp, Homo sapiens
  AL121930.13_61227
  Located on chromosome 6
  Distance between a terminus base of telomere on chromosomal short arm and 5'-terminus of this base sequence : 86443647
  Distance between 3'-terminus of neighbour sequence of sequence listing upward to telomere on chrosomal short arm and 5'-terminus of this base sequence : 18119
cttcctagtctgaattgcattaactatataaatatgtatatatatatatatatatatatatgtaggtatgtataatagaaaacttgaagtactatgtgatattctacatggcattgcctccttttgtttaaattctgaaagtgacttattcttaaatatggactggctgaatggggtactttgtctttctgccagaa

SEQ ID NO: 10467 - DNA, 315 bp, Homo sapiens
  AL121930.13_99342
  Located on chromosome 6
  Distance between a terminus base of telomere on chromosomal short arm and 5'-terminus of this base sequence : 86481765
  Distance between 3'-terminus of neighbour sequence of sequence listing upward to telomere on chrosomal short arm and 5'-terminus of this base sequence : 37921
caactggcaactagcaatatagatggatggatggatagatagatagatagatagatagatagatagatagatagatagatagatagatagatagataactttaagttatgtgtatataggcaaatgcctgaatggtccttttaaatgaagctgccacaaaacagggagcccagtctgccaattgggtagatgtctctaagttcctaactctggcggccagatttattcatctgggtggcgtgtagacttgaaaactgtattgcgagtgactgaaccctactgctagtaaaagaaagttaaacctgtaatcgaaat

SEQ ID NO: 10468 - DNA, 131 bp, Homo sapiens
  D6S463
  Located on chromosome 6
  Distance between a terminus base of telomere on chromosomal short arm and 5'-terminus of this base sequence : 86662456
  Distance between 3'-terminus of neighbour sequence of sequence listing upward to telomere on chrosomal short arm and 5'-terminus of this base sequence : 180376
cttgcattttaccatttgtagataacttaaagagagaagtatacgtgtctatacttgtgtgtgtgtgtgtgtgtgtgtttctgtgtgtatgatagaactaaaaaaaaaaaaaaactgtggctattagttgg

SEQ ID NO: 10469 - DNA, 426 bp, Homo sapiens
  chr6.fa.O7frz.88843948
  Located on chromosome 6
  Distance between a terminus base of telomere on chromosomal short arm and 5'-terminus of this base sequence : 86757538
  Distance between 3'-terminus of neighbour sequence of sequence listing upward to telomere on chrosomal short arm and 5'-terminus of this base sequence : 94951
accacaataagatatcacctcacacctgttaggcaggctattatcaaagagacaaaagataacaagtgttgatgagggagtggagaaaagggaacccttgtgcattgttaatgggaatgtaaattggtatagccacatggaaaacagtattgaggttcctcaaaaaaggaaaaagagaactacaataggattctgcaatgccacttctgtatatatatatatgtgtatatatatatatatatatatatatatatatatacacacacacacacacacacaggaaattaaatcagtgtgttgaagagatagctgcaactccatgttcacacagcatcattcataaaagccaagatatggaaacaacctaagcatgattcgcaaatgaatggataaggaaaatgtgtatgtgtatgcatgaatgtaatg

SEQ ID NO: 10470 - DNA, 393 bp, Homo sapiens
  chr6.fa.O7frz.88957046
  Located on chromosome 6
  Distance between a terminus base of telomere on chromosomal short arm and 5'-terminus of this base sequence : 86870600
  Distance between 3'-terminus of neighbour sequence of sequence listing upward to telomere on chrosomal short arm and 5'-terminus of this base sequence : 112636
tctttctaggatactaatggcttaaatatctagaaactcaaaagtgataggaaggcacaagcgtgatatggaaaaacacaggagtatcagaaatcacttctgattgcaagactcttgaggaaagggagaaaaagggctgtcatcaaaaagaatacacacacacacacacacacacacacacacgcacacacatttgttagttctatctatctgccaagagggctagaagcaagtgtcattctaaaagtgcaattatacccagatcttggattctaaatgccacttttaaataaagggaagtaggcctgcttgaagtacggcttgataccaaagttgagagagggaaaatccaaaatgtgcttggagaatcttatggtgccagaaataaagtac

SEQ ID NO: 10471 - DNA, 269 bp, Homo sapiens
  D6S1646
  Located on chromosome 6
  Distance between a terminus base of telomere on chromosomal short arm and 5'-terminus of this base sequence : 86970065
  Distance between 3'-terminus of neighbour sequence of sequence listing upward to telomere on chrosomal short arm and 5'-terminus of this base sequence : 99072
tgtacccaacacttgcctctttgagaacagcagaataggtggatatcatgacaggaataaaaactactatatgcagagtgaatacaatgtttcagaagtatactagacacttcaaatgtgtgtgtgtgtgtgtgtgtgtgtgtgtgtttaatccttatgaaaaactagattaggattattagcccatcttacaaataaaaaacctgagactcagaaattacatataacttaccagaaacaaaaccacataatcagcacacagtgaaatt

SEQ ID NO: 10472 - DNA, 227 bp, Homo sapiens
  D6S445
  Located on chromosome 6
  Distance between a terminus base of telomere on chromosomal short arm and 5'-terminus of this base sequence : 87229821
  Distance between 3'-terminus of neighbour sequence of sequence listing upward to telomere on chrosomal short arm and 5'-terminus of this base sequence : 259487
tgagaccatctccaaaattacactaagaaaaattttaattaatacataaatgtatgccccctagcaatttgaataggtgaggttacattaaatgctagacaaaagggtgatttccttgcacccaacacacacacacacacacacacacacacacacacacacagaacatactagatcttttgattgctcttccttctctatacttcctctttcaattcctggccacc

SEQ ID NO: 10473 - DNA, 214 bp, Homo sapiens
  AL078599.19_50969
  Located on chromosome 6
  Distance between a terminus base of telomere on chromosomal short arm and 5'-terminus of this base sequence : 87229895
  Distance between 3'-terminus of neighbour sequence of sequence listing upward to telomere on chrosomal short arm and 5'-terminus of this base sequence : -153
aggtgaggttacattaaatgctagacaaaagggtgatttccttgcacccaacacacacacacacacacacacacacacacacacacacagaacatactagatcttttgattgctcttccttctctatacttcctctttcaattcctggccaccaattcctctcaccccaacgtaaaaactctgaataacactatagagcctcgaacagaatcta

SEQ ID NO: 10474 - DNA, 389 bp, Homo sapiens
  AL078599.19_85394
  Located on chromosome 6
  Distance between a terminus base of telomere on chromosomal short arm and 5'-terminus of this base sequence : 87264129
  Distance between 3'-terminus of neighbour sequence of sequence listing upward to telomere on chrosomal short arm and 5'-terminus of this base sequence : 34020
tcatacaggcaacgaaactaactttcccaagatcacaaaactataaataataggtctagattcaagcccaggcattctggatccagagcacacacttagcctcttcaccacttgcttagtccttagtttctagatattgactaatcaacaaaatgaaatcattatcccaggattattttattcaatttaaaagtcttcttttggtaaccagcagcccttagtttaaatatatacagcatagcacacacacacacacacacacacacacacacataaacacagttggcaattgtcttgtttattcataatcatattatttttaagatacacaatataggaaccaagtagtaaaccctctgattttactgacagaaattaggagacatgac

SEQ ID NO: 10475 - DNA, 407 bp, Homo sapiens
  chr6.fa.O7frz.89458094
  Located on chromosome 6
  Distance between a terminus base of telomere on chromosomal short arm and 5'-terminus of this base sequence : 87365807
  Distance between 3'-terminus of neighbour sequence of sequence listing upward to telomere on chrosomal short arm and 5'-terminus of this base sequence : 101289
catctagagtgcgcttcacactggaagctcagtgaaaatttgttcaataaataaatgactcatgatgattctctgtcacttactcttaaaatctcagctgtcaaaacctattaatcctacttctataagatcattcacttgtatgtcttcttctttgtccactgtctccactttcactttttggttgagtactataaggccactataaagtcttctaactggcctctgtgtatccattttccttttctacccaggctccctgtccttcacacacacacacacacacacacacacacacacacacacacacacacacacacacacatctccatggactcattgccactagattcagatttttaaaacagttttgatccaaatacaaacatgttatcctagaactcgag

SEQ ID NO: 10476 - DNA, 209 bp, Homo sapiens
  Z67262
  Located on chromosome 6
  Distance between a terminus base of telomere on chromosomal short arm and 5'-terminus of this base sequence : 87629624
  Distance between 3'-terminus of neighbour sequence of sequence listing upward to telomere on chrosomal short arm and 5'-terminus of this base sequence : 263410
aaatggcatgtggtctccttgcaaaatgaaaaggaatttaaagcatataaatcacctgtttttcttcctctctcaccctacacacacacacacacacacacacacatacacacagacacacacacacacacaccctttctgttaaaaaaatttcagaacagaagaagaaaagcatggaagtgataaaggtatgcttctcagaacaggga

SEQ ID NO: 10477 - DNA, 373 bp, Homo sapiens
  AL050333.18_80650
  Located on chromosome 6
  Distance between a terminus base of telomere on chromosomal short arm and 5'-terminus of this base sequence : 87705425
  Distance between 3'-terminus of neighbour sequence of sequence listing upward to telomere on chrosomal short arm and 5'-terminus of this base sequence : 75592
gatcaaccttgtattccatatgacccccagacacaagaacttttttcaagttcaactgtctagatgaaaaaaaaaaaaatcctagattaatatgttctctaaactacacatgcctaaacttcaaagaagttagtattcaaacaacaatctataggcaattattgtgaaggtgaagtaaaatgatttggtctttggtatctctagccttccattctgtaaatttcccctacaagggggctgttcctttctatgtcaagtctttttctcttaaatgactttacctacacacacacacacacacacacacacacacacacacacacacattaaatgcctgaagttccacctgctaattcaaacattcactctggag

SEQ ID NO: 10478 - DNA, 314 bp, Homo sapiens
  G10001
  Located on chromosome 6
  Distance between a terminus base of telomere on chromosomal short arm and 5'-terminus of this base sequence : 87722274
  Distance between 3'-terminus of neighbour sequence of sequence listing upward to telomere on chrosomal short arm and 5'-terminus of this base sequence : 16476
tcaagatttaataatttgtccacgatgattcactaagtagtagtagtagcagcagcagcagcagcagcagcagtagtagtagtagtagtggtggtggtagtagtactagaagatagtagtagtagtagcagtagtagtagtagtagaagatagtagtggtagtagtagtagtagtagtagtagtagtagtagcagtaatagtagaagatcagtagggagtttaactccacaaaagaatattttactattactatataataaaaattattcttatcagtaaatgttactacataaaagccactacagaaatattt

SEQ ID NO: 10479 - DNA, 399 bp, Homo sapiens
  chr6.fa.O7frz.90161967
  Located on chromosome 6
  Distance between a terminus base of telomere on chromosomal short arm and 5'-terminus of this base sequence : 88050154
  Distance between 3'-terminus of neighbour sequence of sequence listing upward to telomere on chrosomal short arm and 5'-terminus of this base sequence : 327566
aagatactcaatagcatcactcatcaggcaactacaaatcaaaaccacagttagatactctatggcaagatttggccactttggaaaataatttgatggcttctaaatatattaaacatagaattataaaaataaataaataaataaataaataaaaataaaagcagtcaccaaaatgtcttaagtgaataaaacattaagattttcatgagacatggagctggttccaaagaatagaccatcattactcttcctctctatcaagaaattagttaactagcacagagggagaacataattaagagcacttccattacccagggtctgatgggcttcatctgcaataacaatttggagacgtttgccaagcaatccacatacttctaaccagtgacatgc

SEQ ID NO: 10480 - DNA, 375 bp, Homo sapiens
  chr6.fa.O7frz.90386141
  Located on chromosome 6
  Distance between a terminus base of telomere on chromosomal short arm and 5'-terminus of this base sequence : 88127484
  Distance between 3'-terminus of neighbour sequence of sequence listing upward to telomere on chrosomal short arm and 5'-terminus of this base sequence : 76931
agtagatctaccatttgatccagtaatcccactactgggtatttacccagaggaaaagacatcattacaagaaaaagacacttgcacacacatgtttatagagcacaattcacaattgcaaaaatatagaaacagcctaaatgcccatcaaccaatgagtggataaagaaaatgtgatacacacacacacacacacacacacacacacacacacacacacacatatatatatatatatatatatatatatatatatatatatatatatatatatattatggaatactactcagccataaaaaggaacaaaataatggcattcacacaacctggatggagtccaagtccattattctgctaagtgaattaactcag

SEQ ID NO: 10481 - DNA, 427 bp, Homo sapiens
  chr6.fa.O7frz.90281784
  Located on chromosome 6
  Distance between a terminus base of telomere on chromosomal short arm and 5'-terminus of this base sequence : 88249550
  Distance between 3'-terminus of neighbour sequence of sequence listing upward to telomere on chrosomal short arm and 5'-terminus of this base sequence : 121691
agtctatcctgcaagaatgatatcgaatatttcttgtttttcatacatgttcactcccatttcctaaggtattgaatctttcactctgtacttaaagaacatcaatgaaaacctggccttgataatattagcaacatggattaattcctctctatgttccaaatcacatgctaagagtgtgtgtgtgtgtgtgtgtgtgtgtgtgtgtgtgtgtgtgtgtttacttacatgttgcattattttatccttacaacaatgcattaattagatacctttatcatcactgcaacacatgaaagaatcaaggcctagaaataacaagcctatttcaggacacagggaatacagggaagacataggatttggatccacacgcttatgcctttagagcctaagcatttagctactatgttatcctaaaggcaga

SEQ ID NO: 10482 - DNA, 368 bp, Homo sapiens
  AL034377.1_85817
  Located on chromosome 6
  Distance between a terminus base of telomere on chromosomal short arm and 5'-terminus of this base sequence : 88310027
  Distance between 3'-terminus of neighbour sequence of sequence listing upward to telomere on chrosomal short arm and 5'-terminus of this base sequence : 60050
gctgtgataagaaattggtgacttttgggagaactgatcaaataaaaaatacattaagcatactgggtaccaggtgtctccctgtcagaaaagggaactaccaatatgaaaagagaggaaactagcatgaggcctgtggtgttggattggaaggtatcagggtgaactcatagttttgtgtgtgtgtgtgtgtgtgtgtgtgtgtgtgtgtgtgttttcatacagaaatagatatacataaaaatgtgtgtatacatgtatgtattcacacacacacacacgtatattctctagctctgtctactgatattgtgatcccagtagcaaggaccatatgagcactcagatctgaataccgttcttcactg

SEQ ID NO: 10483 - DNA, 322 bp, Homo sapiens
  chr6.fa.O7frz.91054548
  Located on chromosome 6
  Distance between a terminus base of telomere on chromosomal short arm and 5'-terminus of this base sequence : 88570478
  Distance between 3'-terminus of neighbour sequence of sequence listing upward to telomere on chrosomal short arm and 5'-terminus of this base sequence : 260083
ataattaagactagaaggtgaccaggacaagctttgaggaaaaccattgatgggttttttgcggtattttatgttatgttatgttatgttatgttatgttatgttatgttatgttatgttatgttattttgagacagagtctcgctctatcgccattgacaggttttaggcaaaggaatgacataatgtgtctctggcttctctgtggaggatgaattatgcagactctcaagaatagaagcaggaatcagtggtgtgctggagtgggctataactggttagaataatagaagaggaaaagtggcaggtatagatttaggac

SEQ ID NO: 10484 - DNA, 473 bp, Homo sapiens
  AL049699.8_63376
  Located on chromosome 6
  Distance between a terminus base of telomere on chromosomal short arm and 5'-terminus of this base sequence : 88721779
  Distance between 3'-terminus of neighbour sequence of sequence listing upward to telomere on chrosomal short arm and 5'-terminus of this base sequence : 150979
aaacacagtgaaagctgtacagttttttttttttttaattagccggatatggcggcctgtggtcccaactgctcagaaagctaaggtgggatagggatcacttgaaaacaggaggtcaaggctacagtgaccatggaggcatcactgcactccagcctgagtgacaaagtgagaccctacctcaaaaacagagagagagagagagacagagagagaaaagaaagaaagaaagaaagaaagaaagaaagaaagaaagaaagaaagaaaggaaggaaggaaggaaagaaagaaaaagaaagaaagaaaaggaaggaaaggaaggaaggaaggaaagaaagaaaaagaaagaaagaaagaaagaaaaggaaggaaaggaaggaaggaaggaaagaaagaaaaagaaagaaagaaagagaaaggaaagaaaggaaggaaagaaagaaagaaaactaaactaattcaaatggactgtc

SEQ ID NO: 10485 - DNA, 343 bp, Homo sapiens
  HUMUT896
  Located on chromosome 6
  Distance between a terminus base of telomere on chromosomal short arm and 5'-terminus of this base sequence : 88721922
  Distance between 3'-terminus of neighbour sequence of sequence listing upward to telomere on chrosomal short arm and 5'-terminus of this base sequence : -330
actgcactccagcctgagtgacaaagtgagaccctacctcaaaaacagagagagagagagagacagagagagaaaagaaagaaagaaagaaagaaagaaagaaagaaagaaagaaagaaagaaaggaaggaaggaaggaaagaaagaaaaagaaagaaagaaaaggaaggaaaggaaggaaggaaggaaagaaagaaaaagaaagaaagaaagaaagaaaaggaaggaaaggaaggaaggaaggaaagaaagaaaaagaaagaaagaaagagaaaggaaagaaaggaaggaaagaaagaaagaaaactaaactaattcaaatggactgtcaattcaaaggggt

SEQ ID NO: 10486 - DNA, 383 bp, Homo sapiens
  AL049699_31892
  Located on chromosome 6
  Distance between a terminus base of telomere on chromosomal short arm and 5'-terminus of this base sequence : 88753397
  Distance between 3'-terminus of neighbour sequence of sequence listing upward to telomere on chrosomal short arm and 5'-terminus of this base sequence : 31132
atctcagctcactgcagtctccacctcccgggctcaagcgatcctccagccttagccccataagtatctgggaccacaggcgcgcatcaccatgccccgttattattattattattattattattattattattgtatttttggtagagatggggtttcactatgttgcccaggctggtcttgaactcctgagctcaagcaatctgccagcctcggcctcccaaagtgcgggggttataggcatgagccactgtatccagctcacacttttgagaggttaaattaatacaagcctttggaataaactctggcacataataaggattcactaaatattagttattgtttgctcagtgggattttgttgtttatcacaagagcca

SEQ ID NO: 10487 - DNA, 210 bp, Homo sapiens
  D6S1020
  Located on chromosome 6
  Distance between a terminus base of telomere on chromosomal short arm and 5'-terminus of this base sequence : 88753452
  Distance between 3'-terminus of neighbour sequence of sequence listing upward to telomere on chrosomal short arm and 5'-terminus of this base sequence : -328
ccccataagtatctgggaccacaggcgcgcatcaccatgccccgttattattattattattattattattattattattgtatttttggtagagatggggtttcactatgttgcccaggctggtcttgaactcctgagctcaagcaatctgccagcctcggcctcccaaagtgcgggggttataggcatgagccactgtatccagctcac

SEQ ID NO: 10488 - DNA, 456 bp, Homo sapiens
  chr6.fa.O7frz.91430906
  Located on chromosome 6
  Distance between a terminus base of telomere on chromosomal short arm and 5'-terminus of this base sequence : 88935014
  Distance between 3'-terminus of neighbour sequence of sequence listing upward to telomere on chrosomal short arm and 5'-terminus of this base sequence : 181352
atcaaatctatcgcatgagagcacagggggagggacaatgatcgggatataaacccaggcattcgagccggcaacggctaccccctttgggtcccctccttttgtgtgggagctgttttcaatctattaaatcttgcaactgcaaaataataataataataataataataataataataataataagaagaagaagaagaagaagcacagttaagtatgtgtacaatataaagtgtgataagtcttgtggagataataagtatgacatatctgaattctttgaagctttaatgagaatatgcagctcttctgatcttgcataaaatcttttaacaagagtaaagcaaactcagtttgtccagcagatatttattaagcacctagtatgggttaggcactatggtagatgctggggagaggcagtgatgaacatggtggtctaagaattttattggc

SEQ ID NO: 10489 - DNA, 413 bp, Homo sapiens
  AL109915.10_13733
  Located on chromosome 6
  Distance between a terminus base of telomere on chromosomal short arm and 5'-terminus of this base sequence : 89040932
  Distance between 3'-terminus of neighbour sequence of sequence listing upward to telomere on chrosomal short arm and 5'-terminus of this base sequence : 105462
cttgatgttaagatccgctaatgggtcctttgctggaggtttcttgggactctgactggcaggtgtagggcttggagaaagctaatgggaaaaagccagccccaaagagcaggaatagaaagcagagagagaatgagacatggggggaagagggggcagggggagagagggagagggggagagagagagagagagagagagagagagagagagagagagagagagagagagaaaagcattaggcagaacacatatcaaagaaaacaaacctgcagaagattagatggttaaaggcttatgaaatctacttgttctacatagtcacagagttgtgtttaattctggactggtaaaatatacttcaactgatatttggctttcttgaacttctctgacatcagatttagccaaag

SEQ ID NO: 10490 - DNA, 172 bp, Homo sapiens
  D6S1609
  Located on chromosome 6
  Distance between a terminus base of telomere on chromosomal short arm and 5'-terminus of this base sequence : 89160565
  Distance between 3'-terminus of neighbour sequence of sequence listing upward to telomere on chrosomal short arm and 5'-terminus of this base sequence : 119220
tatagcacagagcctgatacacttgaaggaacacacacacacacacacacacacacacacacagagttataattagattcaccctttggctgccaatgtcaaaaaagatttggccatggcaggaagattgcttgaggccaggagttcgagaccagactgggcaaaatggcta

SEQ ID NO: 10491 - DNA, 226 bp, Homo sapiens
  AL109915.10_164927
  Located on chromosome 6
  Distance between a terminus base of telomere on chromosomal short arm and 5'-terminus of this base sequence : 89192141
  Distance between 3'-terminus of neighbour sequence of sequence listing upward to telomere on chrosomal short arm and 5'-terminus of this base sequence : 31404
caagtttgaccttccataaattcatcttttttttttttgactgtgcaacctctaatttcctctaatttggagaagggagggtgggtggagaaagaaaaaaaggtgaaaaacatctaattcagtgtgtacaatctctctcttgtgtgtgtgtatatacatatgcgtgtgtgtgtgtgtgtgtgtgtgtatttttccccctccaccaagaccttggaggtcaataaga

SEQ ID NO: 10492 - DNA, 331 bp, Homo sapiens
  chr6.fa.O7frz.91772188
  Located on chromosome 6
  Distance between a terminus base of telomere on chromosomal short arm and 5'-terminus of this base sequence : 89277849
  Distance between 3'-terminus of neighbour sequence of sequence listing upward to telomere on chrosomal short arm and 5'-terminus of this base sequence : 85482
gacctacttaaactgaagagcttctgcacaaccaaatgaactatcaacaaagcaaacagataacctgcagaatgggagaagatattcgcaaactatgcatccaacgaaggactaatatccagaatctatagggaacttaaataaataaacaagcaataataataataataataataataaccccattaaaaagtgggcaaaggacatgaacagacacttctcaaaagaagatataaagtatccaatacacatgaaaaaatgcccagcatcactaatcactagagaaatggaagtcaaaaccacaatgagataccatctcataccagtcaga

SEQ ID NO: 10493 - DNA, 272 bp, Homo sapiens
  D6S1634
  Located on chromosome 6
  Distance between a terminus base of telomere on chromosomal short arm and 5'-terminus of this base sequence : 89404449
  Distance between 3'-terminus of neighbour sequence of sequence listing upward to telomere on chrosomal short arm and 5'-terminus of this base sequence : 126269
ggttccagaacatctgctcttaacagccattcctatagcctcttaaaaatcagagtaggaagtattttatgtgtttttctgtgtgtgtgtgtgtgtgtgtgtgtgtgtgtgtgtgtgtgtaaagcatggataacaaaaaatgaatctcagttaacatcaccataagaacaaatttcctagacataaactaggattggagaaggtatttcgctgtggctgtggcttagtatgtttaaaccactaatggtgttcagatgcccatttgaaactga

SEQ ID NO: 10494 - DNA, 240 bp, Homo sapiens
  AL034347.23_99977
  Located on chromosome 6
  Distance between a terminus base of telomere on chromosomal short arm and 5'-terminus of this base sequence : 89404451
  Distance between 3'-terminus of neighbour sequence of sequence listing upward to telomere on chrosomal short arm and 5'-terminus of this base sequence : -270
ttccagaacatctgctcttaacagccattcctatagcctcttaaaaatcagagtaggaagtattttatgtgtttttctgtgtgtgtgtgtgtgtgtgtgtgtgtgtgtgtgtgtgtgtaaagcatggataacaaaaaatgaatctcagttaacatcaccataagaacaaatttcctagacataaactaggattggagaaggtatttcgctgtggctgtggcttagtatgtttaaaccact

SEQ ID NO: 10495 - DNA, 334 bp, Homo sapiens
  AL034347.23_35029
  Located on chromosome 6
  Distance between a terminus base of telomere on chromosomal short arm and 5'-terminus of this base sequence : 89469401
  Distance between 3'-terminus of neighbour sequence of sequence listing upward to telomere on chrosomal short arm and 5'-terminus of this base sequence : 64710
cgtgacataatcaaactaagactttaaggaaacacacagatcctagaagagaccaggttttgggttttttcctcctgtttctcctgtttgtttgtttgtttgtttgtttgtttgttaacaggggaaaaaaaacccaaacctggtctcttctaggatctgtgtgttccaccatagagtagaaggtccctccttgtcctagagaagatctagaacacatttctaggacagaatgtataagccagccttatccatggataaacttataccttgatagatggaagatgaggcccaatgaagatgagaaacacatatctatgacattccagcataagaa

SEQ ID NO: 10496 - DNA, 446 bp, Homo sapiens
  AL034347.23_30636
  Located on chromosome 6
  Distance between a terminus base of telomere on chromosomal short arm and 5'-terminus of this base sequence : 89473653
  Distance between 3'-terminus of neighbour sequence of sequence listing upward to telomere on chrosomal short arm and 5'-terminus of this base sequence : 3918
gtgtaattaaaccaggataagcagctatcttggaaactgtggcaagaagcttacagaaaattttggagatgtcgataagggagacatggagagtaagggttgggtcactgtttctccaaggctgataaatcatggctccaatgtggacttggtgtcaggcctcccaaatgatgctgctcctcaccacacacacacacacatacgtaaacatacacacacacacacacacacacacacacacacacacacacacacacggggagagagagttttaaatttccatgcaacctggaagacatacttcttcttcctggggcccagttttctcatctgtaatatgacaggagtaagccagacgatctctaagttcttttccaattctggcattctataactctaaagtttgttttctctgatcagttctgtgatttggaagacaatgagtt

SEQ ID NO: 10497 - DNA, 306 bp, Homo sapiens
  chr6.fa.O7frz.92445236
  Located on chromosome 6
  Distance between a terminus base of telomere on chromosomal short arm and 5'-terminus of this base sequence : 89719414
  Distance between 3'-terminus of neighbour sequence of sequence listing upward to telomere on chrosomal short arm and 5'-terminus of this base sequence : 245315
caattactgaaattgacagaagtctatagtagcagtctggctgtcttgacctgcaggaatctgtggcaatggctaataaattgcagtttgagggatgaggtacatggatagctgactgggcaatttgtgtgtgtgtgtgtgtgtgtgtgtgtgtatgcaacaacaacaaccaaaatatcttcatgtgatgtgctccatcagaatataagaagaatatgagcatcagctatcacaatggaaaatctaggtccttcatccagcttctagatttatgtaattttgtagacctagatctcattggttaaa

SEQ ID NO: 10498 - DNA, 434 bp, Homo sapiens
  chr6.fa.O7frz.92097594
  Located on chromosome 6
  Distance between a terminus base of telomere on chromosomal short arm and 5'-terminus of this base sequence : 89733726
  Distance between 3'-terminus of neighbour sequence of sequence listing upward to telomere on chrosomal short arm and 5'-terminus of this base sequence : 14006
aggtaaagatgtaggtttatgctcctctcttcttcttcctgcaaggaagagagatgttaatgatttatttttcttcctttctttgtttctttctttttctttctttctttctttctttctttctttctttctttctttctttctttctttctttctctttctttctttctttctttcttttctttctttctttctttctttctttctttctttccttctttctttctttctttctttttttttaaacacttttagttttgggggtacatgtgcaggtttgttgtataggtgaatcacatattgtgggtgcttggtgtacagactattttgttacccaggtaataagcatggtactcaataagtagttttttgaccctcaccttcctcccaccctccactctcttaccctcaggtaggacctggtgtctattgtt

SEQ ID NO: 10499 - DNA, 278 bp, Homo sapiens
  AL049550.5_57761
  Located on chromosome 6
  Distance between a terminus base of telomere on chromosomal short arm and 5'-terminus of this base sequence : 89854254
  Distance between 3'-terminus of neighbour sequence of sequence listing upward to telomere on chrosomal short arm and 5'-terminus of this base sequence : 120094
ttcctgtagctcatagtttgatcttctgaagccttcttctctcaactcgtcaaagtcattatccatccaggtttgttccattgctggtgaggaactgcgatcctcagatggaaatgcagaaatcacccgtcttctgcgtcgctcacgctgggagctgtagaccggagctgttcctattcggccatcttggctcctcccccttattttattttattttattttattttattttattttattttattttattttattttatttgagacaaggtcttgttc

SEQ ID NO: 10500 - DNA, 403 bp, Homo sapiens
  AL049550.5_50084
  Located on chromosome 6
  Distance between a terminus base of telomere on chromosomal short arm and 5'-terminus of this base sequence : 89862041
  Distance between 3'-terminus of neighbour sequence of sequence listing upward to telomere on chrosomal short arm and 5'-terminus of this base sequence : 7509
attccacttgatcatggtgtattatctttttgatgtgccgttgaactcggtttgctagtattttgctgaggattcttgtgtttatgttcagcagggatattggcctgtagtttgtgtgtgtgtgtgtgtgtgtgtgtgtgtgtgtgtgtgttcttgtctggttttggtatcagattaatgctggtgccatacaatgagttagggagaattctctcccttcaattgtttggaatagatagaggagcatagatattagttctttttatgtttggtaaaatttggcagtgaatctattcagtcttgggcttttcctttttgggagactttttattattgatttaatattgctactcattattagtctattcaagtttttaatttcttcctgattcagtgttggtag

SEQ ID NO: 10501 - DNA, 428 bp, Homo sapiens
  AL137010.4_24909
  Located on chromosome 6
  Distance between a terminus base of telomere on chromosomal short arm and 5'-terminus of this base sequence : 89916617
  Distance between 3'-terminus of neighbour sequence of sequence listing upward to telomere on chrosomal short arm and 5'-terminus of this base sequence : 54173
ataagaacatcagcaagtgtagaccatggcctgcctgcctttccttccctccctccctccgtccctccctcccttccttccttccctccttccttccttccttccttccatccttccttcctttcttccttccctccctccctccctccctccctccctcccagtctcttcttcttctgcaggcttatctcccataatttcttcttttattttggttcttgcgacaaagtgttaattatcttttgatttgtctctctccatcctcccagctatctgagggcaggaacatttctcaatcatctttgaaccctagaactacaatacaacaaatgtttttcctgagtgaatggtggatggatggatagattaatatccactatcttccctaaccaccccatgaaaccaactttcatgatattgaaatggaa

SEQ ID NO: 10502 - DNA, 223 bp, Homo sapiens
  AL137010.4_20985
  Located on chromosome 6
  Distance between a terminus base of telomere on chromosomal short arm and 5'-terminus of this base sequence : 89920523
  Distance between 3'-terminus of neighbour sequence of sequence listing upward to telomere on chrosomal short arm and 5'-terminus of this base sequence : 3478
atatcttagaacaatggctcacacaaagtaattttctgtcattgtacattgctattagtagttattggtagttcttcttacagcatttatcaatctggttgcatggattatataggtcaagggcatatatatatatatatatatatatatatatatatatatatatatatatatatatatgtctggcaaaagaaaatttctgatccaagatgcatttactgaa

SEQ ID NO: 10503 - DNA, 108 bp, Homo sapiens
  D6S1627
  Located on chromosome 6
  Distance between a terminus base of telomere on chromosomal short arm and 5'-terminus of this base sequence : 90182375
  Distance between 3'-terminus of neighbour sequence of sequence listing upward to telomere on chrosomal short arm and 5'-terminus of this base sequence : 261629
ccctagctagatggctaaaacacacacacacacacacacacacacacacacacacacacacacacaatgaaatctctaaatttcccccaaagtctatcattcctggat

SEQ ID NO: 10504 - DNA, 419 bp, Homo sapiens
  AL035694.8_50688
  Located on chromosome 6
  Distance between a terminus base of telomere on chromosomal short arm and 5'-terminus of this base sequence : 90257640
  Distance between 3'-terminus of neighbour sequence of sequence listing upward to telomere on chrosomal short arm and 5'-terminus of this base sequence : 75157
tggaccataaatcagcgtcgcggtggcgtcgggaagctgagcgctcggaggtgcactcagctgcctctgggttcgcccagtccgagagcggggctccgccgcgggagcccgggcaggaatcggactccgccaggggttcggagtcttctggggaaagggcgtgttgggagagaaaggcaagcccacgcaggagcgacctcctaattaattcatcatcgagaattctccagtggggtgtgtgtgtgtgtgtgtgtgtgtgtgtgtgtgtgtaaaatcaaaaaagacttgggaggcaaacttgggtgggaagcactgaggaaggcgaaacaattcccaacttatctggatcccagacgagtccctctgattgcttaagtcactagaaaaggagattcgtctcagcgattaacaatgatacc

SEQ ID NO: 10505 - DNA, 275 bp, Homo sapiens
  Z67303
  Located on chromosome 6
  Distance between a terminus base of telomere on chromosomal short arm and 5'-terminus of this base sequence : 90267541
  Distance between 3'-terminus of neighbour sequence of sequence listing upward to telomere on chrosomal short arm and 5'-terminus of this base sequence : 9482
gaaatcatctgtgaaaactgctgatgtagtttcgctaaatctactactgattagtttcactaaaactaacattttgaaaaaaatcaataacaattcagtgaattagttatttaacaacttggtcagaccagtaaagggtgactattgattcaaatgagagtggattgtgtccaaactgcttttttcacatgtgtgtttgtgtttgtgtgtgtgtgtgtgtgtgtgtgtgtgtgtgtgttacggaagggggaatactgcaggggtgtcatttaggc

SEQ ID NO: 10506 - DNA, 255 bp, Homo sapiens
  AL035694.8_71610
  Located on chromosome 6
  Distance between a terminus base of telomere on chromosomal short arm and 5'-terminus of this base sequence : 90278664
  Distance between 3'-terminus of neighbour sequence of sequence listing upward to telomere on chrosomal short arm and 5'-terminus of this base sequence : 10848
gaaatgagcactgctatcaaacacttagaagatgtaaagtggtttccatcatgtctccattaaatttaccaaccagacctctgcaaaaaccagatggatcatggttgatgaaagaggactactggaaatgtagtgtgtgtgtgtgtgtgtgtgtgtgtgtgtgtgtgtgtgtgtgtgttagtggtggtgggtattggtagcttcatttttggctactacagcatcgagacacttggtatgcaactattaatttgg

SEQ ID NO: 10507 - DNA, 432 bp, Homo sapiens
  AL035694.8_83602
  Located on chromosome 6
  Distance between a terminus base of telomere on chromosomal short arm and 5'-terminus of this base sequence : 90290656
  Distance between 3'-terminus of neighbour sequence of sequence listing upward to telomere on chrosomal short arm and 5'-terminus of this base sequence : 11737
ttaccttcacttggtactggaggtgattggccatggctaagccagtaaaaaacaaacaccccccgattcccagccctccaacactttgtgctttgcttcccttgtgcctattgtgtgtgtgtgtgcgtgcaagtgtgtgtgtgtgtgtgtgtgtgtgtgtgtctgtgtttgtggtggcccaccaagtacctcttcagagggatgattgttggagtagaatatatctattttgggtcttataaccaaatatcatcaacaccccagcaacgcttctaacaagtatgttgtaaacaatgtctaaaataagagatctgggtttatttgttgacttaacttatccaggatattcattagttcaaataattaggaactggtcacattgtggcagcccatgtatgttcctaggcagatcatttcaaaggtgaaactatg

SEQ ID NO: 10508 - DNA, 396 bp, Homo sapiens
  AL109941.17_106172
  Located on chromosome 6
  Distance between a terminus base of telomere on chromosomal short arm and 5'-terminus of this base sequence : 90352138
  Distance between 3'-terminus of neighbour sequence of sequence listing upward to telomere on chrosomal short arm and 5'-terminus of this base sequence : 61050
gctacattccttctgcataaagtctaatttactgtatcttgtgtgtctctaacttttttccctaaatgagggaataaattttcagcctagaaatgtactgtatcagatgacaacttcattagaatttctttccagttttgaagacctagcctataaccataggcttctttcaccttcacccactctaaaaatcttaccatccaacatcttttcttgttctgttttcctctctaactttctgtcttacagacacacacacacacacacacacacacacacgtgtgtgtgtgcacactgagcaactaaatatttttgaatcttgttgaccaactgtgagtctaggctgctttaggcagcagttaaaatcagggtatgtgagtaatgctaggaaggctt

SEQ ID NO: 10509 - DNA, 427 bp, Homo sapiens
  AL109941.17_100093
  Located on chromosome 6
  Distance between a terminus base of telomere on chromosomal short arm and 5'-terminus of this base sequence : 90358362
  Distance between 3'-terminus of neighbour sequence of sequence listing upward to telomere on chrosomal short arm and 5'-terminus of this base sequence : 5828
cttctgtttacaatttcacttgttgataaaaaaaaaataaaaatgcacaccacttcttgagtgcccatgacatgcctggaaatttatctatctatctatctatctatctatctatctatctatctatctatctagtttacagtgctttaatcattcatgcctggaattttataatcattattttcctgtctcccaacaaccctattaggtgggtaatgacaacaagaatgtatttatttcctgttcgtcaggcactggattaaacctttgatatacacaatcccaaaatatcctcacaacaaggccatgaggtaggtattactgcctctatcaaatgttgaaactgaagtttggagaggttaataataacttgcccacagcttgtgggctagtggaaccaggactcaaatctacagctattgacttt

SEQ ID NO: 10510 - DNA, 119 bp, Homo sapiens
  G08518
  Located on chromosome 6
  Distance between a terminus base of telomere on chromosomal short arm and 5'-terminus of this base sequence : 90358413
  Distance between 3'-terminus of neighbour sequence of sequence listing upward to telomere on chrosomal short arm and 5'-terminus of this base sequence : -376
acttcttgagtgcccatgacatgcctggaaatttatctatctatctatctatctatctatctatctatctatctatctatctagtttacagtgctttaatcattcatgcctggaatttt

SEQ ID NO: 10511 - DNA, 143 bp, Homo sapiens
  D6S1601
  Located on chromosome 6
  Distance between a terminus base of telomere on chromosomal short arm and 5'-terminus of this base sequence : 90359685
  Distance between 3'-terminus of neighbour sequence of sequence listing upward to telomere on chrosomal short arm and 5'-terminus of this base sequence : 1153
gagatgaaaaacatggtctgtatccaaaatgtgaaatgaaattattgtgtaatacacacacacacacacacacacacacacacacaccatgcctgccgtgtgctgttaaacctacttaaataaaagttgtccctgaagaagcc

SEQ ID NO: 10512 - DNA, 427 bp, Homo sapiens
  chr6.fa.O7frz.92860071
  Located on chromosome 6
  Distance between a terminus base of telomere on chromosomal short arm and 5'-terminus of this base sequence : 90445774
  Distance between 3'-terminus of neighbour sequence of sequence listing upward to telomere on chrosomal short arm and 5'-terminus of this base sequence : 85946
ttaatagccatttggcaattgagaatactcttcttttataccacaccaaaatttgatgaggctgttttcttttcttttctttgttttcttttcttttttctttcttttcttttcttttcctctctctctctctctttctcacttttcttttcttttctttttttcttttcttttcttttgagatagtcttgctctgtcacccaggctggaggctggactgcagtggtaaaatcttggctcactgcgacctccgcctcctgggttcaagtgattcttgttcctcagcctcctgagtagctgggattacaggcgtgcaccaccacacctggctaatttttgtaatttttttttttttttttttttgagatggagtctcgctctgtcgccaggctggaatgcagtggcactatctcagttcactgcagtc

SEQ ID NO: 10513 - DNA, 358 bp, Homo sapiens
  AL139806.7_28516
  Located on chromosome 6
  Distance between a terminus base of telomere on chromosomal short arm and 5'-terminus of this base sequence : 90592873
  Distance between 3'-terminus of neighbour sequence of sequence listing upward to telomere on chrosomal short arm and 5'-terminus of this base sequence : 146672
acagtaggaaatagcatgcaatactacagcaatccagtgcatacgtggctatagatacatgtatgtgggtaggtacggtcacatgcacaggcacacacacacacacacacacacacacacacacacacacacacaaactgaaactgcccttgcatttgctattttatttcatttgttaaaacatgttggccatgtattagccttttcagaaaggctagaaaattgcctccagaccacatgggtaatatggaacacaacctgtatttgaacttgagtctctccaccgcaatgcccaggtccttgtgatgggttctctcatttcctccttaacctcctcctaaagccagactttaagtct

SEQ ID NO: 10514 - DNA, 227 bp, Homo sapiens
  D6S1652
  Located on chromosome 6
  Distance between a terminus base of telomere on chromosomal short arm and 5'-terminus of this base sequence : 90729453
  Distance between 3'-terminus of neighbour sequence of sequence listing upward to telomere on chrosomal short arm and 5'-terminus of this base sequence : 136222
gaaatccctggtcggtccttttcaacaaagagtttacagaatagttaaaaccaacaagcacctacatgaactagaaagaaaacacacacacacacacacacacacacacacacacacacacacacacagagctttctgaatagacagaaaagcattaaaaagaaatcatggagagagtgcatattgatgtggaggaaagcaaagtgaccggctcggctaccataaat

SEQ ID NO: 10515 - DNA, 216 bp, Homo sapiens
  chr6.fa.O7frz.92987509
  Located on chromosome 6
  Distance between a terminus base of telomere on chromosomal short arm and 5'-terminus of this base sequence : 90775623
  Distance between 3'-terminus of neighbour sequence of sequence listing upward to telomere on chrosomal short arm and 5'-terminus of this base sequence : 45943
agacgtcatggaagttaggtacaatgcagcactgagatatatatacacacatgtatacacatatatatacatatatgcatctatatatatacacacatatacatatatatatatacacacacacacacacacacaccatggaatactatgcagccataaaaaaggatgagttcatgaagctggaaaccataattctcagcaaactatcacaaagac

SEQ ID NO: 10516 - DNA, 264 bp, Homo sapiens
  chr6.fa.O7frz.93363516
  Located on chromosome 6
  Distance between a terminus base of telomere on chromosomal short arm and 5'-terminus of this base sequence : 90935815
  Distance between 3'-terminus of neighbour sequence of sequence listing upward to telomere on chrosomal short arm and 5'-terminus of this base sequence : 159976
tgaccttgagcaagttatttactctttcttgcctcagttctatcctgtataaaaataaggattataattgtacatagtgcacatagtgtggtctctatattattaccagacacatagtgtggtgtctatatatgttgttattaccagacactataatatagggttaagaaaaggaaagaaagaaagaaagagaaagaaagaaagaaacttcagagagagccaaaatgtggaaagacttgggtttcaaaggatttcaataaagta

SEQ ID NO: 10517 - DNA, 309 bp, Homo sapiens
  chr6.fa.O7frz.93683778
  Located on chromosome 6
  Distance between a terminus base of telomere on chromosomal short arm and 5'-terminus of this base sequence : 91296651
  Distance between 3'-terminus of neighbour sequence of sequence listing upward to telomere on chrosomal short arm and 5'-terminus of this base sequence : 360572
gtctgatacagattgtcttctgacctcactgagttttcttgagcaaattatcccactttgtctttgtgtactggcattcattgcttacagctctggatattgcctcaggcatcaggattagccacctacttccaagcttcagcctgtgcttcttcattattattattattattattattattattattattattattattttggctgtttgttctcttggggactcgtgggaacttctggatcttcccccaccacagccaagctgtagagaaccagcaataacagccctagctatcagtctggatcctc

SEQ ID NO: 10518 - DNA, 428 bp, Homo sapiens
  chr6.fa.O7frz.93883360
  Located on chromosome 6
  Distance between a terminus base of telomere on chromosomal short arm and 5'-terminus of this base sequence : 91477479
  Distance between 3'-terminus of neighbour sequence of sequence listing upward to telomere on chrosomal short arm and 5'-terminus of this base sequence : 180519
gttcagtttcaaagttcatgagtcaaagatggccattgacatgtctgtctttgttaaaatgtctctttttaggttttttaatttttaatttttatgggtatatagaaggtgtatatatttatgggctacatgggatgttttgatacaagcatgcaatgtgaaataatcacatgatggcgagtggagtatccatccccctcaagcatttattctttgtgtttcaaacaatccaattagtattttatttatttattttatatatatatatatatatataattttttttactgaaatattcagtctccatatccctggagactgtcaaaaattgccaatactgactatgttacaagtcatcatggtggagtattgggaaaagttttcaattagcaataatcacacctcagataaacctcattggctacaat

SEQ ID NO: 10519 - DNA, 388 bp, Homo sapiens
  AL049545.6_14902
  Located on chromosome 6
  Distance between a terminus base of telomere on chromosomal short arm and 5'-terminus of this base sequence : 91575022
  Distance between 3'-terminus of neighbour sequence of sequence listing upward to telomere on chrosomal short arm and 5'-terminus of this base sequence : 97115
gctgtatttggccttactttactcttctcttttctcttctcttctcttctcttctcttctcttctcttctcttctcttctcttctcttggtctatgtgcctgcttttataccagtaccatgttgttttggcaactatagcctcgttgtatagtttgaagtcaggtaatgtgatgcctccagatttatcgtttgtattcactcttgctttggatatgcaggctcttttttgattccatataaatttgaggattgtttcttctagttctgtgaagaattatggtgatattttgatgggaattgcattgaatttatagatttcttttagtagcatggtcatttttacaatattgactctacccatccacgagcataggatgtatttccatt

SEQ ID NO: 10520 - DNA, 161 bp, Homo sapiens
  AL049545.6_23914
  Located on chromosome 6
  Distance between a terminus base of telomere on chromosomal short arm and 5'-terminus of this base sequence : 91583966
  Distance between 3'-terminus of neighbour sequence of sequence listing upward to telomere on chrosomal short arm and 5'-terminus of this base sequence : 8556
attcctgagtcatttcagttagaatagcctctagttccatccatgttgctgcaagagtattgatttatttctttttttatggtggagtagttttccatggtgtgtgtgtgtgtgtgtgtgtgtgtgtatcacatttttaattcagtcatctgttgatgaac

SEQ ID NO: 10521 - DNA, 302 bp, Homo sapiens
  AL049545.6_29942
  Located on chromosome 6
  Distance between a terminus base of telomere on chromosomal short arm and 5'-terminus of this base sequence : 91590031
  Distance between 3'-terminus of neighbour sequence of sequence listing upward to telomere on chrosomal short arm and 5'-terminus of this base sequence : 5904
aatgcctgtatcatatgtaacaaacctgcatgttgttcacatgtactctagaacttaaagtgtatatatatatatatatatataatatatgtatgtatacatatataggtatacatatatatatatgtatacatatatatgtatacatatatatatatatatatgtataaaatgcctgtatcttttcccagtatgtttcactctcactatatttctgcctctccctaaggtagctctaaggctttggagaagctaggtgctctcctatggcttgggttgtataaatccatagtggaaaggtg

SEQ ID NO: 10522 - DNA, 260 bp, Homo sapiens
  AL049545.6_62080
  Located on chromosome 6
  Distance between a terminus base of telomere on chromosomal short arm and 5'-terminus of this base sequence : 91622192
  Distance between 3'-terminus of neighbour sequence of sequence listing upward to telomere on chrosomal short arm and 5'-terminus of this base sequence : 31859
caggctagcattaccaagataccaagattagacaaagatacacacacacacacacacacacacacacacacacacaactacaggccaatattcctgatgaaaataaatgcaaaaatcctcaacaaaatactagcaatatgactccaacaacatatcaaaaagataatacaccatgaaaaaatgagatttatcccaggaatgcatgatggttcaacacatgcaaatcaatgaatgtgataaatcaccttaacagaatgagg

SEQ ID NO: 10523 - DNA, 389 bp, Homo sapiens
  chr6.fa.O7frz.94118467
  Located on chromosome 6
  Distance between a terminus base of telomere on chromosomal short arm and 5'-terminus of this base sequence : 91693208
  Distance between 3'-terminus of neighbour sequence of sequence listing upward to telomere on chrosomal short arm and 5'-terminus of this base sequence : 70756
taatcagattataggtccaatcacagaaacactagcgtcagttttgataactcatccttaaaattctatttctctaggactactcttgtttccaaagtatgtattagtctgggttctccagagaaacagaagtaataggatgtctgtgtgtgtgtgtgtgtgtatatatacatatatagctatatatatacatatatacatattttgctatatatatttatatattatatatttatatatactatatatttatatatagtatatatagctatatatattttatatatatatatttatatatattatatatatatatatatatatatatatatgaagatggagacccaggagagctgatggttctagtatgaacatttcctgtatgaaag

SEQ ID NO: 10524 - DNA, 452 bp, Homo sapiens
  chr6.fa.O7frz.94335097
  Located on chromosome 6
  Distance between a terminus base of telomere on chromosomal short arm and 5'-terminus of this base sequence : 91901896
  Distance between 3'-terminus of neighbour sequence of sequence listing upward to telomere on chrosomal short arm and 5'-terminus of this base sequence : 208299
actcatatgaggaacctgtaaataataagagaacatgcaaggcacatacagggcttagaaaaaacttgttgttgttgctgttgttgttgttgttgttattgttgttgttgttgttggaaaacccacatcaggttaatcccaaccaacacctgaacctgctcagcacatgaccacagaactcagcatctccaactctgtatcctggtgcccctgatgcacatagcatccctttctcattgcccacacacattttaacctctcaaagcctcttaattagaaaacattttccattctattctagaaaggtaatctctacttgagaaaatgttatacccagacaagaaatatttcttctttccttttattgatctgataagtcctcccgaggtaaggctgaaaaatcagagctgcctatcaaaaagacacttctgtcaaattaagcaatttaacat

SEQ ID NO: 10525 - DNA, 336 bp, Homo sapiens
  chr6.fa.O7frz.94572268
  Located on chromosome 6
  Distance between a terminus base of telomere on chromosomal short arm and 5'-terminus of this base sequence : 92128768
  Distance between 3'-terminus of neighbour sequence of sequence listing upward to telomere on chrosomal short arm and 5'-terminus of this base sequence : 226420
cttcactaccattgtctctatcaccatgatcaacaataagacgaaagaaagaaaaagaaagaaagaaagaaagaaagaaagagaaagagagtgagagacagagaaagaaagtagaaagaaagaaaaagaacgaaaaagaaagaaagaaaagaaagaaagaaagttgtctaaagccatttttcatccttcttatagaagaaaacactggttttggaatattctttaatttaaaaggttcttggtggaggaagagattattaaaattaccaagagaacctaacattattgaaggaaaacagaagagaaaaaaatgatcagcaagtaactaaagcaata

SEQ ID NO: 10526 - DNA, 316 bp, Homo sapiens
  AL157777.5_47486
  Located on chromosome 6
  Distance between a terminus base of telomere on chromosomal short arm and 5'-terminus of this base sequence : 92401480
  Distance between 3'-terminus of neighbour sequence of sequence listing upward to telomere on chrosomal short arm and 5'-terminus of this base sequence : 272376
atgcatagtttgcactcatctagccatcaaaatgtctataatgtagcaaaagctaatgtttgaacaagaaaatattgtgatattaaattcattttgatccctcacttattgggaataaccactctcacagcattgagttatttgcagagaaaagcgttgcacataacagcctaaacctttctttctatctcattattaagatgcaaaacgcccccgtccacacacacacacacacacacacacacacacacacacacacatgcatgcacaaaaatataagggagtttttttttaatacaaatgcaagaattccaac

SEQ ID NO: 10527 - DNA, 236 bp, Homo sapiens
  Z66967
  Located on chromosome 6
  Distance between a terminus base of telomere on chromosomal short arm and 5'-terminus of this base sequence : 92437206
  Distance between 3'-terminus of neighbour sequence of sequence listing upward to telomere on chrosomal short arm and 5'-terminus of this base sequence : 35410
tacagacaccccaaaaaagttgtcttttcttccttttggcttacacatacacacacacagacacacacacacacacacacacacccctaccattcttcccatttattaaaaggtctccctgccatatatgacttaaccatcttacactgaactacactctcattcacccccttcctaaaggggataatccaatcaatcatatctagcaactgaatcctaaaatgtcatcaatgggc

SEQ ID NO: 10528 - DNA, 286 bp, Homo sapiens
  AL157777.5_89493
  Located on chromosome 6
  Distance between a terminus base of telomere on chromosomal short arm and 5'-terminus of this base sequence : 92443605
  Distance between 3'-terminus of neighbour sequence of sequence listing upward to telomere on chrosomal short arm and 5'-terminus of this base sequence : 6163
tgaacaggaagtgtctaccaaccagatattggcccagctcccacacagcataagacaatgtattaatcagggctctccagagaaacagaaccaattgcacgtgtgtgtgtgtgtgtgtgtgtgtgtgtgtgtgtgtgtgtgtgtgtacagaaagagagagattgatgttaagaaattggctcacacagttgtggagcctggcaagttcaaaatctgcagggtaggcaggtaggctggagacccagggcagagctgatattgcaactcaagtctgaagacggtctag

SEQ ID NO: 10529 - DNA, 298 bp, Homo sapiens
  chr7.fa.O7frz.109197108
  Located on chromosome 6
  Distance between a terminus base of telomere on chromosomal short arm and 5'-terminus of this base sequence : 92700823
  Distance between 3'-terminus of neighbour sequence of sequence listing upward to telomere on chrosomal short arm and 5'-terminus of this base sequence : 256932
ttgtgagtagacctttgagtaaataaactagatttagctttaaaaatacatagacacacacacacacacacacacacacacacacacacacacacacacacaacattaaatctcaagtcttatagtttaattttaaatagattagttatggggagtctgcttatgatactagaattactggttttataatttcctttgaattttaataattattcctctccttaccaactttttgttttttagaagctgtgttgaacttttactgtgtctgcctgttgagttatcagataaacagtgg

SEQ ID NO: 10530 - DNA, 433 bp, Homo sapiens
  AL096817.12_41404
  Located on chromosome 6
  Distance between a terminus base of telomere on chromosomal short arm and 5'-terminus of this base sequence : 92823853
  Distance between 3'-terminus of neighbour sequence of sequence listing upward to telomere on chrosomal short arm and 5'-terminus of this base sequence : 122732
cttgaagtcaggagtttgaaaccagctggccaacatggtgaaaccctgtatttattaaaaatacaaaaaaattagccaggcatggtgtgcacaactgtagtcccagcttgggaggctgaggcaggaaaatcgcttgagcccaggagtttgagactgcagtgagctatgattgcaccactgcactccagcctgggcaacagaatgaaatcctgtctcttaacaacaacaacaaaacacagcgtgtgtgtgtgtgtgtgtgtgtgtgtgtgtgtgtgtgtgtgtgtgtgaaatcctgtctcttaacctcttaacaacaacaaaacacagcgtgtgtgtgtgtgtgtgtgtgtttgtgtgtgtgtgtgtgtgtgtgtgtgttttaacctgaaagcatcactttgcctcttagggtcttggattgtccaagagtaaa

SEQ ID NO: 10531 - DNA, 321 bp, Homo sapiens
  AL096817.12_88601
  Located on chromosome 6
  Distance between a terminus base of telomere on chromosomal short arm and 5'-terminus of this base sequence : 92871116
  Distance between 3'-terminus of neighbour sequence of sequence listing upward to telomere on chrosomal short arm and 5'-terminus of this base sequence : 46830
ccatgctagagaattaggaaacaggcctagcactgtggttcatgcctgtaatcccagcaacttgggaagccaaagtggaaagatcgcttgagcccaggagctcaaggctgcagtgagccatggtctagccactgcactccagcctggaggacagagccagaccctatctcttaaaaacaaacaaacaaacaaacaaacaaacaaacaaagaattaggaatttatttgccaggcaacatgatcacgaacaccttcaaaatggaccagagagatgtccacagtaaaatcagaaatagagaactaaatcaaccaagtgatactg

SEQ ID NO: 10532 - DNA, 143 bp, Homo sapiens
  DID22N_0028011
  Located on chromosome 6
  Distance between a terminus base of telomere on chromosomal short arm and 5'-terminus of this base sequence : 93205049
  Distance between 3'-terminus of neighbour sequence of sequence listing upward to telomere on chrosomal short arm and 5'-terminus of this base sequence : 333612
tcgtctacatttgctgttacgaaaaactgtccttgaagaaaatgtattatctaagtatatagtagtgaagtgtgtgtgtgtgtgtgtgtgtgtgtgtgtgtataatcataaagtgaggaaagtttccagaatccagaagccaa

SEQ ID NO: 10533 - DNA, 488 bp, Homo sapiens
  AC024133.3_29079
  Located on chromosome 6
  Distance between a terminus base of telomere on chromosomal short arm and 5'-terminus of this base sequence : 93307930
  Distance between 3'-terminus of neighbour sequence of sequence listing upward to telomere on chrosomal short arm and 5'-terminus of this base sequence : 102738
tttactgcagaattcctaacttaggtcttcataactgtagatttgtatttccacttttactttcttgctagcttccctacattctccttatcaatcccaccaaacgattatgcaaactgcttccagatgtgtctctctaaagttcagacacagtcatgtcatgtctcttattatgaagctcagtggaaaaatgcttgaatatgacatttaagaccattatttttctcctacctgcctgataactgcaattctctgtcaataataattaacaatattagagcattcatggttcctctctgattgcctttcacatctatctctcatctatctatctatctatctatctatctatctatctatctatttatctatcatctatctaacaaatattacatcaatgcagttgtatatcctctacttaccatgatttttccaacctaggcctcagaccattggaaaagcagtactgcatattaagaacattatgg

SEQ ID NO: 10534 - DNA, 201 bp, Homo sapiens
  D6S300
  Located on chromosome 6
  Distance between a terminus base of telomere on chromosomal short arm and 5'-terminus of this base sequence : 93310774
  Distance between 3'-terminus of neighbour sequence of sequence listing upward to telomere on chrosomal short arm and 5'-terminus of this base sequence : 2356
agatacattgacattcttccgctgtttaatgccttcttaatgctgctcatgcatgcacgcacgcgcatagacacacagacacacacacacacacacacacacacacacacacacacacaatgctcatttaatggcaaataattgctgtttctatttgaattgattaagatatattttaaaaagtaggcttttggcttttga

SEQ ID NO: 10535 - DNA, 303 bp, Homo sapiens
  AC006265.1_58537
  Located on chromosome 6
  Distance between a terminus base of telomere on chromosomal short arm and 5'-terminus of this base sequence : 93385185
  Distance between 3'-terminus of neighbour sequence of sequence listing upward to telomere on chrosomal short arm and 5'-terminus of this base sequence : 74210
catttgattggatcacttctataggttatcaaaacaatgttattattcttttgcaatgtagtaaacatttggctgctaaaattattagggttttaaagttattaaaaagccagcgctcctcttctgtaacttatattgaagtttaaagtccactatggcacatatgtacctatgtaacaaacctgcatgttctgcacaagtatcccagaacttaaagtataattaaaataaataaataaataaataaatagaagtgtttaacagactatgacactctcccttcctatttctttaagcctagtt

SEQ ID NO: 10536 - DNA, 264 bp, Homo sapiens
  AL157378.8_57331
  Located on chromosome 6
  Distance between a terminus base of telomere on chromosomal short arm and 5'-terminus of this base sequence : 93445345
  Distance between 3'-terminus of neighbour sequence of sequence listing upward to telomere on chrosomal short arm and 5'-terminus of this base sequence : 59857
gctgaggtaggagaatcatttaagcccaggagtttgaggttataatatatatatatatatatatattatattatatatggcaccaatattatattatataatggcaccactgcactctagcctggatgacagagtgggaacctatctcttaaaaaaaaaaaaaaaaaggtgtgtgtgtatcagggagaccaaggtatactgcagggaaataactgctgtagttttaattataagagtgggacctaaattagtcaactaattgcc

SEQ ID NO: 10537 - DNA, 399 bp, Homo sapiens
  AC006265.1_120499
  Located on chromosome 6
  Distance between a terminus base of telomere on chromosomal short arm and 5'-terminus of this base sequence : 93447323
  Distance between 3'-terminus of neighbour sequence of sequence listing upward to telomere on chrosomal short arm and 5'-terminus of this base sequence : 1714
ccttgtgatcttgttagataacactaaataaactctgctttataggtggatatagagagatagatagatagatagatagatagagagatagatagagagatagatagatagatgcatctattccattagttctgtccctctagagaaccctgactaatacaacctgtaagtataggatttcatctaatctgttataatttgaatagttgcacctttaataattttacttgtatatattttagattacaagttgaaatatgtagtatttctgtactacttttaggggtttttaatttattctatgttagcagagaatttttaaatgttacaaaacttacctttttaaaaatatctcttgtagtagcaacttggaaatatttgcatgctattagataaaca

SEQ ID NO: 10538 - DNA, 192 bp, Homo sapiens
  AL078595.12_98984
  Located on chromosome 6
  Distance between a terminus base of telomere on chromosomal short arm and 5'-terminus of this base sequence : 93611620
  Distance between 3'-terminus of neighbour sequence of sequence listing upward to telomere on chrosomal short arm and 5'-terminus of this base sequence : 163898
caggttaaactatctgaatggaagaaagcatagagattgcatgaaatgttaaggaattttaagaaatggaacattttacacacacacacacacacacacacacacacacacacacactactgaagttttccagattagccaaagaacacataaactctctgtaaattgatgaggcttccttaattggtaatg

SEQ ID NO: 10539 - DNA, 286 bp, Homo sapiens
  D6S1720
  Located on chromosome 6
  Distance between a terminus base of telomere on chromosomal short arm and 5'-terminus of this base sequence : 93631096
  Distance between 3'-terminus of neighbour sequence of sequence listing upward to telomere on chrosomal short arm and 5'-terminus of this base sequence : 19284
aaagtgaagggatattagtggggctccactaggttcacttcctttattcctcatgatatctgttttttctcacagggggggcattactgttatgtccaaaaatttctaattctggctctctctattctatatgtagaagacagaaattccactgagatactcaattgttgtgtctatactttttcacttttcagaactcacagcacacacacacacacacacacacacacacacacacacacacagatgagtgtagtgcagtggcacaatcacggctcactgagct

SEQ ID NO: 10540 - DNA, 265 bp, Homo sapiens
  AL078595.12_29629
  Located on chromosome 6
  Distance between a terminus base of telomere on chromosomal short arm and 5'-terminus of this base sequence : 93680950
  Distance between 3'-terminus of neighbour sequence of sequence listing upward to telomere on chrosomal short arm and 5'-terminus of this base sequence : 49568
tttgattggagagcttagtttatttacattcaatgttagtattaatgagtaaggacttactcctgccatgtgttatttgttttatggttggtttatgacctccccttccttccttccttccttccttccttccttccttcctccttccattttccttttgattaaagtaattttctctggtgatacattttaatttcttgccttatatttttgtgtatctcttttaggtttttttttaatttaatgttactatgaggtttgcaag

SEQ ID NO: 10541 - DNA, 405 bp, Homo sapiens
  AL121724.19_82470
  Located on chromosome 6
  Distance between a terminus base of telomere on chromosomal short arm and 5'-terminus of this base sequence : 93785418
  Distance between 3'-terminus of neighbour sequence of sequence listing upward to telomere on chrosomal short arm and 5'-terminus of this base sequence : 104203
agttcaaaggccattaaataaccaggatactccttaaaaccatatttgtgctcctattctctttctcctttttggttcctttctccttctttaatagcttaaaatgttaagcctcccctgtccagaaacatactgggctttctattacatttttacatttttagctaccccaaatccttgtcttggttgttgctgtcagtggaaaatataagaaaagaaggaaagagagagagaggaaggaaggaaggaaggaaggaaggaaggaaggaaggaaggaaggaagaaaggaaggaatgttactgcatacctggttgtttcctctaagttttaacttcctttaaaatctgcctgcattttgttattatattatatatttgttttaacttgagtttacagctggtatca

SEQ ID NO: 10542 - DNA, 387 bp, Homo sapiens
  AL121724.19_79612
  Located on chromosome 6
  Distance between a terminus base of telomere on chromosomal short arm and 5'-terminus of this base sequence : 93788379
  Distance between 3'-terminus of neighbour sequence of sequence listing upward to telomere on chrosomal short arm and 5'-terminus of this base sequence : 2556
gatgactggttagtaagattcaactttgccgcaaatttcacatgcctatgggatatacaacattacataattgcaaatgctatgataaatgtggtggtttatggcacgtatattaaagcgaaatctatctatctgtctatctatctatctatctatctatctatctatctatctatctatatctataatgttattttagggtaccccatagacatgcaattcagaatccatgtagtttaggtatgttcttatttatgttcctttctctgtgaattgaaacagatcaaagaaccattgacagttcacaggttaaaacatcaaagaaagagaaagaagtgttgtttaaggctctttggatcttcagtcctaagtgcatgtctttaagta

SEQ ID NO: 10543 - DNA, 140 bp, Homo sapiens
  D6S1054
  Located on chromosome 6
  Distance between a terminus base of telomere on chromosomal short arm and 5'-terminus of this base sequence : 93788466
  Distance between 3'-terminus of neighbour sequence of sequence listing upward to telomere on chrosomal short arm and 5'-terminus of this base sequence : -300
aatgtggtggtttatggcacgtatattaaagcgaaatctatctatctgtctatctatctatctatctatctatctatctatctatctatctatatctataatgttattttagggtaccccatagacatgcaattcagaat

SEQ ID NO: 10544 - DNA, 220 bp, Homo sapiens
  AL121724.19_30424
  Located on chromosome 6
  Distance between a terminus base of telomere on chromosomal short arm and 5'-terminus of this base sequence : 93837569
  Distance between 3'-terminus of neighbour sequence of sequence listing upward to telomere on chrosomal short arm and 5'-terminus of this base sequence : 48963
tgctccattaagttcaccacatgtctaaggccaaaccagactcagactgggaagcaggagataccaaaaaagggagaagaaagtaaggggctgagcaacacattcttaggtccttcttcataaaagaaagtgaggtaaattactgttcgtgtgtgtgtgtgtgtgtgtgtgtgtgtgtatgtgtttaactaaatagaggtgatcgttgaggtaagacaaa

SEQ ID NO: 10545 - DNA, 152 bp, Homo sapiens
  D6S1586
  Located on chromosome 6
  Distance between a terminus base of telomere on chromosomal short arm and 5'-terminus of this base sequence : 93837654
  Distance between 3'-terminus of neighbour sequence of sequence listing upward to telomere on chrosomal short arm and 5'-terminus of this base sequence : -135
aggggctgagcaacacattcttaggtccttcttcataaaagaaagtgaggtaaattactgttcgtgtgtgtgtgtgtgtgtgtgtgtgtgtgtatgtgtttaactaaatagaggtgatcgttgaggtaagacaaatgcaaatactagccctc

SEQ ID NO: 10546 - DNA, 405 bp, Homo sapiens
  AL121724.19_2931
  Located on chromosome 6
  Distance between a terminus base of telomere on chromosomal short arm and 5'-terminus of this base sequence : 93864938
  Distance between 3'-terminus of neighbour sequence of sequence listing upward to telomere on chrosomal short arm and 5'-terminus of this base sequence : 27132
gtagactggatacacttgaggaaaaagtagtgagtttgaacataggtttatagaaacttcaaaaaataaaatgcaaagagaaaaaactaaacagaacatctaagaactgtaggataatttcaagatatgtaatgtatttgtaattgtaataccagaaaaagagagagataatgaagcagaaaaaatatgtgaagtaataataggcaaacctttcccaagtgaataacagacaataaacacagattcagaaggctgagatgaataattaacacacacacacacacacacacacacacacacaccacattcaaactgcagaaaaccaaagacaacaaaaaatcttaaagaaatcagagggaaggacagaacaaaacagattaccttacttgtggaggcataagaata

SEQ ID NO: 10547 - DNA, 208 bp, Homo sapiens
  D6S492
  Located on chromosome 6
  Distance between a terminus base of telomere on chromosomal short arm and 5'-terminus of this base sequence : 93958364
  Distance between 3'-terminus of neighbour sequence of sequence listing upward to telomere on chrosomal short arm and 5'-terminus of this base sequence : 93021
ggttctccagagaaacagagccaataaaatacagatagatagatagatagatagatagatagatagatagatagatgatagatagatagatagatagagatacacagaaagatatttacagtcatgtgtgacttaacaataatacattctaagaaatgtgtccttagttgatttcatcattatgcaaacatcactgagtctacttaca

SEQ ID NO: 10548 - DNA, 247 bp, Homo sapiens
  D6S424
  Located on chromosome 6
  Distance between a terminus base of telomere on chromosomal short arm and 5'-terminus of this base sequence : 94065376
  Distance between 3'-terminus of neighbour sequence of sequence listing upward to telomere on chrosomal short arm and 5'-terminus of this base sequence : 106804
agctaatgcatgctgggcttagtaccttggtgatggactgataagtgcagcaatccaccatggcatatgcttacctatgtaagaaacctgcacatcctgtacatgtaacctggaacacacacacacacacacacacacacacaaattaaaaaaaataaaattcatagaacttaagaattaataataaaagaggatacccagtttaaagttaccaagtaaatgacatacactgtcaggatagccaagc

SEQ ID NO: 10549 - DNA, 335 bp, Homo sapiens
  AL049697.9_75605
  Located on chromosome 6
  Distance between a terminus base of telomere on chromosomal short arm and 5'-terminus of this base sequence : 94656358
  Distance between 3'-terminus of neighbour sequence of sequence listing upward to telomere on chrosomal short arm and 5'-terminus of this base sequence : 590735
cctgaactagaatcagtacgctacatagtcttgcaattggggcactccctaggaacaaaacttatgcctaattggctgatgtttaaagtcagctgtggtgtgtgtgtgtgtgtgtgtgtgtgcacgctcatgtaattggcaaacattgttttgaaaaaaatttttaagcatgagttttagaaaatattttgtgcttggaattggaaagtatttttaggctataactagtttattaacttatatatacatatattgtctactaagtaatgtctttgttgcacgtattttccagacaatgtcactttattattcaagttatactgcttggcagtgat

SEQ ID NO: 10550 - DNA, 359 bp, Homo sapiens
  AL049697.9_111716
  Located on chromosome 6
  Distance between a terminus base of telomere on chromosomal short arm and 5'-terminus of this base sequence : 94692472
  Distance between 3'-terminus of neighbour sequence of sequence listing upward to telomere on chrosomal short arm and 5'-terminus of this base sequence : 35779
atcctaattcaacgtctttacaagtaattccttcctattaaaatgtatttagttcctgaattcacacaataagagttacctgtgtgtgtgtgtgtatatatatatatatatatatatatattttttatttattttttttgagacagaatctcgccctgtcgctcaggctggagtgcagtggtgcgatctcggctcactgcaagttccgcctcctgggttcacgccattctcctgccttagcctcccgagtaactgggactacaggccccgccaccacgcctggctactttttttgtatttttagtagatacggggtttcaccgtgttagccaggatggtctcgatctactgatctcgtg

SEQ ID NO: 10551 - DNA, 129 bp, Homo sapiens
  D6S1595
  Located on chromosome 6
  Distance between a terminus base of telomere on chromosomal short arm and 5'-terminus of this base sequence : 94981707
  Distance between 3'-terminus of neighbour sequence of sequence listing upward to telomere on chrosomal short arm and 5'-terminus of this base sequence : 288876
acctctagttttgcctgcttttagacactctcaaatggcttcagatttgtgtgtgtgtgtgtgtgtgtgtgtgtgtgtgtgtgttttccagggtttataattgttactttgggaggattggtgtaatat

SEQ ID NO: 10552 - DNA, 105 bp, Homo sapiens
  G09249
  Located on chromosome 6
  Distance between a terminus base of telomere on chromosomal short arm and 5'-terminus of this base sequence : 95004239
  Distance between 3'-terminus of neighbour sequence of sequence listing upward to telomere on chrosomal short arm and 5'-terminus of this base sequence : 22403
gcaatggaaagacaaattggtacaaaattattttcaccactaccatcatcatcatcatcatcatcatcatcatcaactgtgttatcacatcaagggtcaggttct

SEQ ID NO: 10553 - DNA, 318 bp, Homo sapiens
  AL121942.9_20076
  Located on chromosome 6
  Distance between a terminus base of telomere on chromosomal short arm and 5'-terminus of this base sequence : 95156482
  Distance between 3'-terminus of neighbour sequence of sequence listing upward to telomere on chrosomal short arm and 5'-terminus of this base sequence : 152138
ctttcttgttcctaatggaagaccagagggtgtttgttaattttttaaagaattcacacacacacaaacacacacacacacacacacacacacacacacacactttcttcaaatatttgacacatagaggtctataatgttttaaagttcctatttgttataaaatttgatttaaataatgtttgggtcccttctttcctttttaatatcatccttctaatgatcacccccccaacacacacacacacacacacacacacatgcaaacacacacacgcagaacccttttatttagtatcttcagcaaggatgaattta

SEQ ID NO: 10554 - DNA, 200 bp, Homo sapiens
  AL121942.9_81895
  Located on chromosome 6
  Distance between a terminus base of telomere on chromosomal short arm and 5'-terminus of this base sequence : 95218279
  Distance between 3'-terminus of neighbour sequence of sequence listing upward to telomere on chrosomal short arm and 5'-terminus of this base sequence : 61479
gttatgcatttgcaggttaaaccaatcacaaatcaaaaatatttgaaacaaattaaaaaaagaaacaataaaaaataatacagagagacagagagagagagagagagagagagagagagagagagaaaatgtgtcctggaaccaatgcctcctgaaactaaaggaaaactgtacttctcaactcattctatgaagctagc

SEQ ID NO: 10555 - DNA, 289 bp, Homo sapiens
  AL136096.7_16857
  Located on chromosome 6
  Distance between a terminus base of telomere on chromosomal short arm and 5'-terminus of this base sequence : 95240586
  Distance between 3'-terminus of neighbour sequence of sequence listing upward to telomere on chrosomal short arm and 5'-terminus of this base sequence : 22107
tgtgactctatttggaaataggactttttacagatgtaattagttaagatgaggttgtactagagcagagtgggcctttaatccaatataactggtgccctcataagaagaggaatatttgggcatgcttgtgcgcacacacacacacacacacacacacacaaacacagatggaaagtggggcgcggaatgccaggtgaagacacagagaaacagacatagggagaagacagccatgtgaaaatggagacaaaaattggagttatgctaccagaatccaaggaatttc

SEQ ID NO: 10556 - DNA, 372 bp, Homo sapiens
  chr6.fa.O7frz.96237523
  Located on chromosome 6
  Distance between a terminus base of telomere on chromosomal short arm and 5'-terminus of this base sequence : 95419980
  Distance between 3'-terminus of neighbour sequence of sequence listing upward to telomere on chrosomal short arm and 5'-terminus of this base sequence : 179105
ttggtattacctagaacatttgaggcatgcatgcaccctacaacccagcatttccactcataggtgtaaaccctggaaaaattctcacccatgtgcaccaggttacatgtacaatactgctctttatatcattgattgtaatagaaaaaatgaaaacaattcaaatgcccactgatatatatatgtatcatatatatatcatatatcatatataatatatatatataaaatatataatatatatataatactttaagttctggggtacatgtgcagaacgtgcaggtttgttacataggtatacatgtgccatggtggtttgctgcacccatcaacccatcatctacattaggtacttctcctaaggctatc

SEQ ID NO: 10557 - DNA, 273 bp, Homo sapiens
  Z67582
  Located on chromosome 6
  Distance between a terminus base of telomere on chromosomal short arm and 5'-terminus of this base sequence : 95682411
  Distance between 3'-terminus of neighbour sequence of sequence listing upward to telomere on chrosomal short arm and 5'-terminus of this base sequence : 262059
gagccaagccatatcaactggctatgagagaaacatgcatctgcctgtaatctttctaaaggtcagtatcacacacacacacacacacacacacacacacacacacacacactctacctgatgagtcacaaaatccaccttccctgtgacacagaaacaaatcaattgctcaagagaagcagagttcttctgatactaaaaccagacaagagactatcccttggttcttcattataaaaacactctgggcaccctcagaaacatccttgtgaa

SEQ ID NO: 10558 - DNA, 398 bp, Homo sapiens
  AL133408.7_49080
  Located on chromosome 6
  Distance between a terminus base of telomere on chromosomal short arm and 5'-terminus of this base sequence : 95811581
  Distance between 3'-terminus of neighbour sequence of sequence listing upward to telomere on chrosomal short arm and 5'-terminus of this base sequence : 128897
ggttcacagaaagcctataacttatccaaagcatatgcctctttgggtgcagaactagcaccagggtccagacttgcagcatcccagtccagcacactgactatggagtcatctataagacaatccttcataaacaaaaggtataactttgcagggcaaatgtttacttacagtcatttaagtttgatccagtttatctaatgcaagaaaaacagtttatatagcaaccaactacagacacacagacacacagacacacacacacacacacacacacacacacacacacgtacatttcataaagcaatttatttcctttctttgtgctattttctcttctactttatttcattaaaacaaaaacaaacaaacaaacctgattgagatccacttaatgg

SEQ ID NO: 10559 - DNA, 258 bp, Homo sapiens
  AL133408.7_113137
  Located on chromosome 6
  Distance between a terminus base of telomere on chromosomal short arm and 5'-terminus of this base sequence : 95875871
  Distance between 3'-terminus of neighbour sequence of sequence listing upward to telomere on chrosomal short arm and 5'-terminus of this base sequence : 63892
atgaacagaaatcctgaagtacacacacacacacacacacacacacacacacaaaatgtgtaaagtgcatttgttaaaaggttaaatggaataaatcttttatttcctgtgttgggaaattctgaatcttactttgtttttccctctatttttgtgtaaagagtttctttttttatacttcagacaagtaagaaaattgactatggagttttcctcttcccctgggaaaatgtaagaacattatgttaggaagccgtt

SEQ ID NO: 10560 - DNA, 118 bp, Homo sapiens
  chr6.fa.O7frz.96825999
  Located on chromosome 6
  Distance between a terminus base of telomere on chromosomal short arm and 5'-terminus of this base sequence : 95980743
  Distance between 3'-terminus of neighbour sequence of sequence listing upward to telomere on chrosomal short arm and 5'-terminus of this base sequence : 104614
caagtaaataagtttgaggcatacatgtgtatgtgtatgtatatgtatatctgtgtacacacacacacaaacacacaaacgaacacacacacacagacaaatgaacttactccagtag

SEQ ID NO: 10561 - DNA, 347 bp, Homo sapiens
  AL079342.17_79598
  Located on chromosome 6
  Distance between a terminus base of telomere on chromosomal short arm and 5'-terminus of this base sequence : 96171272
  Distance between 3'-terminus of neighbour sequence of sequence listing upward to telomere on chrosomal short arm and 5'-terminus of this base sequence : 190411
cgagatcatgccactgtacttcagcatgggagacagagcaagactcggtctcaaaacaggaaagaaaggaaagaaaagaaagaaagaaagaaagaaagaaagaaagaaagaaagaaagaaagaaagaaagaaagaaagaaagaaagaaagaaaggagaaagagagagaaagaaagaaagaaagaagaaagagagagagagggagggagagagggagggagggaggaaggaaggaaggaaggagaaagaaagaaaaaagaaaagaaagaaagaaacagaaagcaagcaagctgtagtgacagtattagtcaagtgtgtatcctcaggcctgttatttaattacagtta

SEQ ID NO: 10562 - DNA, 330 bp, Homo sapiens
  AL079342.17_53503
  Located on chromosome 6
  Distance between a terminus base of telomere on chromosomal short arm and 5'-terminus of this base sequence : 96197223
  Distance between 3'-terminus of neighbour sequence of sequence listing upward to telomere on chrosomal short arm and 5'-terminus of this base sequence : 25604
cgccgtttacctacgtaacaaacctgcacatgtacccttgaacctaaaataaaagttacagtaaaacaacgaaaagaaaaattcccattaaaagcctgttttggtttagaaatcatgcttgcttgccttttatattacataatagtaagaggaatattgcccttcagtatcccaaacaaggcaagagagttgtcactggacatttccatggatctacaacttctgctgcaggaagcaataaaacaggccagaacaacagtgcacacacacacacacacacacacacacacacacacaccagaataggagtcaggtagtttgtgcagtagc

SEQ ID NO: 10563 - DNA, 114 bp, Homo sapiens
  D6S1644
  Located on chromosome 6
  Distance between a terminus base of telomere on chromosomal short arm and 5'-terminus of this base sequence : 96197453
  Distance between 3'-terminus of neighbour sequence of sequence listing upward to telomere on chrosomal short arm and 5'-terminus of this base sequence : -100
ggaagcaataaaacaggccagaacaacagtgcacacacacacacacacacacacacacacacacacaccagaataggagtcaggtagtttgtgcagtagctcatcagccaactg

SEQ ID NO: 10564 - DNA, 428 bp, Homo sapiens
  AL121833.10_9601
  Located on chromosome 6
  Distance between a terminus base of telomere on chromosomal short arm and 5'-terminus of this base sequence : 96421717
  Distance between 3'-terminus of neighbour sequence of sequence listing upward to telomere on chrosomal short arm and 5'-terminus of this base sequence : 224150
tgaactatcaatgaagagtcagtaagaatatataacgtgccttgactgctgtttccaaatgccctagtggcttttgtgatcaagagacacaaactcattttggaagcatagctgaatttgtaatggccttcagccatgtactttctccaccaaggggcattaaaatcatgactaccatgatttgatggaaaagggaaggaaggaaggagggaaggaaggaaggaaggaaggaaggaaggcaggcaggcaggcaggcaggcaggcatgctcttcatattgtaaacctttaaattaaaatgcatatcctgtgggaaagtgcagtcctgtctccctctgctggaatcatagtaaaaattgtttaaggcaaccttttcttcatttccaagcctgcctttgattgaaatccataggcttctaggctcaaatac

SEQ ID NO: 10565 - DNA, 460 bp, Homo sapiens
  AL138717.6_9370
  Located on chromosome 6
  Distance between a terminus base of telomere on chromosomal short arm and 5'-terminus of this base sequence : 96519840
  Distance between 3'-terminus of neighbour sequence of sequence listing upward to telomere on chrosomal short arm and 5'-terminus of this base sequence : 97695
ggtactttatggtgtgattacaattaccaaacacaacattcattttgactgatgagaaaacaattttaaagacattgtgtaacccacccatagtgtaatggaaagagcaccagtcagaatctaggcctattggctcttaaacaaatgttctctctgttatacaaaatagaggtaaaagcagcattaatttggtatttatttatttatttatttatttatttatgttttttttttttgagatggagtctcgctctgtcgcccaggctggactgcggactgcagtggcgcaatctcggctcactgcaagctccgcttcccgggttcacgccattctcctgcctcagcctcccgagtagctgggactacaggcgcccgccaccgcgcccggctaattttttgtatttttagtagagacggggtttcaccttgttagccaggatggtctcgatctcctgacctc

SEQ ID NO: 10566 - DNA, 316 bp, Homo sapiens
  AL138717.6_44928
  Located on chromosome 6
  Distance between a terminus base of telomere on chromosomal short arm and 5'-terminus of this base sequence : 96555502
  Distance between 3'-terminus of neighbour sequence of sequence listing upward to telomere on chrosomal short arm and 5'-terminus of this base sequence : 35202
agagtctaccaggtaaaggcacgttatgagcctaatgatatttcatcctcaatacaatcttgtaagtatcactttccatgtgtgtgtggtgtgtgtgtgtgtgtgtgtgtgtgtgtgtgtgtgtgtctaacagttaacagagagaatccgagctgagtgggcaaaggatttttaagcaatggaagagaaaaatggagactagactctcacaaaagctgaaaggcagagcgtcaagctgtgtaaggcaggtcacaggcagtgagtaaagaggaagatgagcaaaagctttacctcatcgattagatgaggatgtcag

SEQ ID NO: 10567 - DNA, 295 bp, Homo sapiens
  AL138717.6_96733
  Located on chromosome 6
  Distance between a terminus base of telomere on chromosomal short arm and 5'-terminus of this base sequence : 96607227
  Distance between 3'-terminus of neighbour sequence of sequence listing upward to telomere on chrosomal short arm and 5'-terminus of this base sequence : 51409
agaacagattagtggttgtcagagattagggatggtgtcggggagggggttgggtgtaactataattaagtagcatgaggatgattctttgtggtgatggcatagttctgtattttgatagaatggtggttatatgaaactacatatgtgataaaattgcacagagctacacacacacacacacacacacacacacacacattgtaccaatgacttaatatcataaagatgccaattttttccaaatagcagtagtaggaaacattcttgcttctattacatgaaggctgcagac

SEQ ID NO: 10568 - DNA, 351 bp, Homo sapiens
  chr6.fa.O7frz.97637842
  Located on chromosome 6
  Distance between a terminus base of telomere on chromosomal short arm and 5'-terminus of this base sequence : 96712783
  Distance between 3'-terminus of neighbour sequence of sequence listing upward to telomere on chrosomal short arm and 5'-terminus of this base sequence : 105261
agtctggtatttgacctggtaccctcttcactctgtagtcttctctggaccatcttcagtacttttttcctctgccccagtaaatgggagcaagagagcaaggttgctggctagcagatacccagttgagaagcagaatgctgctctctgcttactgaaggtactcctgatctttacaggtgctcctttgcctccagccatcacgaatgagagagagagagagagagaaaatgagtgtgtgtgtgtgtgtgtgtgtgtgtgtgtgtgtgtgtgtgaatgaatgcttctccatgaccagtgtactcccctgagagcaaccctctctgcctgtcttccacttacagtgactga

SEQ ID NO: 10569 - DNA, 157 bp, Homo sapiens
  AL096678.8_118471
  Located on chromosome 6
  Distance between a terminus base of telomere on chromosomal short arm and 5'-terminus of this base sequence : 96905071
  Distance between 3'-terminus of neighbour sequence of sequence listing upward to telomere on chrosomal short arm and 5'-terminus of this base sequence : 191937
actgtacctggtccaattctattattctttatttcccatgtatgttagagattttgtctggtattttatacacacacacacacacacacacacacacacacacacacgtatatatacacacatatattaataatctttaaactgaataaatgctcaa

SEQ ID NO: 10570 - DNA, 268 bp, Homo sapiens
  AL096678.8_127232
  Located on chromosome 6
  Distance between a terminus base of telomere on chromosomal short arm and 5'-terminus of this base sequence : 96913740
  Distance between 3'-terminus of neighbour sequence of sequence listing upward to telomere on chrosomal short arm and 5'-terminus of this base sequence : 8512
agttccagctacttggctacttgggagggtgaggtgggagaatggtttgagcctgggaggcagaagttgcagtgagtcaatattgtgccactgtactccagcctggatgacagagccagacattgtctcaaaggaagaagaaaaaaaaaaaaaaaaaaacaagagagagagagagagagagagagaactccctgatggagggactgtggcatgcaggcacattcactacattgctggcagtgttgtaaatgataccatctttctggag

SEQ ID NO: 10571 - DNA, 119 bp, Homo sapiens
  D6S1613
  Located on chromosome 6
  Distance between a terminus base of telomere on chromosomal short arm and 5'-terminus of this base sequence : 97065160
  Distance between 3'-terminus of neighbour sequence of sequence listing upward to telomere on chrosomal short arm and 5'-terminus of this base sequence : 151152
aggaagactccacctcatttaaaaaaaaaatacatacatacacacacacacacacacacacacacacacacacacacacacacacacacacacacacacatttgctgtaggtgttacct

SEQ ID NO: 10572 - DNA, 218 bp, Homo sapiens
  AL117342_26057
  Located on chromosome 6
  Distance between a terminus base of telomere on chromosomal short arm and 5'-terminus of this base sequence : 97281909
  Distance between 3'-terminus of neighbour sequence of sequence listing upward to telomere on chrosomal short arm and 5'-terminus of this base sequence : 216630
gaatcacttgaaccgaggaggcagaggttacagtgagccgagattgcgccattgcactctggcctgggcaacaagagcgaaactccatttcaaataataataataataataataataataataataataataataataataaaaataaaaggaccttccattcagttaggacttcttatgggcttttatgtagacacctctgctaacctacttcttct

SEQ ID NO: 10573 - DNA, 295 bp, Homo sapiens
  AL117342.12_26272
  Located on chromosome 6
  Distance between a terminus base of telomere on chromosomal short arm and 5'-terminus of this base sequence : 97282056
  Distance between 3'-terminus of neighbour sequence of sequence listing upward to telomere on chrosomal short arm and 5'-terminus of this base sequence : -71
aaaggaccttccattcagttaggacttcttatgggcttttatgtagacacctctgctaacctacttcttctttccaactcagggctgactcctaatatacaatactttgaggggcagtggtagttaccttgcacaaaaactgctaaatttgacacaatacatatatatatatatatatatatattttttttttttttttttttttaccagactatattttgcttcaggttcaaaaactgatttctagccagcattcagagacctactttgcatcttgatccatgagtcactgatt

SEQ ID NO: 10574 - DNA, 375 bp, Homo sapiens
  AL117342.12_61319
  Located on chromosome 6
  Distance between a terminus base of telomere on chromosomal short arm and 5'-terminus of this base sequence : 97316992
  Distance between 3'-terminus of neighbour sequence of sequence listing upward to telomere on chrosomal short arm and 5'-terminus of this base sequence : 34641
tccaagacaattctaaaccaagaaggaggactcgatgcccagacttctaataagattcggctgctgtcttgcaaagccaggcagtgtgggacagctggatgaagtgagtgggactaggcttagattgactctgtgtgatcagagcaagtgatttcacctctttgggactctgggtttgcaacaataaaacataagaagtggtgacagcgatgacttcgcagattctcccagccctaatactctatgagatcatgactattctaatcataaaacacacacacacacacacacacacacacacacacacagtctctctctctctccctctctgatatgttttctcataaccaaaggctcattctagatttaatcaaa

SEQ ID NO: 10575 - DNA, 384 bp, Homo sapiens
  AL121941.14_25253
  Located on chromosome 6
  Distance between a terminus base of telomere on chromosomal short arm and 5'-terminus of this base sequence : 97389450
  Distance between 3'-terminus of neighbour sequence of sequence listing upward to telomere on chrosomal short arm and 5'-terminus of this base sequence : 72083
tcaagacgctatggaaataaagcatgtgaaagaccagaaataaaaaataaacacaacacacaccccaaaacaacacacacacacacacacacacacacacacacacacacgcacatgcacacaccaagaccaccatttaacagaaaacgcctcagagaacagatgacaattttagaaactgggtcagttcacttctggacagcaaccaaaaagactggccttgttctatcaagtactttccatctcctttgaaatcgagggaacctggttgttttgcagccaattcagtttatgaagaagcttagcaaaatctacagcttaaaaaaggagactgcatcttaaatataaagcattagggaaaaagatacctgagttaccatggtg

SEQ ID NO: 10576 - DNA, 312 bp, Homo sapiens
  AL121941.14_23971
  Located on chromosome 6
  Distance between a terminus base of telomere on chromosomal short arm and 5'-terminus of this base sequence : 97390654
  Distance between 3'-terminus of neighbour sequence of sequence listing upward to telomere on chrosomal short arm and 5'-terminus of this base sequence : 820
tatttaccatcaacctccatctaccatggagagaagcctattttacctggatcactgttaatgtggtatagaggtatgctgagaataacataagccacctttaatcctatgctctttaaagagaagcttaaaagtgtcaagggctgtgtgtgtgtgtgtgtgtgtgtgtgtgtgtgtgtgtgtgtgtgctctcctgacccttgaaaatgcaactaatactgccaaatactgaatggaatatggtgagttgggcttttctccccactccaactcccacccccttctatgatgtccattctagaagccttcagt

SEQ ID NO: 10577 - DNA, 285 bp, Homo sapiens
  D6S462
  Located on chromosome 6
  Distance between a terminus base of telomere on chromosomal short arm and 5'-terminus of this base sequence : 97398081
  Distance between 3'-terminus of neighbour sequence of sequence listing upward to telomere on chrosomal short arm and 5'-terminus of this base sequence : 7115
actggagttgggggacatggcctgggctgtgaatttcggtttcctttccgtgtgtgtgtgtgtgtgtgtgtgtgtgtgtgtgtgtgacacagagagtgagagtgcacgcaagagagattgagagagtgagagaaccagtctagtattaaaaggttctcagaaaacagtagacttcagtggagtgaaggcttgtaaaaaaaagaaaaaaaattgttgtttccactacaaaattatccttctccccacctccaacaccagacattttcagcctccctatgatgtcac

SEQ ID NO: 10578 - DNA, 326 bp, Homo sapiens
  AL121941.14_15788
  Located on chromosome 6
  Distance between a terminus base of telomere on chromosomal short arm and 5'-terminus of this base sequence : 97398791
  Distance between 3'-terminus of neighbour sequence of sequence listing upward to telomere on chrosomal short arm and 5'-terminus of this base sequence : 425
tgcacagctgtattgtaaacacgccagagggccatttaccatccgcggaatctgtacaagtcgggctctaccccttcctcatctactgagtgctgacacttgatccagcatgttaaaaacaggtacattcttgagagatccaggggttgctgtggtgcccttcatactcacttcatattctgggagtggggctttaaaacacatacacacacacacacacacacacacacacacgctcccgaagtttgcctctgcattcaatctgcctgacgtcagtctcacacaggatgacataccaccactgcaaataaccaacttaactacag

SEQ ID NO: 10579 - DNA, 224 bp, Homo sapiens
  AL132996.4_54979
  Located on chromosome 6
  Distance between a terminus base of telomere on chromosomal short arm and 5'-terminus of this base sequence : 97521702
  Distance between 3'-terminus of neighbour sequence of sequence listing upward to telomere on chrosomal short arm and 5'-terminus of this base sequence : 122585
gcactccatcctgaatgagaaagtgagactccttctcaaaacaaatgaacaacaacaaaaaataaaaataaaaaaagttcattaactggtttgtttttgctctcatgcaaacatgaggtttggaagggcagaggggtgtgtgtgtgtgagagagagagcgagaaagagagagagagagagagagagagagagagagatgtgttaccataggaagattctccaat

SEQ ID NO: 10580 - DNA, 191 bp, Homo sapiens
  AL132996.4_37802
  Located on chromosome 6
  Distance between a terminus base of telomere on chromosomal short arm and 5'-terminus of this base sequence : 97538921
  Distance between 3'-terminus of neighbour sequence of sequence listing upward to telomere on chrosomal short arm and 5'-terminus of this base sequence : 16995
ataacagtcctgacttgctgagcttccattacacaaggcagtcaatgatgatgcctactctcttcagccttcttcccatttcagcagagacacagggacaactaagccaacctgggggagggtggtgtgtgtgtgtgtgtgtgtgtgtgtgtgtgcgcgcgcgcacgcaatgctggatctttagaactgag

SEQ ID NO: 10581 - DNA, 135 bp, Homo sapiens
  D6S1570
  Located on chromosome 6
  Distance between a terminus base of telomere on chromosomal short arm and 5'-terminus of this base sequence : 97663472
  Distance between 3'-terminus of neighbour sequence of sequence listing upward to telomere on chrosomal short arm and 5'-terminus of this base sequence : 124360
gccattcagtaaagtctcccggaaccatacccactctgacgctttctcattacggagacagaatcacacacacagacacacacacacacacacacacacacacacaggccatgacatgatgttttccaccccaga

SEQ ID NO: 10582 - DNA, 421 bp, Homo sapiens
  chr6.fa.O7frz.98843529
  Located on chromosome 6
  Distance between a terminus base of telomere on chromosomal short arm and 5'-terminus of this base sequence : 97755338
  Distance between 3'-terminus of neighbour sequence of sequence listing upward to telomere on chrosomal short arm and 5'-terminus of this base sequence : 91731
agaggttacgaatctgacatttggatgacacaaggcaccaatcccagcactttgggaggctgaggcaggcggatcacgaggtcaggagattgagaccatcctggctaacacggtgaaaccccatctctactaaaaatacaaaaaattaacggggcgtggtggcaggcacctgtaatcccagctactggggaggctgaggcaggagaatggcgtgaacctgagaggccgaggttgcagtgagccgagatcgcgccactgaactccagcctgggcaacagagctagactctgtcacacacacacacacacacacacacacacacacacacacacacacacacacagaagaaacaactaatataaagctttgccctaagggaaaagaaaaacctcactaccttatttactccaatatgtgagcc

SEQ ID NO: 10583 - DNA, 191 bp, Homo sapiens
  AL135918.6_31932
  Located on chromosome 6
  Distance between a terminus base of telomere on chromosomal short arm and 5'-terminus of this base sequence : 97883042
  Distance between 3'-terminus of neighbour sequence of sequence listing upward to telomere on chrosomal short arm and 5'-terminus of this base sequence : 127283
tccttgactacaaaccagaattaaaaaacgagagaaaaaaagtgagaaaaaggcaactattcttgttgcagaagtactattgaaattagcacagtgtacaatttctggcagaaatgagagaagaatgggggatagagtgtgtgtgtgtgtgtgtgtgtgtgtgtgtgtgtagacttcaatagacctcaaga

SEQ ID NO: 10584 - DNA, 326 bp, Homo sapiens
  chr6.fa.O7frz.99159055
  Located on chromosome 6
  Distance between a terminus base of telomere on chromosomal short arm and 5'-terminus of this base sequence : 98071024
  Distance between 3'-terminus of neighbour sequence of sequence listing upward to telomere on chrosomal short arm and 5'-terminus of this base sequence : 187791
gaggtaagactgttcctttctaagaattaactttactcacaatcattacatccaaccataatgcataagaagaaaaaaggtaacacacacacacacacacacacacacacacacacacaaaacataaacagtaaaagagcaccacagctctgaacttccctgagacagaaaatgtcatatattaatgcaaaataaaatgcagtcccttgctttttattttcctttctgaggtggtagcatttgctagataatgatattttgtgtttctgagtccaaacgtgcttcattttccatgatattttgagtgcataccaacagctaaataa

SEQ ID NO: 10585 - DNA, 442 bp, Homo sapiens
  chr6.fa.O7frz.99292829
  Located on chromosome 6
  Distance between a terminus base of telomere on chromosomal short arm and 5'-terminus of this base sequence : 98204270
  Distance between 3'-terminus of neighbour sequence of sequence listing upward to telomere on chrosomal short arm and 5'-terminus of this base sequence : 132920
ggtaagatcacaatgaatcaatagtaaagaaatatgagaaaattaaaaaaaatatatatatgtatatattctgcataaaagcacatgccctttggcctgatgtggatgatggtcatgttgtacttgtaattagggagaaaagcagattataaaacactgtgcatattatgaccttatttcagttaaaacatagtagtacatataattgtgtaaaaatatattgaattattaactcaagggagatctataatttcactttgcctatacctgactaaggattgcgtgtttgtgtgtatgtgtgtgtgtgtgtgtgtgtgtgtgtgtggtggatttatatggaaatctgtataccaaaataagttcgcttggagtggcaggattttaggtgattcgtgtgtatacattgttttatttctcaaactttgaacagtgagcaagtatt

SEQ ID NO: 10586 - DNA, 351 bp, Homo sapiens
  chr6.fa.O7frz.99380881
  Located on chromosome 6
  Distance between a terminus base of telomere on chromosomal short arm and 5'-terminus of this base sequence : 98299856
  Distance between 3'-terminus of neighbour sequence of sequence listing upward to telomere on chrosomal short arm and 5'-terminus of this base sequence : 95144
tatttctgagagtgattggtctactaaaatatctaagttggttctacctttactgattagtcaatatattagcattttggctggagttcaggaggcaaagctgctctgtgtgtgtgtgtgtgtgtgtgtgtgtgtgcaagagagagagagagagacagagagagagagatggagacatagagagatggggagagagagtgaggggagaaagaaagaaaatgagtgtgtgtgtgtgtgtgtgtgtgcacgcgcgcacaagcgcatgcatttgggaatgaagttaaggctgagaaggagttaatggctgacaacagcaataattgccctgtgtttaattcaggtagcctgttt

SEQ ID NO: 10587 - DNA, 231 bp, Homo sapiens
  D6S450
  Located on chromosome 6
  Distance between a terminus base of telomere on chromosomal short arm and 5'-terminus of this base sequence : 98490639
  Distance between 3'-terminus of neighbour sequence of sequence listing upward to telomere on chrosomal short arm and 5'-terminus of this base sequence : 190432
ggaaatgaagcacaacaatgtaatatttccttctaatatcagtctttcaattcccctattgaatctctaacactatatttcataatcaggtcagtgatgactatacatcaacacatgttttcctctgtgtgtgtgtgtgtgtgtgtgtgtgtaaaacttctcattgccctgaaatgccaaaacccttcacactagcccataaaagtaaccaaaataaacgggtgaatgtgt

SEQ ID NO: 10588 - DNA, 284 bp, Homo sapiens
  AL080284.20_110631
  Located on chromosome 6
  Distance between a terminus base of telomere on chromosomal short arm and 5'-terminus of this base sequence : 98505271
  Distance between 3'-terminus of neighbour sequence of sequence listing upward to telomere on chrosomal short arm and 5'-terminus of this base sequence : 14401
atactgcactcatagacctcgtgtgtgtgtgtgtgtgtgtgtgtgcaaatatacacgtgtgctcatgcatgttttgtctatgtttttatttaaagcaggcaatattgagtccaatgcgtttacaaatatcaagtaataataataaataagcttagttagtaaagtctaattcttttgcagcatcatgtttttcctctagtaaggacaacaatgaatgtttgtgttactttaaaatgtgttcatttttatctgattctaaaagcttttctagtgacataagcatt

SEQ ID NO: 10589 - DNA, 172 bp, Homo sapiens
  D6S1631
  Located on chromosome 6
  Distance between a terminus base of telomere on chromosomal short arm and 5'-terminus of this base sequence : 98509513
  Distance between 3'-terminus of neighbour sequence of sequence listing upward to telomere on chrosomal short arm and 5'-terminus of this base sequence : 3958
gtgccacactgcctctaaccaatatcattctatttttgaaagggatagcaaatggttacataaataataaagatggatatactctgtgtgtgtgtgtgtgtgtgtgtgtgtgtgtgtgtgtgtgtaattttcccagtatgattcctctgtaggtaaatgttctcaagccaaa

SEQ ID NO: 10590 - DNA, 325 bp, Homo sapiens
  AL080284.20_80870
  Located on chromosome 6
  Distance between a terminus base of telomere on chromosomal short arm and 5'-terminus of this base sequence : 98534803
  Distance between 3'-terminus of neighbour sequence of sequence listing upward to telomere on chrosomal short arm and 5'-terminus of this base sequence : 25118
ggaaacgagttactccacaatctgctgtggaatgcctttattttggctgtggtgacctttaggaagtcccagaaagtctttatttataaggttggtgcaaaagtaattgttacctgcccaaatgctcatcaatcaacaagtggataaactgtcatatatatatacatatatatatatatatatatgtatacacacacacacacacacatacatatatatatatatgtatacacacacacacacatacatatatatatatatatatatatatataatggaatactactcagccataaaaaggaatgtattaatggcattcacagca

SEQ ID NO: 10591 - DNA, 294 bp, Homo sapiens
  AL080284.20_46243
  Located on chromosome 6
  Distance between a terminus base of telomere on chromosomal short arm and 5'-terminus of this base sequence : 98569455
  Distance between 3'-terminus of neighbour sequence of sequence listing upward to telomere on chrosomal short arm and 5'-terminus of this base sequence : 34327
cagtttgtcataaggttaaatcacaaaagacttcctagattaggttttcagattctttttcctttagaaagattaaaaaaaaaaagaaatatgggctaaaagctaatttatttctttttctattttcccctcagtgcaagatgtaacgttcagaaaacatgttgagcatgttgaagcattacaaagatcagtctttggttgttgaattaaaaaaaagaaagaaagaaagaaagaaagaaagaaagaaaggcagggaccaaagtccccatggtagtgaggttcttgagataacaa

SEQ ID NO: 10592 - DNA, 391 bp, Homo sapiens
  AL080284.20_821
  Located on chromosome 6
  Distance between a terminus base of telomere on chromosomal short arm and 5'-terminus of this base sequence : 98614972
  Distance between 3'-terminus of neighbour sequence of sequence listing upward to telomere on chrosomal short arm and 5'-terminus of this base sequence : 45223
atgcagtggtatgatcacagttcgctgcaacctctgctttccgggttcgctatttttgtgtctcagcctcctgagtagctgggactacaggtgcgccccacccctggctattgtgtgtgtgtgtgtgtgtgtgtgtgtgtgtgtgtgtgtgtgtacttttagtagagacggggttttgtcatgttgtccaggctggtctcgaactcctggcctcaagtaatccgcctgtatcagcctgccaaagtgctgggattacaagcatgaaccaccacacccagcatggagggacgttttctttttttttctttttttttttaaactagtttaattttattttaagttctgggatacatatgcagtacagtgcaggcttgttaacataggtaaacat

SEQ ID NO: 10593 - DNA, 387 bp, Homo sapiens
  AL132766.13_76505
  Located on chromosome 6
  Distance between a terminus base of telomere on chromosomal short arm and 5'-terminus of this base sequence : 98867111
  Distance between 3'-terminus of neighbour sequence of sequence listing upward to telomere on chrosomal short arm and 5'-terminus of this base sequence : 251748
atgttatgtgacaagtccagagaaatagattggattcaggcagtgttctgtgtgaaaccttacttcttagatctgctagtatgagtttcagaattttgactgcaaatgcaattttggtcctcttggttcacattcatacacttaatagtccctgaagctttcctccttccctctcttcatacctccttccttccttcctctctgccttccttccttccttccttccttccttccctccctccctcccttccttccctccctccctccctccttccctccctctcttccttcctttcttgctttcttccttccatccatcattcctttgctttctaacttcttcccttcgccctccttgctttctacttatgactttatgaatgcaaa

SEQ ID NO: 10594 - DNA, 170 bp, Homo sapiens
  AL132766.13_8021
  Located on chromosome 6
  Distance between a terminus base of telomere on chromosomal short arm and 5'-terminus of this base sequence : 98935681
  Distance between 3'-terminus of neighbour sequence of sequence listing upward to telomere on chrosomal short arm and 5'-terminus of this base sequence : 68183
gtgtccttagattccattagtgactcatgacaagagaaaccaattttgggtaacaagagcaggaaatagagatgtccggctcgactacatctttttaattatagaaatgagcacgtgtgtgtgtgtgtgtgtgtgtgtgtgtgtgtgttatgcttaacaatcagcctatt

SEQ ID NO: 10595 - DNA, 224 bp, Homo sapiens
  D6S458
  Located on chromosome 6
  Distance between a terminus base of telomere on chromosomal short arm and 5'-terminus of this base sequence : 99038330
  Distance between 3'-terminus of neighbour sequence of sequence listing upward to telomere on chrosomal short arm and 5'-terminus of this base sequence : 102479
ggattgcttgagcctgggaagtggaggctgcagtgagccatgattgcaccaccacacacacacacacacacacaattctgtgaaatctaataaatggttatttttctagtagttttcatcctgaaaattgttttaactggttaactcttaaaaatatgtttatagccatacttagacaaaacactccataaacacatatttgttaaacataaacccaatgactc

SEQ ID NO: 10596 - DNA, 139 bp, Homo sapiens
  D6S444
  Located on chromosome 6
  Distance between a terminus base of telomere on chromosomal short arm and 5'-terminus of this base sequence : 99119593
  Distance between 3'-terminus of neighbour sequence of sequence listing upward to telomere on chrosomal short arm and 5'-terminus of this base sequence : 81039
ctttgtcttctatttctcaatgctgaaatgtgtgtgtgtgtgtgtgtgtgtgtgtgtttgtatgtatgtgagacagtgtgtgtgtatgaaaactatagccaattaggttgtttggcaatagacactatgccttgggtga

SEQ ID NO: 10597 - DNA, 253 bp, Homo sapiens
  D6S417
  Located on chromosome 6
  Distance between a terminus base of telomere on chromosomal short arm and 5'-terminus of this base sequence : 99123213
  Distance between 3'-terminus of neighbour sequence of sequence listing upward to telomere on chrosomal short arm and 5'-terminus of this base sequence : 3481
agagaattgcttgagcccaggagatcaaggctgcagtgagccatgaccatgccactgtactccagcctgggtgacagagtgagaacctgtcacacacacacacacacacacacacacacacacacacacacacacacacaaatattactaccaccaacaaattaaacaatcaaaatacaaaatacgtgaggccaaaactgatagaaacatgttgataggttgatctactattacagttggagacttcaacacc

SEQ ID NO: 10598 - DNA, 359 bp, Homo sapiens
  chr6.fa.O7frz.100273596
  Located on chromosome 6
  Distance between a terminus base of telomere on chromosomal short arm and 5'-terminus of this base sequence : 99247229
  Distance between 3'-terminus of neighbour sequence of sequence listing upward to telomere on chrosomal short arm and 5'-terminus of this base sequence : 123763
ctacagaatggttcatacctttagataaaaagcaaatgtgtgtgtgtgtatatatatatatatatatatatatatatatatatatatgtaacatttttctctagctactgaggtgtttattaaaggttttaatttcatttaaaaattacttttttcttactattaaaatgattatgttttctattattcaactaagatgctatccctaacttcctctattttttttaccttacaccccactctcccaccctcagctataaaatgcatatatataagcagtgaaaaacttctgactacctataacattcagaagatattagtcaaataatatttagtgttgcaaaccatattactagagg

SEQ ID NO: 10599 - DNA, 279 bp, Homo sapiens
  chr6.fa.O7frz.100386824
  Located on chromosome 6
  Distance between a terminus base of telomere on chromosomal short arm and 5'-terminus of this base sequence : 99473028
  Distance between 3'-terminus of neighbour sequence of sequence listing upward to telomere on chrosomal short arm and 5'-terminus of this base sequence : 225440
tcatttcttaatagcactcaaatagggtgtatgttcttaggtgcatatatggaatatgcatagatttatatatatatacacatacagatttttatatatatatacatatatatttatatatacacatacaaaatatatccgtaacttgtacccataaatttgtaagttagctgtggctcttgatccaaaatttgactctaatgaatctgttactagaaatgcacatttcatgaacattgcagattgcatattctaacagatttgactagttaggtcaac

SEQ ID NO: 10600 - DNA, 207 bp, Homo sapiens
  D6S275
  Located on chromosome 6
  Distance between a terminus base of telomere on chromosomal short arm and 5'-terminus of this base sequence : 99534105
  Distance between 3'-terminus of neighbour sequence of sequence listing upward to telomere on chrosomal short arm and 5'-terminus of this base sequence : 60798
taatttcacatacaggccctatatgttatatatatatatacacacacacacacacacacacacacatatataaaacattgttattaatataagttagatttgcctagtgttttaataacactcacaaatacttcaaggtgatttttttcccaatagaatctagaatgtatgtagtatttagtagcatatccttagagcgtgttcatt

SEQ ID NO: 10601 - DNA, 248 bp, Homo sapiens
  chr6.fa.O7frz.100748755
  Located on chromosome 6
  Distance between a terminus base of telomere on chromosomal short arm and 5'-terminus of this base sequence : 99697005
  Distance between 3'-terminus of neighbour sequence of sequence listing upward to telomere on chrosomal short arm and 5'-terminus of this base sequence : 162693
ctccatttctatgagtttgactacttttgacacgtcatgttaagtgaaatcatgcagtatttgtcctgtgactggcttctttcacttagcgtaatatacttactattcatccatattgttccatatgccagaatgtccttctttttgaaagctgagtatttcgagtatttcattgtgtgtgtatatatatatatatatatatatatatatatacatgccacattttctttatccattaattcctcagg

SEQ ID NO: 10602 - DNA, 346 bp, Homo sapiens
  chr6.fa.O7frz.101135637
  Located on chromosome 6
  Distance between a terminus base of telomere on chromosomal short arm and 5'-terminus of this base sequence : 100092434
  Distance between 3'-terminus of neighbour sequence of sequence listing upward to telomere on chrosomal short arm and 5'-terminus of this base sequence : 395181
atttattgtatcctgcaactttactaaatttgtttattattttaaacattttttgttgagtctttagaattttcccttccttccttcctttcttccttccgttctttcctttctttctttctttcctccttccttccttccttccttccttccttccttccctccctccctccctccttcccttctttcttttctttctttctttctttctttctttctttctttctttctttctttctttctttctttctttctctctctctctctcttcttttcttttttgttttttggtaacagggtcttaatctgtcacccaggctggagtgtagtggagcaatcagaactc

SEQ ID NO: 10603 - DNA, 406 bp, Homo sapiens
  AC023873.2_136575
  Located on chromosome 6
  Distance between a terminus base of telomere on chromosomal short arm and 5'-terminus of this base sequence : 100427453
  Distance between 3'-terminus of neighbour sequence of sequence listing upward to telomere on chrosomal short arm and 5'-terminus of this base sequence : 334673
ttactatttcaactaacggcacatccagtcccagtcagaaagctgaaaactgtcccaggttctttcattctccctctctctctttttaaaaacaaacaaacaaacaaacaaacaacaacaacaaaaaacggagtcttgctctgtaactaggctctgtcatccaggagtgcagtggcacgatcacagctcactgcagccttgaactccagggcctcacatcctgatcctcctgcctcacatcctcttatatacacaattagtcaccactttctgatgattttctacttcccaaatacaatatatgctcaaatactagaaaaagtatttttccatatctgtatctacatttatatatctttctctatatatacatatccctgaagtgatggagtgattatctcatagt

SEQ ID NO: 10604 - DNA, 246 bp, Homo sapiens
  D6S1056
  Located on chromosome 6
  Distance between a terminus base of telomere on chromosomal short arm and 5'-terminus of this base sequence : 100566668
  Distance between 3'-terminus of neighbour sequence of sequence listing upward to telomere on chrosomal short arm and 5'-terminus of this base sequence : 138809
acaagaacagcatggggtaatcacctccatgatctaatcaacttgcatgaggtccctcccccaataccggtggattacaattcaagatgagatttggtgtaggacataaagccagaccatcttagatagatagacagatagatagatagatagatagatagatagatagatagatagatagatagatagaatagatagatagacacagagacatacacatgtacatatagcaattcatgatccagg

SEQ ID NO: 10605 - DNA, 420 bp, Homo sapiens
  chr6.fa.O7frz.101740757
  Located on chromosome 6
  Distance between a terminus base of telomere on chromosomal short arm and 5'-terminus of this base sequence : 100679811
  Distance between 3'-terminus of neighbour sequence of sequence listing upward to telomere on chrosomal short arm and 5'-terminus of this base sequence : 112897
aatcttaaccagaatcctgaagagtattgtttaagagaaattgataagctgattgaagaataaatatgggaatgcaaaggactaaatgttgaaaagaaattacaaaattggaaaacctaaattattagttatcaaaactcaagctctattacaaagctttatttgaaatataattgatatacagtaaaccccacatttaatatatacaatttgatgcatttgcacatatgcatgcactcataaaatgtcataataattaaggtaatagacatgtctatcacctccagaaatttcttgtatctctgtgtgtgtgtgtttatgtgtgtgtgtgataagaacactcaacatgggatttactctcaacaaatttttaagttcataaaacagtattgttgactatagatactatgccttgaagca

SEQ ID NO: 10606 - DNA, 464 bp, Homo sapiens
  chr6.fa.O7frz.101825639
  Located on chromosome 6
  Distance between a terminus base of telomere on chromosomal short arm and 5'-terminus of this base sequence : 100757593
  Distance between 3'-terminus of neighbour sequence of sequence listing upward to telomere on chrosomal short arm and 5'-terminus of this base sequence : 77362
ttgtttcagtagctttacaggtgcaggtagtttttggttacacgaatgaattgtatagtggtgaagtctgggattttagtgtacctagtgtgcctgtcacctgaatagtatacattgtactcaataggcagtttttcattctttactccacttccaccctcccgcttctgagtgctcaatgctctttgtatcactctgtgtgcctttgtgtacccatagcttagatcccacttataaattagagcatatagtatttggctttctgttactgagttatttcacttagaataatggcctccagttccatctgagttgctgctaaagacattatatcattatttttttatggatgagtagtatttcattatatatatattatatatatatatacacacacacacacacacacacaaacacacacacacatatacactacattttctttatctactcaatggctgatg

SEQ ID NO: 10607 - DNA, 419 bp, Homo sapiens
  chr6.fa.O7frz.102042753
  Located on chromosome 6
  Distance between a terminus base of telomere on chromosomal short arm and 5'-terminus of this base sequence : 100930793
  Distance between 3'-terminus of neighbour sequence of sequence listing upward to telomere on chrosomal short arm and 5'-terminus of this base sequence : 172736
gaattcagctacatgttatggaaaatctgactcagactgctccaacaacagagaatttgttggctcatcaatggaagtcgaaagatagggtacatttcagggacagtttatagtttatttcagtgtcctggcctatgtgtgcttgtttctgtgtgtgtgtgtgtgtgtgtgtgtgtgtgtgtgtaatcttaattgtgcatgttggtttaaacttcaggcagcattcctcaaggtggctccagttttcacatttcacacactacagcatgcagaggaagagagaatgctttgtcttaacattccaagaaaactctgagattcctcacgattggaatgtttacaacatatgtctgcctctatgctgctcatgagtatagaatatactgattaacttaagtcaaatattgcctatcttagga

SEQ ID NO: 10608 - DNA, 285 bp, Homo sapiens
  chr6.fa.O7frz.102120318
  Located on chromosome 6
  Distance between a terminus base of telomere on chromosomal short arm and 5'-terminus of this base sequence : 101008285
  Distance between 3'-terminus of neighbour sequence of sequence listing upward to telomere on chrosomal short arm and 5'-terminus of this base sequence : 77073
tttctgcatctattgaggtaactatgttttttttttttgtctttagttctgtttatgtgatgaatcacatttactgattacatatattgaaccaaccttggatcccagaggtgaagtctacttgtttgtggtggataagctttgagatgtgccactagatgcaatttgttgaggaatttttcactgatgttcatcaaggatattggcctgaagttttcttttgtgtgtgtgtgtgtgtgtgtgtgtgtctgccaggttttggtatcaggatacttgccttataca

SEQ ID NO: 10609 - DNA, 118 bp, Homo sapiens
  DISD22_0001258
  Located on chromosome 6
  Distance between a terminus base of telomere on chromosomal short arm and 5'-terminus of this base sequence : 101119486
  Distance between 3'-terminus of neighbour sequence of sequence listing upward to telomere on chrosomal short arm and 5'-terminus of this base sequence : 110916
ttgatcatcttaatgcataaagggcacaaataggaaagcctaataaataatgcattatgtgtgtgtgtgtgtgtgtgtgtgtgtgtgtgtgtatcctgctaccgtagagtcataccca

SEQ ID NO: 10610 - DNA, 303 bp, Homo sapiens
  chr6.fa.O7frz.103531070
  Located on chromosome 6
  Distance between a terminus base of telomere on chromosomal short arm and 5'-terminus of this base sequence : 101218697
  Distance between 3'-terminus of neighbour sequence of sequence listing upward to telomere on chrosomal short arm and 5'-terminus of this base sequence : 99093
aataaacatgattcaaagttgaacatatggtatattcaggaaataatattttaaaatattccaaacttatgatttctaggaaatgaagaaagaaaaattgaatctagatttgatcataaaacgtgtgtatctttctatagatattctctccatttctctctctctctctctctcacacacacacacacacacacacacacacacacacacacacaaacacacacacacattcttactggaaggacccagggcttcttggagaaaagcctgtaccaccagcacttcaagatgaaatggacaata

SEQ ID NO: 10611 - DNA, 229 bp, Homo sapiens
  chr6.fa.O7frz.103435990
  Located on chromosome 6
  Distance between a terminus base of telomere on chromosomal short arm and 5'-terminus of this base sequence : 101358215
  Distance between 3'-terminus of neighbour sequence of sequence listing upward to telomere on chrosomal short arm and 5'-terminus of this base sequence : 139215
gcagtatgactggagtcactactttcctctgcctgtgggtggaagcaaaacgtttgttttgaatcaacaattgtctattgcacatgtgggcatttatctttatggagtgtgtgtgtgtgtgtgtgtgtgcgtgtttgtgtgaatttacttgtacaacttttgattgaaattacgtatctcattatattgtgttgttttccccaatatgtgtttactgactccacttgaa

SEQ ID NO: 10612 - DNA, 249 bp, Homo sapiens
  chr6.fa.O7frz.103851037
  Located on chromosome 6
  Distance between a terminus base of telomere on chromosomal short arm and 5'-terminus of this base sequence : 101524562
  Distance between 3'-terminus of neighbour sequence of sequence listing upward to telomere on chrosomal short arm and 5'-terminus of this base sequence : 166118
taacatagacaaatcttagcatgtcattgaatcaagtgtcttcaaacatataaaagccctttgctgtactctaagatataattaaggagccctaatcaaattcagaaataatttctttcagaggaaagtctattccctataataataaataatattatttactattttatttaaagatatattatatatatatatatatatatagggcgagggagagaaatagagtttacgaaccacttagtgcttact

SEQ ID NO: 10613 - DNA, 448 bp, Homo sapiens
  chr6.fa.O7frz.103970417
  Located on chromosome 6
  Distance between a terminus base of telomere on chromosomal short arm and 5'-terminus of this base sequence : 101913978
  Distance between 3'-terminus of neighbour sequence of sequence listing upward to telomere on chrosomal short arm and 5'-terminus of this base sequence : 389167
tcttgaatacctgtgcaataaccagcaaccagtgggagatggagagtcagggctaagggtggaaaattcataaagagaataacagttctctctctctctctgcgtgtgtgtgtgtgtgtgtgtgtgtgtgtagtttattaagcattgctattatgttgggaatttgacacatcatatctcatttaataatcagaattataatgaatcttcaaggtaactttaacatcttaacatctccattttacacaaagagaagcagaggttcaggttaattatttgcctagggtcactgttttagactgaattatttctccccaaaatttatatgctaaagctttaactcccaatgtgactgtatttggagataggacctttaaggaggtaattaacattaagtgagttcataaaggcaggctcctaatttgataggactggtatcctaatagga

SEQ ID NO: 10614 - DNA, 214 bp, Homo sapiens
  chr6.fa.O7frz.104096367
  Located on chromosome 6
  Distance between a terminus base of telomere on chromosomal short arm and 5'-terminus of this base sequence : 102036508
  Distance between 3'-terminus of neighbour sequence of sequence listing upward to telomere on chrosomal short arm and 5'-terminus of this base sequence : 122082
tgtctaatttcaaagccactagctgaaccattaaatcatgcctacctcattgtaagagcattttttccccacaagccaatcctccttggtttgtttatttgtttagtttgaaaatctatctatctatctatctatctatctatctatctatctatctatctatctatcatctagaaaacaagcgatggaacttgtagcaaagattaccatctta

SEQ ID NO: 10615 - DNA, 331 bp, Homo sapiens
  AL021367.1_10115
  Located on chromosome 6
  Distance between a terminus base of telomere on chromosomal short arm and 5'-terminus of this base sequence : 102377628
  Distance between 3'-terminus of neighbour sequence of sequence listing upward to telomere on chrosomal short arm and 5'-terminus of this base sequence : 340906
cattactcaagataaccatcacaaccaaataattctgacccacatacctcacccctcacgtgctttgaccagctcaatgtgcacaccctacccctgatgtcaattcccacgctttggaaaaaaaaaaaaaaaaaaaccctacctccagctctttttagggactcagtcaaggaattctctgtctctctctctctctctctctctcacactgcctcccttatgtctgggcgtaaactccaattaagtcttatttggaaaactcttttggcctgtgtcaatttctgttgaatggagagcccaagaacctgtggtcagtaacaatgtcacttaa

SEQ ID NO: 10616 - DNA, 327 bp, Homo sapiens
  AL021367.1_71180
  Located on chromosome 6
  Distance between a terminus base of telomere on chromosomal short arm and 5'-terminus of this base sequence : 102438839
  Distance between 3'-terminus of neighbour sequence of sequence listing upward to telomere on chrosomal short arm and 5'-terminus of this base sequence : 60880
tcataatcacgtgaatcaattcccataataagtcttatctatctatctatctatctatctatctatctatctatccatctatctatatctatatctaatctatctatctatatattctattaattatgtttctctggagaactctaatacaaaagtgataactgaaagaaagtggagatggctatacttatataggacaaaatagactttcagtcaaaatctttcataagagacaaagaaagacattataaatggttcaattcatcaagaggatataataattgtaaatatatatagattcaacattggagcacctaaatatagaaa

SEQ ID NO: 10617 - DNA, 179 bp, Homo sapiens
  D6S1041
  Located on chromosome 6
  Distance between a terminus base of telomere on chromosomal short arm and 5'-terminus of this base sequence : 102438842
  Distance between 3'-terminus of neighbour sequence of sequence listing upward to telomere on chrosomal short arm and 5'-terminus of this base sequence : -324
taatcacgtgaatcaattcccataataagtcttatctatctatctatctatctatctatctatctatctatccatctatctatatctatatctaatctatctatctatatattctattaattatgtttctctggagaactctaatacaaaagtgataactgaaagaaagtggagatggc

SEQ ID NO: 10618 - DNA, 164 bp, Homo sapiens
  AL021367.1_105526
  Located on chromosome 6
  Distance between a terminus base of telomere on chromosomal short arm and 5'-terminus of this base sequence : 102473100
  Distance between 3'-terminus of neighbour sequence of sequence listing upward to telomere on chrosomal short arm and 5'-terminus of this base sequence : 34079
taaactgacatttcatacaatggaatactgctaagtcattaaaaggcacaaattactgatacatgcaacaacatatgaatctcaaacatactcatgaaagagacagaggaaaaaaacatggtgtgtgtgtgtgtgtgtgtgtgtcacatgattccagttacata

SEQ ID NO: 10619 - DNA, 233 bp, Homo sapiens
  D6S1682
  Located on chromosome 6
  Distance between a terminus base of telomere on chromosomal short arm and 5'-terminus of this base sequence : 102473104
  Distance between 3'-terminus of neighbour sequence of sequence listing upward to telomere on chrosomal short arm and 5'-terminus of this base sequence : -160
ctgacatttcatacaatggaatactgctaagtcattaaaaggcacaaattactgatacatgcaacaacatatgaatctcaaacatactcatgaaagagacagaggaaaaaaacatggtgtgtgtgtgtgtgtgtgtgtgtcacatgattccagttacataaagttcttaaataggcaaaacaaatgtaaggtgaaaaaaatcagaagagtagtttccttagggttttgaagag

SEQ ID NO: 10620 - DNA, 240 bp, Homo sapiens
  AL021367.1_113307
  Located on chromosome 6
  Distance between a terminus base of telomere on chromosomal short arm and 5'-terminus of this base sequence : 102480883
  Distance between 3'-terminus of neighbour sequence of sequence listing upward to telomere on chrosomal short arm and 5'-terminus of this base sequence : 7546
atagctctggcacagcaagcagggtcatctgttcttctgggagctgcagagaaagggaacctggaaatctggaatgccagcaaaaagggtaagaaattcttaccacccaagtttctggtctctctctctctctctctctctctctctctctctctctctttctctgtctctctctctgtgtgtgtgtgtgtgtgtgtgtgtgtgtgcgtgtgtaaatggtaaatgtcactgttcgtctcc

SEQ ID NO: 10621 - DNA, 381 bp, Homo sapiens
  AL021367.1_136209
  Located on chromosome 6
  Distance between a terminus base of telomere on chromosomal short arm and 5'-terminus of this base sequence : 102503804
  Distance between 3'-terminus of neighbour sequence of sequence listing upward to telomere on chrosomal short arm and 5'-terminus of this base sequence : 22681
ccattcctgagttatttcacttagaataatggattgcagctccatccaagttgctgcaaagacttttttttcttttttatggctgagtagtattccatggtgtgtgtgtgtgtgtgtgtgtgtgtgtgtgtgtatatacaccacattttctttattcacttgttgttcaatgggcacttaggttaattccatatttttgcaattggaaattgagctgctataaacatgtgcatgtgtctttttcatataatgacttctttttctttgggtacatacccagtagtgggactgctgaattgaatggtagttctacttttagttctttaaggactctccatactgttttctgtagaggttgtattagtttacattccaaccagc

SEQ ID NO: 10622 - DNA, 307 bp, Homo sapiens
  AL132776.11_56739
  Located on chromosome 6
  Distance between a terminus base of telomere on chromosomal short arm and 5'-terminus of this base sequence : 102670554
  Distance between 3'-terminus of neighbour sequence of sequence listing upward to telomere on chrosomal short arm and 5'-terminus of this base sequence : 166369
tgaatgtataaatgatttcagcagaaaaatgaaagaactggaaaaggatccaataaatattagaatttatatatatatatatatatatatatatatatatatatatatatatatgtatgtatgtatttacttcttgaggtgtcttataattttttgcctgccaaacattggaacaaaatacacatgtacaatttttgtttcattttgttttacccccagaggatgcactcctttcttgtcacatggctaggtcaaggggcagaacttttagtttctgtcaagtgttgtgctgagttacagttaacaa

SEQ ID NO: 10623 - DNA, 326 bp, Homo sapiens
  AL033379.2_15387
  Located on chromosome 6
  Distance between a terminus base of telomere on chromosomal short arm and 5'-terminus of this base sequence : 102784305
  Distance between 3'-terminus of neighbour sequence of sequence listing upward to telomere on chrosomal short arm and 5'-terminus of this base sequence : 113444
gtgaatctcagtagataccactcatcactataaatactactgcaatgggcaagttcattcatttaagtttttctaaaatttatactaaattttttgacagattgctggccattttatatatatatatatatatatatatatatatatatatatatatatatagagagagagagagagagagagagagagagagagagagagagagggagagagcgagagagacggagtcttactctgtcctctgtctcccaggctggagtgcagtggggtgatctcagctcactgcaacctccgcctccctggttcaagtgattctcattccttag

SEQ ID NO: 10624 - DNA, 333 bp, Homo sapiens
  AL033379.2_72165
  Located on chromosome 6
  Distance between a terminus base of telomere on chromosomal short arm and 5'-terminus of this base sequence : 102840972
  Distance between 3'-terminus of neighbour sequence of sequence listing upward to telomere on chrosomal short arm and 5'-terminus of this base sequence : 56341
tggatgtcctttaaatcaattaacatcaactgtagtattattcgaggcaaggaaagtccaagtataagaatatcaaaggttgctccttttcaaaaaataatgtcaaatttttgttaataggagcagccacataaatctctcaagcaactcaaagtctcgactcaaaaataaccaaaaatgttagatgtaatattttattccaatactttaagaggatcccagctatacccgaggggatggctattactactactgctactactaccactgttacacacacacacacacacacaccctttccacaattctctccactagatttacatttgatcc

SEQ ID NO: 10625 - DNA, 454 bp, Homo sapiens
  chr6.fa.O7frz.105001186
  Located on chromosome 6
  Distance between a terminus base of telomere on chromosomal short arm and 5'-terminus of this base sequence : 103129383
  Distance between 3'-terminus of neighbour sequence of sequence listing upward to telomere on chrosomal short arm and 5'-terminus of this base sequence : 288078
taatcttgcattaggttacatttctttttcagttttgatgctaggaagcatagagccacattgtgacccacttataatagttatgaggatggatacacacacacacacacacacgcacacacattctctcctgacctcatattgtttcctcttttctcttgctttgagttatttttattcttaatatttaaatgcttgtattgatgcctcagatcctttttgaaatgaggcagagaagataataagtaactagactgaataaaaagatttgagacctctttctgaacatttttggaatcccagagggatcttaatgttagttgtaggcatgaatgctacagcccattagctctgcctatgaaaatgaagtgcctccaaattcccagcttgctccataaataaatcattccacacatttcccaaatttttttcctccttgtttcagcactaaata

SEQ ID NO: 10626 - DNA, 326 bp, Homo sapiens
  AL023656.8_52815
  Located on chromosome 6
  Distance between a terminus base of telomere on chromosomal short arm and 5'-terminus of this base sequence : 103221304
  Distance between 3'-terminus of neighbour sequence of sequence listing upward to telomere on chrosomal short arm and 5'-terminus of this base sequence : 91467
atgtcctaaagcatgattcagtagcagcttttcctatcctttaaacgttttcatactctaaggagcaagattctcaaaggtatctttatcaatctcctttggaaaaaaaaaacccacacacacacacacacacacacacacacacacacacacacaaaaacacatatacacataaataacctctttaaaggcatcaccttaaatagataaaactccttagtgactgctggaactttccaagccatacattatttgtttagtaagtcactatcatgatgaaaagaaattcagtgttatgaagtctattaaacagccttaagctttca

SEQ ID NO: 10627 - DNA, 418 bp, Homo sapiens
  AL023656.8_99958
  Located on chromosome 6
  Distance between a terminus base of telomere on chromosomal short arm and 5'-terminus of this base sequence : 103268227
  Distance between 3'-terminus of neighbour sequence of sequence listing upward to telomere on chrosomal short arm and 5'-terminus of this base sequence : 46597
taactaaggtaatggcattatcagaaaaacaaaaaatccctgaaatttaaacagtggaagttatccaaaaaatcatcaatccaatcttgtcttcaaaaaatgagaaaaaacaatagacaacttctaggtatgaagagacttttacaaagcctcaatttgagataatggtagtttcaatcctgagtcccaatcctgtgcatgcccaaattgtcagggagaaaccaggctggcaagtagcattcaagcacactttgcaatgcctccatgtaacagacaccccagtacatctgtgtgtctgtgcatatgtggaggagggggtaagtaggtggtagacggatggatggatggatggatggatggatggatggatggatggatgaatgaatgaatgaatatgtgaaatcaaagcaagagttta

SEQ ID NO: 10628 - DNA, 467 bp, Homo sapiens
  chr6.fa.O7frz.105235102
  Located on chromosome 6
  Distance between a terminus base of telomere on chromosomal short arm and 5'-terminus of this base sequence : 103378277
  Distance between 3'-terminus of neighbour sequence of sequence listing upward to telomere on chrosomal short arm and 5'-terminus of this base sequence : 109632
agctaaagtcatctgtaggctacactgtgctggatgtcaaatgtggattcttcactcacatgtttaggtggaatagagtgatggaacagcagctgaggactagctggatcgatttctctctctctctctctctctctctctctctctctttctccctccctccctttctctttgtgtctcctctccatagtcttctccatgtggtagcttggctctttaatagtatggagatttcaatgtgttcacacttcttacatgatggctggctttcccagaatgagacctaggtggaaacttaggtcttaccttggctcaggagtcacacagtgtcacttctactgcactctgttagtcaaaagcaagtcacacaggaccaagccagattcaagtggcagggaatgcacaaaagcatgcattctgagaggcatggttcattggagggccatctttgaggactaatgaccaaa

SEQ ID NO: 10629 - DNA, 395 bp, Homo sapiens
  Z84719.1_14217
  Located on chromosome 6
  Distance between a terminus base of telomere on chromosomal short arm and 5'-terminus of this base sequence : 103460122
  Distance between 3'-terminus of neighbour sequence of sequence listing upward to telomere on chrosomal short arm and 5'-terminus of this base sequence : 81378
tagatgacaagctcaaattcagagaagttaagttacttaataatggtagtacatatttattaatgttttctatatgctggaaactgataagggctttatttatatatagttatctatctatctatctatctatctatctatctatctatctatcatctatctacatcatcatcatcatcatcaccaacaaccccataaagataaagaaatggagaattagagatattaagtaacttagccagggtggcatacatgataaatagtagccctgggctttgaacctgaagagatttagtcacgaaccaatagggtcaatctgtgcactgtgacttagtcaaggttacgttgccagtaagtgatggagctgaaattcgtattcctgacttgtctgactg

SEQ ID NO: 10630 - DNA, 173 bp, Homo sapiens
  G08551
  Located on chromosome 6
  Distance between a terminus base of telomere on chromosomal short arm and 5'-terminus of this base sequence : 103460197
  Distance between 3'-terminus of neighbour sequence of sequence listing upward to telomere on chrosomal short arm and 5'-terminus of this base sequence : -320
gctggaaactgataagggctttatttatatatagttatctatctatctatctatctatctatctatctatctatctatcatctatctacatcatcatcatcatcatcaccaacaaccccataaagataaagaaatggagaattagagatattaagtaacttagccagggtggc

SEQ ID NO: 10631 - DNA, 305 bp, Homo sapiens
  Z84719.1_98339
  Located on chromosome 6
  Distance between a terminus base of telomere on chromosomal short arm and 5'-terminus of this base sequence : 103544257
  Distance between 3'-terminus of neighbour sequence of sequence listing upward to telomere on chrosomal short arm and 5'-terminus of this base sequence : 83887
ctcaaagtttctgaggtctgaaaatccctctttccgtatcctcacaacttatattgtagttgcagtgttggaaaaatattacaagttaaaaagaagagtgtgtgtgtgtgtgtgtgtgtgtgtgtgtgtgtgatgcatggatgtgtagcatgtgtggtttcaaaataatttagaattttctagccttcagtataattgattacatggaatatagtgaaatgcatttgtctcttgctattggcgtctatttgtgtagtattagataccctttgagtgaaaaagatggacatttaaagatcaaactg

SEQ ID NO: 10632 - DNA, 249 bp, Homo sapiens
  D6S1060
  Located on chromosome 6
  Distance between a terminus base of telomere on chromosomal short arm and 5'-terminus of this base sequence : 103545507
  Distance between 3'-terminus of neighbour sequence of sequence listing upward to telomere on chrosomal short arm and 5'-terminus of this base sequence : 945
tgattcaaatcctgactcagcacttttaccaaatatgattgtttggggaattatgtcaggttgtggactccctgcctccctttcttccttccttccttccttccttccttccttccttccttccttccttccttccttctttccttccctccttttttctttctttgttttggtttccatctgaaaataaaagggaaagaacatgctctttatctctttggcacagatttgctaaatgataggccctca

SEQ ID NO: 10633 - DNA, 365 bp, Homo sapiens
  Z84719.1_110932
  Located on chromosome 6
  Distance between a terminus base of telomere on chromosomal short arm and 5'-terminus of this base sequence : 103556702
  Distance between 3'-terminus of neighbour sequence of sequence listing upward to telomere on chrosomal short arm and 5'-terminus of this base sequence : 10946
ttgcgttatttagtttcagaattcctgtttggcctttctttttttagtttttaaaaaatcatttttttaaattgggaaatggatcattttcctgatttcatttagttgtctatctctgtagatcattgccttctttacaacaattattttgaattatttgtcaggtaattcatctgtgtttctttggggttggtttttggagattaattttgttaattaattttgttctgccatgctttcctttttctctctctctctctctctctctctctgtgtgtgtgtgtgtgtgtgtgtgtgtgtgtgtgtgtttggctgagttttatgcgtttgaaaaaacagctacctcttccagtcttcacagattg

SEQ ID NO: 10634 - DNA, 252 bp, Homo sapiens
  AL080316.8_1037
  Located on chromosome 6
  Distance between a terminus base of telomere on chromosomal short arm and 5'-terminus of this base sequence : 103772716
  Distance between 3'-terminus of neighbour sequence of sequence listing upward to telomere on chrosomal short arm and 5'-terminus of this base sequence : 215649
attgtggacatggcataagtaggctctgggcatagtctaattttttttcccctttttctgtgtgttttgtcttatgtttcagtattatgctttttcggcttttttggggggaataagataaaggaattttgttttaaactaattgtgagaaggaaaatgccttctaactggtatatatatatatatatatatatatatatatgcacacttatatatgttatatgtatataacatagtcacttttcaaccaaa

SEQ ID NO: 10635 - DNA, 219 bp, Homo sapiens
  chr6.fa.O7frz.105694209
  Located on chromosome 6
  Distance between a terminus base of telomere on chromosomal short arm and 5'-terminus of this base sequence : 103947815
  Distance between 3'-terminus of neighbour sequence of sequence listing upward to telomere on chrosomal short arm and 5'-terminus of this base sequence : 174847
atcaatccttatttcaggaataactaaaataagatatccagcctttaagcaaagaagccaaaacaacaacaacaacaacaacaacaacaacagcaacaacagcaacaagtgccaacagaaaaatatttgtgaaatgtgagatactttttaagaaaatctctggtagtcactacaaaaatggtcaagaaataagtcattgaagaatacgtttgtatgagt

SEQ ID NO: 10636 - DNA, 435 bp, Homo sapiens
  AC023995.2_29915
  Located on chromosome 6
  Distance between a terminus base of telomere on chromosomal short arm and 5'-terminus of this base sequence : 104297481
  Distance between 3'-terminus of neighbour sequence of sequence listing upward to telomere on chrosomal short arm and 5'-terminus of this base sequence : 349447
gccaacttggtgaaatctaatctctactaaaaatacaaaaatcagccaggtgtggtggtgcatgcccgtaatctcagctacttgggaagctgaggcaggagaatctcttgaacccaggaggcagaggttgcagtgagctgagattgccccactgcaatccagcctgggcaacagagtgagaaaaaaagaaagaaagaaagaaaagaaagaaagaaagagagagagagagaaagagagaaagaaagaaagagagagaaagaaagaaagaaagaaagaaagaaagaaagaaagaaagaaagagaaagaaagaagacatctaaaagcaatgtataaatatatgaaacttttttggattcatgattcaaacaaattatttgtgaacagacatctttgtgacaatcagagaaatttgagtaaggactgagcattagatga

SEQ ID NO: 10637 - DNA, 197 bp, Homo sapiens
  D6S1716
  Located on chromosome 6
  Distance between a terminus base of telomere on chromosomal short arm and 5'-terminus of this base sequence : 104372592
  Distance between 3'-terminus of neighbour sequence of sequence listing upward to telomere on chrosomal short arm and 5'-terminus of this base sequence : 74676
tcttcactagagaagcactcagcccaaataagataattcaccatggaattgtgtgtgtgtgtgtgtgtgtgtgtgtgtgtgtagatagattaagtgatagattgagagtatagaggtttttttaagccttcatctctatttttgtaatgttaattttccccttcccccatagttctcccaaaaactgctctgtgatg

SEQ ID NO: 10638 - DNA, 465 bp, Homo sapiens
  chr6.fa.O7frz.106169709
  Located on chromosome 6
  Distance between a terminus base of telomere on chromosomal short arm and 5'-terminus of this base sequence : 104474303
  Distance between 3'-terminus of neighbour sequence of sequence listing upward to telomere on chrosomal short arm and 5'-terminus of this base sequence : 101514
gaaacaatagtgagcagttcacttaacactatggtatgaaaatatataattaagtcatactctcacaaatgttgaggaaacatgaaaaggaacagagattgcttttttttttgctaatgtactgaaaacactatttaccaaactgattttgattagtacatgtggcaaatatttaaagaatttgattctaaaaattattcccataaacttgttttttaaaaagttctcaacaaagaaaatgttctaaacttagaatttggtgatggttgcacaactctgtgaatacaatacaaccttttaattatacactttatgatgtaaatttcatgttacaggaattataactcagtaaagattatatatatatatatatatatatatatatatatatgtttcaaggttcagaaaatggcatgccactcccccaccccaccccaccccaacttcagtgctagtctgctttag

SEQ ID NO: 10639 - DNA, 378 bp, Homo sapiens
  Z84482.1_63477
  Located on chromosome 6
  Distance between a terminus base of telomere on chromosomal short arm and 5'-terminus of this base sequence : 104612874
  Distance between 3'-terminus of neighbour sequence of sequence listing upward to telomere on chrosomal short arm and 5'-terminus of this base sequence : 138106
agcatcagatcataacctcagtcagtatttggattattgtaaaattctattagaaactatatcgctgatgagatatacattacatacctaacttttattaaccaattcaaatggccaagaattaaaggtatatatatatatatatatatatatatatacacatacacacaggcacaatcaagctgacaaaatgtttttccaaatcagtagaatccctctgttgtcctggaactaaataagttttttgtttcttgaagaaagtatgagagataaataatgttattaagaagagaaaaatccttgcaaccagattgatcttcataaccaaatcatctgctttcttaaaacactctggtggtgaaataaagagtctgactc

SEQ ID NO: 10640 - DNA, 326 bp, Homo sapiens
  HUMUT6730B
  Located on chromosome 6
  Distance between a terminus base of telomere on chromosomal short arm and 5'-terminus of this base sequence : 104613608
  Distance between 3'-terminus of neighbour sequence of sequence listing upward to telomere on chrosomal short arm and 5'-terminus of this base sequence : 356
actctagccttggcaacaagagcaaaactctgtccaaaaaaaaaagagaagaaaagaaaaaaaagaaaggaaggaaggaaagaaagaaaatgaaggaaagaaggaaggaagaaaggaaggaaggaaggaaagaaggaatggagagagaaaaaagaaagaaaggaagaagaaaaagaaagggagggagggaaggaaggaaatgaaaggaaggaagggagggagggagtgagggtggaaggaaggaaggaaggaaggaaggaaggaaggaaggaagcttgagtactccctcccttggtgctggtggagttcaaaccacacaagcctac

SEQ ID NO: 10641 - DNA, 220 bp, Homo sapiens
  chr6.fa.O7frz.106403287
  Located on chromosome 6
  Distance between a terminus base of telomere on chromosomal short arm and 5'-terminus of this base sequence : 104703372
  Distance between 3'-terminus of neighbour sequence of sequence listing upward to telomere on chrosomal short arm and 5'-terminus of this base sequence : 89438
tatttgtccaagtatcctgttaacgatttttgaaatcttatctagtgtagaaccatacacacacatttacacacacacacacacacacacacacacacaggaacatgtagacacccatgcccaataagaaaatagatagagaaatgttactatgaactaggttgtttagtaagtgtcttgacttttttaggctactgggtttccatttcctcaactagag

SEQ ID NO: 10642 - DNA, 241 bp, Homo sapiens
  AL022395.2_106160
  Located on chromosome 6
  Distance between a terminus base of telomere on chromosomal short arm and 5'-terminus of this base sequence : 104928192
  Distance between 3'-terminus of neighbour sequence of sequence listing upward to telomere on chrosomal short arm and 5'-terminus of this base sequence : 224600
ccagcaattccacttctagatatatattcaaaggaaataaaatcagtatgtcaaagagataattgcactcccatgttcattgttgcattatttacaacagccaagatatggaatcaatctaagtgtccatcaatggatcaatggataaaggaataacacacacacacacacacacacacacacacacacacgaatactacaaagccttaaaaaagaagaaaatcctgtcatttgtgacaac

SEQ ID NO: 10643 - DNA, 305 bp, Homo sapiens
  AL078603.4_3183
  Located on chromosome 6
  Distance between a terminus base of telomere on chromosomal short arm and 5'-terminus of this base sequence : 105037561
  Distance between 3'-terminus of neighbour sequence of sequence listing upward to telomere on chrosomal short arm and 5'-terminus of this base sequence : 109128
tatagaaatgctgaaggaaatgacatatcaatgtatattgcatgaaatatacatgtgcacgcgcacacacacacacacacacacacacacatatacatgaacacacacccctagtctcaagtcaaggcctctcatcagcttaaaatacctaaagcttatcataatatataacatataaaacttattataatattataacctaattataatattttaccattccttttcagttagaaatttaactcaaatttaactcaacaaatttgttttgatgatttattatgtgaaaggcactatgctaaatg

SEQ ID NO: 10644 - DNA, 247 bp, Homo sapiens
  AL078603.4_88350
  Located on chromosome 6
  Distance between a terminus base of telomere on chromosomal short arm and 5'-terminus of this base sequence : 105122716
  Distance between 3'-terminus of neighbour sequence of sequence listing upward to telomere on chrosomal short arm and 5'-terminus of this base sequence : 84850
ctctaggttaatccatgttaccacaaatgacaggattttcttcttttttaaggctgaatagtattccggtgtgtggtgtgtgtgtgtgtgtgtgtgtgtgtgtgtgtgtgtgtgtgtgtgtgtgtgtgtgtatgcatgtatagaacacattttcttcatctatttatctattgctggacaattaggttgattttatatcttggctattgtgaataatgctgcagtgaatacaggagtgcagatatct

SEQ ID NO: 10645 - DNA, 478 bp, Homo sapiens
  chr6.fa.O7frz.106959586
  Located on chromosome 6
  Distance between a terminus base of telomere on chromosomal short arm and 5'-terminus of this base sequence : 105195039
  Distance between 3'-terminus of neighbour sequence of sequence listing upward to telomere on chrosomal short arm and 5'-terminus of this base sequence : 72076
cgaattaagacagtagcatgaggatttttttggggggaaggtttagtttaaagaccacgaataagtatccacacactgcccctagtccagttctgtccaacagaactttctgaggggagggaaacatttcactcctgcatagtcctatacagtagccacccaccacatgtggctattcagcattgagatgtgtctagagcaactgaggaactgagcattcaattttatgtaattttagtgaatttaaattttaaagtcatgtgtggctagtggcttccatataatacaattctagacactcaaatgtgtgtgtgtgtgtgtgtgtgtgtgtgtatatgtatatatatatgtatatatgtatatatatatgtatatatatatatatatatgtatatatatataccactttgttgtgtaggaatcagcagatgctgtactttttcaattttctaacacctaagaacagttttgcacgtta

SEQ ID NO: 10646 - DNA, 118 bp, Homo sapiens
  D6S1717
  Located on chromosome 6
  Distance between a terminus base of telomere on chromosomal short arm and 5'-terminus of this base sequence : 105301570
  Distance between 3'-terminus of neighbour sequence of sequence listing upward to telomere on chrosomal short arm and 5'-terminus of this base sequence : 106053
gggggctctatctctaaaattaaaaaatatatatatgtgtgtgtgtgtgtgtgtgtgtgtgtgtgtgtgtatgtgtatatatatatatgaaatgggcagacaacattctcaacatccc

SEQ ID NO: 10647 - DNA, 323 bp, Homo sapiens
  AL034371.16_82588
  Located on chromosome 6
  Distance between a terminus base of telomere on chromosomal short arm and 5'-terminus of this base sequence : 105348328
  Distance between 3'-terminus of neighbour sequence of sequence listing upward to telomere on chrosomal short arm and 5'-terminus of this base sequence : 46640
cctttaaggttcattaccatacacatgtgtgaatcacttcatagtaagatttgaatttccaaaatcttgctgtgaatctctgaccctaaagacttgagcatatcatggccatattaccatatgccagtttatcatcccaaacgtctttcttcatctgtaatttgggaacaataattactttattgaagaggtatgaaaactaattgagactatatgtgtgtgtgtgtgtgtgtgtgtgtgtgtgtgtgtgtgtgtgtgtttgagatggagttttgctcttgttgcccaggctggagtcaatggcacaaagtcagctcactgca

SEQ ID NO: 10648 - DNA, 210 bp, Homo sapiens
  AL034371.16_65059
  Located on chromosome 6
  Distance between a terminus base of telomere on chromosomal short arm and 5'-terminus of this base sequence : 105365989
  Distance between 3'-terminus of neighbour sequence of sequence listing upward to telomere on chrosomal short arm and 5'-terminus of this base sequence : 17338
tacagtaagccataatcatgtcacttcactctagcctaggcaacagagcaagaccccattaaaatatatatgtatatgtaaatgtacatatgtatatgtgtgtgtgtgtgtgtgtgtgtgtgtgtgtatatatatatatagtccaaaatgcacttaacacctctaacctgccaaacatcatacattagtttagcttaccttaaacgtgct

SEQ ID NO: 10649 - DNA, 265 bp, Homo sapiens
  D6S1565
  Located on chromosome 6
  Distance between a terminus base of telomere on chromosomal short arm and 5'-terminus of this base sequence : 105366287
  Distance between 3'-terminus of neighbour sequence of sequence listing upward to telomere on chrosomal short arm and 5'-terminus of this base sequence : 88
atggctgattgggaactatggctcagtgccaccactcggcaccagaagagagtactgcaccacacatatggacagcccaggaagagatcaaaattcaaagtatagtttctactgaacaagtattgtttttcacaacctcaaagttgaacaatcataagtcaaacaatgataagtcaggaaccatctgtatatcccaccaccctaccccaccacacacacacacacacacacacacacacacacacatacacacaccccaagatct

SEQ ID NO: 10650 - DNA, 475 bp, Homo sapiens
  chr6.fa.O7frz.107459775
  Located on chromosome 6
  Distance between a terminus base of telomere on chromosomal short arm and 5'-terminus of this base sequence : 105776090
  Distance between 3'-terminus of neighbour sequence of sequence listing upward to telomere on chrosomal short arm and 5'-terminus of this base sequence : 409538
gactacaggcacataccactatacttggctaatttttgtatttttagtagacatggggttttgccatgttgggcaggctgatcttgaactcctgacctcaagcgatctgcccaccttggcctcccaaaatactggggttacagatgtgagccactgcacctgacccactgactgcaatcttaaataaaatgttctattcacattgttcattgttagtatatagaaatgcaactgatttttacgttgactttgtatcctgctactttgctgatttgtttattggttctaacagtttgtgtgtgtgtgtgtgtgtgtgtgtgtgtgtgtgtgaaatatttaaggttttccatgtataaaattatattatctgtgaacagacataaattttacttctttctttccagtctgaaaggcttccaaatatttctctttcttgcctaattgctctgactagaacttccagtactatgttgaa

SEQ ID NO: 10651 - DNA, 268 bp, Homo sapiens
  chr6.fa.O7frz.107648637
  Located on chromosome 6
  Distance between a terminus base of telomere on chromosomal short arm and 5'-terminus of this base sequence : 105949359
  Distance between 3'-terminus of neighbour sequence of sequence listing upward to telomere on chrosomal short arm and 5'-terminus of this base sequence : 172794
tatgcatccagactaacttcttattgcaaaccctcttcttcttcttttttttaaaattgaaaacccctattgtttttcctcacatgtcaaggaagactgagaacctacatatagggttctagcctatatgtagcctcccatgtatgcagggggcacacttgcacacgtatacacacacacacacacacacacactctctctctctctctctctctctctccccctgtctcacagaacggaggaaaaacttcactgcctgactttaata

SEQ ID NO: 10652 - DNA, 281 bp, Homo sapiens
  D6S1671
  Located on chromosome 6
  Distance between a terminus base of telomere on chromosomal short arm and 5'-terminus of this base sequence : 106183963
  Distance between 3'-terminus of neighbour sequence of sequence listing upward to telomere on chrosomal short arm and 5'-terminus of this base sequence : 234336
tatctccaggggtgctgctgttaaacagtaactattccctatctgaccactgtgtggtgctgcttacttttaaattgtgtgtgtgtgtgtgtgtgtgtgtgtgtgtgtgtgtgtgtgtgtgtgtgtgtatctgggtgtgtacgcatatgtaggcttgtctgcgtgtgcatctttgctttgtacatttagatatttctgatttcaaaatgtagcatacattcaagtttggaaacatcgagtgctgagattctatttaatgactacagattgaaattgaccaa

SEQ ID NO: 10653 - DNA, 259 bp, Homo sapiens
  HUMUT2078
  Located on chromosome 6
  Distance between a terminus base of telomere on chromosomal short arm and 5'-terminus of this base sequence : 106232567
  Distance between 3'-terminus of neighbour sequence of sequence listing upward to telomere on chrosomal short arm and 5'-terminus of this base sequence : 48323
gggagacagagcaagactccatctcaagaaaagaaaaaaagaaaagaaaagaaattatgttagacagggttttctagagaaacagaaccaataggatagatagatagatagatagatagatagatagatagatagatagatagaaagatagatagatagatagatagatagatagatagatagaataagataatataatatggcaattggctcacctgattattgaggccaagaagttccatgatgtgccatctgcaag

SEQ ID NO: 10654 - DNA, 146 bp, Homo sapiens
  G08546
  Located on chromosome 6
  Distance between a terminus base of telomere on chromosomal short arm and 5'-terminus of this base sequence : 106232638
  Distance between 3'-terminus of neighbour sequence of sequence listing upward to telomere on chrosomal short arm and 5'-terminus of this base sequence : -188
ttctagagaaacagaaccaataggatagatagatagatagatagatagatagatagatagatagatagatagaaagatagatagatagatagatagatagatagatagatagaataagataatataatatggcaattggctcacct

SEQ ID NO: 10655 - DNA, 454 bp, Homo sapiens
  AL080285.6_97714
  Located on chromosome 6
  Distance between a terminus base of telomere on chromosomal short arm and 5'-terminus of this base sequence : 106232642
  Distance between 3'-terminus of neighbour sequence of sequence listing upward to telomere on chrosomal short arm and 5'-terminus of this base sequence : -142
agagaaacagaaccaataggatagatagatagatagatagatagatagatagatagatagatagatagaaagatagatagatagatagatagatagatagatagatagaataagataatataatatggcaattggctcacctgattattgaggccaagaagttccatgatgtgccatctgcaagccaaagaaccaggaaagcatgattttgcctttgttcaagggcctgataaccagaggaaccaatggtataactctcagtttgaagttaaaggcctgagaactgggggagtgctgatgtccaaaagcagaagaagatggatatctcagctccagaagagagaattaatttgctattcctcaaccattttgttctacctgggccctcaatggattggatgatgcctgcccacattggtgagggtggattttctttactcagtctgctgattca

SEQ ID NO: 10656 - DNA, 408 bp, Homo sapiens
  AL080285.6_94673
  Located on chromosome 6
  Distance between a terminus base of telomere on chromosomal short arm and 5'-terminus of this base sequence : 106235555
  Distance between 3'-terminus of neighbour sequence of sequence listing upward to telomere on chrosomal short arm and 5'-terminus of this base sequence : 2459
tcaggagttcgagaccagtctggccaacatggtgaaaccctgtctatactaaaaatacaaaaattagctgggcatggtggcgggtacgtgtaatcccagctactcagaaggttgaggtaggagaattgtttgaacctggcaggcggagattgcagtgagctgacatcgcaccgttgcactccagcctgaacaacaagagcaaaactccatctcaatatatatatatatatatatataaattttgtgagttgttaaaggttaaaaatatgcttacagaaatgaaaaattcagagaggattagagaataaaattgaaaaatatcttccataaagtagagaaaaacacaaattaatgataaataagagaaaaatatttttaaaaataattaattcaagaattccaacatcc

SEQ ID NO: 10657 - DNA, 260 bp, Homo sapiens
  chr6.fa.O7frz.108048065
  Located on chromosome 6
  Distance between a terminus base of telomere on chromosomal short arm and 5'-terminus of this base sequence : 106422485
  Distance between 3'-terminus of neighbour sequence of sequence listing upward to telomere on chrosomal short arm and 5'-terminus of this base sequence : 186522
ctattgtgccagtttctaacagataattaatctatatatgttgttgccacttagtagtctgtctgaccccaggacagcaggcagagtcaatatctctctctctctctctctctcacacacacacacacacacaccccacacaccaaaactctctctctgtgtcacatacacctgcgtgtactaaggtcttaagtgtcattagtaacaaacacagtctctgtttaaagatgataactcagttattccaagataggaagctc

SEQ ID NO: 10658 - DNA, 366 bp, Homo sapiens
  chr6.fa.O7frz.108152191
  Located on chromosome 6
  Distance between a terminus base of telomere on chromosomal short arm and 5'-terminus of this base sequence : 106526816
  Distance between 3'-terminus of neighbour sequence of sequence listing upward to telomere on chrosomal short arm and 5'-terminus of this base sequence : 104071
ggacagaagttagtgactttcagccaaaagtgtagagagatggagtggagcaggtttggcaggaaacagggcatagaaaactagccacatgagcccttttgttcattctaaatttgtaaacatctggggcatgcagcccaatgggaaagatccagagtaattggtggacaaggctagtgccctgtaagactcaggatccactgaaacaaacaaggaaaatacatccataaaacacacacacactgtctctctctctctctctctctctctctctctcacacacacacacacacacacacacacacacacacagttctagggggaaaaatcacagcctatgtgttctataatggaaggagtaatagc

SEQ ID NO: 10659 - DNA, 232 bp, Homo sapiens
  Z66705
  Located on chromosome 6
  Distance between a terminus base of telomere on chromosomal short arm and 5'-terminus of this base sequence : 106637045
  Distance between 3'-terminus of neighbour sequence of sequence listing upward to telomere on chrosomal short arm and 5'-terminus of this base sequence : 109863
gaggcagtcaagcatccatctgctctgtgtgaatcaagagaaagcaaacatgcattcttatggctaaagtcatagtcaaaccccaaacatcttagaggaacacacacacacacacacacacacacacacacacacacacacacgcacacataacaggcaagcacatactgtaggctaaattaacccagttcctcaatttagtttgcatttccttggtgcttttaacattgga

SEQ ID NO: 10660 - DNA, 238 bp, Homo sapiens
  Z86062.1_160340
  Located on chromosome 6
  Distance between a terminus base of telomere on chromosomal short arm and 5'-terminus of this base sequence : 106637096
  Distance between 3'-terminus of neighbour sequence of sequence listing upward to telomere on chrosomal short arm and 5'-terminus of this base sequence : -181
gcattcttatggctaaagtcatagtcaaaccccaaacatcttagaggaacacacacacacacacacacacacacacacacacacacacacacgcacacataacaggcaagcacatactgtaggctaaattaacccagttcctcaatttagtttgcatttccttggtgcttttaacattggaaaacaaagtacatatatgttgagggggtataaagtacagctcttaagtttggtatgc

SEQ ID NO: 10661 - DNA, 363 bp, Homo sapiens
  chr6.fa.O7frz.108388497
  Located on chromosome 6
  Distance between a terminus base of telomere on chromosomal short arm and 5'-terminus of this base sequence : 106763369
  Distance between 3'-terminus of neighbour sequence of sequence listing upward to telomere on chrosomal short arm and 5'-terminus of this base sequence : 126035
cttcaatacagacgtagttcattttttctgtacttaaatctctctctctctctctctctctcacacacacacacacacacacacacacacacacagacctgatctcacacatacacacagagatgtccataatatactgctaagtgaaaaaatatcaattgaagaaaaatttccataatattatcctgagtgtgttgttatattctatagaggtgtatgtgaatgtatatgtttgaaaacagagatatggacaccctccaaattagttatctcacaaaatgaaaacgggatttggtgggggatgggggaaacagaattaaaaaaacaattttttctttgtatgtcttgtatcgtttgtcttac

SEQ ID NO: 10662 - DNA, 432 bp, Homo sapiens
  AL133338.8_92380
  Located on chromosome 6
  Distance between a terminus base of telomere on chromosomal short arm and 5'-terminus of this base sequence : 106980987
  Distance between 3'-terminus of neighbour sequence of sequence listing upward to telomere on chrosomal short arm and 5'-terminus of this base sequence : 217255
atccataatcacatgagctaatacccgtaataaatcccctcatctatatttatgtctatatcacccatagctgtctgtctgtctatctatctatctatctatctatctaatctaccaatcatctatctatattgactctgtttctctggagatctgagaaacttcactaatatagaacccagaatgacccacactagggattttatattcagaacaacttgaatctatactcctgggaaataattttaaaatataaacaaaatttaaaccaaaatagaatgatctactctaactctccttttggtggcttacattccttgccctgataagctttaagaatgaaggccagtcttaaagcaacagtaccctcctggctctaccaccaagcagacagtcatccttttagcctctaaattacctgaggtgaagtta

SEQ ID NO: 10663 - DNA, 126 bp, Homo sapiens
  HUMUT5893
  Located on chromosome 6
  Distance between a terminus base of telomere on chromosomal short arm and 5'-terminus of this base sequence : 106981010
  Distance between 3'-terminus of neighbour sequence of sequence listing upward to telomere on chrosomal short arm and 5'-terminus of this base sequence : -409
cccgtaataaatcccctcatctatatttatgtctatatcacccatagctgtctgtctgtctatctatctatctatctatctatctaatctaccaatcatctatctatattgactctgtttctctgg

SEQ ID NO: 10664 - DNA, 403 bp, Homo sapiens
  AL133338.8_102485
  Located on chromosome 6
  Distance between a terminus base of telomere on chromosomal short arm and 5'-terminus of this base sequence : 106991019
  Distance between 3'-terminus of neighbour sequence of sequence listing upward to telomere on chrosomal short arm and 5'-terminus of this base sequence : 9883
tatggtctatgatttcaaccacctaggagagactggctcgctttccttagttgtagtttgaaaaaccttacaaaagacttttggtggctggcttaggtgagacgtcttttccttcctggattaagcatctatggcaggcagttgagggcttggttatctatctatctatctatctatctatctatctatctatctatctattcatttcatccatccatcatcacctatcaattatgttcacttcatgtcactggatggaggatcttattgctctaaatatcatttgtaagttgatgacccccaaacattccagatctaacctggccccaactccaggattttacatccaaatgtctacaaatcatttccgtttgaacatctaatggtgacttaggacagacta

SEQ ID NO: 10665 - DNA, 150 bp, Homo sapiens
  D6S468
  Located on chromosome 6
  Distance between a terminus base of telomere on chromosomal short arm and 5'-terminus of this base sequence : 107258849
  Distance between 3'-terminus of neighbour sequence of sequence listing upward to telomere on chrosomal short arm and 5'-terminus of this base sequence : 267427
gactatctcacttttatcaggcagtacttctagcaatgctctcatagtcatgaacccattgtcttacacacacacacacacacacacacacacacacagacacaaacacacacacatatatattttaaatcctgtggtctgaagagatgt

SEQ ID NO: 10666 - DNA, 178 bp, Homo sapiens
  Z24573.1_118
  Located on chromosome 6
  Distance between a terminus base of telomere on chromosomal short arm and 5'-terminus of this base sequence : 107258877
  Distance between 3'-terminus of neighbour sequence of sequence listing upward to telomere on chrosomal short arm and 5'-terminus of this base sequence : -122
tctagcaatgctctcatagtcatgaacccattgtcttacacacacacacacacacacacacacacacacagacacaaacacacacacatatatattttaaatcctgtggtctgaagagatgttgtggggatgtcatgttgaagaatcagggattctgtgaaccaattggatgttagtg

SEQ ID NO: 10667 - DNA, 252 bp, Homo sapiens
  AP002528.1_9884
  Located on chromosome 6
  Distance between a terminus base of telomere on chromosomal short arm and 5'-terminus of this base sequence : 107315345
  Distance between 3'-terminus of neighbour sequence of sequence listing upward to telomere on chrosomal short arm and 5'-terminus of this base sequence : 56290
ttggagtttgaacttagaccactatgattccaaaggcagcagtgtgtgtgtgtgtgtgtgtgtgtgtgtgtgtatgtgtgtattcacatgtacatatgctcatgaactgttgcatagtttaccaaatgttgccaggtttaaaatgtacagagcaggatactgataaattttatactctgatttctctagagttcagaccaaaaacaagacagagatcagtaaaataaagtacaagtgaaagccagaataaga

SEQ ID NO: 10668 - DNA, 101 bp, Homo sapiens
  DID22N_0028225
  Located on chromosome 6
  Distance between a terminus base of telomere on chromosomal short arm and 5'-terminus of this base sequence : 107430380
  Distance between 3'-terminus of neighbour sequence of sequence listing upward to telomere on chrosomal short arm and 5'-terminus of this base sequence : 114783
ggaggaagattgacttcagtctgtatttgttctttctctctatctctgtgtgtgtgtgtgtatgtgtgtgcacacaccttataaggcaatactctgctatc

SEQ ID NO: 10669 - DNA, 117 bp, Homo sapiens
  D6S1543
  Located on chromosome 6
  Distance between a terminus base of telomere on chromosomal short arm and 5'-terminus of this base sequence : 107595693
  Distance between 3'-terminus of neighbour sequence of sequence listing upward to telomere on chrosomal short arm and 5'-terminus of this base sequence : 165212
gtggaacataaagcagccctaatggcgcattgcggagttaaacgtgtgtgtgtgtgtgtgtgtgtgtgtgtgtgtgtgtgtgtgtgtgtttgcgctggtgatactactctatctcag

SEQ ID NO: 10670 - DNA, 411 bp, Homo sapiens
  AP002529.1_8365
  Located on chromosome 6
  Distance between a terminus base of telomere on chromosomal short arm and 5'-terminus of this base sequence : 107613776
  Distance between 3'-terminus of neighbour sequence of sequence listing upward to telomere on chrosomal short arm and 5'-terminus of this base sequence : 17966
gctcattgttatttcctcaaaagccagtagatggaaaactaatcaacattttaataagttgttttatgtacccaaaataagagtagaatgtgtgtgtgtttgtgtgtgtgtgtttgtgtgtgtgtgcgtgtgtgtgtgtgtgtgtgtgtttaagcaaatcagggagattatatgttggggggagacagaggctaaagcaatggcttttttaagttatttatctatgttccagtgtttgtggccagatgggcatctgtgctacaaagagaaggtaatattattggcaagatgaaatgatgtgagaggatttcaaattgtcctatgaacttatgagaactatcaatagtttctctagttttctatttaattgaagaaacatgactagagtcattagatgacctctacaaatca

SEQ ID NO: 10671 - DNA, 245 bp, Homo sapiens
  AP002529.1_36844
  Located on chromosome 6
  Distance between a terminus base of telomere on chromosomal short arm and 5'-terminus of this base sequence : 107642254
  Distance between 3'-terminus of neighbour sequence of sequence listing upward to telomere on chrosomal short arm and 5'-terminus of this base sequence : 28067
tgttgaccagaagacttaacaataacatgaacagtagattaacacatattttgtgtattatatgttaccaatataattctgccaatctttatctttatatacctattttatatatatatatatatgtgtatatatatatatatatatatataagcaaactagagaaaagaaactgttattaaaattataagaaagagaaaatatatttactatttaagtagatagtggatcattgtaaaggttct

SEQ ID NO: 10672 - DNA, 281 bp, Homo sapiens
  AB042031.1_56549
  Located on chromosome 6
  Distance between a terminus base of telomere on chromosomal short arm and 5'-terminus of this base sequence : 107671975
  Distance between 3'-terminus of neighbour sequence of sequence listing upward to telomere on chrosomal short arm and 5'-terminus of this base sequence : 29476
tattagcatggtcctatgactttcttgaatgtaagaatagggattttatatgtgtatatatatacacacacacaggtacaaacacacacatgtgtatgcatacacacacagacatatatataaacacatatttatatacacataaatatatttgtgcatgtatatatatatgtgtgtgtgtgtgtgtgtgtatatatatatatatatatatattcatacacatataaatgctagaagtcatctggagtctccaactccttgaatctgcttaagatcagtct

SEQ ID NO: 10673 - DNA, 408 bp, Homo sapiens
  AB042031.1_69615
  Located on chromosome 6
  Distance between a terminus base of telomere on chromosomal short arm and 5'-terminus of this base sequence : 107685067
  Distance between 3'-terminus of neighbour sequence of sequence listing upward to telomere on chrosomal short arm and 5'-terminus of this base sequence : 12811
attcaacatggagtaaatgcacaagaggttatagactaataattctcactaacgaattttagaacaaatgctttaaaacctttgcttgattataaatatgcagttcacttctcaggggatgtttaggagtattatcatttttaatggaaatctctcatagaggggtgtgtgtgtgtgtgtgtgtgtgtgtgtgtatgtatgtatgtgtgtgtgtgtctcactctccaccctgaacacacaaagtcccatagtctacagttgggtcatttcatttgatcttgagacatttgtttaagctatgtctacacaaagtcactgtaaacattttggtcagtgacctgctttgtttgacagtgtcacaccactgtatttttttctggtctactttcactctggattaactagcag

SEQ ID NO: 10674 - DNA, 241 bp, Homo sapiens
  AB042031.1_73547
  Located on chromosome 6
  Distance between a terminus base of telomere on chromosomal short arm and 5'-terminus of this base sequence : 107689059
  Distance between 3'-terminus of neighbour sequence of sequence listing upward to telomere on chrosomal short arm and 5'-terminus of this base sequence : 3584
caattagttcagtgcagttaggaccagtgaggaatgttttcccagaaaaggtgactatttcaaaagctcacaatgagagataaatttacagatgtatgtgttaatgtgtgtgtgtgtgtgtgtgtgtgtgtgtgtgtgtgtaggtacataggtcagtaagaagaagctgggctcctgggcagatgagccctgtttggaaagcaatggaggcatttgattttggttcaatcaggtaaaggta

SEQ ID NO: 10675 - DNA, 361 bp, Homo sapiens
  AB042031.1_87948
  Located on chromosome 6
  Distance between a terminus base of telomere on chromosomal short arm and 5'-terminus of this base sequence : 107703315
  Distance between 3'-terminus of neighbour sequence of sequence listing upward to telomere on chrosomal short arm and 5'-terminus of this base sequence : 14015
gtgaaagatcagctagtttggtaggttggatgaaagatagatgtagtaaacaatattatagatagatagatagatacacacacacgtacacatacacatacacacacacatatgtatatatatatttagaattccagtcatttaaaaagtaagaatccatgtattcaaaaacaatttattcaaaaacaatatggtctaacaatttagatcatattgaataatgtgtgtgtgtgtgcgtgtgtgtgtctctgtgtgtgtgtgtgtgtgtgtgtgtgtgtgtgtacatagacagatagatagagtcactctgtcgcccaggctggcatacaagggtgcaatctcagcttactgcaacctctgc

SEQ ID NO: 10676 - DNA, 421 bp, Homo sapiens
  AP002529.1_110507
  Located on chromosome 6
  Distance between a terminus base of telomere on chromosomal short arm and 5'-terminus of this base sequence : 107715876
  Distance between 3'-terminus of neighbour sequence of sequence listing upward to telomere on chrosomal short arm and 5'-terminus of this base sequence : 12200
gaggtatttctgatacagaatcacttatttttagttaagtattcaataaatgaccatgttagacttatttctcctctttatagttcagtgtaaggacttgtccacataaaaattgagtgccactgcaccccagtctgggcgagagagcgacactccatctcaatacatgcatacatacatacatacatacatacatacacacagttttctgttttctgggacctaatatttgctactcaacattctataaactttactttgttttaaatatatagtatatatggtatattcagagataacattatctaagcatctaactttttcagaatgcaagaaaataattaaaactcaaattctagacaggctaattgtccattccagagttcttccaagttagaagtggaacagtatccactaggat

SEQ ID NO: 10677 - DNA, 193 bp, Homo sapiens
  D6S449
  Located on chromosome 6
  Distance between a terminus base of telomere on chromosomal short arm and 5'-terminus of this base sequence : 107751666
  Distance between 3'-terminus of neighbour sequence of sequence listing upward to telomere on chrosomal short arm and 5'-terminus of this base sequence : 35369
tcaaaaaggttaagtaacaggtatgtatacatacatacagacagtacatgtacgcacacgcgcacgcacacgcagacacacacacaccacacacacacacacacacactcgagaaacagagagaaggaaaaagagacagtttctgattatttacaaatattttgctttatcattgtttgtcatactgtattga

SEQ ID NO: 10678 - DNA, 207 bp, Homo sapiens
  D6S1642
  Located on chromosome 6
  Distance between a terminus base of telomere on chromosomal short arm and 5'-terminus of this base sequence : 107898609
  Distance between 3'-terminus of neighbour sequence of sequence listing upward to telomere on chrosomal short arm and 5'-terminus of this base sequence : 146750
ccttattgaacttagaaaatggcaggaattcatatggagagttttacacacacacacacacacacacacacacacacacacaaacacatacaacttataattaagatataaaagaaaagtaaatgatacggtgccttaatatacagggtaattttgagttatactagatgtcaggagtggaagggcaagtcaggttaggactcacag

SEQ ID NO: 10679 - DNA, 356 bp, Homo sapiens
  AP002530.2_46918
  Located on chromosome 6
  Distance between a terminus base of telomere on chromosomal short arm and 5'-terminus of this base sequence : 107952252
  Distance between 3'-terminus of neighbour sequence of sequence listing upward to telomere on chrosomal short arm and 5'-terminus of this base sequence : 53436
cttaggaagcttagactgatcaaccattctgctgacatctgctattatattagttctaatctgattctttcgtgtttagattgaacatattttacacacttgtttgctttacttgccatttattatttatttcttcttatagacagtcttctgtggagtcctgttttcttctagaattacatatatattgtgtgtttatgtgtttgtgtgtgtgtgtgtgtgtgtgtaaagatctctcatcttgggatcaacattacaaataaaaacttaatttgagttcacataaaatcagaagcctgtatttaggaagtcaaaatttaagaagaaaacatgtttaggtgagcctgttaattatg

SEQ ID NO: 10680 - DNA, 142 bp, Homo sapiens
  D6S1709
  Located on chromosome 6
  Distance between a terminus base of telomere on chromosomal short arm and 5'-terminus of this base sequence : 107987201
  Distance between 3'-terminus of neighbour sequence of sequence listing upward to telomere on chrosomal short arm and 5'-terminus of this base sequence : 34593
gctacagaatgccatagaaattacaggaaaagaattaggtgactataactaaagggggtcacagtaaaataataccaacatacaccacacacacacacacacacacacacatacacaagcattggctaataatttttcaggt

SEQ ID NO: 10681 - DNA, 287 bp, Homo sapiens
  D6S283
  Located on chromosome 6
  Distance between a terminus base of telomere on chromosomal short arm and 5'-terminus of this base sequence : 107988341
  Distance between 3'-terminus of neighbour sequence of sequence listing upward to telomere on chrosomal short arm and 5'-terminus of this base sequence : 998
tttacaaaatcctgtcctgcttaagtaattacccttgtaatgtctacccttgtgagtgaatagataataagtaaggatttattttcaaaaagataataaacttgtgggttatcaattctagaaagaagctttagtgattaccaggggcaacgcacacacacacacacacacacacacacacacacagacacaaacacacacacacaaacacacacacagagaccgagagagagaaatcagcactatagacaagactatataatctgttgtatcaagacaactatcaa

SEQ ID NO: 10682 - DNA, 327 bp, Homo sapiens
  AB042030.1_61509
  Located on chromosome 6
  Distance between a terminus base of telomere on chromosomal short arm and 5'-terminus of this base sequence : 108031887
  Distance between 3'-terminus of neighbour sequence of sequence listing upward to telomere on chrosomal short arm and 5'-terminus of this base sequence : 43259
caggagttcaaagctaccataggcaacaaagtgaggtgagttcccatatctaaaagagaaacaaaaaaaagcagacaggcatggtggaatgctcccacacacccagagtcccagcctgagcaacagagcaaggccttctctctctctctctctctctctctctctctctctctctcccccccatttcttttacagtcagatttggtagtttgtgttttttaaggaatttatccatttcatctatattgtctaatttgtggccacacagctatacatattattcccttttaatcctttttttttctgttagattgtaggcaatcatct

SEQ ID NO: 10683 - DNA, 423 bp, Homo sapiens
  AB042030.1_64186
  Located on chromosome 6
  Distance between a terminus base of telomere on chromosomal short arm and 5'-terminus of this base sequence : 108034570
  Distance between 3'-terminus of neighbour sequence of sequence listing upward to telomere on chrosomal short arm and 5'-terminus of this base sequence : 2356
gactcttccaaactatgagcatagaatgtttttccattcatttgtgtcatctacagtttttttcatcaatgttttgtattttttcttttagagagctttacctacttgtttaaatgtattgctacatatttgtgtgtgtgtgtgtgtgtgtgtgtgtgtgggtccattgcaagtgagactgcattcttagtttggttctcagtttgtatgttattgattatagaaatgctactgacctttatacattgattttgtatcctgtaacttttctgaagttgtttaacaaatctagaagtcttttggatagtctttaggattttccagttgtaagattttatcatcagttaacatatatcatttgacgtcctcttttccaatttggatgccttttatttcttcctcttgcttgattcctgtagctag

SEQ ID NO: 10684 - DNA, 469 bp, Homo sapiens
  AP002530.2_146718
  Located on chromosome 6
  Distance between a terminus base of telomere on chromosomal short arm and 5'-terminus of this base sequence : 108052051
  Distance between 3'-terminus of neighbour sequence of sequence listing upward to telomere on chrosomal short arm and 5'-terminus of this base sequence : 17058
ctggacttgaggaaatagaaacagcatgtgtgaaaataagagtggaaaaagtggaaaaggcctaagagtggaaaaagacctagtgtgccaaaaatgaaggtcaaggtgggcaggtggagtcaggtagtttttaggccatttatttgtaaacagttattttatctatgtgtctatctgtctgtctgtctgtctatctatctatctgtctatctatctatctatctatctatctatctatctatccctccatccatccatccattcaactgtcatctatttaatctatttttctttggggttaaattatgaaagagcaaggagagaagagatttaaaaactataaagacagggaataattgataacataacatccctgagaaaattgaagaggatgatatacaaaaacaaaatcatttagttttggatggagggtagaggtagaggggtctgtcattgtattagaaggaga

SEQ ID NO: 10685 - DNA, 226 bp, Homo sapiens
  D6S434
  Located on chromosome 6
  Distance between a terminus base of telomere on chromosomal short arm and 5'-terminus of this base sequence : 108064511
  Distance between 3'-terminus of neighbour sequence of sequence listing upward to telomere on chrosomal short arm and 5'-terminus of this base sequence : 11991
agctcagggcttatgccagtattatagtgtgtgtgtgtgtgtgtgtgtgtgtgtgtgtgtgtgtgtgtgcgcgcgcgcgcgcgcgcgcgcgtgcgcgcacatgcaagagcattctcatgagtatgtgtagatatatgtgtgtttatgttttgtgagtgactactaaaaattaatcattatgtcttatacatttcctcacaccattatgattttgggggactacctg

SEQ ID NO: 10686 - DNA, 211 bp, Homo sapiens
  AB041340.1_4266
  Located on chromosome 6
  Distance between a terminus base of telomere on chromosomal short arm and 5'-terminus of this base sequence : 108082747
  Distance between 3'-terminus of neighbour sequence of sequence listing upward to telomere on chrosomal short arm and 5'-terminus of this base sequence : 18010
tcttggtacaatagttaggaaatgttagtagaaagggtatttgatttgagaaaagatgataaaccttttatatatatatatatatatatattttttttttttttgagacatacagtggagtacagtggtgtgatgatagctcattgcagcctggatctcccaggcataagcaattctgtcatctcaacctcttgagtagctggactacagg

SEQ ID NO: 10687 - DNA, 232 bp, Homo sapiens
  AP002530.2_222160
  Located on chromosome 6
  Distance between a terminus base of telomere on chromosomal short arm and 5'-terminus of this base sequence : 108127614
  Distance between 3'-terminus of neighbour sequence of sequence listing upward to telomere on chrosomal short arm and 5'-terminus of this base sequence : 44656
gcatcaggtcttatacatctgacatatgaagaggtttcactatgtaataactgtatgtactatgactgcctgcttccctccctcccttccttccttccttccttccttccttccttccttccttccttccttccttccttccttccactctctgcaagctaggacttttttttacttggtaaaagggatcttttggcaacttgtaaaaagataatttacaaacatgagttcc

SEQ ID NO: 10688 - DNA, 250 bp, Homo sapiens
  D6S1028
  Located on chromosome 6
  Distance between a terminus base of telomere on chromosomal short arm and 5'-terminus of this base sequence : 108145661
  Distance between 3'-terminus of neighbour sequence of sequence listing upward to telomere on chrosomal short arm and 5'-terminus of this base sequence : 17815
ctaaggcagaagatttaacatgcaattctaccagatcccttcctattcccccaacaccttttctctaacccccatatcccaaataataataataataataataataataataataataataataaaagcagttggttcagtgattctgaattaaaaggataatgttttgcaatgttcaagttgtaaaaactggccgagtattggctgtgtggaagactaaagctttcattctaacattcagacatagcaa

SEQ ID NO: 10689 - DNA, 239 bp, Homo sapiens
  DID22N_0028277
  Located on chromosome 6
  Distance between a terminus base of telomere on chromosomal short arm and 5'-terminus of this base sequence : 108268186
  Distance between 3'-terminus of neighbour sequence of sequence listing upward to telomere on chrosomal short arm and 5'-terminus of this base sequence : 122275
tggacttcagccataatttattagattgtatttttttctcttccttggtttattttgttgttgtggtggtggtggtggtggtggtggaatcagtcccgaaggtacttttaagaatggttatagggtagagtatggagtttatgtgtggaaggtttatgggaatgaatatttagctatagatttttaagtaatcttgagatttcagttttcctctttactgttatcatattatgcctgcc

SEQ ID NO: 10690 - DNA, 230 bp, Homo sapiens
  Z67250
  Located on chromosome 6
  Distance between a terminus base of telomere on chromosomal short arm and 5'-terminus of this base sequence : 108375042
  Distance between 3'-terminus of neighbour sequence of sequence listing upward to telomere on chrosomal short arm and 5'-terminus of this base sequence : 106617
cagtggtagagagtcgggtgggatgaatttttcaaccaatacacattccctgtaaataaaggtgcaatgtttttgagtttattttctttacatacatctaattatactctaattctcccctccccacaaacacacacacacacacacacacacttgccattagaattattaagtgatgattcactgaaaataatagaaatatgctacattcctcagataatagccacaga

SEQ ID NO: 10691 - DNA, 256 bp, Homo sapiens
  chr6.fa.O7frz.110554251
  Located on chromosome 6
  Distance between a terminus base of telomere on chromosomal short arm and 5'-terminus of this base sequence : 108498144
  Distance between 3'-terminus of neighbour sequence of sequence listing upward to telomere on chrosomal short arm and 5'-terminus of this base sequence : 122872
gcatgctttaggataaagaatcaaggtgcaaaaatcagcagcatctatacaccaataatggcaaagctgagagccagatcaagaacacaacctcattcacaatagacacacacacacacacacacacacctgggaatacaggtaacatgagaggtgaaagatgtctaaaatcagaattaaaaacactgttgaaagaaatcagagatggcacaaacaaatggagaaactttccatgcttatggatagtaagaatcaa

SEQ ID NO: 10692 - DNA, 214 bp, Homo sapiens
  AF191071.1_55125
  Located on chromosome 6
  Distance between a terminus base of telomere on chromosomal short arm and 5'-terminus of this base sequence : 108590996
  Distance between 3'-terminus of neighbour sequence of sequence listing upward to telomere on chrosomal short arm and 5'-terminus of this base sequence : 92596
cagcgtacatttattgtcttacagttctaaatgtcaaacatcttaaaatcacagtctcagctgggccatgtttcttttggaaggtacaggaaagttgtgtgtgtgtgtgtgtgtgtgtgtgtgtgtgtgtgtgtgtggtttttggtattgtttgccttttccagattgtaaatgtccagattatgcattccttgatgttggttacttcctttac

SEQ ID NO: 10693 - DNA, 388 bp, Homo sapiens
  AF191071.1_60000
  Located on chromosome 6
  Distance between a terminus base of telomere on chromosomal short arm and 5'-terminus of this base sequence : 108595830
  Distance between 3'-terminus of neighbour sequence of sequence listing upward to telomere on chrosomal short arm and 5'-terminus of this base sequence : 4620
agaagcgttagatgctaaattctcccttttctctttctggcatatgtattaaagttatatatctagcttcccttgctgggctatctatatgttgatctatctcttcctatatatctatattaatctctgtctacattatctatctatctatctatctatctatctatctatatctgtacaggtatctgtatctatatataattatccatatgtcatataattaaatctagccaatataaggtacagaagtgatttatatcaatttcaagactaacctctatcatgtgttaccaagctctcatttcttcagttgaaagaaataatttcggataccagagctacaagataaaaggagaggagtcaagataactaagactgagcttggaat

SEQ ID NO: 10694 - DNA, 350 bp, Homo sapiens
  chr6.fa.O7frz.110911752
  Located on chromosome 6
  Distance between a terminus base of telomere on chromosomal short arm and 5'-terminus of this base sequence : 108844293
  Distance between 3'-terminus of neighbour sequence of sequence listing upward to telomere on chrosomal short arm and 5'-terminus of this base sequence : 248075
gagattagaaacatagctttcattctaattttatacttcagataaaagagatagtttcctcttgtcgaaaaaccaccccaaagcaacaccatatatagaaaaacccatagtcatcatccatgagactaggagatgtctgtataccaaagttcacacacacacacacacacacacacacagacacacacacactatttatgtctatgttcatatggatatttatctatatgtatctgtgtgtacatgtaggtgcctgggagcaaactctaatgggaattttatgccgaaatttataaagtaaggctgacaaaatattgttttttaaagtaagtaggctcatctgaaattaa

SEQ ID NO: 10695 - DNA, 302 bp, Homo sapiens
  Z98755.1_140941
  Located on chromosome 6
  Distance between a terminus base of telomere on chromosomal short arm and 5'-terminus of this base sequence : 109017096
  Distance between 3'-terminus of neighbour sequence of sequence listing upward to telomere on chrosomal short arm and 5'-terminus of this base sequence : 172453
gtttatgactgaattacaccgaacttgtttctgcttcagtactttggcacttgctgtaccctatcctataagtatctttagcacatttctttgtatggcctgagatttgctcaaatttgtctctcagagagttactttctgacatttttttgctaaaatgccactcagtactttttattatcctatcatgattttttcccaccattaacagttatcattacctgaaacacacacacacacacacacacacacggtttattatttgtatttctcattaactataatgtaagctccattgccta

SEQ ID NO: 10696 - DNA, 255 bp, Homo sapiens
  Z98755.1_136287
  Located on chromosome 6
  Distance between a terminus base of telomere on chromosomal short arm and 5'-terminus of this base sequence : 109021828
  Distance between 3'-terminus of neighbour sequence of sequence listing upward to telomere on chrosomal short arm and 5'-terminus of this base sequence : 4430
tacttgtcagagatgaaaccagttctctaattgttatttttatagtcttatttccatgtcattttttgtaatgcctaatgattcttttattattttacctacctgtcttcataccctaacacacatacaccacacacacacacacacactctctctctctctctctctctctctgtagtggaaatttaacagttttatcaatgttgtccaggcccatattatttcctctacctcaactaaggaaataccattctg

SEQ ID NO: 10697 - DNA, 292 bp, Homo sapiens
  Z98755.1_101997
  Located on chromosome 6
  Distance between a terminus base of telomere on chromosomal short arm and 5'-terminus of this base sequence : 109056227
  Distance between 3'-terminus of neighbour sequence of sequence listing upward to telomere on chrosomal short arm and 5'-terminus of this base sequence : 34144
caggttggtagtcaacgaatagtaatggtaaggctgtgtgtgtgtgtgtgtgtgtgtgtgtgtgtataacaaaactataataaaaaaacaaacaatttttgaagtttatagtttattaagtttgtagtttgtttctgtgtcttgggaatgtgaattaaactttctgttctttgttttatttgtatttagaagtaaaacatagggtattagtaatatagtgatggaaataaaagcagagtgtgaagtagaaacaaaacctgtatatttttagcctgatacattcatgtgatac

SEQ ID NO: 10698 - DNA, 155 bp, Homo sapiens
  D6S1580
  Located on chromosome 6
  Distance between a terminus base of telomere on chromosomal short arm and 5'-terminus of this base sequence : 109092568
  Distance between 3'-terminus of neighbour sequence of sequence listing upward to telomere on chrosomal short arm and 5'-terminus of this base sequence : 36049
gggacttcttagcctccataatcacataagccaattccttaatagatcaatctttctttctttctacacacacacacacacacacacacacacacacacacacacacatcctattggttctgtttctctggagaactctaataccaaagaccctt

SEQ ID NO: 10699 - DNA, 282 bp, Homo sapiens
  Z98755.1_361
  Located on chromosome 6
  Distance between a terminus base of telomere on chromosomal short arm and 5'-terminus of this base sequence : 109157686
  Distance between 3'-terminus of neighbour sequence of sequence listing upward to telomere on chrosomal short arm and 5'-terminus of this base sequence : 64963
tctacatgcatttccaagaaacaggggaataacttagaaattcaacttttccaaagtaaatactctaagataaggaaaaatatcttcctatactttcaatagggagaattaaggttcttttatttgtatttgttcttatgtaacataagtcaaattcatttagtccatctccaaagttactttaaaaattaaagtccaatttttaaatgcacacacacacacacacacacacacacacacaccacattcatcctagaaaattcaatcctaaggttacctgtt

SEQ ID NO: 10700 - DNA, 282 bp, Homo sapiens; identical to SEQ ID NO: 10699
  AL009029.1_11754
  Located on chromosome 6
  Distance between a terminus base of telomere on chromosomal short arm and 5'-terminus of this base sequence : 109157686
  Distance between 3'-terminus of neighbour sequence of sequence listing upward to telomere on chrosomal short arm and 5'-terminus of this base sequence : -282

SEQ ID NO: 10701 - DNA, 240 bp, Homo sapiens
  AL009029.1_154316
  Located on chromosome 6
  Distance between a terminus base of telomere on chromosomal short arm and 5'-terminus of this base sequence : 109300391
  Distance between 3'-terminus of neighbour sequence of sequence listing upward to telomere on chrosomal short arm and 5'-terminus of this base sequence : 142423
gtgagtcacgatcacgctattgctctccagcctgggcaacagagcaagagaccatctcaaaaaaataaatgagagagagagagagagagagagagagaagactgtacattttcctttgagtgggattttattatttcataatatttaatctaaatgttttttcattgtttctctgaataattttaataatgctattttacttttttaatttaattttccgctgaatagtaattaacaatt

SEQ ID NO: 10702 - DNA, 239 bp, Homo sapiens
  D6S301
  Located on chromosome 6
  Distance between a terminus base of telomere on chromosomal short arm and 5'-terminus of this base sequence : 109317308
  Distance between 3'-terminus of neighbour sequence of sequence listing upward to telomere on chrosomal short arm and 5'-terminus of this base sequence : 16677
attaaatgtgcatacgcaaaagtcaagtttgatacataccttgaactataaacaaaaatcatagacgtatgtaaaacttctaggaaaaaaatatagaatctttgtaaatttaatgcattagtcaggattctccagagaaacagaatcagtagaatttctcataattaatatcgtgtgtgtgtgtgtgtgtgtgtgtgtgtgtgtgtgtgattgtggagaaattggcacatatgattgtg

SEQ ID NO: 10703 - DNA, 394 bp, Homo sapiens
  AL121937.7_32761
  Located on chromosome 6
  Distance between a terminus base of telomere on chromosomal short arm and 5'-terminus of this base sequence : 109317319
  Distance between 3'-terminus of neighbour sequence of sequence listing upward to telomere on chrosomal short arm and 5'-terminus of this base sequence : -228
atacgcaaaagtcaagtttgatacataccttgaactataaacaaaaatcatagacgtatgtaaaacttctaggaaaaaaatatagaatctttgtaaatttaatgcattagtcaggattctccagagaaacagaatcagtagaatttctcataattaatatcgtgtgtgtgtgtgtgtgtgtgtgtgtgtgtgtgtgtgattgtggagaaattggcacatatgattgtggaggctgagaattcccatgagatcagctagtttgaagccaaggaaagcttttagtataactcagttcaagtccaaagggctgagaaccatggaagccaatgccataaatccccagttcaagagctgaaggaaatgagatgagatgtttcagctcaaacagtgagac

SEQ ID NO: 10704 - DNA, 425 bp, Homo sapiens
  Z99290.1_6001
  Located on chromosome 6
  Distance between a terminus base of telomere on chromosomal short arm and 5'-terminus of this base sequence : 109421199
  Distance between 3'-terminus of neighbour sequence of sequence listing upward to telomere on chrosomal short arm and 5'-terminus of this base sequence : 103486
agttaaggagtttctacagccatctctgagctccaaaatttccttcgcccaaagcttctcttataaggcagaactcctgcttagtaaattctgccctcctttgtgggaggtagtagtttagtgggacttgtatgtgtgtgtgtgtgtgtgtgtgtgtgtgtatgtgtgtatttcttagatttagcacgtttgtgcttcacactctactcccaccagttagtttcttgctctatttatctgctctctatttaaaagtagtcaagatagaactttgtcctgtttgcaaatttgcccactcagagtggttatggctggtagatttctgccattgattgctaggccttctccattttcccagctattcactgttgtatggccacagcattgtcttcccatgaatgctctgatattgccaactgctttac

SEQ ID NO: 10705 - DNA, 218 bp, Homo sapiens
  D6S1692
  Located on chromosome 6
  Distance between a terminus base of telomere on chromosomal short arm and 5'-terminus of this base sequence : 109421295
  Distance between 3'-terminus of neighbour sequence of sequence listing upward to telomere on chrosomal short arm and 5'-terminus of this base sequence : -329
tcctttgtgggaggtagtagtttagtgggacttgtatgtgtgtgtgtgtgtgtgtgtgtgtgtgtatgtgtgtatttcttagatttagcacgtttgtgcttcacactctactcccaccagttagtttcttgctctatttatctgctctctatttaaaagtagtcaagatagaactttgtcctgtttgcaaatttgcccactcagagtggttatggctg

SEQ ID NO: 10706 - DNA, 349 bp, Homo sapiens
  AL049554.2_51829
  Located on chromosome 6
  Distance between a terminus base of telomere on chromosomal short arm and 5'-terminus of this base sequence : 109478920
  Distance between 3'-terminus of neighbour sequence of sequence listing upward to telomere on chrosomal short arm and 5'-terminus of this base sequence : 57407
aataaatgaccaatgcatttaaagtgtgatacaagaaaacatagagacttgacaggacttaaggaattttttttggtccttactgaagaaataattccacttaaaaagacaataatctaattttctgatgaggtgttttggagaacaattttctagtctttcagagggtatatatatatatatatatatatatatatatatatatatgtctccttgcagacaatgttttacatatcaattttgttttttctttcaaaaactcccagaaatttttaataaagtgtcagattggtttttcagaaagcactcatatttatcaacaaaagtagatttaaagacttcatggtgc

SEQ ID NO: 10707 - DNA, 128 bp, Homo sapiens
  DISD22_0002131
  Located on chromosome 6
  Distance between a terminus base of telomere on chromosomal short arm and 5'-terminus of this base sequence : 109697460
  Distance between 3'-terminus of neighbour sequence of sequence listing upward to telomere on chrosomal short arm and 5'-terminus of this base sequence : 218191
cactttctatgcacattggttcttatttttggaaataaaaaaatttaaaacatctattatacaagagttcatatatatatatatatatatgtataattctgattgatagatgtctttgactaccttgg

SEQ ID NO: 10708 - DNA, 183 bp, Homo sapiens
  DISD22_0002139
  Located on chromosome 6
  Distance between a terminus base of telomere on chromosomal short arm and 5'-terminus of this base sequence : 109845744
  Distance between 3'-terminus of neighbour sequence of sequence listing upward to telomere on chrosomal short arm and 5'-terminus of this base sequence : 148156
ttccaacttcggaaatgcagaaatgtcacacacacacacacacacacacacacacacacacacacacacacacaaacactgttttatagtacaggaaatatagaaatgcatttgtgcctaaatctcctacatattaatgagcttaaacttttcttttttccccacagtaaacaagctccttac

SEQ ID NO: 10709 - DNA, 317 bp, Homo sapiens
  AL021330.1_71972
  Located on chromosome 6
  Distance between a terminus base of telomere on chromosomal short arm and 5'-terminus of this base sequence : 110069747
  Distance between 3'-terminus of neighbour sequence of sequence listing upward to telomere on chrosomal short arm and 5'-terminus of this base sequence : 223820
gcctattcctactagaccttgtacctcataaaagcacaatctatgatttatttatctttatatactatgtcacctagcaaaagcactgacagtgttagtgttcagtaaacagtctctgaatagatgaatgaatgaatgaatgaatgaatgaatgaatgaatgtatgcatggatttcttccacatagtatgaggttgcagtgaactgccaaatgtttaactaaattgggtattaaggaatttctctctgtgtgtgtatgtgttcctgcatgtgtgtgtgtgtagctaactagaaagacatgaggacatttcattatgt

SEQ ID NO: 10710 - DNA, 183 bp, Homo sapiens
  D6S1015
  Located on chromosome 6
  Distance between a terminus base of telomere on chromosomal short arm and 5'-terminus of this base sequence : 110089497
  Distance between 3'-terminus of neighbour sequence of sequence listing upward to telomere on chrosomal short arm and 5'-terminus of this base sequence : 19433
catgtgattattcaagggtggctgttgctgaggcgtgggtgggagagcacaaagttgctgctgctgctgctcctgctgctgctgctgctgctgctgctgctgctgctgaacaagggagaaggttcgggatagactgggatgaggtgacctggttgcacatttctggggcatatagtgccatac

SEQ ID NO: 10711 - DNA, 397 bp, Homo sapiens
  AL021330.1_40454
  Located on chromosome 6
  Distance between a terminus base of telomere on chromosomal short arm and 5'-terminus of this base sequence : 110101213
  Distance between 3'-terminus of neighbour sequence of sequence listing upward to telomere on chrosomal short arm and 5'-terminus of this base sequence : 11533
ctgactcgttacggtaaagtctagcaagatgagaaacttgccactatgagaggacagtagagacggaggctattgaagaaccattggaaccagctcaatgggcctgcacttatctggcatatattctcagtaaggtaaagggggagaattcttcaaactatttaaaccagtgttttgtgtgtgtgtgtgtgtgtgtgtgtgtgtgtgtgtgtgttgtaatctaactatgatttatttttaacctaggccttctttcaaattcccagacgtttcaatatctccacctgaacatttcacagccatttgaaacataacattcaaatcagaattctgattttcccacttgaaaccatttcttcctgtagtcttttccatctcagcaacctttcactagttg

SEQ ID NO: 10712 - DNA, 440 bp, Homo sapiens
  AC009907.2_158651
  Located on chromosome 6
  Distance between a terminus base of telomere on chromosomal short arm and 5'-terminus of this base sequence : 110139535
  Distance between 3'-terminus of neighbour sequence of sequence listing upward to telomere on chrosomal short arm and 5'-terminus of this base sequence : 37925
ataccaacattgtaatgcagactattttagtagtagtatgattgaatgtgaagggagaaaaaattatcttatgtctagttctgccattcctaatagagtgtgactttgagcaagttgcttgatcttctgtaatttctaaagagtttggcctgctccaaaacttcaattcttctctaggaattaaatatgaaaggtaaatgatagagaaaagaaaatcataacaaagttactaaaactaaaaagagaaaaaatgaaatgagacaggtaagaaaaaatataacttacaagaataaatatttacagtgggcctttcagacttaaagtcctggcttatttcgttattgttgctgttgtgttgtgttgtgttgtgttgtgttgtgttgtgttgtgttgtgttgtgttttaggcttttagcagcctaaagccatggtttctagttt

SEQ ID NO: 10713 - DNA, 364 bp, Homo sapiens
  AL021330.1_1944
  Located on chromosome 6
  Distance between a terminus base of telomere on chromosomal short arm and 5'-terminus of this base sequence : 110139611
  Distance between 3'-terminus of neighbour sequence of sequence listing upward to telomere on chrosomal short arm and 5'-terminus of this base sequence : -364
agttctgccattcctaatagagtgtgactttgagcaagttgcttgatcttctgtaatttctaaagagtttggcctgctccaaaacttcaattcttctctaggaattaaatatgaaaggtaaatgatagagaaaagaaaatcataacaaagttactaaaactaaaaagagaaaaaatgaaatgagacaggtaagaaaaaatataacttacaagaataaatatttacagtgggcctttcagacttaaagtcctggcttatttcgttattgttgctgttgtgttgtgttgtgttgtgttgtgttgtgttgtgttgtgttgtgttgtgttttaggcttttagcagcctaaagccatggtttctagttt

SEQ ID NO: 10714 - DNA, 140 bp, Homo sapiens
  D6S1021
  Located on chromosome 6
  Distance between a terminus base of telomere on chromosomal short arm and 5'-terminus of this base sequence : 110296282
  Distance between 3'-terminus of neighbour sequence of sequence listing upward to telomere on chrosomal short arm and 5'-terminus of this base sequence : 156307
tgtccaggaatatcaccacaaagaagaaacatatcaattattattattattattattattattattatattattattattgtttccacgtaagaatcttgtcttagaaacttcaaaattatgactgcaaatgtcttccaa

SEQ ID NO: 10715 - DNA, 191 bp, Homo sapiens
  D6S1546
  Located on chromosome 6
  Distance between a terminus base of telomere on chromosomal short arm and 5'-terminus of this base sequence : 110302423
  Distance between 3'-terminus of neighbour sequence of sequence listing upward to telomere on chrosomal short arm and 5'-terminus of this base sequence : 6001
tttagcagcacctctggccactgcccactaggtgccagtaatacatatacatacacagacacagacacacacacacacacacacacacacacacacacacacacagagttatgactatcaaaaatgtctccacatgtttactaagtatctcatggggtagaaggcaaaatggccccttgttcaggattgag

SEQ ID NO: 10716 - DNA, 238 bp, Homo sapiens
  AL024505.1_33697
  Located on chromosome 6
  Distance between a terminus base of telomere on chromosomal short arm and 5'-terminus of this base sequence : 110331005
  Distance between 3'-terminus of neighbour sequence of sequence listing upward to telomere on chrosomal short arm and 5'-terminus of this base sequence : 28391
tctaagtggaaacatgttccagcagtgtcacatattggtttacataatgagctataattagatagatagatagatagatagatagatagatagatacatacatacatacatacatacatacatacatacatacatacatacgtaagtatggatttcagcatgtttcttggtctttctaaaataattgtgaaaatgattccctttcctagtaatggcagtccatggaaagtactcctga

SEQ ID NO: 10717 - DNA, 337 bp, Homo sapiens
  chr6.fa.O7frz.112069090
  Located on chromosome 6
  Distance between a terminus base of telomere on chromosomal short arm and 5'-terminus of this base sequence : 110430459
  Distance between 3'-terminus of neighbour sequence of sequence listing upward to telomere on chrosomal short arm and 5'-terminus of this base sequence : 99216
tctgagtgaagtattactgcagtaaatatgactgctttactggtgtctttcattttaagtcagtgtgtttatgttaatttataaagtcttagaaaactggaatcccttctctctcactctctctctctctctctccagatagacagatagatagatgacagatagatagatagatagatagatagatagatagatagatgatagatagatatatagatagatctgcctatcaatataatatcacaaatgttcggtaatgagcaaatgaattttggtggtgatagtgatggtggctttttaaagacaatcctaactcacctagtttggtttaggtact

SEQ ID NO: 10718 - DNA, 314 bp, Homo sapiens
  chr6.fa.O7frz.112213282
  Located on chromosome 6
  Distance between a terminus base of telomere on chromosomal short arm and 5'-terminus of this base sequence : 110557811
  Distance between 3'-terminus of neighbour sequence of sequence listing upward to telomere on chrosomal short arm and 5'-terminus of this base sequence : 127015
agttctgaaagctccttgtaacaaaagcaaagaaatttaatttactctttctctcgtctatatatatatatatatatatatataaaatgtatattaaacacatatacatacacacacatataaaataactgtatatatgttgtctatagacacatatagtttacatatacatagtgtatgtatacatattatatatattaatattctacttctgtggctaaaccctgagtaatagagaatttggtttgagaaaaaagtttttgaaaaaccttgtgtaattttatgacaggcttaatagaaggatttctgaggtc

SEQ ID NO: 10719 - DNA, 435 bp, Homo sapiens
  chr6.fa.O7frz.112454366
  Located on chromosome 6
  Distance between a terminus base of telomere on chromosomal short arm and 5'-terminus of this base sequence : 110718708
  Distance between 3'-terminus of neighbour sequence of sequence listing upward to telomere on chrosomal short arm and 5'-terminus of this base sequence : 160583
aaggctttcactcagctataagaatttaacccaaaaaggaaatacacagacacagacacacacacacacacacacacacagactcacacacagaataacaatagttgagactgagaagagcagcagagggggctaatagtcaaagaagagttgaaaaagatttaatttttactgtattcttttgtacattcagggtttttgtccaataaatgtgcattacatattcaagaagtcaataaatacgaattgcagtttttttaacctatgcttcaaatatgcataccctgtaacccagatatttctcttttaaatgtatgtacaaataaatgccaacaagtttatataaggatatttggtgcagtaatgtctgtaatacaaaagattagatgggatctaatttctctccaataggagaatggttcgataaattctagc

SEQ ID NO: 10720 - DNA, 241 bp, Homo sapiens
  G10189
  Located on chromosome 6
  Distance between a terminus base of telomere on chromosomal short arm and 5'-terminus of this base sequence : 110972094
  Distance between 3'-terminus of neighbour sequence of sequence listing upward to telomere on chrosomal short arm and 5'-terminus of this base sequence : 252951
ttttgccttttccagaatgccctatagttggaatcatccatccatccatccatccatccatccatccatccatccatcacacattctatgatgtgtagttggaattatacatcaacattttcagattggcttctttcacttaataatacgcatttaaagacccttcatgtcttttcatggcttgataactcgtttaattttagtggtgagtaatattccattgtctaaaaaactacagttt

SEQ ID NO: 10721 - DNA, 257 bp, Homo sapiens
  Z95329.1_64548
  Located on chromosome 6
  Distance between a terminus base of telomere on chromosomal short arm and 5'-terminus of this base sequence : 111123493
  Distance between 3'-terminus of neighbour sequence of sequence listing upward to telomere on chrosomal short arm and 5'-terminus of this base sequence : 151158
tctatcctagacagtggctcatgtgcacctgaaaagaatgaatattcagaagatgttgagtgcatggttctatagtgttaattagataatggtggtcgatagtgtagcccaaatctatgtcttatggtgtgtgtgtgtgtgtgtgtgtgtgtgtgtgcacgtgctcataaacttacttgttactggaaaggaatgttaaatttcaactgattgtggatttctctatttcttctttgagtgctaacattgtttgcttc

SEQ ID NO: 10722 - DNA, 360 bp, Homo sapiens
  Z95329.1_47320
  Located on chromosome 6
  Distance between a terminus base of telomere on chromosomal short arm and 5'-terminus of this base sequence : 111140715
  Distance between 3'-terminus of neighbour sequence of sequence listing upward to telomere on chrosomal short arm and 5'-terminus of this base sequence : 16965
ctaatgcctgtaatcctagcacattgggaggccaagatgggagggactgcttgagcccaggagttagacaccagcttgggcaacatggcaaaactctatctctatcaataaaaccacacacacacacacacacacacacacacacacacacacacacacacactggtggtgtatacctgtagtctcagctgctagagagtctgaggtagaggatgattgggtttgggaggtccgggctgcagtgagcccttatcacgccactgcactccagcctgggcaacagagctagaccttatctcaagaaaaataaaatgccctttcaccgtactattttccctggatgtaaccactctttatttg

SEQ ID NO: 10723 - DNA, 210 bp, Homo sapiens
  D6S1664
  Located on chromosome 6
  Distance between a terminus base of telomere on chromosomal short arm and 5'-terminus of this base sequence : 111155065
  Distance between 3'-terminus of neighbour sequence of sequence listing upward to telomere on chrosomal short arm and 5'-terminus of this base sequence : 13990
gatcccacctcagcctcccaaagtgttgagaatgcaggtgcaagctaccacacctggctgaaaatcttaaaaaaagaaaaaattatacataatcccatcgcctagaaataaccattagcatttttttattaattttcttctggttacacacacacacacacacacacacacacacacacacacacacagagatacatacacatgcgggtg

SEQ ID NO: 10724 - DNA, 160 bp, Homo sapiens
  Z67315
  Located on chromosome 6
  Distance between a terminus base of telomere on chromosomal short arm and 5'-terminus of this base sequence : 111170720
  Distance between 3'-terminus of neighbour sequence of sequence listing upward to telomere on chrosomal short arm and 5'-terminus of this base sequence : 15445
tgggcgacagagtgaaactccatctcaaaaaaaaaaaaaattatatgtatgtgtgtatgtatatatatgtatatatatatatatatgtatgtatgtatgtgtgtgtgtgtgtgtgtgtgtgtgtgtgtatatatggaataaagtttgagattccctgctt

SEQ ID NO: 10725 - DNA, 216 bp, Homo sapiens
  D6S1563
  Located on chromosome 6
  Distance between a terminus base of telomere on chromosomal short arm and 5'-terminus of this base sequence : 111296235
  Distance between 3'-terminus of neighbour sequence of sequence listing upward to telomere on chrosomal short arm and 5'-terminus of this base sequence : 125355
tgataaatgagaccctgtgaacagtgtcacattacttgtatcaagatacatctaagcgtcagtagcaaagacactccaaaatgccatgactttagtaatgaataataaataaaatgtctctctctctttctctctcacacacacacacagacacacacacacacacacacacacacacacacacacacacacacatagttccaaagtgagtgctgc

SEQ ID NO: 10726 - DNA, 455 bp, Homo sapiens
  chr6.fa.O7frz.113235537
  Located on chromosome 6
  Distance between a terminus base of telomere on chromosomal short arm and 5'-terminus of this base sequence : 111452260
  Distance between 3'-terminus of neighbour sequence of sequence listing upward to telomere on chrosomal short arm and 5'-terminus of this base sequence : 155809
tactgcagtcctacgaaataagccaggcacggaaagatgaatacctcatgctctcacttatatgttttatttaaaggagtcaaactcacagaagcagtaaaatggtgtttaccagaggcgggggttgggggagatgttggtaaaaggacacagagtttcagttagacaggagaaataagttcaagagatctattgtacaacatggtaactgcctgaaaattgctaagagggattttaagcgttctcaacacacacacacacacacacacacacacacacacacacacacaaagtatgtgaggtaattacacatatgttaaatagcttgatttagccatttcacaatttctacatatatcaaaatgacgtgctacacacctaaatatatacaattttcacctgtcaatttgaaaaattgacttacgaaatacagatacaggctcacttactgattg

SEQ ID NO: 10727 - DNA, 198 bp, Homo sapiens
  AL096794.3_73168
  Located on chromosome 6
  Distance between a terminus base of telomere on chromosomal short arm and 5'-terminus of this base sequence : 111561628
  Distance between 3'-terminus of neighbour sequence of sequence listing upward to telomere on chrosomal short arm and 5'-terminus of this base sequence : 108913
ccagctttaggacaatgttaacagaaaacttaaaaattgtttaaagaacatgaacaaagatgtcaatttgacaggatacaacacattgtattttgtatgtgcagttactgtgtgtgtgtgtgtatatatatatatatatatatatatttttttttttttttttttttcctgatatatttcctataccactggacattt

SEQ ID NO: 10728 - DNA, 421 bp, Homo sapiens
  Z97206.1_13426
  Located on chromosome 6
  Distance between a terminus base of telomere on chromosomal short arm and 5'-terminus of this base sequence : 111647992
  Distance between 3'-terminus of neighbour sequence of sequence listing upward to telomere on chrosomal short arm and 5'-terminus of this base sequence : 86166
cagtggcaacatctagaatttaacatttaacacaaccaagaaattaacattaataatatccaccaactttttaccagttttacatatgctcatttgcatgtgtgtacgtatatatgtgtgtggttagttctatgcagttttatcacatgtagatttgtatgactaccaccacagcaaaaatacagagcagtccatcacagaatccctcatgcttcccttttatggtcagttatctccctccctataatttttaaaacatatatatatatatatatacacacacacacacacacacacacacacacacacacacacacacacatcaatagcccactttaaaataataaaaacaggcttttgtcataacagaaaacacatatatacaccgtgataaaacttagcaagatatgtcaagaaactg

SEQ ID NO: 10729 - DNA, 206 bp, Homo sapiens
  D6S447
  Located on chromosome 6
  Distance between a terminus base of telomere on chromosomal short arm and 5'-terminus of this base sequence : 111656501
  Distance between 3'-terminus of neighbour sequence of sequence listing upward to telomere on chrosomal short arm and 5'-terminus of this base sequence : 8088
agaagggttctgtgcttgctaaatgtagtaactggcaattgaaccagtcctgacactctcccaaattagatgtatacgtgtgtgtgtgtgtgtgtgtgtgtgtgtgtgtgtgtgtggctgtgagagagcgagagaaagagagagaggcagggcctcactctgcttgctctgtcatacaggctggagtacagtggcatgatttcagc

SEQ ID NO: 10730 - DNA, 320 bp, Homo sapiens
  Z97206.1_37976
  Located on chromosome 6
  Distance between a terminus base of telomere on chromosomal short arm and 5'-terminus of this base sequence : 111672761
  Distance between 3'-terminus of neighbour sequence of sequence listing upward to telomere on chrosomal short arm and 5'-terminus of this base sequence : 16054
taactttcattagcaatttgctttatatcctcagttttctccccacagatgctcgctctatctatctatctatctatctatctatctatctatctatctatctatctaactatctatgtatctattttttatgagaatagaatctccttgatatactaataaattgcttttttattctactcaactacttttccatgtttgtttataaagatatcatgtttagtttttaaaactagactttaaaaattatataggtttacacagaataaagaacacagagaactctttattaaaaataaaagtgctttccttctgtcctc

SEQ ID NO: 10731 - DNA, 333 bp, Homo sapiens
  chr6.fa.O7frz.113582320
  Located on chromosome 6
  Distance between a terminus base of telomere on chromosomal short arm and 5'-terminus of this base sequence : 111773991
  Distance between 3'-terminus of neighbour sequence of sequence listing upward to telomere on chrosomal short arm and 5'-terminus of this base sequence : 100910
cttcatgaatggttatgtttaaacacacacatgcatacgcgcacacacacacgcacacgcacacacacacacatgcatgtgcgtgcacacacacaaacacacacacacacacacacacacacacacacacacacacagaaatgcaaactgaaatatttccaggtgaaatgacacgtcatctggtattgctttaaaatgcttcaggaaaaaaattagaagtacatctcagagttaatggaataataactgacattaataataataataataactgacatttattgagaacttactgtgagccattgaattaagtgctttacaactgagcataat

SEQ ID NO: 10732 - DNA, 206 bp, Homo sapiens
  D6S1592
  Located on chromosome 6
  Distance between a terminus base of telomere on chromosomal short arm and 5'-terminus of this base sequence : 111985295
  Distance between 3'-terminus of neighbour sequence of sequence listing upward to telomere on chrosomal short arm and 5'-terminus of this base sequence : 210971
gcaaatgattttgtttaatccaagttacatgaaaactgtgtgtgtgtgtgtgtgtgtgtgtgtgtgtgtgtgtgtgtgtgtgtgtgtatgtgtgagacagagtctcatcccgtcacccagactggagtgcagtggcccaatcttggctcgttgcaacctgtgcctctgggttcaagcaattctcctgcctcggcctcctgagtagc

SEQ ID NO: 10733 - DNA, 396 bp, Homo sapiens
  chr6.fa.O7frz.115372461
  Located on chromosome 6
  Distance between a terminus base of telomere on chromosomal short arm and 5'-terminus of this base sequence : 112201901
  Distance between 3'-terminus of neighbour sequence of sequence listing upward to telomere on chrosomal short arm and 5'-terminus of this base sequence : 216400
gtctgtttatcttcagtacagacacaatcatccattttctttcccaaatgttttttatctgctgtgggcatgatggggagcccatggatatgaagggccaatgtgtatgtattatacacatatgtatatctcaagtattcaagtgtatatgtgtgtgtgtgtgtgtgtgtgtgtgtgtgtctcaacagtggtctctatcagttaatggattatgggcagttttattgttttctgcattttcttggtgttctttatgttgtaataaagaaaaacagaattcagaaattttaaaatttgtcccttgcttgcaggaaaacagccttaacctaagttacaaaattagcgccatgaaacaggtcaagtttttgaacgaacttgtagattgtcaaagcctaa

SEQ ID NO: 10734 - DNA, 295 bp, Homo sapiens
  chr6.fa.O7frz.115276001
  Located on chromosome 6
  Distance between a terminus base of telomere on chromosomal short arm and 5'-terminus of this base sequence : 112298313
  Distance between 3'-terminus of neighbour sequence of sequence listing upward to telomere on chrosomal short arm and 5'-terminus of this base sequence : 96016
taatgagcaattagttgcattcaggggatgttgaccattttagatacctttaaaactagaaaaatatgaaatgaaaatgtaaatttgctgtacttaaacctgtattaaaatttctaataaagttgttatacactattcctttattctaaattctctaaattatttgcaaaatgacttaaacacacacacacacacacacacacacacacacacacacacacacacacatatatattttaaagttcattggggctgggcatggtggcttatgcctgtaatcctagcactatggaag

SEQ ID NO: 10735 - DNA, 420 bp, Homo sapiens
  AL109920.15_81320
  Located on chromosome 6
  Distance between a terminus base of telomere on chromosomal short arm and 5'-terminus of this base sequence : 112423004
  Distance between 3'-terminus of neighbour sequence of sequence listing upward to telomere on chrosomal short arm and 5'-terminus of this base sequence : 124396
cttagtcttcacatgaccaagtagttgttaaattcttgagtgcagggatcttggtttaatacctttctaatcaaaatcccaatagggttttgttatttatttatttatttatttatttttgagacatggtctcacttggtcacctaggctggaatgcagtggcaccatcatgtctcactgcagtcttgacctccccaagctcaggtgatcctgccacctcagcctctgagtagctgggaccacaggcctgagccaccatgcccagctaatttttgtattgttttttagagagcgtgtttcaccatattgcccaggctgatattgaacttctggcctcaagtaatccacccccctcccagcctcccaaagtgctgggattataggtgtgggccaccccatctgacctatttgttcaagaat

SEQ ID NO: 10736 - DNA, 431 bp, Homo sapiens
  AL080314.29_140986
  Located on chromosome 6
  Distance between a terminus base of telomere on chromosomal short arm and 5'-terminus of this base sequence : 112716141
  Distance between 3'-terminus of neighbour sequence of sequence listing upward to telomere on chrosomal short arm and 5'-terminus of this base sequence : 292717
tttgtcctgtttacctatttcaagtctaatgaaaatgtcaattctcttttaaaagacttaggaaagacgtcacacactggcatcctgtgagctgctgcagccctcagatttgttttgtatgagcagcaggttttttcattgtgtttttgtttttgtttttttcaatgaattcactgccagtcttcaaaactctgccctcagatttgttttgtatgagcagcaggttttctcattttgtgtgtgtgtgtgtgtgtgtgtgtgtgtgtgtgtgtgtgtgtgtttaatgaattcagagtctctaaaaaaaactaagaaaatctaacagaaaagtctggacttctagtttttcttggaaaaaaagattgtctggctatcctgggcccaaattccctcatgctgacaagtggcaagactgaacagcaactgtttct

SEQ ID NO: 10737 - DNA, 334 bp, Homo sapiens
  DISO7_00035151
  Located on chromosome 6
  Distance between a terminus base of telomere on chromosomal short arm and 5'-terminus of this base sequence : 112809042
  Distance between 3'-terminus of neighbour sequence of sequence listing upward to telomere on chrosomal short arm and 5'-terminus of this base sequence : 92470
ttcctgcactttgcctaataaaaaagcccgattggctcttttcaggggagtcagtcagggaatctctctctctctctctctctctcactgcctcctttatgttcaggcataaatttctattgcattaagagcccaagaacccataatggataacatattctttgggggctcatccaggatcacaggatgtatggagcctttctcatcccaaggggaagacttgtgagctgagagaactgctggacaagatcccttcgcagctgacaagcagctgcctgaactactgactcagtgtcaccatgagtctttctccggcctcctggacttcctcacc

SEQ ID NO: 10738 - DNA, 142 bp, Homo sapiens
  chr6.fa.O7frz.114640467
  Located on chromosome 6
  Distance between a terminus base of telomere on chromosomal short arm and 5'-terminus of this base sequence : 112887423
  Distance between 3'-terminus of neighbour sequence of sequence listing upward to telomere on chrosomal short arm and 5'-terminus of this base sequence : 78047
gatagaacacaggatacatttcactgagtggccctacaaacagcgcagttaattctgcttgcttgtgttttgtgtgctgtgtgtgtgtgtgtgtgtgtgtgtgtgtgtgtgtgtgttttatgtatgaaagtataagccaggt

SEQ ID NO: 10739 - DNA, 471 bp, Homo sapiens
  chr6.fa.O7frz.114973205
  Located on chromosome 6
  Distance between a terminus base of telomere on chromosomal short arm and 5'-terminus of this base sequence : 113070027
  Distance between 3'-terminus of neighbour sequence of sequence listing upward to telomere on chrosomal short arm and 5'-terminus of this base sequence : 182462
gctaaggcaggagaatcacttgaacccgggaggcggaggtggcagtgagtgccactgcactccagcctgggcaacagagcgtctcaaaaaaaaaaaagaagagggaaggattagccactagggaggcttaggtgggaggatcacttgagtcttggaggtggaggttgcagtgagctgtgactgcaccactgtaccatagcttaggcgacagagtgagactgtgtctcaaaaataaataaataaataaataaagagggagggaaggaggaaataagaaagcaaaaagaatagaaaatatcaaagtgtactgcacaaagtaaatcaagttaagagttttgtttcattactatgtgtatgtctaaatacttatttacaaattcatacaggtaagttgtattgctctataaggtgatttataactgtgggtcactgtggaaaaccattgccctaacaaatacaaagtgccttact

SEQ ID NO: 10740 - DNA, 367 bp, Homo sapiens
  chr6.fa.O7frz.115850451
  Located on chromosome 6
  Distance between a terminus base of telomere on chromosomal short arm and 5'-terminus of this base sequence : 113331949
  Distance between 3'-terminus of neighbour sequence of sequence listing upward to telomere on chrosomal short arm and 5'-terminus of this base sequence : 261451
gcaagaactctaagaggtgaaccttgagacaagtctgaccaaatcacacagatttaacagccctgacaacagttttaacaatatcttcaaacttctcagaaataggacctttcacataccacacacacacacacacacacacacacacacacacacaaataataataatagcagcagcaaacacttatattgtggtttatacattgctttctatatgtcagaaactgttctacatgttttactatatattaactaaattaattcacaatgctaagaggagggtactacaattatcctgattttacagatggggaatgaggcacagagagaaatcaagtaacttgtctaaggtaccatacctggtagg

SEQ ID NO: 10741 - DNA, 100 bp, Homo sapiens
  D6S268
  Located on chromosome 6
  Distance between a terminus base of telomere on chromosomal short arm and 5'-terminus of this base sequence : 113430280
  Distance between 3'-terminus of neighbour sequence of sequence listing upward to telomere on chrosomal short arm and 5'-terminus of this base sequence : 97964
ctaggtggcagagcaacatactgcctcaaaacacacacacacacacacacacacacacacacacacacacacacacacacgattaaaatgacctcctttt

SEQ ID NO: 10742 - DNA, 170 bp, Homo sapiens
  Z16599.1_59
  Located on chromosome 6
  Distance between a terminus base of telomere on chromosomal short arm and 5'-terminus of this base sequence : 113430282
  Distance between 3'-terminus of neighbour sequence of sequence listing upward to telomere on chrosomal short arm and 5'-terminus of this base sequence : -98
aggtggcagagcaacatactgcctcaaaacacacacacacacacacacacacacacacacacacacacacacacacacgattaaaatgacctcctttttgtgtactcataaaattgtaccatgcatactccattgtcatatagtcacacttgatttgaatcatggtcact

SEQ ID NO: 10743 - DNA, 377 bp, Homo sapiens
  chr6.fa.O7frz.116033997
  Located on chromosome 6
  Distance between a terminus base of telomere on chromosomal short arm and 5'-terminus of this base sequence : 113516731
  Distance between 3'-terminus of neighbour sequence of sequence listing upward to telomere on chrosomal short arm and 5'-terminus of this base sequence : 86279
gtgttgagcacatacctaagatagaattattgccttggctccctccattcccccactgggtatccaacacccaaggtgcacctagtaaggatgcttttcttctccttgtgctgaggtcccaggtcagacattttattctagtgagcaaaacagatatgctcctgtcttaacctggctcatagtctggtggaagagacagacattaaaacacacacacacacacacacacacacacacacacacacacacacacacacaaactcaatcaagtctgagaattaccaagtccagagtgctgtcggatctgaccaggtttggggtcagggaaggtctccctaggatgaggtttaagataagatacaaaggactgaattcat

SEQ ID NO: 10744 - DNA, 369 bp, Homo sapiens
  AL096816.12_95584
  Located on chromosome 6
  Distance between a terminus base of telomere on chromosomal short arm and 5'-terminus of this base sequence : 113626792
  Distance between 3'-terminus of neighbour sequence of sequence listing upward to telomere on chrosomal short arm and 5'-terminus of this base sequence : 109684
gtaatcagttcaggctcttatgatgaaatctttaattactagaagtgtgtcattagttagatgtagaatgaatgatagtaccgtgttttattgcctcacatgatatagccatttgtgccataaattcattgacctcatcttaaatgatgagtcctgtaagacagacttgattcattatttcttaagtgacagtttttcctctaataattttttgcttcaccagaaagattgcttttctgtatttttagatcagtattctgaattgaaatttaataaggcaaggacacacacacacacacacacactctgtctctctctctctctctctctctctctctctctcacgttaccgaaaacaagatagtcatg

SEQ ID NO: 10745 - DNA, 364 bp, Homo sapiens
  AL096816.12_69961
  Located on chromosome 6
  Distance between a terminus base of telomere on chromosomal short arm and 5'-terminus of this base sequence : 113652390
  Distance between 3'-terminus of neighbour sequence of sequence listing upward to telomere on chrosomal short arm and 5'-terminus of this base sequence : 25229
aagattcagtcactcttggttccaggcccagaggtggggatggcttccctccctccatagcaacttccaggctgtgcttgctaaatgcaaaagaattgttcccagaagaagtgaccccggtgtctttggatccacttgtcatctctgcagctcctcaatttttgtggcctcacatttgatagtggctcttggtgcttttatttttgtatcccctctctccattgtcacttattcttgagaaagaaagaaaagaaagaaagaaagaaagaaagaaagaaagaaagaaagaaagaaagaaagaaagagaaagaaagaaagaaagaaagaaagtaagtcaaatgtgagctctttattcagaaataaa

SEQ ID NO: 10746 - DNA, 452 bp, Homo sapiens
  chr6.fa.O7frz.116405539
  Located on chromosome 6
  Distance between a terminus base of telomere on chromosomal short arm and 5'-terminus of this base sequence : 113840217
  Distance between 3'-terminus of neighbour sequence of sequence listing upward to telomere on chrosomal short arm and 5'-terminus of this base sequence : 187463
tgctggcaatgtactgttagccagctttgggaaaatgcactgtgctttctccaccactgagaggaagagagagagagagagagagagaagcaaaacaaagcaaaaacaatggggaaatgtttttaaagtttaaaggcaaagagaaaaataatgatggcagattgggtgggagaaatcatcaaggatacagtatgaaaagacagaacaaaatgagtatgtgcttgcaaaagaaaagctagatgctagacagaggagaatttaaaaataaaatgtaaaccatgcaacaaagctattaaatgatgggaaacagacatgaatttgtgtaaggaagagaaagggagacgatgagtctgacagcaagaaaactcgatgggatatttgttgtggagggagagtgccaaggacggaaggcagaaaaaagggcgctggtcctcaagtacagaagtagaatg

SEQ ID NO: 10747 - DNA, 155 bp, Homo sapiens
  Z67148
  Located on chromosome 6
  Distance between a terminus base of telomere on chromosomal short arm and 5'-terminus of this base sequence : 113996312
  Distance between 3'-terminus of neighbour sequence of sequence listing upward to telomere on chrosomal short arm and 5'-terminus of this base sequence : 155643
gcccttacacaaacaggagaatgaagtgcaagagaggcattataaagggccatgggaaagagaggtgtatgtggatgcatgtgctctggggtgtgtgtgtgtgtgtgtgtgtgtgtgtgtgtgtgtgtgtaacaaaaagcagacctcacagagga

SEQ ID NO: 10748 - DNA, 259 bp, Homo sapiens
  AL138829.4_589
  Located on chromosome 6
  Distance between a terminus base of telomere on chromosomal short arm and 5'-terminus of this base sequence : 113996323
  Distance between 3'-terminus of neighbour sequence of sequence listing upward to telomere on chrosomal short arm and 5'-terminus of this base sequence : -144
aacaggagaatgaagtgcaagagaggcattataaagggccatgggaaagagaggtgtatgtggatgcatgtgctctggggtgtgtgtgtgtgtgtgtgtgtgtgtgtgtgtgtgtgtgtaacaaaaagcagacctcacagaggaagtgtcattttagaagtcttgaaggaggaggccgggcatgatggctcatgcctgtaatcccagcactttgggaggctgagacaggtggataccctgaggtaaggagttcaaaacc

SEQ ID NO: 10749 - DNA, 234 bp, Homo sapiens
  Z98200.8_147934
  Located on chromosome 6
  Distance between a terminus base of telomere on chromosomal short arm and 5'-terminus of this base sequence : 114003321
  Distance between 3'-terminus of neighbour sequence of sequence listing upward to telomere on chrosomal short arm and 5'-terminus of this base sequence : 6739
tgaattcctgacctcgagtgatctacctgccttggcctcccaaagtgctggggttacaggtgtgagccaccgcctggtgcatgatctttttaaattttatacacacacacacacacacacacacacacacacacacacacacacgcaaaagcattgtacgtggatgcattcctcctcctatttataggaatgccctactctgtctgtggagtagctgttctttcaccactttac

SEQ ID NO: 10750 - DNA, 135 bp, Homo sapiens
  D6S278
  Located on chromosome 6
  Distance between a terminus base of telomere on chromosomal short arm and 5'-terminus of this base sequence : 114003392
  Distance between 3'-terminus of neighbour sequence of sequence listing upward to telomere on chrosomal short arm and 5'-terminus of this base sequence : -163
gcctggtgcatgatctttttaaattttatacacacacacacacacacacacacacacacacacacacacacacgcaaaagcattgtacgtggatgcattcctcctcctatttataggaatgccctactctgtctg

SEQ ID NO: 10751 - DNA, 203 bp, Homo sapiens
  Z67377
  Located on chromosome 6
  Distance between a terminus base of telomere on chromosomal short arm and 5'-terminus of this base sequence : 114083960
  Distance between 3'-terminus of neighbour sequence of sequence listing upward to telomere on chrosomal short arm and 5'-terminus of this base sequence : 80433
atgaccatgtgaccagttatagaaattaggaatataattattatgagtatttctccatattttgttatgaatatgtatatatatatacatatacacatatatatatacacatacacacacacacacacacacacacaccccaaatatctttattttcttctctcttttattctcttataagatatattgactttaggctgggc

SEQ ID NO: 10752 - DNA, 334 bp, Homo sapiens
  Z98200.8_46128
  Located on chromosome 6
  Distance between a terminus base of telomere on chromosomal short arm and 5'-terminus of this base sequence : 114105148
  Distance between 3'-terminus of neighbour sequence of sequence listing upward to telomere on chrosomal short arm and 5'-terminus of this base sequence : 20985
gaggattgcttgaactggtaggtcaaggctgcagtgagctgagattgtgccactgcactccagcatgggtgacagagggagaccctgtctcaaaatacacacacacacacacacacacacacactcacacaaaactttatctaccttagtgtctcagtttgtttgtgcttctataagaaaatgcctgagatggggtaatttataaacaatagaaatttattttcacatagttctagaggctgggaagtccaagatcaaggcactggcaggtttggaggctggtgaaggcatattcctcagagatgatgccatcgaggtatccttacatggcaga

SEQ ID NO: 10753 - DNA, 197 bp, Homo sapiens
  Z98200.8_38892
  Located on chromosome 6
  Distance between a terminus base of telomere on chromosomal short arm and 5'-terminus of this base sequence : 114112426
  Distance between 3'-terminus of neighbour sequence of sequence listing upward to telomere on chrosomal short arm and 5'-terminus of this base sequence : 6944
agcctatagatactggtatgcagaaaggggtggggtggaaggggtgtgtgtgtgtgtgtgtgtgtgtgtgtgtgtgtgtgtgagagagagagagagagagagagagaaagagacagagaaagagagagagagttattcccagaacatgaggctctgtgtctcaaagtgcctttttcgaggcttccacctttaagact

SEQ ID NO: 10754 - DNA, 325 bp, Homo sapiens
  AL078596.8_545
  Located on chromosome 6
  Distance between a terminus base of telomere on chromosomal short arm and 5'-terminus of this base sequence : 114151785
  Distance between 3'-terminus of neighbour sequence of sequence listing upward to telomere on chrosomal short arm and 5'-terminus of this base sequence : 39162
tagccaagatcgtttcactacactccagcctgggcgacagagcaagactctgtctcaaaaataaataaataaataaataaataaataaataaataaataaataaataagagtaattcaaggccttgaatatcaaccagagtgagtgacagaaaggcttgataccagtatgtcactcacacctttcatgggtagacctttccaaaatcacccagtgtccccctctctgaagaccttcatctgtaaaacagaaataagaagcaactgtgctgaatgttcttagaaggtgtggtcataaactctattaatagacagtagagcctgttg

SEQ ID NO: 10755 - DNA, 400 bp, Homo sapiens
  AL078596.8_30462
  Located on chromosome 6
  Distance between a terminus base of telomere on chromosomal short arm and 5'-terminus of this base sequence : 114181654
  Distance between 3'-terminus of neighbour sequence of sequence listing upward to telomere on chrosomal short arm and 5'-terminus of this base sequence : 29544
attgatgctaatggatgaagacaagggcatagatattctaaaaaataattttgattagtcagaccttctctctctaacacacacacacacacacgcacacacacatacacacacacacacacacacacattgtttttgttttggatgcccaggctgcattgcagtggtgcaatcatggctcactgcaacctctgcctctgaggctcaagcaattctcccacctctgccttctgagtatctgggactacaggtgcccagcgaatttttgtagagatgagcccttgctatgttgcccaggctcatcttgaactcctgggctcaagcgatgctcttgcctcagcctcccaaagtgctgggattacaggtatgagccaccacacctgacctcatacattgctat

SEQ ID NO: 10756 - DNA, 213 bp, Homo sapiens
  AL078596.8_33555
  Located on chromosome 6
  Distance between a terminus base of telomere on chromosomal short arm and 5'-terminus of this base sequence : 114184728
  Distance between 3'-terminus of neighbour sequence of sequence listing upward to telomere on chrosomal short arm and 5'-terminus of this base sequence : 2674
taattgcagaaggaacttcaaggagatgaatgaatgctaaaagggttcttgactgatccattgctaacagcctgagactcttcaatgcctttccgaaaactggtttctagtaaagccttgaatgaacacacacacacacacacacacacacacacacacacacacacacacacaccgtcctacactttaagctgctcctttggtatgactcta

SEQ ID NO: 10757 - DNA, 134 bp, Homo sapiens
  D6S1594
  Located on chromosome 6
  Distance between a terminus base of telomere on chromosomal short arm and 5'-terminus of this base sequence : 114184787
  Distance between 3'-terminus of neighbour sequence of sequence listing upward to telomere on chrosomal short arm and 5'-terminus of this base sequence : -154
attgctaacagcctgagactcttcaatgcctttccgaaaactggtttctagtaaagccttgaatgaacacacacacacacacacacacacacacacacacacacacacacacacaccgtcctacactttaagct

SEQ ID NO: 10758 - DNA, 198 bp, Homo sapiens
  Z98742.5_37204
  Located on chromosome 6
  Distance between a terminus base of telomere on chromosomal short arm and 5'-terminus of this base sequence : 114282929
  Distance between 3'-terminus of neighbour sequence of sequence listing upward to telomere on chrosomal short arm and 5'-terminus of this base sequence : 98008
tcctcgtaaagatatctgcactcccatgttctttgcagcattagtcacaatagccaagatgtggagacaacctgtgtccatagacagttgaatgaataaagaaaatgtagcacgtgcgtgcacacacacacacacacacacacacacacacactggagtattattttatttttttgagaaggaatttcactctgattg

SEQ ID NO: 10759 - DNA, 189 bp, Homo sapiens
  D12S1054
  Located on chromosome 6
  Distance between a terminus base of telomere on chromosomal short arm and 5'-terminus of this base sequence : 114440309
  Distance between 3'-terminus of neighbour sequence of sequence listing upward to telomere on chrosomal short arm and 5'-terminus of this base sequence : 157182
ttcattttgaatgcaaacaaaatgtcagcctatagttgtttcttgacttgtcctgaaatcccttagtcaccattcttctactgaagtgaatatctcccatctatctatctatctatctatctatctatctatctatctatctatatctgcacaggcataccttagagatatcgagggtttggttctagg

SEQ ID NO: 10760 - DNA, 367 bp, Homo sapiens
  AL096818.9_6713
  Located on chromosome 6
  Distance between a terminus base of telomere on chromosomal short arm and 5'-terminus of this base sequence : 114687403
  Distance between 3'-terminus of neighbour sequence of sequence listing upward to telomere on chrosomal short arm and 5'-terminus of this base sequence : 246905
ggaaggtctttctgatgaagacaggaggccagagtgatttgctgctagtttgaagggggcaggaagtagtgacagcctggaatccacctgtgtgaggcagggaaactgtcccctggggtgtgtgtatgtgtgtgtgtgagagcgagagagagagagagagagagagagagagagagagaggaggggaggggaggggaggggaggggagaggagaggaggcctctgatgttgccgtctcttgatcagtgcagatggcatttccacagcaaacccctcctgcccagggcactgttgtggccctcccaggtgtttggataagagtttaattaagaacctaccagggtggtctgaagcttaattgctatgc

SEQ ID NO: 10761 - DNA, 261 bp, Homo sapiens
  Z95118.1_20703
  Located on chromosome 6
  Distance between a terminus base of telomere on chromosomal short arm and 5'-terminus of this base sequence : 114714704
  Distance between 3'-terminus of neighbour sequence of sequence listing upward to telomere on chrosomal short arm and 5'-terminus of this base sequence : 26934
ctggaaatagattgaaatcgttaggcttaatggaaagctgggtaagatactatgatttttttgagaaacaagaagtcaggctgaaaggaaatgcctgctataattagagaaaattaagatttaatccagtaaataccaatgcaaacaattcttcccttctctctctctctctctctctctctctctctctctcgtgtgtgtgtgtgtgtgtgtgtatttctttcatttctcttttaaaactttaaaccagtggctcctagt

SEQ ID NO: 10762 - DNA, 162 bp, Homo sapiens
  Z95118.1_43212
  Located on chromosome 6
  Distance between a terminus base of telomere on chromosomal short arm and 5'-terminus of this base sequence : 114737325
  Distance between 3'-terminus of neighbour sequence of sequence listing upward to telomere on chrosomal short arm and 5'-terminus of this base sequence : 22360
tgcagaagtagctcctaaatctataaatctacacgcttatagaaatggactatagcttgctgaaggaactggaagaaactggtgtgtgtgtgtgtgtgtgtgtgtgtgtgtgttttatttgtggctatcatagaagttaaactggttctaatttctaaacca

SEQ ID NO: 10763 - DNA, 195 bp, Homo sapiens
  chr6.fa.O7frz.117548383
  Located on chromosome 6
  Distance between a terminus base of telomere on chromosomal short arm and 5'-terminus of this base sequence : 115148946
  Distance between 3'-terminus of neighbour sequence of sequence listing upward to telomere on chrosomal short arm and 5'-terminus of this base sequence : 411459
ggtatggttataaatgccactacaaaatagcatatagatgtgcgtgcgtgtgtgtgtgtgtgtgtgtgtgtgtgtgtgtgtgtgtgtgtgtataactttccttttctctgtgttcttatgttttattcctctgatagctgcttttctatgttagagagagggtaagttaatgagtatgtttggtcaccttgtaaa

SEQ ID NO: 10764 - DNA, 102 bp, Homo sapiens
  DISO7_10002210
  Located on chromosome 6
  Distance between a terminus base of telomere on chromosomal short arm and 5'-terminus of this base sequence : 115331292
  Distance between 3'-terminus of neighbour sequence of sequence listing upward to telomere on chrosomal short arm and 5'-terminus of this base sequence : 182151
tgggtcttagacttggccccataaactttctcaccccccatccctgcagatagatacacacacacacacacacacacacacactcattgatgcacagaggga

SEQ ID NO: 10765 - DNA, 241 bp, Homo sapiens
  chr6.fa.O7frz.118083972
  Located on chromosome 6
  Distance between a terminus base of telomere on chromosomal short arm and 5'-terminus of this base sequence : 115496275
  Distance between 3'-terminus of neighbour sequence of sequence listing upward to telomere on chrosomal short arm and 5'-terminus of this base sequence : 164881
taatcgatgcatagtattccactgtataaacatacatgtagtttactcaaccatttatctattggtgaatgttttggccgttttagttcttagctattatagactatatatatgatacacacacacacacacacacacacacacacacacacacaatttatacctgtgtatacccgcacatttataaacttgctacatttaaaaaaaacctatgggctagatttcaggaagtgcaaatagt

SEQ ID NO: 10766 - DNA, 213 bp, Homo sapiens
  chr6.fa.O7frz.118193058
  Located on chromosome 6
  Distance between a terminus base of telomere on chromosomal short arm and 5'-terminus of this base sequence : 115603970
  Distance between 3'-terminus of neighbour sequence of sequence listing upward to telomere on chrosomal short arm and 5'-terminus of this base sequence : 107454
ataatccactgaggatatccactgagggtactgagggatggctgtacaaatattttatgttcatggattataagactcaatattgtaaagatgatagtcttaaccaaatttatctaatagatacaatgcaacccgatcaaaatcccagcagaggggtgtgtgtgtgtgtgtgtgtgtgtgtgtgtgtgtgtgaaaattgagtagctcattcta

SEQ ID NO: 10767 - DNA, 202 bp, Homo sapiens
  AL133472.12_23006
  Located on chromosome 6
  Distance between a terminus base of telomere on chromosomal short arm and 5'-terminus of this base sequence : 115691886
  Distance between 3'-terminus of neighbour sequence of sequence listing upward to telomere on chrosomal short arm and 5'-terminus of this base sequence : 87703
gatactgttctttagctttccagaaagtcaacgagcaaaatgcagtgaatacacacacacacacacacacagacacacacacacacacacacacaatgttgccatgacctttcctcttggcccgtctgctttgctttaattggaccactgccacctgttggtagccattgctttggttgtgctttgactttaggatcatact

SEQ ID NO: 10768 - DNA, 196 bp, Homo sapiens
  D6S498
  Located on chromosome 6
  Distance between a terminus base of telomere on chromosomal short arm and 5'-terminus of this base sequence : 115977682
  Distance between 3'-terminus of neighbour sequence of sequence listing upward to telomere on chrosomal short arm and 5'-terminus of this base sequence : 285594
tccaggttgctgaaaaagacattatttcactcctttttatggctgagtagtattccatagtatatctatatctatatctatctatctatctatctatctatctatctatctatctatctatcatctatctatcatcttttctttatccaatccttggttgaagggcaagtaggttggttccgtatccttgcaattg

SEQ ID NO: 10769 - DNA, 464 bp, Homo sapiens
  chr6.fa.O7frz.113993043
  Located on chromosome 6
  Distance between a terminus base of telomere on chromosomal short arm and 5'-terminus of this base sequence : 116076553
  Distance between 3'-terminus of neighbour sequence of sequence listing upward to telomere on chrosomal short arm and 5'-terminus of this base sequence : 98675
gaaatttacactggaaggagagaatgaaaggtatcaaaagtaaagtcttggctgggcatggtagctcatgctgtaatcccagcactttgggaggccaaggtgggtggatcacttgagctcaggaattcaaggccagcctgggcaacatggcaaaatcctgtctctgttgaaaatgcaaaaattagctgggcatggtggtgttcccctgtggtcccagctacttgggaggctgaggcacaaggattccttgagcccaggaggtggaggttacagtgagccgagattgcaccactgcactccagcctgggcaacagagtgaaaccctatctcaaaaaaaaagtagtctctctttctctgcatatccatacagatgcatatatacacacacgtgtgtgtgggtgtgtgtgtgtgtttccttccctcccacccctggtgattctaacctagcatcagtgtggtctttc

SEQ ID NO: 10770 - DNA, 144 bp, Homo sapiens
  HUMUT893
  Located on chromosome 6
  Distance between a terminus base of telomere on chromosomal short arm and 5'-terminus of this base sequence : 116294287
  Distance between 3'-terminus of neighbour sequence of sequence listing upward to telomere on chrosomal short arm and 5'-terminus of this base sequence : 217270
aagaaaatggtgaaacatgccagtaggaaaatctatcttatctatctatctatctatctatctatctatcatctatctatttatctacctacctacctacaatggttaattttatgtgtcaacttaactggactaaagggtgtc

SEQ ID NO: 10771 - DNA, 178 bp, Homo sapiens
  AL050350.14_44186
  Located on chromosome 6
  Distance between a terminus base of telomere on chromosomal short arm and 5'-terminus of this base sequence : 116447716
  Distance between 3'-terminus of neighbour sequence of sequence listing upward to telomere on chrosomal short arm and 5'-terminus of this base sequence : 153285
actaagcaaatcttaaatgcgtacacacacacacacacacacacacacacacacacacacacacacttggcctcccaggagcagagtcccctcatcccctctctgctcttggaatcagaggcaattcccatactccactgaagctgaagccatggcgagaaaggaatctcaggtagca

SEQ ID NO: 10772 - DNA, 380 bp, Homo sapiens
  chr6.fa.O7frz.118814927
  Located on chromosome 6
  Distance between a terminus base of telomere on chromosomal short arm and 5'-terminus of this base sequence : 116558904
  Distance between 3'-terminus of neighbour sequence of sequence listing upward to telomere on chrosomal short arm and 5'-terminus of this base sequence : 111010
aatactcagacattctgaagtcatgaaagcagtaaacatcttcaaagagatgagaaagtaatcacagcatattggaaaaaaccttcaaacagaagtaaggaaacctgaggtccatctctgaccatggcaaattatgtgaacttgggtaactcagtctttctgagcatccccccaactctcagtattactcagtattaatacttctgtgtttgtgtgtgtgtgtgtgtgtgtttgtatacataggtcaaaattcaaaaggtactgttgtcagaggcattcaaaccagagcaactccatctcaaataaaggctggttaaaataaggctgagacctactgggctgcattcccaggaggttagtcattcttagtcacaggatga

SEQ ID NO: 10773 - DNA, 298 bp, Homo sapiens
  D6S1647
  Located on chromosome 6
  Distance between a terminus base of telomere on chromosomal short arm and 5'-terminus of this base sequence : 116666806
  Distance between 3'-terminus of neighbour sequence of sequence listing upward to telomere on chrosomal short arm and 5'-terminus of this base sequence : 107522
catggctgtctacactttgttgaccctaaaccataaaaatggacaatttctggccgggcacagtggctcacgcctgtagtcccaacactttaggaggccaaggaaggtggatgacttgaggtcaggagtttgagaccagcctgaccaacatggcgaaaccctgtctttacttaaaaaaataataataataataaaattatttatatatatatacacacacacacacacacacacacacacacacacacacacacaaattagccgggagtggtgatacatgcctgtagtctcagctact

SEQ ID NO: 10774 - DNA, 201 bp, Homo sapiens
  Z84480_25334
  Located on chromosome 6
  Distance between a terminus base of telomere on chromosomal short arm and 5'-terminus of this base sequence : 116818899
  Distance between 3'-terminus of neighbour sequence of sequence listing upward to telomere on chrosomal short arm and 5'-terminus of this base sequence : 151795
agagagcaagattccatctcaaaaaaaaaaaaaaataataataataataataatagggaaaactggggagcagggggtggtatatgggaactctactttctactccaggttttctgtaaacctaaaactgctcaagaaaatagtcaattaatttttttaatattttcataaccatccatttaatctcatctttctcataga

SEQ ID NO: 10775 - DNA, 169 bp, Homo sapiens
  Z84480.1_102820
  Located on chromosome 6
  Distance between a terminus base of telomere on chromosomal short arm and 5'-terminus of this base sequence : 116896357
  Distance between 3'-terminus of neighbour sequence of sequence listing upward to telomere on chrosomal short arm and 5'-terminus of this base sequence : 77257
gcatatcaattaggattctaccagaaaaagaactaggagagtgtgtgtgtgtgtgtgtgtggtgtgtgtgtgtgtgtgtgtgtgtgtataaatttataaatttattgcaaggaattgtttgttacctttcataattgtgggggctggctaagcaagtctgaaatcttgg

SEQ ID NO: 10776 - DNA, 435 bp, Homo sapiens
  chr6.fa.O7frz.119104641
  Located on chromosome 6
  Distance between a terminus base of telomere on chromosomal short arm and 5'-terminus of this base sequence : 116944569
  Distance between 3'-terminus of neighbour sequence of sequence listing upward to telomere on chrosomal short arm and 5'-terminus of this base sequence : 48043
tctacttggtttgaaatcaagtggttggaacactgtttgacttttatttgaagcatgttgttgattgaaaatttcattgaggaagttttcaatcagtgtgatcagtttgattctgtaatgagcacagcacctaatattttgaggagctctgttttgaggaccaatgcttaaggtggactttgttcgtaaacaatatcccaatagatttgttgacttgaggtctggtttggttttgtttttgttttgttttgttttgttttgtttccaatagaattaagaattctaatgttgaaaaactgcacaaatttttatgggacaaagcctagaaaagagaaatgtagtttgaatcataatctaaatcatcgtatgatagaagagggaaagttttggtgccataatttctcctttcactggtgttggacttaaatcagttga

SEQ ID NO: 10777 - DNA, 360 bp, Homo sapiens
  chr6.fa.O7frz.119342419
  Located on chromosome 6
  Distance between a terminus base of telomere on chromosomal short arm and 5'-terminus of this base sequence : 116965941
  Distance between 3'-terminus of neighbour sequence of sequence listing upward to telomere on chrosomal short arm and 5'-terminus of this base sequence : 20937
gatgttccagtgagctgagattgcaccactgcactccagcctgggcaacaggagcaaaactccatctcaaaaaaaaaaaaaaaaaaaaaaaaaaaaaaaaatatatatatatatatatatatatatatatatatatatatatatatatatatacacacacacacatatgttgggaacaggcccccaaatctggccataaactggtcccaaaactggccataaacaaaatctctgcagcactgtgacatgttcatgatggccatgatgcccacactgagggttgtgggtttaccggaatgcgggcaaggaacacctggcctacacagggcagaaaaccgcttaaaggcattcttaaaccac

SEQ ID NO: 10778 - DNA, 159 bp, Homo sapiens
  D6S1698
  Located on chromosome 6
  Distance between a terminus base of telomere on chromosomal short arm and 5'-terminus of this base sequence : 117044010
  Distance between 3'-terminus of neighbour sequence of sequence listing upward to telomere on chrosomal short arm and 5'-terminus of this base sequence : 77709
tgcaggtaatttgactaccccgttctagaattttaagaaataaaaagcagactttgtggagaatgggatgagtatatatacacacacacacacacacacacacacacacacacacgagtatgtatgtatataaaacactcaagtatatatgaggggtgt

SEQ ID NO: 10779 - DNA, 439 bp, Homo sapiens
  chr6.fa.O7frz.119720539
  Located on chromosome 6
  Distance between a terminus base of telomere on chromosomal short arm and 5'-terminus of this base sequence : 117252726
  Distance between 3'-terminus of neighbour sequence of sequence listing upward to telomere on chrosomal short arm and 5'-terminus of this base sequence : 208557
ggagtattagaagctgaagttcttgctttatttaaataatcatggcagtaacaaaattcggttaaataatgccccttctaggccaggcgtggtggctcatgcactttaggaagccgaagcaggcagatcacttgaggtcaggagttttgagaccagtctggccaacttggtgaaacttcatctctactaaaaatacaaaaattagctgggcgtggtggtgcacacctgtaatcccagccactctggaggctgagggaggagaatcgcttgaaccaggtaggtggaggttgcagtgagctgagatcacaccactgcactccagcctgggcgacagcgaaaccccatctcaaataaataaataaataaataaataaataaataaaataatgccccttctagttgaaaaactaagttcctacctaagcataatttggattta

SEQ ID NO: 10780 - DNA, 182 bp, Homo sapiens
  AL008730.1_19694
  Located on chromosome 6
  Distance between a terminus base of telomere on chromosomal short arm and 5'-terminus of this base sequence : 117566248
  Distance between 3'-terminus of neighbour sequence of sequence listing upward to telomere on chrosomal short arm and 5'-terminus of this base sequence : 313083
acctgcctaaagattccataacaaggggatttggtatgatgagatatatgcaaaaggtttggattctggaaaaatatatacaagtctttttccagggggggaaaatacacacacacacacacacacacacccctaaggagtccagtgtaattttgtttctcaaattcctgtttctcaaatac

SEQ ID NO: 10781 - DNA, 229 bp, Homo sapiens
  Z97989.1_35395
  Located on chromosome 6
  Distance between a terminus base of telomere on chromosomal short arm and 5'-terminus of this base sequence : 117667552
  Distance between 3'-terminus of neighbour sequence of sequence listing upward to telomere on chrosomal short arm and 5'-terminus of this base sequence : 101122
acaataaagccaggaagtttactcgtgtgtgtgtgtgtgtgtgtgtgtgtgtgtgtaagagaggagagagattgattttacttgtagattatgcaacacaaaaacaaaaacagaaaactctccaaaccccacaaccctcttttccacaacaattctaccttttctcttcagctgtcctgccagggtaaggttcttcaccttccccagagactctcaaggaactggacca

SEQ ID NO: 10782 - DNA, 205 bp, Homo sapiens
  D6S404
  Located on chromosome 6
  Distance between a terminus base of telomere on chromosomal short arm and 5'-terminus of this base sequence : 117668626
  Distance between 3'-terminus of neighbour sequence of sequence listing upward to telomere on chrosomal short arm and 5'-terminus of this base sequence : 845
ctgaagatgggctgtttctaatttgggagtggacaggcacaggggagcctgcttccgactggcatctggggctgatgaggaaactggagccgagaccctgacgccatgggacactctctctctctctctctgccacacacacacacacacacacacacacacacacacacgcacaaacagtggaaatgtcagtatctggggagct

SEQ ID NO: 10783 - DNA, 258 bp, Homo sapiens
  Z17016.1_222
  Located on chromosome 6
  Distance between a terminus base of telomere on chromosomal short arm and 5'-terminus of this base sequence : 117727441
  Distance between 3'-terminus of neighbour sequence of sequence listing upward to telomere on chrosomal short arm and 5'-terminus of this base sequence : 58610
ggattctttaggataagccaatacacgaaggccataatatgtgtgtgtgtgtgtgtgtgtgtgtgtgtgtgtgtgtgtgtggtgtgtgtacttggaagcatcttttccactgaatgttttccaggtactatttgcaaattttaccaaactcccaaggtaaactcattgccgaaacctcgacttgtcattgtgaaaacttgacaacctggtgttgtcactggtacccatgtcctagaacttccatgtaagaggatcttt

SEQ ID NO: 10784 - DNA, 312 bp, Homo sapiens
  Z97989.1_95299
  Located on chromosome 6
  Distance between a terminus base of telomere on chromosomal short arm and 5'-terminus of this base sequence : 117727441
  Distance between 3'-terminus of neighbour sequence of sequence listing upward to telomere on chrosomal short arm and 5'-terminus of this base sequence : -258
ggattctttaggataagccaatacacgaaggccataatatgtgtgtgtgtgtgtgtgtgtgtgtgtgtgtgtgtgtgtgtggtgtgtgtacttggaagcatcttttccactgaatgttttccaggtactatttgcaaattttaccaaactcccaaggtaaactcattgccgaaacctcgacttgtcattgtgaaaacttgacaacctggtgttgtcactggtacccatgtcctagaacttccatgtaagaggatctttgtgccttagtcatttaactcccaggaacatatataagaccagttagccttaggc

SEQ ID NO: 10785 - DNA, 191 bp, Homo sapiens
  D6S302
  Located on chromosome 6
  Distance between a terminus base of telomere on chromosomal short arm and 5'-terminus of this base sequence : 117727444
  Distance between 3'-terminus of neighbour sequence of sequence listing upward to telomere on chrosomal short arm and 5'-terminus of this base sequence : -309
ttctttaggataagccaatacacgaaggccataatatgtgtgtgtgtgtgtgtgtgtgtgtgtgtgtgtgtgtgtgtggtgtgtgtacttggaagcatcttttccactgaatgttttccaggtactatttgcaaattttaccaaactcccaaggtaaactcattgccgaaacctcgacttgtcattgtgaa

SEQ ID NO: 10786 - DNA, 421 bp, Homo sapiens
  chr6.fa.O7frz.120455358
  Located on chromosome 6
  Distance between a terminus base of telomere on chromosomal short arm and 5'-terminus of this base sequence : 117839400
  Distance between 3'-terminus of neighbour sequence of sequence listing upward to telomere on chrosomal short arm and 5'-terminus of this base sequence : 111765
ctgaacggaatgttaaagaataactagtctgatagtttttaagctattctttagtatcagaactgtgtgtgtgtgtgtgtgtccatgccaaatgtgtaacaattatgccaaaagatatccagctagcacaccacatacctggagaatccattataatgggaaccattttatttcaaaaaaaaattcttttcttgttattggtagttctgaaccttagatacacacacacacacacacacacacacacacacacacacacacacacacacattctgaagggctcaactccaaaatattagataaaagtgcaacagaacagctctggttcaagagggaaaggactcaaactcctacctccatggccatcctcctggcctacctggtacttctgggtaactctaaagtcctaagaacactgaaa

SEQ ID NO: 10787 - DNA, 257 bp, Homo sapiens
  chr6.fa.O7frz.120540932
  Located on chromosome 6
  Distance between a terminus base of telomere on chromosomal short arm and 5'-terminus of this base sequence : 117925056
  Distance between 3'-terminus of neighbour sequence of sequence listing upward to telomere on chrosomal short arm and 5'-terminus of this base sequence : 85235
aaactattccggacagactaagtgtcatatgctctcaagaaaaaaacactcttaggctatatatctccttgaaatctcatgtttagttcaatctatcttacgctaaatctggaaatctggagtaggtgggataagtcctctctctctctctctctctctctctccctctctcctcctctctctctgtttcttcacgagaagtcacttcttagtgtctgcaactgtaatagcttcttgatctaattagtggacaaaga

SEQ ID NO: 10788 - DNA, 458 bp, Homo sapiens
  AC062038.2_24487
  Located on chromosome 6
  Distance between a terminus base of telomere on chromosomal short arm and 5'-terminus of this base sequence : 117999327
  Distance between 3'-terminus of neighbour sequence of sequence listing upward to telomere on chrosomal short arm and 5'-terminus of this base sequence : 74014
ttagccactgtatttctggtagttttttatgacagcagtataaaacgaaaacacaggacaatggcaatgcatttggagagggcagtgaccttttctagctgagggcgtcaggaccccttcccccacattccttcctcccttcctccctccctccctccctcccttccttccttctttccttccttccttccttccttccttccttctttccttccttccttctttccttccttccttctttccttccttccttcctcccttctttccttccttccttcctcctttctttccttccttcgcattcttcatttggttctgtgagctgtgcaagcatcttacaataaaattccctcttcctgcttaagccagcagatttttttctgttgcttataaccaaaagagccttaacataaggaactgtggacttgcatgacctgtgacatcaagtaccacagtgt

SEQ ID NO: 10789 - DNA, 166 bp, Homo sapiens
  D6S418
  Located on chromosome 6
  Distance between a terminus base of telomere on chromosomal short arm and 5'-terminus of this base sequence : 118005904
  Distance between 3'-terminus of neighbour sequence of sequence listing upward to telomere on chrosomal short arm and 5'-terminus of this base sequence : 6119
agggttttgccagacaatggagggagtaagtcaccaaagagtgtgtgtgtgtgtgtgtgtgtgtgtgtgtgtgtctagaattgtgtcctatggaatcaaaactggatcaagaaacagtaaaaacataaccttatgggtaacgacgtgggttgaggcaggtgtgcag

SEQ ID NO: 10790 - DNA, 261 bp, Homo sapiens
  Z67300
  Located on chromosome 6
  Distance between a terminus base of telomere on chromosomal short arm and 5'-terminus of this base sequence : 118046895
  Distance between 3'-terminus of neighbour sequence of sequence listing upward to telomere on chrosomal short arm and 5'-terminus of this base sequence : 40825
gatgctattccaaacattgccttatttcttttccctcaaacggatcattgggattggttttaaaaagccctttcacttgcctttaggatttcaaccagagagttcccataggaaagcatcaactcttttactgcagggtgtgtgtgtgtgtgtgtgtgtgtggttgaaatagcggacaggagagtaggagagaagagcaatgtctccgggcgctgtgaggaggtcaggggttcccgctcacccttcttcactgacagccgc

SEQ ID NO: 10791 - DNA, 257 bp, Homo sapiens
  D6S416
  Located on chromosome 6
  Distance between a terminus base of telomere on chromosomal short arm and 5'-terminus of this base sequence : 118179556
  Distance between 3'-terminus of neighbour sequence of sequence listing upward to telomere on chrosomal short arm and 5'-terminus of this base sequence : 132400
ggcccaggataaaatggttggatatttctatatgcaaaaaagatcctccaaaccaagattggaatttaaacccgtaaggcaagaaattcagatgactagtcatcagcattatttttgtgtgtgtgtgtgtgtgtgtgtgtgtgtgtgtgtgtataaaacagagcataccttatgatgatcacttaatcacatttgtggaagaccattttcatggcaaagcacattagattattttgatccttactggaagtggggcc

SEQ ID NO: 10792 - DNA, 425 bp, Homo sapiens
  Z99289.1_93264
  Located on chromosome 6
  Distance between a terminus base of telomere on chromosomal short arm and 5'-terminus of this base sequence : 118199422
  Distance between 3'-terminus of neighbour sequence of sequence listing upward to telomere on chrosomal short arm and 5'-terminus of this base sequence : 19609
tggtaagaatgacttgacatgtaacagagggaagctgtttacagctgggccaaagaaatccaataaccaaattagggcatattgttatgaggaaggatgttcataagaaagccattaccaaacactataaacagcatgatcccattaaaagacacacacacacacacacacacacacacacacagacacacacagacacacacacacagaggcaatgctggaaaaaaaggctctcaaatctaaaggtcacctctacgtggtgtgattacagcatttatatttagtttcttctttttgttttctagaacttttttttgtgatgaacgtattttgtcatcagaaaataacatttatgtataaaatcattgacaaacaaagaattacctaatccttccttgaaggtttaccttacactccagtgaatc

SEQ ID NO: 10793 - DNA, 443 bp, Homo sapiens
  Z99289.1_101602
  Located on chromosome 6
  Distance between a terminus base of telomere on chromosomal short arm and 5'-terminus of this base sequence : 118207605
  Distance between 3'-terminus of neighbour sequence of sequence listing upward to telomere on chrosomal short arm and 5'-terminus of this base sequence : 7758
gtggagtatttatcagaagtcagttatattgccaattcccgaccagttttacttaagacacttgggtgtggaaagataatgctgtctatgaaataaataggtaatgttagaattagaccttctaaagggatctgatttatttgacaatgttttatacattgtctttggtcatcctactaaaaattgtggaacagacacccccctcttcccggaacacagacctttaatatgacagattttttttaaataaaaaagaccagctcccccaaacaattgcaatgaacaatgatggactctcagatggaacaaccaaccaaccaaccaaccaaccaagcaaccaaggaaccaaccaaccaaccaacatatcaacacataagcatacccaaccttaatcaacctggtaaaattgtatcccagtagttctgacatatggaattgaatag

SEQ ID NO: 10794 - DNA, 417 bp, Homo sapiens
  Z99289.1_145504
  Located on chromosome 6
  Distance between a terminus base of telomere on chromosomal short arm and 5'-terminus of this base sequence : 118251521
  Distance between 3'-terminus of neighbour sequence of sequence listing upward to telomere on chrosomal short arm and 5'-terminus of this base sequence : 43473
tattggaaataaggttgctgagactggctgcgtcgatgaaagtcccagtcaagtactgcagcaaaacataggacccaccataaaaggattttatcccatggaaccctctctctttcttcttcttccttttttaaagataataaaaattaggacacaggacaaaaaagtaataaaaatattggtttagtggaatacataagtctcctcactattaaggcaagggaaatggggttatggtctccacgtgtttggaaaattcttcatagacacatgaattgtgtggggcataggggtgtgtgtgtgtgtgtgtgtgtatgtaaaattttaaggacttttaaattagctttggctttggtactatacaaccaataaagtgtgacccgctgctctcttgttcctttatgtatcagcatttct

SEQ ID NO: 10795 - DNA, 465 bp, Homo sapiens
  chr6.fa.O7frz.121039284
  Located on chromosome 6
  Distance between a terminus base of telomere on chromosomal short arm and 5'-terminus of this base sequence : 118382659
  Distance between 3'-terminus of neighbour sequence of sequence listing upward to telomere on chrosomal short arm and 5'-terminus of this base sequence : 130721
tataaagagctttggctaggagtggtggctcacgcctgtaatcccagcactttgggaggctgaggcgggtggatcactaggtcaggagttcgaggccagcctgaccaacatggtgaaaccctatctctaccaaaaatacaaatattagccaggtgtggtggcgtgtgcctgtaatcccagttactcaggaagctgaggcaggataatcacttgaacccaggaggcagaggtttcagtgagctgagattgtgccactgcactccagcctgggcgacagagtgagtttctgtctcaaacaaacaaacaaacaaacaaaaaaacaaagaaaccctaaatatatatatatataatatatatatacacacacacatatatatacacatatatacacatacacacacacacacatacacacacacacatatatatatacacacatatatataaagatctttgagtccgtct

SEQ ID NO: 10796 - DNA, 242 bp, Homo sapiens
  chr6.fa.O7frz.121115435
  Located on chromosome 6
  Distance between a terminus base of telomere on chromosomal short arm and 5'-terminus of this base sequence : 118459025
  Distance between 3'-terminus of neighbour sequence of sequence listing upward to telomere on chrosomal short arm and 5'-terminus of this base sequence : 75901
aatgaagttacatttcttgatcttctaagtttgtgagttgattaatatatgttgcatgtaaattgaatgaaagttccttgcacacaattctttgccctccaacttttttctctattgcaaagatttgttttaatccccattattgttgccatttattttattctttaagccaacacacgcacacacacacacacacacacacacacacacacacagaaactacctcattgattatagtgagc

SEQ ID NO: 10797 - DNA, 162 bp, Homo sapiens
  G08540
  Located on chromosome 6
  Distance between a terminus base of telomere on chromosomal short arm and 5'-terminus of this base sequence : 118607274
  Distance between 3'-terminus of neighbour sequence of sequence listing upward to telomere on chrosomal short arm and 5'-terminus of this base sequence : 148007
tgtacaaaagcctatttagtcagggttttccaagagatagaccaattagatagatagatagatagatgatagatagatagatagatagatagatagatagatagatagatagataaaagatagatatgagtagggatttatgagaggaattggctcacatga

SEQ ID NO: 10798 - DNA, 351 bp, Homo sapiens
  chr6.fa.O7frz.121417827
  Located on chromosome 6
  Distance between a terminus base of telomere on chromosomal short arm and 5'-terminus of this base sequence : 118715144
  Distance between 3'-terminus of neighbour sequence of sequence listing upward to telomere on chrosomal short arm and 5'-terminus of this base sequence : 107708
tttcctaatctctggcttaaacggatttggaagagagagagagagagagagagagagagagagagagagagagagtgtgtgtgtgtgtgtgtgtgtgtgtttgagagagaaagtatgtgtgtgtctgtgttggggataggctatccagattatggcagaatagttcatgtctgagcttctctttaaaaggtgtgaagtgctgtgactctttttcctttgctgtgagccctagtcatcaattccatagcaacaggaaatatcatgttcactgtgcactagtatatggatgaatcagtaagctcctgaaggggaatagaagagagaggtgtcaagttaggttgagttagatca

SEQ ID NO: 10799 - DNA, 251 bp, Homo sapiens
  chr6.fa.O7frz.121546644
  Located on chromosome 6
  Distance between a terminus base of telomere on chromosomal short arm and 5'-terminus of this base sequence : 118817251
  Distance between 3'-terminus of neighbour sequence of sequence listing upward to telomere on chrosomal short arm and 5'-terminus of this base sequence : 101756
atcagtcatagccataagtatgactacatgctaagtcctgagtcctttgggtcctcctggtgactcatggacgtgtggtggtttcagagaccccagacagggatagcaagtgagccaaaggagaattacacacacacacacacacacacacacacacacacacacaccccacagaggcatgcatgcatgcacacacaccacaggcacatgcacacatgcacacaccagtgttccaattgagactttcctac

SEQ ID NO: 10800 - DNA, 163 bp, Homo sapiens
  DISO7_10002217
  Located on chromosome 6
  Distance between a terminus base of telomere on chromosomal short arm and 5'-terminus of this base sequence : 118990238
  Distance between 3'-terminus of neighbour sequence of sequence listing upward to telomere on chrosomal short arm and 5'-terminus of this base sequence : 172736
aatgttagctgcactgcgcattgccatctcctaatctctctctctctctctctctctctctctctctctctctctctctcttcctccctttccctccctctccctgtccctctgcatcttcctctcctttctacctgctctttctctctagggcatggcatgt

SEQ ID NO: 10801 - DNA, 139 bp, Homo sapiens
  DISO7_10002222
  Located on chromosome 6
  Distance between a terminus base of telomere on chromosomal short arm and 5'-terminus of this base sequence : 119314364
  Distance between 3'-terminus of neighbour sequence of sequence listing upward to telomere on chrosomal short arm and 5'-terminus of this base sequence : 323963
agaaataatggaacaattgtgcttttttcctgggtatcagatgattttatttttaaaatacatatatatgtgtgtgtgtgtgtgtgtgtgtatatatatattgcacatagtgaacacactgattcgttctatagaattc

SEQ ID NO: 10802 - DNA, 300 bp, Homo sapiens
  AL049695.20_36655
  Located on chromosome 6
  Distance between a terminus base of telomere on chromosomal short arm and 5'-terminus of this base sequence : 119449238
  Distance between 3'-terminus of neighbour sequence of sequence listing upward to telomere on chrosomal short arm and 5'-terminus of this base sequence : 134735
ggttcacatgctaaagtaccaccaggattttggaaattgaaaaaaaatcatttctcttctgaaaaaaatatggaaatcttgcagagtctgaacacaaagaaggaaggtactttgggatgtctaggaatttaatgcttccatcaggccatgtgtgcatgagaattcattccaaactgtccattgtctccccacagcaaatgcgcgcgcacacacacacacacacacacacacacacacacacacacacacacacacacaatctgtcacagtattgagctcttcagaaacataggagttcag

SEQ ID NO: 10803 - DNA, 174 bp, Homo sapiens
  AL049695.20_17862
  Located on chromosome 6
  Distance between a terminus base of telomere on chromosomal short arm and 5'-terminus of this base sequence : 119468208
  Distance between 3'-terminus of neighbour sequence of sequence listing upward to telomere on chrosomal short arm and 5'-terminus of this base sequence : 18670
gttcttaaacaccttgaaactgacatgcatgttgatacctggttgtgtgcgtgtgtgtgtgtgtgtgtgtgtgtgtgtgtggtgaagggtgcaggggggcttgtttgtggggcctgctggagcaggagtcacttgttttacccttgcatcctgattacctgttagagccttaca

SEQ ID NO: 10804 - DNA, 199 bp, Homo sapiens
  D6S423
  Located on chromosome 6
  Distance between a terminus base of telomere on chromosomal short arm and 5'-terminus of this base sequence : 119468233
  Distance between 3'-terminus of neighbour sequence of sequence listing upward to telomere on chrosomal short arm and 5'-terminus of this base sequence : -149
tgcatgttgatacctggttgtgtgcgtgtgtgtgtgtgtgtgtgtgtgtgtgtgtggtgaagggtgcaggggggcttgtttgtggggcctgctggagcaggagtcacttgttttacccttgcatcctgattacctgttagagccttacaagtctctcacctataacttctcccaggccttgtgattactggggaatccc

SEQ ID NO: 10805 - DNA, 380 bp, Homo sapiens
  AL021326.1_75146
  Located on chromosome 6
  Distance between a terminus base of telomere on chromosomal short arm and 5'-terminus of this base sequence : 119665915
  Distance between 3'-terminus of neighbour sequence of sequence listing upward to telomere on chrosomal short arm and 5'-terminus of this base sequence : 197483
aggattagatttgtgcttcagtatcctccttttgattgcagatgaacaggaaaagaatgaaactttataaggtagactggggcagttaatcagttttaaagtgagaagtatattggagaatatgtaagttcaaccttgatacatattatacttcttgtctgtgtttaactatatatcatatgatttattacacattttataataattaattatacatttatacacacacacacacacacacacacacacacacacacacacacacactctctctctctccttgatttggtgggggaaaacaacacaaattatagaaaatctgtttctcagccagggcaatggggtcaaaaaaagattactgttcagtctaaaccaattgc

SEQ ID NO: 10806 - DNA, 252 bp, Homo sapiens
  D6S1603
  Located on chromosome 6
  Distance between a terminus base of telomere on chromosomal short arm and 5'-terminus of this base sequence : 119689511
  Distance between 3'-terminus of neighbour sequence of sequence listing upward to telomere on chrosomal short arm and 5'-terminus of this base sequence : 23216
gtacctacgggtgccgggtacttggctaggccatttatgcaaactacatcatcaaaaagccataatcattttatagtattgttatctccattttgcagatgtggaaactaaggctagttattcttccagtgagatatttttagtaagcacccaagtgcagaatgagatcttatagactctaaagttgttttatgagtgtgtgtgtgtgtgtgtgtgtgtgtgtcattttttctgcatctttaagcataaaat

SEQ ID NO: 10807 - DNA, 261 bp, Homo sapiens
  Z66675
  Located on chromosome 6
  Distance between a terminus base of telomere on chromosomal short arm and 5'-terminus of this base sequence : 119800440
  Distance between 3'-terminus of neighbour sequence of sequence listing upward to telomere on chrosomal short arm and 5'-terminus of this base sequence : 110677
agctggggtagatgtgagaaggagaataaaaaggagaaagtagaataacttccacacacagccaatttaaaacatctttgcatcggttctttcggggctaaagcccacttactcccctaccacccctactctcaccatttacatatacgtgtgtgtgtgtgtgtgtgtgtgtgtgtgtgtgtgtttatgcatgtatatacgtgtatatatatatatgtatatatatattttatagaaagcatggcaatatgctacaaagct

SEQ ID NO: 10808 - DNA, 202 bp, Homo sapiens
  chr6.fa.O7frz.122608703
  Located on chromosome 6
  Distance between a terminus base of telomere on chromosomal short arm and 5'-terminus of this base sequence : 119916241
  Distance between 3'-terminus of neighbour sequence of sequence listing upward to telomere on chrosomal short arm and 5'-terminus of this base sequence : 115540
aagaaataggcttatttgactcacagttctgcatggctggggagggctcaggaaacttacaatcatggcagaaggcaaaggggaagcaaggcatgtgttacatggtggcaagagagagagagagagagagagagaagggaagcaccacacttttaaaccatcagatttcatgagaactcactcactatcatgagaacagcat

SEQ ID NO: 10809 - DNA, 410 bp, Homo sapiens
  chr6.fa.O7frz.122729368
  Located on chromosome 6
  Distance between a terminus base of telomere on chromosomal short arm and 5'-terminus of this base sequence : 120039012
  Distance between 3'-terminus of neighbour sequence of sequence listing upward to telomere on chrosomal short arm and 5'-terminus of this base sequence : 122569
tattaaaggacatcagttgcactattaaaaataatctagagccagcgtggtggctcaagcctgtaattccagcactttgggaggccaaggtgggcagatcacttgaggtcaggagttcaaaccagcctggccaacatggtgaaaccctgtctctactagaaatacaaaaattagccaggcatggtggcacacatctgtaatcccagctactcaggaagctgaggcagaagaattgcttgaacctgggaggtggaggttgcggtgagctgtgatcatgccattgcactccagtctaggcaacagagcgagactctgtctctaataataataataataataataataataatttagtataatgaagatttctttgctgtcagacagatttaggtttgaattccagttctact

SEQ ID NO: 10810 - DNA, 107 bp, Homo sapiens
  D6S261
  Located on chromosome 6
  Distance between a terminus base of telomere on chromosomal short arm and 5'-terminus of this base sequence : 120098145
  Distance between 3'-terminus of neighbour sequence of sequence listing upward to telomere on chrosomal short arm and 5'-terminus of this base sequence : 58723
gtgaaaccctgtctcactgcatatgtatgtatgcacgcgcacacacacacacacacacacacacacacacatatataccaggcctaatggcatggtcctataaatcc

SEQ ID NO: 10811 - DNA, 457 bp, Homo sapiens
  chr6.fa.O7frz.122920924
  Located on chromosome 6
  Distance between a terminus base of telomere on chromosomal short arm and 5'-terminus of this base sequence : 120134519
  Distance between 3'-terminus of neighbour sequence of sequence listing upward to telomere on chrosomal short arm and 5'-terminus of this base sequence : 36267
tacgaacattgaaaccaattactcataaagggtgcttcctctagaccttcttattgtcctgaattcctatttcattagcaaaagtacatttacatgaaatatatatatatatatatatatatatatttcatatatatgaatctggcataaatatggatgcatacttcccattattaaaattagaattctttaaacaaaacaaaattttcctctattttcaattcttgtcacttctgccatttgctgcttgaagtccttaaaaaatattatgtcttctgaatgctttctaagactatagagaatattggttgaatgaggtttagagttggctaaaggagggcttttttgaccagaagttgattctctgaagttttttgtgtgtctttaacttgtttttttccactgattaatctttcatagtatgtagttataatggtaaccatcacgtacatctgac

SEQ ID NO: 10812 - DNA, 210 bp, Homo sapiens
  D6S401
  Located on chromosome 6
  Distance between a terminus base of telomere on chromosomal short arm and 5'-terminus of this base sequence : 120308866
  Distance between 3'-terminus of neighbour sequence of sequence listing upward to telomere on chrosomal short arm and 5'-terminus of this base sequence : 173890
gaattacctgcccccataaacacacacatgcacacacatatgcgcgtgcacacacacacacacacacacacacacccattgtcattggtctttggtctttggttatttggagactgtggcaatgcctgactagggaagccgcaatgcctgactagggaagccacactgcctgaacagaattggctgtagtactgaacaaacattgaggca

SEQ ID NO: 10813 - DNA, 464 bp, Homo sapiens
  chr6.fa.O7frz.123137086
  Located on chromosome 6
  Distance between a terminus base of telomere on chromosomal short arm and 5'-terminus of this base sequence : 120404413
  Distance between 3'-terminus of neighbour sequence of sequence listing upward to telomere on chrosomal short arm and 5'-terminus of this base sequence : 95337
tatctgtcttatgaggctcaagcatgctttatgtagtgctgagagtttgtgagtgagagctaagctgcatttccctggttgttctttttaactataaagaaaggtgataaattataaatgtgcctgagtcacccaagtatgacagttttaattttcattttaacaatatgtacaataccaaatgcatgaaactcagttggaatgtgacaaggcagtaggggctgtttggaaggcgaggctgagaaggtgagcgtgcccttcctgcccattggctcctgtcctacagacatgggcttgggactgccagtgttctcagcatcttgccactttgtcagctttctgctctatctaagatgatagtttgtgtgtgtgtgtgtgtgtgtgtgtgtgtgtgtgtgtgtgtgtgtgtattttgcatacaagcctgccatgcgaatggctctcagatccttatctatttgaat

SEQ ID NO: 10814 - DNA, 475 bp, Homo sapiens
  chr6.fa.O7frz.123235231
  Located on chromosome 6
  Distance between a terminus base of telomere on chromosomal short arm and 5'-terminus of this base sequence : 120502755
  Distance between 3'-terminus of neighbour sequence of sequence listing upward to telomere on chrosomal short arm and 5'-terminus of this base sequence : 97878
ttaattaggaacattcatgcatttgttcatccaacaaaaacgtatagcataacttccttgttctaagccatgggggatataaagattcttagatactttgccagcacaaagctcatcactgaattcagcttaaattgttttacatcaattcttgagcttcagcacacacatacacacacacacacacacacacacaccgcttactctctattacactggcaatctttttagtctttactaaatgactttaactactatttaacgaaggctctcccttttcacaggaccattctctgtctctgagttaatgatgatgtctctgttgccaaacttcccattctataactttaatcaaagtcccctgcacgcttcctgacctggggcaaagggtggtggtagtagtggtggtagttttcagccttcatcatggcctccctattacagctgcttttcattcataaagcaccaattcata

SEQ ID NO: 10815 - DNA, 452 bp, Homo sapiens
  AL021327.1_34880
  Located on chromosome 6
  Distance between a terminus base of telomere on chromosomal short arm and 5'-terminus of this base sequence : 120681410
  Distance between 3'-terminus of neighbour sequence of sequence listing upward to telomere on chrosomal short arm and 5'-terminus of this base sequence : 178180
ttgtaatgaatattccacctagagacacacctcaccaaggtgtgttctacttcctgataatcacgggcttattccattccacctgtccttttggtcatgacactgttctgggtgacataaacctagttctggtatccctgagaccccattttctccataacagcttccccagtgggacataccatctgaacacgttctgtcagaatcccaagtgtctttccaacttcccttcttgtcatcaattgatttaattttttaaacttttatttatttatttatttatttatttatttatttatttatttttgcagagacggggtctcaccatgttgtccaggctggtctcaaactcctgggctcaagtgatcctcccatctcagcctccccaagtgctggggttaaaggtgtgagcaccgcacctcacccatttgttgactttcaatgcaagtaaa

SEQ ID NO: 10816 - DNA, 459 bp, Homo sapiens
  chr6.fa.O7frz.123512610
  Located on chromosome 6
  Distance between a terminus base of telomere on chromosomal short arm and 5'-terminus of this base sequence : 120880874
  Distance between 3'-terminus of neighbour sequence of sequence listing upward to telomere on chrosomal short arm and 5'-terminus of this base sequence : 199012
tgatacgcctggtactgacagacactaaaaatataatattctgacaacacccttttgcttgatatagatatattgttctctatattacacacacacacacacacacacacacacacacacacacacacatattctgagatggagtctcgatctgttacccaggctggagtgcagtggcactatctcagctcactgcaagctccccctcccaggttgaagtgattttcctgcctcagcctcccaagtagctgggattacaggtacctgccactacacccagttgatttttgtatttttagtagagatggggttccaccgtgttggccaggctggttaactcctgacctcaagtaatctgcctacctcggcctcccatgctggtattcaggcatgagccaccgctcctggcctatattcaacatattgattagctgaattaatgagttgccttgctactat

SEQ ID NO: 10817 - DNA, 391 bp, Homo sapiens
  chr6.fa.O7frz.123609438
  Located on chromosome 6
  Distance between a terminus base of telomere on chromosomal short arm and 5'-terminus of this base sequence : 120941925
  Distance between 3'-terminus of neighbour sequence of sequence listing upward to telomere on chrosomal short arm and 5'-terminus of this base sequence : 60592
tggaattgagaagtgacagtagcccacagggcagcatctgcatggtgagaaccttttgcattaacaatggagggtaaaaagcatctgcatggtgagaaccttttgcattaacaatggaggttaaaggctggatttgggtaagtgagaaggcacatggatagttgggagagctcatgataaagagataataagtgggacacccccacccatcaaccagaacccttggcatatagaaacctctacctaagtctccttagaaagcacaggtatttgattatttctgtgtttgtacatgcatgcatgagtgtgtgtgtgtgtgtgtgtgtgatttgttatgtccccatttaaggatggaataaaagtaaagagtaaacatgttaaagagcatacc

SEQ ID NO: 10818 - DNA, 403 bp, Homo sapiens
  chr6.fa.O7frz.123809909
  Located on chromosome 6
  Distance between a terminus base of telomere on chromosomal short arm and 5'-terminus of this base sequence : 121225052
  Distance between 3'-terminus of neighbour sequence of sequence listing upward to telomere on chrosomal short arm and 5'-terminus of this base sequence : 282736
aatgaacagattacattagtccagtgtttcacacacacacgtgtgcatacatgtgggcatataaatgtgtgtgtgtgtgtgtgtgtgtataaatgtttgacagagagagagaaaaaaaaagaaatgtattgatgatttcactattgctaattttttgctcttatgtccctcatcagttatagttctggaaaggcactgtaattagatttctgccttatcgtattttatagctactcaacaaaagggtattccaccatattccacttatatcttttttatgtgctcactttgcatctttgttctcagggtttccttcctataccagctaatccctcaccttcaggataaaacactaatacctatgtttatgccttcatgtctatgattcatgaggaacattaat

SEQ ID NO: 10819 - DNA, 141 bp, Homo sapiens
  D6S454
  Located on chromosome 6
  Distance between a terminus base of telomere on chromosomal short arm and 5'-terminus of this base sequence : 121319154
  Distance between 3'-terminus of neighbour sequence of sequence listing upward to telomere on chrosomal short arm and 5'-terminus of this base sequence : 93699
attttcaatgctgccctgagattgagtaggaaaatgtgtgtgtgtgtgtgtgtgtgtgtgtgtgtgaatgaacatgatcagatacttttggaatgactttggatattagtacgtacactataggcaagaaattctgaataa

SEQ ID NO: 10820 - DNA, 202 bp, Homo sapiens
  Z92543.1_114166
  Located on chromosome 6
  Distance between a terminus base of telomere on chromosomal short arm and 5'-terminus of this base sequence : 121381613
  Distance between 3'-terminus of neighbour sequence of sequence listing upward to telomere on chrosomal short arm and 5'-terminus of this base sequence : 62318
gtatgtcgttgtccatttcaacagacttgacactgttcagtaaatctcattaaattgtaatttatttttatatatcagttgagtcaaataagttgtggaactttgagatattagaacctcattcatcaccagtagtgctgcacacacacacacacacacacacacatatacatacaaagtacagatagaggcatttgagtgt

SEQ ID NO: 10821 - DNA, 245 bp, Homo sapiens
  Z67794
  Located on chromosome 6
  Distance between a terminus base of telomere on chromosomal short arm and 5'-terminus of this base sequence : 121554651
  Distance between 3'-terminus of neighbour sequence of sequence listing upward to telomere on chrosomal short arm and 5'-terminus of this base sequence : 172836
tgcatccttctaaggctcttatcctgtctaccaatctgtgtcctttaagtgtagtatggagtatattacttataaaattcctgacaattttggtattaaacttaccattttctttctgggggtatatgtgcatgcacatgtgcatgagtgtctgcatgtgacattgtgagtgtgtgtgtgtgtgtgtgtgtgtgtagttgtctctcctgctttactagattgacagttctgttgaaagcaaccct

SEQ ID NO: 10822 - DNA, 221 bp, Homo sapiens
  Z84475.1_86211
  Located on chromosome 6
  Distance between a terminus base of telomere on chromosomal short arm and 5'-terminus of this base sequence : 121554657
  Distance between 3'-terminus of neighbour sequence of sequence listing upward to telomere on chrosomal short arm and 5'-terminus of this base sequence : -239
cttctaaggctcttatcctgtctaccaatctgtgtcctttaagtgtagtatggagtatattacttataaaattcctgacaattttggtattaaacttaccattttctttctgggggtatatgtgcatgcacatgtgcatgagtgtctgcatgtgacattgtgagtgtgtgtgtgtgtgtgtgtgtgtgtagttgtctctcctgctttactagattgacagt

SEQ ID NO: 10823 - DNA, 273 bp, Homo sapiens
  Z84475.1_90050
  Located on chromosome 6
  Distance between a terminus base of telomere on chromosomal short arm and 5'-terminus of this base sequence : 121558581
  Distance between 3'-terminus of neighbour sequence of sequence listing upward to telomere on chrosomal short arm and 5'-terminus of this base sequence : 3703
agcaaattatcttgagttaagcactttaaacacaggcctctaatatttccttcaagattctcagaaaatgagtacatgcacacacacacacacacacacacacacacacacacacacacacaaaataagggggaaaatgccatattaagagtctacgaacagtaaaacccaaaatgagagcaactcagactgaaaatagtaaaattatctgagaagcaataagtcttatagacaacatactgtatataaaatacatactatgcttaaggccgt

SEQ ID NO: 10824 - DNA, 443 bp, Homo sapiens
  Z98753.1_38468
  Located on chromosome 6
  Distance between a terminus base of telomere on chromosomal short arm and 5'-terminus of this base sequence : 122039317
  Distance between 3'-terminus of neighbour sequence of sequence listing upward to telomere on chrosomal short arm and 5'-terminus of this base sequence : 480463
tgcctttgtatccttatagcttagctcccacttataagtgagaacatacaatatttggttttcctttcctgagttacttcacttagaataatggtatccaactccatccacattgctgagaatgccgttattttgttcctttttatggcttagtagtattccatggggtgtgtgtgtgtgtgtgtgtgtgtgtgtgtgtgtatatttatttatatataaatatatatatttatttaaatatatatataatatttaatatatattaaatattaaatatatttaatttatataatttatataatttaatatattaacatttaatataataaaatacattaaaatatatatttatatatataaaatatatttttatatatatataaattacctagagatatatatatatatatatatcacattttctctatgcactcattggttga

SEQ ID NO: 10825 - DNA, 356 bp, Homo sapiens
  Z98753.1_36876
  Located on chromosome 6
  Distance between a terminus base of telomere on chromosomal short arm and 5'-terminus of this base sequence : 122040920
  Distance between 3'-terminus of neighbour sequence of sequence listing upward to telomere on chrosomal short arm and 5'-terminus of this base sequence : 1160
ttgaatttgtagatttcttttgacagtatggtcattttcacagtattgattctacccatccaagagcatgagatgtgtttccatttgtgtgtgtcatcacatactttttattcctgtgctcacccactttttctctctctttggttcatcctgtcatgtatagatagatagatagatagatagatagatacatacatacatacatacatacatacatacatacatacatacacacacacacatacatactgatatagtttggctgtgtccccacccaaatctcaccttgaattgtaaaaaatccccatgtatcaagggcaggatcaggcggagataattgaatcatggagtcagtt

SEQ ID NO: 10826 - DNA, 268 bp, Homo sapiens
  Z98753.1_12686
  Located on chromosome 6
  Distance between a terminus base of telomere on chromosomal short arm and 5'-terminus of this base sequence : 122065139
  Distance between 3'-terminus of neighbour sequence of sequence listing upward to telomere on chrosomal short arm and 5'-terminus of this base sequence : 23863
aggacaaccttgtcactaacagaagtgtctggataattatctgacctttcctgtaagaccttggagcatctttgcttgcaggcatataggaagctctctaagtagaagcctctcctctacaaaagaaaaatatgtgtgtgtgtgtgtgtgtgtgtgtgtgtttgtgtgatcattttttaagaagcataaaagaaatgggaatacatgtatgtatacaatacctgaaagaaaaaatagaaaaaaataagatgcactgcttaaatggtat

SEQ ID NO: 10827 - DNA, 165 bp, Homo sapiens
  Z98753.1_11266
  Located on chromosome 6
  Distance between a terminus base of telomere on chromosomal short arm and 5'-terminus of this base sequence : 122066630
  Distance between 3'-terminus of neighbour sequence of sequence listing upward to telomere on chrosomal short arm and 5'-terminus of this base sequence : 1223
caggtaccataattgaataaggacaactccctataacaaatacacacacacacacacacacacacacacacacacacacacacacacacattctgcttctctgactgaattcgaactggtacaatgggttattaacaaaacaggaaacattatgtgatttggacg

SEQ ID NO: 10828 - DNA, 258 bp, Homo sapiens
  AL049549.3_28286
  Located on chromosome 6
  Distance between a terminus base of telomere on chromosomal short arm and 5'-terminus of this base sequence : 122194331
  Distance between 3'-terminus of neighbour sequence of sequence listing upward to telomere on chrosomal short arm and 5'-terminus of this base sequence : 127536
taccatttgatgagctttgaacttatgcatgcacccatgataccatcacctcagtcaaggtaataaatatatccatcacctccaagttccctgtgttcatgtgtgtgtgtgtgtatgtgtgtgtgtgtgtgtgtgtgtgtgataagaacagttaatatcaagatattccctcaaaattttaagtgtataatccctattactataataccaacaatatagtattattgataagtactgtgttgattggcagatctttag

SEQ ID NO: 10829 - DNA, 221 bp, Homo sapiens
  Z17030.1_184
  Located on chromosome 6
  Distance between a terminus base of telomere on chromosomal short arm and 5'-terminus of this base sequence : 122194368
  Distance between 3'-terminus of neighbour sequence of sequence listing upward to telomere on chrosomal short arm and 5'-terminus of this base sequence : -221
tgataccatcacctcagtcaaggtaataaatatatccatcacctccaagttccctgtgttcatgtgtgtgtgtgtgtatgtgtgtgtgtgtgtgtgtgtgtgtgataagaacagttaatatcaagatattccctcaaaattttaagtgtataatccctattactataataccaacaatatagtattattgataagtactgtgttgattggcagatctttag

SEQ ID NO: 10830 - DNA, 225 bp, Homo sapiens
  D6S303
  Located on chromosome 6
  Distance between a terminus base of telomere on chromosomal short arm and 5'-terminus of this base sequence : 122194409
  Distance between 3'-terminus of neighbour sequence of sequence listing upward to telomere on chrosomal short arm and 5'-terminus of this base sequence : -180
cctccaagttccctgtgttcatgtgtgtgtgtgtgtatgtgtgtgtgtgtgtgtgtgtgtgtgataagaacagttaatatcaagatattccctcaaaattttaagtgtataatccctattactataataccaacaatatagtattattgataagtactgtgttgattggcagatctttagattttattttgtttgcataattgaaacttgacacccactgagcaa

SEQ ID NO: 10831 - DNA, 346 bp, Homo sapiens
  AL049549.3_42807
  Located on chromosome 6
  Distance between a terminus base of telomere on chromosomal short arm and 5'-terminus of this base sequence : 122208821
  Distance between 3'-terminus of neighbour sequence of sequence listing upward to telomere on chrosomal short arm and 5'-terminus of this base sequence : 14187
cacatgtaagtgagatcatagcagtatttgtctctctgtaccaaacttatttcacttagcataatgtcctccagcttcatccatttttagcaagtgacaggatttccttgttttataaggctaaatagtatttcattgtgtgtgtgtatatatatatatatatatatatcacattttctttatccattttatctgttgatgaaaacaggttgattccatatcttggcaattgtgaataatgctgcaatgaacataggattacaaatatcttttggacatggtggtttcattttcttcataaatatacacagaagtggaattcctgaatcatatggcaattctattt

SEQ ID NO: 10832 - DNA, 300 bp, Homo sapiens
  AL049549.3_63839
  Located on chromosome 6
  Distance between a terminus base of telomere on chromosomal short arm and 5'-terminus of this base sequence : 122229803
  Distance between 3'-terminus of neighbour sequence of sequence listing upward to telomere on chrosomal short arm and 5'-terminus of this base sequence : 20636
aagataaccaatggtccagaaccctcagggttgaagacatacattgtgacaacatggggtaaagaatcctaaagatgctatgagaaaacaagaattttgagcatgcaatgaaggaggaaagccacagattcagcagcagctttatgacttgttgcaaaaagagggcctctattttttttgcttgctttgttatgcagtgtgtgtgtgtgtgtgtgtgtgtgtgtgtgtgtgtgtgtaacttttctttcttattgtacaaatccttgttggtggtcggtttatctaacatccataggttgc

SEQ ID NO: 10833 - DNA, 186 bp, Homo sapiens
  DISO7_10002225
  Located on chromosome 6
  Distance between a terminus base of telomere on chromosomal short arm and 5'-terminus of this base sequence : 122347393
  Distance between 3'-terminus of neighbour sequence of sequence listing upward to telomere on chrosomal short arm and 5'-terminus of this base sequence : 117290
gttggtgtgatatgactggagattatgtattatttctttatactttttatcaagcatgctacatatatataaatatgtatatatgtatatgtcactagaaaatatatatatatatatatatatatatatatatatatcaccagaaaaaacattttaattaaaactcttaggagaagcctagaaaga

SEQ ID NO: 10834 - DNA, 243 bp, Homo sapiens
  AL021451.1_54871
  Located on chromosome 6
  Distance between a terminus base of telomere on chromosomal short arm and 5'-terminus of this base sequence : 122410779
  Distance between 3'-terminus of neighbour sequence of sequence listing upward to telomere on chrosomal short arm and 5'-terminus of this base sequence : 63200
cagtacttggcacttattccagctatgtctgtggttggtgggatgcatgcttacatttgtccattctttgcaggtgcttttctgtgttatgtttatggacttttctatactgtcccccattaaaagggagtgtgtgtgtgtgtgtgtgtgtgtgtgtgtgtgtgtgtgtgtctgcacgtgtgtgcgcgacttttctgttctgccattttctaaacacatagtaactgcagattcctagaggac

SEQ ID NO: 10835 - DNA, 416 bp, Homo sapiens
  AL021451.1_56551
  Located on chromosome 6
  Distance between a terminus base of telomere on chromosomal short arm and 5'-terminus of this base sequence : 122412471
  Distance between 3'-terminus of neighbour sequence of sequence listing upward to telomere on chrosomal short arm and 5'-terminus of this base sequence : 1449
tcatccatttctggttctataaactaaatttccttttctctggttaaagaagaagaaatcagtccacatacagataaagaatgtctatttttacaaatgttttttccatttctacttacacacacacacacacacacacacacttgcttccacctaatttctgcttcaaaagagagaggaaattctagggaaattagacacattaatttcacatgattgtgtgcgtctgttaatgcacatgagagattccaggtgggagtaaaagcatatagaatcagagagcttggattgagttgcatgataagaaggcacaaagatcagcttatgatatttgggagttgttcatgtcagcatcttcactttccacaggtgataaactgatgcccacagacataacattagttgctccatgaagt

SEQ ID NO: 10836 - DNA, 207 bp, Homo sapiens
  chr6.fa.O7frz.124840703
  Located on chromosome 6
  Distance between a terminus base of telomere on chromosomal short arm and 5'-terminus of this base sequence : 122570730
  Distance between 3'-terminus of neighbour sequence of sequence listing upward to telomere on chrosomal short arm and 5'-terminus of this base sequence : 157843
acatttaatttcctatccttcaagtactatttgggaaacacacacacacacacacacacacacacacacacgctacacaccaactaggtgaccagtagagaaaaaaagagtagaacagaaaaagagctctttgcacactgctgtgggggctctttctgctaaactttgacctccagatctatgctagttcttactaacttggcaaga

SEQ ID NO: 10837 - DNA, 442 bp, Homo sapiens
  AL050331.11_5554
  Located on chromosome 6
  Distance between a terminus base of telomere on chromosomal short arm and 5'-terminus of this base sequence : 122687327
  Distance between 3'-terminus of neighbour sequence of sequence listing upward to telomere on chrosomal short arm and 5'-terminus of this base sequence : 116390
ataccactacctttcactgcagcatcaaggagtttactttgtggaattgttttatcctgtatgtctagctttcataactttacaaagaggaaagtgtgtgtgtgtgtgtgtgtgtgtgtgtgtgtgtgtgcgcgcgcgcgcgcgtgcgtgcgtgtgtgtgtgtgtgtgtgtgtgtttactagtgggactgggtctaaatttatgtgatctaagtgaaagttaatttgcttgaaacccttcttgtttgcttgaaacccacaagctgaggatcatacctaggggacctctctcccatccaagtactaaccaggcccgaccctgcttcgcttctgagatcaggtgacattgggcgcattcagggtggtatggccataagccctaggacacctttctgaactctttaacttgaagtcagcctttcttgattcataaaggcgataga

SEQ ID NO: 10838 - DNA, 306 bp, Homo sapiens
  AL050331.11_73912
  Located on chromosome 6
  Distance between a terminus base of telomere on chromosomal short arm and 5'-terminus of this base sequence : 122755688
  Distance between 3'-terminus of neighbour sequence of sequence listing upward to telomere on chrosomal short arm and 5'-terminus of this base sequence : 67919
gaatctggtatttggaatactgaggtagtaaaaactttatctgaaccatgaattacaatctaaaatcaacttctgagtttgttaaactctaaactgaaatcaagtattatttccccaccaatattcatatccaaaaataactttaaatacacacacacacacacacacacacacttttagtgaactggtttgaatgaaaataaatttatataattattttatataacaaatcagcataaaatggaaaatcaaactgcctctctagatataataaccttcactgactgttggaaatacatggatagc

SEQ ID NO: 10839 - DNA, 104 bp, Homo sapiens
  DISO7_10002230
  Located on chromosome 6
  Distance between a terminus base of telomere on chromosomal short arm and 5'-terminus of this base sequence : 122925695
  Distance between 3'-terminus of neighbour sequence of sequence listing upward to telomere on chrosomal short arm and 5'-terminus of this base sequence : 169701
gttctaaacagctaattgccactgtgtgtgtgtgtgtgtgtgtgtgtgtgtgtgtgtgtgtgtgtgtgtagctttttgactgcactataaggttgatagtttga

SEQ ID NO: 10840 - DNA, 414 bp, Homo sapiens
  chr6.fa.O7frz.125576291
  Located on chromosome 6
  Distance between a terminus base of telomere on chromosomal short arm and 5'-terminus of this base sequence : 123040143
  Distance between 3'-terminus of neighbour sequence of sequence listing upward to telomere on chrosomal short arm and 5'-terminus of this base sequence : 114344
catactaaatggagtctgcaacactagttacgtgccccaaattctagctctgaaacaaagaaaaacaaacaccagcatcagtaacataaataatgtgagcagaaggttcatagataaagtgagactcatatatatatatatatatatatatatatatatatatatatatgttactaatttcctagacaagaagaacaagatatttgtcaattactttgccctgttttggaaaatcttggaatgtttttcatacccagattcccttcctgaggggctccctatgatcaccatgttctatctaattatcctgccattctggccacagttaatggattagggtgggcattgtgagcctggacagtcagttcatagcttggctagagccctggaagtgacctagcatgaaactctact

SEQ ID NO: 10841 - DNA, 246 bp, Homo sapiens
  Z66898
  Located on chromosome 6
  Distance between a terminus base of telomere on chromosomal short arm and 5'-terminus of this base sequence : 123220830
  Distance between 3'-terminus of neighbour sequence of sequence listing upward to telomere on chrosomal short arm and 5'-terminus of this base sequence : 180273
tgagtattaatttcactacatcccttaagttttggtgtgtttttttttttatttatctcaaagtattttctgcatatgtgtgtgtgtgtgtgtgtgtgtgtgttttaactcactagttatttaagagtatgttactctactcatagttctgaattttctagttttctgtctgtatttttagtttcattccattgttgtcagagaagatactttttatgatttcacttttcaaaaatttatcagagc

SEQ ID NO: 10842 - DNA, 266 bp, Homo sapiens
  AL132795.12_119901
  Located on chromosome 6
  Distance between a terminus base of telomere on chromosomal short arm and 5'-terminus of this base sequence : 123235222
  Distance between 3'-terminus of neighbour sequence of sequence listing upward to telomere on chrosomal short arm and 5'-terminus of this base sequence : 14146
tggaaatagagctcagattcaggtaactacccttcagatctgagagtagaacagcaaggtctaagaagccagtttggacaaaagttaacacttttactaaaaaagattcctttttaaaaagataccgaaaaagtattttaaagaacatgggctttcctcctctaaaataataacatttacttgtagtattctagtgaagaacatcaagtgtgtgtgtgtgtgtgtgtgtctagcacagtgcctgacacataatggtttgtctttag

SEQ ID NO: 10843 - DNA, 323 bp, Homo sapiens
  AL132795.12_125914
  Located on chromosome 6
  Distance between a terminus base of telomere on chromosomal short arm and 5'-terminus of this base sequence : 123241270
  Distance between 3'-terminus of neighbour sequence of sequence listing upward to telomere on chrosomal short arm and 5'-terminus of this base sequence : 5782
tcttcgtatgacactgctacatactctcattcttgaagtataaatcgtaagtgatggctatcggtatgtgcaacagttagattaaaatagtcccgttgccagtgaggtgatagatgatgttcacttattattttgatttaaacatatactgaaattgtagtaacagtttgtttatatatatatatatatatatatatatatatatatatatatatatatactttgtataacaggtctggataaaattgagtttttgcaaagccatgaaaatcaggaaatttaccagaaggcatttgatctgattgaacattactttggtgtag

SEQ ID NO: 10844 - DNA, 456 bp, Homo sapiens
  chr6.fa.O7frz.126093921
  Located on chromosome 6
  Distance between a terminus base of telomere on chromosomal short arm and 5'-terminus of this base sequence : 123557784
  Distance between 3'-terminus of neighbour sequence of sequence listing upward to telomere on chrosomal short arm and 5'-terminus of this base sequence : 316191
gccttcagttctacctattaattctaccacatttgactagaatttttaaattttctgctctccaaataaactctccctccaaaacctcctatattccctatgccatgtctacctctgatttttattttattttattttattttattttattttattttattttattttattttattttattttatgtacaaagagctaccatggtttctttcatgaggtggttgccttggacaacccattcaaggaagatcacttagtccaacttaatgaaatctatatcttttgtatactgacggaaacactggcagcacatattgaggccatgtttttggatcacaacaatgcaagtttgagtagatgtgataagagtgagaactctgaccaaatcttcacagatggctccagtagagctgctggtgacccaccttgctttcaggtacctctgattatcttatg

SEQ ID NO: 10845 - DNA, 291 bp, Homo sapiens
  chr6.fa.O7frz.126186242
  Located on chromosome 6
  Distance between a terminus base of telomere on chromosomal short arm and 5'-terminus of this base sequence : 123636029
  Distance between 3'-terminus of neighbour sequence of sequence listing upward to telomere on chrosomal short arm and 5'-terminus of this base sequence : 77789
ttcctatacctcactgctacatagaaggaaccagaaatagctactccttctagaaattagatagttttcatttatacagagcaaacttttctgtgtaaagtgcaagggttcccaaatttgggcagaaaaattgtgtgtgtgtgtgtgtgtgtgtgtgtgtgtgtgtgtgtattcctctccttacccaattatagctaaaaccatggtttattatttgctgatctttcaagcagagtgaaagaagaagcaatagtctcttcttttaattttagtcatctatgttgactttcc

SEQ ID NO: 10846 - DNA, 437 bp, Homo sapiens
  Z98880.1_79184
  Located on chromosome 6
  Distance between a terminus base of telomere on chromosomal short arm and 5'-terminus of this base sequence : 123786677
  Distance between 3'-terminus of neighbour sequence of sequence listing upward to telomere on chrosomal short arm and 5'-terminus of this base sequence : 150357
ctgctaatccaagttgactttaagagacaggcaaattttcttttctagggaaaagagtaagatattttgccgaagaattaatttttaatctttagagaaatacatacattatgtatgtgtgtgtgtatatatatatatatatacaccttattagaatgtatgtgtatatatatatatatatatatataccttactagaataattattactttggtaaagcatgtgacccttcatttggaatttttcactttaaaattactgagttaactcagtaggagaaaaatctgaagttctccacaacgcagtgtcagatctacctcaaattatagtatttctgtgagtttccggtgtattcttgtgaaactaagttcctctaaaacaaaaatggagacatccaaatttgctctgccttgctggaattcagttatttcacctag

SEQ ID NO: 10847 - DNA, 384 bp, Homo sapiens
  Z98880.1_74588
  Located on chromosome 6
  Distance between a terminus base of telomere on chromosomal short arm and 5'-terminus of this base sequence : 123791200
  Distance between 3'-terminus of neighbour sequence of sequence listing upward to telomere on chrosomal short arm and 5'-terminus of this base sequence : 4086
cagactcaggaacttgcaccagttgctcccctcaggttctcaggcttttggcctcagaaagagcattacaccattggctcccctggttctcaggccttcagacttggactgagtcaggctactaaattccctggatttccaacttgcaggtggcaaatcgcgggacttctctgtctccataatcatgagaaccaatccccttaataagtcccctgtctatctatctatctatctatctatctatctatctatctatctatcatctacctatcatctctatctgtcatatatctatctatcatctatttatatatcctatcagttttatttctcttaagaaccctgattaataaagccttctactgattttggatgttaaggact

SEQ ID NO: 10848 - DNA, 240 bp, Homo sapiens
  chr6.fa.O7frz.126426345
  Located on chromosome 6
  Distance between a terminus base of telomere on chromosomal short arm and 5'-terminus of this base sequence : 123869499
  Distance between 3'-terminus of neighbour sequence of sequence listing upward to telomere on chrosomal short arm and 5'-terminus of this base sequence : 77915
tctttctcagtgataaccttgtaggctctctacccctaggtttatttaaacatattttggtggtgtgttggggtcaaaaacatgtttttgacctaaactttagcaaagagacagtgttcatatccctaaagacaccaatgggacacacacacacacacacacacacacgcctctaaattattatttgcacagattttagaaaacaaatacctgatgttgtagactttacaacgtcagcat

SEQ ID NO: 10849 - DNA, 417 bp, Homo sapiens
  Z85999.1_2560
  Located on chromosome 6
  Distance between a terminus base of telomere on chromosomal short arm and 5'-terminus of this base sequence : 123999329
  Distance between 3'-terminus of neighbour sequence of sequence listing upward to telomere on chrosomal short arm and 5'-terminus of this base sequence : 129590
agaagcagaacagttgtgaaacaaagtagggtgtccataaataacattgtcctgatatatcataatcatggaaaatgctacacatagaaccattgaggacatgttttagttctatatatttttatgtaaatgcacacacacacacacacacacacacacacacccctatagcaaatacatgtgtgtacacacacatttactattgtttttattaaatattgtgtagacacaaaattatagactataaataaaggtataaagaacaacaataaaactaatacctgggttcccccctctgctccctagtctgtgtatgcttttatattctgattttttaaatctgtgtttcattgaaagttttttattacttggaaaaattccatatttatatttattttagaatttgccttgaagtaa

SEQ ID NO: 10850 - DNA, 378 bp, Homo sapiens
  Z85999.1_63831
  Located on chromosome 6
  Distance between a terminus base of telomere on chromosomal short arm and 5'-terminus of this base sequence : 124060701
  Distance between 3'-terminus of neighbour sequence of sequence listing upward to telomere on chrosomal short arm and 5'-terminus of this base sequence : 60955
ctatctttgattctgatacctgagtatttccatttatttatttatttatttatttatttatttttagacagagtctggctctgtcacccaggctggactgcagtggcactgtctcagctcactgcaaactccgcctcccaggttcatgccattctgctgcctcagcctcccgagtagctaggactacaggcgcccaccacgaggcccagctaattttttgtatttttagtagagacggggtttcaccgtgttagccaggatcgtctggatctcctgacctcgtgatccgccatcctcggcctcccaaagtgctgggattacaggcgtgagccaccgcgcccggcttccctttatttcttaagacattagctaggcctt

SEQ ID NO: 10851 - DNA, 431 bp, Homo sapiens
  chr6.fa.O7frz.126702269
  Located on chromosome 6
  Distance between a terminus base of telomere on chromosomal short arm and 5'-terminus of this base sequence : 124145106
  Distance between 3'-terminus of neighbour sequence of sequence listing upward to telomere on chrosomal short arm and 5'-terminus of this base sequence : 84027
ctgtgacctttaaagagcttaagctggctttggttatttctctgtgtgtctgtctgtatgagtgggtgagtccaccaggttggtcttaccttctggttttggttatctcttcagttttctctctctctctctgtctccctctctctctctctctctctctctctctcacacacacacacacacacacaagcacgccctcacactcagacaatttctgttcctgaatatccctctgtttatacccaacctgctgcacctgttccccctaactactcataatttataattaatgcaacatgtgtttgtattagttgatcctatttctttaaactttattttatgttccacattttaaagtagataaatttttaaaatgtaggatgaatcactattattctctttaaaatgatactatgtttgtctaccagtgg

SEQ ID NO: 10852 - DNA, 411 bp, Homo sapiens
  chr6.fa.O7frz.126807990
  Located on chromosome 6
  Distance between a terminus base of telomere on chromosomal short arm and 5'-terminus of this base sequence : 124251490
  Distance between 3'-terminus of neighbour sequence of sequence listing upward to telomere on chrosomal short arm and 5'-terminus of this base sequence : 105953
ttatgtaagcctaacagtaaccacaaaaaagtacctatattagatacacaaaagataaagagaaagaaatcaaagcataccactacataaaataaataaatcacaaagataacagacgaggaagaaagaaacaaagaacctaccaaacagtcagaaaacaattaacaaaatggcaataataagttcttacctctcaataattatgttaaatgtaaatggactacattctctattcaaaagacatagagtggccgaatagattacatgcgcgcgagcgcacacacacacacacacacacacacacacaacccatctatatgctgcctacaaaagactgacttcagctttaaagacacacatagattgaaaggaaataaatgaaagaaagactttccatgcaaatagaaacta

SEQ ID NO: 10853 - DNA, 136 bp, Homo sapiens
  D6S1706
  Located on chromosome 6
  Distance between a terminus base of telomere on chromosomal short arm and 5'-terminus of this base sequence : 124391309
  Distance between 3'-terminus of neighbour sequence of sequence listing upward to telomere on chrosomal short arm and 5'-terminus of this base sequence : 139408
gaagtctgggtaagtctgtgcagaatattatgtgtgtgtgtgtgtgtgtgtgtgtgtgcatgtaacactatatatgtgtaacatatatgtgtgcctgtaacactaggtggtttacacacacacatttacatccaca

SEQ ID NO: 10854 - DNA, 169 bp, Homo sapiens
  G08521
  Located on chromosome 6
  Distance between a terminus base of telomere on chromosomal short arm and 5'-terminus of this base sequence : 124423416
  Distance between 3'-terminus of neighbour sequence of sequence listing upward to telomere on chrosomal short arm and 5'-terminus of this base sequence : 31971
ccccaaaaacaaaaacaaaagaatcctatctatctatctatctatctatctatctatctatctatctatctatctatctgtctatccacatatatacacacacgtgtatatgtgtgtgtatatatatagagagagtttctattaatttaaattctaaactttgtctgaa

SEQ ID NO: 10855 - DNA, 328 bp, Homo sapiens
  Z95326.1_9417
  Located on chromosome 6
  Distance between a terminus base of telomere on chromosomal short arm and 5'-terminus of this base sequence : 124648078
  Distance between 3'-terminus of neighbour sequence of sequence listing upward to telomere on chrosomal short arm and 5'-terminus of this base sequence : 224493
agatgcagtggagttatttgaccctgcagtattatatccaaaataatccatttcatgcataaacaacctggtcttcaggagcactaagggggaaaataatgtgtgctcattattatgcatgtcacgtacaactcatttgaatttagtctctttggcaacgcgtgcaccggtgagataggtgcatcatatcagttcacttatacttccatagaggatattttttagcccctcccttgtttttcagcagaaacacacacacacacacacacacactcaaatggatcaatcaaggaaaataaatgatattcagattctgttcaaatcactt

SEQ ID NO: 10856 - DNA, 422 bp, Homo sapiens
  Z95326.1_27115
  Located on chromosome 6
  Distance between a terminus base of telomere on chromosomal short arm and 5'-terminus of this base sequence : 124665966
  Distance between 3'-terminus of neighbour sequence of sequence listing upward to telomere on chrosomal short arm and 5'-terminus of this base sequence : 17560
tacctatgtatcaaacctgcacgttgtgcacatgtaccctagaactgaaagtataataaaaaataaaataaaataaaataaaataaaataagaaatacattggtttggtccagtaaggcaggacaacttgaagcgcagggcttccagcttataggtggatttaaaaattttctgaaactatactgcaagatggtacactgtatttagtctttgagttcttgtacatctcacttttcaggaatccagggatttaacaaaaacttgaatcaggaaaaaaaaagttaagccattctaaagggcagggagaattatttcaaccataccaataatttataggtagaggctaaaaaagcttagaagatgaaatgtagtaaaatgcctagagttaataattacagtaccatctattgagcctttataat

SEQ ID NO: 10857 - DNA, 434 bp, Homo sapiens
  Z95326.1_52965
  Located on chromosome 6
  Distance between a terminus base of telomere on chromosomal short arm and 5'-terminus of this base sequence : 124691522
  Distance between 3'-terminus of neighbour sequence of sequence listing upward to telomere on chrosomal short arm and 5'-terminus of this base sequence : 25134
aggtattagtaaactcaagcatgaaaaagcaatttagggccaggcactgtggctcatgcctgtaatcccatcactttgggaagctgaggtgggtggatcacttgagcccaggaactcgagaccagcatgggcaatatctctacaaataaaaaagaaaaatttttttttttttagttagccaggagtggtggcacacctctgaggcctcagttactctggaggctgaagtggaaggatcttgtttaagccccagcaattgaggttgcagtgacctgtgttcacaccgctgcactccagcttgggcaacagagtgagaccctgtcaaaaaaaaaaaagaaagagagagagagagagaaggaaggaaggaaggaaggaaggaaggaaggaaggaaggaagaaaaaaagaaaggcaatttaggtcaggtacagtggct

SEQ ID NO: 10858 - DNA, 248 bp, Homo sapiens
  Z95326.1_70605
  Located on chromosome 6
  Distance between a terminus base of telomere on chromosomal short arm and 5'-terminus of this base sequence : 124709382
  Distance between 3'-terminus of neighbour sequence of sequence listing upward to telomere on chrosomal short arm and 5'-terminus of this base sequence : 17426
ggaaggtggagagtttacatacatgtgaagacttttgatacatagtaccaaattgcccttcagagagattataccattcacactctcaccagcagcataggtgagtgccagtaccgctgacatacatacatatatacatacatacatacatacatacatacatacatacatacatacatagcaaaccagagctggacagtagttacagtggcaaaaacagattttattcaggactatttcaataggag

SEQ ID NO: 10859 - DNA, 337 bp, Homo sapiens
  AL133379.3_78883
  Located on chromosome 6
  Distance between a terminus base of telomere on chromosomal short arm and 5'-terminus of this base sequence : 124790289
  Distance between 3'-terminus of neighbour sequence of sequence listing upward to telomere on chrosomal short arm and 5'-terminus of this base sequence : 80659
gtgacttgacgagcattacatatctgagcaaagccagcccagtgccctttatacacttaacctaatgcatatgttctgagaagtcatctaacctagctattgtttttaagaattacaaataatattttaaaactctggtatgttcaaaataaagagaaagaacacaactgaaatcccaaagaaaaagacgaaatcaaatatatgtagcatatacagacacatactttatatatatatagtaactctctctctctctctctctctctctctctatatatatatatatataaaatattaactgaggtattgataggagtcaaataggatgttccttcaa

SEQ ID NO: 10860 - DNA, 358 bp, Homo sapiens
  AL133379.3_50885
  Located on chromosome 6
  Distance between a terminus base of telomere on chromosomal short arm and 5'-terminus of this base sequence : 124818465
  Distance between 3'-terminus of neighbour sequence of sequence listing upward to telomere on chrosomal short arm and 5'-terminus of this base sequence : 27839
attatacgaatgcaatttcagaaggcagatggtatcaggtcaccagaaggggcctgtagatgtgtgtgtgtgtgtgtgtgtgtgtgtgtgtgtgcgtgtgtgtatttttttttaagagacagcttacccaggtgtagtgtagtggcaggaccatagctcactgcagcctcaaactcctgcctcagcctcctgagtagctaggactacaggcatgcattaccacaccaggctaggagcctttaaaagctgtattacacagagacatatgcttaaagggactctttaaggtacacttcccagggaaaaaggaaaaaaccaggcccaccatatagaagtacttggtacatgcattcaataa

SEQ ID NO: 10861 - DNA, 288 bp, Homo sapiens
  D6S433
  Located on chromosome 6
  Distance between a terminus base of telomere on chromosomal short arm and 5'-terminus of this base sequence : 124831513
  Distance between 3'-terminus of neighbour sequence of sequence listing upward to telomere on chrosomal short arm and 5'-terminus of this base sequence : 12690
cctcctactcttgggttagtgaggtgtttgtgtgtgtgtgtgtgtgtgtgtgtgtgtgtgtgtttggtaaaaacatccttccaacaatttcccttgtagttggttgaatggcttcctttggtctgtaatgtttctgtaacgtaatctctttttcttgacttttgacattgtaaagaaatagacttttatgtactaatgcaattttcattatttccattatcatgataaagtagagtatcttcttctggctacagcataattcccatctatttctaatgccattgcagt

SEQ ID NO: 10862 - DNA, 401 bp, Homo sapiens
  chr6.fa.O7frz.127456053
  Located on chromosome 6
  Distance between a terminus base of telomere on chromosomal short arm and 5'-terminus of this base sequence : 124954775
  Distance between 3'-terminus of neighbour sequence of sequence listing upward to telomere on chrosomal short arm and 5'-terminus of this base sequence : 122974
gagtaggtccagaaatgctatccaagggcctaggcctggaatcagtccatggttctctgtgtgctgttgtttcttgtggatgcacatctatgtctttgctttgaaggattagttattcgttccagtcttctctgttcagtttgtttgtttgtttgttttattggatagatttgcttacaggttctttactgcccagtcactgactcctttttggctctaggtgcaccttaagcctatgtttgcctcagctctagtaaacaatcagagagctgcctttcctgaatgagggaggtcccccaaaaaatattctggcagtgtgggaggctggctagcagttcatgcccaggggcctgtgggacaaacctcctacagcacagggctgctgaataaccatagaaatg

SEQ ID NO: 10863 - DNA, 222 bp, Homo sapiens
  Z99496.1_132631
  Located on chromosome 6
  Distance between a terminus base of telomere on chromosomal short arm and 5'-terminus of this base sequence : 125000490
  Distance between 3'-terminus of neighbour sequence of sequence listing upward to telomere on chrosomal short arm and 5'-terminus of this base sequence : 45314
actcgtttacattctcaccaatagtgtaaaatcattcccttctatttcataccaacatctatacacacacacacacacacacacacacacacacacacacacacatatgcatgcatatctagtgttcctgtctgtgtatttggtttttagcttcttattctgaatcaggggcttcagtttaataacttaagttgcatcattattaaagataggccagcttca

SEQ ID NO: 10864 - DNA, 273 bp, Homo sapiens
  Z99496.1_56582
  Located on chromosome 6
  Distance between a terminus base of telomere on chromosomal short arm and 5'-terminus of this base sequence : 125076497
  Distance between 3'-terminus of neighbour sequence of sequence listing upward to telomere on chrosomal short arm and 5'-terminus of this base sequence : 75785
ggttcacttccagtctcatttaatggcatatatatatgtgtgtacatatatgtatgaatatatatgtatgtgtgtgtgtgtgtgtgtgtgtgtgtgtgtgtgtgtgtgtatatatatatatatatatatatatatatatatatatatccatattcaccccaagctagaaccttagagtctacttttattcctttctctctatatttattaaatccccaagttgtacatttttacctccaaaatagttgagtttctattactttaggtcaggcc

SEQ ID NO: 10865 - DNA, 278 bp, Homo sapiens
  Z99496.1_33801
  Located on chromosome 6
  Distance between a terminus base of telomere on chromosomal short arm and 5'-terminus of this base sequence : 125099307
  Distance between 3'-terminus of neighbour sequence of sequence listing upward to telomere on chrosomal short arm and 5'-terminus of this base sequence : 22537
attctctgcatagaacagcactaccctcctctctccccagatgtgactattgaggccagttctgggtgtttcagattttttttctctgcatttacacacacacacacacacacacacatacacacgtggaataccactataaatatctccatctgcttttccccatcgctaatgagtcctggtcaagcccccctcactctgtttcctgttcaacatgcactccctgctgcaaactcccctcatctgattcccctgtgttggtcactgccagttaataa

SEQ ID NO: 10866 - DNA, 214 bp, Homo sapiens
  G08527
  Located on chromosome 6
  Distance between a terminus base of telomere on chromosomal short arm and 5'-terminus of this base sequence : 125124169
  Distance between 3'-terminus of neighbour sequence of sequence listing upward to telomere on chrosomal short arm and 5'-terminus of this base sequence : 24584
ctgggcaacaagaacaaaactccatcattcattcatagacagacagacagacagatagatagatagatagatagatagatagatagatagatagatttttttaaaagcaaatgtatttctatattataaatgtatttctaaacttatttctgtgttctatgtcttaaaacttgaaaatacaatataatttacaatcactccaaaaacataaaat

SEQ ID NO: 10867 - DNA, 410 bp, Homo sapiens
  chr6.fa.O7frz.128011694
  Located on chromosome 6
  Distance between a terminus base of telomere on chromosomal short arm and 5'-terminus of this base sequence : 125414294
  Distance between 3'-terminus of neighbour sequence of sequence listing upward to telomere on chrosomal short arm and 5'-terminus of this base sequence : 289911
aagttggttctttaatctttctaatcacaagaaaaaaaaattgtttgggtgtatatatatataatatatatatatatatttttttttttttgagatggagttttgttctgtcacccaggctggagtgcaatggcacaatctcagttacctgcaacctccacctcccgggtccaggcgattctcctgcctcagtctcccaagtagctgggattacaagtgtctgccaccacactcggctaatttttgtatttttagtagagacggggttttaccatgttggtcaggctggtctcaaactcctgacctcaggtgatccgcctgcctcggcctcccagaagtgctgggattacaggcatgagccactgtgcccagccgggtctgtatatcttaaattgccttcataacttatg

SEQ ID NO: 10868 - DNA, 388 bp, Homo sapiens
  AL137009.8_63596
  Located on chromosome 6
  Distance between a terminus base of telomere on chromosomal short arm and 5'-terminus of this base sequence : 125552359
  Distance between 3'-terminus of neighbour sequence of sequence listing upward to telomere on chrosomal short arm and 5'-terminus of this base sequence : 137655
aggtattgttctatgcgtgactagggttctccagagagcagaatcaggaattctggtagtgaggttagaatctgtgttttaatgagctcttcacataattcccaaatttgaaagtttgagaagcacttgttagtgtgtgtgtgtgtgtgtgtgtggtgtgtagggttcttgtatggttgccatgacattcattttcttccttgtttgtagtaaatatgagtcactcatcgagaccttttgatgccttgatatatgatgggcaaattccccttgacactctcaccgaataatttttgttgaatgagattggagcacctgtctggagcagagtggaaccatcaccaagaactcgagtctcttctctcttctgaaatgctgttaaatagcc

SEQ ID NO: 10869 - DNA, 228 bp, Homo sapiens
  D6S304
  Located on chromosome 6
  Distance between a terminus base of telomere on chromosomal short arm and 5'-terminus of this base sequence : 125552466
  Distance between 3'-terminus of neighbour sequence of sequence listing upward to telomere on chrosomal short arm and 5'-terminus of this base sequence : -281
ttgaaagtttgagaagcacttgttagtgtgtgtgtgtgtgtgtgtgtggtgtgtagggttcttgtatggttgccatgacattcattttcttccttgtttgtagtaaatatgagtcactcatcgagaccttttgatgccttgatatatgatgggcaaattccccttgacactctcaccgaataatttttgttgaatgagattggagcacctgtctggagcagagtggaa

SEQ ID NO: 10870 - DNA, 379 bp, Homo sapiens
  AL137009.8_101865
  Located on chromosome 6
  Distance between a terminus base of telomere on chromosomal short arm and 5'-terminus of this base sequence : 125590581
  Distance between 3'-terminus of neighbour sequence of sequence listing upward to telomere on chrosomal short arm and 5'-terminus of this base sequence : 37887
ttgaggaactatgtaggctgagtatagatatggccaaaattaatgactgaaatttggggaactctgtacattccacactggcccgcagtgtgctccacatgttcacacagaacaagactgctagaaatgagaaaaattatataccatctgctcttcagtgcctttcccgattaacttacgtgtgtgtgtgtgtgtgtgtgtgtgtgtgtgtgtgtgtgtgtgtttatttggagacagaggctcgctatgttacccaggctggagtgtggtgacgtgatcacagcccactgcagccttgaactcctgggctcaagcgatcctcctgcctcagccttccaagtagcaaggactaccagtataagccactatgcctagctta

SEQ ID NO: 10871 - DNA, 295 bp, Homo sapiens
  AL022722.1_13578
  Located on chromosome 6
  Distance between a terminus base of telomere on chromosomal short arm and 5'-terminus of this base sequence : 125615460
  Distance between 3'-terminus of neighbour sequence of sequence listing upward to telomere on chrosomal short arm and 5'-terminus of this base sequence : 24500
ctagaatccttggtcctattactagagaggattacagaaaggttgcagtcactacagagaagttctttattatttacatcactcacagtgctcttcaagtgttccattgaacagaagaagccagccctggatgtgtgggcatgccaatttaggcatcgataatggctcaaacaaacaaacaaacaaacaaacaaaaacatcccctgactcccctaccctcaaaccaaaaacaaacaagacaaactctagcggaattgagaatatctgatatgtctgttgatctcaaggatagtga

SEQ ID NO: 10872 - DNA, 167 bp, Homo sapiens
  D6S287
  Located on chromosome 6
  Distance between a terminus base of telomere on chromosomal short arm and 5'-terminus of this base sequence : 125676970
  Distance between 3'-terminus of neighbour sequence of sequence listing upward to telomere on chrosomal short arm and 5'-terminus of this base sequence : 61215
aaattggatattcatgcttgtaccagattagattaaatcaaattaatgagatttcatatatacacatatatatgtgtgtgtgtgtgtgtgtgtgtgtgtgtgtgtgtgtgtatatttggaaatccttgtaggctatagaaaattacagaagcataaggcactaatat

SEQ ID NO: 10873 - DNA, 159 bp, Homo sapiens
  D6S1696
  Located on chromosome 6
  Distance between a terminus base of telomere on chromosomal short arm and 5'-terminus of this base sequence : 125694953
  Distance between 3'-terminus of neighbour sequence of sequence listing upward to telomere on chrosomal short arm and 5'-terminus of this base sequence : 17816
tccaactgttgttttggtgccttctacttattcagactcctctctcttgttctctctctgtgtgtgtgtgtgtgtgtgtgtgtgtgcgtgtcagttactccccacctgcctcttccccgacatacacacttttaatcatgtgtgtgcattctcaagagc

SEQ ID NO: 10874 - DNA, 256 bp, Homo sapiens
  AL078600.15_34780
  Located on chromosome 6
  Distance between a terminus base of telomere on chromosomal short arm and 5'-terminus of this base sequence : 125775831
  Distance between 3'-terminus of neighbour sequence of sequence listing upward to telomere on chrosomal short arm and 5'-terminus of this base sequence : 80719
ttgatttaaacaactttccagaacccccaataactttcattaatgcttaaggtattattttagataattatatacacgcacataaccatgtacatattatgcatatatatatatatatatatatatatataatcaaggggatataaacatacatgaacacatactagtaaatatagttgttaagttgagcacaatattactcttgagaggcttttccaaacaaactgagcattggtgttgctttcagaattaaagc

SEQ ID NO: 10875 - DNA, 178 bp, Homo sapiens
  AL078600.15_63454
  Located on chromosome 6
  Distance between a terminus base of telomere on chromosomal short arm and 5'-terminus of this base sequence : 125804509
  Distance between 3'-terminus of neighbour sequence of sequence listing upward to telomere on chrosomal short arm and 5'-terminus of this base sequence : 28422
attaggatgcaaagtaaacagaacacataattgtttatattctaattttcttcatttagtacacgaggaagggaagcataagctgtttttgaaataaggtgtgtgtgtgtgtgtgtgtgtgtgtatctctaagatgtttggccaaaatttcatttctagctcctaaagttacctcagt

SEQ ID NO: 10876 - DNA, 254 bp, Homo sapiens
  G08565
  Located on chromosome 6
  Distance between a terminus base of telomere on chromosomal short arm and 5'-terminus of this base sequence : 125874892
  Distance between 3'-terminus of neighbour sequence of sequence listing upward to telomere on chrosomal short arm and 5'-terminus of this base sequence : 70205
ttccctcctcaagataaggcagattttctctattgatttattatctatctatctatctatctatctatctatctatcatctatcattatctatcatctgtctgtcatctctatcatctatcttctatcatctgtctatctgtctatcatctatctattacctatctgtcgtctgtctgtctatctatctatcatctattttcgtcattccaggatgggaggctgttgagtcctggtcaggccctctttgttttc

SEQ ID NO: 10877 - DNA, 366 bp, Homo sapiens
  AL080277.12_45927
  Located on chromosome 6
  Distance between a terminus base of telomere on chromosomal short arm and 5'-terminus of this base sequence : 126144607
  Distance between 3'-terminus of neighbour sequence of sequence listing upward to telomere on chrosomal short arm and 5'-terminus of this base sequence : 269461
aagcaggtatggagttccttacagataattctaagaggtgtgtgtgtgtgtgtgtgtgtgtgtgtgtgtgtgcatgtgcatgttgagatgagtggtttcaggcatccattgaagttacatttttgtgtgtgctacagacgtcacagagcaatctcttagcttcctttatttacaagccaggaacttcagctgttttattaaagactggatgtgaacgctgaggtgctttgccaacaaagacatcaaagggacacaagtgcacttttcccatatgttttagttagtttttccctgcatgtctgatatcagtcagagagagtgctagaatataatacctcacaccttgaagattaaacaccttctcag

SEQ ID NO: 10878 - DNA, 369 bp, Homo sapiens
  AL080277.12_8160
  Located on chromosome 6
  Distance between a terminus base of telomere on chromosomal short arm and 5'-terminus of this base sequence : 126182264
  Distance between 3'-terminus of neighbour sequence of sequence listing upward to telomere on chrosomal short arm and 5'-terminus of this base sequence : 37291
ggtcaaatgctcaaagataaatacatataactcaggcttctgaaaactgtttttgaaaatgaacatatcttgacaagcaaaatacatgtttgtgcatggatttccattgaatgtgtgctgagattcctaaaattgtatatacattaggggtgtgtgtgtgtgtgtgtgtgtgtgtgtgtgtgcatgcgcttaattctggcaatgttggaaattgaaatggggacttgtttaatttaatatgaggatcctaaatacagatttttaggagatggtgtgaaattgcacatttataaaatcctatttatttcagcaaagaaaaatattaaccttatttctatttttcttacttagtcttcaggtgagaaagga

SEQ ID NO: 10879 - DNA, 406 bp, Homo sapiens
  chr6.fa.O7frz.128955683
  Located on chromosome 6
  Distance between a terminus base of telomere on chromosomal short arm and 5'-terminus of this base sequence : 126287415
  Distance between 3'-terminus of neighbour sequence of sequence listing upward to telomere on chrosomal short arm and 5'-terminus of this base sequence : 104782
aggtcagtaagtccaatatcaaggtgccagcatcaggtgagtgccttcttgctccatcataacatggcataaagcatcatgacaaaagggcaaagtgagagagagagagagagagataaaaggggactgaattcattcttttataagaaagccattcccatgataataaatccactccatgcaataatggcattaatccacttatgagggccaagcctcatggcctgatcacctcttaaaggtactaccttttaatactgttacaaatggcaattaaatttcaggtgagtttgggagaggacaaacattcaaaccatagtggctattttgctgatgtcagctggcgtcttttccttatatcttcaattgcttctgacattaatagtaaattatgccagcaatatca

SEQ ID NO: 10880 - DNA, 342 bp, Homo sapiens
  AL049613.2_81586
  Located on chromosome 6
  Distance between a terminus base of telomere on chromosomal short arm and 5'-terminus of this base sequence : 126434959
  Distance between 3'-terminus of neighbour sequence of sequence listing upward to telomere on chrosomal short arm and 5'-terminus of this base sequence : 147138
aacgttaatttgaggtaagacaaaacacaagtgtacatgaattcccaaagcctagttataggtattagttactcaatgttttcaaaaaagttaatggtatagaaacaaattttttttactctgaaggctgctaatggttacaattagattttgcaatagacaggtggagcaaagagatgaaatcatttgtgtgtgtgtgtgtgtgtgtgtgtgtgtgtgtgtgcgcgctcatattagcactgtgaatttttaagcaggcaaatgcccattattctcttaactaaatgcttcttcacagagagaaaatgtatagatataccgttcacattgattaaacgaagg

SEQ ID NO: 10881 - DNA, 238 bp, Homo sapiens
  AL049613.2_37329
  Located on chromosome 6
  Distance between a terminus base of telomere on chromosomal short arm and 5'-terminus of this base sequence : 126479233
  Distance between 3'-terminus of neighbour sequence of sequence listing upward to telomere on chrosomal short arm and 5'-terminus of this base sequence : 43932
attggcatctaaactgtcttaaacatttttaggtccatttttattaagggaagctcaaagtgtagatattactgagattaatatagtcctttaaaatgctgtcataggaagatattacagaaaataagcacataccatttcatgctctttaaacaggcacaattttaggggtatgtgtgtatatatatatatatatatatatatatgacttatgctaagctccatgaatacaggtact

SEQ ID NO: 10882 - DNA, 200 bp, Homo sapiens
  D6S1657
  Located on chromosome 6
  Distance between a terminus base of telomere on chromosomal short arm and 5'-terminus of this base sequence : 126792893
  Distance between 3'-terminus of neighbour sequence of sequence listing upward to telomere on chrosomal short arm and 5'-terminus of this base sequence : 313422
aaagatacaggcccacatttaatgtaattgaatgtaattctgtcacctgtacttattataataaataatactatttattttcttttatattttgttccattgaactgtaaaatattattccacacactcacataagcacacacacacacacacacacacacacacacacacagttgtaggctccacgatggcaaaatggt

SEQ ID NO: 10883 - DNA, 294 bp, Homo sapiens
  chr6.fa.O7frz.129577141
  Located on chromosome 6
  Distance between a terminus base of telomere on chromosomal short arm and 5'-terminus of this base sequence : 126904642
  Distance between 3'-terminus of neighbour sequence of sequence listing upward to telomere on chrosomal short arm and 5'-terminus of this base sequence : 111549
atgcttacatgtaatgtggtcttccattcttttactttcaaactacatatgttaaatctgaagtgagtttcatatacacagcatatacttgcatcataatttttagagactatgacaatctatttttctattggtatattttcagcgtttacatcaggcaattattgatgtgtcaactcctaactctaccatcttacttgttttttgttacttgttattttattttattttattttattttattttattttattttattttattttatttttgagatggagtttcactcttgtt

SEQ ID NO: 10884 - DNA, 270 bp, Homo sapiens
  D6S1608
  Located on chromosome 6
  Distance between a terminus base of telomere on chromosomal short arm and 5'-terminus of this base sequence : 127034584
  Distance between 3'-terminus of neighbour sequence of sequence listing upward to telomere on chrosomal short arm and 5'-terminus of this base sequence : 129648
tgtcaaaccataagcagcagacaggtggggggataataagaacccagatgttctttcctctcttcctgggatctgctaattgtaccttccctcgaccagaccaaaggagaagcaagaatgaaaggtagcattagagattagtatttatggcctcaaaagaaggcatagacggatagaaaattgatctgtaagaaaatggagcaaaaccagtacacacacacacacacacacattataatatatcttctttgagactggaccttgtatctt

SEQ ID NO: 10885 - DNA, 233 bp, Homo sapiens
  AL096854.5_14961
  Located on chromosome 6
  Distance between a terminus base of telomere on chromosomal short arm and 5'-terminus of this base sequence : 127062320
  Distance between 3'-terminus of neighbour sequence of sequence listing upward to telomere on chrosomal short arm and 5'-terminus of this base sequence : 27466
ccaagtatctttgcattatgaaacagtatttgtcacccactaaaatgtgacatacttttcactttattaaattcttccttgctgtttgtactcccctcatctcacacacacacacacacacacacacacacacacacacacacaaatatcattttataagggcaatgaataaaataacttttgtgtactgatgtagtctcagagaccagaatagtgtctggaatagtacgtgc

SEQ ID NO: 10886 - DNA, 219 bp, Homo sapiens
  AC064878.9_129874
  Located on chromosome 6
  Distance between a terminus base of telomere on chromosomal short arm and 5'-terminus of this base sequence : 127394982
  Distance between 3'-terminus of neighbour sequence of sequence listing upward to telomere on chrosomal short arm and 5'-terminus of this base sequence : 332429
attacggaatcactgagcataggatatgctagaagaacatctatagatttacatgcatatatatgtgtgtgtgtgtgtgtgtgtgtgtgtgtgtgtataaactatcatgcagatttaatgaaaggtaacttttttttccagaaataactccccctggtttcacatacttaagagaaagaagatggcattctttctttgttgattggttgatgtcagaat

SEQ ID NO: 10887 - DNA, 476 bp, Homo sapiens
  AC064878.9_92664
  Located on chromosome 6
  Distance between a terminus base of telomere on chromosomal short arm and 5'-terminus of this base sequence : 127432014
  Distance between 3'-terminus of neighbour sequence of sequence listing upward to telomere on chrosomal short arm and 5'-terminus of this base sequence : 36813
tcttggaagctataagtaacaaactaccttttcaatggaaattttctcctgatctgttggcctcaccatatctgaaagaaaagaaaatttcgggtgcattttaaaacagagtaatttttaaataacagtcagttctgaagatgttctcttctacccaaaatgtcaaggagcataagtttagatataagtcagggtcctccagagaaacagaatgaataggatgtggctctatctatctatctatctatctatctatctatctatctatctatctgatatatatacatatatatatatacacacatatatttatggagagagacatattgattattaggaattagctcatgaaattatggaaggtggaaagtccaccatctgctgcatgccacctggagacccaagaaagccagtggtgtgattcagtcccaatcagaaggcctgagaacaaggtgagccagtgattacgtaaatct

SEQ ID NO: 10888 - DNA, 184 bp, Homo sapiens
  G12412
  Located on chromosome 6
  Distance between a terminus base of telomere on chromosomal short arm and 5'-terminus of this base sequence : 127432204
  Distance between 3'-terminus of neighbour sequence of sequence listing upward to telomere on chrosomal short arm and 5'-terminus of this base sequence : -286
agggtcctccagagaaacagaatgaataggatgtggctctatctatctatctatctatctatctatctatctatctatctatctgatatatatacatatatatatatacacacatatatttatggagagagacatattgattattaggaattagctcatgaaattatggaaggtggaaagtcca

SEQ ID NO: 10889 - DNA, 193 bp, Homo sapiens
  DISO7_10002231
  Located on chromosome 6
  Distance between a terminus base of telomere on chromosomal short arm and 5'-terminus of this base sequence : 127674873
  Distance between 3'-terminus of neighbour sequence of sequence listing upward to telomere on chrosomal short arm and 5'-terminus of this base sequence : 242485
ccacctgtaattaaagtgaatcagaacatatttattttactgtgtccacagaaaaaataaagttaatttcttttttactggtaaatgttattgaaatctgatatgtatatatctgatatatatatatacatatatacacacacgtgtatatatacacatgtgtgtatatatatttgccacttgtgcagtgttt

SEQ ID NO: 10890 - DNA, 329 bp, Homo sapiens
  chr6.fa.O7frz.132125292
  Located on chromosome 6
  Distance between a terminus base of telomere on chromosomal short arm and 5'-terminus of this base sequence : 127946722
  Distance between 3'-terminus of neighbour sequence of sequence listing upward to telomere on chrosomal short arm and 5'-terminus of this base sequence : 271656
ggctaaaattgctgtacctaactaaggttagagacatcaagaaatagaaacatttgaatgtgtccaaaattcaattgacaatagtagttttataagcactctaataagcagtgctcccactaaacaaaagttaatattgatgtcacgatgcatatatatatatatatatatacatatatatatgaggcatatatacacatcatgatatatatatatatatgatagatgagaataaatttccatggtttgctggtaaacctttcaattaaaaattatttattttcttacttaaaaacttatatgtgatgtccagtatgtaaagttaggaa

SEQ ID NO: 10891 - DNA, 267 bp, Homo sapiens
  chr6.fa.O7frz.130634491
  Located on chromosome 6
  Distance between a terminus base of telomere on chromosomal short arm and 5'-terminus of this base sequence : 128023322
  Distance between 3'-terminus of neighbour sequence of sequence listing upward to telomere on chrosomal short arm and 5'-terminus of this base sequence : 76271
gcctggtcagttaatactaaactaattgaagcacctgagggagagcagatagagtatggaggagggatgtaatgagatctgggttaaaatctgttcatatcattcattggataaggtattttgcttttctaatcatcagtttccttttcttaatgtaagggtttttttgtttgtttgtttgtttgtttttaattgtcctgtgttggggtaaagagaaaggatctgcttggtacctggcacctactacgtgatcaataaaccatttat

SEQ ID NO: 10892 - DNA, 470 bp, Homo sapiens
  Z93931.1_11103
  Located on chromosome 6
  Distance between a terminus base of telomere on chromosomal short arm and 5'-terminus of this base sequence : 128282171
  Distance between 3'-terminus of neighbour sequence of sequence listing upward to telomere on chrosomal short arm and 5'-terminus of this base sequence : 258582
ctgcaataactttgcattctaggcacacttactgctttgcaccataattagtttttgctcttcttatccattttaggactttggttgacgattgagttattcacaattagttcgtgtcacataatcatcagtggtctacaaagaccccacacacattttatttatctatctatctatctatctatctatctatctatctatctatctatctaattcattttttcaacagtctgtactcccacgtccctccacatcataggctgtcattttaacgtgtttccatgtatcctttaatttgtttgctaaatgggcatcattgctttgtgtgaatgtattttaatttatatgtatggtattgttatagattattttgtttcttccttttaagcttgctcagcgctatgtgttttaaaggtatatctgttattttgttacatctagttctttgcttctaactgtggcaaagcatc

SEQ ID NO: 10893 - DNA, 394 bp, Homo sapiens
  Z93931.1_50680
  Located on chromosome 6
  Distance between a terminus base of telomere on chromosomal short arm and 5'-terminus of this base sequence : 128321810
  Distance between 3'-terminus of neighbour sequence of sequence listing upward to telomere on chrosomal short arm and 5'-terminus of this base sequence : 39169
gcttacgttattcatctttgctactggctgccagtaaagatttacaataacttccagatgcaaaatgtgccaggctatggcatgcatgcatgcgcatgagcacacacacacacacacacacacacacacacacacacactcttgggctccaaggtttacaaatctagtggtgtgggcctttagattcactcacatagccatttcccaccaaggccatccatgattccaagatggctgagtggggttgggaatacataacacctaaattggccagaaccgacattatcttttacttatatctctccttggttggagcttccctagtatcactataaatatgtatagaatgcaaatgtttctgcatttaaggcactgcctgatcaatggtagataa

SEQ ID NO: 10894 - DNA, 260 bp, Homo sapiens
  D6S1712
  Located on chromosome 6
  Distance between a terminus base of telomere on chromosomal short arm and 5'-terminus of this base sequence : 128321814
  Distance between 3'-terminus of neighbour sequence of sequence listing upward to telomere on chrosomal short arm and 5'-terminus of this base sequence : -390
acgttattcatctttgctactggctgccagtaaagatttacaataacttccagatgcaaaatgtgccaggctatggcatgcatgcatgcgcatgagcacacacacacacacacacacacacacacacacacacactcttgggctccaaggtttacaaatctagtggtgtgggcctttagattcactcacatagccatttcccaccaaggccatccatgattccaagatggctgagtggggttgggaatacataacaccta

SEQ ID NO: 10895 - DNA, 364 bp, Homo sapiens
  Z93931.1_66218
  Located on chromosome 6
  Distance between a terminus base of telomere on chromosomal short arm and 5'-terminus of this base sequence : 128337332
  Distance between 3'-terminus of neighbour sequence of sequence listing upward to telomere on chrosomal short arm and 5'-terminus of this base sequence : 15258
cgcatacctactttccaactaggaagttggttcttacactatttctttctttttatagtacttctttccattttaaccatatagggtgactatagatgtgtgtgtgtgtgtgtgtctgtgtgtgtgtgtgtgtgtgtgtgtgtgtgtgtgtgtaccacttaggttttaagtatctggagggcagaaatgtatcatttaggcatttggttcatgttacagtacattgtgtgaatacttgacaagagttttacctggctaggtgattgagcttttttcttttaggtaagcaattataaaaggacagttattacttatcattgtttcattacctaataagtgcctatccaaagaatataggcatcct

SEQ ID NO: 10896 - DNA, 216 bp, Homo sapiens
  Z93931.1_142820
  Located on chromosome 6
  Distance between a terminus base of telomere on chromosomal short arm and 5'-terminus of this base sequence : 128413918
  Distance between 3'-terminus of neighbour sequence of sequence listing upward to telomere on chrosomal short arm and 5'-terminus of this base sequence : 76222
tcaacactttggatccacttactccgtggtttccccagtagtggaataggggatggtgaggtgagaggaaattagagaacattactgccatttatcattgttattatagattttcccgagtttaaattagaagtgtgtgtgtgtgtgtgtgtgtgtgtgtgtgtgtgtgtgtgtgtgcatgtgtgggtgcccatctcagtatcattgaagccacat

SEQ ID NO: 10897 - DNA, 285 bp, Homo sapiens
  Z93931.1_143744
  Located on chromosome 6
  Distance between a terminus base of telomere on chromosomal short arm and 5'-terminus of this base sequence : 128414750
  Distance between 3'-terminus of neighbour sequence of sequence listing upward to telomere on chrosomal short arm and 5'-terminus of this base sequence : 616
cctatctgctcagtctctgataactagtctttagagataaattttttctaaattccacatgagtgagatcatgtggcattttcctttatctgccttatttcactcaacatggatgtcctccagtttcatctatgttgttgcaaatgacagaatttattctttttatggctgaacagtattcctctctctctctgtctctctctctctctctctctctctctctctgtgtgtgtgtgtgtgtgtgtgcaatattttctttatgtattcatccactaatgaccactt

SEQ ID NO: 10898 - DNA, 340 bp, Homo sapiens
  chr6.fa.O7frz.131193946
  Located on chromosome 6
  Distance between a terminus base of telomere on chromosomal short arm and 5'-terminus of this base sequence : 128496445
  Distance between 3'-terminus of neighbour sequence of sequence listing upward to telomere on chrosomal short arm and 5'-terminus of this base sequence : 81410
gttgtaaatcaggtgaccatataggcatgatctgtttctggaatctctactatcttttattggttcagtttcagtccttgtgccaatattacactgtgatagttactgtaaatttgtaaaatccaccagttagttcttctttttcaagatttttcatgccttacttaggtcctttgcatttctatgtacatttcagcatcagctttttagtttccaaatacacacacacacacacacacacaaatgcttgctggtaattttgattgtaattttgttgattatgttgatcaattttgagaggattagtttttttcctctcagcaatttagttttaagcata

SEQ ID NO: 10899 - DNA, 263 bp, Homo sapiens
  AL121846.6_9143
  Located on chromosome 6
  Distance between a terminus base of telomere on chromosomal short arm and 5'-terminus of this base sequence : 128772065
  Distance between 3'-terminus of neighbour sequence of sequence listing upward to telomere on chrosomal short arm and 5'-terminus of this base sequence : 275280
ttcaatggatgaacagctaaagaaaatgtgctttatacacaaacgaacacacacacacacacacacacacagagtgggatactattcagcattaaaaacaaaggaaatcttgtcctttgcaacacagatgaacctgaaaaaacatcatgttaagtgaaataagttgttcacaaagagacaaatatagagtctaaaaaagcagaactcacagaagcacacaataaatgtgatttctaggggataggaatagaggtcatggtgac

SEQ ID NO: 10900 - DNA, 181 bp, Homo sapiens
  Z99129.1_34387
  Located on chromosome 6
  Distance between a terminus base of telomere on chromosomal short arm and 5'-terminus of this base sequence : 128945346
  Distance between 3'-terminus of neighbour sequence of sequence listing upward to telomere on chrosomal short arm and 5'-terminus of this base sequence : 173018
agttccactaacctgttccatatggtaccaattcttaatctaacagttaacagttcattcaaaataatggcaacaatgtatttgattttgtacacatatatttttgtgtgtgtgtgtgtgtgtgtgtgtgtatagtcgtcatacttaggggtgcttatatataagtggaatgacagcaatg

SEQ ID NO: 10901 - DNA, 277 bp, Homo sapiens
  chr6.fa.O7frz.131743388
  Located on chromosome 6
  Distance between a terminus base of telomere on chromosomal short arm and 5'-terminus of this base sequence : 129041202
  Distance between 3'-terminus of neighbour sequence of sequence listing upward to telomere on chrosomal short arm and 5'-terminus of this base sequence : 95675
aatgactagtgatcttgaacatcttttcatatgtttgttggacatttgtgtattttctttggggaaatatctattcaagtcctttgcccagtttttagttgctttttttgagttgtagcagttctttatatatttgggtattaacactgtagcaaatatatgatctcctgcaggctgccttttcactctcctgatagtgtcctttgatgcacaaaactttttatttatttatttatttatttatttatttatttatttatgagaaagagtcttggtc

SEQ ID NO: 10902 - DNA, 379 bp, Homo sapiens
  chr6.fa.O7frz.131881272
  Located on chromosome 6
  Distance between a terminus base of telomere on chromosomal short arm and 5'-terminus of this base sequence : 129178513
  Distance between 3'-terminus of neighbour sequence of sequence listing upward to telomere on chrosomal short arm and 5'-terminus of this base sequence : 137034
catggaaagcttggtaatactatctgtggctgtgtacccagctaaactttctatttctatagaaagggggagaggagcaaatagcagccagccagcagtattccctacactcgtcttcctccagttttatagtctgcaccctttggtgggcccttattgcccattgccaaggctatttctaaaaacttttgctggatttgctatttgcttactaccaatccacccatcacccattctttcttataaggaatcacatgtttttgttgttgttgttgttgttgttgttgttaaacctcatcagacctttgctcagtggcccacagcatgaagtctctgtttcaatattctttataatctggtcctagtatacctgttgcca

SEQ ID NO: 10903 - DNA, 103 bp, Homo sapiens
  DID22N_0028557
  Located on chromosome 6
  Distance between a terminus base of telomere on chromosomal short arm and 5'-terminus of this base sequence : 129242996
  Distance between 3'-terminus of neighbour sequence of sequence listing upward to telomere on chrosomal short arm and 5'-terminus of this base sequence : 64104
ctttatcttgcaggcaacagggaatcttaaaaggctgtgcgtgtgtgtgtgtgtgtgtgtgtgtgtgtgtggtaaacgaacgggatgagtgctatcaaacctt

SEQ ID NO: 10904 - DNA, 296 bp, Homo sapiens
  AC005587.1_124039
  Located on chromosome 6
  Distance between a terminus base of telomere on chromosomal short arm and 5'-terminus of this base sequence : 129570191
  Distance between 3'-terminus of neighbour sequence of sequence listing upward to telomere on chrosomal short arm and 5'-terminus of this base sequence : 327092
tgacagagcaagactccatctcaaaaaaggaaagaaagaaagaagaaaagaaagaaagaaagaaagaaagaaagaaagaaagaaagaaagaaagaaagaaagaaagaaggaaggaaggaaggaaggaaggaagcaaggaaggaaggaaggaaggaaggaaggaaggaaggaaggaaagaaagaaagaaagaaagaaagaaagaaagaaagaaagaaagaaagaaagagagaaagaaagaaagggaaaagaaggcatggtgaatatattttagatagttcacgcttagagtaacctg

SEQ ID NO: 10905 - DNA, 283 bp, Homo sapiens
  chr6.fa.O7frz.142204984
  Located on chromosome 6
  Distance between a terminus base of telomere on chromosomal short arm and 5'-terminus of this base sequence : 129607690
  Distance between 3'-terminus of neighbour sequence of sequence listing upward to telomere on chrosomal short arm and 5'-terminus of this base sequence : 37203
cattccataccattccactagggttgattccatgccattccattccattccattccattccattccattccattccattccattccattccattccactcgggttgattccattccattccattccaatccattccattccattccattccattccattccattccattccattccattccattccattccactcgggttgattccattccattccattccattccattccattccattccactccattccattacattccattctactctggttaattccgt

SEQ ID NO: 10906 - DNA, 110 bp, Homo sapiens
  DISO7_10002232
  Located on chromosome 6
  Distance between a terminus base of telomere on chromosomal short arm and 5'-terminus of this base sequence : 129744611
  Distance between 3'-terminus of neighbour sequence of sequence listing upward to telomere on chrosomal short arm and 5'-terminus of this base sequence : 136638
tggctgtgttccaatcacggaatggaatggaatggaatggaatggaatggaatagaatagaatagaatagaatagaatagaatagaatttacagcaataagtattgggcg

SEQ ID NO: 10907 - DNA, 277 bp, Homo sapiens
  Z67084
  Located on chromosome 6
  Distance between a terminus base of telomere on chromosomal short arm and 5'-terminus of this base sequence : 129953055
  Distance between 3'-terminus of neighbour sequence of sequence listing upward to telomere on chrosomal short arm and 5'-terminus of this base sequence : 208334
agatggggcttgtggttaatatggtaaccctgtatctagagggtgtgctgaataattaacagatattgtgagtgatcagtaatcctattaaatgttgttcccattttacagataaggaaattgtgaatcagagaagatagtttacttaaatagtttttatctaggcctactcagtgaacatttatctacctcttttgggacacacacacacacacacacacacaccacatttttgaaattctgggaatataaagatgaatgaggcacagtctggctc

SEQ ID NO: 10908 - DNA, 304 bp, Homo sapiens
  chr6.fa.O7frz.132313848
  Located on chromosome 6
  Distance between a terminus base of telomere on chromosomal short arm and 5'-terminus of this base sequence : 130290012
  Distance between 3'-terminus of neighbour sequence of sequence listing upward to telomere on chrosomal short arm and 5'-terminus of this base sequence : 336680
tatttccattactgcgaaatacttctcatagcagtattgtcagaatagatttggcgctctctctctctctctctctctctctctctctcaatctcaatcattttttcttctcctctatcccacacataattctttcttctacatcaatcctttaagaaggtatgctgtttcatggttcatcaaacataaggcagaaaaaaagaaatatgtccagtaccttctgcaggtttttttgttttcttggaatctgaaaacacaaagataaattattaataaaacagatacaataaatcaacagctgatc

SEQ ID NO: 10909 - DNA, 340 bp, Homo sapiens
  chr6.fa.O7frz.132402004
  Located on chromosome 6
  Distance between a terminus base of telomere on chromosomal short arm and 5'-terminus of this base sequence : 130333153
  Distance between 3'-terminus of neighbour sequence of sequence listing upward to telomere on chrosomal short arm and 5'-terminus of this base sequence : 42837
aaaggtagtgaggaaagttcagctactaaacatatttcaaaggtgaaagtgagaggatttaataatgaattaaggaagagaaataatggagtcagcagtggctagagagatttaagcctggggaaaaaagggtgtagtaatcttctaataagaggaaaatactgagcatagagccacattcagaggtagaggtgtgtgtgtgtgtgtgtgtgtgtgtgtgtgtgtgtgtgtgtgtgtatgtgtagatgaggggtgttgttgtttgttcaaaaaaacatattaacttcaagaagtctactggatatttaaatggagatggtgaataggcaattggatagat

SEQ ID NO: 10910 - DNA, 235 bp, Homo sapiens
  chr6.fa.O7frz.132588662
  Located on chromosome 6
  Distance between a terminus base of telomere on chromosomal short arm and 5'-terminus of this base sequence : 130530310
  Distance between 3'-terminus of neighbour sequence of sequence listing upward to telomere on chrosomal short arm and 5'-terminus of this base sequence : 196817
cagttccactaaatggatactaaatatattttatcttctttatgattttcttaaaaaacattttcctttccctagcttacttcattgtaattatctctctctctctatatatatatacagacacacacacacacacacacacacacacaggcacacgcacacacatataacatacaaaatatgtgttaatcaacaatgtttttggtaaagcctctggtcaacagtaggctattaa

SEQ ID NO: 10911 - DNA, 219 bp, Homo sapiens
  chr6.fa.O7frz.132784908
  Located on chromosome 6
  Distance between a terminus base of telomere on chromosomal short arm and 5'-terminus of this base sequence : 130726320
  Distance between 3'-terminus of neighbour sequence of sequence listing upward to telomere on chrosomal short arm and 5'-terminus of this base sequence : 195775
aacacgtatttctgaatgtagaagttttaggtccaagtatgagtttttaattcaataaaatatgtggataagagttaagaacaatgtgattgtaaatttaaaaattattttttagactctaacaaattttcagacttcttgtggaaacacacacacacacacacacacacacacacacacacacacacacacagaggaatcataaccaggaacttctgt

SEQ ID NO: 10912 - DNA, 438 bp, Homo sapiens
  AL035692.10_60582
  Located on chromosome 6
  Distance between a terminus base of telomere on chromosomal short arm and 5'-terminus of this base sequence : 130819782
  Distance between 3'-terminus of neighbour sequence of sequence listing upward to telomere on chrosomal short arm and 5'-terminus of this base sequence : 93243
atttgaaatgcaattgtcaaacctatatttgataaattaatctttatttacagcaataagtattgtcttacatctgtattaatataaaatagtcgtatatatacatacatacatatatatatatatatatgtatatatatatacacacacacacacacacacacacacacacacacacacacacacacatatcaattccccccaacccccaagggcatattttcaaactgggcatcaaccaaccaattttacaggtatttttcactgaattcagtctatgttttggactaaagtttatggtccaaattatgtaatgataaattagataagtctaaccattatctttacctctcagatggtctggaataatggcagctcaataaatcctttccctgaaatacagagaggtagatacttgtcttgcttagtacaccaatt

SEQ ID NO: 10913 - DNA, 346 bp, Homo sapiens
  chr6.fa.O7frz.134240035
  Located on chromosome 6
  Distance between a terminus base of telomere on chromosomal short arm and 5'-terminus of this base sequence : 130973231
  Distance between 3'-terminus of neighbour sequence of sequence listing upward to telomere on chrosomal short arm and 5'-terminus of this base sequence : 153011
cttgtttccacaaaggtaaagattttcacagtatttcatttagctttctaatctaacgcacctgctttctcttttcttcatctatcagaaaattacacacacacacacacacacacacacaacactcaacaaactgaaaaggtccagtgattccacttgatttattaaaatatgcactcactagctgcctttccatatgtgacatgcacgcactgcagttcccgcttacccaggcctatgaaatgctaaccctgtgctacagtctgaatgtgtcccccaaaattcatatgttgaaacttattgatagtattagatggtggtgccttcaggaagttattcactcatg

SEQ ID NO: 10914 - DNA, 305 bp, Homo sapiens
  chr6.fa.O7frz.134147986
  Located on chromosome 6
  Distance between a terminus base of telomere on chromosomal short arm and 5'-terminus of this base sequence : 131065242
  Distance between 3'-terminus of neighbour sequence of sequence listing upward to telomere on chrosomal short arm and 5'-terminus of this base sequence : 91665
tgacctaaccaaagcagtaacagaaaacatggagacacagagatattcttgggatacatactggagaaataccctgaaattaattatgtatgggacacggtgggaggtgtgtcataatggacacacacacacacacatacacacacacacacacacacagcatgcttcttcctatgttcttatttactgtatactgatagtttggttatatattaaggttttttatgctgcttaccaattattttactttccttctttattttctgtgtgtagtaaatttattgtctgacattgttcacaaattt

SEQ ID NO: 10915 - DNA, 235 bp, Homo sapiens
  AL121968.10_34932
  Located on chromosome 6
  Distance between a terminus base of telomere on chromosomal short arm and 5'-terminus of this base sequence : 131185464
  Distance between 3'-terminus of neighbour sequence of sequence listing upward to telomere on chrosomal short arm and 5'-terminus of this base sequence : 119917
tggactcaacctagaaactgttaggccccttttaatttccatcttggattttccctagtagtatgtgtctgtgtgtcgtgtgtgtgtgtgtgtgtgtgtgtgtgtgtatctgtgtgtgtgtgtgtctgtgtaagatgctataacaggctaattttacttgttaggtaagttatattcccctgcaaacaactgaaatgaaaatcatttctttgttgattcctggaattgtattaac

SEQ ID NO: 10916 - DNA, 239 bp, Homo sapiens
  AL121968.10_44146
  Located on chromosome 6
  Distance between a terminus base of telomere on chromosomal short arm and 5'-terminus of this base sequence : 131194594
  Distance between 3'-terminus of neighbour sequence of sequence listing upward to telomere on chrosomal short arm and 5'-terminus of this base sequence : 8895
atttcactgcactcttgctaaccctgtgtattatctgttctcatagttgttaatttgatagaagaaaaaatgttattttcatttttaattgtatttctaatcgtagtgagttagaatttttcgtatgttcattacccatttttgttttctgtttggaaaattgtgtgtgtgtgtgtgtgtgtgtgtgtgtgtgcgcgcgcgtgtgtgtgtgtgtgtgtgagataagtttcgttcttgct

SEQ ID NO: 10917 - DNA, 219 bp, Homo sapiens
  HUMUT2139
  Located on chromosome 6
  Distance between a terminus base of telomere on chromosomal short arm and 5'-terminus of this base sequence : 131302536
  Distance between 3'-terminus of neighbour sequence of sequence listing upward to telomere on chrosomal short arm and 5'-terminus of this base sequence : 107703
cctaataatgcatggcccttgtattagtcagggttttccagaaaaacagaatcaatatgagatagatagatagatagatagatagatagatagatagatagatagatagatagatagatagattagatagatacagacagacagatagatacatagacagtataagaaattgactcatgtaattatagaggatagaagtcccaatatctgcagtctgca

SEQ ID NO: 10918 - DNA, 189 bp, Homo sapiens
  chr6.fa.O7frz.133828805
  Located on chromosome 6
  Distance between a terminus base of telomere on chromosomal short arm and 5'-terminus of this base sequence : 131384430
  Distance between 3'-terminus of neighbour sequence of sequence listing upward to telomere on chrosomal short arm and 5'-terminus of this base sequence : 81675
agaagcgtcattacctcttaaggaggttttaaatcaatcaaacctgtttcttttactgaattcatatgtatgtatgtgactgtgtgtgtgtgtgtgtgtgtgtgtgtgtgtgtgtgtgtgtgtgtgaacataagaaaaaatatacttttccaatttttgacaggcatgtttaaggcatagtcacatttg

SEQ ID NO: 10919 - DNA, 381 bp, Homo sapiens
  chr6.fa.O7frz.133712044
  Located on chromosome 6
  Distance between a terminus base of telomere on chromosomal short arm and 5'-terminus of this base sequence : 131501169
  Distance between 3'-terminus of neighbour sequence of sequence listing upward to telomere on chrosomal short arm and 5'-terminus of this base sequence : 116550
aacttcggtttcaattgtaaacaaacacttgtaaacctttaatatttcccctgacaatttttctacctcaatttcttgtcttaattgaaatttagatttactctaatgggaatgctttctgttcagccattcaaaggagatgagagttttgtgtgtgtgtgtgtgtgtgtttgtgtgcgtgtgcacctcatgatcaaaagacaaaatatgaataaagaattggagagttttcagcattcttcttattctgcattactcttctttcaccttacctaaaaactttttttaaaacaattatgtcatctggctggaccgctatgcatatatcctaattcttagcatattctggtcttttccctaagttcaccaattagtttgaaa

SEQ ID NO: 10920 - DNA, 154 bp, Homo sapiens
  D6S988
  Located on chromosome 6
  Distance between a terminus base of telomere on chromosomal short arm and 5'-terminus of this base sequence : 131608898
  Distance between 3'-terminus of neighbour sequence of sequence listing upward to telomere on chrosomal short arm and 5'-terminus of this base sequence : 107348
ctcagataacagattagggtgctttccttaaattccaataaaaaggaatctactaggctcttcatatagaaattgtctctttcctgacacacacacacacacacacacacacactctctcatcatgaaagagacaatttctatgtatgcgtgaa

SEQ ID NO: 10921 - DNA, 189 bp, Homo sapiens
  D6S1639
  Located on chromosome 6
  Distance between a terminus base of telomere on chromosomal short arm and 5'-terminus of this base sequence : 131667658
  Distance between 3'-terminus of neighbour sequence of sequence listing upward to telomere on chrosomal short arm and 5'-terminus of this base sequence : 58606
tctcaaggaagtctgccccctagccaccctgtctgaaattgcaacacacacacacacacacacacacacacacacacacacacacacacacacacacacacacacacacaccccctatctccctttcctgccttattttcctccgtcacacttatcactaatacactgcaatggtctaaatgtttctcc

SEQ ID NO: 10922 - DNA, 179 bp, Homo sapiens
  D6S408
  Located on chromosome 6
  Distance between a terminus base of telomere on chromosomal short arm and 5'-terminus of this base sequence : 131685946
  Distance between 3'-terminus of neighbour sequence of sequence listing upward to telomere on chrosomal short arm and 5'-terminus of this base sequence : 18099
gcagaagcagactgaggctaattacagaattcagccatccttcataaaagaccacaaaaatcagcagaatgtcatttcttactcagtatttcttgctttattagaaatcacattcacacacacacacacacacacacacacaaacacacacacatgtacacagagatgacatccagtaa

SEQ ID NO: 10923 - DNA, 221 bp, Homo sapiens
  D6S1702
  Located on chromosome 6
  Distance between a terminus base of telomere on chromosomal short arm and 5'-terminus of this base sequence : 131979492
  Distance between 3'-terminus of neighbour sequence of sequence listing upward to telomere on chrosomal short arm and 5'-terminus of this base sequence : 293367
tgccagcattttttggatattgtgttttgttttttcacatcccatgtctacaaattgcccattttcaacctatgatattttcaacttggagcatctgcctacatatgtgtgtgtgtgtgtgtgtgtgtgtgtgtgtgtgtgtgtgtgtgtgtgtgtgtatatcttattacaggttttaatccatcctgtgaagaatatcctaggcacaaaaatggctcctt

SEQ ID NO: 10924 - DNA, 376 bp, Homo sapiens
  chr6.fa.O7frz.133111590
  Located on chromosome 6
  Distance between a terminus base of telomere on chromosomal short arm and 5'-terminus of this base sequence : 132119140
  Distance between 3'-terminus of neighbour sequence of sequence listing upward to telomere on chrosomal short arm and 5'-terminus of this base sequence : 139427
tcttccatgagtcattagtcaggtaaagacacttaaggcacataattaggcaagtatgtagttttttatttaatattggtttgaggaaactagctctaaataaattaggggaccaattgggaacctttgatatggtcaggttttagaggagatgagaaggataaaaggagaaagttgtttgaaaaaaatcaagttacaaaatactgcgatttcatttttagatatatggatctgtctatctatctatctatctatctatctatctatctatctatctatcgtgtaacacatatgttaaagatgtaaaatacccattgttttatatatctgtaagaaagaaaaagtgctgtcaattaattgcaagacataattgatt

SEQ ID NO: 10925 - DNA, 408 bp, Homo sapiens
  chr6.fa.O7frz.132991150
  Located on chromosome 6
  Distance between a terminus base of telomere on chromosomal short arm and 5'-terminus of this base sequence : 132239782
  Distance between 3'-terminus of neighbour sequence of sequence listing upward to telomere on chrosomal short arm and 5'-terminus of this base sequence : 120266
ttcttatcaaatattcaatgttcacattttgcaaattgccgtgtgtgtgtgtgtgtgtgtgtgtgtgtgtgtgtgtgtatttaacaatttgtttgattcaaggtccaaatacagtctatacatagagattgcttaataggtctctcaagtctcctttgacttcttggttccccctcctccttttctttcttctttttttttccttgcaattttctgttgacaaattgggccatttgtactgtagagtgtcctgcagtcttgattttgttgatttcatccatgaaatgttgtttagtgtgtgtttctatgtttcttatatttttcatagattgatagttaaatctagagcttattcagatttgttttattttttaagcaagattacttcataggtatgtccatgttatt

SEQ ID NO: 10926 - DNA, 341 bp, Homo sapiens
  AC025347.1_117800
  Located on chromosome 6
  Distance between a terminus base of telomere on chromosomal short arm and 5'-terminus of this base sequence : 132325795
  Distance between 3'-terminus of neighbour sequence of sequence listing upward to telomere on chrosomal short arm and 5'-terminus of this base sequence : 85605
tccttgtaagtgcaagaaatacaagaattaaatacaaatacaatgaataaaatacagccctgtgaagacaaaagagaaagacaggaaataaggcaaagataaagtgataagtagtcagggaaaagtaggtgtcaagtatcagagtaccaccaaggaaagacacagttaaatgtctgcccactttattattattattattattattattattattattattattattatactttaagttctggggtacttgtgcagaacatgcaggtttattacataggtatacacgtgccatggtggtttgctgcacccatcaacctgtcatctacattaggtatttctgc

SEQ ID NO: 10927 - DNA, 218 bp, Homo sapiens
  D6S1025
  Located on chromosome 6
  Distance between a terminus base of telomere on chromosomal short arm and 5'-terminus of this base sequence : 132325941
  Distance between 3'-terminus of neighbour sequence of sequence listing upward to telomere on chrosomal short arm and 5'-terminus of this base sequence : -195
ccaccaaggaaagacacagttaaatgtctgcccactttattattattattattattattattattattattattattattatactttaagttctggggtacttgtgcagaacatgcaggtttattacataggtatacacgtgccatggtggtttgctgcacccatcaacctgtcatctacattaggtatttctgctaatgctattcctcccctagtcc

SEQ ID NO: 10928 - DNA, 185 bp, Homo sapiens
  D6S1715
  Located on chromosome 6
  Distance between a terminus base of telomere on chromosomal short arm and 5'-terminus of this base sequence : 132377261
  Distance between 3'-terminus of neighbour sequence of sequence listing upward to telomere on chrosomal short arm and 5'-terminus of this base sequence : 51102
aatgtcttttgtaaactctcctaacatgcttattaaatgtgtgtgtgtgtgtgtgtgtgtgtgtgtgtgtgtgtgtgtgtgttttgagaaaacctgggaagtggtttgataattatagccccgagttaacatagcctacccccacatgcttagttccagttttcagattcccactgctggtgatt

SEQ ID NO: 10929 - DNA, 261 bp, Homo sapiens
  DISD22_0004298
  Located on chromosome 6
  Distance between a terminus base of telomere on chromosomal short arm and 5'-terminus of this base sequence : 132530983
  Distance between 3'-terminus of neighbour sequence of sequence listing upward to telomere on chrosomal short arm and 5'-terminus of this base sequence : 153537
tgaatgcaaatatcttccattagtttccctggaaacacacactctctctctctctctctctctctctctctctctctcaatctctctctctctctctctctatatatatatatatacacacactatatatatatatatatatatatacacacactatatatatatacacactatatatatatatacacactatatatatatatatacacactatatatatataattagtagataatatataaagctggtaacttggatgca

SEQ ID NO: 10930 - DNA, 416 bp, Homo sapiens
  chr6.fa.O7frz.134697176
  Located on chromosome 6
  Distance between a terminus base of telomere on chromosomal short arm and 5'-terminus of this base sequence : 132872541
  Distance between 3'-terminus of neighbour sequence of sequence listing upward to telomere on chrosomal short arm and 5'-terminus of this base sequence : 341297
tatccttccattgtgagtaaataggtattcacatgtctgtatttgtattcttctttcttacacacaaaagatagcttaaccactctcctgctccttgctgttttttaaaaaaacttgaatatatcttagaaataatttcgtatgtatatgaagatcttcctcattcctttttagagccacacaatactccattgtgtggatttgccataatttattaaaccagtcgcccagctgcattatgaatgtttggtttatttttcagtcttttgctatcatgaataatgctgcaaagaatagttttatacacacacacacacacacacacacacacacacacacacaatcatttcatatttttgccagcgtatctatggaataggaggatcatttttcttaagatgaaccatgtaaatgat

SEQ ID NO: 10931 - DNA, 254 bp, Homo sapiens
  D6S1039
  Located on chromosome 6
  Distance between a terminus base of telomere on chromosomal short arm and 5'-terminus of this base sequence : 133155511
  Distance between 3'-terminus of neighbour sequence of sequence listing upward to telomere on chrosomal short arm and 5'-terminus of this base sequence : 282554
cacccagccaataaacagataatttaggacacagaacatatctatctatctatctatctatctatctatctatctatctatctatctaaaatacctatctctctctatatataaatatataaataaatatataaatatataaaaatataaataaatatataaatatatatatataatagtcattataaaaaagaagcaaccatagaactataaagacttactggaaatttaggaatatgatgcctgaaaataag

SEQ ID NO: 10932 - DNA, 279 bp, Homo sapiens
  DISO7_10017614
  Located on chromosome 6
  Distance between a terminus base of telomere on chromosomal short arm and 5'-terminus of this base sequence : 133462233
  Distance between 3'-terminus of neighbour sequence of sequence listing upward to telomere on chrosomal short arm and 5'-terminus of this base sequence : 306468
aatgccatttgctaaggtgttattattactttaaatttcattatgttttatgtgatgatggatttaaagcaaaaatattactcttatatttattatatacatatatatgtgtgtgtgtgtgtgtgtgtatatatatatatatatatatatataatgtggtccctgttacatatatatatgtatatatgtgtgtgtgtatatattatatatatatataatgtggtccctgttttcatgttattctaatcactatatcatggatatttccatacaagtctt

SEQ ID NO: 10933 - DNA, 153 bp, Homo sapiens
  DISO7_10002252
  Located on chromosome 6
  Distance between a terminus base of telomere on chromosomal short arm and 5'-terminus of this base sequence : 133539947
  Distance between 3'-terminus of neighbour sequence of sequence listing upward to telomere on chrosomal short arm and 5'-terminus of this base sequence : 77435
tgagtcatattaacatatctggagggtgtgtgtgtgtgtgtgtgtgtgtgtgtgtgtgtgtgttgtgtgtgtgtgtttccagagggcgatgtgaaggccaatggctggaacggaggagggctgtgttttcattaccaggcaacagtgcaagaa

SEQ ID NO: 10934 - DNA, 112 bp, Homo sapiens
  DISO7_10017620
  Located on chromosome 6
  Distance between a terminus base of telomere on chromosomal short arm and 5'-terminus of this base sequence : 133619042
  Distance between 3'-terminus of neighbour sequence of sequence listing upward to telomere on chrosomal short arm and 5'-terminus of this base sequence : 78942
cagagttctgcaatgaccccacaaggggagctagctgagtatcaggcagagagagacagagagagagagagagagagagagaagagagagaaagaaactgtggccttgatga

SEQ ID NO: 10935 - DNA, 273 bp, Homo sapiens
  AL035603.11_63729
  Located on chromosome 6
  Distance between a terminus base of telomere on chromosomal short arm and 5'-terminus of this base sequence : 133652296
  Distance between 3'-terminus of neighbour sequence of sequence listing upward to telomere on chrosomal short arm and 5'-terminus of this base sequence : 33142
ctctcaagtccttattgaagtgactggccattcagaaaatttaaacgtatgaatgtattaagaactattgacttaataagtccactctttgaagagcatttgcatcatggagataaaatattatattctaagttacagaaaaattcaaggaaactgaagaaaagagatttttgggtaaaagaataaatacatcacaaacacacacacacacacacacacacacacacacaactgggctattgagagacagtgtggcatgtataatgactccat

SEQ ID NO: 10936 - DNA, 294 bp, Homo sapiens
  AL035603.11_134343
  Located on chromosome 6
  Distance between a terminus base of telomere on chromosomal short arm and 5'-terminus of this base sequence : 133722986
  Distance between 3'-terminus of neighbour sequence of sequence listing upward to telomere on chrosomal short arm and 5'-terminus of this base sequence : 70417
aaacttgctgtctaagctttacagttttgatttcctcagcatgacagtatggctgcccatgggcgctgggagaatatgtctctttgtttacaccttgcaagggagacagaaggagagagtaagagagagagagagagagagagagagagagagagagaatatgaatcttctcttcagagaagatctgagcaaacctctcttctagttgcattagcccaaagagtctaggctgacccaaccaagctccagtccctggacagaggagagtagtatttgatagccatcaattgatag

SEQ ID NO: 10937 - DNA, 230 bp, Homo sapiens
  AL031776.7_81196
  Located on chromosome 6
  Distance between a terminus base of telomere on chromosomal short arm and 5'-terminus of this base sequence : 133959077
  Distance between 3'-terminus of neighbour sequence of sequence listing upward to telomere on chrosomal short arm and 5'-terminus of this base sequence : 235797
tacatcaataacattcaagctgagagcaaaatcaagaaggcaatcccatttaccataaacacacacacacacacacacacacacacacacttaggaatacatctaaccaaaaaggtaaaagatctctacaaggagaactacaaaacactactgaaagaaatcatagattacacaaacagttggaaaaacattccatgctcctcttggattggcagaatcagtatcattaa

SEQ ID NO: 10938 - DNA, 164 bp, Homo sapiens
  AL031776.7_27349
  Located on chromosome 6
  Distance between a terminus base of telomere on chromosomal short arm and 5'-terminus of this base sequence : 134012930
  Distance between 3'-terminus of neighbour sequence of sequence listing upward to telomere on chrosomal short arm and 5'-terminus of this base sequence : 53623
gacagagctaaagctactgatcactcactcaccctccctccccaccacacacacacacacacacacacacacacacacacacactatttatgtattttagattccaggggtgaataagatgcacagcatggaagaaaaggttgagaataacctgccaacctatc

SEQ ID NO: 10939 - DNA, 101 bp, Homo sapiens
  DISO7_10002235
  Located on chromosome 6
  Distance between a terminus base of telomere on chromosomal short arm and 5'-terminus of this base sequence : 134080281
  Distance between 3'-terminus of neighbour sequence of sequence listing upward to telomere on chrosomal short arm and 5'-terminus of this base sequence : 67187
ctggacaattggcttattaatcattatagatatacagatataaatatatatatataatatatacacaaacacactcacacatacagacacctgttaatttc

SEQ ID NO: 10940 - DNA, 450 bp, Homo sapiens
  AC053482.2_127868
  Located on chromosome 6
  Distance between a terminus base of telomere on chromosomal short arm and 5'-terminus of this base sequence : 134500581
  Distance between 3'-terminus of neighbour sequence of sequence listing upward to telomere on chrosomal short arm and 5'-terminus of this base sequence : 420199
acttgaggtcaagagtttgagaccagcctggccaacatggtgaaactccatctctactaaaaatacaaaaattagctgggcgtggtggtgtgtgcctataatcccggctacttgggaggttgaggaagaagaattgcttgagccctggaggcagaggttgcagtgagctgagatcgcaccactgcactccagcctgggcaacagagtgactctgtctcaaaaacaaacaaacaaacaaacaaacagaaaactcaactccggtttgccggttgagttgaccttgggccatttttctagcactgtctgtgcttcagtttacttattgttagagttaagattataaaacctacattgctagattattttggggagtcaataaaaacataaatacaatggtggctcgagttgcagaaaaaaaccgtgttcctgtcacatgaccaggaaagatta

SEQ ID NO: 10941 - DNA, 465 bp, Homo sapiens
  chr6.fa.O7frz.136689612
  Located on chromosome 6
  Distance between a terminus base of telomere on chromosomal short arm and 5'-terminus of this base sequence : 134600861
  Distance between 3'-terminus of neighbour sequence of sequence listing upward to telomere on chrosomal short arm and 5'-terminus of this base sequence : 99830
acactaactggtctaaactgacacgttccctttccttgaagccttctcaaatggtcaataattattcgtttcctattttggcaatactgtttaatataggtataacattggtccttagttctttttgaaagtatatttattgtcaaaaagttaaactatatatacctccatactttaggcccacagcaagaaagggcacttttatactttttggtacataaacgcatgcacacacacacacacacacacacaggcactcacagacacacacttaataaatgagaacatactactcacaactccactgtccctcattttacccatctgtctgtttgtgtgtcggatagtaccacatatcaatcgttatttagattgtttgcaattttgcactatttaaaacagtgcccatctgtgtttatttttcatggcctaatttgtgatgataacctagaataaattcctgga

SEQ ID NO: 10942 - DNA, 477 bp, Homo sapiens
  chr6.fa.O7frz.136797028
  Located on chromosome 6
  Distance between a terminus base of telomere on chromosomal short arm and 5'-terminus of this base sequence : 134707548
  Distance between 3'-terminus of neighbour sequence of sequence listing upward to telomere on chrosomal short arm and 5'-terminus of this base sequence : 106222
acatatttggtttaggcaagtcagtagatggtggtggcatttgcaaagataagaaatgagaaccccattggtaatctttctttctttctttctctttctttctttctttctttctatctttctttctttctttctttctttctttctttttttctttctttccttctttcttttctttctggaccatgtaatagttcttatattgttcactagtacccagtttccctctactttcaggcttaagggaaggttacactttcacactcgaacatacacacggactatgattttctctggccaattaaataagtgcaattgatagagatagagatctcacatttgtacattatttgtagttcttgattctctaccatcctttacccataccatgataacaagtcatattcccgaagaaggagccaattgaggatgatgtatttcagaaaatttttccttgacaagttataagtgaccaat

SEQ ID NO: 10943 - DNA, 223 bp, Homo sapiens
  chr6.fa.O7frz.136913099
  Located on chromosome 6
  Distance between a terminus base of telomere on chromosomal short arm and 5'-terminus of this base sequence : 134823532
  Distance between 3'-terminus of neighbour sequence of sequence listing upward to telomere on chrosomal short arm and 5'-terminus of this base sequence : 115507
taggaacattcacagatttcacaggccttgttcgggcctattgctattcggccctgatttggtcatacttactaagtaaaggcagggcaaataaagatgatgggctctgtactctgcttggggcaggagggggctaggggtggggagagagagggtcagagagaaagagagagagagagagagagagagagagagagaacttgagctacacataaacctttaa

SEQ ID NO: 10944 - DNA, 185 bp, Homo sapiens
  D6S1033
  Located on chromosome 6
  Distance between a terminus base of telomere on chromosomal short arm and 5'-terminus of this base sequence : 135051375
  Distance between 3'-terminus of neighbour sequence of sequence listing upward to telomere on chrosomal short arm and 5'-terminus of this base sequence : 227620
aatcacttgaacctaagaagcagaggttgtagtgccaatgcactccagcctgggtgacagagtgagattccatctcaaaataataataataataataataataataataataataataataataataatccagcctcacatattactttatagcaatgcaaggactaactaacacaccaaatgaa

SEQ ID NO: 10945 - DNA, 328 bp, Homo sapiens
  AL035594.7_19913
  Located on chromosome 6
  Distance between a terminus base of telomere on chromosomal short arm and 5'-terminus of this base sequence : 135248326
  Distance between 3'-terminus of neighbour sequence of sequence listing upward to telomere on chrosomal short arm and 5'-terminus of this base sequence : 196766
actggattgaatcagttgaaaggctttaagaccaggggtgaggcttctccgaagtagaagaaattctaccagtgaacaacagcttcagtctgtgcatgcatgttttagcctgccctccccaagggcttgccctacagacttcagacttgcctagccaatctgcacaagcacataaaccaattccttgcagtaaatctcttcaattttgtaaataaaatcctactatatgtaatcttataattatatagacatatatatatatatatatatatatatatatatatatatttcaataaaatcatatctatctcctactggttctgcttta

SEQ ID NO: 10946 - DNA, 104 bp, Homo sapiens
  D6S1030
  Located on chromosome 6
  Distance between a terminus base of telomere on chromosomal short arm and 5'-terminus of this base sequence : 135396851
  Distance between 3'-terminus of neighbour sequence of sequence listing upward to telomere on chrosomal short arm and 5'-terminus of this base sequence : 148197
ccatggtacttagaaacactgcattattattattattattattattattattattattattattattatccttttccccatcaaggtataagcttctctggggc

SEQ ID NO: 10947 - DNA, 472 bp, Homo sapiens
  AL034349.3_26421
  Located on chromosome 6
  Distance between a terminus base of telomere on chromosomal short arm and 5'-terminus of this base sequence : 135456533
  Distance between 3'-terminus of neighbour sequence of sequence listing upward to telomere on chrosomal short arm and 5'-terminus of this base sequence : 59578
gagctatttcacttcaggaaaggaatttagctgggtacagtggcttatgccagcactttgaaaggccaaggtgggaggatcacttgaggccaggagttcaacaccagccttggcaaaatagcaagaatctgtctctacaaaaaaataagaaaaaaaaaagttgagcatggtggtacacacgtgtagtccccaccactcaggaggctgaggtaggaggatcacttgagcctaggaggtcaaggttgcaggcaggcaggcaggcaggcaggcaggcaggcaggcatagaaaggaaggcaagaaggaagtaagacaggaaggcaggaaggcaggaaggaaggaaggaaggaaggaaggaaggaaggaaggaaggaaggaaggaaggaaggaaggcaggaaggcaggcaggaaggcaggcaggcaggcaggcaggcaggcaggcaggcaggcaggctggcttagatattcctcaca

SEQ ID NO: 10948 - DNA, 191 bp, Homo sapiens
  AL034349.3_52690
  Located on chromosome 6
  Distance between a terminus base of telomere on chromosomal short arm and 5'-terminus of this base sequence : 135482901
  Distance between 3'-terminus of neighbour sequence of sequence listing upward to telomere on chrosomal short arm and 5'-terminus of this base sequence : 25896
taatggaccaatttaatcgaagtgtttctcttcagcacatcaacctctgtattgtcaagatttgttaggaaaaaacatatttatacatttgtagtatagatatgtataaccaccttgtgaaaaatgttttatcttttgttattccgtgtgtgtgtgtgtgtgtgtgtgtgtgaaatccagatgtcctaatg

SEQ ID NO: 10949 - DNA, 198 bp, Homo sapiens
  D6S407
  Located on chromosome 6
  Distance between a terminus base of telomere on chromosomal short arm and 5'-terminus of this base sequence : 135515386
  Distance between 3'-terminus of neighbour sequence of sequence listing upward to telomere on chrosomal short arm and 5'-terminus of this base sequence : 32294
aaaagtacctcccgccccctacacacacacacacacacacacacacacacacacacacacacacacacacacacagaaacaactatacttatactgtggtcaattcatagaactagaagagagtttagaaatcaccaaatgcaaatgctttattttaaccacatggtaaacaagcacaatgggtgacttggtgtcatc

SEQ ID NO: 10950 - DNA, 270 bp, Homo sapiens
  AL034349.3_95301
  Located on chromosome 6
  Distance between a terminus base of telomere on chromosomal short arm and 5'-terminus of this base sequence : 135525470
  Distance between 3'-terminus of neighbour sequence of sequence listing upward to telomere on chrosomal short arm and 5'-terminus of this base sequence : 9886
ctagctcaccagcctaactttatgtattttgttttagagacaaggtcttgctctgttgcccaagctagagtgcagtgcccaatcaccactcactgcagcctttaactactgagctcaagcaatcctccagcctcagcctccaaaatagctgggactaaaagcatgcaccactatgcctggttattattgtgtgtgtgtgtgtgtgtgtgtgtgtgtgtgtgtgtgtgtgtagagataaggtcttgctattttgcctaccagactaacttt

SEQ ID NO: 10951 - DNA, 213 bp, Homo sapiens
  D6S1690
  Located on chromosome 6
  Distance between a terminus base of telomere on chromosomal short arm and 5'-terminus of this base sequence : 135536160
  Distance between 3'-terminus of neighbour sequence of sequence listing upward to telomere on chrosomal short arm and 5'-terminus of this base sequence : 10420
caactaagtcctagcattgttaagatgtgtgtgtgtgtgtgtgtgtgtgtgtgtgtattcacacagaggactacatacttacatctttcacatttcccaacaaaataaatacaaacaataactccactacgcactattttattttgccttgtttctgaattccccttattaaaacaattcctagaatgacacctgttggaggattcagccagc

SEQ ID NO: 10952 - DNA, 308 bp, Homo sapiens
  AL080315.18_62768
  Located on chromosome 6
  Distance between a terminus base of telomere on chromosomal short arm and 5'-terminus of this base sequence : 135644035
  Distance between 3'-terminus of neighbour sequence of sequence listing upward to telomere on chrosomal short arm and 5'-terminus of this base sequence : 107662
gctagacatggtagtgcgtgcctgtaatcccagctacatgggaggctgaagcaggagaatcgcttgagcccaggaggcagaggtttcagtgagccgagatcgcaccactgcactccagcctgggtgacagagcgagactctgcctctaaataaataaataaataaataaataaataaatgtgcaaactcattatttataaataaataaatagatgagtcagggaagagtgaacccgggaggcagaagttgcagtgagctgagatcacaccactgcataccagtctgggtgacagaatgaaactccttc

SEQ ID NO: 10953 - DNA, 353 bp, Homo sapiens
  AL080315.18_73802
  Located on chromosome 6
  Distance between a terminus base of telomere on chromosomal short arm and 5'-terminus of this base sequence : 135654937
  Distance between 3'-terminus of neighbour sequence of sequence listing upward to telomere on chrosomal short arm and 5'-terminus of this base sequence : 10594
tattcaaataccaggctagatgttgaggatatagtgttgaaaatgtaatcttaagttcactgtgtattgggaatacagataaagaagccaaggatttcattacagtgtgataagtaatataacagaggaattcacacaatatttaaagatgagagcagagaatagaggcatattttttaacctaaaaattgactttgttgtcaaagaagattttctataggcaactaaacttaatgcatttcttgaaggaaaagaagataccagccaggaggaaactcgtgtgtgtgtgtgtgtgtgtgtgtgcatgagagagagagaggtagtactttgggtatttcgagtatgtgcaaagc

SEQ ID NO: 10954 - DNA, 223 bp, Homo sapiens
  DISO7_10002240
  Located on chromosome 6
  Distance between a terminus base of telomere on chromosomal short arm and 5'-terminus of this base sequence : 135836795
  Distance between 3'-terminus of neighbour sequence of sequence listing upward to telomere on chrosomal short arm and 5'-terminus of this base sequence : 181505
ttaagcattggctgctttccatcttccttttctctgaagtcattatttgtgtgtgtgtgtgtgtgtgtgtgtgtgtgtgtgtttccctgctagtttagtctttatttctgaaataattttctcctattcataattctttctaagttttgacagcttttgtttctctggtagtctccattataggtatgtataattctatttaagctgttcgttcatggcttct

SEQ ID NO: 10955 - DNA, 134 bp, Homo sapiens
  DISO7_10002241
  Located on chromosome 6
  Distance between a terminus base of telomere on chromosomal short arm and 5'-terminus of this base sequence : 136196218
  Distance between 3'-terminus of neighbour sequence of sequence listing upward to telomere on chrosomal short arm and 5'-terminus of this base sequence : 359200
tctgttattgagtctgagtctgcatttttatttctcttctaactcttattcatatggacttcattttcttatgtttcgtaagtgtgtgtgtgtgtgtgtgtgtatgtgtgtgttttgtggatgtatgcgtgcat

SEQ ID NO: 10956 - DNA, 429 bp, Homo sapiens
  AC022216.4_44252
  Located on chromosome 6
  Distance between a terminus base of telomere on chromosomal short arm and 5'-terminus of this base sequence : 136259026
  Distance between 3'-terminus of neighbour sequence of sequence listing upward to telomere on chrosomal short arm and 5'-terminus of this base sequence : 62674
tattgatggacgtacggacattttcaatattttttactacaaacgttgttatacattgtttttctgttgttgttgttgttgttgttggagatggagtcttgctctatcacccaggctggagtgcagtggtgtgatctcggctcactgcaacctccacctcccgggttcaagtgattctctgcctcagcctcccgagtagctgggattacaggtgcttgccaccatgcccagctaatttttgtatttttagtagagacagggtttcaccatcttggccaggctggtcttgaactcctgaactcatgagtcacccttctcagcctcccaaagtgctgggattgcaagcgtgtttcagtgaatagccatgtgcccagctgtttctcacatgcacccttataactgtgggataaatctctgaaggtgaaactg

SEQ ID NO: 10957 - DNA, 369 bp, Homo sapiens
  chr6.fa.O7frz.138049343
  Located on chromosome 6
  Distance between a terminus base of telomere on chromosomal short arm and 5'-terminus of this base sequence : 136363866
  Distance between 3'-terminus of neighbour sequence of sequence listing upward to telomere on chrosomal short arm and 5'-terminus of this base sequence : 104411
gtcagtgtagctacgatagcacagtattagtttctcaaatcaaagagttcctttaaaaatatttatatcaaagactgagttctctgtcagtgataaagtgtgtgtgtgagtgtgtgtgtgtaagaaagtatatgtgttcatagacacacattcatagctagggactgtatgataaattacattctaactatcactaaattaaaaacaaacttcttctcccttttcctttacagaattgtcaacatcacactgctggtgacttctgtgaacgatgtgctcttggatactatggaattgtcaagggattgccaaatgactgtcagcaatgtgcctgccctctgatttcttccagtaacaagtaagattgag

SEQ ID NO: 10958 - DNA, 183 bp, Homo sapiens
  chr6.fa.O7frz.138245722
  Located on chromosome 6
  Distance between a terminus base of telomere on chromosomal short arm and 5'-terminus of this base sequence : 136546199
  Distance between 3'-terminus of neighbour sequence of sequence listing upward to telomere on chrosomal short arm and 5'-terminus of this base sequence : 181964
ttcttatgaagtaatgctaaggagggaaaaagcttaagcttaagagaagaattttggctttttatttcacttttatgggcaattaccctctcctgttagcctcagcttctagacacacacacacacacacacacacacacacacacacacacacatccagtcatctgtttagtaatgttggag

SEQ ID NO: 10959 - DNA, 223 bp, Homo sapiens
  D6S1620
  Located on chromosome 6
  Distance between a terminus base of telomere on chromosomal short arm and 5'-terminus of this base sequence : 136648340
  Distance between 3'-terminus of neighbour sequence of sequence listing upward to telomere on chrosomal short arm and 5'-terminus of this base sequence : 101958
caaagagtaacaatcctaagcaacctaaaacacaataattttactgtataaaatcccttttaggatgtacccccaaaacacacacacatacacacacacacacacacacacacacagacaaatagaaaaaaaaagaaaaacaagtttaaaccatttctagtaatcatattgttgatggtagtattagcatattctgagaatgctgtgcattaacttaggatga

SEQ ID NO: 10960 - DNA, 390 bp, Homo sapiens
  chr6.fa.O7frz.138370071
  Located on chromosome 6
  Distance between a terminus base of telomere on chromosomal short arm and 5'-terminus of this base sequence : 136740490
  Distance between 3'-terminus of neighbour sequence of sequence listing upward to telomere on chrosomal short arm and 5'-terminus of this base sequence : 91927
tatgtaacgttagctaggcaacgtggcgtgcacctgtagtcccagctattcaggaggctgaggagaaaagatcccttgagcccagggggtcaagctgcagtgagccatgatcaagccactgcattccagcctgggtgagagagcaagatcttgtctcaaaaactaaaactaatatgtgtgtgtatatatatatatatgtgtgtgtgtgtgtgtgtatatatatatatgtatatatgtgtgtatatatgcatataagtgtgtatatatattcacacattattttgtggaaaaatagaatcttattaaaatttatttggggaagaatttaccttgtctcttatatgaccattatgaccattggggatttttgtttccagaaataaccattat

SEQ ID NO: 10961 - DNA, 473 bp, Homo sapiens
  chr6.fa.O7frz.138570987
  Located on chromosome 6
  Distance between a terminus base of telomere on chromosomal short arm and 5'-terminus of this base sequence : 136941302
  Distance between 3'-terminus of neighbour sequence of sequence listing upward to telomere on chrosomal short arm and 5'-terminus of this base sequence : 200422
cacagtcacttctcaagtacagtagccaagaataaaatgaacaggccaggtgtggtggctagtgcctgtaatctagcgctttgggaggacgaggagggaggatcactccaggccaggagttcaagaccagcctgggcaacacagggagaccgtggcaaaaaatatttaaaaactagccaggcatggtggcatgtgcctgaagtcccagctacttgggagggtgaggtggaaagacacttaagccccagtatttcaaggctgcagtgagctatgatcatgccactgcactccagcctgggtgtcagtgccagaccctgtctctaaataaataaataaataaataaataaataaataaataaatggcacaattgtggataccatctgtgggtggcaggcagaagtgactctctactgccccagaggctagctctgttgttagtctatggcagtgtgtaagttgcaggtttgtaag

SEQ ID NO: 10962 - DNA, 162 bp, Homo sapiens
  D6S1705
  Located on chromosome 6
  Distance between a terminus base of telomere on chromosomal short arm and 5'-terminus of this base sequence : 137018546
  Distance between 3'-terminus of neighbour sequence of sequence listing upward to telomere on chrosomal short arm and 5'-terminus of this base sequence : 76771
gtgactgggcatgtctaggtctggatgtacatgagatgtgtgtgtgtgtgtgtgtgtgtgtgtgtgtgtgtgtgtatgtgtgtgtgttacagacttctcaacttgtcaatagccaaaaacaggtgaaggaaaggtccataccttggaaaatccctcaaacaa

SEQ ID NO: 10963 - DNA, 325 bp, Homo sapiens
  chr6.fa.O7frz.139170300
  Located on chromosome 6
  Distance between a terminus base of telomere on chromosomal short arm and 5'-terminus of this base sequence : 137178602
  Distance between 3'-terminus of neighbour sequence of sequence listing upward to telomere on chrosomal short arm and 5'-terminus of this base sequence : 159894
atcaccttaggtcaggagtttgagaccagcctggctaacatggtgaaaccctgtctctactaaaaatacaaaaaagtagccaggtgtggtggcacattcctgtaatcccagctacccgggggactgagacaggagaatcgtttgaacctgggggacagaggttgtggtgagccaagatggtgccactgtgctccagcctaggcaacagagtgagactccgtctcaaaaaataaataaataaataaataaataaataaataaataaataaataataaaattacaacagttccataattttacttggattatctaaacatgtgtaaa

SEQ ID NO: 10964 - DNA, 478 bp, Homo sapiens
  chr6.fa.O7frz.139078999
  Located on chromosome 6
  Distance between a terminus base of telomere on chromosomal short arm and 5'-terminus of this base sequence : 137269634
  Distance between 3'-terminus of neighbour sequence of sequence listing upward to telomere on chrosomal short arm and 5'-terminus of this base sequence : 90707
agtaggtgcattacagttgtctacctctagtgtgtttctgtttctgcttgcgtcttctgtttcttttatgattgttgttatatcatttggttcataagtattcctaatatatttagtgtgatgtgcaccccatagtattgtaaactgccctttattgtggcatttatttttggctagctttcaaccttgctgatattaagattcatacatctgctttccctttgatagcatttgtctggtatacttttgatcaccctgttattttgaactgttctgaatcatttcatttttaagtgttttgcgtgtgtgtgtgtgtgtgtgtgtgtgtgtgtgtgttccaatctgaaaagtttgttttgtttgcttctttgcctttattaacaaaaagtcactcacagcatttcaacattgttcaaacacacaaatcacagccaatggccccaacaaataaccacttaatgtctagatcaaaaccatg

SEQ ID NO: 10965 - DNA, 417 bp, Homo sapiens
  AL121947.14_122108
  Located on chromosome 6
  Distance between a terminus base of telomere on chromosomal short arm and 5'-terminus of this base sequence : 137380242
  Distance between 3'-terminus of neighbour sequence of sequence listing upward to telomere on chrosomal short arm and 5'-terminus of this base sequence : 110130
atttatcagtaagctccatctgactgctgtgtccacagttgacagaggaggaaaagggcttgatggttgttgttgttatttttttaaactgttcattatcaaaataatacaatttcactaagaaaattttgaaagaaaaaaattgtctaaaataaaaatttagagtaatacccttactcttcaatttcattccccattggtagcctctgttaatatttttgtgtatatcccactatgtcttacacacacacacacacacacacacacacacacacattttaacaaagatgggatcacactatacaagattctacaagttattttctcactaacaatgtctccttaacccctactcatatccgtggatatagatcttttgtctaatgctgcatggtattccattgtatgaacatgttg

SEQ ID NO: 10966 - DNA, 116 bp, Homo sapiens
  Z67385
  Located on chromosome 6
  Distance between a terminus base of telomere on chromosomal short arm and 5'-terminus of this base sequence : 137380431
  Distance between 3'-terminus of neighbour sequence of sequence listing upward to telomere on chrosomal short arm and 5'-terminus of this base sequence : -228
ttccccattggtagcctctgttaatatttttgtgtatatcccactatgtcttacacacacacacacacacacacacacacacacacattttaacaaagatgggatcacactataca

SEQ ID NO: 10967 - DNA, 156 bp, Homo sapiens
  Z67354
  Located on chromosome 6
  Distance between a terminus base of telomere on chromosomal short arm and 5'-terminus of this base sequence : 137443231
  Distance between 3'-terminus of neighbour sequence of sequence listing upward to telomere on chrosomal short arm and 5'-terminus of this base sequence : 62684
agctaattaacacatccattccttcacagttacctttgtgtgtgtgtgtgtgtgtgtgtgtgcatgcgtacatgttaagaacacttaagatctactcttagcaaattttaaatatgtaacatagtatttttaactctatgtagtcccttggtgtac

SEQ ID NO: 10968 - DNA, 266 bp, Homo sapiens
  AL137251.5_33584
  Located on chromosome 6
  Distance between a terminus base of telomere on chromosomal short arm and 5'-terminus of this base sequence : 137486924
  Distance between 3'-terminus of neighbour sequence of sequence listing upward to telomere on chrosomal short arm and 5'-terminus of this base sequence : 43537
catttcaacagaagatttggaggggacaaatatccaaactatatcatgtatatgtggagagggggttgtgtggtgtgtgtgtgtgtgtgtgtgtgtgtgtgtgtgtgtgtgtgtgtgtgtggtgagggggcacagatgaatgaggagtgttttctccccttaggatttcaccttgccacaagccatctgggcttctccctccagggtcagcccacccaaatagaccacctagtgccttgggtggagttgagtacttgcaggtgttt

SEQ ID NO: 10969 - DNA, 266 bp, Homo sapiens
  D6S1040
  Located on chromosome 6
  Distance between a terminus base of telomere on chromosomal short arm and 5'-terminus of this base sequence : 137686364
  Distance between 3'-terminus of neighbour sequence of sequence listing upward to telomere on chrosomal short arm and 5'-terminus of this base sequence : 199174
tatatttcttgggaaagatagatggaaaaatacataaatatcggtgtttatattgataaatatttatcctaatagaggataaatagacgcatagatagatagatagatagatagatagatagatagatgacagacagatatagcctacccatactggagtttaaatactttgagtctcaccagcctcatccaatagttcaatcctgcatgcagcatgacagtggaaagcacatggatggttgtgaaccagaaacagtcctgcattc

SEQ ID NO: 10970 - DNA, 388 bp, Homo sapiens
  chr6.fa.O7frz.139409282
  Located on chromosome 6
  Distance between a terminus base of telomere on chromosomal short arm and 5'-terminus of this base sequence : 137769260
  Distance between 3'-terminus of neighbour sequence of sequence listing upward to telomere on chrosomal short arm and 5'-terminus of this base sequence : 82630
ttcatgaaattctaaaagtgaaacagaaatacaacacaataaatattttatggtatgggtgaatatatgctcctcaaaggtctcctgcacccttgagttttatcacagcattttctataatcagataacttgttatgattatagaacatatttttaatacacatgaggaagtgactccccataattcatcaccctgagataatcactattaatcatgggtgtgtgtgtgtgtgtgtgtgtgtgtgtgtgtatttaggtccagacgttttgctatttattctgaaataattgtaaccatatgacataaaacaaaaaattgcataaattgattttaaaacatctttttctgattataaaagtaatatagtgacattattgaacatttgga

SEQ ID NO: 10971 - DNA, 295 bp, Homo sapiens
  chr6.fa.O7frz.139530373
  Located on chromosome 6
  Distance between a terminus base of telomere on chromosomal short arm and 5'-terminus of this base sequence : 137889667
  Distance between 3'-terminus of neighbour sequence of sequence listing upward to telomere on chrosomal short arm and 5'-terminus of this base sequence : 120019
atgtcaagcctagtgtatagtgacacacacacacacacacacacacacacacacacactctctctctctctctctctctctctcctcctccctccttagctttgggcaagtaataataaattgaaaagaaaatagaatgaactatgtgaagtgacttgtctctatttttattataatttaaaggaccacatagtttgtgtgaaggctcactgcctttaactggcatgccagctaggtaggctaagatttgttcttctgcccacaataccttttctgccttattgttaacagacac

SEQ ID NO: 10972 - DNA, 114 bp, Homo sapiens
  D6S1572
  Located on chromosome 6
  Distance between a terminus base of telomere on chromosomal short arm and 5'-terminus of this base sequence : 138038185
  Distance between 3'-terminus of neighbour sequence of sequence listing upward to telomere on chrosomal short arm and 5'-terminus of this base sequence : 148223
cctgaaatcatcctgcaaatatttattaagcatttaataaggaaacacacacacacacacacacacacacacacacacacacacacactccaccaggctggtcactgtagagaa

SEQ ID NO: 10973 - DNA, 314 bp, Homo sapiens
  chr6.fa.O7frz.139787556
  Located on chromosome 6
  Distance between a terminus base of telomere on chromosomal short arm and 5'-terminus of this base sequence : 138146625
  Distance between 3'-terminus of neighbour sequence of sequence listing upward to telomere on chrosomal short arm and 5'-terminus of this base sequence : 108326
gaatgagaacacttgttccacctaataataggcccaggctgagaccttaataaactaactgacttcctttcttccttccttccttccttccttccttccttccttccttccttccttccttctttagttccttccttcctttcttctttccctccctccctccttccctccctccctccctctctctctttctttcttctttccttctttcttttgaattaagaagagcaaggatgaataaaaaggtgcatttcaagtaaaggagtttttaataaggatctaagtgggtgggaaacgtacagatcttaggagtg

SEQ ID NO: 10974 - DNA, 143 bp, Homo sapiens
  DISO7_10002243
  Located on chromosome 6
  Distance between a terminus base of telomere on chromosomal short arm and 5'-terminus of this base sequence : 138263269
  Distance between 3'-terminus of neighbour sequence of sequence listing upward to telomere on chrosomal short arm and 5'-terminus of this base sequence : 116330
agctgtggcccaattaaggggcttgttgaggagagaggtccaggacatagattatatatatgtgtgtgtgtgtgtgtgtgtgtgtgtgtgtgtgtgtgtgtgtgtgtgtgtatatatatatgacagttataggattcagtggc

SEQ ID NO: 10975 - DNA, 137 bp, Homo sapiens
  DISO7_10002244
  Located on chromosome 6
  Distance between a terminus base of telomere on chromosomal short arm and 5'-terminus of this base sequence : 138267778
  Distance between 3'-terminus of neighbour sequence of sequence listing upward to telomere on chrosomal short arm and 5'-terminus of this base sequence : 4366
gaatcttacagcaaggtttgctttttattatgactcagacttttccatgaggtttctcagaagtccaaatatatatatatatatatatatatgttcagttataggtagaaaaagatgctaaccaacagagaatagag

SEQ ID NO: 10976 - DNA, 429 bp, Homo sapiens
  AL137063.11_121353
  Located on chromosome 6
  Distance between a terminus base of telomere on chromosomal short arm and 5'-terminus of this base sequence : 138400629
  Distance between 3'-terminus of neighbour sequence of sequence listing upward to telomere on chrosomal short arm and 5'-terminus of this base sequence : 132714
cctggctaacttattttggtagacatggggtttcactatgttggtcaggctggtcttgaactcccttaagtgatccacctatctcaacctcccaaagtgctgggattacaggagtgagccaccgcacctggcctacctatctcctatctatctatctatctaatctatctatctatctatctatctatctatctatctatctatctatcaatcatctatccattatctatcatctacctatccattatctatctattatctgtctatcaatcatctctttccctccttcctatgggttctatttctgttgagaatgaatacacatatgatccagcaattccactttagggtatatttacaaaagaattgaaagcatggtcttgaagagatattttctataccgatgttcatagcagagttattcacaat

SEQ ID NO: 10977 - DNA, 375 bp, Homo sapiens
  AL137063.11_126020
  Located on chromosome 6
  Distance between a terminus base of telomere on chromosomal short arm and 5'-terminus of this base sequence : 138405192
  Distance between 3'-terminus of neighbour sequence of sequence listing upward to telomere on chrosomal short arm and 5'-terminus of this base sequence : 4134
agcactttctaattaggatgaaacttgtatttaggcacagtatatactgacctgtgatgtgttggtttaggtgctaaaaagttaaccctctcaaaattctttagccactaacaatgaatctcttaattccagtcacattctttgtgtcatgttaaaatgcaaatatcccaggagagagacctgacatgttataaatattgtatgaagctcttagactcttttctgaggaaggaaggaaagaaggatgggaagaaggaaggaaggaagaaggaaggaaggaaggaaggaaggaaggaaggaaggaaggaaggaaggaaggaagattgtaaaaatggcataagagggctcaggttttcctgagttgcactaagatta

SEQ ID NO: 10978 - DNA, 464 bp, Homo sapiens
  AL137063.11_128011
  Located on chromosome 6
  Distance between a terminus base of telomere on chromosomal short arm and 5'-terminus of this base sequence : 138407139
  Distance between 3'-terminus of neighbour sequence of sequence listing upward to telomere on chrosomal short arm and 5'-terminus of this base sequence : 1572
agaaatgtctggatgaagataacgggttgtgggccgagcacggtggctcacgcctgtaatcccagcacttttgggaggccaaggcaggcagatcatgaggtcaggagatcgagaccatcctggctaacacggtgaaaccccgactctactaaaaatacaaaaaattagccgggcgtggtggcaggcgcctgttgtcccagctactcgggaggctgaggaagaatggcgtgaacccaggaggcggagcttgcaatgagccgagatcaggccactgcactccagcctgggcgacagagagagactccgtcaaaaataaataaataaataaataaataaataaataaataaataaataaataagataacgggttgtggagaccaaggttttatcacgcaaatgaagcctccagttagccggcttcagagaaaatagattgtaaatgtttcttatcaggcttaacgtc

SEQ ID NO: 10979 - DNA, 366 bp, Homo sapiens
  AL049546.3_60270
  Located on chromosome 6
  Distance between a terminus base of telomere on chromosomal short arm and 5'-terminus of this base sequence : 138471084
  Distance between 3'-terminus of neighbour sequence of sequence listing upward to telomere on chrosomal short arm and 5'-terminus of this base sequence : 63481
gtccatagttccaaactattgaattgttactagagttggacttttggtttgcaatctcttgaaaatgtggaagtaaacacacacacacacacacacacacacacacacacacacacacacagtgatacatctgataaatattttactttaggatgcaaaatgtgtcattttctttcacccttcaaataaaatggaatattttccaatccatcttgctgtaattgtgggaaattcagtctcactctttattagattcctgttcccccagttccaccaggttactcaaagttccaagaaatcttattcagggcaggttttatattaaaggccctcccctgtatggtgtccttggtcactgttaattat

SEQ ID NO: 10980 - DNA, 357 bp, Homo sapiens
  HUMUT5174B
  Located on chromosome 6
  Distance between a terminus base of telomere on chromosomal short arm and 5'-terminus of this base sequence : 138503755
  Distance between 3'-terminus of neighbour sequence of sequence listing upward to telomere on chrosomal short arm and 5'-terminus of this base sequence : 32305
ttttgagaaacattcatactgttctccctagttgctatactagtttacattactttctttcttttctttctctttctttctttcttttctttctctttctctttctttccttccttccttccttccttccttccttccttccttccttccttcttctttcttttctttctttcctttctttctttctttctttctttctttctttctttctttctttctttctttctttttctttctttctttctttctttctttctttctttctttctttctttctttctttctttctttctttctttcttccttttcttctttctttcttttctttatttcttgacagagtcttgctctgttgcc

SEQ ID NO: 10981 - DNA, 352 bp, Homo sapiens
  AL121575.24_34383
  Located on chromosome 6
  Distance between a terminus base of telomere on chromosomal short arm and 5'-terminus of this base sequence : 138555624
  Distance between 3'-terminus of neighbour sequence of sequence listing upward to telomere on chrosomal short arm and 5'-terminus of this base sequence : 51512
ggacaagctacatcaccaatagagtttacttaatttattttgacaactgcctctaattacttaacataacacattatatgggtaataaaaacagttaataatgtaaaacctcattgctgtttcaggtcgagtgagagatgtgtgcatatattctccaggcatttgtggagtggatcatgttgctctctctctctctttctctctctgtgtgtgtgtgtgtgtgtgtgtgtgtgtgtgtgtgtctgtgtgtctgttgggacaatttcttcagataaatttttggattcacagatgtgaagagattaaattccatatggaatgtgaaaaaataattcgtaactattgccaattc

SEQ ID NO: 10982 - DNA, 193 bp, Homo sapiens
  D6S457
  Located on chromosome 6
  Distance between a terminus base of telomere on chromosomal short arm and 5'-terminus of this base sequence : 138555781
  Distance between 3'-terminus of neighbour sequence of sequence listing upward to telomere on chrosomal short arm and 5'-terminus of this base sequence : -195
ggcatttgtggagtggatcatgttgctctctctctctctttctctctctgtgtgtgtgtgtgtgtgtgtgtgtgtgtgtgtgtgtctgtgtgtctgttgggacaatttcttcagataaatttttggattcacagatgtgaagagattaaattccatatggaatgtgaaaaaataattcgtaactattgccaat

SEQ ID NO: 10983 - DNA, 210 bp, Homo sapiens
  D6S1656
  Located on chromosome 6
  Distance between a terminus base of telomere on chromosomal short arm and 5'-terminus of this base sequence : 138803024
  Distance between 3'-terminus of neighbour sequence of sequence listing upward to telomere on chrosomal short arm and 5'-terminus of this base sequence : 247050
ctgggcaatataatgaaaccccatgtctatctctctctctctctcaatctctctctgtctctctttctttctctctctccatacacacacacacacacacacacacacacacacgtgtgtatgtacatatctccatattttatatatatgtataatatgcataagaaaatcattttggaggaagtaaattgtcacagcgaattgtcacaa

SEQ ID NO: 10984 - DNA, 259 bp, Homo sapiens
  AL117378.15_54743
  Located on chromosome 6
  Distance between a terminus base of telomere on chromosomal short arm and 5'-terminus of this base sequence : 138867348
  Distance between 3'-terminus of neighbour sequence of sequence listing upward to telomere on chrosomal short arm and 5'-terminus of this base sequence : 64114
gacagagtgagactccatcttaaaaaaataataataataaataaataaataaataaataaatatttaaaattgtgtagataaaatcattctaaacattatttcatattagcatagcagaatctgaaaatatttgcataaatatgacaattaatatctttaatattgtaaagcatttttacactttagttagaaaaaaagatgaatatactagtaggaaaatagggaaggacatgagctgacagctagagcttcataatt

SEQ ID NO: 10985 - DNA, 460 bp, Homo sapiens
  AL117378.15_85959
  Located on chromosome 6
  Distance between a terminus base of telomere on chromosomal short arm and 5'-terminus of this base sequence : 138898381
  Distance between 3'-terminus of neighbour sequence of sequence listing upward to telomere on chrosomal short arm and 5'-terminus of this base sequence : 30774
ctgaactcaggaattcaagaccagcctgggcaacatggtgaaaccccgtttctactaaaatacaaaaaattagtagagcatggcggcatgcacctgtagtcccagctactcgggaggctgaggcaggagaattgcttgaactcgggaggtgggaggttgcagcaagccgagatggcgccactgcactccagcctgggagacattgagactccgtctctaaacaaacaaacaaacaaacaaacaaacaaacaaacaaacaaacagggtcttcctactttgccaaggctagtcttgaactcctgggctcaagcaccctcccagcttggtctcccaaagtgttgggattacaagtaagagccactgtgcccagcaccatataaattttagaataatcttgtctttgtccttatcaacaaaatttcttgctgggattgtgctggtaattgcaataaacttatgt

SEQ ID NO: 10986 - DNA, 227 bp, Homo sapiens
  AL021408.1_26350
  Located on chromosome 6
  Distance between a terminus base of telomere on chromosomal short arm and 5'-terminus of this base sequence : 139043803
  Distance between 3'-terminus of neighbour sequence of sequence listing upward to telomere on chrosomal short arm and 5'-terminus of this base sequence : 144962
ctatctgcctattaatagcctcatgctgtaaaaggtcccccaggggtgtgtgtgtgtgtgtgtgtgtgtgtgtgtgtgtgcatgtgtgtagtaaggggttcttcattaccagcaaaatttattgctaaagatcctgaaactggtaattaataaacaaagttaattatttggcaacctaacaagattcacacattcaaaactgttggaaatttaaggcacctgctaat

SEQ ID NO: 10987 - DNA, 260 bp, Homo sapiens
  AL021408_107173
  Located on chromosome 6
  Distance between a terminus base of telomere on chromosomal short arm and 5'-terminus of this base sequence : 139124561
  Distance between 3'-terminus of neighbour sequence of sequence listing upward to telomere on chrosomal short arm and 5'-terminus of this base sequence : 80531
ctcaggaggatgaagtgggaggattgcttgggcctgggaagtcaagactgtagtgagccatgattgcaccactgcactccagtctgggtgacagagagatcctgtctcaaaataataataataataataataataataataataatccattatatttcttataagtcccctctctacctcagttgccttgtctataagaggaggatacagtaatacttatttcataagattattgtgagaattacatggaacttcatctg

SEQ ID NO: 10988 - DNA, 406 bp, Homo sapiens
  AL021408.1_107361
  Located on chromosome 6
  Distance between a terminus base of telomere on chromosomal short arm and 5'-terminus of this base sequence : 139124796
  Distance between 3'-terminus of neighbour sequence of sequence listing upward to telomere on chrosomal short arm and 5'-terminus of this base sequence : -25
tgagaattacatggaacttcatctgcctatctatctacctagctatgtatgtatgtatgtatgatgtatgtatgtatgtatgtatgtatctatctatctatctatctatctagagtttggaagagtgcctggaccattgcaaatgcatagtacaagatagctactattattactattgccgttgtcatcataatcatccctcttttctgtaaaaagtaatgggtttatatgtcagataaatatgttgaacttaattctctttatgtgtccctgaacctatctaagccttttccatggtctcttcatgtgaaaagtgtggttcttccctgcttaaatatgaacttggccatgtgacatgttttgatcaatagcatatgagcagaagtgacaatatgccagttctaag

SEQ ID NO: 10989 - DNA, 250 bp, Homo sapiens
  AL021408.1_116125
  Located on chromosome 6
  Distance between a terminus base of telomere on chromosomal short arm and 5'-terminus of this base sequence : 139133452
  Distance between 3'-terminus of neighbour sequence of sequence listing upward to telomere on chrosomal short arm and 5'-terminus of this base sequence : 8250
ttcactgatgccaattaacactgtgtcataatgttggcatgcatgagacacaagcaattttactctaggaagagaaagaaattcaagaatttttttcctgtatatataagccttcatatattgcactattttaagtattatatggaaagatgcccttcaggtctctttcttcacacacacacacacacacacacacacacacaatcacccatcctggacatcctatctactttcctgtattgacctctca

SEQ ID NO: 10990 - DNA, 376 bp, Homo sapiens
  AL021408.1_119228
  Located on chromosome 6
  Distance between a terminus base of telomere on chromosomal short arm and 5'-terminus of this base sequence : 139136453
  Distance between 3'-terminus of neighbour sequence of sequence listing upward to telomere on chrosomal short arm and 5'-terminus of this base sequence : 2751
tcgaattccagcattctatactgtttcctgggtgcatgaaaaatgtctttatctcatcctcattctcaaaagataattttactgagtataagattctagcttgacataaattttctttcagagctgtgaagatattattctggcatccattgttgttaatgggaagtctacttcagtttaattttcatttgtttaaagttattttatcttgtgtctctttttaagatctttttgtctttggtgttctgctgtttgattgcaatgtgtctaaaagtgtgtgtgtgtgtgtgtgtgtgtgtgtgtgtgtgtgttttattctactttatattagcatttgttggatttcctgaaactaaagattgcagtccataacaat

SEQ ID NO: 10991 - DNA, 371 bp, Homo sapiens
  HUMUT6095
  Located on chromosome 6
  Distance between a terminus base of telomere on chromosomal short arm and 5'-terminus of this base sequence : 139139659
  Distance between 3'-terminus of neighbour sequence of sequence listing upward to telomere on chrosomal short arm and 5'-terminus of this base sequence : 2830
gaggtagcagtgtgttaaggcagaacaagtttccaaagacctgtgttttaattatgtttttttaccatttactaatgaaagcttcatatttttatctatatggtttaaataatatatcatcctaaaactgtttgtcagttcatctcttcttctggtgactcattgaaaagtattttttatgtacaaaaactgtatatatctatatctatctatctatctatatatctatctatctatatatatatatatatatatatggagagagagagaactagatagctattttaaaatgtatttgcattggtagatgtcacaaatcaggtgtttcacttttacatttcatttcagacagaagtgcttgccttggtgat

SEQ ID NO: 10992 - DNA, 173 bp, Homo sapiens
  D6S472
  Located on chromosome 6
  Distance between a terminus base of telomere on chromosomal short arm and 5'-terminus of this base sequence : 139206376
  Distance between 3'-terminus of neighbour sequence of sequence listing upward to telomere on chrosomal short arm and 5'-terminus of this base sequence : 66346
aattttacaagatgcagatgttgtgtaaggtaatgaatcaagccaaatgacccaaaagatgtaatgggcagagatttttacaaaatggataaaagatcagagcaaatgaaatacagacacacacacacacacacacacacacacacacacaaaataaaatggccctcactctt

SEQ ID NO: 10993 - DNA, 312 bp, Homo sapiens
  AL023578.1_40267
  Located on chromosome 6
  Distance between a terminus base of telomere on chromosomal short arm and 5'-terminus of this base sequence : 139286386
  Distance between 3'-terminus of neighbour sequence of sequence listing upward to telomere on chrosomal short arm and 5'-terminus of this base sequence : 79837
gctttaaaccaggtaaccttaaagtagcaagtatttctgcttttactgggattagggattagttggaaataattgggaatgttacagaaataaaaagttacatttctgcatatcttgtcagtgtgtaaatgtctctccatacatacatgtaaacgaatggtattatatatatatatatatatatatattactgtagtcaataaaaaacagtgttattattatgctttaatattgatgggtaattttcctttgtaaattccatctaaactctgagacatgtttttctaagaagatagcaaagttgactgcaat

SEQ ID NO: 10994 - DNA, 471 bp, Homo sapiens
  chr6.fa.O7frz.141544744
  Located on chromosome 6
  Distance between a terminus base of telomere on chromosomal short arm and 5'-terminus of this base sequence : 139382826
  Distance between 3'-terminus of neighbour sequence of sequence listing upward to telomere on chrosomal short arm and 5'-terminus of this base sequence : 96128
ccagattaggctgtctataagatatatcccagctgaaattgtgtgtgagtgtgtgtgaatgcacactatatgatggttgaattgttgccagtatttagtaattagatttttatttaaacacacacacacacactcacagagagagagagagagagagagacagaaagaaagaaagaaagaaagaaagaaagaaagaaagaaagaaagaaagaaagaaagaaagaaaaagaaagagtaaagagaatctaaattttgtcttctctcaaaataaaagaacaaacagaagatctggcaatactgaatttacattcctttttaacagtaattcactcacaaaacccccagttccctcagtgccatctcctctctgttgcattacatcctgcctgttccattcaagctctcatcactcttttttctcattttttaatttatataaatgtatgcgttacaagtgcagattctttacac

SEQ ID NO: 10995 - DNA, 214 bp, Homo sapiens
  HUMUT1837
  Located on chromosome 6
  Distance between a terminus base of telomere on chromosomal short arm and 5'-terminus of this base sequence : 139476212
  Distance between 3'-terminus of neighbour sequence of sequence listing upward to telomere on chrosomal short arm and 5'-terminus of this base sequence : 92915
gggccgatgaagtgattgggatgacatcagggatggagcgggaagccctcctacaccaggctaggggctgagaggcagaggaggaaagaaacagtccctcagtgcagcacagcacagcacagcacagcacagcacagcacagcacagcacagcacagcacagcagagagaatagagcccttgagcagagaaatgggcacttccctctccctcca

SEQ ID NO: 10996 - DNA, 255 bp, Homo sapiens
  AL032821.2_130357
  Located on chromosome 6
  Distance between a terminus base of telomere on chromosomal short arm and 5'-terminus of this base sequence : 139770369
  Distance between 3'-terminus of neighbour sequence of sequence listing upward to telomere on chrosomal short arm and 5'-terminus of this base sequence : 293943
atactgcaatagtcctgtccagttaaaaaaaaaaaaaaggaaaagaaaaaagggggagggaaatcatgctctcttgttctcgtgctctctctctctctcagtgtgtgtgtgtgtgtgtgtgtgtgtgtgtgtcagtgtgtacatatatatatgtggaatttctctgcaagaaacctgcaatatctgttgccttcccctaaggggatggagggctgggcacctgcacaactgatgtgtatacaaaggctgagcaac

SEQ ID NO: 10997 - DNA, 254 bp, Homo sapiens
  chr6.fa.O7frz.141987935
  Located on chromosome 6
  Distance between a terminus base of telomere on chromosomal short arm and 5'-terminus of this base sequence : 139886642
  Distance between 3'-terminus of neighbour sequence of sequence listing upward to telomere on chrosomal short arm and 5'-terminus of this base sequence : 116018
atgaaggcagagaaagttagacatgatatggtaaaatacttggttaaaacggagacattatgtgatatggccaagaaggaatgtcttttctcattcacatttatctaacagatgcctcatctttttgaagaaggaaacacacacacacacacacacacacacacacacacgcacacacacacagagtccttttttaagcagtttcattcaaatggagtaattttttgatggtgtctaggagtttcataggatgg

SEQ ID NO: 10998 - DNA, 189 bp, Homo sapiens
  chr6.fa.O7frz.142095537
  Located on chromosome 6
  Distance between a terminus base of telomere on chromosomal short arm and 5'-terminus of this base sequence : 139994333
  Distance between 3'-terminus of neighbour sequence of sequence listing upward to telomere on chrosomal short arm and 5'-terminus of this base sequence : 107437
cagtgttaacaagttggctaatgttgcatctatttttctaaaaattttctgagcacatataagtgtgtgtgtgtgtgtgtgtgtggtgtgtgtgtgtgtgtgtgtgtgtgtattgcttttcttacagaaatgggatcatattataacattttattaagacattttgtaatttgctgttcttactcaaca

SEQ ID NO: 10999 - DNA, 298 bp, Homo sapiens
  AL121959.15_8600
  Located on chromosome 6
  Distance between a terminus base of telomere on chromosomal short arm and 5'-terminus of this base sequence : 140188573
  Distance between 3'-terminus of neighbour sequence of sequence listing upward to telomere on chrosomal short arm and 5'-terminus of this base sequence : 194051
actcaccaggttgagttacattatgagtattttattagggttctcctgagaaacaaaccaataggacacacgcacacacacacacacacacacacacacacacacgcatgcatgcatgtatatggagagaaatatatatatattaagagagagattataaaaaattggctcacacaattatggaggctgagaaatcccagaatctgccttctgcaagatggaaccccaaagaagcagtggtataattcattctgagttcaaaaggtagggaaagatgagatgagctgttacagctcag

SEQ ID NO: 11000 - DNA, 341 bp, Homo sapiens
  AL121959.15_32269
  Located on chromosome 6
  Distance between a terminus base of telomere on chromosomal short arm and 5'-terminus of this base sequence : 140212042
  Distance between 3'-terminus of neighbour sequence of sequence listing upward to telomere on chrosomal short arm and 5'-terminus of this base sequence : 23171
caaggtcttcgacttctaacactgcaatcctttttaaagccatataaaggtcctttgtgttgctatcaaaaacacctctgacctcctctttcttgttttcatataaagtgacagctctgtcccatccttcataaaaaggcaaaaaaaaaaaaaaaaaaaaaaaccctgccaataccatccttcttcagaagccagacactattaatcatcagcaggaggcagtatggcttcaattagctacacagtgttcaataaattctcagttattctgagtgtgtgtgtgtgtgtgtgtgtgtgtgtgtgtgtgtggtggtggccttagtgctggacaatgttctatc

SEQ ID NO: 11001 - DNA, 207 bp, Homo sapiens
  D6S975
  Located on chromosome 6
  Distance between a terminus base of telomere on chromosomal short arm and 5'-terminus of this base sequence : 140245468
  Distance between 3'-terminus of neighbour sequence of sequence listing upward to telomere on chrosomal short arm and 5'-terminus of this base sequence : 33085
gtggggtttggagaatcctttacagaactgcaagtgagaccatctggggaaaattcattttttaatagatcaaatcattcaacctatcaatgactatacagcccgtggcaatcctagtcctgattaaacatatccacttgcacataaatatacgtatacacacacacacacacacacacacacacatgcagcatattttgtgtgagt

SEQ ID NO: 11002 - DNA, 159 bp, Homo sapiens
  AL121959.15_68156
  Located on chromosome 6
  Distance between a terminus base of telomere on chromosomal short arm and 5'-terminus of this base sequence : 140248129
  Distance between 3'-terminus of neighbour sequence of sequence listing upward to telomere on chrosomal short arm and 5'-terminus of this base sequence : 2454
aaacttgaaccgaagtagcataaaagccaattgttttatgaatactgagcccttaataactttcactttgtgcacacacacacacacacacacacacacacacacagagaaagaaccaccccctccctccctcaagaagcactgctattcagattaagg

SEQ ID NO: 11003 - DNA, 324 bp, Homo sapiens
  AL121959.15_83278
  Located on chromosome 6
  Distance between a terminus base of telomere on chromosomal short arm and 5'-terminus of this base sequence : 140263073
  Distance between 3'-terminus of neighbour sequence of sequence listing upward to telomere on chrosomal short arm and 5'-terminus of this base sequence : 14785
ttcctatgaagacaacggatttgcgcctggggtgagagtgtgtgcgggagagtggtgtggagactgtcctctctcaccgcgtctcctgcgcctctccccgccatcccgagcgggcctagagagtcattcatgaatcttaacctgagggcaggggaggaaggtgcaggtccctctgccctttctgccaaggtgcagaatagcgcccgggcgtgtgttttggttccagagcagttccacgtggagcaacttcgtgtgtgtgtgtgtgtgtgtgtgtgtgtgttgtgtacttgatctgtgaggaggtaacaggactctggtgttcaa

SEQ ID NO: 11004 - DNA, 182 bp, Homo sapiens
  AL121959.15_93131
  Located on chromosome 6
  Distance between a terminus base of telomere on chromosomal short arm and 5'-terminus of this base sequence : 140273081
  Distance between 3'-terminus of neighbour sequence of sequence listing upward to telomere on chrosomal short arm and 5'-terminus of this base sequence : 9684
ttaggtagataatcatggaagcagtcagactaacctggagatttcacatcatttactaattgatgcctaagtaggcagggtagaggtacttgaaaacacacacacacacacacacacacacacacacacacacacacacacactcactctctctctctcacttcctttgatttgtgctttaa

SEQ ID NO: 11005 - DNA, 360 bp, Homo sapiens
  AL024497.5_123643
  Located on chromosome 6
  Distance between a terminus base of telomere on chromosomal short arm and 5'-terminus of this base sequence : 140399096
  Distance between 3'-terminus of neighbour sequence of sequence listing upward to telomere on chrosomal short arm and 5'-terminus of this base sequence : 125833
ggttaaagttcactttatttgcagcaagttgcattcatttacgctattcatcctttctgtcttggtgtgtgtgtgtgtgtgtgtgtgtgtgtgtgtgtgtatttctatggaaaaattttcaacatttatttttttatttattggcccacccccttgtgtgtcttgtgaaaactaggatttgaatttaactttttggcatgaaattctgactcatttcttgacctgcttgttttccacttcattcaaaacacattcagaagtaagcctggggtgatggtgcatacctgtagacccagttacgtggaaggctgagacaggaggatggcttacactagggagtttgagactgtagtgcaccat

SEQ ID NO: 11006 - DNA, 274 bp, Homo sapiens
  AL024497.5_534
  Located on chromosome 6
  Distance between a terminus base of telomere on chromosomal short arm and 5'-terminus of this base sequence : 140522142
  Distance between 3'-terminus of neighbour sequence of sequence listing upward to telomere on chrosomal short arm and 5'-terminus of this base sequence : 122686
catggctaataggcgttagtattttgatttagagaactgctgtactggatcctgccctggttatacactggcaacatctggcttagaaccacacatttaaaggccaagagctatttattttcttcatcttcctcttctctctctctctctctctctctctctcactctctctctctctctattcagtaaaatgtctggggaatagtttcagtattttgatagagcagtacacagaataaattggcagtagttcaatttgcttcctattaaactc

SEQ ID NO: 11007 - DNA, 438 bp, Homo sapiens
  chr6.fa.O7frz.142852459
  Located on chromosome 6
  Distance between a terminus base of telomere on chromosomal short arm and 5'-terminus of this base sequence : 140594994
  Distance between 3'-terminus of neighbour sequence of sequence listing upward to telomere on chrosomal short arm and 5'-terminus of this base sequence : 72578
tagaaaatgtcagcaaagaaatagaaagtttcactcagcaaaaaaataaagaagaagaagaactccgtggaaattttagaaataaaaaaaaagaaaacacagcaaaagaagaagaagaagagaaggagtaggagaagaagaggaaagaagaagaaggagaaggagaagaagaaaagaagaagaagaagaagaagaagaagaagaagaagaagaagaagaagaagaagaagaagaccccccagcaatttgagaggtcaaagagggaggatcacttgatccccggagttggagaccaacatggttaaaatgggaagagaaataattagccaggcatggttgcacatgcctgtgatcctaactacacaggaggctaaggtgagaggatcgcttcagctggggagaggtagaagctgcagtgagccatgagtatgtcactgt

SEQ ID NO: 11008 - DNA, 412 bp, Homo sapiens
  AL078586.35_74793
  Located on chromosome 6
  Distance between a terminus base of telomere on chromosomal short arm and 5'-terminus of this base sequence : 140755594
  Distance between 3'-terminus of neighbour sequence of sequence listing upward to telomere on chrosomal short arm and 5'-terminus of this base sequence : 160162
agttctgcagatctaatgtacaacaaagtgaatatacttaatagtcctgaattgtacacttaaaatggttaaggcggtaaattttatctatctatctatctatctatctatctatctatctatctgtctatatattattaaaatatatataatattatatgtattttaaccatagttgaaaaacaattactcctgccagaaggtaagaacagcaatatgcctgcaagataacacaaatcttgaaataacaacacgctttttaatgcaatttgtcctcctttgctaaatcttgcctcaatttgcaccgcagagagaacttccgtagccacgctctcgaaaatattcccttttcagttaccattcccttttctctactttgtcttcataacacttcaagcactacctgacatta

SEQ ID NO: 11009 - DNA, 180 bp, Homo sapiens
  D6S1038
  Located on chromosome 6
  Distance between a terminus base of telomere on chromosomal short arm and 5'-terminus of this base sequence : 140755638
  Distance between 3'-terminus of neighbour sequence of sequence listing upward to telomere on chrosomal short arm and 5'-terminus of this base sequence : -368
tcctgaattgtacacttaaaatggttaaggcggtaaattttatctatctatctatctatctatctatctatctatctatctgtctatatattattaaaatatatataatattatatgtattttaaccatagttgaaaaacaattactcctgccagaaggtaagaacagcaatatgcctgc

SEQ ID NO: 11010 - DNA, 463 bp, Homo sapiens
  chr6.fa.O7frz.143104740
  Located on chromosome 6
  Distance between a terminus base of telomere on chromosomal short arm and 5'-terminus of this base sequence : 140857470
  Distance between 3'-terminus of neighbour sequence of sequence listing upward to telomere on chrosomal short arm and 5'-terminus of this base sequence : 101652
ttagtcctccatcctttactagacaaagctgcgcaattagaataataaaatgcagccgggagaaattgttaacgcttgtaatcccagcattttgagaggctgaggctgaaggatcgcttgagtccaggagttcaagcctgcagtgagctatgatcggaccattgtacttcagcatgggcgacagaatgagaccctgtctttaataataataataataataataataataataataataaatccaaaacatcaagaaattggttgtgcccttttaaaatacacttagaaggggaacggttagaaatcttaatttcagggatattttactcctaaacctattctttttgtttttgcagagattgatcatgcctacaatgacaactggaaaacagaaatgaaaccatataagccaagcactcacgcaatctttgtcctcccagttgacttaagaacacttgtgaag

SEQ ID NO: 11011 - DNA, 207 bp, Homo sapiens
  AL035699.4_62924
  Located on chromosome 6
  Distance between a terminus base of telomere on chromosomal short arm and 5'-terminus of this base sequence : 140963368
  Distance between 3'-terminus of neighbour sequence of sequence listing upward to telomere on chrosomal short arm and 5'-terminus of this base sequence : 105435
gaaagtagaatggcaggagtaagaagactaaaggaatctgtgtgtgtgtgtgtgtgtgtgtgtgtgtgtactgaatttctacaaagaaaatgtatttatgtataatcatttataaataaactgtaaggatactggatccggatttgacaataaaacctaacagagctgaggatttttaaaacctatacatttggcacatctcattaa

SEQ ID NO: 11012 - DNA, 377 bp, Homo sapiens
  AL035699.4_33420
  Located on chromosome 6
  Distance between a terminus base of telomere on chromosomal short arm and 5'-terminus of this base sequence : 140992595
  Distance between 3'-terminus of neighbour sequence of sequence listing upward to telomere on chrosomal short arm and 5'-terminus of this base sequence : 29020
tcaaggaccatgttatacagacattttgtcattttaattaaaaataagggccttacatttatcagtgataaattttattttgttggtagtgcctctttgggcttgtccagtaatcagcaaactttttcttaaagggccagagagtaaatattttaggcttgtggttcatttggttcttgtcacaactactcagttgtgctgcgtagtcattatggaaacacacgggcatggctgtgttccaataaaacttttgcaaaacaggcactggcccattggctgtagtgtgctgacccttgcctaacctattatgatcttggtgtttgtttgtttgtttgtttgtttgtttttttcccctcatctgtaactgttctcaagtt

SEQ ID NO: 11013 - DNA, 135 bp, Homo sapiens
  D6S976
  Located on chromosome 6
  Distance between a terminus base of telomere on chromosomal short arm and 5'-terminus of this base sequence : 141102370
  Distance between 3'-terminus of neighbour sequence of sequence listing upward to telomere on chrosomal short arm and 5'-terminus of this base sequence : 109398
ctgaaacaggcaagttgtcatgggggtggggtgtgtgtgtgtgtgtgtgtgtgtgtgtgtgtgtgtgtgtgtgtgtgcttatgcatgcatgcacatgcactgaatcacagggtctatctactttggggtggaagc

SEQ ID NO: 11014 - DNA, 457 bp, Homo sapiens
  chr6.fa.O7frz.143882387
  Located on chromosome 6
  Distance between a terminus base of telomere on chromosomal short arm and 5'-terminus of this base sequence : 141169583
  Distance between 3'-terminus of neighbour sequence of sequence listing upward to telomere on chrosomal short arm and 5'-terminus of this base sequence : 67078
gactttgatctgaaactttattgtcagttttcatctggtttcattctttcaaaaatctttttgaattctgactctgttgtatacatgttatagctctttttaaattttatttatttatttatttatttattgagacgaagtctcgctctgtcacccaggctgcaatacaatggtgcgatctcagctcactgcaacctccatctcccaggttcaagccattctcctgcctcagtctcccaaatagctgggactacaggcacctgccaccatgtctcgctaatttttatatttttagtagagatgggatttcaccatgttggccaggctggtcttgaactcctgacctcaagtgatccgcttgcctgggcctctcaaggtgctgggattacaggtgtgagccactgcacctggcctggtctgaagttttaatgtcaggtttaatgtcaggtgatcaatg

SEQ ID NO: 11015 - DNA, 201 bp, Homo sapiens
  Z84486.1_69318
  Located on chromosome 6
  Distance between a terminus base of telomere on chromosomal short arm and 5'-terminus of this base sequence : 141340808
  Distance between 3'-terminus of neighbour sequence of sequence listing upward to telomere on chrosomal short arm and 5'-terminus of this base sequence : 170768
gtactatctgaagtttcacgcatccatggggggggtcttggaatgtatcccccatggataagagtgtactactctgtgtgtgtgtgtgtgtgtgtgtgtgtgtgtgtgtgtgtggtgtgtatgcatcaaccctgccttaatttggaggggggaagggtggggctggatgggtaagagaggtccaggaaatttacctaaagg

SEQ ID NO: 11016 - DNA, 363 bp, Homo sapiens
  Z84486.1_63596
  Located on chromosome 6
  Distance between a terminus base of telomere on chromosomal short arm and 5'-terminus of this base sequence : 141346547
  Distance between 3'-terminus of neighbour sequence of sequence listing upward to telomere on chrosomal short arm and 5'-terminus of this base sequence : 5538
gtttaaggtagttaattacgcagattatatctatcctatcctatctatctgtccatctgtctatctatctatctatctatctatctatctatctatcatctatctatctgtctacctatccactcatctatatctcccccataccccattcctcattcctgggaacacggttcatgctcaacacatgagagtacgaggatgccaaaagacatactgggttagtaaatggctaatagtttagattgaaagcattcaaattgaaataaataattggtgaagaagctgagaggtgctgctctcttgtaggcaatataatcactgagttttgaatcttattgtcttagtaagcttgtgctaccataa

SEQ ID NO: 11017 - DNA, 413 bp, Homo sapiens
  Z84486.1_56748
  Located on chromosome 6
  Distance between a terminus base of telomere on chromosomal short arm and 5'-terminus of this base sequence : 141353135
  Distance between 3'-terminus of neighbour sequence of sequence listing upward to telomere on chrosomal short arm and 5'-terminus of this base sequence : 6225
taggaactgatgctacaatcacactgataaattaattgacacttttgaggtttttctcactgttatggaactcccactctcactgccaatgtctaggcttgggtcagcaatttaaaacttgtccagcctgaccaacatggtgaaaccccatctctactacaaatacaaaaattagccgggtgtggtgtcaggtgcctgtaatcccagctactcaggaggctgaggcagtggaatcacttgaacctgggaggcggaggttgcagtgagccgagatcgcgcaactggactccagcctgggagacagagtgagactcagtttcgaaaacaaaacaaaacaaaacaaaacaaaacaaaacacttgttaaaggccgatgagtaaaggaaatgaatgagacagttaggcactgtaagaa

SEQ ID NO: 11018 - DNA, 143 bp, Homo sapiens
  D6S270
  Located on chromosome 6
  Distance between a terminus base of telomere on chromosomal short arm and 5'-terminus of this base sequence : 141353927
  Distance between 3'-terminus of neighbour sequence of sequence listing upward to telomere on chrosomal short arm and 5'-terminus of this base sequence : 379
gtagtgaagcctggatgtgggttccctctaggcctggaagcctgtgtgtgtgtgtgtgtgtgtgtgtgtgtgtgtgtgtgtctggtaattgaacagcatttatcacacttcaagtgtcatggaaccattcagatcagttacac

SEQ ID NO: 11019 - DNA, 322 bp, Homo sapiens
  Z84486.1_50190
  Located on chromosome 6
  Distance between a terminus base of telomere on chromosomal short arm and 5'-terminus of this base sequence : 141359785
  Distance between 3'-terminus of neighbour sequence of sequence listing upward to telomere on chrosomal short arm and 5'-terminus of this base sequence : 5715
tatggctgtcctagataagtgaagaaattaccatgtagtgatatgaccaacacagggattcaggattgaaatggtaggattggcttgtgcagaggatggtttaatagatgccagcaagcagagaaagaagaattgagaaatatgcttgtcctttatttgctgctggatctgtagtgtcagattccagccaactgagagtattcctggcttcagtgatcatccatccatccatccatccatccatccatccatccatccatccatctgtccaacacatatttactgaatgactaactatgtattaggaattcatctatgagca

SEQ ID NO: 11020 - DNA, 400 bp, Homo sapiens
  AL078590.28_140796
  Located on chromosome 6
  Distance between a terminus base of telomere on chromosomal short arm and 5'-terminus of this base sequence : 141582583
  Distance between 3'-terminus of neighbour sequence of sequence listing upward to telomere on chrosomal short arm and 5'-terminus of this base sequence : 222476
ggtataaagcatttaggacatcagaggagctcactccattttttagaaataggaccatatattgtgtatttttttaagcaaattaggatacattgaaatactcctccccttacacacacacacacacacacacacacacacacacacacactttttcaatattcttttggtcaaaataactgcaatgattgtttgtgaaaccttccccaactgccctaggcagaatttgtagttccctccactgtgctttcttagttcttcagacatccctctattatgaaatttacatttttatattgtaattatctgtttgcatttttgttctcttcctctccagctgaactatgaaagcaaggaccatatcttattcaggtttgttcctcagtgctcagtacattat

SEQ ID NO: 11021 - DNA, 286 bp, Homo sapiens
  AL021939.1_71953
  Located on chromosome 6
  Distance between a terminus base of telomere on chromosomal short arm and 5'-terminus of this base sequence : 141886654
  Distance between 3'-terminus of neighbour sequence of sequence listing upward to telomere on chrosomal short arm and 5'-terminus of this base sequence : 303671
ggagtctagaacgagttccatctccaggtattatattttgcaggaaacaataaagggggttgtgatcagtattttcggtgatggaacagtctgattgttcatatcactcatttgtgagttacagatgggcagagttcacataggtgacaatattgccaaaggaagatgctgtcttactagagtgtgtgtgtgtgtgtgtgtgtgctcttcagcagccagcctagaaggatattttcttatacttcttggtctcttggcctctgactatttagcattggtttgcagt

SEQ ID NO: 11022 - DNA, 411 bp, Homo sapiens
  AL021939.1_101398
  Located on chromosome 6
  Distance between a terminus base of telomere on chromosomal short arm and 5'-terminus of this base sequence : 141916029
  Distance between 3'-terminus of neighbour sequence of sequence listing upward to telomere on chrosomal short arm and 5'-terminus of this base sequence : 29089
ggctagtcgtatggtaatgagtagaaccaatcctctcctcccaatagggtgcagtgactccaaatggtcatgggctggccatcatggaatcatcagccccaggaggatacaccaagctccataaggcagtgccatcttggttctcaggttctctgaatggccaaacatcaaaatcaccagaatggaaaattgagcatgtataggaagctctccttccactcccaacataaagaatgggtagaaatatacgagtgtgtgtgtgtgtgtgtgtgtacgctaaatgccactaaactgtacaattgttaaaatggtaaatgtcatgtatattttactacgataaaaataacgaggacagccagagtcaatcagtgccaagatagggagaatatgaggttatagtcattggaaaga

SEQ ID NO: 11023 - DNA, 357 bp, Homo sapiens
  chr6.fa.O7frz.144362479
  Located on chromosome 6
  Distance between a terminus base of telomere on chromosomal short arm and 5'-terminus of this base sequence : 142119802
  Distance between 3'-terminus of neighbour sequence of sequence listing upward to telomere on chrosomal short arm and 5'-terminus of this base sequence : 203362
agttatgtccagataacattcaaggtgctgctaacgttccctccatgacagaaaggctattcccttcagaccttggcgttctctttttcactgagaactgagattagactgtcccttggtatatattggttttattgttgaggtgtacgtgtgtgtgtgtgtgtgtgtgtgtgtgtgtgtgtgtgtgtgtgagtgtgtgtttggtgttatatatatccaatctctcaagggcaaattgcaaacaccctaccagccgagtgtccacccggagacagtatatcatcaacatatgtccttaaagggtcatttccaatcctgtgattctaggtttttgttttgtttcctccaagattacgc

SEQ ID NO: 11024 - DNA, 306 bp, Homo sapiens
  AL049552.20_39786
  Located on chromosome 6
  Distance between a terminus base of telomere on chromosomal short arm and 5'-terminus of this base sequence : 142360784
  Distance between 3'-terminus of neighbour sequence of sequence listing upward to telomere on chrosomal short arm and 5'-terminus of this base sequence : 240625
aaatgaaagagcactgacagtaactaaaatccatttaaagaaataaagaacactgataaaggtaactacacaaaatataaaaaccagtacatatatatacatacatacatatatatatatatatatatatatatatatatatatatgtttttgtttgtaattcttttctctccatctaattaaaaaaaactttgtaaagaaatagttataaaaataagttggtgggcttaaaatgtataaagatgtaatttgtataaaaccagcacaaaggaggcagaagggaaatgaactatcttggagcaaagt

SEQ ID NO: 11025 - DNA, 301 bp, Homo sapiens
  AL049552.20_44054
  Located on chromosome 6
  Distance between a terminus base of telomere on chromosomal short arm and 5'-terminus of this base sequence : 142365092
  Distance between 3'-terminus of neighbour sequence of sequence listing upward to telomere on chrosomal short arm and 5'-terminus of this base sequence : 4002
aagcctacttcaactccatttctgaaaaccaaaaattatttctcagtttattgaaataagctctgattcacacacacacacacacacacacacacacagtatattaaaaaaatctagtatacataattatataacaaaacataattataatctccccaattagaaaatgagcaaagaatttgaattagacatttctccaaagaaaacatacaaatgtcatttcagaagatgctcacattatcgtcactgggaaatgcaaatgaaaatcatgaggtgtcacttcctatccactaggacagct

SEQ ID NO: 11026 - DNA, 250 bp, Homo sapiens
  AL049552.20_60773
  Located on chromosome 6
  Distance between a terminus base of telomere on chromosomal short arm and 5'-terminus of this base sequence : 142381859
  Distance between 3'-terminus of neighbour sequence of sequence listing upward to telomere on chrosomal short arm and 5'-terminus of this base sequence : 16466
gaggtacctaggtatggtttcacacacacacacacacacacacacacacacacacacacacacacacacgtgtgtatatttatactctaaaggaatataaatttttcattttcttcagtttaattaggaggtatctatggtttcatttatatatatgtatacgtgtatgtgtgtatctttggattttgctaagcttttaaattttattttttttgattttattttttatttcaataggtctttgaggaac

SEQ ID NO: 11027 - DNA, 382 bp, Homo sapiens
  AL035604.15_122452
  Located on chromosome 6
  Distance between a terminus base of telomere on chromosomal short arm and 5'-terminus of this base sequence : 142709098
  Distance between 3'-terminus of neighbour sequence of sequence listing upward to telomere on chrosomal short arm and 5'-terminus of this base sequence : 326989
cttcactaaatgcctgttgaacaccttttatgtgccaaccactgtcagttagtggaggcacagacaaaagtgagaggtgaactcagttgatggtatgtaggtgggtctatttctgggctctctatgcttctccattgatttatttgtttatttttttctctttgtttgccaaagactttcttaatctttaacaatgtaattccagtgagagaaaaagaagtttcagaagtaatataccaaatcatgggatgggactgtgggggtggtgagtgagttcaggagagtgagtgagttcaggagagagagagagagagagagagagagagagagagagaaaatgaaggccatataaggtaaagtgttgaatgttacgtgctctgtt

SEQ ID NO: 11028 - DNA, 407 bp, Homo sapiens
  chr6.fa.O7frz.145055653
  Located on chromosome 6
  Distance between a terminus base of telomere on chromosomal short arm and 5'-terminus of this base sequence : 142817845
  Distance between 3'-terminus of neighbour sequence of sequence listing upward to telomere on chrosomal short arm and 5'-terminus of this base sequence : 108365
ttaggcatatggtacttcgagagtgccttgtctagcatgaagtcagaaaacaagttgagtggcctttatcgctctgagtcttccgtcttttgtttaagcatcactgtgcccagagttggcatttatcatatggctacatttaactaaataaaaatatcatcctttttcaacatatgaaaatccccaaacttcaaagttgactccaaaatgtgcttgtttttaaaaattggcactcaagtatttagggataaaggctctttatgtcggcaacttattctcaaacaagtcagaaaaatcactcatacacacacacacacacacacacacacacacacacacacaaagaaaatctgataaaatattaatttgggaatctaaatgaaagtataggataattctttgtgctg

SEQ ID NO: 11029 - DNA, 210 bp, Homo sapiens
  D6S1626
  Located on chromosome 6
  Distance between a terminus base of telomere on chromosomal short arm and 5'-terminus of this base sequence : 142981360
  Distance between 3'-terminus of neighbour sequence of sequence listing upward to telomere on chrosomal short arm and 5'-terminus of this base sequence : 163108
gagattgccgattaccactatagtgtctaaatattcttatacatgtctttttgtgcaaaaaattacacacattctttcaagtatctacctataattgcaaattgcaattgttgggtcatagagtgtatatgtgtgtgtgtgtgtgtgtgtgtgtatgtgtgtgtgtgtgtgtgtgtgtgtgtgtgtgtagttcagctttattctgccaaa

SEQ ID NO: 11030 - DNA, 157 bp, Homo sapiens
  D6S292
  Located on chromosome 6
  Distance between a terminus base of telomere on chromosomal short arm and 5'-terminus of this base sequence : 143014318
  Distance between 3'-terminus of neighbour sequence of sequence listing upward to telomere on chrosomal short arm and 5'-terminus of this base sequence : 32748
agaactaaagttgcctgttcttgtattggatctgtgtgtgtgtgtgtgtgtgtgtgtgtgtgtgtgtgtgtgtgtgtgtgttttatgtatattaagaagggaggtgggaaggagaggacattggcctaattaccactgagattgtgtcttgtgaatt

SEQ ID NO: 11031 - DNA, 294 bp, Homo sapiens
  chr6.fa.O7frz.145377381
  Located on chromosome 6
  Distance between a terminus base of telomere on chromosomal short arm and 5'-terminus of this base sequence : 143176275
  Distance between 3'-terminus of neighbour sequence of sequence listing upward to telomere on chrosomal short arm and 5'-terminus of this base sequence : 161800
tttgtatccaaagaccttactagaataaagtgagccgctgtttttcttttcccatcagtaaatttattctctaattctctggccttgtccctgtaaggaaagagaagagagaatgatccaagtgtgtgtgtgtgtgtgtgtgtgtgtgtgtgtgtgtgtgttttcagaaacagggtcttgctttctcacccaggctggagtgcaatagtgcaatcatagctcactgcagcctggaattcctgagctcaaacaatccctccacctcagcctccctagtagctcagactacaggca

SEQ ID NO: 11032 - DNA, 400 bp, Homo sapiens
  chr6.fa.O7frz.145603096
  Located on chromosome 6
  Distance between a terminus base of telomere on chromosomal short arm and 5'-terminus of this base sequence : 143401894
  Distance between 3'-terminus of neighbour sequence of sequence listing upward to telomere on chrosomal short arm and 5'-terminus of this base sequence : 225325
tgattgacagttctttggtaaggaggcagagaagcagaactctcaaatctagcgttctccctcttgtcctattatttctgcttagtattctattttctgggcctctaccatgattcatagggcagttttctggccccctctatgaactggttattgaacttcccttaacgctgatgtcctatgtcctaattctctactccttaccacttctaaccttacacacacacacacacacacacacacacacacacacacacacagagagagagagagagaatgcatggagtcagagtcaatctaagaaaggacacccatgaaggtgagaactgaggatgcagtgtggcggtcacacgggtgaggagtcacccttctgcaataattagcctgtaggacattaaag

SEQ ID NO: 11033 - DNA, 364 bp, Homo sapiens
  AL133511.9_27410
  Located on chromosome 6
  Distance between a terminus base of telomere on chromosomal short arm and 5'-terminus of this base sequence : 143525419
  Distance between 3'-terminus of neighbour sequence of sequence listing upward to telomere on chrosomal short arm and 5'-terminus of this base sequence : 123125
gccataaaatagtatcttcctgaacactgttttaagaactcaattgtatattacatttccatgtaatgtgtgtgtgtgtgtgtgtgtgtgtgtatatatatatatatatatatatatatatatatatagtaaaattacagaaattggctgcaagggtacatattctccccctcgggagggagatagggagaggaagggagagagagatgaacattagccataatgtcctaattttagtgtccccatttttgtgtgtctgatgtaaaagtactgtttgcctcacaatgctattataaaagtggttgtcaaggataataagttccaataaaaatatttgctatagctagacaatcgctaggcatct

SEQ ID NO: 11034 - DNA, 158 bp, Homo sapiens
  chr6.fa.O7frz.145803482
  Located on chromosome 6
  Distance between a terminus base of telomere on chromosomal short arm and 5'-terminus of this base sequence : 143602446
  Distance between 3'-terminus of neighbour sequence of sequence listing upward to telomere on chrosomal short arm and 5'-terminus of this base sequence : 76663
ggacagtgaatgagcaagagcaggcgtgtatgtgtacacgtgtgtgtatacgtgtgtgtgtgtgtgtgtgtgtgtgtgtgtgtgtgtgtgtgtgtgtctgacctggcccaaggcccaggagtacaacccaatagctctcagtctgaattctacagcaa

SEQ ID NO: 11035 - DNA, 423 bp, Homo sapiens
  AL024508.1_126351
  Located on chromosome 6
  Distance between a terminus base of telomere on chromosomal short arm and 5'-terminus of this base sequence : 143675798
  Distance between 3'-terminus of neighbour sequence of sequence listing upward to telomere on chrosomal short arm and 5'-terminus of this base sequence : 73194
agatttatggcatcactttgatgtggaaagaaatttgtacatacagggagttgccagtaattcttgaattggatgctggacgatattaagaaccatccagaggggcatggcaccatctgagaagagcaataaatttttttaaagtgtgtgtgtgtgtgtgtgtgtgtgtgtgtattatacatttaaatctatatgtctgaagtccactagagaccagcaaaaatgagctgcagaccagaaactgcaagtcatttcccatggtctaaaacattgtaaatagtgattggggatattacatctaactctgacccacctgggtaatgggtggtggggatgggataacaatgcaggtaagcctgatacttttcaccacaatacgggagataatactgaagactgtgtcaacgtgactgcagtattaag

SEQ ID NO: 11036 - DNA, 275 bp, Homo sapiens
  AL024508.1_140528
  Located on chromosome 6
  Distance between a terminus base of telomere on chromosomal short arm and 5'-terminus of this base sequence : 143690002
  Distance between 3'-terminus of neighbour sequence of sequence listing upward to telomere on chrosomal short arm and 5'-terminus of this base sequence : 13781
ttccaaatgttagaaagctatgtagtcatttatgttgtagaagcatgttaaaagtcagaagaaaactagtgtttccaagtaaaatgtagtcgtctacttggaagccatcattcagggtgtgtgtgtgtgtgtgtgtgtgtgtgtgtgtgtgtacaataaacatttaaaaatgagaaccccgcacatattttttaaagtagtttttacaaactcttaaaaatatacagagcactgaggataggtaacacactgaaatgatcaattccataagaatg

SEQ ID NO: 11037 - DNA, 469 bp, Homo sapiens
  chr6.fa.O7frz.145980673
  Located on chromosome 6
  Distance between a terminus base of telomere on chromosomal short arm and 5'-terminus of this base sequence : 143779503
  Distance between 3'-terminus of neighbour sequence of sequence listing upward to telomere on chrosomal short arm and 5'-terminus of this base sequence : 89226
ctgaacataggctgaacaatacaggcaaagacgaacaagaagttgattcatgaatgtaccatgttcctataaagataaaaaggcaaaagtcagtaacaaaaacccacattgtaacctaagaataatatgatcctgagaaaatcttcaaagaagaaagcttcctaaaataacctttatactaaaactatatatatatatatatatatatatataaagtttgagacagagtatcactctgtcacccaggctggagtgtagtggcacaatcacagctcactgcaacctctacatcctaggctcgagcgatcctcccacctcagcctcctgaatagctgggactacaggcatacaccaccacatccagctaattttttctattttttgtagaaacgaggtttttgccatattgcccaggctcatcccaaactcctgggctcaagcgatctgctcacctcaggattataggtgt

SEQ ID NO: 11038 - DNA, 239 bp, Homo sapiens
  D6S1009
  Located on chromosome 6
  Distance between a terminus base of telomere on chromosomal short arm and 5'-terminus of this base sequence : 144001287
  Distance between 3'-terminus of neighbour sequence of sequence listing upward to telomere on chrosomal short arm and 5'-terminus of this base sequence : 221315
aatagtgacattctcttcttatggcaattatatttgagttatctatctatctatctatctatctatctatctatctatctatctgtattttaaagagacagggtctttcactctgttgcctaggctggagtgcagcattgtgatcatagctaactgcagccttgaactcctgagctcaagggatcttcctgtctcagccttccaagtaggtaagactacaagtgtgtggcaccatacct

SEQ ID NO: 11039 - DNA, 416 bp, Homo sapiens
  chr6.fa.O7frz.146342604
  Located on chromosome 6
  Distance between a terminus base of telomere on chromosomal short arm and 5'-terminus of this base sequence : 144127465
  Distance between 3'-terminus of neighbour sequence of sequence listing upward to telomere on chrosomal short arm and 5'-terminus of this base sequence : 125939
gattacagacgtgagccactgcacccggtccctccctccttcctccctcctttccttccttccttccttccttccttccttccttccttccttccttccttccttccttccctccttctgtctctctctctctctctctcatctctctctagttttggaactgcctattctaaccctttataactttcctgttgagtttttggtaagttttaaaaataaattttaatgagaattttatagatgcataacacttttccaagtatagtattcctgggtgtcactgaacaccacaggtgggcaaactacagcttggaggccaaatctgtcctgtaaatggcattttattggaacacagtcatgctcatttgttaacatatggtctatggctgcttttgccctacaacggctgaactgag

SEQ ID NO: 11040 - DNA, 379 bp, Homo sapiens
  AL023580.1_96332
  Located on chromosome 6
  Distance between a terminus base of telomere on chromosomal short arm and 5'-terminus of this base sequence : 144474932
  Distance between 3'-terminus of neighbour sequence of sequence listing upward to telomere on chrosomal short arm and 5'-terminus of this base sequence : 347051
ctcaaacattcagccaactaataaacatggtgttagatttggctgactaaagagttttactttttgaagaatagtttaaggtcagtaatgtatttgtcagggttctccagaaagacagaaccagaaggattatctatctatcatctatcatctatctatctatctatctatctatctatctatctatctatctacctatctatctatctaaatgtgtgtgtgtgtgtgtgtgtgtgtgtgtgtgtgtgtgtgtgtgtggagagagaaggaaagggatttattataaggtatttgttcacacaattacgaaggctgagaagtctaccatatgtaagatgaagacccaagaaagccagtggtgtagttccagtccaagtcc

SEQ ID NO: 11041 - DNA, 350 bp, Homo sapiens
  AL023580.1_22940
  Located on chromosome 6
  Distance between a terminus base of telomere on chromosomal short arm and 5'-terminus of this base sequence : 144548386
  Distance between 3'-terminus of neighbour sequence of sequence listing upward to telomere on chrosomal short arm and 5'-terminus of this base sequence : 73075
gtagaggctgaccagaaactacttcccaactcctgctttcccagccagggaaagccatgacctgctttcccaggtcatgccctgctcttcctggcaggaagccactagtggaaatacaaagtccaatggaatctttcgttctttctctctctttctttctttctttctttctttctttctttctttctttctttctctttctttctctttctttctttttctttctttctttctctttctttctctctctctttctttcctctctctttccttctttctttctttttttctttctctctctgtctctctctctttctttctctcttgctctctttcgacagagcttcatg
